United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 85

SEQ ID NO: 3592184 - DNA, 21 bp, Homo sapiens
agaagatgaaatttgataaac

SEQ ID NO: 3592185 - DNA, 16 bp, Homo sapiens
agaagatgccagcttc

SEQ ID NO: 3592186 - DNA, 15 bp, Homo sapiens
agaagattctatgtt

SEQ ID NO: 3592187 - DNA, 22 bp, Homo sapiens
agaagcaagacacgtggcctcg

SEQ ID NO: 3592188 - DNA, 13 bp, Homo sapiens
agaagccagccac

SEQ ID NO: 3592189 - DNA, 18 bp, Homo sapiens
agaagccagccacagacc

SEQ ID NO: 3592190 - DNA, 13 bp, Homo sapiens
agaagccaggaat

SEQ ID NO: 3592191 - DNA, 23 bp, Homo sapiens
agaagcccccagctaagaacctg

SEQ ID NO: 3592192 - DNA, 15 bp, Homo sapiens
agaagccccgacaca

SEQ ID NO: 3592193 - DNA, 22 bp, Homo sapiens
agaagctacccctcaaactgca

SEQ ID NO: 3592194 - DNA, 23 bp, Homo sapiens
agaagctacccctcaaactgcac

SEQ ID NO: 3592195 - DNA, 23 bp, Homo sapiens
agaagctcctctccccagcccag

SEQ ID NO: 3592196 - DNA, 17 bp, Homo sapiens
agaaggcaaggccctgc

SEQ ID NO: 3592197 - DNA, 14 bp, Homo sapiens
agaaggccagagag

SEQ ID NO: 3592198 - DNA, 19 bp, Homo sapiens
agaaggccagagagggaaa

SEQ ID NO: 3592199 - DNA, 22 bp, Homo sapiens
agaaggccccagagagaccctg

SEQ ID NO: 3592200 - DNA, 11 bp, Homo sapiens
agaaggcctgg

SEQ ID NO: 3592201 - DNA, 11 bp, Homo sapiens
agaaggggcag

SEQ ID NO: 3592202 - DNA, 13 bp, Homo sapiens
agaagggggccct

SEQ ID NO: 3592203 - DNA, 16 bp, Homo sapiens
agaagggggccctgct

SEQ ID NO: 3592204 - DNA, 18 bp, Homo sapiens
agaagggggccctgctac

SEQ ID NO: 3592205 - DNA, 20 bp, Homo sapiens
agaaggtaaggtgtgaacct

SEQ ID NO: 3592206 - DNA, 16 bp, Homo sapiens
agaagtatatttttgc

SEQ ID NO: 3592207 - DNA, 22 bp, Homo sapiens
agaagtcatcttgctaccagta

SEQ ID NO: 3592208 - DNA, 14 bp, Homo sapiens
agaagtgctcttgg

SEQ ID NO: 3592209 - DNA, 13 bp, Homo sapiens
agaataaaaactt

SEQ ID NO: 3592210 - DNA, 17 bp, Homo sapiens
agaataaacatttgtta

SEQ ID NO: 3592211 - DNA, 15 bp, Homo sapiens
agaataaaggcagtt

SEQ ID NO: 3592212 - DNA, 18 bp, Homo sapiens
agaataaaggcagttttc

SEQ ID NO: 3592213 - DNA, 21 bp, Homo sapiens
agaataaattctacctccttg

SEQ ID NO: 3592214 - DNA, 16 bp, Homo sapiens
agaatagatgctgact

SEQ ID NO: 3592215 - DNA, 20 bp, Homo sapiens
agaataggcagggggccctg

SEQ ID NO: 3592216 - DNA, 15 bp, Homo sapiens
agaatccagtattat

SEQ ID NO: 3592217 - DNA, 18 bp, Homo sapiens
agaatcttcctggcacaa

SEQ ID NO: 3592218 - DNA, 19 bp, Homo sapiens
agaatcttcctggcacaat

SEQ ID NO: 3592219 - DNA, 14 bp, Homo sapiens
agaatgaccttgag

SEQ ID NO: 3592220 - DNA, 14 bp, Homo sapiens
agaatgagacatcc

SEQ ID NO: 3592221 - DNA, 16 bp, Homo sapiens
agaatgagcacccatt

SEQ ID NO: 3592222 - DNA, 14 bp, Homo sapiens
agaatgatttcatg

SEQ ID NO: 3592223 - DNA, 18 bp, Homo sapiens
agaatggataaaataatg

SEQ ID NO: 3592224 - DNA, 16 bp, Homo sapiens
agaatggcatggcagg

SEQ ID NO: 3592225 - DNA, 18 bp, Homo sapiens
agaatggcatggcaggag

SEQ ID NO: 3592226 - DNA, 21 bp, Homo sapiens
agaatggcatggcaggagtct

SEQ ID NO: 3592227 - DNA, 13 bp, Homo sapiens
agaatggcctgga

SEQ ID NO: 3592228 - DNA, 15 bp, Homo sapiens
agaatggcctggagc

SEQ ID NO: 3592229 - DNA, 12 bp, Homo sapiens
agaatgtaaagc

SEQ ID NO: 3592230 - DNA, 15 bp, Homo sapiens
agaatgtaaagcaac

SEQ ID NO: 3592231 - DNA, 20 bp, Homo sapiens
agaatgtcaataaatttgct

SEQ ID NO: 3592232 - DNA, 20 bp, Homo sapiens
agaatgtggaaatagatgtg

SEQ ID NO: 3592233 - DNA, 12 bp, Homo sapiens
agaattatctca

SEQ ID NO: 3592234 - DNA, 13 bp, Homo sapiens
agccacagcagag

SEQ ID NO: 3592235 - DNA, 16 bp, Homo sapiens
agccacagtcactgga

SEQ ID NO: 3592236 - DNA, 17 bp, Homo sapiens
agccacagtcactggat

SEQ ID NO: 3592237 - DNA, 12 bp, Homo sapiens
agccacatcttg

SEQ ID NO: 3592238 - DNA, 18 bp, Homo sapiens
agccacatcttgctctgc

SEQ ID NO: 3592239 - DNA, 14 bp, Homo sapiens
agccaccagttctc

SEQ ID NO: 3592240 - DNA, 22 bp, Homo sapiens
agccacctgggaacacagttct

SEQ ID NO: 3592241 - DNA, 22 bp, Homo sapiens
agccagaacgtggctctgctgg

SEQ ID NO: 3592242 - DNA, 14 bp, Homo sapiens
agccagactggcac

SEQ ID NO: 3592243 - DNA, 19 bp, Homo sapiens
agccagactggcacagttt

SEQ ID NO: 3592244 - DNA, 14 bp, Homo sapiens
agccagattctctt

SEQ ID NO: 3592245 - DNA, 11 bp, Homo sapiens
agccagcaggg

SEQ ID NO: 3592246 - DNA, 22 bp, Homo sapiens
agccagccacagacccctggga

SEQ ID NO: 3592247 - DNA, 23 bp, Homo sapiens
agccagccacagacccctgggag

SEQ ID NO: 3592248 - DNA, 17 bp, Homo sapiens
agccagcccttccctgg

SEQ ID NO: 3592249 - DNA, 13 bp, Homo sapiens
agccagcctgctt

SEQ ID NO: 3592250 - DNA, 17 bp, Homo sapiens
agccagcctgcttccca

SEQ ID NO: 3592251 - DNA, 18 bp, Homo sapiens
agccagcctgcttcccac

SEQ ID NO: 3592252 - DNA, 20 bp, Homo sapiens
agccagcctgcttcccacaa

SEQ ID NO: 3592253 - DNA, 22 bp, Homo sapiens
agccagcctgcttcccacaact

SEQ ID NO: 3592254 - DNA, 12 bp, Homo sapiens
agccagcctggc

SEQ ID NO: 3592255 - DNA, 21 bp, Homo sapiens
agccaggaatttcccaggacc

SEQ ID NO: 3592256 - DNA, 16 bp, Homo sapiens
agccaggatgcccaga

SEQ ID NO: 3592257 - DNA, 23 bp, Homo sapiens
agccaggctcctacctgtctgct

SEQ ID NO: 3592258 - DNA, 18 bp, Homo sapiens
agccagggcccctggatc

SEQ ID NO: 3592259 - DNA, 15 bp, Homo sapiens
agccaggtacaggag

SEQ ID NO: 3592260 - DNA, 17 bp, Homo sapiens
agccaggtacaggagag

SEQ ID NO: 3592261 - DNA, 19 bp, Homo sapiens
agccaggtacaggagaggc

SEQ ID NO: 3592262 - DNA, 20 bp, Homo sapiens
agccaggtacaggagaggca

SEQ ID NO: 3592263 - DNA, 22 bp, Homo sapiens
agccaggtacaggagaggcagc

SEQ ID NO: 3592264 - DNA, 15 bp, Homo sapiens
agccaggtctgactc

SEQ ID NO: 3592265 - DNA, 18 bp, Homo sapiens
agccaggtctgactccaa

SEQ ID NO: 3592266 - DNA, 20 bp, Homo sapiens
agccaggtctgactccaaag

SEQ ID NO: 3592267 - DNA, 22 bp, Homo sapiens
agccaggtctgactccaaagct

SEQ ID NO: 3592268 - DNA, 14 bp, Homo sapiens
agccagtgtctagg

SEQ ID NO: 3592269 - DNA, 21 bp, Homo sapiens
agccatacataaaagaaataa

SEQ ID NO: 3592270 - DNA, 20 bp, Homo sapiens
agccatccctttttttacat

SEQ ID NO: 3592271 - DNA, 18 bp, Homo sapiens
agccatcgattgtgtact

SEQ ID NO: 3592272 - DNA, 14 bp, Homo sapiens
agccattttccaac

SEQ ID NO: 3592273 - DNA, 15 bp, Homo sapiens
agcccaaacctggga

SEQ ID NO: 3592274 - DNA, 17 bp, Homo sapiens
agcccaaacctgggaag

SEQ ID NO: 3592275 - DNA, 23 bp, Homo sapiens
agcccaacctacattccaccctg

SEQ ID NO: 3592276 - DNA, 20 bp, Homo sapiens
agcccactgtcctgggcctg

SEQ ID NO: 3592277 - DNA, 22 bp, Homo sapiens
agcccactgtcctgggcctgca

SEQ ID NO: 3592278 - DNA, 21 bp, Homo sapiens
agcccagagacatacttgaag

SEQ ID NO: 3592279 - DNA, 13 bp, Homo sapiens
agcccagagccac

SEQ ID NO: 3592280 - DNA, 16 bp, Homo sapiens
agcccagagccacctg

SEQ ID NO: 3592281 - DNA, 18 bp, Homo sapiens
agcccagagccacctgga

SEQ ID NO: 3592282 - DNA, 17 bp, Homo sapiens
agcccagagtcccccca

SEQ ID NO: 3592283 - DNA, 20 bp, Homo sapiens
agcccagccaggccaacagc

SEQ ID NO: 3592284 - DNA, 12 bp, Homo sapiens
agcccagctcca

SEQ ID NO: 3592285 - DNA, 11 bp, Homo sapiens
agcccaggcca

SEQ ID NO: 3592286 - DNA, 14 bp, Homo sapiens
agcccatttctggg

SEQ ID NO: 3592287 - DNA, 18 bp, Homo sapiens
agccccaactccaggggc

SEQ ID NO: 3592288 - DNA, 13 bp, Homo sapiens
agccccagcccct

SEQ ID NO: 3592289 - DNA, 23 bp, Homo sapiens
agccccataattttttttttcct

SEQ ID NO: 3592290 - DNA, 15 bp, Homo sapiens
agccccatttcctca

SEQ ID NO: 3592291 - DNA, 16 bp, Homo sapiens
agcccccagccctggg

SEQ ID NO: 3592292 - DNA, 20 bp, Homo sapiens
agcccccagctaagaacctg

SEQ ID NO: 3592293 - DNA, 16 bp, Homo sapiens
agccccgccaggtgcc

SEQ ID NO: 3592294 - DNA, 16 bp, Homo sapiens
agccccgttttgggga

SEQ ID NO: 3592295 - DNA, 17 bp, Homo sapiens
agcccctactgtgggca

SEQ ID NO: 3592296 - DNA, 21 bp, Homo sapiens
agcccctactgtgggcaaagt

SEQ ID NO: 3592297 - DNA, 13 bp, Homo sapiens
agcccctccccag

SEQ ID NO: 3592298 - DNA, 14 bp, Homo sapiens
agcccctccccagc

SEQ ID NO: 3592299 - DNA, 15 bp, Homo sapiens
agcccctccccagcc

SEQ ID NO: 3592300 - DNA, 22 bp, Homo sapiens
agcccctccccagccagccctt

SEQ ID NO: 3592301 - DNA, 22 bp, Homo sapiens
agcccctgtctagagagggagg

SEQ ID NO: 3592302 - DNA, 23 bp, Homo sapiens
agcccctgtctagagagggaggc

SEQ ID NO: 3592303 - DNA, 21 bp, Homo sapiens
agccccttcatccgcctgtgg

SEQ ID NO: 3592304 - DNA, 13 bp, Homo sapiens
agcccgacagtgc

SEQ ID NO: 3592305 - DNA, 20 bp, Homo sapiens
agcccgacagtgccatcccc

SEQ ID NO: 3592306 - DNA, 21 bp, Homo sapiens
agcccgacagtgccatcccca

SEQ ID NO: 3592307 - DNA, 16 bp, Homo sapiens
agcccggggccagctt

SEQ ID NO: 3592308 - DNA, 18 bp, Homo sapiens
agccctaagtggctgcct

SEQ ID NO: 3592309 - DNA, 19 bp, Homo sapiens
agccctaagtggctgcctt

SEQ ID NO: 3592310 - DNA, 20 bp, Homo sapiens
agccctaagtggctgccttc

SEQ ID NO: 3592311 - DNA, 15 bp, Homo sapiens
agccctagccctgct

SEQ ID NO: 3592312 - DNA, 16 bp, Homo sapiens
agccctagccctgctc

SEQ ID NO: 3592313 - DNA, 17 bp, Homo sapiens
agccctattgctgctaa

SEQ ID NO: 3592314 - DNA, 13 bp, Homo sapiens
agccctcaccaca

SEQ ID NO: 3592315 - DNA, 12 bp, Homo sapiens
agccctccctgc

SEQ ID NO: 3592316 - DNA, 16 bp, Homo sapiens
agccctccctgcccct

SEQ ID NO: 3592317 - DNA, 17 bp, Homo sapiens
agccctccctgcccctc

SEQ ID NO: 3592318 - DNA, 17 bp, Homo sapiens
agccctcctgagggccg

SEQ ID NO: 3592319 - DNA, 13 bp, Homo sapiens
agccctgcaccat

SEQ ID NO: 3592320 - DNA, 19 bp, Homo sapiens
agccctgctccaactccat

SEQ ID NO: 3592321 - DNA, 17 bp, Homo sapiens
agccctgctttgggctg

SEQ ID NO: 3592322 - DNA, 20 bp, Homo sapiens
agccctgctttgggctgccc

SEQ ID NO: 3592323 - DNA, 12 bp, Homo sapiens
agccctggagag

SEQ ID NO: 3592324 - DNA, 22 bp, Homo sapiens
agccctggagagccccatggtg

SEQ ID NO: 3592325 - DNA, 19 bp, Homo sapiens
agccctggcaaatgcctga

SEQ ID NO: 3592326 - DNA, 15 bp, Homo sapiens
agccctggcctggct

SEQ ID NO: 3592327 - DNA, 17 bp, Homo sapiens
agccctggcctggctgg

SEQ ID NO: 3592328 - DNA, 16 bp, Homo sapiens
agccctgggaaccact

SEQ ID NO: 3592329 - DNA, 20 bp, Homo sapiens
agccctgggaaccactccca

SEQ ID NO: 3592330 - DNA, 20 bp, Homo sapiens
agccctggttagctgacagt

SEQ ID NO: 3592331 - DNA, 20 bp, Homo sapiens
agccctgttgacacaggtct

SEQ ID NO: 3592332 - DNA, 22 bp, Homo sapiens
agcccttatgcggttaattttg

SEQ ID NO: 3592333 - DNA, 14 bp, Homo sapiens
agcccttcatttgg

SEQ ID NO: 3592334 - DNA, 22 bp, Homo sapiens
agcccttccatgtcgcctctgc

SEQ ID NO: 3592335 - DNA, 23 bp, Homo sapiens
agcccttccatgtcgcctctgca

SEQ ID NO: 3592336 - DNA, 17 bp, Homo sapiens
agcccttccctggcccc

SEQ ID NO: 3592337 - DNA, 19 bp, Homo sapiens
agcccttctatacccaccc

SEQ ID NO: 3592338 - DNA, 20 bp, Homo sapiens
agcccttggaacaccctgga

SEQ ID NO: 3592339 - DNA, 21 bp, Homo sapiens
agcccttggaacaccctggat

SEQ ID NO: 3592340 - DNA, 23 bp, Homo sapiens
agcccttggaacaccctggatgc

SEQ ID NO: 3592341 - DNA, 16 bp, Homo sapiens
agccgcagacctggag

SEQ ID NO: 3592342 - DNA, 21 bp, Homo sapiens
agccgcagagaaatgccccag

SEQ ID NO: 3592343 - DNA, 12 bp, Homo sapiens
agccgcctgctt

SEQ ID NO: 3592344 - DNA, 22 bp, Homo sapiens
agccgcctgcttcttctctcca

SEQ ID NO: 3592345 - DNA, 21 bp, Homo sapiens
agccggggtgtaacttcctgc

SEQ ID NO: 3592346 - DNA, 18 bp, Homo sapiens
agccggtaactgtcctgt

SEQ ID NO: 3592347 - DNA, 22 bp, Homo sapiens
agccggtcagaggagcgcaggc

SEQ ID NO: 3592348 - DNA, 15 bp, Homo sapiens
agccgtattttacat

SEQ ID NO: 3592349 - DNA, 22 bp, Homo sapiens
agccgtggcttcccgctcagcc

SEQ ID NO: 3592350 - DNA, 18 bp, Homo sapiens
agcctaaagggcagggcc

SEQ ID NO: 3592351 - DNA, 23 bp, Homo sapiens
agcctaaagggcagggcccacgt

SEQ ID NO: 3592352 - DNA, 15 bp, Homo sapiens
agcctaagaagaagg

SEQ ID NO: 3592353 - DNA, 17 bp, Homo sapiens
agcctacagacatggaa

SEQ ID NO: 3592354 - DNA, 23 bp, Homo sapiens
agcctacctctgtctgagacagg

SEQ ID NO: 3592355 - DNA, 23 bp, Homo sapiens
agcctactgtactatttaaaatg

SEQ ID NO: 3592356 - DNA, 16 bp, Homo sapiens
agcctagatgttttat

SEQ ID NO: 3592357 - DNA, 13 bp, Homo sapiens
agcctagcggagc

SEQ ID NO: 3592358 - DNA, 18 bp, Homo sapiens
agcctagcggagcccagc

SEQ ID NO: 3592359 - DNA, 21 bp, Homo sapiens
agcctagcggagcccagcctg

SEQ ID NO: 3592360 - DNA, 12 bp, Homo sapiens
agcctagctcct

SEQ ID NO: 3592361 - DNA, 20 bp, Homo sapiens
agcctcaacctcctgggttc

SEQ ID NO: 3592362 - DNA, 17 bp, Homo sapiens
agcctcagaaggcccca

SEQ ID NO: 3592363 - DNA, 20 bp, Homo sapiens
agcctcagaaggccccagag

SEQ ID NO: 3592364 - DNA, 22 bp, Homo sapiens
agcctcagaaggccccagagag

SEQ ID NO: 3592365 - DNA, 22 bp, Homo sapiens
aggctgtagaaaggggagaatg

SEQ ID NO: 3592366 - DNA, 23 bp, Homo sapiens
aggctgttggaaaatccagaact

SEQ ID NO: 3592367 - DNA, 21 bp, Homo sapiens
aggctgttggttcaaactttt

SEQ ID NO: 3592368 - DNA, 23 bp, Homo sapiens
aggcttagggacaggaccccagc

SEQ ID NO: 3592369 - DNA, 23 bp, Homo sapiens
aggcttattcagttcttacacat

SEQ ID NO: 3592370 - DNA, 20 bp, Homo sapiens
aggcttcttccttcttgtca

SEQ ID NO: 3592371 - DNA, 16 bp, Homo sapiens
aggcttggtcccatcg

SEQ ID NO: 3592372 - DNA, 14 bp, Homo sapiens
aggcttttccaaat

SEQ ID NO: 3592373 - DNA, 14 bp, Homo sapiens
agggaaaaggcagg

SEQ ID NO: 3592374 - DNA, 13 bp, Homo sapiens
agggaaagcgggc

SEQ ID NO: 3592375 - DNA, 21 bp, Homo sapiens
agggaaagcgggcagccccgt

SEQ ID NO: 3592376 - DNA, 15 bp, Homo sapiens
agggaagaactattg

SEQ ID NO: 3592377 - DNA, 14 bp, Homo sapiens
agggaagacctgaa

SEQ ID NO: 3592378 - DNA, 17 bp, Homo sapiens
agggaagacctgaaaga

SEQ ID NO: 3592379 - DNA, 17 bp, Homo sapiens
agggaagatgacctgcc

SEQ ID NO: 3592380 - DNA, 16 bp, Homo sapiens
agggaaggagacacca

SEQ ID NO: 3592381 - DNA, 14 bp, Homo sapiens
agggaagggagcca

SEQ ID NO: 3592382 - DNA, 15 bp, Homo sapiens
agggaagggagccaa

SEQ ID NO: 3592383 - DNA, 19 bp, Homo sapiens
agggaagggagccaaggga

SEQ ID NO: 3592384 - DNA, 16 bp, Homo sapiens
agggaatggccacaaa

SEQ ID NO: 3592385 - DNA, 17 bp, Homo sapiens
agggacagaggccccag

SEQ ID NO: 3592386 - DNA, 22 bp, Homo sapiens
agggacagaggccccagcctcc

SEQ ID NO: 3592387 - DNA, 13 bp, Homo sapiens
agggacaggaccc

SEQ ID NO: 3592388 - DNA, 21 bp, Homo sapiens
agggaccatcaagaacctaca

SEQ ID NO: 3592389 - DNA, 20 bp, Homo sapiens
agggaccatctgctgcagtt

SEQ ID NO: 3592390 - DNA, 23 bp, Homo sapiens
agggaccatctgctgcagttacc

SEQ ID NO: 3592391 - DNA, 14 bp, Homo sapiens
agggaccggcggac

SEQ ID NO: 3592392 - DNA, 20 bp, Homo sapiens
agggaccggtgctgcaggag

SEQ ID NO: 3592393 - DNA, 16 bp, Homo sapiens
agggacctctcccagg

SEQ ID NO: 3592394 - DNA, 21 bp, Homo sapiens
agggacctgagagcatctcag

SEQ ID NO: 3592395 - DNA, 23 bp, Homo sapiens
agggacttctgtcttcacaacag

SEQ ID NO: 3592396 - DNA, 14 bp, Homo sapiens
agggagcagccccc

SEQ ID NO: 3592397 - DNA, 17 bp, Homo sapiens
agggagcattgcagcct

SEQ ID NO: 3592398 - DNA, 18 bp, Homo sapiens
agggagcattgcagccta

SEQ ID NO: 3592399 - DNA, 17 bp, Homo sapiens
agggagcattttcctcc

SEQ ID NO: 3592400 - DNA, 21 bp, Homo sapiens
agggagccaagggatggacat

SEQ ID NO: 3592401 - DNA, 23 bp, Homo sapiens
agggagctctggggacagcttcc

SEQ ID NO: 3592402 - DNA, 13 bp, Homo sapiens
agggaggcaagcc

SEQ ID NO: 3592403 - DNA, 16 bp, Homo sapiens
agggaggcaagccctg

SEQ ID NO: 3592404 - DNA, 23 bp, Homo sapiens
agggagggcagctggcccccagc

SEQ ID NO: 3592405 - DNA, 20 bp, Homo sapiens
agggaggggcctaggcctca

SEQ ID NO: 3592406 - DNA, 17 bp, Homo sapiens
agggatatggcaggact

SEQ ID NO: 3592407 - DNA, 20 bp, Homo sapiens
agggatatggcaggactcct

SEQ ID NO: 3592408 - DNA, 16 bp, Homo sapiens
agggatccccaggagg

SEQ ID NO: 3592409 - DNA, 21 bp, Homo sapiens
agggatccccaggaggcctgg

SEQ ID NO: 3592410 - DNA, 18 bp, Homo sapiens
agggatgaccttcccagg

SEQ ID NO: 3592411 - DNA, 22 bp, Homo sapiens
agggatgactaaaatatttatt

SEQ ID NO: 3592412 - DNA, 15 bp, Homo sapiens
agggatgatgaggga

SEQ ID NO: 3592413 - DNA, 20 bp, Homo sapiens
agggatgatgagggaagcaa

SEQ ID NO: 3592414 - DNA, 15 bp, Homo sapiens
agggatgccctggag

SEQ ID NO: 3592415 - DNA, 19 bp, Homo sapiens
agggatgccctggaggtgg

SEQ ID NO: 3592416 - DNA, 14 bp, Homo sapiens
agggatgctgggct

SEQ ID NO: 3592417 - DNA, 15 bp, Homo sapiens
agggatggacatctt

SEQ ID NO: 3592418 - DNA, 22 bp, Homo sapiens
agggatggacttgtgattggct

SEQ ID NO: 3592419 - DNA, 14 bp, Homo sapiens
agggatggagaaag

SEQ ID NO: 3592420 - DNA, 15 bp, Homo sapiens
agggatggagggaag

SEQ ID NO: 3592421 - DNA, 20 bp, Homo sapiens
agggattagggagagaagat

SEQ ID NO: 3592422 - DNA, 16 bp, Homo sapiens
agggattgctgaggca

SEQ ID NO: 3592423 - DNA, 22 bp, Homo sapiens
agggatttggggctcagagtgg

SEQ ID NO: 3592424 - DNA, 17 bp, Homo sapiens
agggcaaggggtgagga

SEQ ID NO: 3592425 - DNA, 14 bp, Homo sapiens
agggcactggtggc

SEQ ID NO: 3592426 - DNA, 16 bp, Homo sapiens
agggcactggtggccc

SEQ ID NO: 3592427 - DNA, 15 bp, Homo sapiens
agggcagcaggccag

SEQ ID NO: 3592428 - DNA, 20 bp, Homo sapiens
agggcagcaggccagagaaa

SEQ ID NO: 3592429 - DNA, 22 bp, Homo sapiens
agggcagcaggccagagaaagc

SEQ ID NO: 3592430 - DNA, 23 bp, Homo sapiens
agggcagcaggccagagaaagca

SEQ ID NO: 3592431 - DNA, 19 bp, Homo sapiens
agggcagctggcccccagc

SEQ ID NO: 3592432 - DNA, 19 bp, Homo sapiens
agggcagggcccacgtgta

SEQ ID NO: 3592433 - DNA, 15 bp, Homo sapiens
agggcagtgcccatg

SEQ ID NO: 3592434 - DNA, 19 bp, Homo sapiens
agggcagtggcttctttcc

SEQ ID NO: 3592435 - DNA, 15 bp, Homo sapiens
agggcataaagtaaa

SEQ ID NO: 3592436 - DNA, 19 bp, Homo sapiens
agggcataaagtaaataca

SEQ ID NO: 3592437 - DNA, 20 bp, Homo sapiens
agggcataaagtaaatacat

SEQ ID NO: 3592438 - DNA, 20 bp, Homo sapiens
agggccaagagatctgtgtg

SEQ ID NO: 3592439 - DNA, 19 bp, Homo sapiens
agggccaccggtgggcagt

SEQ ID NO: 3592440 - DNA, 21 bp, Homo sapiens
agggccacctccacacccacc

SEQ ID NO: 3592441 - DNA, 16 bp, Homo sapiens
agggccacctgcagga

SEQ ID NO: 3592442 - DNA, 16 bp, Homo sapiens
agggccagagccaggg

SEQ ID NO: 3592443 - DNA, 15 bp, Homo sapiens
agggccaggtgcaga

SEQ ID NO: 3592444 - DNA, 13 bp, Homo sapiens
agggcccagagcc

SEQ ID NO: 3592445 - DNA, 18 bp, Homo sapiens
agggcccagagcccagct

SEQ ID NO: 3592446 - DNA, 21 bp, Homo sapiens
agggcccagagcccagctcca

SEQ ID NO: 3592447 - DNA, 12 bp, Homo sapiens
agggcccagccc

SEQ ID NO: 3592448 - DNA, 13 bp, Homo sapiens
agggcccagccca

SEQ ID NO: 3592449 - DNA, 14 bp, Homo sapiens
agggcccagcccag

SEQ ID NO: 3592450 - DNA, 22 bp, Homo sapiens
agggcccctggatctcctccct

SEQ ID NO: 3592451 - DNA, 11 bp, Homo sapiens
agggccctggc

SEQ ID NO: 3592452 - DNA, 14 bp, Homo sapiens
agggccgggcaggg

SEQ ID NO: 3592453 - DNA, 15 bp, Homo sapiens
agggcctccagggcc

SEQ ID NO: 3592454 - DNA, 12 bp, Homo sapiens
agggcctggagc

SEQ ID NO: 3592455 - DNA, 21 bp, Homo sapiens
agggcctggagccccatcggc

SEQ ID NO: 3592456 - DNA, 22 bp, Homo sapiens
agggcgagggatgatgagggaa

SEQ ID NO: 3592457 - DNA, 15 bp, Homo sapiens
agggcgcccagcgcc

SEQ ID NO: 3592458 - DNA, 13 bp, Homo sapiens
agggcggggctgg

SEQ ID NO: 3592459 - DNA, 23 bp, Homo sapiens
agggctaaataaagaggagataa

SEQ ID NO: 3592460 - DNA, 13 bp, Homo sapiens
agggctcagggca

SEQ ID NO: 3592461 - DNA, 14 bp, Homo sapiens
agggctcagggcag

SEQ ID NO: 3592462 - DNA, 15 bp, Homo sapiens
agggctggagcctgg

SEQ ID NO: 3592463 - DNA, 21 bp, Homo sapiens
agggctggcacgtgacaggct

SEQ ID NO: 3592464 - DNA, 16 bp, Homo sapiens
agggcttctcctcctc

SEQ ID NO: 3592465 - DNA, 17 bp, Homo sapiens
agggcttggcccagcgc

SEQ ID NO: 3592466 - DNA, 18 bp, Homo sapiens
agggcttggcccagcgcc

SEQ ID NO: 3592467 - DNA, 22 bp, Homo sapiens
agggcttggggctgcacctcct

SEQ ID NO: 3592468 - DNA, 18 bp, Homo sapiens
agggctttggttccttct

SEQ ID NO: 3592469 - DNA, 13 bp, Homo sapiens
aggggaagagaag

SEQ ID NO: 3592470 - DNA, 21 bp, Homo sapiens
aggggaccaattctggacaga

SEQ ID NO: 3592471 - DNA, 16 bp, Homo sapiens
aggggaccccactccc

SEQ ID NO: 3592472 - DNA, 20 bp, Homo sapiens
aggggaccccgagaaccctg

SEQ ID NO: 3592473 - DNA, 22 bp, Homo sapiens
aggggaccccgagaaccctgag

SEQ ID NO: 3592474 - DNA, 16 bp, Homo sapiens
aggggaggccatctgg

SEQ ID NO: 3592475 - DNA, 20 bp, Homo sapiens
aggggaggccatctggagag

SEQ ID NO: 3592476 - DNA, 17 bp, Homo sapiens
aggggatgataaaggaa

SEQ ID NO: 3592477 - DNA, 21 bp, Homo sapiens
aggggcagtggagatcaggag

SEQ ID NO: 3592478 - DNA, 21 bp, Homo sapiens
aggggcatccaaggcaaacaa

SEQ ID NO: 3592479 - DNA, 20 bp, Homo sapiens
aggggccaccacctttggct

SEQ ID NO: 3592480 - DNA, 21 bp, Homo sapiens
aggggccacgtggatgggcaa

SEQ ID NO: 3592481 - DNA, 14 bp, Homo sapiens
aggggccccatggc

SEQ ID NO: 3592482 - DNA, 16 bp, Homo sapiens
aggggccccatggcag

SEQ ID NO: 3592483 - DNA, 20 bp, Homo sapiens
aggggccccgtgtcctgcct

SEQ ID NO: 3592484 - DNA, 17 bp, Homo sapiens
aggggcccggccagcca

SEQ ID NO: 3592485 - DNA, 21 bp, Homo sapiens
aggggcccggccagccatgtc

SEQ ID NO: 3592486 - DNA, 22 bp, Homo sapiens
aggggccgctgccacccacctc

SEQ ID NO: 3592487 - DNA, 15 bp, Homo sapiens
aggggcctctgttcc

SEQ ID NO: 3592488 - DNA, 20 bp, Homo sapiens
aggggcctctgttcctttct

SEQ ID NO: 3592489 - DNA, 23 bp, Homo sapiens
aggggcctctgttcctttctctg

SEQ ID NO: 3592490 - DNA, 16 bp, Homo sapiens
aggggcctgcagaagg

SEQ ID NO: 3592491 - DNA, 12 bp, Homo sapiens
aggggcctggag

SEQ ID NO: 3592492 - DNA, 14 bp, Homo sapiens
aggggcctggaggt

SEQ ID NO: 3592493 - DNA, 23 bp, Homo sapiens
aggggcctggcagccgtgccttc

SEQ ID NO: 3592494 - DNA, 16 bp, Homo sapiens
aggggcgtctgttccc

SEQ ID NO: 3592495 - DNA, 19 bp, Homo sapiens
aggggcgtctgttccccct

SEQ ID NO: 3592496 - DNA, 19 bp, Homo sapiens
ataaatgtcactttttgag

SEQ ID NO: 3592497 - DNA, 14 bp, Homo sapiens
ataaatgtttatat

SEQ ID NO: 3592498 - DNA, 15 bp, Homo sapiens
ataaatgtttatatt

SEQ ID NO: 3592499 - DNA, 18 bp, Homo sapiens
ataaattattactttaaa

SEQ ID NO: 3592500 - DNA, 17 bp, Homo sapiens
ataaattatttgattat

SEQ ID NO: 3592501 - DNA, 19 bp, Homo sapiens
ataaattatttgattattt

SEQ ID NO: 3592502 - DNA, 23 bp, Homo sapiens
ataaattcccaacttctcttgct

SEQ ID NO: 3592503 - DNA, 13 bp, Homo sapiens
ataaattcctctt

SEQ ID NO: 3592504 - DNA, 13 bp, Homo sapiens
ataaattctaaat

SEQ ID NO: 3592505 - DNA, 22 bp, Homo sapiens
ataaattctacctccttgtgtt

SEQ ID NO: 3592506 - DNA, 15 bp, Homo sapiens
ataaattctactaag

SEQ ID NO: 3592507 - DNA, 21 bp, Homo sapiens
ataaattctactaagttattt

SEQ ID NO: 3592508 - DNA, 13 bp, Homo sapiens
ataaattgctcct

SEQ ID NO: 3592509 - DNA, 18 bp, Homo sapiens
ataaattgctccttgaca

SEQ ID NO: 3592510 - DNA, 12 bp, Homo sapiens
ataaatttaatc

SEQ ID NO: 3592511 - DNA, 15 bp, Homo sapiens
ataaattttttgaaa

SEQ ID NO: 3592512 - DNA, 20 bp, Homo sapiens
ataaattttttgaaacacaa

SEQ ID NO: 3592513 - DNA, 16 bp, Homo sapiens
ataacaatgtgctctc

SEQ ID NO: 3592514 - DNA, 23 bp, Homo sapiens
ataacacagatattgttataaat

SEQ ID NO: 3592515 - DNA, 12 bp, Homo sapiens
ataacactgact

SEQ ID NO: 3592516 - DNA, 14 bp, Homo sapiens
ataaccaaatgaaa

SEQ ID NO: 3592517 - DNA, 22 bp, Homo sapiens
ataacctgtctcacctggactt

SEQ ID NO: 3592518 - DNA, 14 bp, Homo sapiens
ataactattacagt

SEQ ID NO: 3592519 - DNA, 17 bp, Homo sapiens
ataactattacagtgtt

SEQ ID NO: 3592520 - DNA, 19 bp, Homo sapiens
ataactattacagtgttgg

SEQ ID NO: 3592521 - DNA, 21 bp, Homo sapiens
ataactcctgtcccttttccc

SEQ ID NO: 3592522 - DNA, 13 bp, Homo sapiens
ataactgaaccaa

SEQ ID NO: 3592523 - DNA, 19 bp, Homo sapiens
ataactgaaccaaattgca

SEQ ID NO: 3592524 - DNA, 15 bp, Homo sapiens
ataactgagttatat

SEQ ID NO: 3592525 - DNA, 18 bp, Homo sapiens
ataacttgctttcttctt

SEQ ID NO: 3592526 - DNA, 17 bp, Homo sapiens
ataactttgactttctt

SEQ ID NO: 3592527 - DNA, 15 bp, Homo sapiens
ataagaacaagtttt

SEQ ID NO: 3592528 - DNA, 15 bp, Homo sapiens
ataagaagaagagag

SEQ ID NO: 3592529 - DNA, 17 bp, Homo sapiens
ataagaagaagagaggc

SEQ ID NO: 3592530 - DNA, 23 bp, Homo sapiens
ataagacaaatattcctttgcat

SEQ ID NO: 3592531 - DNA, 14 bp, Homo sapiens
ataagagcatgaaa

SEQ ID NO: 3592532 - DNA, 20 bp, Homo sapiens
ataagatattttattttgaa

SEQ ID NO: 3592533 - DNA, 14 bp, Homo sapiens
ataagattcatatt

SEQ ID NO: 3592534 - DNA, 20 bp, Homo sapiens
ataagcaaaaacaaaaagaa

SEQ ID NO: 3592535 - DNA, 23 bp, Homo sapiens
ataagctatcacctagcagcctc

SEQ ID NO: 3592536 - DNA, 17 bp, Homo sapiens
ataagcttggtgacaaa

SEQ ID NO: 3592537 - DNA, 14 bp, Homo sapiens
ataaggtggcttct

SEQ ID NO: 3592538 - DNA, 16 bp, Homo sapiens
ataagttctattttac

SEQ ID NO: 3592539 - DNA, 21 bp, Homo sapiens
ataagtttctattctgtcagt

SEQ ID NO: 3592540 - DNA, 13 bp, Homo sapiens
ataataaagaata

SEQ ID NO: 3592541 - DNA, 18 bp, Homo sapiens
ataataaaggactgtaat

SEQ ID NO: 3592542 - DNA, 19 bp, Homo sapiens
ataataaatcacacattca

SEQ ID NO: 3592543 - DNA, 12 bp, Homo sapiens
ataataggtcat

SEQ ID NO: 3592544 - DNA, 21 bp, Homo sapiens
ataataggtcatatgttgtgt

SEQ ID NO: 3592545 - DNA, 19 bp, Homo sapiens
ataatagtcacctgctgtt

SEQ ID NO: 3592546 - DNA, 12 bp, Homo sapiens
ataatctagaac

SEQ ID NO: 3592547 - DNA, 24 bp, Homo sapiens
ataatctgagcaggtacatttctg

SEQ ID NO: 3592548 - DNA, 20 bp, Homo sapiens
ataatctggactcctctgtc

SEQ ID NO: 3592549 - DNA, 11 bp, Homo sapiens
ataatgtattt

SEQ ID NO: 3592550 - DNA, 18 bp, Homo sapiens
ataatgtatttgaaaatt

SEQ ID NO: 3592551 - DNA, 23 bp, Homo sapiens
ataattcagggtggtaaagtatg

SEQ ID NO: 3592552 - DNA, 12 bp, Homo sapiens
ataattctgaaa

SEQ ID NO: 3592553 - DNA, 13 bp, Homo sapiens
ataattctgaaac

SEQ ID NO: 3592554 - DNA, 18 bp, Homo sapiens
ataattggatttcctaat

SEQ ID NO: 3592555 - DNA, 20 bp, Homo sapiens
ataattggatttcctaatac

SEQ ID NO: 3592556 - DNA, 12 bp, Homo sapiens
ataattggctta

SEQ ID NO: 3592557 - DNA, 19 bp, Homo sapiens
ataatttaaaaatatattt

SEQ ID NO: 3592558 - DNA, 14 bp, Homo sapiens
ataatttatttcaa

SEQ ID NO: 3592559 - DNA, 23 bp, Homo sapiens
ataatttccttcaggcagctgaa

SEQ ID NO: 3592560 - DNA, 19 bp, Homo sapiens
ataattttcctttaatatg

SEQ ID NO: 3592561 - DNA, 12 bp, Homo sapiens
ataattttgcaa

SEQ ID NO: 3592562 - DNA, 12 bp, Homo sapiens
ataattttgtaa

SEQ ID NO: 3592563 - DNA, 14 bp, Homo sapiens
atacaaaaaattag

SEQ ID NO: 3592564 - DNA, 19 bp, Homo sapiens
atacaaaaattagccgggc

SEQ ID NO: 3592565 - DNA, 22 bp, Homo sapiens
atacaaaagctttttaaaattt

SEQ ID NO: 3592566 - DNA, 13 bp, Homo sapiens
atacaaactctca

SEQ ID NO: 3592567 - DNA, 18 bp, Homo sapiens
atacaatcatagcattgt

SEQ ID NO: 3592568 - DNA, 20 bp, Homo sapiens
atacacacacacagacatat

SEQ ID NO: 3592569 - DNA, 14 bp, Homo sapiens
atacacacgctgcc

SEQ ID NO: 3592570 - DNA, 17 bp, Homo sapiens
atacaccagcattcctt

SEQ ID NO: 3592571 - DNA, 22 bp, Homo sapiens
atacaccgtttagaaaaaacaa

SEQ ID NO: 3592572 - DNA, 14 bp, Homo sapiens
atacactcatgggg

SEQ ID NO: 3592573 - DNA, 13 bp, Homo sapiens
atacactgtaagc

SEQ ID NO: 3592574 - DNA, 15 bp, Homo sapiens
atacactgtaagctt

SEQ ID NO: 3592575 - DNA, 17 bp, Homo sapiens
atacaggaaaaacaaaa

SEQ ID NO: 3592576 - DNA, 18 bp, Homo sapiens
atacagtattatagatat

SEQ ID NO: 3592577 - DNA, 15 bp, Homo sapiens
atacataatggtact

SEQ ID NO: 3592578 - DNA, 15 bp, Homo sapiens
atacatactatgaaa

SEQ ID NO: 3592579 - DNA, 21 bp, Homo sapiens
atacatgaatgggcatttcta

SEQ ID NO: 3592580 - DNA, 20 bp, Homo sapiens
atacatgcatataatgaata

SEQ ID NO: 3592581 - DNA, 20 bp, Homo sapiens
atacatgttggaaatgtgtt

SEQ ID NO: 3592582 - DNA, 16 bp, Homo sapiens
ataccactagtggaaa

SEQ ID NO: 3592583 - DNA, 19 bp, Homo sapiens
ataccagcttgtatgcaat

SEQ ID NO: 3592584 - DNA, 14 bp, Homo sapiens
ataccctccctccc

SEQ ID NO: 3592585 - DNA, 16 bp, Homo sapiens
ataccctccctcccta

SEQ ID NO: 3592586 - DNA, 16 bp, Homo sapiens
atacctaaataaagaa

SEQ ID NO: 3592587 - DNA, 17 bp, Homo sapiens
atacctctaataaacac

SEQ ID NO: 3592588 - DNA, 17 bp, Homo sapiens
atacctgctatcagcag

SEQ ID NO: 3592589 - DNA, 22 bp, Homo sapiens
ataccttctatgtattagtgtc

SEQ ID NO: 3592590 - DNA, 18 bp, Homo sapiens
atactgccttgtttaatg

SEQ ID NO: 3592591 - DNA, 20 bp, Homo sapiens
atactgccttgtttaatggt

SEQ ID NO: 3592592 - DNA, 20 bp, Homo sapiens
atactgtctctccagtgaaa

SEQ ID NO: 3592593 - DNA, 11 bp, Homo sapiens
atactgtggcc

SEQ ID NO: 3592594 - DNA, 15 bp, Homo sapiens
atactgtggcctgca

SEQ ID NO: 3592595 - DNA, 18 bp, Homo sapiens
atactgtggcctgcagga

SEQ ID NO: 3592596 - DNA, 14 bp, Homo sapiens
atacttattttcag

SEQ ID NO: 3592597 - DNA, 21 bp, Homo sapiens
atacttattttcagtgcatca

SEQ ID NO: 3592598 - DNA, 19 bp, Homo sapiens
atacttgaagggccagagc

SEQ ID NO: 3592599 - DNA, 22 bp, Homo sapiens
atacttgaagggccagagccag

SEQ ID NO: 3592600 - DNA, 16 bp, Homo sapiens
atacttgaatattata

SEQ ID NO: 3592601 - DNA, 13 bp, Homo sapiens
atactttccatgt

SEQ ID NO: 3592602 - DNA, 18 bp, Homo sapiens
atagaataaaggcagttt

SEQ ID NO: 3592603 - DNA, 15 bp, Homo sapiens
atagacattctcaca

SEQ ID NO: 3592604 - DNA, 16 bp, Homo sapiens
atagacattctcacat

SEQ ID NO: 3592605 - DNA, 13 bp, Homo sapiens
atagaccaaagca

SEQ ID NO: 3592606 - DNA, 19 bp, Homo sapiens
atagaccaattgaagcatg

SEQ ID NO: 3592607 - DNA, 19 bp, Homo sapiens
atagactgtaacttccaaa

SEQ ID NO: 3592608 - DNA, 17 bp, Homo sapiens
atagagaaaattcaggt

SEQ ID NO: 3592609 - DNA, 23 bp, Homo sapiens
atagagcatatttgccaataaag

SEQ ID NO: 3592610 - DNA, 16 bp, Homo sapiens
atagatgctggcccag

SEQ ID NO: 3592611 - DNA, 20 bp, Homo sapiens
atagatgctggcccagggcc

SEQ ID NO: 3592612 - DNA, 17 bp, Homo sapiens
atagatgtaatttttca

SEQ ID NO: 3592613 - DNA, 11 bp, Homo sapiens
atagatgtgtg

SEQ ID NO: 3592614 - DNA, 16 bp, Homo sapiens
atagattcagagaaat

SEQ ID NO: 3592615 - DNA, 14 bp, Homo sapiens
atagcaaactccag

SEQ ID NO: 3592616 - DNA, 17 bp, Homo sapiens
atagcattgtctatttt

SEQ ID NO: 3592617 - DNA, 20 bp, Homo sapiens
atagcccaggatatatttta

SEQ ID NO: 3592618 - DNA, 19 bp, Homo sapiens
atagctctggggtgggcag

SEQ ID NO: 3592619 - DNA, 21 bp, Homo sapiens
atagcttcaccccaatcccag

SEQ ID NO: 3592620 - DNA, 15 bp, Homo sapiens
atagctttatttctt

SEQ ID NO: 3592621 - DNA, 16 bp, Homo sapiens
ataggaaactgaagca

SEQ ID NO: 3592622 - DNA, 14 bp, Homo sapiens
ataggaactgaggt

SEQ ID NO: 3592623 - DNA, 22 bp, Homo sapiens
ataggcagggggccctgcccca

SEQ ID NO: 3592624 - DNA, 18 bp, Homo sapiens
ataggcctgtcccttgcc

SEQ ID NO: 3592625 - DNA, 23 bp, Homo sapiens
ataggcctgtcccttgcctctgc

SEQ ID NO: 3592626 - DNA, 22 bp, Homo sapiens
ataggctattttctaaagactt

SEQ ID NO: 3592627 - DNA, 21 bp, Homo sapiens
ataggctcttaagcagcatgg

SEQ ID NO: 3592628 - DNA, 15 bp, Homo sapiens
ataggtaaattttta

SEQ ID NO: 3592629 - DNA, 14 bp, Homo sapiens
atgcatgtagcata

SEQ ID NO: 3592630 - DNA, 16 bp, Homo sapiens
atgcatgtagcatata

SEQ ID NO: 3592631 - DNA, 20 bp, Homo sapiens
atgcatgtagcatataaatg

SEQ ID NO: 3592632 - DNA, 21 bp, Homo sapiens
atgcattataggatcatttgt

SEQ ID NO: 3592633 - DNA, 15 bp, Homo sapiens
atgcattgaaagaat

SEQ ID NO: 3592634 - DNA, 16 bp, Homo sapiens
atgcattgaaagaatt

SEQ ID NO: 3592635 - DNA, 15 bp, Homo sapiens
atgcattttgctttg

SEQ ID NO: 3592636 - DNA, 19 bp, Homo sapiens
atgccacaaggacttcctg

SEQ ID NO: 3592637 - DNA, 15 bp, Homo sapiens
atgccacacctggcc

SEQ ID NO: 3592638 - DNA, 12 bp, Homo sapiens
atgccactggga

SEQ ID NO: 3592639 - DNA, 18 bp, Homo sapiens
atgccactgggacagctg

SEQ ID NO: 3592640 - DNA, 19 bp, Homo sapiens
atgccacttctcactcacc

SEQ ID NO: 3592641 - DNA, 14 bp, Homo sapiens
atgccagcttctct

SEQ ID NO: 3592642 - DNA, 19 bp, Homo sapiens
atgccagcttctctctcca

SEQ ID NO: 3592643 - DNA, 20 bp, Homo sapiens
atgccagcttctctctccag

SEQ ID NO: 3592644 - DNA, 23 bp, Homo sapiens
atgccagcttctctctccagggt

SEQ ID NO: 3592645 - DNA, 14 bp, Homo sapiens
atgcccagtaaaat

SEQ ID NO: 3592646 - DNA, 22 bp, Homo sapiens
atgcccagtaaaatttcaggat

SEQ ID NO: 3592647 - DNA, 24 bp, Homo sapiens
atgccccctccaggagagagccag

SEQ ID NO: 3592648 - DNA, 19 bp, Homo sapiens
atgccctccactccactgc

SEQ ID NO: 3592649 - DNA, 17 bp, Homo sapiens
atgccctcctaaatgtc

SEQ ID NO: 3592650 - DNA, 19 bp, Homo sapiens
atgccctcctaaatgtcag

SEQ ID NO: 3592651 - DNA, 23 bp, Homo sapiens
atgccctcctctcccattgtccc

SEQ ID NO: 3592652 - DNA, 19 bp, Homo sapiens
atgcctaggagatgttggg

SEQ ID NO: 3592653 - DNA, 16 bp, Homo sapiens
atgcctcacgagattt

SEQ ID NO: 3592654 - DNA, 20 bp, Homo sapiens
atgcctctgacagtccacag

SEQ ID NO: 3592655 - DNA, 19 bp, Homo sapiens
atgcctgtcttaattttct

SEQ ID NO: 3592656 - DNA, 19 bp, Homo sapiens
atgcctgttaatttataat

SEQ ID NO: 3592657 - DNA, 13 bp, Homo sapiens
atgccttaaaatg

SEQ ID NO: 3592658 - DNA, 15 bp, Homo sapiens
atgccttaaaatgga

SEQ ID NO: 3592659 - DNA, 22 bp, Homo sapiens
atgccttaaaatggaattgaaa

SEQ ID NO: 3592660 - DNA, 17 bp, Homo sapiens
atgccttttgaatacat

SEQ ID NO: 3592661 - DNA, 22 bp, Homo sapiens
atgccttttgaatacatttgta

SEQ ID NO: 3592662 - DNA, 14 bp, Homo sapiens
atgctaaaacctga

SEQ ID NO: 3592663 - DNA, 18 bp, Homo sapiens
atgctagtgttgtatttc

SEQ ID NO: 3592664 - DNA, 23 bp, Homo sapiens
atgctattttttcccttctcttc

SEQ ID NO: 3592665 - DNA, 23 bp, Homo sapiens
atgctcaacccccctcccagaca

SEQ ID NO: 3592666 - DNA, 16 bp, Homo sapiens
atgctcaatttcagca

SEQ ID NO: 3592667 - DNA, 17 bp, Homo sapiens
atgctcagaccagctct

SEQ ID NO: 3592668 - DNA, 17 bp, Homo sapiens
atgctctctcaaattgt

SEQ ID NO: 3592669 - DNA, 13 bp, Homo sapiens
atgctgacagctc

SEQ ID NO: 3592670 - DNA, 15 bp, Homo sapiens
atgctgcctcaggac

SEQ ID NO: 3592671 - DNA, 16 bp, Homo sapiens
atgctgcctcaggacc

SEQ ID NO: 3592672 - DNA, 18 bp, Homo sapiens
atgctgcctcaggaccca

SEQ ID NO: 3592673 - DNA, 23 bp, Homo sapiens
atgctgcctcaggacccatccct

SEQ ID NO: 3592674 - DNA, 19 bp, Homo sapiens
atgctgctggggaagacag

SEQ ID NO: 3592675 - DNA, 13 bp, Homo sapiens
atgctgcttttgg

SEQ ID NO: 3592676 - DNA, 17 bp, Homo sapiens
atgctggcaaatccagg

SEQ ID NO: 3592677 - DNA, 19 bp, Homo sapiens
atgctggcaaatccaggct

SEQ ID NO: 3592678 - DNA, 15 bp, Homo sapiens
atgctggcccagggc

SEQ ID NO: 3592679 - DNA, 16 bp, Homo sapiens
atgctggcccagggcc

SEQ ID NO: 3592680 - DNA, 20 bp, Homo sapiens
atgctggcccagggcccaga

SEQ ID NO: 3592681 - DNA, 14 bp, Homo sapiens
atgctgggctgggc

SEQ ID NO: 3592682 - DNA, 14 bp, Homo sapiens
atgctgtatatgtt

SEQ ID NO: 3592683 - DNA, 16 bp, Homo sapiens
atgctgtctggccctg

SEQ ID NO: 3592684 - DNA, 20 bp, Homo sapiens
atgctgtctttcttgctccc

SEQ ID NO: 3592685 - DNA, 18 bp, Homo sapiens
atgctgtgctaaatatca

SEQ ID NO: 3592686 - DNA, 21 bp, Homo sapiens
atgctgttaatatttctaaaa

SEQ ID NO: 3592687 - DNA, 17 bp, Homo sapiens
atgctgttgtgaagcta

SEQ ID NO: 3592688 - DNA, 11 bp, Homo sapiens
atgctgtttgt

SEQ ID NO: 3592689 - DNA, 19 bp, Homo sapiens
atgcttacggccatctctt

SEQ ID NO: 3592690 - DNA, 23 bp, Homo sapiens
atgcttccactaccaaaagacat

SEQ ID NO: 3592691 - DNA, 12 bp, Homo sapiens
atgcttgattta

SEQ ID NO: 3592692 - DNA, 13 bp, Homo sapiens
atgcttgggctga

SEQ ID NO: 3592693 - DNA, 20 bp, Homo sapiens
atgcttttaaactgattacg

SEQ ID NO: 3592694 - DNA, 17 bp, Homo sapiens
atgcttttgctaatacc

SEQ ID NO: 3592695 - DNA, 13 bp, Homo sapiens
atgcttttgtcta

SEQ ID NO: 3592696 - DNA, 16 bp, Homo sapiens
atggaaacactgattt

SEQ ID NO: 3592697 - DNA, 19 bp, Homo sapiens
atggaaagaggtgaaaatg

SEQ ID NO: 3592698 - DNA, 16 bp, Homo sapiens
atggaagaagaaagga

SEQ ID NO: 3592699 - DNA, 18 bp, Homo sapiens
atggaagaagaaaggact

SEQ ID NO: 3592700 - DNA, 20 bp, Homo sapiens
atggaatatcatgaatgtga

SEQ ID NO: 3592701 - DNA, 23 bp, Homo sapiens
atggaattccctcctgagtgccc

SEQ ID NO: 3592702 - DNA, 19 bp, Homo sapiens
atggacatcttgtcatttt

SEQ ID NO: 3592703 - DNA, 16 bp, Homo sapiens
atggactcaggatcca

SEQ ID NO: 3592704 - DNA, 19 bp, Homo sapiens
atggactcaggatccagtg

SEQ ID NO: 3592705 - DNA, 23 bp, Homo sapiens
atggactcaggatccagtgacat

SEQ ID NO: 3592706 - DNA, 18 bp, Homo sapiens
atggacttgtgattggct

SEQ ID NO: 3592707 - DNA, 19 bp, Homo sapiens
atggacttgtgattggctg

SEQ ID NO: 3592708 - DNA, 23 bp, Homo sapiens
atggacttgtgattggctgcagg

SEQ ID NO: 3592709 - DNA, 13 bp, Homo sapiens
atggagaaagaag

SEQ ID NO: 3592710 - DNA, 14 bp, Homo sapiens
atggagaaagaagt

SEQ ID NO: 3592711 - DNA, 19 bp, Homo sapiens
atggagaaagaagtggaga

SEQ ID NO: 3592712 - DNA, 16 bp, Homo sapiens
atggagaacatgtttt

SEQ ID NO: 3592713 - DNA, 21 bp, Homo sapiens
atggagcctacctctgtctga

SEQ ID NO: 3592714 - DNA, 19 bp, Homo sapiens
atggaggatctctaaagag

SEQ ID NO: 3592715 - DNA, 21 bp, Homo sapiens
atggaggatctctaaagagca

SEQ ID NO: 3592716 - DNA, 15 bp, Homo sapiens
atggagggaagacct

SEQ ID NO: 3592717 - DNA, 16 bp, Homo sapiens
atggagggaagacctg

SEQ ID NO: 3592718 - DNA, 19 bp, Homo sapiens
atggagggcttggcccagc

SEQ ID NO: 3592719 - DNA, 22 bp, Homo sapiens
atggaggggatgataaaggaaa

SEQ ID NO: 3592720 - DNA, 15 bp, Homo sapiens
atggagtttctctct

SEQ ID NO: 3592721 - DNA, 16 bp, Homo sapiens
atggagtttctctctt

SEQ ID NO: 3592722 - DNA, 21 bp, Homo sapiens
atggataaaataatgctgcaa

SEQ ID NO: 3592723 - DNA, 16 bp, Homo sapiens
atggatggcagactct

SEQ ID NO: 3592724 - DNA, 20 bp, Homo sapiens
atggattcacccccctctgc

SEQ ID NO: 3592725 - DNA, 14 bp, Homo sapiens
atggatttgttaca

SEQ ID NO: 3592726 - DNA, 15 bp, Homo sapiens
atggcaacagatctg

SEQ ID NO: 3592727 - DNA, 17 bp, Homo sapiens
atggcaacagatctgga

SEQ ID NO: 3592728 - DNA, 24 bp, Homo sapiens
atggcaacagatctggaacctcag

SEQ ID NO: 3592729 - DNA, 19 bp, Homo sapiens
atggcaaggactgcaggga

SEQ ID NO: 3592730 - DNA, 15 bp, Homo sapiens
atggcaattttgtaa

SEQ ID NO: 3592731 - DNA, 12 bp, Homo sapiens
atggcagagcca

SEQ ID NO: 3592732 - DNA, 13 bp, Homo sapiens
atggcagagccag

SEQ ID NO: 3592733 - DNA, 16 bp, Homo sapiens
atggcagagccaggct

SEQ ID NO: 3592734 - DNA, 15 bp, Homo sapiens
atggcagctcctgac

SEQ ID NO: 3592735 - DNA, 14 bp, Homo sapiens
atggcagctgccac

SEQ ID NO: 3592736 - DNA, 19 bp, Homo sapiens
atggcaggactcctggcag

SEQ ID NO: 3592737 - DNA, 20 bp, Homo sapiens
atggcaggactcctggcagg

SEQ ID NO: 3592738 - DNA, 14 bp, Homo sapiens
atggcaggagtctc

SEQ ID NO: 3592739 - DNA, 16 bp, Homo sapiens
atggcagtcctggagg

SEQ ID NO: 3592740 - DNA, 17 bp, Homo sapiens
atggcagtcctggaggc

SEQ ID NO: 3592741 - DNA, 18 bp, Homo sapiens
atggcagtcctggaggca

SEQ ID NO: 3592742 - DNA, 17 bp, Homo sapiens
atggcagtgactcccca

SEQ ID NO: 3592743 - DNA, 16 bp, Homo sapiens
atggcataacctgtct

SEQ ID NO: 3592744 - DNA, 17 bp, Homo sapiens
atggcataacctgtctc

SEQ ID NO: 3592745 - DNA, 21 bp, Homo sapiens
atggcatagccccggcccccc

SEQ ID NO: 3592746 - DNA, 21 bp, Homo sapiens
atggcatccctttttcataaa

SEQ ID NO: 3592747 - DNA, 17 bp, Homo sapiens
atggcatgcgccaccat

SEQ ID NO: 3592748 - DNA, 18 bp, Homo sapiens
atggccacaaacctgccc

SEQ ID NO: 3592749 - DNA, 21 bp, Homo sapiens
atggccagtgagatcaatgtg

SEQ ID NO: 3592750 - DNA, 18 bp, Homo sapiens
atggccatcttctttctt

SEQ ID NO: 3592751 - DNA, 13 bp, Homo sapiens
atggccatgctca

SEQ ID NO: 3592752 - DNA, 16 bp, Homo sapiens
atggcctggagcaggc

SEQ ID NO: 3592753 - DNA, 15 bp, Homo sapiens
atggctataggtgct

SEQ ID NO: 3592754 - DNA, 16 bp, Homo sapiens
atggctataggtgcta

SEQ ID NO: 3592755 - DNA, 21 bp, Homo sapiens
atggctataggtgctacaaaa

SEQ ID NO: 3592756 - DNA, 19 bp, Homo sapiens
atggctatttttgaagcaa

SEQ ID NO: 3592757 - DNA, 12 bp, Homo sapiens
atggctgcccag

SEQ ID NO: 3592758 - DNA, 18 bp, Homo sapiens
atggctgtgcctctgcct

SEQ ID NO: 3592759 - DNA, 19 bp, Homo sapiens
atggctgtgcctctgcctg

SEQ ID NO: 3592760 - DNA, 20 bp, Homo sapiens
atgggaaagcattgtaaatg

SEQ ID NO: 3592761 - DNA, 18 bp, Homo sapiens
atttcagattcccagagc

SEQ ID NO: 3592762 - DNA, 15 bp, Homo sapiens
atttcagccaaagtc

SEQ ID NO: 3592763 - DNA, 15 bp, Homo sapiens
atttcagctttggct

SEQ ID NO: 3592764 - DNA, 12 bp, Homo sapiens
atttcaggactc

SEQ ID NO: 3592765 - DNA, 18 bp, Homo sapiens
atttcagtgttttcattt

SEQ ID NO: 3592766 - DNA, 20 bp, Homo sapiens
atttcatacctatcatctta

SEQ ID NO: 3592767 - DNA, 19 bp, Homo sapiens
atttcatgaaaaagctgct

SEQ ID NO: 3592768 - DNA, 13 bp, Homo sapiens
atttcattcctcg

SEQ ID NO: 3592769 - DNA, 12 bp, Homo sapiens
atttcatttctt

SEQ ID NO: 3592770 - DNA, 15 bp, Homo sapiens
atttccaagaggctg

SEQ ID NO: 3592771 - DNA, 19 bp, Homo sapiens
atttccataccattgtgga

SEQ ID NO: 3592772 - DNA, 13 bp, Homo sapiens
atttccatttctg

SEQ ID NO: 3592773 - DNA, 15 bp, Homo sapiens
atttccatttctgat

SEQ ID NO: 3592774 - DNA, 19 bp, Homo sapiens
atttcccaacacaaagatt

SEQ ID NO: 3592775 - DNA, 13 bp, Homo sapiens
atttcccaggacc

SEQ ID NO: 3592776 - DNA, 14 bp, Homo sapiens
atttcccaggaccc

SEQ ID NO: 3592777 - DNA, 16 bp, Homo sapiens
atttcccaggaccctg

SEQ ID NO: 3592778 - DNA, 23 bp, Homo sapiens
atttcccctctgcacccagaaca

SEQ ID NO: 3592779 - DNA, 20 bp, Homo sapiens
atttccgtgaactctggtgc

SEQ ID NO: 3592780 - DNA, 21 bp, Homo sapiens
atttcctaatactgtcatcct

SEQ ID NO: 3592781 - DNA, 23 bp, Homo sapiens
atttccttcaggcagctgaaatt

SEQ ID NO: 3592782 - DNA, 21 bp, Homo sapiens
atttcgggtgaatctgtctat

SEQ ID NO: 3592783 - DNA, 17 bp, Homo sapiens
atttctaaaatgttaaa

SEQ ID NO: 3592784 - DNA, 14 bp, Homo sapiens
atttctaagtattt

SEQ ID NO: 3592785 - DNA, 22 bp, Homo sapiens
atttctaagtatttaaatgttc

SEQ ID NO: 3592786 - DNA, 19 bp, Homo sapiens
atttctaatccttttcctt

SEQ ID NO: 3592787 - DNA, 18 bp, Homo sapiens
atttctacaactggagtt

SEQ ID NO: 3592788 - DNA, 19 bp, Homo sapiens
atttctacaactggagttt

SEQ ID NO: 3592789 - DNA, 21 bp, Homo sapiens
atttctacaactggagttttt

SEQ ID NO: 3592790 - DNA, 14 bp, Homo sapiens
atttctacattaca

SEQ ID NO: 3592791 - DNA, 23 bp, Homo sapiens
atttctactatgatcagaagaac

SEQ ID NO: 3592792 - DNA, 13 bp, Homo sapiens
atttctatacagt

SEQ ID NO: 3592793 - DNA, 16 bp, Homo sapiens
atttctatattcctcc

SEQ ID NO: 3592794 - DNA, 20 bp, Homo sapiens
atttctatattcctccagct

SEQ ID NO: 3592795 - DNA, 17 bp, Homo sapiens
atttctcagctgtgcct

SEQ ID NO: 3592796 - DNA, 13 bp, Homo sapiens
atttctcatgttg

SEQ ID NO: 3592797 - DNA, 18 bp, Homo sapiens
atttctcatttagcattg

SEQ ID NO: 3592798 - DNA, 17 bp, Homo sapiens
atttctccatcccctcc

SEQ ID NO: 3592799 - DNA, 14 bp, Homo sapiens
atttctgattctga

SEQ ID NO: 3592800 - DNA, 18 bp, Homo sapiens
atttctggggggagaaaa

SEQ ID NO: 3592801 - DNA, 17 bp, Homo sapiens
atttcttaacttcttgc

SEQ ID NO: 3592802 - DNA, 19 bp, Homo sapiens
atttcttccctgctttgca

SEQ ID NO: 3592803 - DNA, 20 bp, Homo sapiens
atttcttccctgctttgcat

SEQ ID NO: 3592804 - DNA, 18 bp, Homo sapiens
atttcttcgtgatgacat

SEQ ID NO: 3592805 - DNA, 15 bp, Homo sapiens
atttctttcttccat

SEQ ID NO: 3592806 - DNA, 23 bp, Homo sapiens
atttctttcttccattccttcat

SEQ ID NO: 3592807 - DNA, 16 bp, Homo sapiens
atttgaaaaaaacttc

SEQ ID NO: 3592808 - DNA, 22 bp, Homo sapiens
atttgaaaaaaacttcattctc

SEQ ID NO: 3592809 - DNA, 17 bp, Homo sapiens
atttgaaaccaggacat

SEQ ID NO: 3592810 - DNA, 19 bp, Homo sapiens
atttgattatttaagacta

SEQ ID NO: 3592811 - DNA, 16 bp, Homo sapiens
atttgatttgtacaga

SEQ ID NO: 3592812 - DNA, 16 bp, Homo sapiens
atttgcatattttgag

SEQ ID NO: 3592813 - DNA, 16 bp, Homo sapiens
atttgcctccagtgca

SEQ ID NO: 3592814 - DNA, 12 bp, Homo sapiens
atttgcctgtct

SEQ ID NO: 3592815 - DNA, 16 bp, Homo sapiens
atttgccttcagtctt

SEQ ID NO: 3592816 - DNA, 16 bp, Homo sapiens
atttgctatgagctgg

SEQ ID NO: 3592817 - DNA, 20 bp, Homo sapiens
atttgctatgagctggggat

SEQ ID NO: 3592818 - DNA, 19 bp, Homo sapiens
atttgcttgcaatctaatc

SEQ ID NO: 3592819 - DNA, 18 bp, Homo sapiens
atttgctttaatgagtgc

SEQ ID NO: 3592820 - DNA, 13 bp, Homo sapiens
atttgctttggaa

SEQ ID NO: 3592821 - DNA, 15 bp, Homo sapiens
atttgctttggaagt

SEQ ID NO: 3592822 - DNA, 18 bp, Homo sapiens
atttgctttttcaccaga

SEQ ID NO: 3592823 - DNA, 22 bp, Homo sapiens
atttggaaataaagtcagatgg

SEQ ID NO: 3592824 - DNA, 15 bp, Homo sapiens
atttggctttcacat

SEQ ID NO: 3592825 - DNA, 17 bp, Homo sapiens
atttgggagacatgtga

SEQ ID NO: 3592826 - DNA, 22 bp, Homo sapiens
atttgggcctgctccagacctg

SEQ ID NO: 3592827 - DNA, 17 bp, Homo sapiens
atttgggttctgcctgc

SEQ ID NO: 3592828 - DNA, 14 bp, Homo sapiens
atttgtaaaaatga

SEQ ID NO: 3592829 - DNA, 21 bp, Homo sapiens
atttgtaaaaatgagtcattt

SEQ ID NO: 3592830 - DNA, 17 bp, Homo sapiens
atttgtaaaacttctgc

SEQ ID NO: 3592831 - DNA, 21 bp, Homo sapiens
atttgtacagattctttatta

SEQ ID NO: 3592832 - DNA, 21 bp, Homo sapiens
atttgtacatagttatttatt

SEQ ID NO: 3592833 - DNA, 22 bp, Homo sapiens
atttgtataaagaaactggtcc

SEQ ID NO: 3592834 - DNA, 20 bp, Homo sapiens
atttgtattaatttgtaaga

SEQ ID NO: 3592835 - DNA, 15 bp, Homo sapiens
atttgtcaacagatt

SEQ ID NO: 3592836 - DNA, 20 bp, Homo sapiens
atttgtcttaaaaaatgtga

SEQ ID NO: 3592837 - DNA, 14 bp, Homo sapiens
atttgtgagactgt

SEQ ID NO: 3592838 - DNA, 15 bp, Homo sapiens
atttgtgatacttcc

SEQ ID NO: 3592839 - DNA, 22 bp, Homo sapiens
atttgtggggagggatttgggg

SEQ ID NO: 3592840 - DNA, 14 bp, Homo sapiens
atttgttaaaatac

SEQ ID NO: 3592841 - DNA, 13 bp, Homo sapiens
atttgttaaattg

SEQ ID NO: 3592842 - DNA, 14 bp, Homo sapiens
atttgttataatga

SEQ ID NO: 3592843 - DNA, 15 bp, Homo sapiens
atttgttggaatgaa

SEQ ID NO: 3592844 - DNA, 18 bp, Homo sapiens
atttgtttaaacaatctt

SEQ ID NO: 3592845 - DNA, 19 bp, Homo sapiens
atttgtttgctgaaattta

SEQ ID NO: 3592846 - DNA, 22 bp, Homo sapiens
attttaaacaaaggttgagatg

SEQ ID NO: 3592847 - DNA, 12 bp, Homo sapiens
attttaaatgaa

SEQ ID NO: 3592848 - DNA, 13 bp, Homo sapiens
attttaaatgaaa

SEQ ID NO: 3592849 - DNA, 10 bp, Homo sapiens
attttaatac

SEQ ID NO: 3592850 - DNA, 14 bp, Homo sapiens
attttaccaaagca

SEQ ID NO: 3592851 - DNA, 16 bp, Homo sapiens
attttaccaaagcatc

SEQ ID NO: 3592852 - DNA, 22 bp, Homo sapiens
attttacctagctaattattta

SEQ ID NO: 3592853 - DNA, 15 bp, Homo sapiens
attttacctattctg

SEQ ID NO: 3592854 - DNA, 16 bp, Homo sapiens
attttactttttcctg

SEQ ID NO: 3592855 - DNA, 17 bp, Homo sapiens
attttactttttcctgg

SEQ ID NO: 3592856 - DNA, 16 bp, Homo sapiens
attttagaatgtcaat

SEQ ID NO: 3592857 - DNA, 13 bp, Homo sapiens
attttagctcttc

SEQ ID NO: 3592858 - DNA, 12 bp, Homo sapiens
attttatgtctt

SEQ ID NO: 3592859 - DNA, 13 bp, Homo sapiens
attttatgtcttt

SEQ ID NO: 3592860 - DNA, 15 bp, Homo sapiens
attttattattttct

SEQ ID NO: 3592861 - DNA, 14 bp, Homo sapiens
attttcaagaaact

SEQ ID NO: 3592862 - DNA, 17 bp, Homo sapiens
attttcacactggtaaa

SEQ ID NO: 3592863 - DNA, 21 bp, Homo sapiens
attttcacactggtaaatgtt

SEQ ID NO: 3592864 - DNA, 22 bp, Homo sapiens
attttcacttttggcaatgact

SEQ ID NO: 3592865 - DNA, 18 bp, Homo sapiens
attttcagtgcatcatta

SEQ ID NO: 3592866 - DNA, 12 bp, Homo sapiens
attttccttctg

SEQ ID NO: 3592867 - DNA, 13 bp, Homo sapiens
attttcctttaat

SEQ ID NO: 3592868 - DNA, 17 bp, Homo sapiens
attttcctttttcttcg

SEQ ID NO: 3592869 - DNA, 15 bp, Homo sapiens
attttctatttaaaa

SEQ ID NO: 3592870 - DNA, 21 bp, Homo sapiens
attttctcactgaactccacc

SEQ ID NO: 3592871 - DNA, 11 bp, Homo sapiens
attttctcttt

SEQ ID NO: 3592872 - DNA, 22 bp, Homo sapiens
attttctggaatacatgaaata

SEQ ID NO: 3592873 - DNA, 23 bp, Homo sapiens
attttctttgtgtagctttgctc

SEQ ID NO: 3592874 - DNA, 16 bp, Homo sapiens
attttctttttcttaa

SEQ ID NO: 3592875 - DNA, 17 bp, Homo sapiens
attttgaaaagatgtac

SEQ ID NO: 3592876 - DNA, 19 bp, Homo sapiens
attttgaagtgctgtttat

SEQ ID NO: 3592877 - DNA, 14 bp, Homo sapiens
attttgagaaactg

SEQ ID NO: 3592878 - DNA, 21 bp, Homo sapiens
attttgagaaactgctgcaga

SEQ ID NO: 3592879 - DNA, 23 bp, Homo sapiens
attttgagaaactgctgcagatt

SEQ ID NO: 3592880 - DNA, 21 bp, Homo sapiens
attttgatgagatattaaatt

SEQ ID NO: 3592881 - DNA, 23 bp, Homo sapiens
attttgatgagatattaaattct

SEQ ID NO: 3592882 - DNA, 17 bp, Homo sapiens
attttgatgtaaagatg

SEQ ID NO: 3592883 - DNA, 22 bp, Homo sapiens
attttgcaaaaatcctattctg

SEQ ID NO: 3592884 - DNA, 18 bp, Homo sapiens
attttgcgtcagagaaat

SEQ ID NO: 3592885 - DNA, 13 bp, Homo sapiens
attttgctaactg

SEQ ID NO: 3592886 - DNA, 17 bp, Homo sapiens
attttgctaactgggtt

SEQ ID NO: 3592887 - DNA, 18 bp, Homo sapiens
attttgctaactgggtta

SEQ ID NO: 3592888 - DNA, 21 bp, Homo sapiens
attttgctaactgggttaaat

SEQ ID NO: 3592889 - DNA, 22 bp, Homo sapiens
attttgctaactgggttaaata

SEQ ID NO: 3592890 - DNA, 21 bp, Homo sapiens
attttgctaactggttaaaca

SEQ ID NO: 3592891 - DNA, 20 bp, Homo sapiens
attttgtaaactcaaaatat

SEQ ID NO: 3592892 - DNA, 19 bp, Homo sapiens
attttgtaacgaagacaca

SEQ ID NO: 3592893 - DNA, 17 bp, Homo sapiens
caatcttttaaattgca

SEQ ID NO: 3592894 - DNA, 14 bp, Homo sapiens
caatgatatccaat

SEQ ID NO: 3592895 - DNA, 16 bp, Homo sapiens
caatgcccagtaaaat

SEQ ID NO: 3592896 - DNA, 19 bp, Homo sapiens
caatgcctcacgagatttg

SEQ ID NO: 3592897 - DNA, 18 bp, Homo sapiens
caatgcttgcatggagaa

SEQ ID NO: 3592898 - DNA, 17 bp, Homo sapiens
caatggaagaaatggct

SEQ ID NO: 3592899 - DNA, 20 bp, Homo sapiens
caatggaagaagaaaggact

SEQ ID NO: 3592900 - DNA, 21 bp, Homo sapiens
caatggaagaagaaaggactg

SEQ ID NO: 3592901 - DNA, 13 bp, Homo sapiens
caatgtgctctcg

SEQ ID NO: 3592902 - DNA, 21 bp, Homo sapiens
caatgttggagcagcaggcct

SEQ ID NO: 3592903 - DNA, 19 bp, Homo sapiens
caattaaacggattatttt

SEQ ID NO: 3592904 - DNA, 23 bp, Homo sapiens
caattaaacggattattttttca

SEQ ID NO: 3592905 - DNA, 21 bp, Homo sapiens
caattaagttattaacatttg

SEQ ID NO: 3592906 - DNA, 16 bp, Homo sapiens
caattatgaagattta

SEQ ID NO: 3592907 - DNA, 18 bp, Homo sapiens
caattatttgcatatttt

SEQ ID NO: 3592908 - DNA, 18 bp, Homo sapiens
caattcatggttcaagta

SEQ ID NO: 3592909 - DNA, 14 bp, Homo sapiens
caattctgcccgct

SEQ ID NO: 3592910 - DNA, 15 bp, Homo sapiens
caattgaagcatgaa

SEQ ID NO: 3592911 - DNA, 18 bp, Homo sapiens
caattgaagcatgaacgt

SEQ ID NO: 3592912 - DNA, 19 bp, Homo sapiens
caattgaagcatgaacgtg

SEQ ID NO: 3592913 - DNA, 17 bp, Homo sapiens
caattgtttatatggat

SEQ ID NO: 3592914 - DNA, 19 bp, Homo sapiens
caattttacctattctgaa

SEQ ID NO: 3592915 - DNA, 11 bp, Homo sapiens
caattttcctt

SEQ ID NO: 3592916 - DNA, 20 bp, Homo sapiens
caattttctggaatacatga

SEQ ID NO: 3592917 - DNA, 10 bp, Homo sapiens
caatttttga

SEQ ID NO: 3592918 - DNA, 17 bp, Homo sapiens
caattttttatttttat

SEQ ID NO: 3592919 - DNA, 22 bp, Homo sapiens
caattttttttccgtaaatgtc

SEQ ID NO: 3592920 - DNA, 17 bp, Homo sapiens
cacaaaagacagctggc

SEQ ID NO: 3592921 - DNA, 14 bp, Homo sapiens
cacaaactccaggc

SEQ ID NO: 3592922 - DNA, 20 bp, Homo sapiens
cacaaagaacttgctgctgc

SEQ ID NO: 3592923 - DNA, 21 bp, Homo sapiens
cacaaagaacttgctgctgcc

SEQ ID NO: 3592924 - DNA, 13 bp, Homo sapiens
cacaaagaagaaa

SEQ ID NO: 3592925 - DNA, 23 bp, Homo sapiens
cacaaatatttattttctttctg

SEQ ID NO: 3592926 - DNA, 20 bp, Homo sapiens
cacaaatttcacttatacct

SEQ ID NO: 3592927 - DNA, 14 bp, Homo sapiens
cacaacagagtaac

SEQ ID NO: 3592928 - DNA, 13 bp, Homo sapiens
cacaacagcagtc

SEQ ID NO: 3592929 - DNA, 13 bp, Homo sapiens
cacaacagccctg

SEQ ID NO: 3592930 - DNA, 17 bp, Homo sapiens
cacaactactagtgtga

SEQ ID NO: 3592931 - DNA, 17 bp, Homo sapiens
cacaacttagtgtaata

SEQ ID NO: 3592932 - DNA, 22 bp, Homo sapiens
cacaagactggcccagtgccag

SEQ ID NO: 3592933 - DNA, 23 bp, Homo sapiens
cacaagactggcccagtgccagc

SEQ ID NO: 3592934 - DNA, 12 bp, Homo sapiens
cacaagcctcct

SEQ ID NO: 3592935 - DNA, 21 bp, Homo sapiens
cacaaggaaccctcaggccac

SEQ ID NO: 3592936 - DNA, 14 bp, Homo sapiens
cacaaggacttcct

SEQ ID NO: 3592937 - DNA, 17 bp, Homo sapiens
cacaaggatagatgctg

SEQ ID NO: 3592938 - DNA, 20 bp, Homo sapiens
cacaagtggtggtaaccctg

SEQ ID NO: 3592939 - DNA, 21 bp, Homo sapiens
cacaagtggtggtaaccctgg

SEQ ID NO: 3592940 - DNA, 19 bp, Homo sapiens
cacaataggtctttctctc

SEQ ID NO: 3592941 - DNA, 20 bp, Homo sapiens
cacaataggtctttctctca

SEQ ID NO: 3592942 - DNA, 22 bp, Homo sapiens
cacaatgttggagcagcaggcc

SEQ ID NO: 3592943 - DNA, 18 bp, Homo sapiens
cacaattattggcaaagt

SEQ ID NO: 3592944 - DNA, 17 bp, Homo sapiens
cacaattgaacttccag

SEQ ID NO: 3592945 - DNA, 19 bp, Homo sapiens
cacaattgaacttccagga

SEQ ID NO: 3592946 - DNA, 18 bp, Homo sapiens
cacacaaataacaagaat

SEQ ID NO: 3592947 - DNA, 18 bp, Homo sapiens
cacacacagacatatata

SEQ ID NO: 3592948 - DNA, 11 bp, Homo sapiens
cacacactgtg

SEQ ID NO: 3592949 - DNA, 13 bp, Homo sapiens
cacacactgtgcc

SEQ ID NO: 3592950 - DNA, 12 bp, Homo sapiens
cacacagctgcc

SEQ ID NO: 3592951 - DNA, 13 bp, Homo sapiens
cacacagctgccc

SEQ ID NO: 3592952 - DNA, 16 bp, Homo sapiens
cacacagctgccctag

SEQ ID NO: 3592953 - DNA, 15 bp, Homo sapiens
cacacagggcagtcc

SEQ ID NO: 3592954 - DNA, 16 bp, Homo sapiens
cacaccacatctaagc

SEQ ID NO: 3592955 - DNA, 18 bp, Homo sapiens
cacaccaggcgctaattc

SEQ ID NO: 3592956 - DNA, 14 bp, Homo sapiens
cacacccaccccct

SEQ ID NO: 3592957 - DNA, 19 bp, Homo sapiens
cacacccaccccctctgga

SEQ ID NO: 3592958 - DNA, 14 bp, Homo sapiens
cacacccaggaagg

SEQ ID NO: 3592959 - DNA, 15 bp, Homo sapiens
cacacccaggaaggg

SEQ ID NO: 3592960 - DNA, 13 bp, Homo sapiens
cacacccctgtcc

SEQ ID NO: 3592961 - DNA, 14 bp, Homo sapiens
cacaccctgtttta

SEQ ID NO: 3592962 - DNA, 23 bp, Homo sapiens
cacaccgtggcagcttgctgggc

SEQ ID NO: 3592963 - DNA, 12 bp, Homo sapiens
cacacctcctcc

SEQ ID NO: 3592964 - DNA, 14 bp, Homo sapiens
cacacctcctccca

SEQ ID NO: 3592965 - DNA, 22 bp, Homo sapiens
cacacctcctcccactgcccac

SEQ ID NO: 3592966 - DNA, 20 bp, Homo sapiens
cacacctggccttaaagagg

SEQ ID NO: 3592967 - DNA, 12 bp, Homo sapiens
cacaccttgcag

SEQ ID NO: 3592968 - DNA, 19 bp, Homo sapiens
cacaccttgcagaaggcaa

SEQ ID NO: 3592969 - DNA, 17 bp, Homo sapiens
cacacgctgctctgccc

SEQ ID NO: 3592970 - DNA, 22 bp, Homo sapiens
cacacgtaggacgcatgaaggt

SEQ ID NO: 3592971 - DNA, 22 bp, Homo sapiens
cacactcagaaaattccctggg

SEQ ID NO: 3592972 - DNA, 21 bp, Homo sapiens
cacactcatacacatgtgcac

SEQ ID NO: 3592973 - DNA, 14 bp, Homo sapiens
cacactggcgtctg

SEQ ID NO: 3592974 - DNA, 20 bp, Homo sapiens
cacacttcaggctcttctcc

SEQ ID NO: 3592975 - DNA, 15 bp, Homo sapiens
cacactttctggcaa

SEQ ID NO: 3592976 - DNA, 16 bp, Homo sapiens
cacagaaaccaatttt

SEQ ID NO: 3592977 - DNA, 15 bp, Homo sapiens
cacagaaccttcaac

SEQ ID NO: 3592978 - DNA, 17 bp, Homo sapiens
cacagacaagcagccct

SEQ ID NO: 3592979 - DNA, 15 bp, Homo sapiens
cacagaccaggcctt

SEQ ID NO: 3592980 - DNA, 15 bp, Homo sapiens
cacagacccctggga

SEQ ID NO: 3592981 - DNA, 17 bp, Homo sapiens
cacagacccctgggagc

SEQ ID NO: 3592982 - DNA, 23 bp, Homo sapiens
cacagactgaactcgcagggaat

SEQ ID NO: 3592983 - DNA, 15 bp, Homo sapiens
cacagaggacacaga

SEQ ID NO: 3592984 - DNA, 18 bp, Homo sapiens
cacagcaattcctcaggc

SEQ ID NO: 3592985 - DNA, 12 bp, Homo sapiens
cacagcagagca

SEQ ID NO: 3592986 - DNA, 20 bp, Homo sapiens
cacagcagccccaggagaag

SEQ ID NO: 3592987 - DNA, 19 bp, Homo sapiens
cacagcagttgaaaagact

SEQ ID NO: 3592988 - DNA, 15 bp, Homo sapiens
cacagcatcgggagc

SEQ ID NO: 3592989 - DNA, 22 bp, Homo sapiens
cacagcatcgggagcacccaga

SEQ ID NO: 3592990 - DNA, 19 bp, Homo sapiens
cacagccggtcagaggagc

SEQ ID NO: 3592991 - DNA, 13 bp, Homo sapiens
cacagccttcgga

SEQ ID NO: 3592992 - DNA, 21 bp, Homo sapiens
cacagccttcggacagacata

SEQ ID NO: 3592993 - DNA, 22 bp, Homo sapiens
cacagccttctaaattcccaaa

SEQ ID NO: 3592994 - DNA, 16 bp, Homo sapiens
cacagctacaacccta

SEQ ID NO: 3592995 - DNA, 22 bp, Homo sapiens
cacagctactcagtggggctgg

SEQ ID NO: 3592996 - DNA, 19 bp, Homo sapiens
cacagctcctccatgcctg

SEQ ID NO: 3592997 - DNA, 23 bp, Homo sapiens
cacagctcctccatgcctgacca

SEQ ID NO: 3592998 - DNA, 12 bp, Homo sapiens
cacagctcttca

SEQ ID NO: 3592999 - DNA, 22 bp, Homo sapiens
cacagctgccctagctgacccc

SEQ ID NO: 3593000 - DNA, 16 bp, Homo sapiens
cacaggactctgcctc

SEQ ID NO: 3593001 - DNA, 22 bp, Homo sapiens
cacaggactttgatgaagacca

SEQ ID NO: 3593002 - DNA, 15 bp, Homo sapiens
cacaggagggccagc

SEQ ID NO: 3593003 - DNA, 20 bp, Homo sapiens
cacaggcaaaatccttgctt

SEQ ID NO: 3593004 - DNA, 13 bp, Homo sapiens
cacaggcacacag

SEQ ID NO: 3593005 - DNA, 13 bp, Homo sapiens
cacaggccctccc

SEQ ID NO: 3593006 - DNA, 14 bp, Homo sapiens
cacaggccttgctt

SEQ ID NO: 3593007 - DNA, 19 bp, Homo sapiens
cacaggcttagggacagga

SEQ ID NO: 3593008 - DNA, 22 bp, Homo sapiens
cacaggcttagggacaggaccc

SEQ ID NO: 3593009 - DNA, 20 bp, Homo sapiens
cacagggaaaattgccccat

SEQ ID NO: 3593010 - DNA, 20 bp, Homo sapiens
cacagggaatggccacaaac

SEQ ID NO: 3593011 - DNA, 20 bp, Homo sapiens
cacagggtgagggccacctc

SEQ ID NO: 3593012 - DNA, 23 bp, Homo sapiens
cacagggtgagggccacctccac

SEQ ID NO: 3593013 - DNA, 21 bp, Homo sapiens
cacaggtctcattgcttctga

SEQ ID NO: 3593014 - DNA, 15 bp, Homo sapiens
cacaggtctttccta

SEQ ID NO: 3593015 - DNA, 18 bp, Homo sapiens
cacaggtctttcctaagg

SEQ ID NO: 3593016 - DNA, 17 bp, Homo sapiens
cacagtaccggattctc

SEQ ID NO: 3593017 - DNA, 13 bp, Homo sapiens
cacagtatctgct

SEQ ID NO: 3593018 - DNA, 16 bp, Homo sapiens
cacagtatctgctgtt

SEQ ID NO: 3593019 - DNA, 17 bp, Homo sapiens
cacagtatctgctgttc

SEQ ID NO: 3593020 - DNA, 23 bp, Homo sapiens
cacagtatctgctgttcttcagt

SEQ ID NO: 3593021 - DNA, 14 bp, Homo sapiens
cacagtcactggat

SEQ ID NO: 3593022 - DNA, 19 bp, Homo sapiens
cacagtgcatctcagccca

SEQ ID NO: 3593023 - DNA, 18 bp, Homo sapiens
cacagtgctcttttctcc

SEQ ID NO: 3593024 - DNA, 13 bp, Homo sapiens
cacagtgggagct

SEQ ID NO: 3593025 - DNA, 24 bp, Homo sapiens
cagcatcgggagcacccagagcac

SEQ ID NO: 3593026 - DNA, 18 bp, Homo sapiens
cagcatgaataaaacact

SEQ ID NO: 3593027 - DNA, 16 bp, Homo sapiens
cagcatgactttcctt

SEQ ID NO: 3593028 - DNA, 17 bp, Homo sapiens
cagcatgcaccacgggc

SEQ ID NO: 3593029 - DNA, 15 bp, Homo sapiens
cagcatggaaaaatg

SEQ ID NO: 3593030 - DNA, 16 bp, Homo sapiens
cagcatggaaaaatgg

SEQ ID NO: 3593031 - DNA, 17 bp, Homo sapiens
cagcatggaaaaatggt

SEQ ID NO: 3593032 - DNA, 18 bp, Homo sapiens
cagcatggaaaaatggtt

SEQ ID NO: 3593033 - DNA, 19 bp, Homo sapiens
cagcatggcatagccccgg

SEQ ID NO: 3593034 - DNA, 14 bp, Homo sapiens
cagcattctcactc

SEQ ID NO: 3593035 - DNA, 22 bp, Homo sapiens
cagcatttactatgcacaacag

SEQ ID NO: 3593036 - DNA, 11 bp, Homo sapiens
cagccaaagtc

SEQ ID NO: 3593037 - DNA, 21 bp, Homo sapiens
cagccaccgaagccgcctgtg

SEQ ID NO: 3593038 - DNA, 16 bp, Homo sapiens
cagccactccccagcc

SEQ ID NO: 3593039 - DNA, 20 bp, Homo sapiens
cagccactccccagccagcc

SEQ ID NO: 3593040 - DNA, 12 bp, Homo sapiens
cagccactggct

SEQ ID NO: 3593041 - DNA, 17 bp, Homo sapiens
cagccagaacgtggctc

SEQ ID NO: 3593042 - DNA, 20 bp, Homo sapiens
cagccagaacgtggctctgc

SEQ ID NO: 3593043 - DNA, 21 bp, Homo sapiens
cagccagaacgtggctctgct

SEQ ID NO: 3593044 - DNA, 23 bp, Homo sapiens
cagccagaacgtggctctgctgg

SEQ ID NO: 3593045 - DNA, 15 bp, Homo sapiens
cagccagactggcac

SEQ ID NO: 3593046 - DNA, 13 bp, Homo sapiens
cagccagcctcag

SEQ ID NO: 3593047 - DNA, 19 bp, Homo sapiens
cagccagcctcagaaggcc

SEQ ID NO: 3593048 - DNA, 13 bp, Homo sapiens
cagccagcctggc

SEQ ID NO: 3593049 - DNA, 23 bp, Homo sapiens
cagccaggccaacagcacctccc

SEQ ID NO: 3593050 - DNA, 16 bp, Homo sapiens
cagccagggctcaatc

SEQ ID NO: 3593051 - DNA, 20 bp, Homo sapiens
cagccaggtctgactccaaa

SEQ ID NO: 3593052 - DNA, 16 bp, Homo sapiens
cagccataggtgcagt

SEQ ID NO: 3593053 - DNA, 23 bp, Homo sapiens
cagccatccagggggcaagagga

SEQ ID NO: 3593054 - DNA, 12 bp, Homo sapiens
cagccattttcc

SEQ ID NO: 3593055 - DNA, 14 bp, Homo sapiens
cagccattttccaa

SEQ ID NO: 3593056 - DNA, 17 bp, Homo sapiens
cagcccaaacctgggaa

SEQ ID NO: 3593057 - DNA, 23 bp, Homo sapiens
cagcccaaacctgggaaggccag

SEQ ID NO: 3593058 - DNA, 19 bp, Homo sapiens
cagcccacatagtgatggt

SEQ ID NO: 3593059 - DNA, 11 bp, Homo sapiens
cagcccacccc

SEQ ID NO: 3593060 - DNA, 13 bp, Homo sapiens
cagcccagagaca

SEQ ID NO: 3593061 - DNA, 14 bp, Homo sapiens
cagcccagccaggc

SEQ ID NO: 3593062 - DNA, 15 bp, Homo sapiens
cagcccagccaggcc

SEQ ID NO: 3593063 - DNA, 17 bp, Homo sapiens
cagcccattcccaaggg

SEQ ID NO: 3593064 - DNA, 22 bp, Homo sapiens
cagcccattcccaagggagact

SEQ ID NO: 3593065 - DNA, 15 bp, Homo sapiens
cagccccacaggact

SEQ ID NO: 3593066 - DNA, 15 bp, Homo sapiens
cagccccagggcctg

SEQ ID NO: 3593067 - DNA, 13 bp, Homo sapiens
cagccccccttgc

SEQ ID NO: 3593068 - DNA, 21 bp, Homo sapiens
cagccccgggcggagccttcc

SEQ ID NO: 3593069 - DNA, 15 bp, Homo sapiens
cagcccgacagtgcc

SEQ ID NO: 3593070 - DNA, 20 bp, Homo sapiens
cagcccgacagtgccatccc

SEQ ID NO: 3593071 - DNA, 17 bp, Homo sapiens
cagcccgtgtccaggag

SEQ ID NO: 3593072 - DNA, 13 bp, Homo sapiens
cagccctccctgc

SEQ ID NO: 3593073 - DNA, 16 bp, Homo sapiens
cagccctccctgcccc

SEQ ID NO: 3593074 - DNA, 17 bp, Homo sapiens
cagccctcctctgcact

SEQ ID NO: 3593075 - DNA, 17 bp, Homo sapiens
cagccctgcctgagaag

SEQ ID NO: 3593076 - DNA, 13 bp, Homo sapiens
cagccctgctttg

SEQ ID NO: 3593077 - DNA, 19 bp, Homo sapiens
cagccctgctttgggctgc

SEQ ID NO: 3593078 - DNA, 12 bp, Homo sapiens
cagccctgggaa

SEQ ID NO: 3593079 - DNA, 21 bp, Homo sapiens
cagccctgggggattcctgag

SEQ ID NO: 3593080 - DNA, 12 bp, Homo sapiens
cagcccttccct

SEQ ID NO: 3593081 - DNA, 12 bp, Homo sapiens
cagccgcagaga

SEQ ID NO: 3593082 - DNA, 13 bp, Homo sapiens
cagccgcagagaa

SEQ ID NO: 3593083 - DNA, 23 bp, Homo sapiens
cagccgcagagaaatgccccagt

SEQ ID NO: 3593084 - DNA, 15 bp, Homo sapiens
cagccgccagctggg

SEQ ID NO: 3593085 - DNA, 13 bp, Homo sapiens
cagccgtatttta

SEQ ID NO: 3593086 - DNA, 15 bp, Homo sapiens
cagccgtattttaca

SEQ ID NO: 3593087 - DNA, 9 bp, Homo sapiens
cagccgtgc

SEQ ID NO: 3593088 - DNA, 17 bp, Homo sapiens
cagcctaagaagaaggc

SEQ ID NO: 3593089 - DNA, 23 bp, Homo sapiens
cagcctaagaagaaggccagaga

SEQ ID NO: 3593090 - DNA, 19 bp, Homo sapiens
cagcctagcctggctctgc

SEQ ID NO: 3593091 - DNA, 19 bp, Homo sapiens
cagcctcaacctcctgggt

SEQ ID NO: 3593092 - DNA, 21 bp, Homo sapiens
cagcctcaagtcactcccaag

SEQ ID NO: 3593093 - DNA, 20 bp, Homo sapiens
cagcctccaagctccatctc

SEQ ID NO: 3593094 - DNA, 17 bp, Homo sapiens
cagcctccatgctgcct

SEQ ID NO: 3593095 - DNA, 20 bp, Homo sapiens
cagcctccatgctgcctcca

SEQ ID NO: 3593096 - DNA, 11 bp, Homo sapiens
cagcctcccct

SEQ ID NO: 3593097 - DNA, 19 bp, Homo sapiens
cagcctcccctcccctggg

SEQ ID NO: 3593098 - DNA, 22 bp, Homo sapiens
cagcctcccctcccctggggac

SEQ ID NO: 3593099 - DNA, 18 bp, Homo sapiens
cagcctccctgaagcctt

SEQ ID NO: 3593100 - DNA, 20 bp, Homo sapiens
cagcctccctgtctccagct

SEQ ID NO: 3593101 - DNA, 21 bp, Homo sapiens
cagcctccctgtctccagctg

SEQ ID NO: 3593102 - DNA, 22 bp, Homo sapiens
cagcctccctgtctccagctgc

SEQ ID NO: 3593103 - DNA, 23 bp, Homo sapiens
cagcctccgggcgtgtgaagaac

SEQ ID NO: 3593104 - DNA, 14 bp, Homo sapiens
cagcctcctgggta

SEQ ID NO: 3593105 - DNA, 16 bp, Homo sapiens
cagcctgactagaact

SEQ ID NO: 3593106 - DNA, 22 bp, Homo sapiens
cagcctgattcggggctgacct

SEQ ID NO: 3593107 - DNA, 21 bp, Homo sapiens
cagcctgcaggacctcgtgcc

SEQ ID NO: 3593108 - DNA, 10 bp, Homo sapiens
cagcctggca

SEQ ID NO: 3593109 - DNA, 13 bp, Homo sapiens
cagcctggccaga

SEQ ID NO: 3593110 - DNA, 16 bp, Homo sapiens
cagcctgggagcccag

SEQ ID NO: 3593111 - DNA, 18 bp, Homo sapiens
cagcctgggcgacaaaaa

SEQ ID NO: 3593112 - DNA, 19 bp, Homo sapiens
cagcctggggtctggagtt

SEQ ID NO: 3593113 - DNA, 16 bp, Homo sapiens
cagcctggtttctggg

SEQ ID NO: 3593114 - DNA, 17 bp, Homo sapiens
cagcctggtttctgggt

SEQ ID NO: 3593115 - DNA, 19 bp, Homo sapiens
cagcctggtttctgggtgc

SEQ ID NO: 3593116 - DNA, 20 bp, Homo sapiens
cagcctggtttctgggtgct

SEQ ID NO: 3593117 - DNA, 15 bp, Homo sapiens
cagcctgtcctgggc

SEQ ID NO: 3593118 - DNA, 16 bp, Homo sapiens
cagcctgttccagaag

SEQ ID NO: 3593119 - DNA, 21 bp, Homo sapiens
cagccttaaggccctcattct

SEQ ID NO: 3593120 - DNA, 16 bp, Homo sapiens
cagccttagagctctt

SEQ ID NO: 3593121 - DNA, 18 bp, Homo sapiens
cagccttagagctcttgt

SEQ ID NO: 3593122 - DNA, 18 bp, Homo sapiens
cagccttccccagctcca

SEQ ID NO: 3593123 - DNA, 22 bp, Homo sapiens
cagccttccccagctccagcag

SEQ ID NO: 3593124 - DNA, 18 bp, Homo sapiens
cagccttcccctccctgt

SEQ ID NO: 3593125 - DNA, 14 bp, Homo sapiens
cagcgaacagcctt

SEQ ID NO: 3593126 - DNA, 19 bp, Homo sapiens
cagcgcagggctggcacgt

SEQ ID NO: 3593127 - DNA, 20 bp, Homo sapiens
cagcgccacctggaagccgc

SEQ ID NO: 3593128 - DNA, 16 bp, Homo sapiens
cagcggctccagctca

SEQ ID NO: 3593129 - DNA, 15 bp, Homo sapiens
cagcggctcctgcaa

SEQ ID NO: 3593130 - DNA, 14 bp, Homo sapiens
cagcgggcggaggg

SEQ ID NO: 3593131 - DNA, 17 bp, Homo sapiens
cagcgggcggaggggat

SEQ ID NO: 3593132 - DNA, 22 bp, Homo sapiens
cagcggggtggggggggagaga

SEQ ID NO: 3593133 - DNA, 23 bp, Homo sapiens
cagcgggtacttatttctcagct

SEQ ID NO: 3593134 - DNA, 15 bp, Homo sapiens
cagcgtaaaatggtg

SEQ ID NO: 3593135 - DNA, 15 bp, Homo sapiens
cagcgtcccttggtg

SEQ ID NO: 3593136 - DNA, 23 bp, Homo sapiens
cagctaagaacctggaacttggg

SEQ ID NO: 3593137 - DNA, 13 bp, Homo sapiens
cagctacaaccct

SEQ ID NO: 3593138 - DNA, 20 bp, Homo sapiens
cagctacaaccctaccctgg

SEQ ID NO: 3593139 - DNA, 19 bp, Homo sapiens
cagctactcagtggggctg

SEQ ID NO: 3593140 - DNA, 14 bp, Homo sapiens
cagctcaagggctg

SEQ ID NO: 3593141 - DNA, 20 bp, Homo sapiens
cagctcacgtaatgcattgc

SEQ ID NO: 3593142 - DNA, 14 bp, Homo sapiens
cagctcagccagtg

SEQ ID NO: 3593143 - DNA, 20 bp, Homo sapiens
cagctcagccctggcctggc

SEQ ID NO: 3593144 - DNA, 21 bp, Homo sapiens
cagctcagccctggcctggct

SEQ ID NO: 3593145 - DNA, 13 bp, Homo sapiens
cagctcaggacag

SEQ ID NO: 3593146 - DNA, 19 bp, Homo sapiens
cagctcaggacagatgcca

SEQ ID NO: 3593147 - DNA, 22 bp, Homo sapiens
cagctcaggacagatgccacac

SEQ ID NO: 3593148 - DNA, 18 bp, Homo sapiens
cagctcccctcggagaag

SEQ ID NO: 3593149 - DNA, 15 bp, Homo sapiens
cagctccctgcctgt

SEQ ID NO: 3593150 - DNA, 16 bp, Homo sapiens
cagctccgggatcagc

SEQ ID NO: 3593151 - DNA, 14 bp, Homo sapiens
cagctccgtgtttc

SEQ ID NO: 3593152 - DNA, 16 bp, Homo sapiens
cagctccgtgtttctc

SEQ ID NO: 3593153 - DNA, 13 bp, Homo sapiens
cagctcctcagcg

SEQ ID NO: 3593154 - DNA, 18 bp, Homo sapiens
cagctcctcagcggctcc

SEQ ID NO: 3593155 - DNA, 17 bp, Homo sapiens
cagctcctgaccttggg

SEQ ID NO: 3593156 - DNA, 17 bp, Homo sapiens
cagctctagcctctgga

SEQ ID NO: 3593157 - DNA, 12 bp, Homo sapiens
cagctctcccct

SEQ ID NO: 3593158 - DNA, 14 bp, Homo sapiens
catataatgaataa

SEQ ID NO: 3593159 - DNA, 18 bp, Homo sapiens
catatactgttcttcatt

SEQ ID NO: 3593160 - DNA, 21 bp, Homo sapiens
catatactgttcttcatttta

SEQ ID NO: 3593161 - DNA, 13 bp, Homo sapiens
catatagacacac

SEQ ID NO: 3593162 - DNA, 18 bp, Homo sapiens
catatagaccaattgaag

SEQ ID NO: 3593163 - DNA, 21 bp, Homo sapiens
catatagaccaattgaagcat

SEQ ID NO: 3593164 - DNA, 23 bp, Homo sapiens
catatagaccaattgaagcatga

SEQ ID NO: 3593165 - DNA, 12 bp, Homo sapiens
catatataaatt

SEQ ID NO: 3593166 - DNA, 13 bp, Homo sapiens
catatataaatta

SEQ ID NO: 3593167 - DNA, 20 bp, Homo sapiens
catatataaattattacttt

SEQ ID NO: 3593168 - DNA, 19 bp, Homo sapiens
catatataggcagttgcat

SEQ ID NO: 3593169 - DNA, 19 bp, Homo sapiens
catatattaattagcaggt

SEQ ID NO: 3593170 - DNA, 23 bp, Homo sapiens
catatctcttgcccttcctactc

SEQ ID NO: 3593171 - DNA, 23 bp, Homo sapiens
catatgaccattgagtccctgct

SEQ ID NO: 3593172 - DNA, 19 bp, Homo sapiens
catatggagaacatgtttt

SEQ ID NO: 3593173 - DNA, 20 bp, Homo sapiens
catatggagaacatgtttta

SEQ ID NO: 3593174 - DNA, 12 bp, Homo sapiens
catatggaggac

SEQ ID NO: 3593175 - DNA, 21 bp, Homo sapiens
catatggaggactgtgacaga

SEQ ID NO: 3593176 - DNA, 20 bp, Homo sapiens
catatgggatattcccaagc

SEQ ID NO: 3593177 - DNA, 21 bp, Homo sapiens
catatgggatattcccaagcc

SEQ ID NO: 3593178 - DNA, 18 bp, Homo sapiens
catatgttaagcagctaa

SEQ ID NO: 3593179 - DNA, 15 bp, Homo sapiens
catattatttcattg

SEQ ID NO: 3593180 - DNA, 17 bp, Homo sapiens
catatttactaccttat

SEQ ID NO: 3593181 - DNA, 14 bp, Homo sapiens
catatttacttctt

SEQ ID NO: 3593182 - DNA, 17 bp, Homo sapiens
catatttacttcttata

SEQ ID NO: 3593183 - DNA, 18 bp, Homo sapiens
catattttattgtatttt

SEQ ID NO: 3593184 - DNA, 22 bp, Homo sapiens
catattttattgtattttgatg

SEQ ID NO: 3593185 - DNA, 14 bp, Homo sapiens
catcaaataaattt

SEQ ID NO: 3593186 - DNA, 16 bp, Homo sapiens
catcaaatatttcttg

SEQ ID NO: 3593187 - DNA, 17 bp, Homo sapiens
catcacacccatttaaa

SEQ ID NO: 3593188 - DNA, 18 bp, Homo sapiens
catcaccatttcctcctt

SEQ ID NO: 3593189 - DNA, 15 bp, Homo sapiens
catcacgacacattt

SEQ ID NO: 3593190 - DNA, 21 bp, Homo sapiens
catcacggatggtgcatgggc

SEQ ID NO: 3593191 - DNA, 20 bp, Homo sapiens
catcactctaggttttacag

SEQ ID NO: 3593192 - DNA, 15 bp, Homo sapiens
catcacttgtacaaa

SEQ ID NO: 3593193 - DNA, 11 bp, Homo sapiens
catcagcaaac

SEQ ID NO: 3593194 - DNA, 16 bp, Homo sapiens
catcagccccacagga

SEQ ID NO: 3593195 - DNA, 20 bp, Homo sapiens
catcagcctgttccagaagg

SEQ ID NO: 3593196 - DNA, 14 bp, Homo sapiens
catcagccttggga

SEQ ID NO: 3593197 - DNA, 13 bp, Homo sapiens
catcagctgctga

SEQ ID NO: 3593198 - DNA, 17 bp, Homo sapiens
catcagctgctgaaaca

SEQ ID NO: 3593199 - DNA, 18 bp, Homo sapiens
catcaggctaagaccctg

SEQ ID NO: 3593200 - DNA, 21 bp, Homo sapiens
catcaggctaagaccctgtgt

SEQ ID NO: 3593201 - DNA, 17 bp, Homo sapiens
catcagtctccaacatg

SEQ ID NO: 3593202 - DNA, 14 bp, Homo sapiens
catcatctctgaag

SEQ ID NO: 3593203 - DNA, 15 bp, Homo sapiens
catcatctctgaagg

SEQ ID NO: 3593204 - DNA, 13 bp, Homo sapiens
catcatctgggaa

SEQ ID NO: 3593205 - DNA, 23 bp, Homo sapiens
catcatctgggaacttgtcacag

SEQ ID NO: 3593206 - DNA, 13 bp, Homo sapiens
catcatgtttaca

SEQ ID NO: 3593207 - DNA, 19 bp, Homo sapiens
catcatgtttacagaggac

SEQ ID NO: 3593208 - DNA, 21 bp, Homo sapiens
catcatgtttacagaggacag

SEQ ID NO: 3593209 - DNA, 14 bp, Homo sapiens
catcattactgttc

SEQ ID NO: 3593210 - DNA, 20 bp, Homo sapiens
catcattgtttagatgaggc

SEQ ID NO: 3593211 - DNA, 14 bp, Homo sapiens
catcatttcagcca

SEQ ID NO: 3593212 - DNA, 16 bp, Homo sapiens
catcatttcagccaaa

SEQ ID NO: 3593213 - DNA, 21 bp, Homo sapiens
catcatttcagccaaagtcct

SEQ ID NO: 3593214 - DNA, 16 bp, Homo sapiens
catccaaggcaaacaa

SEQ ID NO: 3593215 - DNA, 14 bp, Homo sapiens
catccaagtggcct

SEQ ID NO: 3593216 - DNA, 21 bp, Homo sapiens
catccacccgggggagcccag

SEQ ID NO: 3593217 - DNA, 13 bp, Homo sapiens
catccagggggca

SEQ ID NO: 3593218 - DNA, 21 bp, Homo sapiens
catccagtgtgagatactgtg

SEQ ID NO: 3593219 - DNA, 23 bp, Homo sapiens
catccagtgtgagatactgtgta

SEQ ID NO: 3593220 - DNA, 13 bp, Homo sapiens
catccagttcatg

SEQ ID NO: 3593221 - DNA, 15 bp, Homo sapiens
catccatcctgagcc

SEQ ID NO: 3593222 - DNA, 19 bp, Homo sapiens
catccatggggctgattgt

SEQ ID NO: 3593223 - DNA, 19 bp, Homo sapiens
catccatgttccgagaaga

SEQ ID NO: 3593224 - DNA, 17 bp, Homo sapiens
catcccctccctgcctg

SEQ ID NO: 3593225 - DNA, 20 bp, Homo sapiens
catcccctccctgcctgctc

SEQ ID NO: 3593226 - DNA, 20 bp, Homo sapiens
catccctcacccatcctaga

SEQ ID NO: 3593227 - DNA, 16 bp, Homo sapiens
catccctgactggcca

SEQ ID NO: 3593228 - DNA, 21 bp, Homo sapiens
catccctgactggccaaaccc

SEQ ID NO: 3593229 - DNA, 17 bp, Homo sapiens
catccctgcctggaggc

SEQ ID NO: 3593230 - DNA, 22 bp, Homo sapiens
catccctggagcaggagccccg

SEQ ID NO: 3593231 - DNA, 13 bp, Homo sapiens
catcccttcctgg

SEQ ID NO: 3593232 - DNA, 15 bp, Homo sapiens
catcccttcctggaa

SEQ ID NO: 3593233 - DNA, 19 bp, Homo sapiens
catcccttcctggaaacag

SEQ ID NO: 3593234 - DNA, 20 bp, Homo sapiens
catcccttcctggaaacagc

SEQ ID NO: 3593235 - DNA, 21 bp, Homo sapiens
catccctttttttacatttca

SEQ ID NO: 3593236 - DNA, 15 bp, Homo sapiens
catccgactgcccct

SEQ ID NO: 3593237 - DNA, 16 bp, Homo sapiens
catccgactgcccctg

SEQ ID NO: 3593238 - DNA, 18 bp, Homo sapiens
catcctaaagaacaaagt

SEQ ID NO: 3593239 - DNA, 13 bp, Homo sapiens
catcctcatccct

SEQ ID NO: 3593240 - DNA, 20 bp, Homo sapiens
catcctcatccctgactggc

SEQ ID NO: 3593241 - DNA, 14 bp, Homo sapiens
catcctccagcagg

SEQ ID NO: 3593242 - DNA, 16 bp, Homo sapiens
catcctccagcaggga

SEQ ID NO: 3593243 - DNA, 12 bp, Homo sapiens
catcctgagcca

SEQ ID NO: 3593244 - DNA, 15 bp, Homo sapiens
catcctggggcagca

SEQ ID NO: 3593245 - DNA, 20 bp, Homo sapiens
catcctggggcagcactccc

SEQ ID NO: 3593246 - DNA, 15 bp, Homo sapiens
catccttctcactgc

SEQ ID NO: 3593247 - DNA, 17 bp, Homo sapiens
catcgaagggattgtgt

SEQ ID NO: 3593248 - DNA, 18 bp, Homo sapiens
catcgaagggattgtgta

SEQ ID NO: 3593249 - DNA, 20 bp, Homo sapiens
catcgcaatagttttttact

SEQ ID NO: 3593250 - DNA, 14 bp, Homo sapiens
catcgcacagttta

SEQ ID NO: 3593251 - DNA, 16 bp, Homo sapiens
catctacaaaacatta

SEQ ID NO: 3593252 - DNA, 20 bp, Homo sapiens
catctacaaaacattaaact

SEQ ID NO: 3593253 - DNA, 20 bp, Homo sapiens
catctaccttttctggcaaa

SEQ ID NO: 3593254 - DNA, 14 bp, Homo sapiens
catctcaaaacaaa

SEQ ID NO: 3593255 - DNA, 22 bp, Homo sapiens
catctcaggagatggagggctt

SEQ ID NO: 3593256 - DNA, 23 bp, Homo sapiens
catctcaggaggggcagcgcatg

SEQ ID NO: 3593257 - DNA, 21 bp, Homo sapiens
catctcagggaactgaccctc

SEQ ID NO: 3593258 - DNA, 19 bp, Homo sapiens
catctcatgagtgtgcccc

SEQ ID NO: 3593259 - DNA, 14 bp, Homo sapiens
catctccactccag

SEQ ID NO: 3593260 - DNA, 18 bp, Homo sapiens
catctccctcctccaggt

SEQ ID NO: 3593261 - DNA, 12 bp, Homo sapiens
catctctgaagg

SEQ ID NO: 3593262 - DNA, 13 bp, Homo sapiens
catctctgctcca

SEQ ID NO: 3593263 - DNA, 15 bp, Homo sapiens
catctcttctgcaag

SEQ ID NO: 3593264 - DNA, 20 bp, Homo sapiens
catctgaatgaaaataactg

SEQ ID NO: 3593265 - DNA, 14 bp, Homo sapiens
catctgaccagcag

SEQ ID NO: 3593266 - DNA, 19 bp, Homo sapiens
catctgaccagcagcgcct

SEQ ID NO: 3593267 - DNA, 13 bp, Homo sapiens
catctgaccccaa

SEQ ID NO: 3593268 - DNA, 15 bp, Homo sapiens
catctgaccccaagg

SEQ ID NO: 3593269 - DNA, 23 bp, Homo sapiens
catctgaccccaagggggctgct

SEQ ID NO: 3593270 - DNA, 16 bp, Homo sapiens
catctgactgccaagc

SEQ ID NO: 3593271 - DNA, 20 bp, Homo sapiens
catctgactgccaagccaga

SEQ ID NO: 3593272 - DNA, 15 bp, Homo sapiens
catctgagctggggg

SEQ ID NO: 3593273 - DNA, 16 bp, Homo sapiens
catctgctaagtaatt

SEQ ID NO: 3593274 - DNA, 12 bp, Homo sapiens
catctgctgtct

SEQ ID NO: 3593275 - DNA, 14 bp, Homo sapiens
catctgctgtcttt

SEQ ID NO: 3593276 - DNA, 20 bp, Homo sapiens
catctggagagcccagagtc

SEQ ID NO: 3593277 - DNA, 14 bp, Homo sapiens
catctggctctaat

SEQ ID NO: 3593278 - DNA, 18 bp, Homo sapiens
catctggctctaattcac

SEQ ID NO: 3593279 - DNA, 23 bp, Homo sapiens
catctggctggaaagcagagcct

SEQ ID NO: 3593280 - DNA, 20 bp, Homo sapiens
catctgggaacttgtcacag

SEQ ID NO: 3593281 - DNA, 16 bp, Homo sapiens
catctgggggagtgga

SEQ ID NO: 3593282 - DNA, 17 bp, Homo sapiens
catctgtacctctgcct

SEQ ID NO: 3593283 - DNA, 21 bp, Homo sapiens
catctgtctcggctctgcatg

SEQ ID NO: 3593284 - DNA, 14 bp, Homo sapiens
catctgtggagctg

SEQ ID NO: 3593285 - DNA, 19 bp, Homo sapiens
catctgtttgaagattata

SEQ ID NO: 3593286 - DNA, 18 bp, Homo sapiens
catcttacattagtgatt

SEQ ID NO: 3593287 - DNA, 22 bp, Homo sapiens
catcttccacctcacctctttg

SEQ ID NO: 3593288 - DNA, 12 bp, Homo sapiens
catcttctttct

SEQ ID NO: 3593289 - DNA, 16 bp, Homo sapiens
catcttgagccacagt

SEQ ID NO: 3593290 - DNA, 17 bp, Homo sapiens
ccagctaagaacctgga

SEQ ID NO: 3593291 - DNA, 19 bp, Homo sapiens
ccagctaagaacctggaac

SEQ ID NO: 3593292 - DNA, 20 bp, Homo sapiens
ccagctacacctttctcctt

SEQ ID NO: 3593293 - DNA, 20 bp, Homo sapiens
ccagctactcaggaggctga

SEQ ID NO: 3593294 - DNA, 21 bp, Homo sapiens
ccagctcacgtaatgcattgc

SEQ ID NO: 3593295 - DNA, 15 bp, Homo sapiens
ccagctcagccctgg

SEQ ID NO: 3593296 - DNA, 19 bp, Homo sapiens
ccagctcaggacagatgcc

SEQ ID NO: 3593297 - DNA, 14 bp, Homo sapiens
ccagctccaacctg

SEQ ID NO: 3593298 - DNA, 15 bp, Homo sapiens
ccagctccaacctgc

SEQ ID NO: 3593299 - DNA, 22 bp, Homo sapiens
ccagctccaaggggaatcagaa

SEQ ID NO: 3593300 - DNA, 14 bp, Homo sapiens
ccagctccgtgttt

SEQ ID NO: 3593301 - DNA, 18 bp, Homo sapiens
ccagctccgtgtttctct

SEQ ID NO: 3593302 - DNA, 20 bp, Homo sapiens
ccagctccgtgtttctctaa

SEQ ID NO: 3593303 - DNA, 17 bp, Homo sapiens
ccagctctagcctctgg

SEQ ID NO: 3593304 - DNA, 19 bp, Homo sapiens
ccagctctagcctctggac

SEQ ID NO: 3593305 - DNA, 13 bp, Homo sapiens
ccagctctgacat

SEQ ID NO: 3593306 - DNA, 18 bp, Homo sapiens
ccagctctgacatccctt

SEQ ID NO: 3593307 - DNA, 21 bp, Homo sapiens
ccagctctgacatcccttcct

SEQ ID NO: 3593308 - DNA, 23 bp, Homo sapiens
ccagctctgacatcccttcctgg

SEQ ID NO: 3593309 - DNA, 22 bp, Homo sapiens
ccagctctgcgtcggtcctggt

SEQ ID NO: 3593310 - DNA, 24 bp, Homo sapiens
ccagctctgtcctcttggccatcc

SEQ ID NO: 3593311 - DNA, 18 bp, Homo sapiens
ccagctgaaggcagtggc

SEQ ID NO: 3593312 - DNA, 13 bp, Homo sapiens
ccagctgcacccc

SEQ ID NO: 3593313 - DNA, 19 bp, Homo sapiens
ccagctgcaccccttcctg

SEQ ID NO: 3593314 - DNA, 22 bp, Homo sapiens
ccagctgcaccccttcctgggc

SEQ ID NO: 3593315 - DNA, 13 bp, Homo sapiens
ccagctgcactga

SEQ ID NO: 3593316 - DNA, 14 bp, Homo sapiens
ccagctgcctgggc

SEQ ID NO: 3593317 - DNA, 16 bp, Homo sapiens
ccagctgcctgggccc

SEQ ID NO: 3593318 - DNA, 24 bp, Homo sapiens
ccagctggagaaatatggtactca

SEQ ID NO: 3593319 - DNA, 16 bp, Homo sapiens
ccagctgggaagccct

SEQ ID NO: 3593320 - DNA, 18 bp, Homo sapiens
ccagcttctctctccagg

SEQ ID NO: 3593321 - DNA, 17 bp, Homo sapiens
ccagcttgggcagatct

SEQ ID NO: 3593322 - DNA, 20 bp, Homo sapiens
ccagctttgctaccaaagca

SEQ ID NO: 3593323 - DNA, 14 bp, Homo sapiens
ccaggaactgggcc

SEQ ID NO: 3593324 - DNA, 23 bp, Homo sapiens
ccaggaaggccaaaatcaagagt

SEQ ID NO: 3593325 - DNA, 20 bp, Homo sapiens
ccaggaagggaaagcgggca

SEQ ID NO: 3593326 - DNA, 14 bp, Homo sapiens
ccaggaatttccca

SEQ ID NO: 3593327 - DNA, 18 bp, Homo sapiens
ccaggaatttcccaggac

SEQ ID NO: 3593328 - DNA, 21 bp, Homo sapiens
ccaggaatttcccaggaccct

SEQ ID NO: 3593329 - DNA, 20 bp, Homo sapiens
ccaggacaggagatgctgtg

SEQ ID NO: 3593330 - DNA, 14 bp, Homo sapiens
ccaggaccctgaag

SEQ ID NO: 3593331 - DNA, 15 bp, Homo sapiens
ccaggactcccagaa

SEQ ID NO: 3593332 - DNA, 14 bp, Homo sapiens
ccaggactgtttca

SEQ ID NO: 3593333 - DNA, 15 bp, Homo sapiens
ccaggagacagacca

SEQ ID NO: 3593334 - DNA, 22 bp, Homo sapiens
ccaggagacagaccacttgcca

SEQ ID NO: 3593335 - DNA, 17 bp, Homo sapiens
ccaggagacctccagct

SEQ ID NO: 3593336 - DNA, 16 bp, Homo sapiens
ccaggagagagccagg

SEQ ID NO: 3593337 - DNA, 17 bp, Homo sapiens
ccaggagcctgtgcctc

SEQ ID NO: 3593338 - DNA, 22 bp, Homo sapiens
ccaggagggaggcaggggaggg

SEQ ID NO: 3593339 - DNA, 14 bp, Homo sapiens
ccaggatgcccaga

SEQ ID NO: 3593340 - DNA, 16 bp, Homo sapiens
ccaggatttattttga

SEQ ID NO: 3593341 - DNA, 14 bp, Homo sapiens
ccaggcaccacagc

SEQ ID NO: 3593342 - DNA, 19 bp, Homo sapiens
ccaggcaccacagcctcca

SEQ ID NO: 3593343 - DNA, 16 bp, Homo sapiens
ccaggcactgctgccc

SEQ ID NO: 3593344 - DNA, 18 bp, Homo sapiens
ccaggcactgctgcccag

SEQ ID NO: 3593345 - DNA, 13 bp, Homo sapiens
ccaggcagatcca

SEQ ID NO: 3593346 - DNA, 15 bp, Homo sapiens
ccaggcagatccagg

SEQ ID NO: 3593347 - DNA, 16 bp, Homo sapiens
ccaggcagatccagga

SEQ ID NO: 3593348 - DNA, 19 bp, Homo sapiens
ccaggcagcctccgggcgt

SEQ ID NO: 3593349 - DNA, 18 bp, Homo sapiens
ccaggcagctatttcagc

SEQ ID NO: 3593350 - DNA, 18 bp, Homo sapiens
ccaggcaggagcccttct

SEQ ID NO: 3593351 - DNA, 20 bp, Homo sapiens
ccaggccccaccggccaggc

SEQ ID NO: 3593352 - DNA, 12 bp, Homo sapiens
ccaggcccctcc

SEQ ID NO: 3593353 - DNA, 18 bp, Homo sapiens
ccaggcccctccctctcc

SEQ ID NO: 3593354 - DNA, 18 bp, Homo sapiens
ccaggccgcgcccagcag

SEQ ID NO: 3593355 - DNA, 21 bp, Homo sapiens
ccaggccgcgcccagcagagg

SEQ ID NO: 3593356 - DNA, 12 bp, Homo sapiens
ccaggcctgcct

SEQ ID NO: 3593357 - DNA, 19 bp, Homo sapiens
ccaggcctgggtgatctgc

SEQ ID NO: 3593358 - DNA, 23 bp, Homo sapiens
ccaggcctgggtgatctgctgct

SEQ ID NO: 3593359 - DNA, 22 bp, Homo sapiens
ccaggcctgtcaagagggagga

SEQ ID NO: 3593360 - DNA, 19 bp, Homo sapiens
ccaggccttacatctggct

SEQ ID NO: 3593361 - DNA, 20 bp, Homo sapiens
ccaggccttacatctggctg

SEQ ID NO: 3593362 - DNA, 18 bp, Homo sapiens
ccaggccttatctccaag

SEQ ID NO: 3593363 - DNA, 19 bp, Homo sapiens
ccaggctagagtgcaatgg

SEQ ID NO: 3593364 - DNA, 14 bp, Homo sapiens
ccaggctcaggaga

SEQ ID NO: 3593365 - DNA, 19 bp, Homo sapiens
ccaggctcaggagaagcca

SEQ ID NO: 3593366 - DNA, 21 bp, Homo sapiens
ccaggctcaggagaagccagt

SEQ ID NO: 3593367 - DNA, 17 bp, Homo sapiens
ccaggctcctacctgtc

SEQ ID NO: 3593368 - DNA, 14 bp, Homo sapiens
ccaggctgcctcct

SEQ ID NO: 3593369 - DNA, 21 bp, Homo sapiens
ccaggctgcctcctgccctta

SEQ ID NO: 3593370 - DNA, 19 bp, Homo sapiens
ccaggctggagtgcaatgg

SEQ ID NO: 3593371 - DNA, 20 bp, Homo sapiens
ccaggctggagtgcaatggt

SEQ ID NO: 3593372 - DNA, 21 bp, Homo sapiens
ccaggctggtgttctgtctgg

SEQ ID NO: 3593373 - DNA, 21 bp, Homo sapiens
ccagggaagctgtcctggagg

SEQ ID NO: 3593374 - DNA, 18 bp, Homo sapiens
ccagggacagaggcccca

SEQ ID NO: 3593375 - DNA, 23 bp, Homo sapiens
ccagggacagaggccccagcctc

SEQ ID NO: 3593376 - DNA, 19 bp, Homo sapiens
ccagggagcattttcctcc

SEQ ID NO: 3593377 - DNA, 16 bp, Homo sapiens
ccagggagctctgggg

SEQ ID NO: 3593378 - DNA, 12 bp, Homo sapiens
ccagggatgctg

SEQ ID NO: 3593379 - DNA, 15 bp, Homo sapiens
ccagggatgctgggc

SEQ ID NO: 3593380 - DNA, 20 bp, Homo sapiens
ccagggatgctgggctgggc

SEQ ID NO: 3593381 - DNA, 23 bp, Homo sapiens
ccagggatgctgggctgggccct

SEQ ID NO: 3593382 - DNA, 21 bp, Homo sapiens
ccagggcagcaggccagagaa

SEQ ID NO: 3593383 - DNA, 23 bp, Homo sapiens
ccagggcagcaggccagagaaag

SEQ ID NO: 3593384 - DNA, 18 bp, Homo sapiens
ccagggccagtgggaccc

SEQ ID NO: 3593385 - DNA, 13 bp, Homo sapiens
ccagggcccagag

SEQ ID NO: 3593386 - DNA, 14 bp, Homo sapiens
ccagggcccagagc

SEQ ID NO: 3593387 - DNA, 19 bp, Homo sapiens
ccagggcccagagcccagc

SEQ ID NO: 3593388 - DNA, 22 bp, Homo sapiens
ccagggcccagagcccagctcc

SEQ ID NO: 3593389 - DNA, 16 bp, Homo sapiens
ccagggcccccaccga

SEQ ID NO: 3593390 - DNA, 13 bp, Homo sapiens
ccagggcctccag

SEQ ID NO: 3593391 - DNA, 14 bp, Homo sapiens
ccagggcctccagg

SEQ ID NO: 3593392 - DNA, 16 bp, Homo sapiens
ccagggcctccagggc

SEQ ID NO: 3593393 - DNA, 15 bp, Homo sapiens
ccagggcctgacacc

SEQ ID NO: 3593394 - DNA, 17 bp, Homo sapiens
ccagggctggagacttc

SEQ ID NO: 3593395 - DNA, 19 bp, Homo sapiens
ccagggctggagacttcct

SEQ ID NO: 3593396 - DNA, 23 bp, Homo sapiens
ccagggctggagacttcctctgg

SEQ ID NO: 3593397 - DNA, 19 bp, Homo sapiens
ccaggggaactggcagcgc

SEQ ID NO: 3593398 - DNA, 14 bp, Homo sapiens
ccaggggagccctc

SEQ ID NO: 3593399 - DNA, 14 bp, Homo sapiens
ccaggggaggagcc

SEQ ID NO: 3593400 - DNA, 12 bp, Homo sapiens
ccaggggcctgc

SEQ ID NO: 3593401 - DNA, 15 bp, Homo sapiens
ccaggggcctgcaga

SEQ ID NO: 3593402 - DNA, 15 bp, Homo sapiens
ccagggtctctcagg

SEQ ID NO: 3593403 - DNA, 22 bp, Homo sapiens
ccagggtgacaaggcctgcttg

SEQ ID NO: 3593404 - DNA, 19 bp, Homo sapiens
ccagggttggcaccttccc

SEQ ID NO: 3593405 - DNA, 20 bp, Homo sapiens
ccaggtacaggagaggcagc

SEQ ID NO: 3593406 - DNA, 17 bp, Homo sapiens
ccaggtcagcctggaag

SEQ ID NO: 3593407 - DNA, 18 bp, Homo sapiens
ccaggtcagcctggaagg

SEQ ID NO: 3593408 - DNA, 22 bp, Homo sapiens
ccaggtcggagtgcctggagtc

SEQ ID NO: 3593409 - DNA, 16 bp, Homo sapiens
ccaggtctgactccaa

SEQ ID NO: 3593410 - DNA, 17 bp, Homo sapiens
ccaggtctgactccaaa

SEQ ID NO: 3593411 - DNA, 18 bp, Homo sapiens
ccaggtctgactccaaag

SEQ ID NO: 3593412 - DNA, 12 bp, Homo sapiens
ccaggtgccagt

SEQ ID NO: 3593413 - DNA, 13 bp, Homo sapiens
ccaggtgccagtt

SEQ ID NO: 3593414 - DNA, 15 bp, Homo sapiens
ccaggttccacagag

SEQ ID NO: 3593415 - DNA, 18 bp, Homo sapiens
ccaggttccacagaggac

SEQ ID NO: 3593416 - DNA, 15 bp, Homo sapiens
ccaggttcccccagc

SEQ ID NO: 3593417 - DNA, 17 bp, Homo sapiens
ccaggttcccccagcaa

SEQ ID NO: 3593418 - DNA, 17 bp, Homo sapiens
ccaggttcgagacccaa

SEQ ID NO: 3593419 - DNA, 18 bp, Homo sapiens
ccaggtttttcaattaaa

SEQ ID NO: 3593420 - DNA, 14 bp, Homo sapiens
ccagtaaaatttca

SEQ ID NO: 3593421 - DNA, 17 bp, Homo sapiens
ccagtaaaatttcagga

SEQ ID NO: 3593422 - DNA, 21 bp, Homo sapiens
cccccagggcctccagggccc

SEQ ID NO: 3593423 - DNA, 18 bp, Homo sapiens
cccccaggtgcagcccca

SEQ ID NO: 3593424 - DNA, 14 bp, Homo sapiens
cccccatctgagct

SEQ ID NO: 3593425 - DNA, 20 bp, Homo sapiens
cccccatgctgccttcaggg

SEQ ID NO: 3593426 - DNA, 15 bp, Homo sapiens
cccccatttcccgca

SEQ ID NO: 3593427 - DNA, 20 bp, Homo sapiens
cccccgcgctcgcccagcag

SEQ ID NO: 3593428 - DNA, 22 bp, Homo sapiens
ccccctccaggagagagccagg

SEQ ID NO: 3593429 - DNA, 12 bp, Homo sapiens
ccccctcccacc

SEQ ID NO: 3593430 - DNA, 12 bp, Homo sapiens
ccccctcccaga

SEQ ID NO: 3593431 - DNA, 19 bp, Homo sapiens
ccccctcccccagccactc

SEQ ID NO: 3593432 - DNA, 21 bp, Homo sapiens
ccccctctggagaaggcctgg

SEQ ID NO: 3593433 - DNA, 20 bp, Homo sapiens
ccccctgcaacttccgctga

SEQ ID NO: 3593434 - DNA, 14 bp, Homo sapiens
ccccctgcagccca

SEQ ID NO: 3593435 - DNA, 18 bp, Homo sapiens
ccccctgctccaccagca

SEQ ID NO: 3593436 - DNA, 12 bp, Homo sapiens
ccccctgtcctc

SEQ ID NO: 3593437 - DNA, 15 bp, Homo sapiens
cccccttccctggga

SEQ ID NO: 3593438 - DNA, 21 bp, Homo sapiens
ccccgagggctgagcctggtc

SEQ ID NO: 3593439 - DNA, 21 bp, Homo sapiens
ccccgcagacggtctgtgtgc

SEQ ID NO: 3593440 - DNA, 13 bp, Homo sapiens
ccccgccccagag

SEQ ID NO: 3593441 - DNA, 16 bp, Homo sapiens
ccccgccccagagctc

SEQ ID NO: 3593442 - DNA, 16 bp, Homo sapiens
ccccgcgatgccctgg

SEQ ID NO: 3593443 - DNA, 19 bp, Homo sapiens
ccccgctcaggggcctgga

SEQ ID NO: 3593444 - DNA, 17 bp, Homo sapiens
ccccgctcccgctccca

SEQ ID NO: 3593445 - DNA, 21 bp, Homo sapiens
ccccgggctggagaaagagct

SEQ ID NO: 3593446 - DNA, 22 bp, Homo sapiens
ccccgggctggagaaagagctg

SEQ ID NO: 3593447 - DNA, 14 bp, Homo sapiens
ccccgtcacagcct

SEQ ID NO: 3593448 - DNA, 15 bp, Homo sapiens
ccccgtcggactgcc

SEQ ID NO: 3593449 - DNA, 19 bp, Homo sapiens
ccccgtcggactgccccca

SEQ ID NO: 3593450 - DNA, 13 bp, Homo sapiens
ccccgttttgggg

SEQ ID NO: 3593451 - DNA, 17 bp, Homo sapiens
cccctaaagagcatcct

SEQ ID NO: 3593452 - DNA, 16 bp, Homo sapiens
cccctacccaaccctg

SEQ ID NO: 3593453 - DNA, 17 bp, Homo sapiens
cccctcacactgcaagg

SEQ ID NO: 3593454 - DNA, 13 bp, Homo sapiens
cccctccaaacct

SEQ ID NO: 3593455 - DNA, 18 bp, Homo sapiens
cccctccaaacctccagc

SEQ ID NO: 3593456 - DNA, 20 bp, Homo sapiens
cccctccagttttgcctgag

SEQ ID NO: 3593457 - DNA, 16 bp, Homo sapiens
cccctcccacccaccg

SEQ ID NO: 3593458 - DNA, 19 bp, Homo sapiens
cccctcccagacaggccct

SEQ ID NO: 3593459 - DNA, 20 bp, Homo sapiens
cccctcccagacaggccctc

SEQ ID NO: 3593460 - DNA, 12 bp, Homo sapiens
cccctccccagc

SEQ ID NO: 3593461 - DNA, 15 bp, Homo sapiens
cccctccccagccag

SEQ ID NO: 3593462 - DNA, 15 bp, Homo sapiens
cccctccctctccag

SEQ ID NO: 3593463 - DNA, 12 bp, Homo sapiens
cccctcctgcac

SEQ ID NO: 3593464 - DNA, 19 bp, Homo sapiens
cccctctccaggcctgtca

SEQ ID NO: 3593465 - DNA, 19 bp, Homo sapiens
cccctctgcacccagaaca

SEQ ID NO: 3593466 - DNA, 12 bp, Homo sapiens
cccctctgctgc

SEQ ID NO: 3593467 - DNA, 12 bp, Homo sapiens
cccctctggaga

SEQ ID NO: 3593468 - DNA, 19 bp, Homo sapiens
cccctctggagaaggcctg

SEQ ID NO: 3593469 - DNA, 21 bp, Homo sapiens
cccctgcaacttccgctgagg

SEQ ID NO: 3593470 - DNA, 14 bp, Homo sapiens
cccctgcagcccag

SEQ ID NO: 3593471 - DNA, 17 bp, Homo sapiens
cccctgcagcccaggcc

SEQ ID NO: 3593472 - DNA, 22 bp, Homo sapiens
cccctgcagcccaggccagtca

SEQ ID NO: 3593473 - DNA, 17 bp, Homo sapiens
cccctgcctgacagcct

SEQ ID NO: 3593474 - DNA, 19 bp, Homo sapiens
cccctgctccaccagcagc

SEQ ID NO: 3593475 - DNA, 16 bp, Homo sapiens
cccctggctttgcctc

SEQ ID NO: 3593476 - DNA, 18 bp, Homo sapiens
cccctggctttgcctctt

SEQ ID NO: 3593477 - DNA, 18 bp, Homo sapiens
cccctggcttttcactgc

SEQ ID NO: 3593478 - DNA, 18 bp, Homo sapiens
cccctgtggccctggcca

SEQ ID NO: 3593479 - DNA, 19 bp, Homo sapiens
cccctgtgtattcaccacc

SEQ ID NO: 3593480 - DNA, 15 bp, Homo sapiens
cccctgttcactcta

SEQ ID NO: 3593481 - DNA, 11 bp, Homo sapiens
ccccttcagga

SEQ ID NO: 3593482 - DNA, 14 bp, Homo sapiens
ccccttcaggagcc

SEQ ID NO: 3593483 - DNA, 15 bp, Homo sapiens
ccccttcaggagcct

SEQ ID NO: 3593484 - DNA, 17 bp, Homo sapiens
ccccttcatccatcctg

SEQ ID NO: 3593485 - DNA, 23 bp, Homo sapiens
ccccttccatggtactgtagcag

SEQ ID NO: 3593486 - DNA, 16 bp, Homo sapiens
ccccttccctgggagg

SEQ ID NO: 3593487 - DNA, 20 bp, Homo sapiens
ccccttcctgtttcagaccc

SEQ ID NO: 3593488 - DNA, 14 bp, Homo sapiens
cccctttcacactg

SEQ ID NO: 3593489 - DNA, 22 bp, Homo sapiens
ccccttttcggccccatgtatc

SEQ ID NO: 3593490 - DNA, 14 bp, Homo sapiens
cccgacagcctggc

SEQ ID NO: 3593491 - DNA, 18 bp, Homo sapiens
cccgacaggtgggcctgg

SEQ ID NO: 3593492 - DNA, 23 bp, Homo sapiens
cccgacagtgccatccccacctt

SEQ ID NO: 3593493 - DNA, 20 bp, Homo sapiens
cccgacgtttgcggcagtgt

SEQ ID NO: 3593494 - DNA, 17 bp, Homo sapiens
cccgagacgtgtaatga

SEQ ID NO: 3593495 - DNA, 23 bp, Homo sapiens
cccgagggctgagcctggtccca

SEQ ID NO: 3593496 - DNA, 20 bp, Homo sapiens
cccgcagacggtctgtgtgc

SEQ ID NO: 3593497 - DNA, 22 bp, Homo sapiens
cccgcagacggtctgtgtgctg

SEQ ID NO: 3593498 - DNA, 11 bp, Homo sapiens
cccgccagggc

SEQ ID NO: 3593499 - DNA, 12 bp, Homo sapiens
cccgccagggct

SEQ ID NO: 3593500 - DNA, 17 bp, Homo sapiens
cccgccagggctgggga

SEQ ID NO: 3593501 - DNA, 14 bp, Homo sapiens
cccgccccagagct

SEQ ID NO: 3593502 - DNA, 15 bp, Homo sapiens
cccgcccctcccacg

SEQ ID NO: 3593503 - DNA, 15 bp, Homo sapiens
cccgcccctgtggcc

SEQ ID NO: 3593504 - DNA, 19 bp, Homo sapiens
cccgcccctgtggccctgg

SEQ ID NO: 3593505 - DNA, 17 bp, Homo sapiens
cccgccctcaggctccg

SEQ ID NO: 3593506 - DNA, 17 bp, Homo sapiens
cccgccgcccagcccac

SEQ ID NO: 3593507 - DNA, 23 bp, Homo sapiens
cccgcctcgacctccccacccgc

SEQ ID NO: 3593508 - DNA, 17 bp, Homo sapiens
cccgcgcagctgcctag

SEQ ID NO: 3593509 - DNA, 16 bp, Homo sapiens
cccgcgctcgcccagc

SEQ ID NO: 3593510 - DNA, 17 bp, Homo sapiens
cccgcgctcgcccagca

SEQ ID NO: 3593511 - DNA, 19 bp, Homo sapiens
cccgcgctcgcccagcagg

SEQ ID NO: 3593512 - DNA, 12 bp, Homo sapiens
cccgctcagccc

SEQ ID NO: 3593513 - DNA, 14 bp, Homo sapiens
cccgctcagccctc

SEQ ID NO: 3593514 - DNA, 19 bp, Homo sapiens
cccgctcagccctccctgc

SEQ ID NO: 3593515 - DNA, 23 bp, Homo sapiens
cccgctcagccctccctgcccct

SEQ ID NO: 3593516 - DNA, 18 bp, Homo sapiens
cccgctccatggaaaagc

SEQ ID NO: 3593517 - DNA, 17 bp, Homo sapiens
cccgctcccacacccct

SEQ ID NO: 3593518 - DNA, 13 bp, Homo sapiens
cccgctcccacag

SEQ ID NO: 3593519 - DNA, 19 bp, Homo sapiens
cccgctcccacagcttcct

SEQ ID NO: 3593520 - DNA, 22 bp, Homo sapiens
cccgctgcccaggggagccctc

SEQ ID NO: 3593521 - DNA, 17 bp, Homo sapiens
cccggaggggcctggca

SEQ ID NO: 3593522 - DNA, 16 bp, Homo sapiens
cccggcagtgcacgcg

SEQ ID NO: 3593523 - DNA, 15 bp, Homo sapiens
cccggccagctctgg

SEQ ID NO: 3593524 - DNA, 17 bp, Homo sapiens
cccggccagctctggag

SEQ ID NO: 3593525 - DNA, 21 bp, Homo sapiens
cccggccccccgcgctcgccc

SEQ ID NO: 3593526 - DNA, 20 bp, Homo sapiens
cccggccgccccgccccaga

SEQ ID NO: 3593527 - DNA, 17 bp, Homo sapiens
cccggccggagggcagg

SEQ ID NO: 3593528 - DNA, 19 bp, Homo sapiens
cccggctcgtgtatttatt

SEQ ID NO: 3593529 - DNA, 18 bp, Homo sapiens
cccggtgcccaagaatag

SEQ ID NO: 3593530 - DNA, 19 bp, Homo sapiens
cccggtgtatcctggccct

SEQ ID NO: 3593531 - DNA, 23 bp, Homo sapiens
cccggtgtatcctggccctgggg

SEQ ID NO: 3593532 - DNA, 15 bp, Homo sapiens
cccgtcacagcctca

SEQ ID NO: 3593533 - DNA, 22 bp, Homo sapiens
cccgtcctctcggctgccaggg

SEQ ID NO: 3593534 - DNA, 19 bp, Homo sapiens
cccgtcggactgcccccag

SEQ ID NO: 3593535 - DNA, 20 bp, Homo sapiens
cccgtcggactgcccccaga

SEQ ID NO: 3593536 - DNA, 22 bp, Homo sapiens
cccgtcggactgcccccagaaa

SEQ ID NO: 3593537 - DNA, 13 bp, Homo sapiens
cccgtctctgccc

SEQ ID NO: 3593538 - DNA, 23 bp, Homo sapiens
cccgtctctgccctgggctcctc

SEQ ID NO: 3593539 - DNA, 17 bp, Homo sapiens
cccgtctggacctgggg

SEQ ID NO: 3593540 - DNA, 17 bp, Homo sapiens
ccctaaagagcatcctg

SEQ ID NO: 3593541 - DNA, 18 bp, Homo sapiens
ccctaaagagcatcctga

SEQ ID NO: 3593542 - DNA, 12 bp, Homo sapiens
ccctaaagccag

SEQ ID NO: 3593543 - DNA, 14 bp, Homo sapiens
ccctaaagccaggc

SEQ ID NO: 3593544 - DNA, 16 bp, Homo sapiens
ccctaagcccccaggg

SEQ ID NO: 3593545 - DNA, 20 bp, Homo sapiens
ccctaagtggctgccttctt

SEQ ID NO: 3593546 - DNA, 12 bp, Homo sapiens
ccctaatcttcc

SEQ ID NO: 3593547 - DNA, 23 bp, Homo sapiens
ccctaattaaaaactgtgatttt

SEQ ID NO: 3593548 - DNA, 20 bp, Homo sapiens
ccctacagacagcttacagg

SEQ ID NO: 3593549 - DNA, 14 bp, Homo sapiens
ccctacatgtattg

SEQ ID NO: 3593550 - DNA, 13 bp, Homo sapiens
ccctagccctgct

SEQ ID NO: 3593551 - DNA, 16 bp, Homo sapiens
ccctaggtgcccaggg

SEQ ID NO: 3593552 - DNA, 19 bp, Homo sapiens
ccctaggtgcccagggcca

SEQ ID NO: 3593553 - DNA, 14 bp, Homo sapiens
ccctatgctggtag

SEQ ID NO: 3593554 - DNA, 12 bp, Homo sapiens
cctgccagctgc

SEQ ID NO: 3593555 - DNA, 13 bp, Homo sapiens
cctgccagctgca

SEQ ID NO: 3593556 - DNA, 17 bp, Homo sapiens
cctgccagctgcactga

SEQ ID NO: 3593557 - DNA, 18 bp, Homo sapiens
cctgccagctgcactgat

SEQ ID NO: 3593558 - DNA, 16 bp, Homo sapiens
cctgccatgccagtaa

SEQ ID NO: 3593559 - DNA, 23 bp, Homo sapiens
cctgcccaaacccttaactgaca

SEQ ID NO: 3593560 - DNA, 19 bp, Homo sapiens
cctgcccagtcgaccccaa

SEQ ID NO: 3593561 - DNA, 17 bp, Homo sapiens
cctgcccatgccccagt

SEQ ID NO: 3593562 - DNA, 19 bp, Homo sapiens
cctgccccaccccatccag

SEQ ID NO: 3593563 - DNA, 23 bp, Homo sapiens
cctgccccaccccatccagccag

SEQ ID NO: 3593564 - DNA, 24 bp, Homo sapiens
cctgccccaccccatccagccaga

SEQ ID NO: 3593565 - DNA, 16 bp, Homo sapiens
cctgccccctgccagt

SEQ ID NO: 3593566 - DNA, 18 bp, Homo sapiens
cctgccccctgccagtga

SEQ ID NO: 3593567 - DNA, 14 bp, Homo sapiens
cctgccccctgggc

SEQ ID NO: 3593568 - DNA, 15 bp, Homo sapiens
cctgccccctgggct

SEQ ID NO: 3593569 - DNA, 18 bp, Homo sapiens
cctgcccctcccttcaac

SEQ ID NO: 3593570 - DNA, 20 bp, Homo sapiens
cctgcccgcctaagaccctg

SEQ ID NO: 3593571 - DNA, 19 bp, Homo sapiens
cctgccctctatttattag

SEQ ID NO: 3593572 - DNA, 16 bp, Homo sapiens
cctgcctccaccagca

SEQ ID NO: 3593573 - DNA, 14 bp, Homo sapiens
cctgcctccaggaa

SEQ ID NO: 3593574 - DNA, 14 bp, Homo sapiens
cctgcctgacagcc

SEQ ID NO: 3593575 - DNA, 16 bp, Homo sapiens
cctgcctgcagcaggc

SEQ ID NO: 3593576 - DNA, 12 bp, Homo sapiens
cctgcctgctcc

SEQ ID NO: 3593577 - DNA, 12 bp, Homo sapiens
cctgcctggagg

SEQ ID NO: 3593578 - DNA, 11 bp, Homo sapiens
cctgcctgtgc

SEQ ID NO: 3593579 - DNA, 22 bp, Homo sapiens
cctgcctgttggcaggcccact

SEQ ID NO: 3593580 - DNA, 12 bp, Homo sapiens
cctgcctgtttc

SEQ ID NO: 3593581 - DNA, 13 bp, Homo sapiens
cctgcctgtttcc

SEQ ID NO: 3593582 - DNA, 13 bp, Homo sapiens
cctgcgagacgca

SEQ ID NO: 3593583 - DNA, 21 bp, Homo sapiens
cctgcgagacgcacacagctg

SEQ ID NO: 3593584 - DNA, 20 bp, Homo sapiens
cctgcgccaccgcccagaga

SEQ ID NO: 3593585 - DNA, 13 bp, Homo sapiens
cctgcgcctccag

SEQ ID NO: 3593586 - DNA, 17 bp, Homo sapiens
cctgcgcctccagaggt

SEQ ID NO: 3593587 - DNA, 16 bp, Homo sapiens
cctgctcagccctgca

SEQ ID NO: 3593588 - DNA, 17 bp, Homo sapiens
cctgctcattatgccac

SEQ ID NO: 3593589 - DNA, 23 bp, Homo sapiens
cctgctcattatgccacttcctt

SEQ ID NO: 3593590 - DNA, 15 bp, Homo sapiens
cctgctccaccagca

SEQ ID NO: 3593591 - DNA, 17 bp, Homo sapiens
cctgctccaccagcagc

SEQ ID NO: 3593592 - DNA, 16 bp, Homo sapiens
cctgctccagacctga

SEQ ID NO: 3593593 - DNA, 20 bp, Homo sapiens
cctgctccttggcaccccca

SEQ ID NO: 3593594 - DNA, 18 bp, Homo sapiens
cctgctctcctcttgcca

SEQ ID NO: 3593595 - DNA, 21 bp, Homo sapiens
cctgctgaatgcctcgctccc

SEQ ID NO: 3593596 - DNA, 14 bp, Homo sapiens
cctgctgcaccctg

SEQ ID NO: 3593597 - DNA, 23 bp, Homo sapiens
cctgctgcaccctgcgcctccag

SEQ ID NO: 3593598 - DNA, 14 bp, Homo sapiens
cctgctgccagtgc

SEQ ID NO: 3593599 - DNA, 17 bp, Homo sapiens
cctgctgccagtgcagc

SEQ ID NO: 3593600 - DNA, 12 bp, Homo sapiens
cctgctgcgctg

SEQ ID NO: 3593601 - DNA, 13 bp, Homo sapiens
cctgctgcgctgc

SEQ ID NO: 3593602 - DNA, 14 bp, Homo sapiens
cctgctgcgctgct

SEQ ID NO: 3593603 - DNA, 15 bp, Homo sapiens
cctgctggtacctgc

SEQ ID NO: 3593604 - DNA, 19 bp, Homo sapiens
cctgctggtacctgccctc

SEQ ID NO: 3593605 - DNA, 14 bp, Homo sapiens
cctgctgtgctgct

SEQ ID NO: 3593606 - DNA, 16 bp, Homo sapiens
cctgcttcccacaact

SEQ ID NO: 3593607 - DNA, 19 bp, Homo sapiens
cctgcttgactttccagaa

SEQ ID NO: 3593608 - DNA, 20 bp, Homo sapiens
cctgcttgactttccagaat

SEQ ID NO: 3593609 - DNA, 17 bp, Homo sapiens
cctgctttgggctgccc

SEQ ID NO: 3593610 - DNA, 21 bp, Homo sapiens
cctgctttgggctgccctggt

SEQ ID NO: 3593611 - DNA, 12 bp, Homo sapiens
cctggaaacagc

SEQ ID NO: 3593612 - DNA, 15 bp, Homo sapiens
cctggaaacagcatg

SEQ ID NO: 3593613 - DNA, 20 bp, Homo sapiens
cctggaaaccttccacccag

SEQ ID NO: 3593614 - DNA, 17 bp, Homo sapiens
cctggaacttggggagt

SEQ ID NO: 3593615 - DNA, 20 bp, Homo sapiens
cctggaagagctgagacctt

SEQ ID NO: 3593616 - DNA, 13 bp, Homo sapiens
cctggaagctctc

SEQ ID NO: 3593617 - DNA, 12 bp, Homo sapiens
cctggacacagc

SEQ ID NO: 3593618 - DNA, 16 bp, Homo sapiens
cctggacacagctctt

SEQ ID NO: 3593619 - DNA, 13 bp, Homo sapiens
cctggagagcccc

SEQ ID NO: 3593620 - DNA, 14 bp, Homo sapiens
cctggagcaggagc

SEQ ID NO: 3593621 - DNA, 23 bp, Homo sapiens
cctggagcaggagccccgccaca

SEQ ID NO: 3593622 - DNA, 13 bp, Homo sapiens
cctggagcaggcc

SEQ ID NO: 3593623 - DNA, 22 bp, Homo sapiens
cctggagcttcagccaggtctg

SEQ ID NO: 3593624 - DNA, 18 bp, Homo sapiens
cctggaggacggccggct

SEQ ID NO: 3593625 - DNA, 19 bp, Homo sapiens
cctggaggcaaaggcctgg

SEQ ID NO: 3593626 - DNA, 20 bp, Homo sapiens
cctggaggcaaaggcctgga

SEQ ID NO: 3593627 - DNA, 21 bp, Homo sapiens
cctggaggcaaaggcctggac

SEQ ID NO: 3593628 - DNA, 14 bp, Homo sapiens
cctggaggcccagt

SEQ ID NO: 3593629 - DNA, 16 bp, Homo sapiens
cctggaggctggggat

SEQ ID NO: 3593630 - DNA, 17 bp, Homo sapiens
cctggaggctggggatg

SEQ ID NO: 3593631 - DNA, 16 bp, Homo sapiens
cctggaggtctccagg

SEQ ID NO: 3593632 - DNA, 15 bp, Homo sapiens
cctggaggtctggct

SEQ ID NO: 3593633 - DNA, 16 bp, Homo sapiens
cctggaggtctggctg

SEQ ID NO: 3593634 - DNA, 19 bp, Homo sapiens
cctggaggtctggctgagc

SEQ ID NO: 3593635 - DNA, 20 bp, Homo sapiens
cctggaggtctggctgagcc

SEQ ID NO: 3593636 - DNA, 21 bp, Homo sapiens
cctggaggtggctgagcccct

SEQ ID NO: 3593637 - DNA, 15 bp, Homo sapiens
cctggatccagcact

SEQ ID NO: 3593638 - DNA, 20 bp, Homo sapiens
cctggatctatccctgcggc

SEQ ID NO: 3593639 - DNA, 21 bp, Homo sapiens
cctggatgagaaacagctcag

SEQ ID NO: 3593640 - DNA, 22 bp, Homo sapiens
cctggatgagaaacagctcagc

SEQ ID NO: 3593641 - DNA, 21 bp, Homo sapiens
cctggcaaatgcctgactcag

SEQ ID NO: 3593642 - DNA, 21 bp, Homo sapiens
cctggcacaatgttggagcag

SEQ ID NO: 3593643 - DNA, 23 bp, Homo sapiens
cctggcacccccacaagctgtcc

SEQ ID NO: 3593644 - DNA, 13 bp, Homo sapiens
cctggcagctctg

SEQ ID NO: 3593645 - DNA, 14 bp, Homo sapiens
cctggcagctctgg

SEQ ID NO: 3593646 - DNA, 21 bp, Homo sapiens
cctggcagctctggacagccc

SEQ ID NO: 3593647 - DNA, 14 bp, Homo sapiens
cctggcagctgctg

SEQ ID NO: 3593648 - DNA, 15 bp, Homo sapiens
cctggcagctgctgt

SEQ ID NO: 3593649 - DNA, 22 bp, Homo sapiens
cctggcagctgctgtgggtggg

SEQ ID NO: 3593650 - DNA, 17 bp, Homo sapiens
cctggcagggccacctg

SEQ ID NO: 3593651 - DNA, 20 bp, Homo sapiens
cctggcagggccacctgcag

SEQ ID NO: 3593652 - DNA, 22 bp, Homo sapiens
cctggcagggccacctgcagga

SEQ ID NO: 3593653 - DNA, 14 bp, Homo sapiens
cctggccagacaca

SEQ ID NO: 3593654 - DNA, 16 bp, Homo sapiens
cctggccagacacagg

SEQ ID NO: 3593655 - DNA, 19 bp, Homo sapiens
cctggccagacacaggccc

SEQ ID NO: 3593656 - DNA, 14 bp, Homo sapiens
cctggccaggcagg

SEQ ID NO: 3593657 - DNA, 14 bp, Homo sapiens
cctggccatttcca

SEQ ID NO: 3593658 - DNA, 23 bp, Homo sapiens
cctggccatttccaagaggctgt

SEQ ID NO: 3593659 - DNA, 13 bp, Homo sapiens
cctggccctgggg

SEQ ID NO: 3593660 - DNA, 18 bp, Homo sapiens
cctggcctgaactgagga

SEQ ID NO: 3593661 - DNA, 12 bp, Homo sapiens
cctggcctggct

SEQ ID NO: 3593662 - DNA, 14 bp, Homo sapiens
cctggcctggctgg

SEQ ID NO: 3593663 - DNA, 15 bp, Homo sapiens
cctggcctggctggg

SEQ ID NO: 3593664 - DNA, 18 bp, Homo sapiens
cctggccttaaagaggga

SEQ ID NO: 3593665 - DNA, 20 bp, Homo sapiens
cctggccttgggatccaggc

SEQ ID NO: 3593666 - DNA, 20 bp, Homo sapiens
cctggcgactgcccctgcct

SEQ ID NO: 3593667 - DNA, 22 bp, Homo sapiens
cctggcggtgtataccaggcag

SEQ ID NO: 3593668 - DNA, 16 bp, Homo sapiens
cctggcgtgctcagac

SEQ ID NO: 3593669 - DNA, 17 bp, Homo sapiens
cctggcgtgctcagacc

SEQ ID NO: 3593670 - DNA, 16 bp, Homo sapiens
cctggctcactggcag

SEQ ID NO: 3593671 - DNA, 14 bp, Homo sapiens
cctggctccactct

SEQ ID NO: 3593672 - DNA, 19 bp, Homo sapiens
cctggctccactcttgatc

SEQ ID NO: 3593673 - DNA, 14 bp, Homo sapiens
cctggctctgcccc

SEQ ID NO: 3593674 - DNA, 18 bp, Homo sapiens
cctggctctgccccctcc

SEQ ID NO: 3593675 - DNA, 22 bp, Homo sapiens
cctggctgcggggcgggcacac

SEQ ID NO: 3593676 - DNA, 18 bp, Homo sapiens
cctggctgggactgggaa

SEQ ID NO: 3593677 - DNA, 14 bp, Homo sapiens
cctggctttgcctc

SEQ ID NO: 3593678 - DNA, 16 bp, Homo sapiens
cctggcttttcactgc

SEQ ID NO: 3593679 - DNA, 17 bp, Homo sapiens
cctggcttttcactgct

SEQ ID NO: 3593680 - DNA, 24 bp, Homo sapiens
cctggcttttcactgctggctgcc

SEQ ID NO: 3593681 - DNA, 19 bp, Homo sapiens
cctgggaacacagttctgg

SEQ ID NO: 3593682 - DNA, 17 bp, Homo sapiens
cctgggaacacatctgg

SEQ ID NO: 3593683 - DNA, 21 bp, Homo sapiens
cctgggaacacatctggctgc

SEQ ID NO: 3593684 - DNA, 15 bp, Homo sapiens
cctgggaaccactcc

SEQ ID NO: 3593685 - DNA, 15 bp, Homo sapiens
cctgggaaggccagc

SEQ ID NO: 3593686 - DNA, 20 bp, Homo sapiens
cctgggagccagtcctccac

SEQ ID NO: 3593687 - DNA, 15 bp, Homo sapiens
cgtttgcggcagtgt

SEQ ID NO: 3593688 - DNA, 18 bp, Homo sapiens
cgtttggagaaggtctgt

SEQ ID NO: 3593689 - DNA, 21 bp, Homo sapiens
cgtttggagaaggtctgtggt

SEQ ID NO: 3593690 - DNA, 23 bp, Homo sapiens
ctaaaaaggcccttagagggaat

SEQ ID NO: 3593691 - DNA, 13 bp, Homo sapiens
ctaaaaagtataa

SEQ ID NO: 3593692 - DNA, 16 bp, Homo sapiens
ctaaaaagtataaaat

SEQ ID NO: 3593693 - DNA, 17 bp, Homo sapiens
ctaaaaagtataaaata

SEQ ID NO: 3593694 - DNA, 11 bp, Homo sapiens
ctaaaaataaa

SEQ ID NO: 3593695 - DNA, 21 bp, Homo sapiens
ctaaaaatacaccgtttagaa

SEQ ID NO: 3593696 - DNA, 22 bp, Homo sapiens
ctaaaaatacaccgtttagaaa

SEQ ID NO: 3593697 - DNA, 22 bp, Homo sapiens
ctaaaacccaaaggtggcagct

SEQ ID NO: 3593698 - DNA, 14 bp, Homo sapiens
ctaaaacctgaaat

SEQ ID NO: 3593699 - DNA, 23 bp, Homo sapiens
ctaaaatatttattttttttaag

SEQ ID NO: 3593700 - DNA, 20 bp, Homo sapiens
ctaaaatttcataattctga

SEQ ID NO: 3593701 - DNA, 15 bp, Homo sapiens
ctaaactaagatgtg

SEQ ID NO: 3593702 - DNA, 16 bp, Homo sapiens
ctaaactccatgatat

SEQ ID NO: 3593703 - DNA, 17 bp, Homo sapiens
ctaaactttttttctgt

SEQ ID NO: 3593704 - DNA, 21 bp, Homo sapiens
ctaaactttttttctgtacca

SEQ ID NO: 3593705 - DNA, 20 bp, Homo sapiens
ctaaagccaggctcaggaga

SEQ ID NO: 3593706 - DNA, 16 bp, Homo sapiens
ctaaagggaccatctg

SEQ ID NO: 3593707 - DNA, 19 bp, Homo sapiens
ctaaagggaccatctgctg

SEQ ID NO: 3593708 - DNA, 20 bp, Homo sapiens
ctaaagggaccatctgctgc

SEQ ID NO: 3593709 - DNA, 21 bp, Homo sapiens
ctaaagggaccatctgctgca

SEQ ID NO: 3593710 - DNA, 22 bp, Homo sapiens
ctaaagggactacctctgtgcc

SEQ ID NO: 3593711 - DNA, 11 bp, Homo sapiens
ctaaataaaga

SEQ ID NO: 3593712 - DNA, 22 bp, Homo sapiens
ctaaataaatgtaatagccaaa

SEQ ID NO: 3593713 - DNA, 16 bp, Homo sapiens
ctaaattgcagtttac

SEQ ID NO: 3593714 - DNA, 13 bp, Homo sapiens
ctaaatttaatgc

SEQ ID NO: 3593715 - DNA, 15 bp, Homo sapiens
ctaaatttaatgctg

SEQ ID NO: 3593716 - DNA, 15 bp, Homo sapiens
ctaaattttctaaat

SEQ ID NO: 3593717 - DNA, 12 bp, Homo sapiens
ctaacagccctc

SEQ ID NO: 3593718 - DNA, 22 bp, Homo sapiens
ctaacagccctcctctgcactc

SEQ ID NO: 3593719 - DNA, 11 bp, Homo sapiens
ctaacatgaaa

SEQ ID NO: 3593720 - DNA, 22 bp, Homo sapiens
ctaaccaaatctctcaaatctg

SEQ ID NO: 3593721 - DNA, 14 bp, Homo sapiens
ctaacccagtcttt

SEQ ID NO: 3593722 - DNA, 12 bp, Homo sapiens
ctaacctgtgac

SEQ ID NO: 3593723 - DNA, 24 bp, Homo sapiens
ctaactcctataaagtgcctcgga

SEQ ID NO: 3593724 - DNA, 18 bp, Homo sapiens
ctaactctgagagctgtt

SEQ ID NO: 3593725 - DNA, 16 bp, Homo sapiens
ctaagaagaaggccag

SEQ ID NO: 3593726 - DNA, 21 bp, Homo sapiens
ctaagaagaaggccagagagg

SEQ ID NO: 3593727 - DNA, 16 bp, Homo sapiens
ctaagaataaacattt

SEQ ID NO: 3593728 - DNA, 17 bp, Homo sapiens
ctaagaataaacatttg

SEQ ID NO: 3593729 - DNA, 15 bp, Homo sapiens
ctaagacagaggaac

SEQ ID NO: 3593730 - DNA, 19 bp, Homo sapiens
ctaagaccctgtgtcctcc

SEQ ID NO: 3593731 - DNA, 16 bp, Homo sapiens
ctaagcaaccacactg

SEQ ID NO: 3593732 - DNA, 19 bp, Homo sapiens
ctaagcagaggaggggccg

SEQ ID NO: 3593733 - DNA, 14 bp, Homo sapiens
ctaagcccccaggg

SEQ ID NO: 3593734 - DNA, 21 bp, Homo sapiens
ctaagcccccagggcctccag

SEQ ID NO: 3593735 - DNA, 20 bp, Homo sapiens
ctaagcctgaaggggcgtct

SEQ ID NO: 3593736 - DNA, 14 bp, Homo sapiens
ctaagctaggaatg

SEQ ID NO: 3593737 - DNA, 11 bp, Homo sapiens
ctaaggatttt

SEQ ID NO: 3593738 - DNA, 23 bp, Homo sapiens
ctaagtaaaaccacagcagttga

SEQ ID NO: 3593739 - DNA, 17 bp, Homo sapiens
ctaagtaaataggaatt

SEQ ID NO: 3593740 - DNA, 15 bp, Homo sapiens
ctaagtaatttagaa

SEQ ID NO: 3593741 - DNA, 20 bp, Homo sapiens
ctaagtacacaataagcaaa

SEQ ID NO: 3593742 - DNA, 13 bp, Homo sapiens
ctaagtatttaaa

SEQ ID NO: 3593743 - DNA, 19 bp, Homo sapiens
ctaagtccttccacctgcc

SEQ ID NO: 3593744 - DNA, 13 bp, Homo sapiens
ctaagtgctgctg

SEQ ID NO: 3593745 - DNA, 18 bp, Homo sapiens
ctaagtgctgctgtggag

SEQ ID NO: 3593746 - DNA, 15 bp, Homo sapiens
ctaagtggctgcctt

SEQ ID NO: 3593747 - DNA, 22 bp, Homo sapiens
ctaagtggctgccttctttcca

SEQ ID NO: 3593748 - DNA, 22 bp, Homo sapiens
ctaagttattttatgacatgaa

SEQ ID NO: 3593749 - DNA, 17 bp, Homo sapiens
ctaatcagcattctcac

SEQ ID NO: 3593750 - DNA, 19 bp, Homo sapiens
ctaatcagcattctcactc

SEQ ID NO: 3593751 - DNA, 13 bp, Homo sapiens
ctaatcagtgatt

SEQ ID NO: 3593752 - DNA, 21 bp, Homo sapiens
ctaatcagtgattatttttcc

SEQ ID NO: 3593753 - DNA, 18 bp, Homo sapiens
ctaatccaggcagatcca

SEQ ID NO: 3593754 - DNA, 19 bp, Homo sapiens
ctaatccaggcagatccag

SEQ ID NO: 3593755 - DNA, 23 bp, Homo sapiens
ctaatccaggcagatccaggact

SEQ ID NO: 3593756 - DNA, 14 bp, Homo sapiens
ctaatccttttcct

SEQ ID NO: 3593757 - DNA, 14 bp, Homo sapiens
ctaatctgaactga

SEQ ID NO: 3593758 - DNA, 20 bp, Homo sapiens
ctaatgattcaaatgtttta

SEQ ID NO: 3593759 - DNA, 23 bp, Homo sapiens
ctaatgccttttgaatacatttg

SEQ ID NO: 3593760 - DNA, 14 bp, Homo sapiens
ctaatgtactgcat

SEQ ID NO: 3593761 - DNA, 19 bp, Homo sapiens
ctaatgtcacaattatgtg

SEQ ID NO: 3593762 - DNA, 20 bp, Homo sapiens
ctaatgtgagtgtgaagctt

SEQ ID NO: 3593763 - DNA, 18 bp, Homo sapiens
ctaatgttattttccttc

SEQ ID NO: 3593764 - DNA, 20 bp, Homo sapiens
ctaatgttattttccttctg

SEQ ID NO: 3593765 - DNA, 21 bp, Homo sapiens
ctaatgttattttccttctga

SEQ ID NO: 3593766 - DNA, 23 bp, Homo sapiens
ctaattaaaaactgtgattttta

SEQ ID NO: 3593767 - DNA, 20 bp, Homo sapiens
ctaattcaaggaatttctta

SEQ ID NO: 3593768 - DNA, 13 bp, Homo sapiens
ctaattctgggaa

SEQ ID NO: 3593769 - DNA, 21 bp, Homo sapiens
ctaattctttgacctgttggg

SEQ ID NO: 3593770 - DNA, 15 bp, Homo sapiens
ctaattgtgccccta

SEQ ID NO: 3593771 - DNA, 18 bp, Homo sapiens
ctaattgtgcccctaaag

SEQ ID NO: 3593772 - DNA, 23 bp, Homo sapiens
ctaatttatcctgaaatttcaga

SEQ ID NO: 3593773 - DNA, 17 bp, Homo sapiens
ctacaaaaacacagcaa

SEQ ID NO: 3593774 - DNA, 19 bp, Homo sapiens
ctacaactggagttttttt

SEQ ID NO: 3593775 - DNA, 21 bp, Homo sapiens
ctacagacatggaacagtgta

SEQ ID NO: 3593776 - DNA, 18 bp, Homo sapiens
ctacagctaatcagcatt

SEQ ID NO: 3593777 - DNA, 21 bp, Homo sapiens
ctacagctaatcagcattctc

SEQ ID NO: 3593778 - DNA, 15 bp, Homo sapiens
ctacagtgactccct

SEQ ID NO: 3593779 - DNA, 10 bp, Homo sapiens
ctacatgaaa

SEQ ID NO: 3593780 - DNA, 14 bp, Homo sapiens
ctacatgaaacaga

SEQ ID NO: 3593781 - DNA, 18 bp, Homo sapiens
ctacatgaaacagaaaca

SEQ ID NO: 3593782 - DNA, 18 bp, Homo sapiens
ctacatgtattgcacatt

SEQ ID NO: 3593783 - DNA, 15 bp, Homo sapiens
ctacatgttctttgt

SEQ ID NO: 3593784 - DNA, 11 bp, Homo sapiens
ctacattccac

SEQ ID NO: 3593785 - DNA, 14 bp, Homo sapiens
ctaccaaagcacct

SEQ ID NO: 3593786 - DNA, 15 bp, Homo sapiens
ctaccaaagcacctt

SEQ ID NO: 3593787 - DNA, 17 bp, Homo sapiens
ctaccaagctgtcacag

SEQ ID NO: 3593788 - DNA, 20 bp, Homo sapiens
ctaccagccagcctcagaag

SEQ ID NO: 3593789 - DNA, 20 bp, Homo sapiens
ctaccagggtctctcaggga

SEQ ID NO: 3593790 - DNA, 19 bp, Homo sapiens
ctaccagtatttagaagcc

SEQ ID NO: 3593791 - DNA, 21 bp, Homo sapiens
ctaccatgtgaaactctaccc

SEQ ID NO: 3593792 - DNA, 12 bp, Homo sapiens
ctaccatttcag

SEQ ID NO: 3593793 - DNA, 15 bp, Homo sapiens
ctacccaaccctgcc

SEQ ID NO: 3593794 - DNA, 14 bp, Homo sapiens
ctacccagctctgt

SEQ ID NO: 3593795 - DNA, 13 bp, Homo sapiens
ctaccccagccag

SEQ ID NO: 3593796 - DNA, 16 bp, Homo sapiens
ctaccctaaccaagtt

SEQ ID NO: 3593797 - DNA, 13 bp, Homo sapiens
ctaccctcccacc

SEQ ID NO: 3593798 - DNA, 16 bp, Homo sapiens
ctacctcacctgggca

SEQ ID NO: 3593799 - DNA, 16 bp, Homo sapiens
ctacctctgtctgaga

SEQ ID NO: 3593800 - DNA, 18 bp, Homo sapiens
ctacctctgtctgagaca

SEQ ID NO: 3593801 - DNA, 15 bp, Homo sapiens
ctacctgtctgctgc

SEQ ID NO: 3593802 - DNA, 17 bp, Homo sapiens
ctacctgtctgctgcca

SEQ ID NO: 3593803 - DNA, 13 bp, Homo sapiens
ctacctgtgcctg

SEQ ID NO: 3593804 - DNA, 18 bp, Homo sapiens
ctacctgtgtttttttct

SEQ ID NO: 3593805 - DNA, 22 bp, Homo sapiens
ctaccttatcactgcattattc

SEQ ID NO: 3593806 - DNA, 18 bp, Homo sapiens
ctacgcaccattttgtca

SEQ ID NO: 3593807 - DNA, 21 bp, Homo sapiens
ctactaaggggcttgtgttct

SEQ ID NO: 3593808 - DNA, 16 bp, Homo sapiens
ctactagtgtgactcc

SEQ ID NO: 3593809 - DNA, 17 bp, Homo sapiens
ctactagtgtgactcct

SEQ ID NO: 3593810 - DNA, 14 bp, Homo sapiens
ctactattggccct

SEQ ID NO: 3593811 - DNA, 12 bp, Homo sapiens
ctactattttct

SEQ ID NO: 3593812 - DNA, 14 bp, Homo sapiens
ctactctttgattt

SEQ ID NO: 3593813 - DNA, 15 bp, Homo sapiens
ctactggttacctgg

SEQ ID NO: 3593814 - DNA, 23 bp, Homo sapiens
ctactggttacctggagaagtag

SEQ ID NO: 3593815 - DNA, 22 bp, Homo sapiens
ctactgtaataaagatgattgt

SEQ ID NO: 3593816 - DNA, 20 bp, Homo sapiens
ctactgtaatgctgcctcag

SEQ ID NO: 3593817 - DNA, 15 bp, Homo sapiens
ctactgtactattta

SEQ ID NO: 3593818 - DNA, 18 bp, Homo sapiens
ctacttatgaaatgtgca

SEQ ID NO: 3593819 - DNA, 18 bp, Homo sapiens
ctatgcacaacagagtaa

SEQ ID NO: 3593820 - DNA, 20 bp, Homo sapiens
ctatgcatggtgccccagga

SEQ ID NO: 3593821 - DNA, 19 bp, Homo sapiens
ctatgggggcactgaggac

SEQ ID NO: 3593822 - DNA, 13 bp, Homo sapiens
ctatgtaaactac

SEQ ID NO: 3593823 - DNA, 16 bp, Homo sapiens
ctatgtatcaaatgta

SEQ ID NO: 3593824 - DNA, 14 bp, Homo sapiens
ctatgtattaattt

SEQ ID NO: 3593825 - DNA, 13 bp, Homo sapiens
ctatgttttacca

SEQ ID NO: 3593826 - DNA, 20 bp, Homo sapiens
ctattaatcaagagaaactt

SEQ ID NO: 3593827 - DNA, 20 bp, Homo sapiens
ctattacagtgttggagaac

SEQ ID NO: 3593828 - DNA, 19 bp, Homo sapiens
ctattatctgtcagctgca

SEQ ID NO: 3593829 - DNA, 18 bp, Homo sapiens
ctattctcaaatgctggc

SEQ ID NO: 3593830 - DNA, 19 bp, Homo sapiens
ctattctgaaaaagacata

SEQ ID NO: 3593831 - DNA, 22 bp, Homo sapiens
ctattctgtcagtgttaaagat

SEQ ID NO: 3593832 - DNA, 22 bp, Homo sapiens
ctattgatacaatattgtgcat

SEQ ID NO: 3593833 - DNA, 23 bp, Homo sapiens
ctattgatacaatattgtgcatg

SEQ ID NO: 3593834 - DNA, 12 bp, Homo sapiens
ctattgctgcta

SEQ ID NO: 3593835 - DNA, 14 bp, Homo sapiens
ctattgtagagcca

SEQ ID NO: 3593836 - DNA, 16 bp, Homo sapiens
ctattgtgccaactgc

SEQ ID NO: 3593837 - DNA, 17 bp, Homo sapiens
ctattgtttgttgcact

SEQ ID NO: 3593838 - DNA, 23 bp, Homo sapiens
ctatttaaaatgctcaatttcag

SEQ ID NO: 3593839 - DNA, 14 bp, Homo sapiens
ctatttatgccttg

SEQ ID NO: 3593840 - DNA, 21 bp, Homo sapiens
ctatttatgccttgatgattt

SEQ ID NO: 3593841 - DNA, 19 bp, Homo sapiens
ctatttatttatttattca

SEQ ID NO: 3593842 - DNA, 15 bp, Homo sapiens
ctatttccacccatt

SEQ ID NO: 3593843 - DNA, 11 bp, Homo sapiens
ctatttcttga

SEQ ID NO: 3593844 - DNA, 16 bp, Homo sapiens
ctatttcttgaagaat

SEQ ID NO: 3593845 - DNA, 21 bp, Homo sapiens
ctatttcttgaagaataaatt

SEQ ID NO: 3593846 - DNA, 14 bp, Homo sapiens
ctatttgcagaggc

SEQ ID NO: 3593847 - DNA, 15 bp, Homo sapiens
ctattttctaaagac

SEQ ID NO: 3593848 - DNA, 15 bp, Homo sapiens
ctattttctttttta

SEQ ID NO: 3593849 - DNA, 19 bp, Homo sapiens
ctattttgtaaactcaaaa

SEQ ID NO: 3593850 - DNA, 17 bp, Homo sapiens
ctatttttatacactgt

SEQ ID NO: 3593851 - DNA, 12 bp, Homo sapiens
ctatttttcctt

SEQ ID NO: 3593852 - DNA, 21 bp, Homo sapiens
ctcaaaaaaaagaaaatgtct

SEQ ID NO: 3593853 - DNA, 16 bp, Homo sapiens
ctcaaaagttttttct

SEQ ID NO: 3593854 - DNA, 14 bp, Homo sapiens
ctcaaaatgtgtaa

SEQ ID NO: 3593855 - DNA, 14 bp, Homo sapiens
ctcaaactgcacat

SEQ ID NO: 3593856 - DNA, 13 bp, Homo sapiens
ctcaaagaaagtg

SEQ ID NO: 3593857 - DNA, 23 bp, Homo sapiens
ctcaaatgctggcaaatccaggc

SEQ ID NO: 3593858 - DNA, 16 bp, Homo sapiens
ctcaaatggggccaga

SEQ ID NO: 3593859 - DNA, 19 bp, Homo sapiens
ctcaaatggggccagatcc

SEQ ID NO: 3593860 - DNA, 14 bp, Homo sapiens
ctcaacctcctggg

SEQ ID NO: 3593861 - DNA, 18 bp, Homo sapiens
ctcaagccccatttcctc

SEQ ID NO: 3593862 - DNA, 14 bp, Homo sapiens
ctcaagtaaaacaa

SEQ ID NO: 3593863 - DNA, 19 bp, Homo sapiens
ctcaagtaaaacaaatgaa

SEQ ID NO: 3593864 - DNA, 20 bp, Homo sapiens
ctcaagtaaaacaaatgaaa

SEQ ID NO: 3593865 - DNA, 15 bp, Homo sapiens
ctcaagtaaaagaaa

SEQ ID NO: 3593866 - DNA, 19 bp, Homo sapiens
ctcaagtcactcccaagcc

SEQ ID NO: 3593867 - DNA, 20 bp, Homo sapiens
ctcaagtcactcccaagccc

SEQ ID NO: 3593868 - DNA, 23 bp, Homo sapiens
ctcaagtgatctgtccacctcgg

SEQ ID NO: 3593869 - DNA, 17 bp, Homo sapiens
ctcaataaacatttcat

SEQ ID NO: 3593870 - DNA, 13 bp, Homo sapiens
ctcaatgcccagt

SEQ ID NO: 3593871 - DNA, 23 bp, Homo sapiens
ctcaatgcccagtaaaatttcag

SEQ ID NO: 3593872 - DNA, 13 bp, Homo sapiens
ctcaattatttgc

SEQ ID NO: 3593873 - DNA, 14 bp, Homo sapiens
ctcaattatttgca

SEQ ID NO: 3593874 - DNA, 16 bp, Homo sapiens
ctcaattatttgcata

SEQ ID NO: 3593875 - DNA, 22 bp, Homo sapiens
ctcaattatttgcatattttga

SEQ ID NO: 3593876 - DNA, 12 bp, Homo sapiens
ctcaatttcagc

SEQ ID NO: 3593877 - DNA, 13 bp, Homo sapiens
ctcacacccctgt

SEQ ID NO: 3593878 - DNA, 19 bp, Homo sapiens
ctcacacccctgtcccacc

SEQ ID NO: 3593879 - DNA, 14 bp, Homo sapiens
ctcacactgcaagg

SEQ ID NO: 3593880 - DNA, 17 bp, Homo sapiens
ctcacagaacccttgga

SEQ ID NO: 3593881 - DNA, 22 bp, Homo sapiens
ctcacagctactcagtggggct

SEQ ID NO: 3593882 - DNA, 13 bp, Homo sapiens
ctcacataagccc

SEQ ID NO: 3593883 - DNA, 13 bp, Homo sapiens
ctcaccacagcct

SEQ ID NO: 3593884 - DNA, 14 bp, Homo sapiens
ctcaccacagcctt

SEQ ID NO: 3593885 - DNA, 17 bp, Homo sapiens
ctcaccactaccagcca

SEQ ID NO: 3593886 - DNA, 23 bp, Homo sapiens
ctcaccactaccagccagcctca

SEQ ID NO: 3593887 - DNA, 17 bp, Homo sapiens
ctcacccccagctttgc

SEQ ID NO: 3593888 - DNA, 17 bp, Homo sapiens
ctcacccctagccctgg

SEQ ID NO: 3593889 - DNA, 19 bp, Homo sapiens
ctcacctgagtcaccctac

SEQ ID NO: 3593890 - DNA, 12 bp, Homo sapiens
ctcacctggact

SEQ ID NO: 3593891 - DNA, 19 bp, Homo sapiens
ctcacctggtcgccaatcc

SEQ ID NO: 3593892 - DNA, 22 bp, Homo sapiens
ctcacgagatttgccaggggca

SEQ ID NO: 3593893 - DNA, 12 bp, Homo sapiens
ctcactccccag

SEQ ID NO: 3593894 - DNA, 18 bp, Homo sapiens
ctcactgaactccaccga

SEQ ID NO: 3593895 - DNA, 22 bp, Homo sapiens
ctcactgcagcctcaacctcct

SEQ ID NO: 3593896 - DNA, 14 bp, Homo sapiens
ctcacttagtcctt

SEQ ID NO: 3593897 - DNA, 15 bp, Homo sapiens
ctcacttgcccacac

SEQ ID NO: 3593898 - DNA, 15 bp, Homo sapiens
ctcagaccagctctt

SEQ ID NO: 3593899 - DNA, 16 bp, Homo sapiens
ctcagaccagctcttc

SEQ ID NO: 3593900 - DNA, 14 bp, Homo sapiens
ctcagacccaacag

SEQ ID NO: 3593901 - DNA, 23 bp, Homo sapiens
ctcagagaatttctaccatttca

SEQ ID NO: 3593902 - DNA, 15 bp, Homo sapiens
ctcagagccacccct

SEQ ID NO: 3593903 - DNA, 18 bp, Homo sapiens
ctcagatccagggacaga

SEQ ID NO: 3593904 - DNA, 18 bp, Homo sapiens
ctcagatgcagtttggag

SEQ ID NO: 3593905 - DNA, 22 bp, Homo sapiens
ctcagattcttcattgaggatt

SEQ ID NO: 3593906 - DNA, 15 bp, Homo sapiens
ctcagattgtaatat

SEQ ID NO: 3593907 - DNA, 16 bp, Homo sapiens
ctcagatttctgagga

SEQ ID NO: 3593908 - DNA, 14 bp, Homo sapiens
ctcagcagagtgag

SEQ ID NO: 3593909 - DNA, 14 bp, Homo sapiens
ctcagccagagaag

SEQ ID NO: 3593910 - DNA, 19 bp, Homo sapiens
ctcagcccacatagtgatg

SEQ ID NO: 3593911 - DNA, 15 bp, Homo sapiens
ctcagccccaactct

SEQ ID NO: 3593912 - DNA, 15 bp, Homo sapiens
ctcagccctgcacca

SEQ ID NO: 3593913 - DNA, 16 bp, Homo sapiens
ctcagccctgcaccat

SEQ ID NO: 3593914 - DNA, 14 bp, Homo sapiens
ctcagccctggcct

SEQ ID NO: 3593915 - DNA, 17 bp, Homo sapiens
ctcagccctggcctggc

SEQ ID NO: 3593916 - DNA, 22 bp, Homo sapiens
ctcagcctaccgctggccctgc

SEQ ID NO: 3593917 - DNA, 14 bp, Homo sapiens
ctcagcctcctgag

SEQ ID NO: 3593918 - DNA, 22 bp, Homo sapiens
ctcagcctcctgagtagctgga

SEQ ID NO: 3593919 - DNA, 14 bp, Homo sapiens
ctcagcctggccag

SEQ ID NO: 3593920 - DNA, 17 bp, Homo sapiens
ctcagcctggccagaca

SEQ ID NO: 3593921 - DNA, 20 bp, Homo sapiens
ctcagccttgccagagatcc

SEQ ID NO: 3593922 - DNA, 15 bp, Homo sapiens
ctcagctgcctcctg

SEQ ID NO: 3593923 - DNA, 22 bp, Homo sapiens
ctcaggaaatcaaatatgcaaa

SEQ ID NO: 3593924 - DNA, 17 bp, Homo sapiens
ctcaggaattcagtgcc

SEQ ID NO: 3593925 - DNA, 12 bp, Homo sapiens
ctcaggacagat

SEQ ID NO: 3593926 - DNA, 19 bp, Homo sapiens
ctcaggacagatgccacac

SEQ ID NO: 3593927 - DNA, 17 bp, Homo sapiens
ctcaggacccatccctg

SEQ ID NO: 3593928 - DNA, 20 bp, Homo sapiens
ctcaggacccatccctgcct

SEQ ID NO: 3593929 - DNA, 22 bp, Homo sapiens
ctcaggacccatccctgcctgg

SEQ ID NO: 3593930 - DNA, 14 bp, Homo sapiens
ctcaggagaagcca

SEQ ID NO: 3593931 - DNA, 20 bp, Homo sapiens
ctcaggagaagccagtgtct

SEQ ID NO: 3593932 - DNA, 20 bp, Homo sapiens
ctcaggagatggagggcttg

SEQ ID NO: 3593933 - DNA, 23 bp, Homo sapiens
ctcaggagccgaagcccaggggc

SEQ ID NO: 3593934 - DNA, 17 bp, Homo sapiens
ctcaggaggcaggacct

SEQ ID NO: 3593935 - DNA, 14 bp, Homo sapiens
ctcaggccaaggga

SEQ ID NO: 3593936 - DNA, 18 bp, Homo sapiens
ctcaggccaagggaccag

SEQ ID NO: 3593937 - DNA, 15 bp, Homo sapiens
ctcaggccacaccgg

SEQ ID NO: 3593938 - DNA, 19 bp, Homo sapiens
ctcaggccacagtggggct

SEQ ID NO: 3593939 - DNA, 20 bp, Homo sapiens
ctcaggccacagtggggctg

SEQ ID NO: 3593940 - DNA, 13 bp, Homo sapiens
ctcaggcccagaa

SEQ ID NO: 3593941 - DNA, 23 bp, Homo sapiens
ctcaggccgaaggaggagtcagg

SEQ ID NO: 3593942 - DNA, 20 bp, Homo sapiens
ctcaggcctgactctcagca

SEQ ID NO: 3593943 - DNA, 11 bp, Homo sapiens
ctcaggctccg

SEQ ID NO: 3593944 - DNA, 12 bp, Homo sapiens
ctcaggctctgc

SEQ ID NO: 3593945 - DNA, 20 bp, Homo sapiens
ctcagggaaaagcagctctc

SEQ ID NO: 3593946 - DNA, 23 bp, Homo sapiens
ctcagggaaaagcagctctcccc

SEQ ID NO: 3593947 - DNA, 17 bp, Homo sapiens
ctcagggaactgaccct

SEQ ID NO: 3593948 - DNA, 11 bp, Homo sapiens
ctcagggaccg

SEQ ID NO: 3593949 - DNA, 15 bp, Homo sapiens
ctcagggatcacact

SEQ ID NO: 3593950 - DNA, 22 bp, Homo sapiens
ctcagggatggagggaagacct

SEQ ID NO: 3593951 - DNA, 14 bp, Homo sapiens
ctcagggctggagc

SEQ ID NO: 3593952 - DNA, 13 bp, Homo sapiens
ctctcctgacccc

SEQ ID NO: 3593953 - DNA, 23 bp, Homo sapiens
ctctccttttgaggcttctcctt

SEQ ID NO: 3593954 - DNA, 19 bp, Homo sapiens
ctctcgactgtcagtgggg

SEQ ID NO: 3593955 - DNA, 19 bp, Homo sapiens
ctctcgccccatccctgct

SEQ ID NO: 3593956 - DNA, 18 bp, Homo sapiens
ctctcggctgccaggggc

SEQ ID NO: 3593957 - DNA, 16 bp, Homo sapiens
ctctctatagcaccag

SEQ ID NO: 3593958 - DNA, 14 bp, Homo sapiens
ctctctccaggagg

SEQ ID NO: 3593959 - DNA, 24 bp, Homo sapiens
ctctctccagggtgcttagttggc

SEQ ID NO: 3593960 - DNA, 12 bp, Homo sapiens
ctctctccaggt

SEQ ID NO: 3593961 - DNA, 10 bp, Homo sapiens
ctctctctga

SEQ ID NO: 3593962 - DNA, 19 bp, Homo sapiens
ctctctgagggggtggggg

SEQ ID NO: 3593963 - DNA, 18 bp, Homo sapiens
ctctctgagtcaaatcca

SEQ ID NO: 3593964 - DNA, 20 bp, Homo sapiens
ctctctgagtcaaatccagt

SEQ ID NO: 3593965 - DNA, 9 bp, Homo sapiens
ctctctgct

SEQ ID NO: 3593966 - DNA, 13 bp, Homo sapiens
ctctcttcccctt

SEQ ID NO: 3593967 - DNA, 14 bp, Homo sapiens
ctctcttccccttc

SEQ ID NO: 3593968 - DNA, 19 bp, Homo sapiens
ctctcttccccttccctta

SEQ ID NO: 3593969 - DNA, 13 bp, Homo sapiens
ctctcttcctcca

SEQ ID NO: 3593970 - DNA, 19 bp, Homo sapiens
ctctcttgttgtccaggct

SEQ ID NO: 3593971 - DNA, 21 bp, Homo sapiens
ctctgaaaacaaggtttccat

SEQ ID NO: 3593972 - DNA, 22 bp, Homo sapiens
ctctgaaggagttacagggaag

SEQ ID NO: 3593973 - DNA, 21 bp, Homo sapiens
ctctgacaactgtgaagccac

SEQ ID NO: 3593974 - DNA, 13 bp, Homo sapiens
ctctgacatccct

SEQ ID NO: 3593975 - DNA, 14 bp, Homo sapiens
ctctgacatccctt

SEQ ID NO: 3593976 - DNA, 15 bp, Homo sapiens
ctctgacatcccttc

SEQ ID NO: 3593977 - DNA, 18 bp, Homo sapiens
ctctgacatcccttcctg

SEQ ID NO: 3593978 - DNA, 19 bp, Homo sapiens
ctctgacatcccttcctgg

SEQ ID NO: 3593979 - DNA, 21 bp, Homo sapiens
ctctgacatcccttcctggaa

SEQ ID NO: 3593980 - DNA, 12 bp, Homo sapiens
ctctgaggacaa

SEQ ID NO: 3593981 - DNA, 20 bp, Homo sapiens
ctctgaggggtgggggtgcc

SEQ ID NO: 3593982 - DNA, 17 bp, Homo sapiens
ctctgagtcaaatccag

SEQ ID NO: 3593983 - DNA, 18 bp, Homo sapiens
ctctgagtcaaatccagt

SEQ ID NO: 3593984 - DNA, 20 bp, Homo sapiens
ctctgagtcaaatccagtgg

SEQ ID NO: 3593985 - DNA, 18 bp, Homo sapiens
ctctgattagttgacagt

SEQ ID NO: 3593986 - DNA, 23 bp, Homo sapiens
ctctgattagttgacagtattaa

SEQ ID NO: 3593987 - DNA, 20 bp, Homo sapiens
ctctgattttcaaagctttt

SEQ ID NO: 3593988 - DNA, 22 bp, Homo sapiens
ctctgattttcaaagctttttc

SEQ ID NO: 3593989 - DNA, 22 bp, Homo sapiens
ctctgcacagacaagcagccct

SEQ ID NO: 3593990 - DNA, 15 bp, Homo sapiens
ctctgcacgctcaat

SEQ ID NO: 3593991 - DNA, 21 bp, Homo sapiens
ctctgcactggggcgtttcct

SEQ ID NO: 3593992 - DNA, 12 bp, Homo sapiens
ctctgcagccca

SEQ ID NO: 3593993 - DNA, 20 bp, Homo sapiens
ctctgcagcccattcccaag

SEQ ID NO: 3593994 - DNA, 22 bp, Homo sapiens
ctctgcagcccattcccaaggg

SEQ ID NO: 3593995 - DNA, 23 bp, Homo sapiens
ctctgcagcccattcccaaggga

SEQ ID NO: 3593996 - DNA, 13 bp, Homo sapiens
ctctgcagtaaaa

SEQ ID NO: 3593997 - DNA, 18 bp, Homo sapiens
ctctgcagtaaaacacat

SEQ ID NO: 3593998 - DNA, 19 bp, Homo sapiens
ctctgccaaaggatgtgat

SEQ ID NO: 3593999 - DNA, 22 bp, Homo sapiens
ctctgccagttacttgggcttc

SEQ ID NO: 3594000 - DNA, 15 bp, Homo sapiens
ctctgccccagcctg

SEQ ID NO: 3594001 - DNA, 21 bp, Homo sapiens
ctctgccccagcttgggcaga

SEQ ID NO: 3594002 - DNA, 15 bp, Homo sapiens
ctctgccccatcctc

SEQ ID NO: 3594003 - DNA, 14 bp, Homo sapiens
ctctgccccctccc

SEQ ID NO: 3594004 - DNA, 15 bp, Homo sapiens
ctctgcccctaagct

SEQ ID NO: 3594005 - DNA, 13 bp, Homo sapiens
ctctgccctggat

SEQ ID NO: 3594006 - DNA, 15 bp, Homo sapiens
ctctgccctggattg

SEQ ID NO: 3594007 - DNA, 16 bp, Homo sapiens
ctctgccctgggctcc

SEQ ID NO: 3594008 - DNA, 14 bp, Homo sapiens
ctctgcctcctctt

SEQ ID NO: 3594009 - DNA, 15 bp, Homo sapiens
ctctgcctgggctct

SEQ ID NO: 3594010 - DNA, 20 bp, Homo sapiens
ctctgcctgggctctggaag

SEQ ID NO: 3594011 - DNA, 21 bp, Homo sapiens
ctctgcgtcggtcctggtgcc

SEQ ID NO: 3594012 - DNA, 22 bp, Homo sapiens
ctctgctgccggctctgggcct

SEQ ID NO: 3594013 - DNA, 19 bp, Homo sapiens
ctctggaataaagttgcag

SEQ ID NO: 3594014 - DNA, 20 bp, Homo sapiens
ctctggaataaagttgcaga

SEQ ID NO: 3594015 - DNA, 22 bp, Homo sapiens
ctctggactggaaagcacaaga

SEQ ID NO: 3594016 - DNA, 17 bp, Homo sapiens
ctctggagaacagtggt

SEQ ID NO: 3594017 - DNA, 21 bp, Homo sapiens
ctctggaggtcatctggcgga

SEQ ID NO: 3594018 - DNA, 15 bp, Homo sapiens
ctctggagtggccac

SEQ ID NO: 3594019 - DNA, 13 bp, Homo sapiens
ctctggcagcacc

SEQ ID NO: 3594020 - DNA, 13 bp, Homo sapiens
ctctggctcccca

SEQ ID NO: 3594021 - DNA, 14 bp, Homo sapiens
ctctggctccccaa

SEQ ID NO: 3594022 - DNA, 15 bp, Homo sapiens
ctctggctccccaag

SEQ ID NO: 3594023 - DNA, 16 bp, Homo sapiens
ctctggctccccaagg

SEQ ID NO: 3594024 - DNA, 15 bp, Homo sapiens
ctctgggacccacag

SEQ ID NO: 3594025 - DNA, 18 bp, Homo sapiens
ctctgggcaaagcccctc

SEQ ID NO: 3594026 - DNA, 12 bp, Homo sapiens
ctctggggacag

SEQ ID NO: 3594027 - DNA, 16 bp, Homo sapiens
ctctgggggctgagga

SEQ ID NO: 3594028 - DNA, 22 bp, Homo sapiens
ctctgggtccttggctcccggg

SEQ ID NO: 3594029 - DNA, 17 bp, Homo sapiens
ctctgggtcttggccat

SEQ ID NO: 3594030 - DNA, 14 bp, Homo sapiens
ctctgggtgctgcc

SEQ ID NO: 3594031 - DNA, 23 bp, Homo sapiens
ctctggtgagtcaccacttcagg

SEQ ID NO: 3594032 - DNA, 23 bp, Homo sapiens
ctctggtgtgtggtgaggggctt

SEQ ID NO: 3594033 - DNA, 21 bp, Homo sapiens
ctctgtaaatgaaaaaaccca

SEQ ID NO: 3594034 - DNA, 22 bp, Homo sapiens
ctctgtccgtgccccttccctg

SEQ ID NO: 3594035 - DNA, 23 bp, Homo sapiens
ctctgtccgtgccccttccctgg

SEQ ID NO: 3594036 - DNA, 15 bp, Homo sapiens
ctctgtcttgtgttt

SEQ ID NO: 3594037 - DNA, 16 bp, Homo sapiens
ctctgtcttgtgtttc

SEQ ID NO: 3594038 - DNA, 16 bp, Homo sapiens
ctctgtggcaaaaaga

SEQ ID NO: 3594039 - DNA, 10 bp, Homo sapiens
ctctgtggcc

SEQ ID NO: 3594040 - DNA, 21 bp, Homo sapiens
ctctgtggtcacccatgcatc

SEQ ID NO: 3594041 - DNA, 15 bp, Homo sapiens
ctctgtgtgcacaaa

SEQ ID NO: 3594042 - DNA, 17 bp, Homo sapiens
ctctgtgtgcacaaata

SEQ ID NO: 3594043 - DNA, 23 bp, Homo sapiens
ctctgttccatgcaactggagtt

SEQ ID NO: 3594044 - DNA, 16 bp, Homo sapiens
ctctgttcctttctct

SEQ ID NO: 3594045 - DNA, 20 bp, Homo sapiens
ctctgttgcaagtgcaataa

SEQ ID NO: 3594046 - DNA, 14 bp, Homo sapiens
ctctgttgcccagg

SEQ ID NO: 3594047 - DNA, 17 bp, Homo sapiens
ctcttaagcagcatgga

SEQ ID NO: 3594048 - DNA, 22 bp, Homo sapiens
ctcttaagcagcatggaaaaat

SEQ ID NO: 3594049 - DNA, 21 bp, Homo sapiens
ctcttaagtggtctagtcaag

SEQ ID NO: 3594050 - DNA, 16 bp, Homo sapiens
ctcttcaactgaccag

SEQ ID NO: 3594051 - DNA, 17 bp, Homo sapiens
ctcttcaactgaccagc

SEQ ID NO: 3594052 - DNA, 20 bp, Homo sapiens
ctcttcaactgaccagcctc

SEQ ID NO: 3594053 - DNA, 17 bp, Homo sapiens
ctcttcagtgactcctg

SEQ ID NO: 3594054 - DNA, 14 bp, Homo sapiens
ctcttccagggcag

SEQ ID NO: 3594055 - DNA, 10 bp, Homo sapiens
ctcttcccac

SEQ ID NO: 3594056 - DNA, 11 bp, Homo sapiens
ctcttcccact

SEQ ID NO: 3594057 - DNA, 15 bp, Homo sapiens
ctcttcccactccag

SEQ ID NO: 3594058 - DNA, 14 bp, Homo sapiens
ctcttcccactttt

SEQ ID NO: 3594059 - DNA, 15 bp, Homo sapiens
ctcttccccttagaa

SEQ ID NO: 3594060 - DNA, 20 bp, Homo sapiens
ctcttccgtgacgtcactgg

SEQ ID NO: 3594061 - DNA, 16 bp, Homo sapiens
ctcttcctcctcccaa

SEQ ID NO: 3594062 - DNA, 13 bp, Homo sapiens
ctcttctccactg

SEQ ID NO: 3594063 - DNA, 16 bp, Homo sapiens
ctcttctcctttcaca

SEQ ID NO: 3594064 - DNA, 15 bp, Homo sapiens
ctcttctgctctttt

SEQ ID NO: 3594065 - DNA, 19 bp, Homo sapiens
ctcttctgctcttttcctg

SEQ ID NO: 3594066 - DNA, 19 bp, Homo sapiens
ctcttctggtgttgactgg

SEQ ID NO: 3594067 - DNA, 16 bp, Homo sapiens
ctcttcttctgaagat

SEQ ID NO: 3594068 - DNA, 22 bp, Homo sapiens
ctcttctttaaagggatggcaa

SEQ ID NO: 3594069 - DNA, 14 bp, Homo sapiens
ctcttctttgtgcc

SEQ ID NO: 3594070 - DNA, 18 bp, Homo sapiens
ctcttctttgtgcctttg

SEQ ID NO: 3594071 - DNA, 13 bp, Homo sapiens
ctcttgaaaagtt

SEQ ID NO: 3594072 - DNA, 21 bp, Homo sapiens
ctcttgaaaagttcagggacc

SEQ ID NO: 3594073 - DNA, 16 bp, Homo sapiens
ctcttgagttcctctg

SEQ ID NO: 3594074 - DNA, 19 bp, Homo sapiens
ctcttgagttcctctgcag

SEQ ID NO: 3594075 - DNA, 18 bp, Homo sapiens
ctcttgccactgcctctt

SEQ ID NO: 3594076 - DNA, 19 bp, Homo sapiens
ctcttgcccttcctactcc

SEQ ID NO: 3594077 - DNA, 14 bp, Homo sapiens
ctcttggcaggagt

SEQ ID NO: 3594078 - DNA, 16 bp, Homo sapiens
ctcttgtccctttccc

SEQ ID NO: 3594079 - DNA, 18 bp, Homo sapiens
ctcttgtccctttcccta

SEQ ID NO: 3594080 - DNA, 24 bp, Homo sapiens
ctcttgtcctcttctgctcttttc

SEQ ID NO: 3594081 - DNA, 17 bp, Homo sapiens
ctcttgttcctgaaatg

SEQ ID NO: 3594082 - DNA, 17 bp, Homo sapiens
ctctttagtgttctgtt

SEQ ID NO: 3594083 - DNA, 12 bp, Homo sapiens
ctctttccctgc

SEQ ID NO: 3594084 - DNA, 23 bp, Homo sapiens
ctgcctggaggcaaaggcctgga

SEQ ID NO: 3594085 - DNA, 16 bp, Homo sapiens
ctgcctggaggctcct

SEQ ID NO: 3594086 - DNA, 21 bp, Homo sapiens
ctgcctggaggctcctctagg

SEQ ID NO: 3594087 - DNA, 13 bp, Homo sapiens
ctgcctggcacag

SEQ ID NO: 3594088 - DNA, 17 bp, Homo sapiens
ctgcctgggccgtggca

SEQ ID NO: 3594089 - DNA, 23 bp, Homo sapiens
ctgcctgggccgtggcacagctg

SEQ ID NO: 3594090 - DNA, 13 bp, Homo sapiens
ctgcctgtgcccg

SEQ ID NO: 3594091 - DNA, 15 bp, Homo sapiens
ctgcctgtgggcttc

SEQ ID NO: 3594092 - DNA, 19 bp, Homo sapiens
ctgcctgttcccattcttg

SEQ ID NO: 3594093 - DNA, 21 bp, Homo sapiens
ctgcctgttggcaggcccact

SEQ ID NO: 3594094 - DNA, 14 bp, Homo sapiens
ctgcctgtttcccg

SEQ ID NO: 3594095 - DNA, 15 bp, Homo sapiens
ctgcctgtttcccgt

SEQ ID NO: 3594096 - DNA, 23 bp, Homo sapiens
ctgcctgtttcccgtaaggctgt

SEQ ID NO: 3594097 - DNA, 23 bp, Homo sapiens
ctgccttctttccatcaactccc

SEQ ID NO: 3594098 - DNA, 20 bp, Homo sapiens
ctgccttgtttaatgttaat

SEQ ID NO: 3594099 - DNA, 14 bp, Homo sapiens
ctgcctttaagcca

SEQ ID NO: 3594100 - DNA, 16 bp, Homo sapiens
ctgcctttaagccaaa

SEQ ID NO: 3594101 - DNA, 17 bp, Homo sapiens
ctgcctttaagccaaag

SEQ ID NO: 3594102 - DNA, 20 bp, Homo sapiens
ctgcgaatctagaggagggg

SEQ ID NO: 3594103 - DNA, 16 bp, Homo sapiens
ctgcgccctgtgcccg

SEQ ID NO: 3594104 - DNA, 20 bp, Homo sapiens
ctgcgcctccagaggtcctc

SEQ ID NO: 3594105 - DNA, 15 bp, Homo sapiens
ctgcggaggcggtgg

SEQ ID NO: 3594106 - DNA, 22 bp, Homo sapiens
ctgcggggcgggcacacctcct

SEQ ID NO: 3594107 - DNA, 16 bp, Homo sapiens
ctgctaagtaatttag

SEQ ID NO: 3594108 - DNA, 20 bp, Homo sapiens
ctgctaagtcattggcaaag

SEQ ID NO: 3594109 - DNA, 15 bp, Homo sapiens
ctgctacctgttctt

SEQ ID NO: 3594110 - DNA, 17 bp, Homo sapiens
ctgctactggcaaaagg

SEQ ID NO: 3594111 - DNA, 19 bp, Homo sapiens
ctgctagagacgctgatcc

SEQ ID NO: 3594112 - DNA, 21 bp, Homo sapiens
ctgctataaataggtttatat

SEQ ID NO: 3594113 - DNA, 14 bp, Homo sapiens
ctgctatagcctgg

SEQ ID NO: 3594114 - DNA, 15 bp, Homo sapiens
ctgctatagcctggg

SEQ ID NO: 3594115 - DNA, 17 bp, Homo sapiens
ctgctatttacactatt

SEQ ID NO: 3594116 - DNA, 16 bp, Homo sapiens
ctgctcaaggccacag

SEQ ID NO: 3594117 - DNA, 21 bp, Homo sapiens
ctgctcagccctgcaccatgc

SEQ ID NO: 3594118 - DNA, 18 bp, Homo sapiens
ctgctcagcttctcctgt

SEQ ID NO: 3594119 - DNA, 23 bp, Homo sapiens
ctgctccaaccgggatgggagcc

SEQ ID NO: 3594120 - DNA, 15 bp, Homo sapiens
ctgctccaactccat

SEQ ID NO: 3594121 - DNA, 24 bp, Homo sapiens
ctgctccaactccatactccactc

SEQ ID NO: 3594122 - DNA, 14 bp, Homo sapiens
ctgctccaccagca

SEQ ID NO: 3594123 - DNA, 20 bp, Homo sapiens
ctgctccaccagcagcatgg

SEQ ID NO: 3594124 - DNA, 22 bp, Homo sapiens
ctgctccaccagcagcatggca

SEQ ID NO: 3594125 - DNA, 12 bp, Homo sapiens
ctgctcctgctt

SEQ ID NO: 3594126 - DNA, 14 bp, Homo sapiens
ctgctcctgctttt

SEQ ID NO: 3594127 - DNA, 18 bp, Homo sapiens
ctgctcctgcttttctgt

SEQ ID NO: 3594128 - DNA, 22 bp, Homo sapiens
ctgctcctgcttttctgtcctg

SEQ ID NO: 3594129 - DNA, 14 bp, Homo sapiens
ctgctcctgggcat

SEQ ID NO: 3594130 - DNA, 17 bp, Homo sapiens
ctgctcgtggactgtgc

SEQ ID NO: 3594131 - DNA, 18 bp, Homo sapiens
ctgctcgtggactgtgct

SEQ ID NO: 3594132 - DNA, 12 bp, Homo sapiens
ctgctctaacag

SEQ ID NO: 3594133 - DNA, 19 bp, Homo sapiens
ctgctctccgcgcctaccc

SEQ ID NO: 3594134 - DNA, 22 bp, Homo sapiens
ctgctctgccccagcttgggca

SEQ ID NO: 3594135 - DNA, 22 bp, Homo sapiens
ctgctctggaataaagttgcag

SEQ ID NO: 3594136 - DNA, 14 bp, Homo sapiens
ctgctcttttcctg

SEQ ID NO: 3594137 - DNA, 22 bp, Homo sapiens
ctgctgaaagactcgagaacca

SEQ ID NO: 3594138 - DNA, 18 bp, Homo sapiens
ctgctgaaggaataaatt

SEQ ID NO: 3594139 - DNA, 16 bp, Homo sapiens
ctgctgaaggctcatt

SEQ ID NO: 3594140 - DNA, 23 bp, Homo sapiens
ctgctgaatgcctcgctcccttc

SEQ ID NO: 3594141 - DNA, 13 bp, Homo sapiens
ctgctgagctggc

SEQ ID NO: 3594142 - DNA, 21 bp, Homo sapiens
ctgctgagttggcctggccat

SEQ ID NO: 3594143 - DNA, 19 bp, Homo sapiens
ctgctgatactgggtctgc

SEQ ID NO: 3594144 - DNA, 21 bp, Homo sapiens
ctgctgatatcaacagcttcc

SEQ ID NO: 3594145 - DNA, 23 bp, Homo sapiens
ctgctgatatcaacagcttccct

SEQ ID NO: 3594146 - DNA, 13 bp, Homo sapiens
ctgctgcaccctg

SEQ ID NO: 3594147 - DNA, 12 bp, Homo sapiens
ctgctgcagggt

SEQ ID NO: 3594148 - DNA, 20 bp, Homo sapiens
ctgctgcagttaccacagca

SEQ ID NO: 3594149 - DNA, 20 bp, Homo sapiens
ctgctgccagcacagtaggt

SEQ ID NO: 3594150 - DNA, 14 bp, Homo sapiens
ctgctgccagtgca

SEQ ID NO: 3594151 - DNA, 12 bp, Homo sapiens
ctgctgcccagc

SEQ ID NO: 3594152 - DNA, 21 bp, Homo sapiens
ctgctgccggctctgggcctg

SEQ ID NO: 3594153 - DNA, 17 bp, Homo sapiens
ctgctgcgctgcttggt

SEQ ID NO: 3594154 - DNA, 15 bp, Homo sapiens
ctgctgctcctctct

SEQ ID NO: 3594155 - DNA, 20 bp, Homo sapiens
ctgctggagtccagtgcttt

SEQ ID NO: 3594156 - DNA, 12 bp, Homo sapiens
ctgctggctgcc

SEQ ID NO: 3594157 - DNA, 14 bp, Homo sapiens
ctgctggctgcctt

SEQ ID NO: 3594158 - DNA, 15 bp, Homo sapiens
ctgctggctgcctta

SEQ ID NO: 3594159 - DNA, 11 bp, Homo sapiens
ctgctgggctt

SEQ ID NO: 3594160 - DNA, 19 bp, Homo sapiens
ctgctggggaagacagtgg

SEQ ID NO: 3594161 - DNA, 19 bp, Homo sapiens
ctgctggggccgccacggc

SEQ ID NO: 3594162 - DNA, 15 bp, Homo sapiens
ctgctggtacctgcc

SEQ ID NO: 3594163 - DNA, 14 bp, Homo sapiens
ctgctgtatgtgag

SEQ ID NO: 3594164 - DNA, 16 bp, Homo sapiens
ctgctgtatgtgagct

SEQ ID NO: 3594165 - DNA, 20 bp, Homo sapiens
ctgctgtctaacctgtgacc

SEQ ID NO: 3594166 - DNA, 14 bp, Homo sapiens
ctgctgtgctgctc

SEQ ID NO: 3594167 - DNA, 15 bp, Homo sapiens
ctgctgtgctgctca

SEQ ID NO: 3594168 - DNA, 12 bp, Homo sapiens
ctgctgtgtcct

SEQ ID NO: 3594169 - DNA, 20 bp, Homo sapiens
ctgctgttatatttcatcat

SEQ ID NO: 3594170 - DNA, 16 bp, Homo sapiens
ctgcttaaactggaaa

SEQ ID NO: 3594171 - DNA, 19 bp, Homo sapiens
ctgcttcatccaatgtgaa

SEQ ID NO: 3594172 - DNA, 11 bp, Homo sapiens
ctgcttcccac

SEQ ID NO: 3594173 - DNA, 16 bp, Homo sapiens
ctgcttcctttcttga

SEQ ID NO: 3594174 - DNA, 17 bp, Homo sapiens
ctgcttcctttcttgat

SEQ ID NO: 3594175 - DNA, 17 bp, Homo sapiens
ctgcttgactttccaga

SEQ ID NO: 3594176 - DNA, 16 bp, Homo sapiens
ctgcttgcccgctccc

SEQ ID NO: 3594177 - DNA, 17 bp, Homo sapiens
ctgcttgcccgctccca

SEQ ID NO: 3594178 - DNA, 20 bp, Homo sapiens
ctgcttgcttgctttttaat

SEQ ID NO: 3594179 - DNA, 17 bp, Homo sapiens
ctgcttggcccttcaag

SEQ ID NO: 3594180 - DNA, 15 bp, Homo sapiens
ctgctttgcatcttt

SEQ ID NO: 3594181 - DNA, 19 bp, Homo sapiens
ctgctttgcatctttgtta

SEQ ID NO: 3594182 - DNA, 18 bp, Homo sapiens
ctgctttggatagtctcc

SEQ ID NO: 3594183 - DNA, 21 bp, Homo sapiens
ctgctttggatagtctcctac

SEQ ID NO: 3594184 - DNA, 18 bp, Homo sapiens
ctgctttgggctgccctg

SEQ ID NO: 3594185 - DNA, 19 bp, Homo sapiens
ctgctttgggctgccctgg

SEQ ID NO: 3594186 - DNA, 23 bp, Homo sapiens
ctgctttgggctgccctggtgct

SEQ ID NO: 3594187 - DNA, 15 bp, Homo sapiens
ctgcttttcaatgtg

SEQ ID NO: 3594188 - DNA, 19 bp, Homo sapiens
ctgcttttctgtcctgggc

SEQ ID NO: 3594189 - DNA, 20 bp, Homo sapiens
ctgcttttctgtcctgggca

SEQ ID NO: 3594190 - DNA, 23 bp, Homo sapiens
ctggaaacagcatgaataaaaca

SEQ ID NO: 3594191 - DNA, 20 bp, Homo sapiens
ctggaaagcagagcctcctg

SEQ ID NO: 3594192 - DNA, 23 bp, Homo sapiens
ctggaaagcagagcctcctggga

SEQ ID NO: 3594193 - DNA, 22 bp, Homo sapiens
ctggaaaggatctgtgattggc

SEQ ID NO: 3594194 - DNA, 20 bp, Homo sapiens
ctggaaattgaaataaagat

SEQ ID NO: 3594195 - DNA, 20 bp, Homo sapiens
ctggaaccacattgaagaat

SEQ ID NO: 3594196 - DNA, 16 bp, Homo sapiens
ctggaacccagactca

SEQ ID NO: 3594197 - DNA, 18 bp, Homo sapiens
ctggaacccagactcaga

SEQ ID NO: 3594198 - DNA, 12 bp, Homo sapiens
ctggaacctcag

SEQ ID NO: 3594199 - DNA, 19 bp, Homo sapiens
ctggaagacgtggctctgg

SEQ ID NO: 3594200 - DNA, 17 bp, Homo sapiens
ctggaagagctgagacc

SEQ ID NO: 3594201 - DNA, 14 bp, Homo sapiens
ctggaagggacagt

SEQ ID NO: 3594202 - DNA, 13 bp, Homo sapiens
ctggaaggggcca

SEQ ID NO: 3594203 - DNA, 17 bp, Homo sapiens
ctggaagtacttggccc

SEQ ID NO: 3594204 - DNA, 15 bp, Homo sapiens
ctggaatacatgaaa

SEQ ID NO: 3594205 - DNA, 16 bp, Homo sapiens
ctggaatccagaagga

SEQ ID NO: 3594206 - DNA, 20 bp, Homo sapiens
ctggaatccagaaggaagct

SEQ ID NO: 3594207 - DNA, 16 bp, Homo sapiens
ctggacacagctcttc

SEQ ID NO: 3594208 - DNA, 13 bp, Homo sapiens
ctggacagacaga

SEQ ID NO: 3594209 - DNA, 18 bp, Homo sapiens
ctggacataacattttca

SEQ ID NO: 3594210 - DNA, 16 bp, Homo sapiens
ctggacatactgctgg

SEQ ID NO: 3594211 - DNA, 17 bp, Homo sapiens
ctggacatactgctgga

SEQ ID NO: 3594212 - DNA, 15 bp, Homo sapiens
ctggaccactgggca

SEQ ID NO: 3594213 - DNA, 22 bp, Homo sapiens
ctggacccttgattcattctga

SEQ ID NO: 3594214 - DNA, 23 bp, Homo sapiens
ctggacccttgattcattctgaa

SEQ ID NO: 3594215 - DNA, 20 bp, Homo sapiens
ctggactagagggacctctc

SEQ ID NO: 3594216 - DNA, 16 bp, Homo sapiens
ctgtaaagatgaatgt

SEQ ID NO: 3594217 - DNA, 14 bp, Homo sapiens
ctgtaaatcctaga

SEQ ID NO: 3594218 - DNA, 21 bp, Homo sapiens
ctgtaaatcctagacttgaaa

SEQ ID NO: 3594219 - DNA, 14 bp, Homo sapiens
ctgtaacaatgtaa

SEQ ID NO: 3594220 - DNA, 15 bp, Homo sapiens
ctgtaacaatgtaat

SEQ ID NO: 3594221 - DNA, 17 bp, Homo sapiens
ctgtaacaggtattttg

SEQ ID NO: 3594222 - DNA, 15 bp, Homo sapiens
ctgtaacatcgcaca

SEQ ID NO: 3594223 - DNA, 13 bp, Homo sapiens
ctgtaagggcagt

SEQ ID NO: 3594224 - DNA, 16 bp, Homo sapiens
ctgtaagggcagtgcc

SEQ ID NO: 3594225 - DNA, 20 bp, Homo sapiens
ctgtaataaagatgattgtg

SEQ ID NO: 3594226 - DNA, 16 bp, Homo sapiens
ctgtaatgacaaaaga

SEQ ID NO: 3594227 - DNA, 16 bp, Homo sapiens
ctgtaatgctgcctca

SEQ ID NO: 3594228 - DNA, 22 bp, Homo sapiens
ctgtaatgctgcctcaggaccc

SEQ ID NO: 3594229 - DNA, 13 bp, Homo sapiens
ctgtaattgtaat

SEQ ID NO: 3594230 - DNA, 12 bp, Homo sapiens
ctgtacatagtc

SEQ ID NO: 3594231 - DNA, 15 bp, Homo sapiens
ctgtacatatgtaaa

SEQ ID NO: 3594232 - DNA, 13 bp, Homo sapiens
ctgtaccaaatct

SEQ ID NO: 3594233 - DNA, 14 bp, Homo sapiens
ctgtaccaaatctg

SEQ ID NO: 3594234 - DNA, 18 bp, Homo sapiens
ctgtaccagttaattttt

SEQ ID NO: 3594235 - DNA, 14 bp, Homo sapiens
ctgtacctcagtgg

SEQ ID NO: 3594236 - DNA, 21 bp, Homo sapiens
ctgtactaacccagtctttct

SEQ ID NO: 3594237 - DNA, 21 bp, Homo sapiens
ctgtactcctcccaggcgccc

SEQ ID NO: 3594238 - DNA, 15 bp, Homo sapiens
ctgtagctctaaaat

SEQ ID NO: 3594239 - DNA, 15 bp, Homo sapiens
ctgtaggtgttatgt

SEQ ID NO: 3594240 - DNA, 24 bp, Homo sapiens
ctgtagtttccgctttgcttgctt

SEQ ID NO: 3594241 - DNA, 15 bp, Homo sapiens
ctgtataaagcatgt

SEQ ID NO: 3594242 - DNA, 15 bp, Homo sapiens
ctgtatataaaataa

SEQ ID NO: 3594243 - DNA, 19 bp, Homo sapiens
ctgtatccactttcagaat

SEQ ID NO: 3594244 - DNA, 14 bp, Homo sapiens
ctgtatccattcta

SEQ ID NO: 3594245 - DNA, 17 bp, Homo sapiens
ctgtatggaaacactga

SEQ ID NO: 3594246 - DNA, 14 bp, Homo sapiens
ctgtatgtcatgga

SEQ ID NO: 3594247 - DNA, 16 bp, Homo sapiens
ctgtatgtgagctgta

SEQ ID NO: 3594248 - DNA, 19 bp, Homo sapiens
ctgtatgtgagctgtaaaa

SEQ ID NO: 3594249 - DNA, 17 bp, Homo sapiens
ctgtattttctttcact

SEQ ID NO: 3594250 - DNA, 14 bp, Homo sapiens
ctgtcaaaactact

SEQ ID NO: 3594251 - DNA, 15 bp, Homo sapiens
ctgtcacttgtcggg

SEQ ID NO: 3594252 - DNA, 21 bp, Homo sapiens
ctgtcacttgtcgggggccca

SEQ ID NO: 3594253 - DNA, 17 bp, Homo sapiens
ctgtcagtgttaaagat

SEQ ID NO: 3594254 - DNA, 18 bp, Homo sapiens
ctgtcagtgttaaagatt

SEQ ID NO: 3594255 - DNA, 12 bp, Homo sapiens
ctgtccagctcc

SEQ ID NO: 3594256 - DNA, 13 bp, Homo sapiens
ctgtccagctcca

SEQ ID NO: 3594257 - DNA, 20 bp, Homo sapiens
ctgtccaggcactgctgccc

SEQ ID NO: 3594258 - DNA, 22 bp, Homo sapiens
ctgtccaggcactgctgcccag

SEQ ID NO: 3594259 - DNA, 21 bp, Homo sapiens
ctgtccatttttattcagggg

SEQ ID NO: 3594260 - DNA, 14 bp, Homo sapiens
ctgtcccacccaca

SEQ ID NO: 3594261 - DNA, 19 bp, Homo sapiens
ctgtcccacccacacagct

SEQ ID NO: 3594262 - DNA, 20 bp, Homo sapiens
ctgtcccacccacacagctg

SEQ ID NO: 3594263 - DNA, 20 bp, Homo sapiens
ctgtcccactacatctggga

SEQ ID NO: 3594264 - DNA, 14 bp, Homo sapiens
ctgtcccttgcctc

SEQ ID NO: 3594265 - DNA, 16 bp, Homo sapiens
ctgtcccttttccctt

SEQ ID NO: 3594266 - DNA, 18 bp, Homo sapiens
ctgtcctcagccttgcca

SEQ ID NO: 3594267 - DNA, 21 bp, Homo sapiens
ctgtcctcagccttgccagag

SEQ ID NO: 3594268 - DNA, 20 bp, Homo sapiens
ctgtcctgcagtcccacact

SEQ ID NO: 3594269 - DNA, 22 bp, Homo sapiens
ctgtcctgggcatgggtccagg

SEQ ID NO: 3594270 - DNA, 23 bp, Homo sapiens
ctgtcctgggcatgggtccaggg

SEQ ID NO: 3594271 - DNA, 18 bp, Homo sapiens
ctgtcctgggcctgcaga

SEQ ID NO: 3594272 - DNA, 14 bp, Homo sapiens
ctgtcctgggctgg

SEQ ID NO: 3594273 - DNA, 12 bp, Homo sapiens
ctgtcctgtcct

SEQ ID NO: 3594274 - DNA, 12 bp, Homo sapiens
ctgtcctgtctt

SEQ ID NO: 3594275 - DNA, 21 bp, Homo sapiens
ctgtccttaacccacctctcc

SEQ ID NO: 3594276 - DNA, 23 bp, Homo sapiens
ctgtcgttgttgtggaagcatgt

SEQ ID NO: 3594277 - DNA, 16 bp, Homo sapiens
ctgtctaacctgtgac

SEQ ID NO: 3594278 - DNA, 16 bp, Homo sapiens
ctgtctagagagggag

SEQ ID NO: 3594279 - DNA, 17 bp, Homo sapiens
ctgtctagagagggagg

SEQ ID NO: 3594280 - DNA, 12 bp, Homo sapiens
ctgtctccagct

SEQ ID NO: 3594281 - DNA, 14 bp, Homo sapiens
ctgtctccagctgc

SEQ ID NO: 3594282 - DNA, 17 bp, Homo sapiens
ctgtctccagggccccc

SEQ ID NO: 3594283 - DNA, 16 bp, Homo sapiens
ctgtctgaagccaatg

SEQ ID NO: 3594284 - DNA, 19 bp, Homo sapiens
ctgtctgagacaggtgcct

SEQ ID NO: 3594285 - DNA, 15 bp, Homo sapiens
ctgtctgctcagaca

SEQ ID NO: 3594286 - DNA, 15 bp, Homo sapiens
ctgtctgctgccagc

SEQ ID NO: 3594287 - DNA, 23 bp, Homo sapiens
ctgtctggaagacgtggctctgg

SEQ ID NO: 3594288 - DNA, 15 bp, Homo sapiens
ctgtctggccctggg

SEQ ID NO: 3594289 - DNA, 12 bp, Homo sapiens
ctgtctgggctc

SEQ ID NO: 3594290 - DNA, 13 bp, Homo sapiens
ctgtctgggctca

SEQ ID NO: 3594291 - DNA, 13 bp, Homo sapiens
ctgtctgtctcta

SEQ ID NO: 3594292 - DNA, 19 bp, Homo sapiens
ctgtctgttgtattcattg

SEQ ID NO: 3594293 - DNA, 18 bp, Homo sapiens
ctgtcttcacaacagatt

SEQ ID NO: 3594294 - DNA, 20 bp, Homo sapiens
ctgtcttctttctccatgga

SEQ ID NO: 3594295 - DNA, 13 bp, Homo sapiens
ctgtcttgaatta

SEQ ID NO: 3594296 - DNA, 14 bp, Homo sapiens
ctgtcttggggcca

SEQ ID NO: 3594297 - DNA, 15 bp, Homo sapiens
ctgtctttcttgctc

SEQ ID NO: 3594298 - DNA, 17 bp, Homo sapiens
ctgtctttcttgctccc

SEQ ID NO: 3594299 - DNA, 20 bp, Homo sapiens
ctgtctttcttgctccctga

SEQ ID NO: 3594300 - DNA, 21 bp, Homo sapiens
ctgtcttttctttgccatctc

SEQ ID NO: 3594301 - DNA, 15 bp, Homo sapiens
ctgtgaaagaagaga

SEQ ID NO: 3594302 - DNA, 20 bp, Homo sapiens
ctgtgaacaagcttcagtaa

SEQ ID NO: 3594303 - DNA, 19 bp, Homo sapiens
ctgtgaacttgactgggtg

SEQ ID NO: 3594304 - DNA, 13 bp, Homo sapiens
ctgtgaagccacc

SEQ ID NO: 3594305 - DNA, 14 bp, Homo sapiens
ctgtgaagcctctc

SEQ ID NO: 3594306 - DNA, 14 bp, Homo sapiens
ctgtgaaggaccct

SEQ ID NO: 3594307 - DNA, 21 bp, Homo sapiens
ctgtgaattcattctggaggg

SEQ ID NO: 3594308 - DNA, 22 bp, Homo sapiens
ctgtgacagactttggacagtg

SEQ ID NO: 3594309 - DNA, 22 bp, Homo sapiens
ctgtgactcctgttgccatgga

SEQ ID NO: 3594310 - DNA, 23 bp, Homo sapiens
ctgtgactcttagccctcaccac

SEQ ID NO: 3594311 - DNA, 17 bp, Homo sapiens
ctgtgacttcagctctg

SEQ ID NO: 3594312 - DNA, 22 bp, Homo sapiens
ctgtgacttcagctctgtttta

SEQ ID NO: 3594313 - DNA, 18 bp, Homo sapiens
ctgtgagcacaaagaaga

SEQ ID NO: 3594314 - DNA, 20 bp, Homo sapiens
ctgtgagcacaaagaagaaa

SEQ ID NO: 3594315 - DNA, 20 bp, Homo sapiens
ctgtgatatgtctgctgagt

SEQ ID NO: 3594316 - DNA, 21 bp, Homo sapiens
ctgtgatcactccagtgcact

SEQ ID NO: 3594317 - DNA, 13 bp, Homo sapiens
ctgtgattggctg

SEQ ID NO: 3594318 - DNA, 14 bp, Homo sapiens
ctgtgattggctgg

SEQ ID NO: 3594319 - DNA, 16 bp, Homo sapiens
ctgtgcaaacagtaac

SEQ ID NO: 3594320 - DNA, 15 bp, Homo sapiens
ctgtgcagacccagt

SEQ ID NO: 3594321 - DNA, 12 bp, Homo sapiens
ctgtgccaacct

SEQ ID NO: 3594322 - DNA, 13 bp, Homo sapiens
ctgtgccacaggc

SEQ ID NO: 3594323 - DNA, 16 bp, Homo sapiens
ctgtgccagaggccag

SEQ ID NO: 3594324 - DNA, 11 bp, Homo sapiens
ctgtgccagca

SEQ ID NO: 3594325 - DNA, 16 bp, Homo sapiens
ctgtgccagcaccaca

SEQ ID NO: 3594326 - DNA, 20 bp, Homo sapiens
ctgtgccagcaccacagccg

SEQ ID NO: 3594327 - DNA, 14 bp, Homo sapiens
ctgtgccatgctgg

SEQ ID NO: 3594328 - DNA, 20 bp, Homo sapiens
ctgtgccatgctgggccact

SEQ ID NO: 3594329 - DNA, 22 bp, Homo sapiens
ctgtgcccctggccttgggatc

SEQ ID NO: 3594330 - DNA, 22 bp, Homo sapiens
ctgtgccgaccacgccccagga

SEQ ID NO: 3594331 - DNA, 12 bp, Homo sapiens
ctgtgcctctgc

SEQ ID NO: 3594332 - DNA, 17 bp, Homo sapiens
ctgtgcctctgcctgtc

SEQ ID NO: 3594333 - DNA, 13 bp, Homo sapiens
ctgtgcctttcct

SEQ ID NO: 3594334 - DNA, 18 bp, Homo sapiens
ctgtgcctttcctatcac

SEQ ID NO: 3594335 - DNA, 16 bp, Homo sapiens
ctgtgccttttgccat

SEQ ID NO: 3594336 - DNA, 13 bp, Homo sapiens
ctgtgctccacac

SEQ ID NO: 3594337 - DNA, 13 bp, Homo sapiens
ctgtgctggggca

SEQ ID NO: 3594338 - DNA, 13 bp, Homo sapiens
ctgtgcttctaat

SEQ ID NO: 3594339 - DNA, 11 bp, Homo sapiens
ctgtgctttgg

SEQ ID NO: 3594340 - DNA, 18 bp, Homo sapiens
ctgtggaacataaaaagg

SEQ ID NO: 3594341 - DNA, 21 bp, Homo sapiens
ctgtggaacataaaaaggaca

SEQ ID NO: 3594342 - DNA, 19 bp, Homo sapiens
ctgtggagggagggcagct

SEQ ID NO: 3594343 - DNA, 20 bp, Homo sapiens
ctgtggagggagggcagctg

SEQ ID NO: 3594344 - DNA, 15 bp, Homo sapiens
ctgtggagtgaggtg

SEQ ID NO: 3594345 - DNA, 20 bp, Homo sapiens
ctgtggcaaaaagagtcaga

SEQ ID NO: 3594346 - DNA, 17 bp, Homo sapiens
ctgtggcagagttacag

SEQ ID NO: 3594347 - DNA, 23 bp, Homo sapiens
ctgtggcagagttacagttctgt

SEQ ID NO: 3594348 - DNA, 22 bp, Homo sapiens
ctgtggccccatccaaccactg

SEQ ID NO: 3594349 - DNA, 20 bp, Homo sapiens
cttgcctatgatactgtctc

SEQ ID NO: 3594350 - DNA, 21 bp, Homo sapiens
cttgcctatgatactgtctct

SEQ ID NO: 3594351 - DNA, 17 bp, Homo sapiens
cttgcctctgccctgga

SEQ ID NO: 3594352 - DNA, 23 bp, Homo sapiens
cttgccttcctcagctgcctcct

SEQ ID NO: 3594353 - DNA, 19 bp, Homo sapiens
cttgctatattgcccaggc

SEQ ID NO: 3594354 - DNA, 14 bp, Homo sapiens
cttgctctcctcat

SEQ ID NO: 3594355 - DNA, 15 bp, Homo sapiens
cttgctctcctcatc

SEQ ID NO: 3594356 - DNA, 20 bp, Homo sapiens
cttgctgcaagcacagccct

SEQ ID NO: 3594357 - DNA, 21 bp, Homo sapiens
cttgctgcaagcacagccctt

SEQ ID NO: 3594358 - DNA, 10 bp, Homo sapiens
cttgctgcct

SEQ ID NO: 3594359 - DNA, 13 bp, Homo sapiens
cttgctgcttcta

SEQ ID NO: 3594360 - DNA, 11 bp, Homo sapiens
cttgctgggta

SEQ ID NO: 3594361 - DNA, 18 bp, Homo sapiens
cttgcttctttctagaaa

SEQ ID NO: 3594362 - DNA, 13 bp, Homo sapiens
cttgcttgctttt

SEQ ID NO: 3594363 - DNA, 15 bp, Homo sapiens
cttgcttggaagcca

SEQ ID NO: 3594364 - DNA, 16 bp, Homo sapiens
cttgcttggaagccag

SEQ ID NO: 3594365 - DNA, 19 bp, Homo sapiens
cttgcttggaagccaggta

SEQ ID NO: 3594366 - DNA, 15 bp, Homo sapiens
cttgctttcctgcat

SEQ ID NO: 3594367 - DNA, 18 bp, Homo sapiens
cttgctttcctgggcctt

SEQ ID NO: 3594368 - DNA, 11 bp, Homo sapiens
cttgctttcta

SEQ ID NO: 3594369 - DNA, 23 bp, Homo sapiens
cttgctttcttttttaaaatcaa

SEQ ID NO: 3594370 - DNA, 17 bp, Homo sapiens
cttggaacaccctggat

SEQ ID NO: 3594371 - DNA, 16 bp, Homo sapiens
cttggaacaccttggg

SEQ ID NO: 3594372 - DNA, 14 bp, Homo sapiens
cttggacattttat

SEQ ID NO: 3594373 - DNA, 17 bp, Homo sapiens
cttggacattttatgtc

SEQ ID NO: 3594374 - DNA, 16 bp, Homo sapiens
cttggactcattttaa

SEQ ID NO: 3594375 - DNA, 14 bp, Homo sapiens
cttggaggagagag

SEQ ID NO: 3594376 - DNA, 16 bp, Homo sapiens
cttggcaccagacacc

SEQ ID NO: 3594377 - DNA, 21 bp, Homo sapiens
cttggcaccagacacccagga

SEQ ID NO: 3594378 - DNA, 14 bp, Homo sapiens
cttggcacccccat

SEQ ID NO: 3594379 - DNA, 20 bp, Homo sapiens
cttggcacccccatgctgcc

SEQ ID NO: 3594380 - DNA, 21 bp, Homo sapiens
cttggcacccccatgctgcct

SEQ ID NO: 3594381 - DNA, 22 bp, Homo sapiens
cttggcacccccatgctgcctt

SEQ ID NO: 3594382 - DNA, 23 bp, Homo sapiens
cttggcaggagtgggctctgagc

SEQ ID NO: 3594383 - DNA, 21 bp, Homo sapiens
cttggccatgatgtccttgga

SEQ ID NO: 3594384 - DNA, 18 bp, Homo sapiens
cttggcccccttcaggag

SEQ ID NO: 3594385 - DNA, 19 bp, Homo sapiens
cttggcccccttcaggagc

SEQ ID NO: 3594386 - DNA, 20 bp, Homo sapiens
cttggcccccttcaggagcc

SEQ ID NO: 3594387 - DNA, 21 bp, Homo sapiens
cttggcccccttcaggagcct

SEQ ID NO: 3594388 - DNA, 23 bp, Homo sapiens
cttggcccccttcaggagcctgg

SEQ ID NO: 3594389 - DNA, 18 bp, Homo sapiens
cttggccctcctcagctc

SEQ ID NO: 3594390 - DNA, 20 bp, Homo sapiens
cttggccctcctcagctccc

SEQ ID NO: 3594391 - DNA, 22 bp, Homo sapiens
cttggccctcctcagctccctg

SEQ ID NO: 3594392 - DNA, 23 bp, Homo sapiens
cttggctcacaaggcccaggaga

SEQ ID NO: 3594393 - DNA, 24 bp, Homo sapiens
cttggctcactgcaacttctgcct

SEQ ID NO: 3594394 - DNA, 15 bp, Homo sapiens
cttggctgacccctc

SEQ ID NO: 3594395 - DNA, 21 bp, Homo sapiens
cttggctttatgcaaatacaa

SEQ ID NO: 3594396 - DNA, 20 bp, Homo sapiens
cttggctttcagagccagcc

SEQ ID NO: 3594397 - DNA, 18 bp, Homo sapiens
cttgggaatggatcctgg

SEQ ID NO: 3594398 - DNA, 18 bp, Homo sapiens
cttgggaccccagagaaa

SEQ ID NO: 3594399 - DNA, 18 bp, Homo sapiens
cttgggatagcaaactcc

SEQ ID NO: 3594400 - DNA, 22 bp, Homo sapiens
cttgggatagcaaactccaggt

SEQ ID NO: 3594401 - DNA, 19 bp, Homo sapiens
cttgggatagtgttctgct

SEQ ID NO: 3594402 - DNA, 14 bp, Homo sapiens
cttgggcagatctc

SEQ ID NO: 3594403 - DNA, 19 bp, Homo sapiens
cttgggcagatctcccaca

SEQ ID NO: 3594404 - DNA, 20 bp, Homo sapiens
cttgggcttcaacagccaag

SEQ ID NO: 3594405 - DNA, 22 bp, Homo sapiens
cttgggcttcaacagccaagct

SEQ ID NO: 3594406 - DNA, 17 bp, Homo sapiens
cttgggtcacatgactc

SEQ ID NO: 3594407 - DNA, 18 bp, Homo sapiens
cttgggtcacatgactct

SEQ ID NO: 3594408 - DNA, 20 bp, Homo sapiens
cttgggtcacatgactctca

SEQ ID NO: 3594409 - DNA, 13 bp, Homo sapiens
cttggtggggagc

SEQ ID NO: 3594410 - DNA, 17 bp, Homo sapiens
cttgtaactaaaataat

SEQ ID NO: 3594411 - DNA, 13 bp, Homo sapiens
cttgtacaaaata

SEQ ID NO: 3594412 - DNA, 14 bp, Homo sapiens
cttgtactgggaca

SEQ ID NO: 3594413 - DNA, 23 bp, Homo sapiens
cttgtatattttaagaaataaca

SEQ ID NO: 3594414 - DNA, 15 bp, Homo sapiens
cttgtcactggtaga

SEQ ID NO: 3594415 - DNA, 18 bp, Homo sapiens
cttgtcattttttttctt

SEQ ID NO: 3594416 - DNA, 23 bp, Homo sapiens
cttgtcccccgtgatctcccctc

SEQ ID NO: 3594417 - DNA, 13 bp, Homo sapiens
cttgtcctcttct

SEQ ID NO: 3594418 - DNA, 17 bp, Homo sapiens
cttgtcctgggcctgcc

SEQ ID NO: 3594419 - DNA, 18 bp, Homo sapiens
cttgtctcacgcagccag

SEQ ID NO: 3594420 - DNA, 15 bp, Homo sapiens
cttgtgattggctgc

SEQ ID NO: 3594421 - DNA, 17 bp, Homo sapiens
cttgtgattggctgcag

SEQ ID NO: 3594422 - DNA, 19 bp, Homo sapiens
cttgtgattggctgcagga

SEQ ID NO: 3594423 - DNA, 15 bp, Homo sapiens
cttgtgatttccatt

SEQ ID NO: 3594424 - DNA, 21 bp, Homo sapiens
cttgtgatttccatttctgat

SEQ ID NO: 3594425 - DNA, 22 bp, Homo sapiens
cttgtggcagcctgattcgggg

SEQ ID NO: 3594426 - DNA, 23 bp, Homo sapiens
cttgtggcagcctgattcggggc

SEQ ID NO: 3594427 - DNA, 16 bp, Homo sapiens
cttgtggcctatgaaa

SEQ ID NO: 3594428 - DNA, 18 bp, Homo sapiens
cttgtgtctctgtgcttt

SEQ ID NO: 3594429 - DNA, 15 bp, Homo sapiens
cttgtgttcagaaga

SEQ ID NO: 3594430 - DNA, 17 bp, Homo sapiens
cttgtgttcagaagaat

SEQ ID NO: 3594431 - DNA, 14 bp, Homo sapiens
cttgtgttctgctc

SEQ ID NO: 3594432 - DNA, 16 bp, Homo sapiens
cttgttaagatagtta

SEQ ID NO: 3594433 - DNA, 21 bp, Homo sapiens
cttgttgtttgtaacaagaaa

SEQ ID NO: 3594434 - DNA, 14 bp, Homo sapiens
cttgtttaatgtta

SEQ ID NO: 3594435 - DNA, 21 bp, Homo sapiens
cttgttttttttttccactta

SEQ ID NO: 3594436 - DNA, 14 bp, Homo sapiens
ctttaaaaaaataa

SEQ ID NO: 3594437 - DNA, 17 bp, Homo sapiens
ctttaaaacaaagggaa

SEQ ID NO: 3594438 - DNA, 23 bp, Homo sapiens
ctttaaattatatgatatgcatg

SEQ ID NO: 3594439 - DNA, 18 bp, Homo sapiens
ctttaacttctgttttac

SEQ ID NO: 3594440 - DNA, 22 bp, Homo sapiens
ctttaacttttttttctctctt

SEQ ID NO: 3594441 - DNA, 20 bp, Homo sapiens
ctttaagaaccttaatgaca

SEQ ID NO: 3594442 - DNA, 23 bp, Homo sapiens
ctttaagaaccttaatgacaaca

SEQ ID NO: 3594443 - DNA, 21 bp, Homo sapiens
ctttaagaactaaaatgttct

SEQ ID NO: 3594444 - DNA, 22 bp, Homo sapiens
ctttaagaactaaaatgttcta

SEQ ID NO: 3594445 - DNA, 19 bp, Homo sapiens
ctttaagccaaagaaacaa

SEQ ID NO: 3594446 - DNA, 20 bp, Homo sapiens
ctttaaggatttgaaccatg

SEQ ID NO: 3594447 - DNA, 18 bp, Homo sapiens
ctttaagtgtgctgggca

SEQ ID NO: 3594448 - DNA, 17 bp, Homo sapiens
ctttaatatgaaatttt

SEQ ID NO: 3594449 - DNA, 20 bp, Homo sapiens
ctttaatgagtgcacctgcc

SEQ ID NO: 3594450 - DNA, 22 bp, Homo sapiens
ctttaatgagtgcacctgcctc

SEQ ID NO: 3594451 - DNA, 21 bp, Homo sapiens
ctttaatgatatgcttgtaac

SEQ ID NO: 3594452 - DNA, 14 bp, Homo sapiens
ctttactcctggct

SEQ ID NO: 3594453 - DNA, 15 bp, Homo sapiens
ctttactcctggctc

SEQ ID NO: 3594454 - DNA, 15 bp, Homo sapiens
ctttactcgtgcatt

SEQ ID NO: 3594455 - DNA, 18 bp, Homo sapiens
ctttagcttacctgggca

SEQ ID NO: 3594456 - DNA, 20 bp, Homo sapiens
ctttagcttacctgggcaca

SEQ ID NO: 3594457 - DNA, 15 bp, Homo sapiens
ctttagctttctgag

SEQ ID NO: 3594458 - DNA, 15 bp, Homo sapiens
ctttagtgttctgtt

SEQ ID NO: 3594459 - DNA, 19 bp, Homo sapiens
ctttagttaggtcattttt

SEQ ID NO: 3594460 - DNA, 18 bp, Homo sapiens
ctttataaaccataaaat

SEQ ID NO: 3594461 - DNA, 16 bp, Homo sapiens
ctttatctctgaggct

SEQ ID NO: 3594462 - DNA, 17 bp, Homo sapiens
ctttatctctgaggcta

SEQ ID NO: 3594463 - DNA, 14 bp, Homo sapiens
ctttatgcaaatac

SEQ ID NO: 3594464 - DNA, 21 bp, Homo sapiens
ctttatgcaaatacaatcagc

SEQ ID NO: 3594465 - DNA, 15 bp, Homo sapiens
ctttatgttctttca

SEQ ID NO: 3594466 - DNA, 21 bp, Homo sapiens
ctttattgccaaaacccagct

SEQ ID NO: 3594467 - DNA, 19 bp, Homo sapiens
ctttatttattaaacttca

SEQ ID NO: 3594468 - DNA, 19 bp, Homo sapiens
ctttatttttttcccatga

SEQ ID NO: 3594469 - DNA, 22 bp, Homo sapiens
ctttcacccatcctaggaacca

SEQ ID NO: 3594470 - DNA, 18 bp, Homo sapiens
ctttcagagcccccagcc

SEQ ID NO: 3594471 - DNA, 17 bp, Homo sapiens
ctttcagtgcagtttct

SEQ ID NO: 3594472 - DNA, 22 bp, Homo sapiens
ctttcagtgcagtttcttttca

SEQ ID NO: 3594473 - DNA, 19 bp, Homo sapiens
ctttcatattttaaacaga

SEQ ID NO: 3594474 - DNA, 23 bp, Homo sapiens
ctttcatattttaaacagaggat

SEQ ID NO: 3594475 - DNA, 17 bp, Homo sapiens
ctttcatgtcttgtcat

SEQ ID NO: 3594476 - DNA, 19 bp, Homo sapiens
ctttcattaccctacagac

SEQ ID NO: 3594477 - DNA, 16 bp, Homo sapiens
ctttcccaccattcct

SEQ ID NO: 3594478 - DNA, 22 bp, Homo sapiens
ctttccggccaaggtgccacca

SEQ ID NO: 3594479 - DNA, 13 bp, Homo sapiens
gaagccaggtaca

SEQ ID NO: 3594480 - DNA, 20 bp, Homo sapiens
gaagccaggtacaggagagg

SEQ ID NO: 3594481 - DNA, 24 bp, Homo sapiens
gaagccaggtacaggagaggcagc

SEQ ID NO: 3594482 - DNA, 18 bp, Homo sapiens
gaagccagtgtctaggca

SEQ ID NO: 3594483 - DNA, 21 bp, Homo sapiens
gaagccagtgtctaggcactg

SEQ ID NO: 3594484 - DNA, 21 bp, Homo sapiens
gaagccatgtggggttgctga

SEQ ID NO: 3594485 - DNA, 22 bp, Homo sapiens
gaagccggggtgtaacttcctg

SEQ ID NO: 3594486 - DNA, 17 bp, Homo sapiens
gaagcctactggtagaa

SEQ ID NO: 3594487 - DNA, 16 bp, Homo sapiens
gaagcctccccagctc

SEQ ID NO: 3594488 - DNA, 14 bp, Homo sapiens
gaagctcccacccc

SEQ ID NO: 3594489 - DNA, 18 bp, Homo sapiens
gaagctcccaccccactc

SEQ ID NO: 3594490 - DNA, 20 bp, Homo sapiens
gaagctcccaccccactcag

SEQ ID NO: 3594491 - DNA, 14 bp, Homo sapiens
gaagctgctgcagc

SEQ ID NO: 3594492 - DNA, 12 bp, Homo sapiens
gaagctgctgtg

SEQ ID NO: 3594493 - DNA, 16 bp, Homo sapiens
gaagctgctgtgtcct

SEQ ID NO: 3594494 - DNA, 19 bp, Homo sapiens
gaagctgtgttgaaacaga

SEQ ID NO: 3594495 - DNA, 23 bp, Homo sapiens
gaagctgtgttgaaacagaaaaa

SEQ ID NO: 3594496 - DNA, 22 bp, Homo sapiens
gaagcttccatgatgcacagta

SEQ ID NO: 3594497 - DNA, 21 bp, Homo sapiens
gaagcttgttgaaaacccaga

SEQ ID NO: 3594498 - DNA, 14 bp, Homo sapiens
gaaggaaaatattt

SEQ ID NO: 3594499 - DNA, 21 bp, Homo sapiens
gaaggaaagaagggggccctg

SEQ ID NO: 3594500 - DNA, 15 bp, Homo sapiens
gaaggaagctgtgtt

SEQ ID NO: 3594501 - DNA, 19 bp, Homo sapiens
gaaggaagctgtgttgaaa

SEQ ID NO: 3594502 - DNA, 23 bp, Homo sapiens
gaaggaagctgtgttgaaacaga

SEQ ID NO: 3594503 - DNA, 14 bp, Homo sapiens
gaaggacaggaccc

SEQ ID NO: 3594504 - DNA, 19 bp, Homo sapiens
gaaggacaggaccctcagg

SEQ ID NO: 3594505 - DNA, 20 bp, Homo sapiens
gaaggacaggaccctcagga

SEQ ID NO: 3594506 - DNA, 22 bp, Homo sapiens
gaaggacccggaggggcctggc

SEQ ID NO: 3594507 - DNA, 12 bp, Homo sapiens
gaaggagaatgg

SEQ ID NO: 3594508 - DNA, 13 bp, Homo sapiens
gaaggagaatggc

SEQ ID NO: 3594509 - DNA, 19 bp, Homo sapiens
gaaggagaatggcatggca

SEQ ID NO: 3594510 - DNA, 24 bp, Homo sapiens
gaaggagaatggcatggcaggagt

SEQ ID NO: 3594511 - DNA, 19 bp, Homo sapiens
gaaggaggccaaccagccc

SEQ ID NO: 3594512 - DNA, 21 bp, Homo sapiens
gaaggaggccaaccagcccga

SEQ ID NO: 3594513 - DNA, 18 bp, Homo sapiens
gaaggagttacagggaag

SEQ ID NO: 3594514 - DNA, 19 bp, Homo sapiens
gaaggcagtggcaggggag

SEQ ID NO: 3594515 - DNA, 19 bp, Homo sapiens
gaaggccaaaatcaagagt

SEQ ID NO: 3594516 - DNA, 16 bp, Homo sapiens
gaaggccagagaggga

SEQ ID NO: 3594517 - DNA, 17 bp, Homo sapiens
gaaggccccagagagac

SEQ ID NO: 3594518 - DNA, 22 bp, Homo sapiens
gaaggccccagagagaccctgc

SEQ ID NO: 3594519 - DNA, 23 bp, Homo sapiens
gaaggcctggaagagctgagacc

SEQ ID NO: 3594520 - DNA, 15 bp, Homo sapiens
gaaggccttgttaaa

SEQ ID NO: 3594521 - DNA, 12 bp, Homo sapiens
gaagggagccaa

SEQ ID NO: 3594522 - DNA, 20 bp, Homo sapiens
gaagggagccaagggatgga

SEQ ID NO: 3594523 - DNA, 18 bp, Homo sapiens
gaagggccagagccaggg

SEQ ID NO: 3594524 - DNA, 21 bp, Homo sapiens
gaagggctttggttccttctc

SEQ ID NO: 3594525 - DNA, 16 bp, Homo sapiens
gaaggggaggcacact

SEQ ID NO: 3594526 - DNA, 18 bp, Homo sapiens
gaaggggccccatggcag

SEQ ID NO: 3594527 - DNA, 21 bp, Homo sapiens
gaaggggcgtctgttccccct

SEQ ID NO: 3594528 - DNA, 15 bp, Homo sapiens
gaagggggccctgct

SEQ ID NO: 3594529 - DNA, 14 bp, Homo sapiens
gaagggggccgcca

SEQ ID NO: 3594530 - DNA, 21 bp, Homo sapiens
gaagggtctctctccaggtca

SEQ ID NO: 3594531 - DNA, 18 bp, Homo sapiens
gaaggtgctgacggccag

SEQ ID NO: 3594532 - DNA, 19 bp, Homo sapiens
gaaggtgctgacggccagg

SEQ ID NO: 3594533 - DNA, 21 bp, Homo sapiens
gaaggtgctgacggccaggga

SEQ ID NO: 3594534 - DNA, 18 bp, Homo sapiens
gaagtaaattaggcagtg

SEQ ID NO: 3594535 - DNA, 23 bp, Homo sapiens
gaagtacttggcccccttcagga

SEQ ID NO: 3594536 - DNA, 21 bp, Homo sapiens
gaagtatgtatattaaaaaag

SEQ ID NO: 3594537 - DNA, 22 bp, Homo sapiens
gaagtccttcagtgagcccctc

SEQ ID NO: 3594538 - DNA, 23 bp, Homo sapiens
gaagtccttcagtgagcccctcc

SEQ ID NO: 3594539 - DNA, 19 bp, Homo sapiens
gaagtctgagcccatttct

SEQ ID NO: 3594540 - DNA, 17 bp, Homo sapiens
gaagtgcacaggagcca

SEQ ID NO: 3594541 - DNA, 18 bp, Homo sapiens
gaagtgcacaggagccaa

SEQ ID NO: 3594542 - DNA, 22 bp, Homo sapiens
gaagtgcggggtaggggaagaa

SEQ ID NO: 3594543 - DNA, 20 bp, Homo sapiens
gaagtgctcttggctgaccc

SEQ ID NO: 3594544 - DNA, 22 bp, Homo sapiens
gaagtgctcttggctgacccct

SEQ ID NO: 3594545 - DNA, 20 bp, Homo sapiens
gaagtgctgtttattaatct

SEQ ID NO: 3594546 - DNA, 20 bp, Homo sapiens
gaagttaaaagcacaaagga

SEQ ID NO: 3594547 - DNA, 14 bp, Homo sapiens
gaagttcatcttgc

SEQ ID NO: 3594548 - DNA, 21 bp, Homo sapiens
gaagttgttgctatacatgtt

SEQ ID NO: 3594549 - DNA, 13 bp, Homo sapiens
gaagtttgtagcc

SEQ ID NO: 3594550 - DNA, 15 bp, Homo sapiens
gaagtttttgaaata

SEQ ID NO: 3594551 - DNA, 18 bp, Homo sapiens
gaagtttttgaaatacct

SEQ ID NO: 3594552 - DNA, 16 bp, Homo sapiens
gaataaacatttgtta

SEQ ID NO: 3594553 - DNA, 14 bp, Homo sapiens
gaataaagacacct

SEQ ID NO: 3594554 - DNA, 11 bp, Homo sapiens
gaataaagcaa

SEQ ID NO: 3594555 - DNA, 17 bp, Homo sapiens
gaataaaggcagttttc

SEQ ID NO: 3594556 - DNA, 15 bp, Homo sapiens
gaataaagtattcta

SEQ ID NO: 3594557 - DNA, 14 bp, Homo sapiens
gaataaagttgcag

SEQ ID NO: 3594558 - DNA, 15 bp, Homo sapiens
gaataaagttgcaga

SEQ ID NO: 3594559 - DNA, 12 bp, Homo sapiens
gaataacttgaa

SEQ ID NO: 3594560 - DNA, 13 bp, Homo sapiens
gaatacatttgta

SEQ ID NO: 3594561 - DNA, 12 bp, Homo sapiens
gaatacttattt

SEQ ID NO: 3594562 - DNA, 15 bp, Homo sapiens
gaatacttattttca

SEQ ID NO: 3594563 - DNA, 14 bp, Homo sapiens
gaatacttgaagaa

SEQ ID NO: 3594564 - DNA, 20 bp, Homo sapiens
gaatagatcagtatttcact

SEQ ID NO: 3594565 - DNA, 22 bp, Homo sapiens
gaataggcagggggccctgccc

SEQ ID NO: 3594566 - DNA, 21 bp, Homo sapiens
gaatagtatcctccaggtttt

SEQ ID NO: 3594567 - DNA, 23 bp, Homo sapiens
gaatagtctagatggctcctctc

SEQ ID NO: 3594568 - DNA, 19 bp, Homo sapiens
gaatatgtagtatctatat

SEQ ID NO: 3594569 - DNA, 23 bp, Homo sapiens
gaatatgtagtatctatatgact

SEQ ID NO: 3594570 - DNA, 19 bp, Homo sapiens
gaatattgccattatgctt

SEQ ID NO: 3594571 - DNA, 14 bp, Homo sapiens
gaatatttgtttta

SEQ ID NO: 3594572 - DNA, 18 bp, Homo sapiens
gaatatttgttttaatac

SEQ ID NO: 3594573 - DNA, 12 bp, Homo sapiens
gaatatttttgt

SEQ ID NO: 3594574 - DNA, 16 bp, Homo sapiens
gaatcagctggacata

SEQ ID NO: 3594575 - DNA, 17 bp, Homo sapiens
gaatctagcccaaccta

SEQ ID NO: 3594576 - DNA, 17 bp, Homo sapiens
gaatctatatttaacaa

SEQ ID NO: 3594577 - DNA, 16 bp, Homo sapiens
gaatctgtatatattt

SEQ ID NO: 3594578 - DNA, 13 bp, Homo sapiens
gaatctgtgcaaa

SEQ ID NO: 3594579 - DNA, 18 bp, Homo sapiens
gaatcttcctggcacaat

SEQ ID NO: 3594580 - DNA, 22 bp, Homo sapiens
gaatctttagagaagtatacat

SEQ ID NO: 3594581 - DNA, 23 bp, Homo sapiens
gaatctttagagaagtatacata

SEQ ID NO: 3594582 - DNA, 16 bp, Homo sapiens
gaatgaaaataactga

SEQ ID NO: 3594583 - DNA, 15 bp, Homo sapiens
gaatgaaccttctgg

SEQ ID NO: 3594584 - DNA, 11 bp, Homo sapiens
gaatgagcctc

SEQ ID NO: 3594585 - DNA, 21 bp, Homo sapiens
gaatgcagaaaacagggtctg

SEQ ID NO: 3594586 - DNA, 13 bp, Homo sapiens
gaatgcagcagga

SEQ ID NO: 3594587 - DNA, 19 bp, Homo sapiens
gaatgcctcgctcccttca

SEQ ID NO: 3594588 - DNA, 20 bp, Homo sapiens
gaatgcctcgctcccttcaa

SEQ ID NO: 3594589 - DNA, 15 bp, Homo sapiens
gaatgctgtatatgt

SEQ ID NO: 3594590 - DNA, 16 bp, Homo sapiens
gaatggcagtcctgga

SEQ ID NO: 3594591 - DNA, 17 bp, Homo sapiens
gaatggcagtcctggag

SEQ ID NO: 3594592 - DNA, 21 bp, Homo sapiens
gaatggcagtcctggaggcag

SEQ ID NO: 3594593 - DNA, 18 bp, Homo sapiens
gaatggcatggcaggagt

SEQ ID NO: 3594594 - DNA, 13 bp, Homo sapiens
gaatggccacaaa

SEQ ID NO: 3594595 - DNA, 20 bp, Homo sapiens
gaatggccacaaacctgccc

SEQ ID NO: 3594596 - DNA, 15 bp, Homo sapiens
gaatggccctcattc

SEQ ID NO: 3594597 - DNA, 13 bp, Homo sapiens
gaatggcctggag

SEQ ID NO: 3594598 - DNA, 14 bp, Homo sapiens
gaatggcctggagc

SEQ ID NO: 3594599 - DNA, 16 bp, Homo sapiens
gaatgggacgaggaca

SEQ ID NO: 3594600 - DNA, 15 bp, Homo sapiens
gaatgtcagggccag

SEQ ID NO: 3594601 - DNA, 18 bp, Homo sapiens
gaatgtcagtatgtggaa

SEQ ID NO: 3594602 - DNA, 20 bp, Homo sapiens
gaatgtcagttgttatttat

SEQ ID NO: 3594603 - DNA, 22 bp, Homo sapiens
gaatgtcagttgttatttattg

SEQ ID NO: 3594604 - DNA, 17 bp, Homo sapiens
gaatgtgtgtgtgtggc

SEQ ID NO: 3594605 - DNA, 23 bp, Homo sapiens
gaatgttagagtaatgaaatgga

SEQ ID NO: 3594606 - DNA, 15 bp, Homo sapiens
gaattaggctgtaac

SEQ ID NO: 3594607 - DNA, 22 bp, Homo sapiens
gaattagtatttcagtgttttc

SEQ ID NO: 3594608 - DNA, 12 bp, Homo sapiens
gaattatctcaa

SEQ ID NO: 3594609 - DNA, 21 bp, Homo sapiens
gaattatctcaagtaaaacaa

SEQ ID NO: 3594610 - DNA, 23 bp, Homo sapiens
gagcaaaagaaacaccagtgtta

SEQ ID NO: 3594611 - DNA, 18 bp, Homo sapiens
gagcaaatattaaaattg

SEQ ID NO: 3594612 - DNA, 23 bp, Homo sapiens
gagcaagcaccaacctccagact

SEQ ID NO: 3594613 - DNA, 20 bp, Homo sapiens
gagcaagccggcaagcgagc

SEQ ID NO: 3594614 - DNA, 18 bp, Homo sapiens
gagcacacccgtgtgcac

SEQ ID NO: 3594615 - DNA, 22 bp, Homo sapiens
gagcacacccgtgtgcacactc

SEQ ID NO: 3594616 - DNA, 13 bp, Homo sapiens
gagcacccagagc

SEQ ID NO: 3594617 - DNA, 20 bp, Homo sapiens
gagcaccccctgctccacca

SEQ ID NO: 3594618 - DNA, 15 bp, Homo sapiens
gagcagagaacctgc

SEQ ID NO: 3594619 - DNA, 17 bp, Homo sapiens
gagcagagaacctgctc

SEQ ID NO: 3594620 - DNA, 16 bp, Homo sapiens
gagcagagaattctct

SEQ ID NO: 3594621 - DNA, 21 bp, Homo sapiens
gagcagcagcaccaaccacag

SEQ ID NO: 3594622 - DNA, 11 bp, Homo sapiens
gagcagcaggc

SEQ ID NO: 3594623 - DNA, 12 bp, Homo sapiens
gagcagcaggcc

SEQ ID NO: 3594624 - DNA, 17 bp, Homo sapiens
gagcagcaggcctctgg

SEQ ID NO: 3594625 - DNA, 18 bp, Homo sapiens
gagcagcaggcctctggg

SEQ ID NO: 3594626 - DNA, 20 bp, Homo sapiens
gagcagcaggcctctgggac

SEQ ID NO: 3594627 - DNA, 21 bp, Homo sapiens
gagcagcaggcctctgggacc

SEQ ID NO: 3594628 - DNA, 23 bp, Homo sapiens
gagcagcaggcctctgggaccca

SEQ ID NO: 3594629 - DNA, 23 bp, Homo sapiens
gagcagcccccgggccgctggct

SEQ ID NO: 3594630 - DNA, 23 bp, Homo sapiens
gagcaggcccaatgctgcttttg

SEQ ID NO: 3594631 - DNA, 17 bp, Homo sapiens
gagcagggatctgcccc

SEQ ID NO: 3594632 - DNA, 19 bp, Homo sapiens
gagcagggctaaataaaga

SEQ ID NO: 3594633 - DNA, 12 bp, Homo sapiens
gagcagggtcca

SEQ ID NO: 3594634 - DNA, 15 bp, Homo sapiens
gagcagggtccacag

SEQ ID NO: 3594635 - DNA, 17 bp, Homo sapiens
gagcagggtccacagct

SEQ ID NO: 3594636 - DNA, 20 bp, Homo sapiens
gagcaggttccccaagggcc

SEQ ID NO: 3594637 - DNA, 16 bp, Homo sapiens
gagcagtcgcctgcct

SEQ ID NO: 3594638 - DNA, 21 bp, Homo sapiens
gagcagtcgcctgcctgcagc

SEQ ID NO: 3594639 - DNA, 20 bp, Homo sapiens
gagcataatttaaaaatata

SEQ ID NO: 3594640 - DNA, 21 bp, Homo sapiens
gagcatatttgccaataaagc

SEQ ID NO: 3594641 - DNA, 22 bp, Homo sapiens
gagcatatttgccaataaagct

SEQ ID NO: 3594642 - DNA, 16 bp, Homo sapiens
gagcatgcacatgctg

SEQ ID NO: 3594643 - DNA, 17 bp, Homo sapiens
gagcatggagacagcag

SEQ ID NO: 3594644 - DNA, 13 bp, Homo sapiens
gagcatggggcca

SEQ ID NO: 3594645 - DNA, 14 bp, Homo sapiens
gagcattgcagcct

SEQ ID NO: 3594646 - DNA, 15 bp, Homo sapiens
gagcatttttaaggg

SEQ ID NO: 3594647 - DNA, 21 bp, Homo sapiens
gagccaaatgaccgagccctg

SEQ ID NO: 3594648 - DNA, 23 bp, Homo sapiens
gagccaaatgaccgagccctgga

SEQ ID NO: 3594649 - DNA, 22 bp, Homo sapiens
gagccaagggatggacatcttg

SEQ ID NO: 3594650 - DNA, 14 bp, Homo sapiens
gagccaccagttct

SEQ ID NO: 3594651 - DNA, 18 bp, Homo sapiens
gagccaccgcgcccagcc

SEQ ID NO: 3594652 - DNA, 13 bp, Homo sapiens
gagccacctggat

SEQ ID NO: 3594653 - DNA, 12 bp, Homo sapiens
gagccagcaggg

SEQ ID NO: 3594654 - DNA, 18 bp, Homo sapiens
gagccagcctgcttccca

SEQ ID NO: 3594655 - DNA, 22 bp, Homo sapiens
gagccagcctggctctgccccc

SEQ ID NO: 3594656 - DNA, 17 bp, Homo sapiens
gagccaggactcccaga

SEQ ID NO: 3594657 - DNA, 18 bp, Homo sapiens
gagccaggactcccagaa

SEQ ID NO: 3594658 - DNA, 22 bp, Homo sapiens
gagccaggactcccagaacctc

SEQ ID NO: 3594659 - DNA, 16 bp, Homo sapiens
gagccaggatgcccag

SEQ ID NO: 3594660 - DNA, 11 bp, Homo sapiens
gagcccactgt

SEQ ID NO: 3594661 - DNA, 24 bp, Homo sapiens
gagcccactgtcctgggcctgcag

SEQ ID NO: 3594662 - DNA, 16 bp, Homo sapiens
gagcccagagtccccc

SEQ ID NO: 3594663 - DNA, 18 bp, Homo sapiens
gagcccagagtcccccca

SEQ ID NO: 3594664 - DNA, 13 bp, Homo sapiens
gagcccagcctgg

SEQ ID NO: 3594665 - DNA, 16 bp, Homo sapiens
gagcccagcctgggag

SEQ ID NO: 3594666 - DNA, 20 bp, Homo sapiens
gagcccaggcagctatttca

SEQ ID NO: 3594667 - DNA, 14 bp, Homo sapiens
gagcccccagccct

SEQ ID NO: 3594668 - DNA, 14 bp, Homo sapiens
gagcccctactgtg

SEQ ID NO: 3594669 - DNA, 16 bp, Homo sapiens
gagcccctactgtggg

SEQ ID NO: 3594670 - DNA, 13 bp, Homo sapiens
gagcccctcccca

SEQ ID NO: 3594671 - DNA, 15 bp, Homo sapiens
gagcccctccccagc

SEQ ID NO: 3594672 - DNA, 23 bp, Homo sapiens
gagccctagccctgctccaactc

SEQ ID NO: 3594673 - DNA, 17 bp, Homo sapiens
gagccctattgctgcta

SEQ ID NO: 3594674 - DNA, 12 bp, Homo sapiens
gagccctggaga

SEQ ID NO: 3594675 - DNA, 14 bp, Homo sapiens
gagccctggagagc

SEQ ID NO: 3594676 - DNA, 18 bp, Homo sapiens
gagccctggagagcccca

SEQ ID NO: 3594677 - DNA, 23 bp, Homo sapiens
gagcccttctatacccacccaga

SEQ ID NO: 3594678 - DNA, 13 bp, Homo sapiens
gagcctacctctg

SEQ ID NO: 3594679 - DNA, 16 bp, Homo sapiens
gagcctagctcctgcc

SEQ ID NO: 3594680 - DNA, 19 bp, Homo sapiens
gagcctcccaccagagccg

SEQ ID NO: 3594681 - DNA, 13 bp, Homo sapiens
gagcctctggctt

SEQ ID NO: 3594682 - DNA, 17 bp, Homo sapiens
gagcctggccaggcagg

SEQ ID NO: 3594683 - DNA, 11 bp, Homo sapiens
gagcctggggt

SEQ ID NO: 3594684 - DNA, 12 bp, Homo sapiens
gagcctggggtg

SEQ ID NO: 3594685 - DNA, 19 bp, Homo sapiens
gagcctggttcagacacag

SEQ ID NO: 3594686 - DNA, 19 bp, Homo sapiens
gagcctgtgcctcctcacc

SEQ ID NO: 3594687 - DNA, 23 bp, Homo sapiens
gagccttagaggtctttaatcat

SEQ ID NO: 3594688 - DNA, 23 bp, Homo sapiens
gagccttgtcagtgtgtcagttt

SEQ ID NO: 3594689 - DNA, 18 bp, Homo sapiens
gagccttttgctctctgt

SEQ ID NO: 3594690 - DNA, 23 bp, Homo sapiens
gagcgagtaaagtctgggccagg

SEQ ID NO: 3594691 - DNA, 22 bp, Homo sapiens
gagcgcaggcagcgcagggctg

SEQ ID NO: 3594692 - DNA, 19 bp, Homo sapiens
gagcgcttcagttcagctt

SEQ ID NO: 3594693 - DNA, 15 bp, Homo sapiens
gagcggcaccctggt

SEQ ID NO: 3594694 - DNA, 14 bp, Homo sapiens
gagcggctggagaa

SEQ ID NO: 3594695 - DNA, 19 bp, Homo sapiens
gagctaggaaccctggagg

SEQ ID NO: 3594696 - DNA, 15 bp, Homo sapiens
gagctccgatgcccg

SEQ ID NO: 3594697 - DNA, 16 bp, Homo sapiens
gagctctgcagagcag

SEQ ID NO: 3594698 - DNA, 13 bp, Homo sapiens
gagctctggggac

SEQ ID NO: 3594699 - DNA, 15 bp, Homo sapiens
gagctctggggacag

SEQ ID NO: 3594700 - DNA, 20 bp, Homo sapiens
gagctctggggacagcttcc

SEQ ID NO: 3594701 - DNA, 22 bp, Homo sapiens
gagctctggggacagcttcctc

SEQ ID NO: 3594702 - DNA, 13 bp, Homo sapiens
gagctcttccctt

SEQ ID NO: 3594703 - DNA, 20 bp, Homo sapiens
gagctcttgtgttcagaaga

SEQ ID NO: 3594704 - DNA, 13 bp, Homo sapiens
gagctgagctgga

SEQ ID NO: 3594705 - DNA, 23 bp, Homo sapiens
gagctgcctggatgagaaacagc

SEQ ID NO: 3594706 - DNA, 21 bp, Homo sapiens
gagctgctatagcctggggtg

SEQ ID NO: 3594707 - DNA, 14 bp, Homo sapiens
gagctgctgccctg

SEQ ID NO: 3594708 - DNA, 19 bp, Homo sapiens
gagctggcaaccagccagc

SEQ ID NO: 3594709 - DNA, 18 bp, Homo sapiens
gagctgtaaaaatgttac

SEQ ID NO: 3594710 - DNA, 13 bp, Homo sapiens
gagctgtctgtct

SEQ ID NO: 3594711 - DNA, 16 bp, Homo sapiens
gagctgtctgtctcta

SEQ ID NO: 3594712 - DNA, 13 bp, Homo sapiens
gagctgtgccagc

SEQ ID NO: 3594713 - DNA, 14 bp, Homo sapiens
gagctgttatgctg

SEQ ID NO: 3594714 - DNA, 22 bp, Homo sapiens
gagctgttatgctgtttcctag

SEQ ID NO: 3594715 - DNA, 22 bp, Homo sapiens
gagctgtttggatacagctgct

SEQ ID NO: 3594716 - DNA, 14 bp, Homo sapiens
gagcttcagccagg

SEQ ID NO: 3594717 - DNA, 23 bp, Homo sapiens
gagcttctcccagtgtgagaccc

SEQ ID NO: 3594718 - DNA, 23 bp, Homo sapiens
gagctttgtctacttcaaaagtt

SEQ ID NO: 3594719 - DNA, 22 bp, Homo sapiens
gaggaaaaaaatcgtccaggga

SEQ ID NO: 3594720 - DNA, 20 bp, Homo sapiens
gaggaaaaccaagccgtggc

SEQ ID NO: 3594721 - DNA, 21 bp, Homo sapiens
gaggaaaaccaagccgtggct

SEQ ID NO: 3594722 - DNA, 22 bp, Homo sapiens
gaggaaaggattttaccaaagc

SEQ ID NO: 3594723 - DNA, 15 bp, Homo sapiens
gaggacaaccattcc

SEQ ID NO: 3594724 - DNA, 13 bp, Homo sapiens
gaggacacagaga

SEQ ID NO: 3594725 - DNA, 24 bp, Homo sapiens
gaggaccaatgcttgcatggagaa

SEQ ID NO: 3594726 - DNA, 22 bp, Homo sapiens
gaggactggttctgaggccaga

SEQ ID NO: 3594727 - DNA, 14 bp, Homo sapiens
gaggacttgtgtct

SEQ ID NO: 3594728 - DNA, 17 bp, Homo sapiens
gaggacttgtgtctctg

SEQ ID NO: 3594729 - DNA, 12 bp, Homo sapiens
gaggagagagac

SEQ ID NO: 3594730 - DNA, 14 bp, Homo sapiens
gaggagagagaccc

SEQ ID NO: 3594731 - DNA, 15 bp, Homo sapiens
gaggagcagcaggag

SEQ ID NO: 3594732 - DNA, 12 bp, Homo sapiens
gaggagcctctg

SEQ ID NO: 3594733 - DNA, 20 bp, Homo sapiens
gaggagcctctggcttccct

SEQ ID NO: 3594734 - DNA, 13 bp, Homo sapiens
gaggagcgcaggc

SEQ ID NO: 3594735 - DNA, 20 bp, Homo sapiens
gaggagcgcaggcagcgcag

SEQ ID NO: 3594736 - DNA, 20 bp, Homo sapiens
gaggagcttctcccagtgtg

SEQ ID NO: 3594737 - DNA, 14 bp, Homo sapiens
gaggaggaaaagaa

SEQ ID NO: 3594738 - DNA, 14 bp, Homo sapiens
gaggagggaggcgg

SEQ ID NO: 3594739 - DNA, 18 bp, Homo sapiens
gaggagggaggcggcctc

SEQ ID NO: 3594740 - DNA, 19 bp, Homo sapiens
gaggagggggcaggctgag

SEQ ID NO: 3594741 - DNA, 17 bp, Homo sapiens
gaggatacagaggagat

SEQ ID NO: 3594742 - DNA, 15 bp, Homo sapiens
gcaaaaacaaaaaga

SEQ ID NO: 3594743 - DNA, 20 bp, Homo sapiens
gcaaaaaggagccttttgct

SEQ ID NO: 3594744 - DNA, 18 bp, Homo sapiens
gcaaaactccaggcagga

SEQ ID NO: 3594745 - DNA, 21 bp, Homo sapiens
gcaaaagaaacaccagtgtta

SEQ ID NO: 3594746 - DNA, 20 bp, Homo sapiens
gcaaaagatgtgcaaaatca

SEQ ID NO: 3594747 - DNA, 11 bp, Homo sapiens
gcaaaatacat

SEQ ID NO: 3594748 - DNA, 21 bp, Homo sapiens
gcaaacaatcccaatctttct

SEQ ID NO: 3594749 - DNA, 15 bp, Homo sapiens
gcaaacatcaaataa

SEQ ID NO: 3594750 - DNA, 23 bp, Homo sapiens
gcaaacatcaaataaatttctgg

SEQ ID NO: 3594751 - DNA, 13 bp, Homo sapiens
gcaaactctgctg

SEQ ID NO: 3594752 - DNA, 14 bp, Homo sapiens
gcaaactctgctgt

SEQ ID NO: 3594753 - DNA, 22 bp, Homo sapiens
gcaaagataatttatttcaata

SEQ ID NO: 3594754 - DNA, 14 bp, Homo sapiens
gcaaagccaaggca

SEQ ID NO: 3594755 - DNA, 23 bp, Homo sapiens
gcaaagcccttggaacaccctgg

SEQ ID NO: 3594756 - DNA, 12 bp, Homo sapiens
gcaaaggcctgg

SEQ ID NO: 3594757 - DNA, 16 bp, Homo sapiens
gcaaagggaaatcaag

SEQ ID NO: 3594758 - DNA, 14 bp, Homo sapiens
gcaaagtcctcctt

SEQ ID NO: 3594759 - DNA, 17 bp, Homo sapiens
gcaaagtcctcctttca

SEQ ID NO: 3594760 - DNA, 17 bp, Homo sapiens
gcaaagtgacaaagcaa

SEQ ID NO: 3594761 - DNA, 20 bp, Homo sapiens
gcaaataaaacgctttcccc

SEQ ID NO: 3594762 - DNA, 16 bp, Homo sapiens
gcaaatacaatcagcc

SEQ ID NO: 3594763 - DNA, 19 bp, Homo sapiens
gcaaatagattcagagaaa

SEQ ID NO: 3594764 - DNA, 13 bp, Homo sapiens
gcaaatcagaaaa

SEQ ID NO: 3594765 - DNA, 14 bp, Homo sapiens
gcaaatcagaaaac

SEQ ID NO: 3594766 - DNA, 14 bp, Homo sapiens
gcaaattttaactg

SEQ ID NO: 3594767 - DNA, 18 bp, Homo sapiens
gcaacagatctggaacct

SEQ ID NO: 3594768 - DNA, 18 bp, Homo sapiens
gcaacatgaagaatgcat

SEQ ID NO: 3594769 - DNA, 19 bp, Homo sapiens
gcaacatgaagaatgcatt

SEQ ID NO: 3594770 - DNA, 20 bp, Homo sapiens
gcaacatttgacaaaactaa

SEQ ID NO: 3594771 - DNA, 15 bp, Homo sapiens
gcaaccaaaaagaaa

SEQ ID NO: 3594772 - DNA, 14 bp, Homo sapiens
gcaaccatttgaaa

SEQ ID NO: 3594773 - DNA, 18 bp, Homo sapiens
gcaaccgcctcaaaatgt

SEQ ID NO: 3594774 - DNA, 17 bp, Homo sapiens
gcaacgtagcctgggct

SEQ ID NO: 3594775 - DNA, 19 bp, Homo sapiens
gcaactagtaaaatgctgg

SEQ ID NO: 3594776 - DNA, 19 bp, Homo sapiens
gcaactgacctgagcggca

SEQ ID NO: 3594777 - DNA, 15 bp, Homo sapiens
gcaactgtgaattca

SEQ ID NO: 3594778 - DNA, 17 bp, Homo sapiens
gcaacttccgctgaggg

SEQ ID NO: 3594779 - DNA, 18 bp, Homo sapiens
gcaacttccgctgagggg

SEQ ID NO: 3594780 - DNA, 11 bp, Homo sapiens
gcaagaaacag

SEQ ID NO: 3594781 - DNA, 13 bp, Homo sapiens
gcaagacagaaaa

SEQ ID NO: 3594782 - DNA, 15 bp, Homo sapiens
gcaagacagaaaagt

SEQ ID NO: 3594783 - DNA, 21 bp, Homo sapiens
gcaagacagaaaagtgcctga

SEQ ID NO: 3594784 - DNA, 18 bp, Homo sapiens
gcaagaccacggagggag

SEQ ID NO: 3594785 - DNA, 12 bp, Homo sapiens
gcaagacctcat

SEQ ID NO: 3594786 - DNA, 18 bp, Homo sapiens
gcaagataaacattatta

SEQ ID NO: 3594787 - DNA, 14 bp, Homo sapiens
gcaagcagatgaca

SEQ ID NO: 3594788 - DNA, 11 bp, Homo sapiens
gcaagcagctt

SEQ ID NO: 3594789 - DNA, 23 bp, Homo sapiens
gcaagccctgttgacacaggtct

SEQ ID NO: 3594790 - DNA, 23 bp, Homo sapiens
gcaagcctgtatcagaatctgaa

SEQ ID NO: 3594791 - DNA, 15 bp, Homo sapiens
gcaagcgagcacagt

SEQ ID NO: 3594792 - DNA, 13 bp, Homo sapiens
gcaagcgggagcc

SEQ ID NO: 3594793 - DNA, 17 bp, Homo sapiens
gcaagctaggccccaga

SEQ ID NO: 3594794 - DNA, 16 bp, Homo sapiens
gcaaggattacagaaa

SEQ ID NO: 3594795 - DNA, 17 bp, Homo sapiens
gcaaggattacagaaac

SEQ ID NO: 3594796 - DNA, 20 bp, Homo sapiens
gcaaggattacagaaactga

SEQ ID NO: 3594797 - DNA, 23 bp, Homo sapiens
gcaaggattacagaaactgatgc

SEQ ID NO: 3594798 - DNA, 23 bp, Homo sapiens
gcaaggggaccccgagaaccctg

SEQ ID NO: 3594799 - DNA, 17 bp, Homo sapiens
gcaaggtactctggtga

SEQ ID NO: 3594800 - DNA, 20 bp, Homo sapiens
gcaaggtttaggctggtggc

SEQ ID NO: 3594801 - DNA, 24 bp, Homo sapiens
gcaaggtttaggctggtggcccag

SEQ ID NO: 3594802 - DNA, 19 bp, Homo sapiens
gcaagtcccttcagactgg

SEQ ID NO: 3594803 - DNA, 22 bp, Homo sapiens
gcaagtcccttcagactggccc

SEQ ID NO: 3594804 - DNA, 17 bp, Homo sapiens
gcaagtggagctgtctg

SEQ ID NO: 3594805 - DNA, 15 bp, Homo sapiens
gcaataaataaagct

SEQ ID NO: 3594806 - DNA, 11 bp, Homo sapiens
gcaatatataa

SEQ ID NO: 3594807 - DNA, 18 bp, Homo sapiens
gcaatcctcctacctcag

SEQ ID NO: 3594808 - DNA, 23 bp, Homo sapiens
gcaatgggtcttagctctttctc

SEQ ID NO: 3594809 - DNA, 19 bp, Homo sapiens
gcaatttaactagacacag

SEQ ID NO: 3594810 - DNA, 14 bp, Homo sapiens
gcaatttagacaaa

SEQ ID NO: 3594811 - DNA, 13 bp, Homo sapiens
gcacaaaagacag

SEQ ID NO: 3594812 - DNA, 14 bp, Homo sapiens
gcacaaacagaatt

SEQ ID NO: 3594813 - DNA, 19 bp, Homo sapiens
gcacaaacagaattttcca

SEQ ID NO: 3594814 - DNA, 20 bp, Homo sapiens
gcacaaacagaattttccat

SEQ ID NO: 3594815 - DNA, 15 bp, Homo sapiens
gcacaaatatttatt

SEQ ID NO: 3594816 - DNA, 19 bp, Homo sapiens
gcacaactttaagaggaca

SEQ ID NO: 3594817 - DNA, 17 bp, Homo sapiens
gcacaagactggcccag

SEQ ID NO: 3594818 - DNA, 16 bp, Homo sapiens
gcacacagctgagcac

SEQ ID NO: 3594819 - DNA, 18 bp, Homo sapiens
gcacacagctgagcactt

SEQ ID NO: 3594820 - DNA, 11 bp, Homo sapiens
gcacacagggc

SEQ ID NO: 3594821 - DNA, 14 bp, Homo sapiens
gcacacatatatag

SEQ ID NO: 3594822 - DNA, 14 bp, Homo sapiens
gcacacccgtgtgc

SEQ ID NO: 3594823 - DNA, 15 bp, Homo sapiens
gcacacctcctccca

SEQ ID NO: 3594824 - DNA, 19 bp, Homo sapiens
gcacacctcctcccactgc

SEQ ID NO: 3594825 - DNA, 20 bp, Homo sapiens
gcacacctcctcccactgcc

SEQ ID NO: 3594826 - DNA, 19 bp, Homo sapiens
gcacacctgaatcagctgg

SEQ ID NO: 3594827 - DNA, 20 bp, Homo sapiens
gcacacctgaatcagctgga

SEQ ID NO: 3594828 - DNA, 21 bp, Homo sapiens
gcacacctgaatcagctggac

SEQ ID NO: 3594829 - DNA, 23 bp, Homo sapiens
gcacactctcccattatatttat

SEQ ID NO: 3594830 - DNA, 18 bp, Homo sapiens
gcacagacaagcagccct

SEQ ID NO: 3594831 - DNA, 20 bp, Homo sapiens
gcacagcagctgcaggggcc

SEQ ID NO: 3594832 - DNA, 11 bp, Homo sapiens
gcacagccctt

SEQ ID NO: 3594833 - DNA, 14 bp, Homo sapiens
gcacagctgggagc

SEQ ID NO: 3594834 - DNA, 20 bp, Homo sapiens
gcacagtaggtcccggccag

SEQ ID NO: 3594835 - DNA, 21 bp, Homo sapiens
gcacagtaggtcccggccagc

SEQ ID NO: 3594836 - DNA, 15 bp, Homo sapiens
gcacagtatctgctg

SEQ ID NO: 3594837 - DNA, 17 bp, Homo sapiens
gcacagtatctgctgtt

SEQ ID NO: 3594838 - DNA, 13 bp, Homo sapiens
gcacagtgggagc

SEQ ID NO: 3594839 - DNA, 14 bp, Homo sapiens
gcacagtgtgagcc

SEQ ID NO: 3594840 - DNA, 18 bp, Homo sapiens
gcacagttttctgagaaa

SEQ ID NO: 3594841 - DNA, 22 bp, Homo sapiens
gcacagttttctgagaaagact

SEQ ID NO: 3594842 - DNA, 23 bp, Homo sapiens
gcacagttttctgagaaagacta

SEQ ID NO: 3594843 - DNA, 22 bp, Homo sapiens
gcacatccatcagcaccccagt

SEQ ID NO: 3594844 - DNA, 15 bp, Homo sapiens
gcacatgagtggaaa

SEQ ID NO: 3594845 - DNA, 15 bp, Homo sapiens
gcacatggtgtgggg

SEQ ID NO: 3594846 - DNA, 14 bp, Homo sapiens
gcaccagacaccca

SEQ ID NO: 3594847 - DNA, 18 bp, Homo sapiens
gcaccagacacccaggac

SEQ ID NO: 3594848 - DNA, 21 bp, Homo sapiens
gcaccagacacccaggactta

SEQ ID NO: 3594849 - DNA, 22 bp, Homo sapiens
gcaccaggggccaacctcaggc

SEQ ID NO: 3594850 - DNA, 14 bp, Homo sapiens
gcaccatcagcctg

SEQ ID NO: 3594851 - DNA, 15 bp, Homo sapiens
gcaccattttgtcag

SEQ ID NO: 3594852 - DNA, 11 bp, Homo sapiens
gcacccagaac

SEQ ID NO: 3594853 - DNA, 23 bp, Homo sapiens
gcacccccacaagctgtccctgc

SEQ ID NO: 3594854 - DNA, 19 bp, Homo sapiens
gcaccccctgctccaccag

SEQ ID NO: 3594855 - DNA, 15 bp, Homo sapiens
gcaccctgcgcctcc

SEQ ID NO: 3594856 - DNA, 16 bp, Homo sapiens
gcaccctgcgcctcca

SEQ ID NO: 3594857 - DNA, 14 bp, Homo sapiens
gcaccctggtctgt

SEQ ID NO: 3594858 - DNA, 20 bp, Homo sapiens
gcaccgccacgtcccagcat

SEQ ID NO: 3594859 - DNA, 17 bp, Homo sapiens
gcaccgcctcttcccgc

SEQ ID NO: 3594860 - DNA, 15 bp, Homo sapiens
gcaccgtccaggccc

SEQ ID NO: 3594861 - DNA, 17 bp, Homo sapiens
gcaccgtccaggcccca

SEQ ID NO: 3594862 - DNA, 15 bp, Homo sapiens
gcacctccccgctgg

SEQ ID NO: 3594863 - DNA, 20 bp, Homo sapiens
gcacctcctaccctcccacc

SEQ ID NO: 3594864 - DNA, 19 bp, Homo sapiens
gcacctgcctccaccagca

SEQ ID NO: 3594865 - DNA, 21 bp, Homo sapiens
gcacctgcctccaccagcaag

SEQ ID NO: 3594866 - DNA, 12 bp, Homo sapiens
gcacctgtttcc

SEQ ID NO: 3594867 - DNA, 16 bp, Homo sapiens
gcaccttccagcccgg

SEQ ID NO: 3594868 - DNA, 14 bp, Homo sapiens
gcacgctcaatgcc

SEQ ID NO: 3594869 - DNA, 16 bp, Homo sapiens
gcacgtgacaggctcg

SEQ ID NO: 3594870 - DNA, 16 bp, Homo sapiens
gcactaaaatgaggat

SEQ ID NO: 3594871 - DNA, 21 bp, Homo sapiens
gcactaaaatgaggatccagg

SEQ ID NO: 3594872 - DNA, 21 bp, Homo sapiens
gcactcacccctagccctggt

SEQ ID NO: 3594873 - DNA, 22 bp, Homo sapiens
gcactcccacctgacacaccag

SEQ ID NO: 3594874 - DNA, 16 bp, Homo sapiens
gcactcctttatctgt

SEQ ID NO: 3594875 - DNA, 22 bp, Homo sapiens
gccaggggggtgaggagctggg

SEQ ID NO: 3594876 - DNA, 19 bp, Homo sapiens
gccaggtacaggagaggca

SEQ ID NO: 3594877 - DNA, 14 bp, Homo sapiens
gccaggtactgcat

SEQ ID NO: 3594878 - DNA, 20 bp, Homo sapiens
gccagtcttgacgagtgtga

SEQ ID NO: 3594879 - DNA, 18 bp, Homo sapiens
gccagtgcagccactggc

SEQ ID NO: 3594880 - DNA, 14 bp, Homo sapiens
gccagtggctggat

SEQ ID NO: 3594881 - DNA, 11 bp, Homo sapiens
gccagtgtcta

SEQ ID NO: 3594882 - DNA, 15 bp, Homo sapiens
gccagttacttgggc

SEQ ID NO: 3594883 - DNA, 23 bp, Homo sapiens
gccagttttccgaagtctctgat

SEQ ID NO: 3594884 - DNA, 16 bp, Homo sapiens
gccataaacggttcct

SEQ ID NO: 3594885 - DNA, 18 bp, Homo sapiens
gccataaacggttcctgg

SEQ ID NO: 3594886 - DNA, 23 bp, Homo sapiens
gccataggtctaaataggatcct

SEQ ID NO: 3594887 - DNA, 14 bp, Homo sapiens
gccatatttactac

SEQ ID NO: 3594888 - DNA, 17 bp, Homo sapiens
gccatatttactacctt

SEQ ID NO: 3594889 - DNA, 22 bp, Homo sapiens
gccatccccaccttcacctcgg

SEQ ID NO: 3594890 - DNA, 15 bp, Homo sapiens
gccatctcaggagat

SEQ ID NO: 3594891 - DNA, 14 bp, Homo sapiens
gccatctctgctcc

SEQ ID NO: 3594892 - DNA, 15 bp, Homo sapiens
gccatctctgctcca

SEQ ID NO: 3594893 - DNA, 22 bp, Homo sapiens
gccatctgactgccaagccaga

SEQ ID NO: 3594894 - DNA, 13 bp, Homo sapiens
gccatcttctttc

SEQ ID NO: 3594895 - DNA, 14 bp, Homo sapiens
gccatgatgtatat

SEQ ID NO: 3594896 - DNA, 15 bp, Homo sapiens
gccatgcctcctcag

SEQ ID NO: 3594897 - DNA, 19 bp, Homo sapiens
gccatggaattccctcctg

SEQ ID NO: 3594898 - DNA, 20 bp, Homo sapiens
gccatgtcgccaaaaataca

SEQ ID NO: 3594899 - DNA, 19 bp, Homo sapiens
gccattgatcataaactga

SEQ ID NO: 3594900 - DNA, 13 bp, Homo sapiens
gccatttttacat

SEQ ID NO: 3594901 - DNA, 13 bp, Homo sapiens
gcccaaacctggg

SEQ ID NO: 3594902 - DNA, 15 bp, Homo sapiens
gcccaaacctgggaa

SEQ ID NO: 3594903 - DNA, 23 bp, Homo sapiens
gcccaacctctgtggtcacccat

SEQ ID NO: 3594904 - DNA, 24 bp, Homo sapiens
gcccaacctgctctcctcttgcca

SEQ ID NO: 3594905 - DNA, 14 bp, Homo sapiens
gcccaactggggtt

SEQ ID NO: 3594906 - DNA, 19 bp, Homo sapiens
gcccaagttcatgcagctg

SEQ ID NO: 3594907 - DNA, 11 bp, Homo sapiens
gcccacccctc

SEQ ID NO: 3594908 - DNA, 12 bp, Homo sapiens
gcccacccctca

SEQ ID NO: 3594909 - DNA, 23 bp, Homo sapiens
gcccacccctcactccccaggga

SEQ ID NO: 3594910 - DNA, 23 bp, Homo sapiens
gcccacgagggtctcccctcctg

SEQ ID NO: 3594911 - DNA, 13 bp, Homo sapiens
gcccactccccag

SEQ ID NO: 3594912 - DNA, 15 bp, Homo sapiens
gcccactgtcctggg

SEQ ID NO: 3594913 - DNA, 19 bp, Homo sapiens
gcccagaattgcagttcag

SEQ ID NO: 3594914 - DNA, 12 bp, Homo sapiens
gcccagagccac

SEQ ID NO: 3594915 - DNA, 15 bp, Homo sapiens
gcccagagccacctg

SEQ ID NO: 3594916 - DNA, 15 bp, Homo sapiens
gcccagagcccagct

SEQ ID NO: 3594917 - DNA, 17 bp, Homo sapiens
gcccagagcccagctcc

SEQ ID NO: 3594918 - DNA, 18 bp, Homo sapiens
gcccagagcccagctcca

SEQ ID NO: 3594919 - DNA, 14 bp, Homo sapiens
gcccagcaggagag

SEQ ID NO: 3594920 - DNA, 13 bp, Homo sapiens
gcccagccaggcc

SEQ ID NO: 3594921 - DNA, 16 bp, Homo sapiens
gcccagcccaccccat

SEQ ID NO: 3594922 - DNA, 13 bp, Homo sapiens
gcccagcccagag

SEQ ID NO: 3594923 - DNA, 14 bp, Homo sapiens
gcccagcccagagc

SEQ ID NO: 3594924 - DNA, 16 bp, Homo sapiens
gcccagcccagagcca

SEQ ID NO: 3594925 - DNA, 17 bp, Homo sapiens
gcccagcccagagccac

SEQ ID NO: 3594926 - DNA, 19 bp, Homo sapiens
gcccagcctgggagcccag

SEQ ID NO: 3594927 - DNA, 20 bp, Homo sapiens
gcccagcctgggagcccaga

SEQ ID NO: 3594928 - DNA, 21 bp, Homo sapiens
gcccagcctgggagcccagag

SEQ ID NO: 3594929 - DNA, 22 bp, Homo sapiens
gcccagcctgggagcccagagg

SEQ ID NO: 3594930 - DNA, 20 bp, Homo sapiens
gcccagctttccctgccagg

SEQ ID NO: 3594931 - DNA, 16 bp, Homo sapiens
gcccaggatatatttt

SEQ ID NO: 3594932 - DNA, 14 bp, Homo sapiens
gcccaggcagcctc

SEQ ID NO: 3594933 - DNA, 22 bp, Homo sapiens
gcccaggcagctatttcagcct

SEQ ID NO: 3594934 - DNA, 19 bp, Homo sapiens
gcccaggctggagtgcagt

SEQ ID NO: 3594935 - DNA, 14 bp, Homo sapiens
gcccaggctggtct

SEQ ID NO: 3594936 - DNA, 14 bp, Homo sapiens
gcccagggcccaga

SEQ ID NO: 3594937 - DNA, 23 bp, Homo sapiens
gcccagggcccagagcccagctc

SEQ ID NO: 3594938 - DNA, 19 bp, Homo sapiens
gcccagtaaaatttcagga

SEQ ID NO: 3594939 - DNA, 14 bp, Homo sapiens
gcccagtgaagcct

SEQ ID NO: 3594940 - DNA, 18 bp, Homo sapiens
gcccagttcatcaccatt

SEQ ID NO: 3594941 - DNA, 20 bp, Homo sapiens
gcccatgggagctggttaga

SEQ ID NO: 3594942 - DNA, 14 bp, Homo sapiens
gcccattcccaagg

SEQ ID NO: 3594943 - DNA, 15 bp, Homo sapiens
gcccattcccaaggg

SEQ ID NO: 3594944 - DNA, 18 bp, Homo sapiens
gccccaactccaggggca

SEQ ID NO: 3594945 - DNA, 22 bp, Homo sapiens
gccccaccccacctcacagcta

SEQ ID NO: 3594946 - DNA, 16 bp, Homo sapiens
gccccaccggccaggc

SEQ ID NO: 3594947 - DNA, 20 bp, Homo sapiens
gccccacctcccccttcccc

SEQ ID NO: 3594948 - DNA, 21 bp, Homo sapiens
gccccacctcccccttcccct

SEQ ID NO: 3594949 - DNA, 15 bp, Homo sapiens
gccccacctcggcac

SEQ ID NO: 3594950 - DNA, 19 bp, Homo sapiens
gccccacctcggcacacac

SEQ ID NO: 3594951 - DNA, 20 bp, Homo sapiens
gccccacctcggcacacact

SEQ ID NO: 3594952 - DNA, 21 bp, Homo sapiens
gccccacctcggcacacactg

SEQ ID NO: 3594953 - DNA, 22 bp, Homo sapiens
gccccacttctggccacatcag

SEQ ID NO: 3594954 - DNA, 11 bp, Homo sapiens
gccccagagct

SEQ ID NO: 3594955 - DNA, 12 bp, Homo sapiens
gccccagagctc

SEQ ID NO: 3594956 - DNA, 17 bp, Homo sapiens
gccccagagctccgatg

SEQ ID NO: 3594957 - DNA, 18 bp, Homo sapiens
gccccagcctccctgaag

SEQ ID NO: 3594958 - DNA, 18 bp, Homo sapiens
gccccagcctgtccttgt

SEQ ID NO: 3594959 - DNA, 19 bp, Homo sapiens
gccccaggaccagctcagg

SEQ ID NO: 3594960 - DNA, 13 bp, Homo sapiens
gccccaggagaag

SEQ ID NO: 3594961 - DNA, 17 bp, Homo sapiens
gccccagtcggccccat

SEQ ID NO: 3594962 - DNA, 20 bp, Homo sapiens
gccccagtcggccccatctc

SEQ ID NO: 3594963 - DNA, 22 bp, Homo sapiens
gccccagtgttatttattcccc

SEQ ID NO: 3594964 - DNA, 21 bp, Homo sapiens
gccccataattttttttttcc

SEQ ID NO: 3594965 - DNA, 17 bp, Homo sapiens
gccccatcctcatccct

SEQ ID NO: 3594966 - DNA, 20 bp, Homo sapiens
gccccatcctcatccctgac

SEQ ID NO: 3594967 - DNA, 18 bp, Homo sapiens
gccccatcctccagcagg

SEQ ID NO: 3594968 - DNA, 14 bp, Homo sapiens
gcccccacctccac

SEQ ID NO: 3594969 - DNA, 15 bp, Homo sapiens
gcccccacctccacc

SEQ ID NO: 3594970 - DNA, 18 bp, Homo sapiens
gcccccacctccaccctc

SEQ ID NO: 3594971 - DNA, 11 bp, Homo sapiens
gcccccagaaa

SEQ ID NO: 3594972 - DNA, 18 bp, Homo sapiens
gcccccagaaagcctcct

SEQ ID NO: 3594973 - DNA, 19 bp, Homo sapiens
gcccccagaaagcctcctg

SEQ ID NO: 3594974 - DNA, 21 bp, Homo sapiens
gcccccagaaagcctcctgcc

SEQ ID NO: 3594975 - DNA, 15 bp, Homo sapiens
gcccccagccctggg

SEQ ID NO: 3594976 - DNA, 16 bp, Homo sapiens
gcccccagccctggga

SEQ ID NO: 3594977 - DNA, 22 bp, Homo sapiens
gcccccagctaagaacctggaa

SEQ ID NO: 3594978 - DNA, 16 bp, Homo sapiens
gcccccagggcctcca

SEQ ID NO: 3594979 - DNA, 19 bp, Homo sapiens
gcccccagggcctccaggg

SEQ ID NO: 3594980 - DNA, 21 bp, Homo sapiens
gcccccagggcctccagggcc

SEQ ID NO: 3594981 - DNA, 16 bp, Homo sapiens
gcccccaggtgccagt

SEQ ID NO: 3594982 - DNA, 15 bp, Homo sapiens
gcccccattcccagc

SEQ ID NO: 3594983 - DNA, 20 bp, Homo sapiens
gcccccattcccagcctgac

SEQ ID NO: 3594984 - DNA, 16 bp, Homo sapiens
gcccccccccacccct

SEQ ID NO: 3594985 - DNA, 13 bp, Homo sapiens
gccccccctaaga

SEQ ID NO: 3594986 - DNA, 18 bp, Homo sapiens
gccccccgcgcgcccacc

SEQ ID NO: 3594987 - DNA, 21 bp, Homo sapiens
gccccccgcgcgcccaccctc

SEQ ID NO: 3594988 - DNA, 19 bp, Homo sapiens
gccccccgcgctcgcccag

SEQ ID NO: 3594989 - DNA, 23 bp, Homo sapiens
gccccccgcgctcgcccagcagg

SEQ ID NO: 3594990 - DNA, 21 bp, Homo sapiens
gcccccgctcccgctcccagg

SEQ ID NO: 3594991 - DNA, 20 bp, Homo sapiens
gccccctctttgtagctcct

SEQ ID NO: 3594992 - DNA, 13 bp, Homo sapiens
gccccctgccagt

SEQ ID NO: 3594993 - DNA, 14 bp, Homo sapiens
gccccctgccagtg

SEQ ID NO: 3594994 - DNA, 13 bp, Homo sapiens
gccccctgggctg

SEQ ID NO: 3594995 - DNA, 12 bp, Homo sapiens
gcccccttcagg

SEQ ID NO: 3594996 - DNA, 17 bp, Homo sapiens
gcccccttcaggagcct

SEQ ID NO: 3594997 - DNA, 22 bp, Homo sapiens
gccccgacacacggggctcggg

SEQ ID NO: 3594998 - DNA, 15 bp, Homo sapiens
gccccgccagggctg

SEQ ID NO: 3594999 - DNA, 16 bp, Homo sapiens
gccccgccagggctgg

SEQ ID NO: 3595000 - DNA, 16 bp, Homo sapiens
gccccgccccagagct

SEQ ID NO: 3595001 - DNA, 18 bp, Homo sapiens
gccccgcccctcccacgc

SEQ ID NO: 3595002 - DNA, 23 bp, Homo sapiens
gccccgcccctcccacgcctcac

SEQ ID NO: 3595003 - DNA, 16 bp, Homo sapiens
gccccgggctggagaa

SEQ ID NO: 3595004 - DNA, 22 bp, Homo sapiens
gccccgggctggagaaagagct

SEQ ID NO: 3595005 - DNA, 19 bp, Homo sapiens
gccccgtcggactgccccc

SEQ ID NO: 3595006 - DNA, 19 bp, Homo sapiens
gccccgtgtcctgcctgtc

SEQ ID NO: 3595007 - DNA, 19 bp, Homo sapiens
gcgtgatcaaagccacact

SEQ ID NO: 3595008 - DNA, 20 bp, Homo sapiens
gcgtgatcaaagccacactc

SEQ ID NO: 3595009 - DNA, 15 bp, Homo sapiens
gcgtgctcagaccca

SEQ ID NO: 3595010 - DNA, 22 bp, Homo sapiens
gcgttattggtcggcagccttc

SEQ ID NO: 3595011 - DNA, 17 bp, Homo sapiens
gcgtttataattggctt

SEQ ID NO: 3595012 - DNA, 18 bp, Homo sapiens
gctaaaaaggcccttaga

SEQ ID NO: 3595013 - DNA, 19 bp, Homo sapiens
gctaaaaaggcccttagag

SEQ ID NO: 3595014 - DNA, 12 bp, Homo sapiens
gctaaagcctgt

SEQ ID NO: 3595015 - DNA, 17 bp, Homo sapiens
gctaaagcctgtgggtt

SEQ ID NO: 3595016 - DNA, 15 bp, Homo sapiens
gctaactgggttaaa

SEQ ID NO: 3595017 - DNA, 18 bp, Homo sapiens
gctaactggttaaacatt

SEQ ID NO: 3595018 - DNA, 16 bp, Homo sapiens
gctaagaacctggaac

SEQ ID NO: 3595019 - DNA, 17 bp, Homo sapiens
gctaagaacctggaact

SEQ ID NO: 3595020 - DNA, 15 bp, Homo sapiens
gctaagaccctgtgt

SEQ ID NO: 3595021 - DNA, 14 bp, Homo sapiens
gctaatcagcattc

SEQ ID NO: 3595022 - DNA, 18 bp, Homo sapiens
gctacaaaaacacagcaa

SEQ ID NO: 3595023 - DNA, 21 bp, Homo sapiens
gctacaaccctaccctggcag

SEQ ID NO: 3595024 - DNA, 15 bp, Homo sapiens
gctacacctttctcc

SEQ ID NO: 3595025 - DNA, 19 bp, Homo sapiens
gctaccagtatttagaagc

SEQ ID NO: 3595026 - DNA, 22 bp, Homo sapiens
gctaccagtatttagaagccaa

SEQ ID NO: 3595027 - DNA, 21 bp, Homo sapiens
gctactcagtggggctggcat

SEQ ID NO: 3595028 - DNA, 19 bp, Homo sapiens
gctactggttacctggaga

SEQ ID NO: 3595029 - DNA, 21 bp, Homo sapiens
gctactggttacctggagaag

SEQ ID NO: 3595030 - DNA, 20 bp, Homo sapiens
gctagagaaatcagctgcta

SEQ ID NO: 3595031 - DNA, 21 bp, Homo sapiens
gctagagaaatcagctgctat

SEQ ID NO: 3595032 - DNA, 18 bp, Homo sapiens
gctagagacgctgatcca

SEQ ID NO: 3595033 - DNA, 12 bp, Homo sapiens
gctagatccagc

SEQ ID NO: 3595034 - DNA, 13 bp, Homo sapiens
gctagctgtgctg

SEQ ID NO: 3595035 - DNA, 11 bp, Homo sapiens
gctaggaaccc

SEQ ID NO: 3595036 - DNA, 18 bp, Homo sapiens
gctaggaatgaaatcctg

SEQ ID NO: 3595037 - DNA, 16 bp, Homo sapiens
gctaggccccagaggc

SEQ ID NO: 3595038 - DNA, 22 bp, Homo sapiens
gctaggccccagaggccctgga

SEQ ID NO: 3595039 - DNA, 22 bp, Homo sapiens
gctaggcctccgttgtctggtt

SEQ ID NO: 3595040 - DNA, 11 bp, Homo sapiens
gctagtgcctt

SEQ ID NO: 3595041 - DNA, 23 bp, Homo sapiens
gctataaattcctctttgctttg

SEQ ID NO: 3595042 - DNA, 18 bp, Homo sapiens
gctataaattttttgaaa

SEQ ID NO: 3595043 - DNA, 13 bp, Homo sapiens
gctataggtgcta

SEQ ID NO: 3595044 - DNA, 15 bp, Homo sapiens
gctatagtgacatgc

SEQ ID NO: 3595045 - DNA, 18 bp, Homo sapiens
gctatagtgacatgcagt

SEQ ID NO: 3595046 - DNA, 13 bp, Homo sapiens
gctatctctgtgt

SEQ ID NO: 3595047 - DNA, 21 bp, Homo sapiens
gctatggggatagatgtgtgg

SEQ ID NO: 3595048 - DNA, 21 bp, Homo sapiens
gctattcccagggaaccccag

SEQ ID NO: 3595049 - DNA, 17 bp, Homo sapiens
gctatttcagcctcctg

SEQ ID NO: 3595050 - DNA, 18 bp, Homo sapiens
gctattttctaaagactt

SEQ ID NO: 3595051 - DNA, 13 bp, Homo sapiens
gctatttttatac

SEQ ID NO: 3595052 - DNA, 18 bp, Homo sapiens
gctatttttatacactgt

SEQ ID NO: 3595053 - DNA, 19 bp, Homo sapiens
gctatttttatacactgta

SEQ ID NO: 3595054 - DNA, 23 bp, Homo sapiens
gctattttttcccttctcttcta

SEQ ID NO: 3595055 - DNA, 15 bp, Homo sapiens
gctcaacccccctcc

SEQ ID NO: 3595056 - DNA, 22 bp, Homo sapiens
gctcaagccctgaatttcttct

SEQ ID NO: 3595057 - DNA, 15 bp, Homo sapiens
gctcaagggctggca

SEQ ID NO: 3595058 - DNA, 16 bp, Homo sapiens
gctcaagggctggcac

SEQ ID NO: 3595059 - DNA, 22 bp, Homo sapiens
gctcaagtgatcctcacgcctt

SEQ ID NO: 3595060 - DNA, 15 bp, Homo sapiens
gctcaatttcagcac

SEQ ID NO: 3595061 - DNA, 14 bp, Homo sapiens
gctcacaaaccatg

SEQ ID NO: 3595062 - DNA, 17 bp, Homo sapiens
gctcacaaggcccagga

SEQ ID NO: 3595063 - DNA, 22 bp, Homo sapiens
gctcacgtaatgcattgcctgt

SEQ ID NO: 3595064 - DNA, 12 bp, Homo sapiens
gctcactggcag

SEQ ID NO: 3595065 - DNA, 17 bp, Homo sapiens
gctcactggcaggtgtg

SEQ ID NO: 3595066 - DNA, 24 bp, Homo sapiens
gctcagagaggtagcactctcaga

SEQ ID NO: 3595067 - DNA, 14 bp, Homo sapiens
gctcagccagtggg

SEQ ID NO: 3595068 - DNA, 12 bp, Homo sapiens
gctcagccctcc

SEQ ID NO: 3595069 - DNA, 17 bp, Homo sapiens
gctcagccctggcctgg

SEQ ID NO: 3595070 - DNA, 19 bp, Homo sapiens
gctcagccctggcctggct

SEQ ID NO: 3595071 - DNA, 20 bp, Homo sapiens
gctcagccctggcctggctg

SEQ ID NO: 3595072 - DNA, 22 bp, Homo sapiens
gctcagccctggcctggctggg

SEQ ID NO: 3595073 - DNA, 18 bp, Homo sapiens
gctcagcctggtttctgg

SEQ ID NO: 3595074 - DNA, 23 bp, Homo sapiens
gctcagcctggtttctgggtgct

SEQ ID NO: 3595075 - DNA, 12 bp, Homo sapiens
gctcagcttctc

SEQ ID NO: 3595076 - DNA, 13 bp, Homo sapiens
gctcagcttctcc

SEQ ID NO: 3595077 - DNA, 17 bp, Homo sapiens
gctcaggacagatgcca

SEQ ID NO: 3595078 - DNA, 20 bp, Homo sapiens
gctcaggacagatgccacac

SEQ ID NO: 3595079 - DNA, 15 bp, Homo sapiens
gctcaggagaagcca

SEQ ID NO: 3595080 - DNA, 15 bp, Homo sapiens
gctcagggcagtggc

SEQ ID NO: 3595081 - DNA, 16 bp, Homo sapiens
gctcagggcagtggct

SEQ ID NO: 3595082 - DNA, 18 bp, Homo sapiens
gctcaggggcctggaggt

SEQ ID NO: 3595083 - DNA, 22 bp, Homo sapiens
gctcaggggcctggaggtctgg

SEQ ID NO: 3595084 - DNA, 19 bp, Homo sapiens
gctcatatgctgacagctc

SEQ ID NO: 3595085 - DNA, 13 bp, Homo sapiens
gctcatctgttgt

SEQ ID NO: 3595086 - DNA, 13 bp, Homo sapiens
gctcatgctgctc

SEQ ID NO: 3595087 - DNA, 21 bp, Homo sapiens
gctccaacctgcaaagatctg

SEQ ID NO: 3595088 - DNA, 17 bp, Homo sapiens
gctccaagatgttctcc

SEQ ID NO: 3595089 - DNA, 14 bp, Homo sapiens
gctccacactcaga

SEQ ID NO: 3595090 - DNA, 15 bp, Homo sapiens
gctccagaagatgcc

SEQ ID NO: 3595091 - DNA, 17 bp, Homo sapiens
gctccagaagatgccag

SEQ ID NO: 3595092 - DNA, 20 bp, Homo sapiens
gctccagaagatgccagctt

SEQ ID NO: 3595093 - DNA, 23 bp, Homo sapiens
gctccagaagatgccagcttctc

SEQ ID NO: 3595094 - DNA, 12 bp, Homo sapiens
gctccagacctg

SEQ ID NO: 3595095 - DNA, 21 bp, Homo sapiens
gctccagcaggaaggacccca

SEQ ID NO: 3595096 - DNA, 16 bp, Homo sapiens
gctccataccttttct

SEQ ID NO: 3595097 - DNA, 19 bp, Homo sapiens
gctcccacagaacacagca

SEQ ID NO: 3595098 - DNA, 12 bp, Homo sapiens
gctcccacagct

SEQ ID NO: 3595099 - DNA, 16 bp, Homo sapiens
gctcccacagcttcct

SEQ ID NO: 3595100 - DNA, 15 bp, Homo sapiens
gctcccacaggccct

SEQ ID NO: 3595101 - DNA, 16 bp, Homo sapiens
gctcccacaggccctt

SEQ ID NO: 3595102 - DNA, 17 bp, Homo sapiens
gctcccacaggcccttc

SEQ ID NO: 3595103 - DNA, 21 bp, Homo sapiens
gctcccacaggcccttcctct

SEQ ID NO: 3595104 - DNA, 20 bp, Homo sapiens
gctcccaggttcccccagca

SEQ ID NO: 3595105 - DNA, 19 bp, Homo sapiens
gctcccctaaagccaggct

SEQ ID NO: 3595106 - DNA, 21 bp, Homo sapiens
gctcccctaaagccaggctca

SEQ ID NO: 3595107 - DNA, 14 bp, Homo sapiens
gctcccgctcccag

SEQ ID NO: 3595108 - DNA, 16 bp, Homo sapiens
gctcccgggggcccca

SEQ ID NO: 3595109 - DNA, 19 bp, Homo sapiens
gctccctcttcctctccat

SEQ ID NO: 3595110 - DNA, 15 bp, Homo sapiens
gctccctgcctgttt

SEQ ID NO: 3595111 - DNA, 15 bp, Homo sapiens
gctccgcagggcgcc

SEQ ID NO: 3595112 - DNA, 15 bp, Homo sapiens
gctccgggcaccagg

SEQ ID NO: 3595113 - DNA, 17 bp, Homo sapiens
gctccgtagctctgctg

SEQ ID NO: 3595114 - DNA, 20 bp, Homo sapiens
gctccgtagctctgctgctg

SEQ ID NO: 3595115 - DNA, 21 bp, Homo sapiens
gctccgtggccccgccctcag

SEQ ID NO: 3595116 - DNA, 18 bp, Homo sapiens
gctcctacctgtctgctg

SEQ ID NO: 3595117 - DNA, 19 bp, Homo sapiens
gctcctacctgtctgctgc

SEQ ID NO: 3595118 - DNA, 22 bp, Homo sapiens
gctcctacctgtctgctgccag

SEQ ID NO: 3595119 - DNA, 13 bp, Homo sapiens
gctcctagaggga

SEQ ID NO: 3595120 - DNA, 18 bp, Homo sapiens
gctcctagagggaggggc

SEQ ID NO: 3595121 - DNA, 19 bp, Homo sapiens
gctcctagagggaggggcc

SEQ ID NO: 3595122 - DNA, 14 bp, Homo sapiens
gctcctcccggtgc

SEQ ID NO: 3595123 - DNA, 14 bp, Homo sapiens
gctcctcctcaccc

SEQ ID NO: 3595124 - DNA, 14 bp, Homo sapiens
gctcctcctccctg

SEQ ID NO: 3595125 - DNA, 18 bp, Homo sapiens
gctcctctccccagccca

SEQ ID NO: 3595126 - DNA, 21 bp, Homo sapiens
gctcctctccccagcccagag

SEQ ID NO: 3595127 - DNA, 23 bp, Homo sapiens
gctcctctccccagcccagagac

SEQ ID NO: 3595128 - DNA, 19 bp, Homo sapiens
gctcctcttagctcagctg

SEQ ID NO: 3595129 - DNA, 12 bp, Homo sapiens
gctcctcttgtt

SEQ ID NO: 3595130 - DNA, 18 bp, Homo sapiens
gctcctcttgttcctgaa

SEQ ID NO: 3595131 - DNA, 21 bp, Homo sapiens
gctcctcttgttcctgaaatg

SEQ ID NO: 3595132 - DNA, 22 bp, Homo sapiens
gctcctcttgttcctgaaatgt

SEQ ID NO: 3595133 - DNA, 17 bp, Homo sapiens
gctcctgcttttctgtc

SEQ ID NO: 3595134 - DNA, 19 bp, Homo sapiens
gctcctgcttttctgtcct

SEQ ID NO: 3595135 - DNA, 12 bp, Homo sapiens
gctcctgggccg

SEQ ID NO: 3595136 - DNA, 19 bp, Homo sapiens
gctccttggcacccccatg

SEQ ID NO: 3595137 - DNA, 12 bp, Homo sapiens
gctcgcccagca

SEQ ID NO: 3595138 - DNA, 15 bp, Homo sapiens
gctcgggccgtaggg

SEQ ID NO: 3595139 - DNA, 21 bp, Homo sapiens
gctgccttcggtacccaccac

SEQ ID NO: 3595140 - DNA, 19 bp, Homo sapiens
gctgcgaatctagaggagg

SEQ ID NO: 3595141 - DNA, 23 bp, Homo sapiens
gctgcgaatctagaggagggggc

SEQ ID NO: 3595142 - DNA, 23 bp, Homo sapiens
gctgctcccctaaagccaggctc

SEQ ID NO: 3595143 - DNA, 23 bp, Homo sapiens
gctgctcctagagggaggggcct

SEQ ID NO: 3595144 - DNA, 14 bp, Homo sapiens
gctgctctgcccca

SEQ ID NO: 3595145 - DNA, 17 bp, Homo sapiens
gctgctctgccccagct

SEQ ID NO: 3595146 - DNA, 15 bp, Homo sapiens
gctgctgaaggctca

SEQ ID NO: 3595147 - DNA, 23 bp, Homo sapiens
gctgctgcagctccctcctcagg

SEQ ID NO: 3595148 - DNA, 18 bp, Homo sapiens
gctgctgccagggcttcc

SEQ ID NO: 3595149 - DNA, 13 bp, Homo sapiens
gctgctgccctgc

SEQ ID NO: 3595150 - DNA, 14 bp, Homo sapiens
gctgctgccgccgc

SEQ ID NO: 3595151 - DNA, 13 bp, Homo sapiens
gctgctgccttca

SEQ ID NO: 3595152 - DNA, 20 bp, Homo sapiens
gctgctggggaagacagtgg

SEQ ID NO: 3595153 - DNA, 21 bp, Homo sapiens
gctgctggggaagacagtggc

SEQ ID NO: 3595154 - DNA, 16 bp, Homo sapiens
gctgctgggtggcagg

SEQ ID NO: 3595155 - DNA, 17 bp, Homo sapiens
gctggaaagttgggccc

SEQ ID NO: 3595156 - DNA, 14 bp, Homo sapiens
gctggaaggggcca

SEQ ID NO: 3595157 - DNA, 18 bp, Homo sapiens
gctggacatactgctgga

SEQ ID NO: 3595158 - DNA, 16 bp, Homo sapiens
gctggactattgtgcc

SEQ ID NO: 3595159 - DNA, 12 bp, Homo sapiens
gctggagtgagg

SEQ ID NO: 3595160 - DNA, 21 bp, Homo sapiens
gctggagtgtgagggtcctgc

SEQ ID NO: 3595161 - DNA, 16 bp, Homo sapiens
gctggattacaggcat

SEQ ID NO: 3595162 - DNA, 14 bp, Homo sapiens
gctggcaaccagcc

SEQ ID NO: 3595163 - DNA, 15 bp, Homo sapiens
gctggcacaaaagac

SEQ ID NO: 3595164 - DNA, 18 bp, Homo sapiens
gctggcacaaaagacagc

SEQ ID NO: 3595165 - DNA, 19 bp, Homo sapiens
gctggcacgtgacaggctc

SEQ ID NO: 3595166 - DNA, 16 bp, Homo sapiens
gctggcccagggccca

SEQ ID NO: 3595167 - DNA, 17 bp, Homo sapiens
gctggcccagggcccag

SEQ ID NO: 3595168 - DNA, 18 bp, Homo sapiens
gctggcccagggcccaga

SEQ ID NO: 3595169 - DNA, 19 bp, Homo sapiens
gctggcccccagccctggg

SEQ ID NO: 3595170 - DNA, 19 bp, Homo sapiens
gctggccctggctcccaca

SEQ ID NO: 3595171 - DNA, 19 bp, Homo sapiens
gctggccgcctgcagcccg

SEQ ID NO: 3595172 - DNA, 18 bp, Homo sapiens
gctggcggacgcagctgg

SEQ ID NO: 3595173 - DNA, 14 bp, Homo sapiens
gctggctgccttag

SEQ ID NO: 3595174 - DNA, 17 bp, Homo sapiens
gctggctgggccttcac

SEQ ID NO: 3595175 - DNA, 20 bp, Homo sapiens
gctgggaataagtgccagga

SEQ ID NO: 3595176 - DNA, 14 bp, Homo sapiens
gctgggagcctggt

SEQ ID NO: 3595177 - DNA, 15 bp, Homo sapiens
gctgggagctctgca

SEQ ID NO: 3595178 - DNA, 22 bp, Homo sapiens
gctgggattacaggcgtgagcc

SEQ ID NO: 3595179 - DNA, 14 bp, Homo sapiens
gctgggcagaggga

SEQ ID NO: 3595180 - DNA, 13 bp, Homo sapiens
gctgggccactgg

SEQ ID NO: 3595181 - DNA, 17 bp, Homo sapiens
gctgggccactggggac

SEQ ID NO: 3595182 - DNA, 18 bp, Homo sapiens
gctgggccactggggact

SEQ ID NO: 3595183 - DNA, 19 bp, Homo sapiens
gctgggccctctttccctg

SEQ ID NO: 3595184 - DNA, 13 bp, Homo sapiens
gctgggccttcac

SEQ ID NO: 3595185 - DNA, 13 bp, Homo sapiens
gctggggacagag

SEQ ID NO: 3595186 - DNA, 13 bp, Homo sapiens
gctggggactcag

SEQ ID NO: 3595187 - DNA, 20 bp, Homo sapiens
gctggggagccctattgctg

SEQ ID NO: 3595188 - DNA, 22 bp, Homo sapiens
gctggggagccctattgctgct

SEQ ID NO: 3595189 - DNA, 15 bp, Homo sapiens
gctggggatgcgcct

SEQ ID NO: 3595190 - DNA, 23 bp, Homo sapiens
gctggggccgccacggcctggct

SEQ ID NO: 3595191 - DNA, 14 bp, Homo sapiens
gctggggcctcaga

SEQ ID NO: 3595192 - DNA, 22 bp, Homo sapiens
gctgggggctgccgagccacca

SEQ ID NO: 3595193 - DNA, 15 bp, Homo sapiens
gctgggggtgggcca

SEQ ID NO: 3595194 - DNA, 19 bp, Homo sapiens
gctggtagatgctgaggcc

SEQ ID NO: 3595195 - DNA, 20 bp, Homo sapiens
gctggtagatgctgaggccc

SEQ ID NO: 3595196 - DNA, 13 bp, Homo sapiens
gctggtagcagca

SEQ ID NO: 3595197 - DNA, 18 bp, Homo sapiens
gctggtagcagcaggctc

SEQ ID NO: 3595198 - DNA, 23 bp, Homo sapiens
gctggtattggaatagcagcctc

SEQ ID NO: 3595199 - DNA, 19 bp, Homo sapiens
gctggtcctgcacatgagt

SEQ ID NO: 3595200 - DNA, 14 bp, Homo sapiens
gctggtggcccagg

SEQ ID NO: 3595201 - DNA, 14 bp, Homo sapiens
gctggtggcctctg

SEQ ID NO: 3595202 - DNA, 22 bp, Homo sapiens
gctggtgggaaggccggcagcg

SEQ ID NO: 3595203 - DNA, 21 bp, Homo sapiens
gctgtaactactttataacta

SEQ ID NO: 3595204 - DNA, 16 bp, Homo sapiens
gctgtaagggcagtgc

SEQ ID NO: 3595205 - DNA, 18 bp, Homo sapiens
gctgtacctgttcctccc

SEQ ID NO: 3595206 - DNA, 20 bp, Homo sapiens
gctgtactaacccagtcttt

SEQ ID NO: 3595207 - DNA, 20 bp, Homo sapiens
gctgtagacatttgctatga

SEQ ID NO: 3595208 - DNA, 21 bp, Homo sapiens
gctgtcacaggttttcagaga

SEQ ID NO: 3595209 - DNA, 17 bp, Homo sapiens
gctgtctccatgtttga

SEQ ID NO: 3595210 - DNA, 13 bp, Homo sapiens
gctgtctctgagg

SEQ ID NO: 3595211 - DNA, 17 bp, Homo sapiens
gctgtctttcttgctcc

SEQ ID NO: 3595212 - DNA, 19 bp, Homo sapiens
gctgtctttcttgctccct

SEQ ID NO: 3595213 - DNA, 22 bp, Homo sapiens
gctgtcttttctttgccatctc

SEQ ID NO: 3595214 - DNA, 16 bp, Homo sapiens
gctgtgcagcctgtcc

SEQ ID NO: 3595215 - DNA, 13 bp, Homo sapiens
gctgtgctctggc

SEQ ID NO: 3595216 - DNA, 13 bp, Homo sapiens
gctgtgctttgga

SEQ ID NO: 3595217 - DNA, 14 bp, Homo sapiens
gctgtgctttggaa

SEQ ID NO: 3595218 - DNA, 21 bp, Homo sapiens
gctgtggggaacacagctaca

SEQ ID NO: 3595219 - DNA, 18 bp, Homo sapiens
gctgtggggtcggagagg

SEQ ID NO: 3595220 - DNA, 17 bp, Homo sapiens
gctgtggggtcgggctc

SEQ ID NO: 3595221 - DNA, 23 bp, Homo sapiens
gctgtggtagggggtgtctcagg

SEQ ID NO: 3595222 - DNA, 13 bp, Homo sapiens
gctgtgtgtctgt

SEQ ID NO: 3595223 - DNA, 17 bp, Homo sapiens
gctgtgttaactgttca

SEQ ID NO: 3595224 - DNA, 17 bp, Homo sapiens
gctgttacagttttctt

SEQ ID NO: 3595225 - DNA, 19 bp, Homo sapiens
gctgttatttcttccctgc

SEQ ID NO: 3595226 - DNA, 15 bp, Homo sapiens
gctgttcacagccag

SEQ ID NO: 3595227 - DNA, 23 bp, Homo sapiens
gctgttcacagccagactggcac

SEQ ID NO: 3595228 - DNA, 21 bp, Homo sapiens
gctgttccattacaccacagc

SEQ ID NO: 3595229 - DNA, 19 bp, Homo sapiens
gctgttcttcagtcctttg

SEQ ID NO: 3595230 - DNA, 21 bp, Homo sapiens
gctgttcttcagtcctttgtc

SEQ ID NO: 3595231 - DNA, 22 bp, Homo sapiens
gctgttcttcagtcctttgtct

SEQ ID NO: 3595232 - DNA, 15 bp, Homo sapiens
gctgttgagggccaa

SEQ ID NO: 3595233 - DNA, 19 bp, Homo sapiens
gctgttgagggccaagaga

SEQ ID NO: 3595234 - DNA, 13 bp, Homo sapiens
gctgtttcctagc

SEQ ID NO: 3595235 - DNA, 13 bp, Homo sapiens
gcttaaaacactt

SEQ ID NO: 3595236 - DNA, 19 bp, Homo sapiens
gcttaccagggtctttgca

SEQ ID NO: 3595237 - DNA, 23 bp, Homo sapiens
gcttaggagacagatcactcctg

SEQ ID NO: 3595238 - DNA, 12 bp, Homo sapiens
gcttatacactt

SEQ ID NO: 3595239 - DNA, 15 bp, Homo sapiens
gcttcaaaaagccac

SEQ ID NO: 3595240 - DNA, 23 bp, Homo sapiens
gcttcaaaaagccacagcagagc

SEQ ID NO: 3595241 - DNA, 15 bp, Homo sapiens
gcttcaacagccaag

SEQ ID NO: 3595242 - DNA, 20 bp, Homo sapiens
gcttcaccccaatcccagct

SEQ ID NO: 3595243 - DNA, 22 bp, Homo sapiens
gcttcagccaggtctgactcca

SEQ ID NO: 3595244 - DNA, 18 bp, Homo sapiens
gcttcagttcagctttaa

SEQ ID NO: 3595245 - DNA, 18 bp, Homo sapiens
gcttccatgatgcacagt

SEQ ID NO: 3595246 - DNA, 13 bp, Homo sapiens
gcttcccaacaga

SEQ ID NO: 3595247 - DNA, 14 bp, Homo sapiens
gcttccccactccc

SEQ ID NO: 3595248 - DNA, 15 bp, Homo sapiens
gcttcccgctcagcc

SEQ ID NO: 3595249 - DNA, 16 bp, Homo sapiens
gcttcccgctcagccc

SEQ ID NO: 3595250 - DNA, 15 bp, Homo sapiens
gcttccctaaactgc

SEQ ID NO: 3595251 - DNA, 20 bp, Homo sapiens
gcttccctcccctctagttt

SEQ ID NO: 3595252 - DNA, 11 bp, Homo sapiens
gcttccctgga

SEQ ID NO: 3595253 - DNA, 18 bp, Homo sapiens
gcttcctcacacccctgt

SEQ ID NO: 3595254 - DNA, 13 bp, Homo sapiens
gcttctaaaacaa

SEQ ID NO: 3595255 - DNA, 14 bp, Homo sapiens
gcttctaaaacaat

SEQ ID NO: 3595256 - DNA, 14 bp, Homo sapiens
gcttctaatattag

SEQ ID NO: 3595257 - DNA, 14 bp, Homo sapiens
gcttctcacggcct

SEQ ID NO: 3595258 - DNA, 23 bp, Homo sapiens
gcttctcccagtgtgagacccca

SEQ ID NO: 3595259 - DNA, 17 bp, Homo sapiens
gcttctccttctccttc

SEQ ID NO: 3595260 - DNA, 13 bp, Homo sapiens
gcttctctctcca

SEQ ID NO: 3595261 - DNA, 15 bp, Homo sapiens
gcttctctctccagg

SEQ ID NO: 3595262 - DNA, 11 bp, Homo sapiens
gcttctctgca

SEQ ID NO: 3595263 - DNA, 15 bp, Homo sapiens
gcttctctgcagtaa

SEQ ID NO: 3595264 - DNA, 21 bp, Homo sapiens
gcttctgaagctgctgcagct

SEQ ID NO: 3595265 - DNA, 21 bp, Homo sapiens
gcttcttattaatcatacaaa

SEQ ID NO: 3595266 - DNA, 18 bp, Homo sapiens
gcttcttcacaggcactc

SEQ ID NO: 3595267 - DNA, 12 bp, Homo sapiens
gcttctttctag

SEQ ID NO: 3595268 - DNA, 20 bp, Homo sapiens
gcttgaacctgggaggcaga

SEQ ID NO: 3595269 - DNA, 17 bp, Homo sapiens
gcttgaatggtttttct

SEQ ID NO: 3595270 - DNA, 15 bp, Homo sapiens
gcttgactttccaga

SEQ ID NO: 3595271 - DNA, 16 bp, Homo sapiens
gcttgcatggagaatg

SEQ ID NO: 3595272 - DNA, 13 bp, Homo sapiens
ggcacagtgggag

SEQ ID NO: 3595273 - DNA, 18 bp, Homo sapiens
ggcacatgccacctggca

SEQ ID NO: 3595274 - DNA, 20 bp, Homo sapiens
ggcaccagacacccaggact

SEQ ID NO: 3595275 - DNA, 15 bp, Homo sapiens
ggcaccaggggccaa

SEQ ID NO: 3595276 - DNA, 15 bp, Homo sapiens
ggcaccatcagcctg

SEQ ID NO: 3595277 - DNA, 17 bp, Homo sapiens
ggcacccccacaagctg

SEQ ID NO: 3595278 - DNA, 15 bp, Homo sapiens
ggcacccccatgctg

SEQ ID NO: 3595279 - DNA, 19 bp, Homo sapiens
ggcaccgccacgtcccagc

SEQ ID NO: 3595280 - DNA, 17 bp, Homo sapiens
ggcaccgtccaggcccc

SEQ ID NO: 3595281 - DNA, 15 bp, Homo sapiens
ggcacgtgacaggct

SEQ ID NO: 3595282 - DNA, 20 bp, Homo sapiens
ggcactccaaacctgtcttg

SEQ ID NO: 3595283 - DNA, 22 bp, Homo sapiens
ggcagagcctttttacctggcc

SEQ ID NO: 3595284 - DNA, 13 bp, Homo sapiens
ggcagagttacag

SEQ ID NO: 3595285 - DNA, 14 bp, Homo sapiens
ggcagatccaggac

SEQ ID NO: 3595286 - DNA, 19 bp, Homo sapiens
ggcagatctcccacatgcc

SEQ ID NO: 3595287 - DNA, 15 bp, Homo sapiens
ggcagcaatttaaat

SEQ ID NO: 3595288 - DNA, 19 bp, Homo sapiens
ggcagcaccgcctcttccc

SEQ ID NO: 3595289 - DNA, 23 bp, Homo sapiens
ggcagcactccccagagctgtgc

SEQ ID NO: 3595290 - DNA, 12 bp, Homo sapiens
ggcagcaggcca

SEQ ID NO: 3595291 - DNA, 15 bp, Homo sapiens
ggcagcaggccagag

SEQ ID NO: 3595292 - DNA, 18 bp, Homo sapiens
ggcagcaggccagagaaa

SEQ ID NO: 3595293 - DNA, 18 bp, Homo sapiens
ggcagcatgcttgggctg

SEQ ID NO: 3595294 - DNA, 23 bp, Homo sapiens
ggcagcatgcttgggctgaccca

SEQ ID NO: 3595295 - DNA, 12 bp, Homo sapiens
ggcagccagcag

SEQ ID NO: 3595296 - DNA, 13 bp, Homo sapiens
ggcagccagcaga

SEQ ID NO: 3595297 - DNA, 15 bp, Homo sapiens
ggcagccatgataat

SEQ ID NO: 3595298 - DNA, 15 bp, Homo sapiens
ggcagcgaccccagg

SEQ ID NO: 3595299 - DNA, 21 bp, Homo sapiens
ggcagcgcacgcggatgctac

SEQ ID NO: 3595300 - DNA, 18 bp, Homo sapiens
ggcagcgcatgtgtgcat

SEQ ID NO: 3595301 - DNA, 23 bp, Homo sapiens
ggcagcgggcggaggggatccag

SEQ ID NO: 3595302 - DNA, 16 bp, Homo sapiens
ggcagctagtgccttt

SEQ ID NO: 3595303 - DNA, 20 bp, Homo sapiens
ggcagctatttcagcctcct

SEQ ID NO: 3595304 - DNA, 14 bp, Homo sapiens
ggcagctcctgacc

SEQ ID NO: 3595305 - DNA, 12 bp, Homo sapiens
ggcagctggccc

SEQ ID NO: 3595306 - DNA, 20 bp, Homo sapiens
ggcagctggcccccagccct

SEQ ID NO: 3595307 - DNA, 22 bp, Homo sapiens
ggcagctggcccccagccctgg

SEQ ID NO: 3595308 - DNA, 13 bp, Homo sapiens
ggcagcttgctgg

SEQ ID NO: 3595309 - DNA, 17 bp, Homo sapiens
ggcagcttgctgggctt

SEQ ID NO: 3595310 - DNA, 14 bp, Homo sapiens
ggcagcttgtgaag

SEQ ID NO: 3595311 - DNA, 18 bp, Homo sapiens
ggcaggaaagccacatct

SEQ ID NO: 3595312 - DNA, 14 bp, Homo sapiens
ggcaggactcctgg

SEQ ID NO: 3595313 - DNA, 15 bp, Homo sapiens
ggcaggactcctggc

SEQ ID NO: 3595314 - DNA, 16 bp, Homo sapiens
ggcaggactcctggca

SEQ ID NO: 3595315 - DNA, 23 bp, Homo sapiens
ggcaggactcctggcagggccac

SEQ ID NO: 3595316 - DNA, 19 bp, Homo sapiens
ggcaggagtgggctctgag

SEQ ID NO: 3595317 - DNA, 20 bp, Homo sapiens
ggcaggagtgggctctgagc

SEQ ID NO: 3595318 - DNA, 19 bp, Homo sapiens
ggcaggcggctcctcctca

SEQ ID NO: 3595319 - DNA, 18 bp, Homo sapiens
ggcagggaaggacaggac

SEQ ID NO: 3595320 - DNA, 13 bp, Homo sapiens
ggcagggagagag

SEQ ID NO: 3595321 - DNA, 17 bp, Homo sapiens
ggcagggcccacgtgta

SEQ ID NO: 3595322 - DNA, 19 bp, Homo sapiens
ggcagggggacagcaggga

SEQ ID NO: 3595323 - DNA, 17 bp, Homo sapiens
ggcagggggccctgccc

SEQ ID NO: 3595324 - DNA, 18 bp, Homo sapiens
ggcagggggccctgcccc

SEQ ID NO: 3595325 - DNA, 21 bp, Homo sapiens
ggcaggtgcttttggcagaga

SEQ ID NO: 3595326 - DNA, 22 bp, Homo sapiens
ggcaggtgcttttggcagagac

SEQ ID NO: 3595327 - DNA, 14 bp, Homo sapiens
ggcagtcctggagg

SEQ ID NO: 3595328 - DNA, 18 bp, Homo sapiens
ggcagtcctggaggcagg

SEQ ID NO: 3595329 - DNA, 17 bp, Homo sapiens
ggcagtccttactcccc

SEQ ID NO: 3595330 - DNA, 16 bp, Homo sapiens
ggcagtgactccccag

SEQ ID NO: 3595331 - DNA, 20 bp, Homo sapiens
ggcagtgactccccagccca

SEQ ID NO: 3595332 - DNA, 14 bp, Homo sapiens
ggcagtgattctgt

SEQ ID NO: 3595333 - DNA, 17 bp, Homo sapiens
ggcagtggcaggggagc

SEQ ID NO: 3595334 - DNA, 19 bp, Homo sapiens
ggcagtgggtggatcctgg

SEQ ID NO: 3595335 - DNA, 20 bp, Homo sapiens
ggcagttccttacctccctg

SEQ ID NO: 3595336 - DNA, 20 bp, Homo sapiens
ggcatcaagggagacaccag

SEQ ID NO: 3595337 - DNA, 15 bp, Homo sapiens
ggcatcgtggtgggg

SEQ ID NO: 3595338 - DNA, 13 bp, Homo sapiens
ggcatgagctctt

SEQ ID NO: 3595339 - DNA, 17 bp, Homo sapiens
ggcatgagctcttggca

SEQ ID NO: 3595340 - DNA, 14 bp, Homo sapiens
ggcatggcaggagt

SEQ ID NO: 3595341 - DNA, 18 bp, Homo sapiens
ggcatggccaggtggcca

SEQ ID NO: 3595342 - DNA, 14 bp, Homo sapiens
ggcatggctgggaa

SEQ ID NO: 3595343 - DNA, 17 bp, Homo sapiens
ggcatgggtccagggcc

SEQ ID NO: 3595344 - DNA, 18 bp, Homo sapiens
ggcatgggtccagggcct

SEQ ID NO: 3595345 - DNA, 19 bp, Homo sapiens
ggcatggtcccttaaggca

SEQ ID NO: 3595346 - DNA, 18 bp, Homo sapiens
ggcattagcaaggcagag

SEQ ID NO: 3595347 - DNA, 21 bp, Homo sapiens
ggcattagcaaggcagagcct

SEQ ID NO: 3595348 - DNA, 23 bp, Homo sapiens
ggcatttgtttctttctctgagg

SEQ ID NO: 3595349 - DNA, 14 bp, Homo sapiens
ggcattttaagtaa

SEQ ID NO: 3595350 - DNA, 16 bp, Homo sapiens
ggccaaaatcaagagt

SEQ ID NO: 3595351 - DNA, 14 bp, Homo sapiens
ggccaacaaagaac

SEQ ID NO: 3595352 - DNA, 14 bp, Homo sapiens
ggccaaccagcccg

SEQ ID NO: 3595353 - DNA, 18 bp, Homo sapiens
ggccaacctcaggctcct

SEQ ID NO: 3595354 - DNA, 21 bp, Homo sapiens
ggccaactgcaaaaaaagcct

SEQ ID NO: 3595355 - DNA, 15 bp, Homo sapiens
ggccaagagatctgt

SEQ ID NO: 3595356 - DNA, 16 bp, Homo sapiens
ggccaagagatctgtg

SEQ ID NO: 3595357 - DNA, 19 bp, Homo sapiens
ggccaagagatctgtgtgg

SEQ ID NO: 3595358 - DNA, 15 bp, Homo sapiens
ggccaaggagctgct

SEQ ID NO: 3595359 - DNA, 12 bp, Homo sapiens
ggccaaggtgcc

SEQ ID NO: 3595360 - DNA, 15 bp, Homo sapiens
ggccacacccaggaa

SEQ ID NO: 3595361 - DNA, 18 bp, Homo sapiens
ggccacacgtggctggcg

SEQ ID NO: 3595362 - DNA, 23 bp, Homo sapiens
ggccacagactgacccccatctg

SEQ ID NO: 3595363 - DNA, 22 bp, Homo sapiens
ggccacagtggggctgcaggca

SEQ ID NO: 3595364 - DNA, 14 bp, Homo sapiens
ggccacatcagccc

SEQ ID NO: 3595365 - DNA, 16 bp, Homo sapiens
ggccacatcagcccca

SEQ ID NO: 3595366 - DNA, 16 bp, Homo sapiens
ggccacattgctggct

SEQ ID NO: 3595367 - DNA, 18 bp, Homo sapiens
ggccacattgctggctgc

SEQ ID NO: 3595368 - DNA, 19 bp, Homo sapiens
ggccacattgctggctgcc

SEQ ID NO: 3595369 - DNA, 20 bp, Homo sapiens
ggccaccacctttggctggt

SEQ ID NO: 3595370 - DNA, 19 bp, Homo sapiens
ggccaccccaaaccccagc

SEQ ID NO: 3595371 - DNA, 18 bp, Homo sapiens
ggccaccggtgggcagtg

SEQ ID NO: 3595372 - DNA, 14 bp, Homo sapiens
ggccactaaagctt

SEQ ID NO: 3595373 - DNA, 18 bp, Homo sapiens
ggccactaaagcttcaga

SEQ ID NO: 3595374 - DNA, 20 bp, Homo sapiens
ggccactaagcagaggaggg

SEQ ID NO: 3595375 - DNA, 21 bp, Homo sapiens
ggccactaagcagaggagggg

SEQ ID NO: 3595376 - DNA, 12 bp, Homo sapiens
ggccactgggga

SEQ ID NO: 3595377 - DNA, 20 bp, Homo sapiens
ggccactggggactttattt

SEQ ID NO: 3595378 - DNA, 21 bp, Homo sapiens
ggccagaaaggtgtgaggaga

SEQ ID NO: 3595379 - DNA, 17 bp, Homo sapiens
ggccagacacaggccct

SEQ ID NO: 3595380 - DNA, 23 bp, Homo sapiens
ggccagacccacgggctcatgca

SEQ ID NO: 3595381 - DNA, 18 bp, Homo sapiens
ggccagagaaagcaaagg

SEQ ID NO: 3595382 - DNA, 23 bp, Homo sapiens
ggccagagagggaaaaggcaggt

SEQ ID NO: 3595383 - DNA, 13 bp, Homo sapiens
ggccagagccagg

SEQ ID NO: 3595384 - DNA, 13 bp, Homo sapiens
ggccagatccagc

SEQ ID NO: 3595385 - DNA, 17 bp, Homo sapiens
ggccagatccagcctgg

SEQ ID NO: 3595386 - DNA, 20 bp, Homo sapiens
ggccagatgcacatccctgg

SEQ ID NO: 3595387 - DNA, 23 bp, Homo sapiens
ggccagatgcacatccctggaag

SEQ ID NO: 3595388 - DNA, 14 bp, Homo sapiens
ggccagcccagcca

SEQ ID NO: 3595389 - DNA, 14 bp, Homo sapiens
ggccagctctggag

SEQ ID NO: 3595390 - DNA, 20 bp, Homo sapiens
ggccaggcaggagcccttct

SEQ ID NO: 3595391 - DNA, 17 bp, Homo sapiens
ggccaggccgcgcccag

SEQ ID NO: 3595392 - DNA, 11 bp, Homo sapiens
ggccaggcctt

SEQ ID NO: 3595393 - DNA, 22 bp, Homo sapiens
ggccaggccttacatctggctg

SEQ ID NO: 3595394 - DNA, 15 bp, Homo sapiens
ggccagggagaagct

SEQ ID NO: 3595395 - DNA, 16 bp, Homo sapiens
ggccagggagaagctc

SEQ ID NO: 3595396 - DNA, 17 bp, Homo sapiens
ggccagggagaagctcc

SEQ ID NO: 3595397 - DNA, 22 bp, Homo sapiens
ggccagtgcagtttggtgtgtc

SEQ ID NO: 3595398 - DNA, 22 bp, Homo sapiens
ggccagtggccttccccagcat

SEQ ID NO: 3595399 - DNA, 18 bp, Homo sapiens
ggccataaacggttcctg

SEQ ID NO: 3595400 - DNA, 21 bp, Homo sapiens
ggccatctgactgccaagcca

SEQ ID NO: 3595401 - DNA, 23 bp, Homo sapiens
ggccatctgactgccaagccaga

SEQ ID NO: 3595402 - DNA, 15 bp, Homo sapiens
ggccatcttctttct

SEQ ID NO: 3595403 - DNA, 17 bp, Homo sapiens
ggccatgcctcctcagg

SEQ ID NO: 3595404 - DNA, 23 bp, Homo sapiens
gggctggagaaagagctgcctgg

SEQ ID NO: 3595405 - DNA, 24 bp, Homo sapiens
gggctggagaaagagctgcctgga

SEQ ID NO: 3595406 - DNA, 16 bp, Homo sapiens
gggctgggagctctgc

SEQ ID NO: 3595407 - DNA, 18 bp, Homo sapiens
gggctgggagctctgcag

SEQ ID NO: 3595408 - DNA, 19 bp, Homo sapiens
gggctggggacagagggtg

SEQ ID NO: 3595409 - DNA, 13 bp, Homo sapiens
gggctggggcctc

SEQ ID NO: 3595410 - DNA, 14 bp, Homo sapiens
gggctgtgccaacc

SEQ ID NO: 3595411 - DNA, 20 bp, Homo sapiens
gggcttataataaaggactg

SEQ ID NO: 3595412 - DNA, 17 bp, Homo sapiens
gggctttctcttcccct

SEQ ID NO: 3595413 - DNA, 22 bp, Homo sapiens
gggctttctcttccccttcctg

SEQ ID NO: 3595414 - DNA, 17 bp, Homo sapiens
gggctttggttccttct

SEQ ID NO: 3595415 - DNA, 16 bp, Homo sapiens
ggggaactggcagcgc

SEQ ID NO: 3595416 - DNA, 16 bp, Homo sapiens
ggggaagacagtggcc

SEQ ID NO: 3595417 - DNA, 17 bp, Homo sapiens
ggggaagacagtggccc

SEQ ID NO: 3595418 - DNA, 18 bp, Homo sapiens
ggggaattccctccccct

SEQ ID NO: 3595419 - DNA, 18 bp, Homo sapiens
ggggaccaattctggaca

SEQ ID NO: 3595420 - DNA, 24 bp, Homo sapiens
ggggacccaaaccccctgcagccc

SEQ ID NO: 3595421 - DNA, 12 bp, Homo sapiens
ggggaccccact

SEQ ID NO: 3595422 - DNA, 22 bp, Homo sapiens
ggggactcggagggtgccgtgc

SEQ ID NO: 3595423 - DNA, 13 bp, Homo sapiens
ggggactgccttg

SEQ ID NO: 3595424 - DNA, 17 bp, Homo sapiens
ggggagggaagggagcc

SEQ ID NO: 3595425 - DNA, 14 bp, Homo sapiens
ggggagggtgacag

SEQ ID NO: 3595426 - DNA, 13 bp, Homo sapiens
ggggagtggaata

SEQ ID NO: 3595427 - DNA, 18 bp, Homo sapiens
ggggagtggttaggcagc

SEQ ID NO: 3595428 - DNA, 22 bp, Homo sapiens
ggggagtggttaggcagcaagc

SEQ ID NO: 3595429 - DNA, 17 bp, Homo sapiens
ggggagttaagacctgg

SEQ ID NO: 3595430 - DNA, 21 bp, Homo sapiens
ggggagttaagacctggcagc

SEQ ID NO: 3595431 - DNA, 13 bp, Homo sapiens
ggggatccagcca

SEQ ID NO: 3595432 - DNA, 21 bp, Homo sapiens
ggggatccagccacttccccc

SEQ ID NO: 3595433 - DNA, 21 bp, Homo sapiens
ggggatccctcccccccatgc

SEQ ID NO: 3595434 - DNA, 23 bp, Homo sapiens
ggggatgttctgcctctccctgg

SEQ ID NO: 3595435 - DNA, 18 bp, Homo sapiens
ggggattgcccctggctt

SEQ ID NO: 3595436 - DNA, 12 bp, Homo sapiens
ggggcaagacag

SEQ ID NO: 3595437 - DNA, 16 bp, Homo sapiens
ggggcagcactcccca

SEQ ID NO: 3595438 - DNA, 21 bp, Homo sapiens
ggggcaggaaagccacatctt

SEQ ID NO: 3595439 - DNA, 19 bp, Homo sapiens
ggggcaggattctctgcag

SEQ ID NO: 3595440 - DNA, 22 bp, Homo sapiens
ggggcaggattctctgcagccc

SEQ ID NO: 3595441 - DNA, 14 bp, Homo sapiens
ggggcaggctgagg

SEQ ID NO: 3595442 - DNA, 18 bp, Homo sapiens
ggggcagggaaggacagg

SEQ ID NO: 3595443 - DNA, 17 bp, Homo sapiens
ggggccaacctcaggct

SEQ ID NO: 3595444 - DNA, 19 bp, Homo sapiens
ggggccaacctcaggctcc

SEQ ID NO: 3595445 - DNA, 20 bp, Homo sapiens
ggggccaacctcaggctcct

SEQ ID NO: 3595446 - DNA, 12 bp, Homo sapiens
ggggccaggaaa

SEQ ID NO: 3595447 - DNA, 17 bp, Homo sapiens
ggggccatgcctcctca

SEQ ID NO: 3595448 - DNA, 13 bp, Homo sapiens
ggggcccaagtgg

SEQ ID NO: 3595449 - DNA, 14 bp, Homo sapiens
ggggccccgccagg

SEQ ID NO: 3595450 - DNA, 17 bp, Homo sapiens
ggggccccgccagggct

SEQ ID NO: 3595451 - DNA, 19 bp, Homo sapiens
ggggccccgccagggctgg

SEQ ID NO: 3595452 - DNA, 22 bp, Homo sapiens
ggggccccgccagggctgggga

SEQ ID NO: 3595453 - DNA, 16 bp, Homo sapiens
ggggcccgacaggtgg

SEQ ID NO: 3595454 - DNA, 12 bp, Homo sapiens
ggggccctgccc

SEQ ID NO: 3595455 - DNA, 20 bp, Homo sapiens
ggggcctaggcctcagccag

SEQ ID NO: 3595456 - DNA, 14 bp, Homo sapiens
ggggcctcaggctc

SEQ ID NO: 3595457 - DNA, 15 bp, Homo sapiens
ggggcctcaggctcc

SEQ ID NO: 3595458 - DNA, 15 bp, Homo sapiens
ggggcctgcagaagg

SEQ ID NO: 3595459 - DNA, 21 bp, Homo sapiens
ggggcctgcagaaggaaagaa

SEQ ID NO: 3595460 - DNA, 12 bp, Homo sapiens
ggggcctggagg

SEQ ID NO: 3595461 - DNA, 21 bp, Homo sapiens
ggggcctggaggtctggctga

SEQ ID NO: 3595462 - DNA, 12 bp, Homo sapiens
ggggcctggcag

SEQ ID NO: 3595463 - DNA, 20 bp, Homo sapiens
ggggcctttgggtgctgttt

SEQ ID NO: 3595464 - DNA, 17 bp, Homo sapiens
ggggctctgtggcaaaa

SEQ ID NO: 3595465 - DNA, 17 bp, Homo sapiens
ggggctgacctttcaaa

SEQ ID NO: 3595466 - DNA, 18 bp, Homo sapiens
ggggctgagccctcctga

SEQ ID NO: 3595467 - DNA, 23 bp, Homo sapiens
ggggctgagccctcctgagggcc

SEQ ID NO: 3595468 - DNA, 15 bp, Homo sapiens
ggggctgaggagcag

SEQ ID NO: 3595469 - DNA, 19 bp, Homo sapiens
ggggctgcacctcctaccc

SEQ ID NO: 3595470 - DNA, 20 bp, Homo sapiens
ggggcttataataaaggact

SEQ ID NO: 3595471 - DNA, 16 bp, Homo sapiens
ggggcttttgccactc

SEQ ID NO: 3595472 - DNA, 12 bp, Homo sapiens
gggggccccacc

SEQ ID NO: 3595473 - DNA, 18 bp, Homo sapiens
gggggccccgccagggct

SEQ ID NO: 3595474 - DNA, 23 bp, Homo sapiens
gggggcccgacaggtgggcctgg

SEQ ID NO: 3595475 - DNA, 13 bp, Homo sapiens
gggggccctgcta

SEQ ID NO: 3595476 - DNA, 12 bp, Homo sapiens
gggggctggggg

SEQ ID NO: 3595477 - DNA, 12 bp, Homo sapiens
gggggctgtgcc

SEQ ID NO: 3595478 - DNA, 18 bp, Homo sapiens
gggggctgtgccaacctg

SEQ ID NO: 3595479 - DNA, 22 bp, Homo sapiens
gggggtcctctctgagtcaaat

SEQ ID NO: 3595480 - DNA, 14 bp, Homo sapiens
gggggtgggggtgc

SEQ ID NO: 3595481 - DNA, 23 bp, Homo sapiens
ggggtaaagcagttcctgtccca

SEQ ID NO: 3595482 - DNA, 12 bp, Homo sapiens
ggggtccctgca

SEQ ID NO: 3595483 - DNA, 13 bp, Homo sapiens
ggggtcctggcca

SEQ ID NO: 3595484 - DNA, 22 bp, Homo sapiens
ggggtgcggcggtcccagctcc

SEQ ID NO: 3595485 - DNA, 13 bp, Homo sapiens
ggggtgctctctc

SEQ ID NO: 3595486 - DNA, 16 bp, Homo sapiens
ggggtggggtcatgcc

SEQ ID NO: 3595487 - DNA, 16 bp, Homo sapiens
ggggtgtaacttcctg

SEQ ID NO: 3595488 - DNA, 21 bp, Homo sapiens
ggggttgcgtctgaggcctgc

SEQ ID NO: 3595489 - DNA, 24 bp, Homo sapiens
gggtaggggaagaagagctatcag

SEQ ID NO: 3595490 - DNA, 15 bp, Homo sapiens
gggtcagcatccagt

SEQ ID NO: 3595491 - DNA, 21 bp, Homo sapiens
gggtcatctgtacctctgcct

SEQ ID NO: 3595492 - DNA, 14 bp, Homo sapiens
gggtcatgccctcc

SEQ ID NO: 3595493 - DNA, 16 bp, Homo sapiens
gggtcatgccctcctc

SEQ ID NO: 3595494 - DNA, 13 bp, Homo sapiens
gggtccacagctg

SEQ ID NO: 3595495 - DNA, 15 bp, Homo sapiens
gggtccacagctgga

SEQ ID NO: 3595496 - DNA, 16 bp, Homo sapiens
gggtccacctggagag

SEQ ID NO: 3595497 - DNA, 14 bp, Homo sapiens
gggtccagggaggg

SEQ ID NO: 3595498 - DNA, 12 bp, Homo sapiens
gggtccagggcc

SEQ ID NO: 3595499 - DNA, 13 bp, Homo sapiens
gggtcctctctga

SEQ ID NO: 3595500 - DNA, 14 bp, Homo sapiens
gggtcctctctgag

SEQ ID NO: 3595501 - DNA, 23 bp, Homo sapiens
gggtcctctctgagtcaaatcca

SEQ ID NO: 3595502 - DNA, 14 bp, Homo sapiens
gggtcctcttttcc

SEQ ID NO: 3595503 - DNA, 23 bp, Homo sapiens
gggtcctcttttcctggcagctg

SEQ ID NO: 3595504 - DNA, 19 bp, Homo sapiens
gggtcctgcagcctgcagg

SEQ ID NO: 3595505 - DNA, 23 bp, Homo sapiens
gggtcctgcagcctgcaggacct

SEQ ID NO: 3595506 - DNA, 13 bp, Homo sapiens
gggtcctggccat

SEQ ID NO: 3595507 - DNA, 15 bp, Homo sapiens
gggtcctggccatcc

SEQ ID NO: 3595508 - DNA, 16 bp, Homo sapiens
gggtcctggccatccc

SEQ ID NO: 3595509 - DNA, 15 bp, Homo sapiens
gggtcctgggggcag

SEQ ID NO: 3595510 - DNA, 19 bp, Homo sapiens
gggtccttttgacactgct

SEQ ID NO: 3595511 - DNA, 18 bp, Homo sapiens
gggtctcccctcctgcac

SEQ ID NO: 3595512 - DNA, 17 bp, Homo sapiens
gggtctcctcaggacca

SEQ ID NO: 3595513 - DNA, 18 bp, Homo sapiens
gggtctctctccaggtca

SEQ ID NO: 3595514 - DNA, 19 bp, Homo sapiens
gggtctctctccaggtcag

SEQ ID NO: 3595515 - DNA, 20 bp, Homo sapiens
gggtctggagttgatctgga

SEQ ID NO: 3595516 - DNA, 22 bp, Homo sapiens
gggtctggagttgatctggaac

SEQ ID NO: 3595517 - DNA, 21 bp, Homo sapiens
gggtctggtctcctcagcctc

SEQ ID NO: 3595518 - DNA, 19 bp, Homo sapiens
gggtctttcttgggatagt

SEQ ID NO: 3595519 - DNA, 13 bp, Homo sapiens
gggtgagagagga

SEQ ID NO: 3595520 - DNA, 15 bp, Homo sapiens
gggtgaggagctggg

SEQ ID NO: 3595521 - DNA, 18 bp, Homo sapiens
gggtgaggataggacaga

SEQ ID NO: 3595522 - DNA, 17 bp, Homo sapiens
gggtgcagaagctgtgg

SEQ ID NO: 3595523 - DNA, 18 bp, Homo sapiens
gggtgccgctctctctga

SEQ ID NO: 3595524 - DNA, 21 bp, Homo sapiens
gggtgccgctttctctgaggg

SEQ ID NO: 3595525 - DNA, 15 bp, Homo sapiens
gggtgggcagttttt

SEQ ID NO: 3595526 - DNA, 23 bp, Homo sapiens
gggtgggctttgttgtgagaatg

SEQ ID NO: 3595527 - DNA, 13 bp, Homo sapiens
gggtgggggtgct

SEQ ID NO: 3595528 - DNA, 17 bp, Homo sapiens
gggtggggtcatgccct

SEQ ID NO: 3595529 - DNA, 21 bp, Homo sapiens
gggtggggtcatgccctcctc

SEQ ID NO: 3595530 - DNA, 16 bp, Homo sapiens
gggtgtaacttcctgc

SEQ ID NO: 3595531 - DNA, 21 bp, Homo sapiens
gggttaaatattttgctaact

SEQ ID NO: 3595532 - DNA, 22 bp, Homo sapiens
gggttcaagcaatcctcctacc

SEQ ID NO: 3595533 - DNA, 20 bp, Homo sapiens
gggttgctggtcctgcacat

SEQ ID NO: 3595534 - DNA, 21 bp, Homo sapiens
gggttgctggtcctgcacatg

SEQ ID NO: 3595535 - DNA, 23 bp, Homo sapiens
gggttggacgggatgacctccag

SEQ ID NO: 3595536 - DNA, 21 bp, Homo sapiens
gtccttttgggaagaatccag

SEQ ID NO: 3595537 - DNA, 18 bp, Homo sapiens
gtcgaaggggaggcacac

SEQ ID NO: 3595538 - DNA, 22 bp, Homo sapiens
gtcgaggccacattgctggctg

SEQ ID NO: 3595539 - DNA, 16 bp, Homo sapiens
gtcgccaaaaatacag

SEQ ID NO: 3595540 - DNA, 20 bp, Homo sapiens
gtcgcctgcctgcagcaggc

SEQ ID NO: 3595541 - DNA, 16 bp, Homo sapiens
gtcggagtgcctggag

SEQ ID NO: 3595542 - DNA, 14 bp, Homo sapiens
gtcgggcagccagc

SEQ ID NO: 3595543 - DNA, 22 bp, Homo sapiens
gtcgtcttgaacgagcagccca

SEQ ID NO: 3595544 - DNA, 23 bp, Homo sapiens
gtcgtcttgaacgagcagcccag

SEQ ID NO: 3595545 - DNA, 17 bp, Homo sapiens
gtctaaattttctaaat

SEQ ID NO: 3595546 - DNA, 20 bp, Homo sapiens
gtctaatgattcaaatgttt

SEQ ID NO: 3595547 - DNA, 21 bp, Homo sapiens
gtctacgggggcacttggagg

SEQ ID NO: 3595548 - DNA, 15 bp, Homo sapiens
gtctactgcaagagc

SEQ ID NO: 3595549 - DNA, 15 bp, Homo sapiens
gtctagagagaacca

SEQ ID NO: 3595550 - DNA, 13 bp, Homo sapiens
gtctagagaggga

SEQ ID NO: 3595551 - DNA, 15 bp, Homo sapiens
gtctagagagggagg

SEQ ID NO: 3595552 - DNA, 21 bp, Homo sapiens
gtctagagagggaggcaagcc

SEQ ID NO: 3595553 - DNA, 16 bp, Homo sapiens
gtctagatggctcctc

SEQ ID NO: 3595554 - DNA, 18 bp, Homo sapiens
gtctagatggctcctctc

SEQ ID NO: 3595555 - DNA, 19 bp, Homo sapiens
gtctagatggctcctctca

SEQ ID NO: 3595556 - DNA, 16 bp, Homo sapiens
gtctatctgtgaacgt

SEQ ID NO: 3595557 - DNA, 20 bp, Homo sapiens
gtctattttgtaactgtaaa

SEQ ID NO: 3595558 - DNA, 16 bp, Homo sapiens
gtctcaaactcctgac

SEQ ID NO: 3595559 - DNA, 17 bp, Homo sapiens
gtctcaagagggcactg

SEQ ID NO: 3595560 - DNA, 22 bp, Homo sapiens
gtctcaagagggcactggtggc

SEQ ID NO: 3595561 - DNA, 19 bp, Homo sapiens
gtctcacctggacttaagc

SEQ ID NO: 3595562 - DNA, 20 bp, Homo sapiens
gtctcacgcagccagtgcac

SEQ ID NO: 3595563 - DNA, 16 bp, Homo sapiens
gtctcactctgttgcc

SEQ ID NO: 3595564 - DNA, 14 bp, Homo sapiens
gtctcagcctctgc

SEQ ID NO: 3595565 - DNA, 20 bp, Homo sapiens
gtctcagcctctgccagcgc

SEQ ID NO: 3595566 - DNA, 15 bp, Homo sapiens
gtctcaggtccctgc

SEQ ID NO: 3595567 - DNA, 10 bp, Homo sapiens
gtctccagct

SEQ ID NO: 3595568 - DNA, 17 bp, Homo sapiens
gtctccagctgcctggg

SEQ ID NO: 3595569 - DNA, 19 bp, Homo sapiens
gtctccagctgcctgggcc

SEQ ID NO: 3595570 - DNA, 20 bp, Homo sapiens
gtctccagggcccccaccga

SEQ ID NO: 3595571 - DNA, 16 bp, Homo sapiens
gtctcccctcctgcac

SEQ ID NO: 3595572 - DNA, 18 bp, Homo sapiens
gtctccccttctctgcct

SEQ ID NO: 3595573 - DNA, 17 bp, Homo sapiens
gtctccgggactgccct

SEQ ID NO: 3595574 - DNA, 19 bp, Homo sapiens
gtctcctacgcaccatttt

SEQ ID NO: 3595575 - DNA, 14 bp, Homo sapiens
gtctcctcactctg

SEQ ID NO: 3595576 - DNA, 19 bp, Homo sapiens
gtctcctcactctgtccct

SEQ ID NO: 3595577 - DNA, 21 bp, Homo sapiens
gtctcctcactctgtccctgt

SEQ ID NO: 3595578 - DNA, 13 bp, Homo sapiens
gtctcggctctgc

SEQ ID NO: 3595579 - DNA, 15 bp, Homo sapiens
gtctcggctctgcat

SEQ ID NO: 3595580 - DNA, 17 bp, Homo sapiens
gtctctctccaggtcag

SEQ ID NO: 3595581 - DNA, 21 bp, Homo sapiens
gtctctctccaggtcagcctg

SEQ ID NO: 3595582 - DNA, 22 bp, Homo sapiens
gtctctctccaggtcagcctgg

SEQ ID NO: 3595583 - DNA, 19 bp, Homo sapiens
gtctctcttctctccagct

SEQ ID NO: 3595584 - DNA, 21 bp, Homo sapiens
gtctctgattagttgacagta

SEQ ID NO: 3595585 - DNA, 20 bp, Homo sapiens
gtctctgccagttacttggg

SEQ ID NO: 3595586 - DNA, 22 bp, Homo sapiens
gtctctgccctgggctcctctt

SEQ ID NO: 3595587 - DNA, 14 bp, Homo sapiens
gtctcttctccact

SEQ ID NO: 3595588 - DNA, 16 bp, Homo sapiens
gtctcttctccactgg

SEQ ID NO: 3595589 - DNA, 17 bp, Homo sapiens
gtctcttctccactgga

SEQ ID NO: 3595590 - DNA, 22 bp, Homo sapiens
gtctgaaactggcttccccact

SEQ ID NO: 3595591 - DNA, 19 bp, Homo sapiens
gtctgagatgccccgagcc

SEQ ID NO: 3595592 - DNA, 15 bp, Homo sapiens
gtctgagcccatttc

SEQ ID NO: 3595593 - DNA, 19 bp, Homo sapiens
gtctgagcccatttctggg

SEQ ID NO: 3595594 - DNA, 22 bp, Homo sapiens
gtctgaggcctgccccctgggc

SEQ ID NO: 3595595 - DNA, 14 bp, Homo sapiens
gtctgagtcatggc

SEQ ID NO: 3595596 - DNA, 16 bp, Homo sapiens
gtctgattttctcact

SEQ ID NO: 3595597 - DNA, 22 bp, Homo sapiens
gtctgattttctcactgaactc

SEQ ID NO: 3595598 - DNA, 23 bp, Homo sapiens
gtctgattttctcactgaactcc

SEQ ID NO: 3595599 - DNA, 19 bp, Homo sapiens
gtctgcagctcaagggctg

SEQ ID NO: 3595600 - DNA, 21 bp, Homo sapiens
gtctgcagctcaagggctggc

SEQ ID NO: 3595601 - DNA, 21 bp, Homo sapiens
gtctgcatttcggtggctagt

SEQ ID NO: 3595602 - DNA, 12 bp, Homo sapiens
gtctgccagggc

SEQ ID NO: 3595603 - DNA, 13 bp, Homo sapiens
gtctgccagggcc

SEQ ID NO: 3595604 - DNA, 14 bp, Homo sapiens
gtctgccttctgct

SEQ ID NO: 3595605 - DNA, 24 bp, Homo sapiens
gtctgcgtgggtttttgtatccag

SEQ ID NO: 3595606 - DNA, 16 bp, Homo sapiens
gtctgctccaatgact

SEQ ID NO: 3595607 - DNA, 22 bp, Homo sapiens
gtctgctcctcttgttcctgaa

SEQ ID NO: 3595608 - DNA, 15 bp, Homo sapiens
gtctggcccaccagg

SEQ ID NO: 3595609 - DNA, 16 bp, Homo sapiens
gtctggctgagccctg

SEQ ID NO: 3595610 - DNA, 18 bp, Homo sapiens
gtctgggatatggctgcc

SEQ ID NO: 3595611 - DNA, 22 bp, Homo sapiens
gtctgggatatggctgcccagg

SEQ ID NO: 3595612 - DNA, 20 bp, Homo sapiens
gtctgggcgtccagctcagc

SEQ ID NO: 3595613 - DNA, 21 bp, Homo sapiens
gtctgggcgtccagctcagcc

SEQ ID NO: 3595614 - DNA, 17 bp, Homo sapiens
gtctggtgtttgtcatg

SEQ ID NO: 3595615 - DNA, 13 bp, Homo sapiens
gtctgtatgtcat

SEQ ID NO: 3595616 - DNA, 15 bp, Homo sapiens
gtctgtatgtcatgg

SEQ ID NO: 3595617 - DNA, 22 bp, Homo sapiens
gtctgtggagatggactcagga

SEQ ID NO: 3595618 - DNA, 11 bp, Homo sapiens
gtctgtgtgtg

SEQ ID NO: 3595619 - DNA, 21 bp, Homo sapiens
gtctgtgtgtttatgtgtgtg

SEQ ID NO: 3595620 - DNA, 17 bp, Homo sapiens
gtctgtttaaagtggca

SEQ ID NO: 3595621 - DNA, 14 bp, Homo sapiens
gtcttaaaaattta

SEQ ID NO: 3595622 - DNA, 18 bp, Homo sapiens
gtcttaaaaatttataca

SEQ ID NO: 3595623 - DNA, 19 bp, Homo sapiens
gtcttaattaaaagaatat

SEQ ID NO: 3595624 - DNA, 21 bp, Homo sapiens
gtcttatagtgtttggacagc

SEQ ID NO: 3595625 - DNA, 16 bp, Homo sapiens
gtcttatcaactggtt

SEQ ID NO: 3595626 - DNA, 15 bp, Homo sapiens
gtcttcaaatttttt

SEQ ID NO: 3595627 - DNA, 19 bp, Homo sapiens
gtcttcactttcctcagtt

SEQ ID NO: 3595628 - DNA, 21 bp, Homo sapiens
gtcttcctaattgtgccccta

SEQ ID NO: 3595629 - DNA, 23 bp, Homo sapiens
gtcttctttctccatggagccta

SEQ ID NO: 3595630 - DNA, 21 bp, Homo sapiens
gtcttgaacgagcagcccagg

SEQ ID NO: 3595631 - DNA, 22 bp, Homo sapiens
gtcttgaacgagcagcccaggg

SEQ ID NO: 3595632 - DNA, 22 bp, Homo sapiens
gtcttgaattagtatttcagtg

SEQ ID NO: 3595633 - DNA, 21 bp, Homo sapiens
gtcttggccgactcagggacc

SEQ ID NO: 3595634 - DNA, 20 bp, Homo sapiens
gtcttggggccactttcaga

SEQ ID NO: 3595635 - DNA, 23 bp, Homo sapiens
gtcttgtgtttccacagcctgca

SEQ ID NO: 3595636 - DNA, 13 bp, Homo sapiens
gtctttaatcatt

SEQ ID NO: 3595637 - DNA, 16 bp, Homo sapiens
gtctttcttgctccct

SEQ ID NO: 3595638 - DNA, 18 bp, Homo sapiens
gtctttctttgtcattca

SEQ ID NO: 3595639 - DNA, 15 bp, Homo sapiens
gtctttggttcagct

SEQ ID NO: 3595640 - DNA, 13 bp, Homo sapiens
gtgaaaatgaaga

SEQ ID NO: 3595641 - DNA, 17 bp, Homo sapiens
gtgaaactctaccctga

SEQ ID NO: 3595642 - DNA, 15 bp, Homo sapiens
gtgaacacatcagct

SEQ ID NO: 3595643 - DNA, 22 bp, Homo sapiens
gtgaacctacctgccttggaga

SEQ ID NO: 3595644 - DNA, 17 bp, Homo sapiens
gtgaactagggaagctc

SEQ ID NO: 3595645 - DNA, 22 bp, Homo sapiens
gtgaactcaccctgggagccag

SEQ ID NO: 3595646 - DNA, 14 bp, Homo sapiens
gtgaactccaggca

SEQ ID NO: 3595647 - DNA, 21 bp, Homo sapiens
gtgaagacccaaaacagcttt

SEQ ID NO: 3595648 - DNA, 18 bp, Homo sapiens
gtgaagaggtctgattgg

SEQ ID NO: 3595649 - DNA, 22 bp, Homo sapiens
gtgaagatctttggcatgattt

SEQ ID NO: 3595650 - DNA, 20 bp, Homo sapiens
gtgaagattggggacactca

SEQ ID NO: 3595651 - DNA, 23 bp, Homo sapiens
gtgaagattggggacactcatat

SEQ ID NO: 3595652 - DNA, 17 bp, Homo sapiens
gtgaagttcatcttgca

SEQ ID NO: 3595653 - DNA, 22 bp, Homo sapiens
gtgaatacattaacggtgctaa

SEQ ID NO: 3595654 - DNA, 22 bp, Homo sapiens
gtgaatacttattttcagtgca

SEQ ID NO: 3595655 - DNA, 14 bp, Homo sapiens
gtgaatcagagcac

SEQ ID NO: 3595656 - DNA, 21 bp, Homo sapiens
gtgaattaggctgtaactact

SEQ ID NO: 3595657 - DNA, 17 bp, Homo sapiens
gtgaatttttttttcct

SEQ ID NO: 3595658 - DNA, 13 bp, Homo sapiens
gtgacaaagcaat

SEQ ID NO: 3595659 - DNA, 14 bp, Homo sapiens
gtgacagactttgg

SEQ ID NO: 3595660 - DNA, 19 bp, Homo sapiens
gtgacagactttggacagt

SEQ ID NO: 3595661 - DNA, 21 bp, Homo sapiens
gtgacaggctcgtcagccacc

SEQ ID NO: 3595662 - DNA, 19 bp, Homo sapiens
gtgacagggcaagaccctg

SEQ ID NO: 3595663 - DNA, 18 bp, Homo sapiens
gtgacagtgaagatagaa

SEQ ID NO: 3595664 - DNA, 19 bp, Homo sapiens
gtgacatgattctgaactt

SEQ ID NO: 3595665 - DNA, 22 bp, Homo sapiens
gtgacatgattctgaacttttg

SEQ ID NO: 3595666 - DNA, 20 bp, Homo sapiens
gttttgaagattctatgtta

SEQ ID NO: 3595667 - DNA, 14 bp, Homo sapiens
gttttgctgagagc

SEQ ID NO: 3595668 - DNA, 15 bp, Homo sapiens
gttttgggtactttc

SEQ ID NO: 3595669 - DNA, 23 bp, Homo sapiens
gttttgggtactttctatctcat

SEQ ID NO: 3595670 - DNA, 19 bp, Homo sapiens
gttttgggtgtttttcatg

SEQ ID NO: 3595671 - DNA, 13 bp, Homo sapiens
gttttgttgtttg

SEQ ID NO: 3595672 - DNA, 17 bp, Homo sapiens
gtttttaataaagacag

SEQ ID NO: 3595673 - DNA, 23 bp, Homo sapiens
gtttttcaattaaacggattatt

SEQ ID NO: 3595674 - DNA, 12 bp, Homo sapiens
gtttttcatgtt

SEQ ID NO: 3595675 - DNA, 19 bp, Homo sapiens
gtttttcttttctttattt

SEQ ID NO: 3595676 - DNA, 15 bp, Homo sapiens
gtttttgaaatacct

SEQ ID NO: 3595677 - DNA, 15 bp, Homo sapiens
gtttttgacagcctt

SEQ ID NO: 3595678 - DNA, 13 bp, Homo sapiens
gtttttgtattta

SEQ ID NO: 3595679 - DNA, 21 bp, Homo sapiens
gttttttcttccttttcactg

SEQ ID NO: 3595680 - DNA, 14 bp, Homo sapiens
gtttttttctaaaa

SEQ ID NO: 3595681 - DNA, 13 bp, Homo sapiens
taaaaaaaagaaa

SEQ ID NO: 3595682 - DNA, 21 bp, Homo sapiens
taaaaaaactggatatttcaa

SEQ ID NO: 3595683 - DNA, 19 bp, Homo sapiens
taaaaaacactaaacattc

SEQ ID NO: 3595684 - DNA, 13 bp, Homo sapiens
taaaaaagagaca

SEQ ID NO: 3595685 - DNA, 16 bp, Homo sapiens
taaaaaatcagaacaa

SEQ ID NO: 3595686 - DNA, 23 bp, Homo sapiens
taaaaaatcagaacaaaacttct

SEQ ID NO: 3595687 - DNA, 13 bp, Homo sapiens
taaaaaatgaaat

SEQ ID NO: 3595688 - DNA, 17 bp, Homo sapiens
taaaaacaaatgagttt

SEQ ID NO: 3595689 - DNA, 20 bp, Homo sapiens
taaaaactcaggcaaagaaa

SEQ ID NO: 3595690 - DNA, 19 bp, Homo sapiens
taaaaactgcccattgtaa

SEQ ID NO: 3595691 - DNA, 21 bp, Homo sapiens
taaaaactgtgatttttatca

SEQ ID NO: 3595692 - DNA, 22 bp, Homo sapiens
taaaaactgtgatttttatcac

SEQ ID NO: 3595693 - DNA, 14 bp, Homo sapiens
taaaaacttttgag

SEQ ID NO: 3595694 - DNA, 13 bp, Homo sapiens
taaaaagtataaa

SEQ ID NO: 3595695 - DNA, 20 bp, Homo sapiens
taaaaagttttagttttgat

SEQ ID NO: 3595696 - DNA, 14 bp, Homo sapiens
taaaaataccttct

SEQ ID NO: 3595697 - DNA, 20 bp, Homo sapiens
taaaaataccttctatgtat

SEQ ID NO: 3595698 - DNA, 22 bp, Homo sapiens
taaaaatcatatagaccaattg

SEQ ID NO: 3595699 - DNA, 12 bp, Homo sapiens
taaaaatgtctt

SEQ ID NO: 3595700 - DNA, 15 bp, Homo sapiens
taaaaattaaatgga

SEQ ID NO: 3595701 - DNA, 22 bp, Homo sapiens
taaaaattgaatgtggctgaag

SEQ ID NO: 3595702 - DNA, 22 bp, Homo sapiens
taaaaatttatacaccagcaat

SEQ ID NO: 3595703 - DNA, 14 bp, Homo sapiens
taaaacaaatgaaa

SEQ ID NO: 3595704 - DNA, 17 bp, Homo sapiens
taaaacaaatgaaattt

SEQ ID NO: 3595705 - DNA, 18 bp, Homo sapiens
taaaacataaacacattt

SEQ ID NO: 3595706 - DNA, 15 bp, Homo sapiens
taaaacattaaaata

SEQ ID NO: 3595707 - DNA, 19 bp, Homo sapiens
taaaacattaaaatataat

SEQ ID NO: 3595708 - DNA, 13 bp, Homo sapiens
taaaacattactt

SEQ ID NO: 3595709 - DNA, 20 bp, Homo sapiens
taaaacattacttatttaac

SEQ ID NO: 3595710 - DNA, 17 bp, Homo sapiens
taaaaccaggctttcta

SEQ ID NO: 3595711 - DNA, 13 bp, Homo sapiens
taaaacccaaagg

SEQ ID NO: 3595712 - DNA, 15 bp, Homo sapiens
taaaaccttgaaggt

SEQ ID NO: 3595713 - DNA, 22 bp, Homo sapiens
taaaaccttgaaggtctgtcat

SEQ ID NO: 3595714 - DNA, 17 bp, Homo sapiens
taaaactggctttggct

SEQ ID NO: 3595715 - DNA, 20 bp, Homo sapiens
taaaacttgatgtgttatct

SEQ ID NO: 3595716 - DNA, 22 bp, Homo sapiens
taaaacttgatgtgttatctct

SEQ ID NO: 3595717 - DNA, 15 bp, Homo sapiens
taaaagcattttgta

SEQ ID NO: 3595718 - DNA, 17 bp, Homo sapiens
taaaagcattttgtaat

SEQ ID NO: 3595719 - DNA, 14 bp, Homo sapiens
taaaagtaataaag

SEQ ID NO: 3595720 - DNA, 17 bp, Homo sapiens
taaaagtaataaagaga

SEQ ID NO: 3595721 - DNA, 18 bp, Homo sapiens
taaaagtaataaagagaa

SEQ ID NO: 3595722 - DNA, 21 bp, Homo sapiens
taaaagtaataaagagaaata

SEQ ID NO: 3595723 - DNA, 20 bp, Homo sapiens
taaaagtcccagttaagtga

SEQ ID NO: 3595724 - DNA, 17 bp, Homo sapiens
taaaagttgcattttaa

SEQ ID NO: 3595725 - DNA, 15 bp, Homo sapiens
taaaataaataatct

SEQ ID NO: 3595726 - DNA, 16 bp, Homo sapiens
taaaataacttgcatc

SEQ ID NO: 3595727 - DNA, 16 bp, Homo sapiens
taaaataattttgtaa

SEQ ID NO: 3595728 - DNA, 21 bp, Homo sapiens
taaaatacacactcaaatcaa

SEQ ID NO: 3595729 - DNA, 13 bp, Homo sapiens
taaaatacatgaa

SEQ ID NO: 3595730 - DNA, 22 bp, Homo sapiens
taaaatacctctaataaacact

SEQ ID NO: 3595731 - DNA, 23 bp, Homo sapiens
taaaatattaacatattatttca

SEQ ID NO: 3595732 - DNA, 22 bp, Homo sapiens
taaaatattcctgcatttgtga

SEQ ID NO: 3595733 - DNA, 17 bp, Homo sapiens
taaaatattcgaaattc

SEQ ID NO: 3595734 - DNA, 18 bp, Homo sapiens
taaaatcatttctgcatc

SEQ ID NO: 3595735 - DNA, 22 bp, Homo sapiens
taaaatcatttctgcatcagct

SEQ ID NO: 3595736 - DNA, 12 bp, Homo sapiens
taaaatgaggat

SEQ ID NO: 3595737 - DNA, 21 bp, Homo sapiens
taaaatgaggatccagggcag

SEQ ID NO: 3595738 - DNA, 16 bp, Homo sapiens
taaaatgcattgaaag

SEQ ID NO: 3595739 - DNA, 17 bp, Homo sapiens
taaaatgctcaatttca

SEQ ID NO: 3595740 - DNA, 12 bp, Homo sapiens
taaaatggaatt

SEQ ID NO: 3595741 - DNA, 15 bp, Homo sapiens
taaaatggaattgaa

SEQ ID NO: 3595742 - DNA, 18 bp, Homo sapiens
taaaatggtttgtcctga

SEQ ID NO: 3595743 - DNA, 15 bp, Homo sapiens
taaaatgtattcaag

SEQ ID NO: 3595744 - DNA, 17 bp, Homo sapiens
taaaattaatgcagatt

SEQ ID NO: 3595745 - DNA, 23 bp, Homo sapiens
taaaattgggcttgtgatttcca

SEQ ID NO: 3595746 - DNA, 15 bp, Homo sapiens
taaaattgtgatgtg

SEQ ID NO: 3595747 - DNA, 16 bp, Homo sapiens
taaaattgtgatgtgt

SEQ ID NO: 3595748 - DNA, 15 bp, Homo sapiens
taaaattgttaacct

SEQ ID NO: 3595749 - DNA, 12 bp, Homo sapiens
taaaatttcagg

SEQ ID NO: 3595750 - DNA, 13 bp, Homo sapiens
taaaatttcagga

SEQ ID NO: 3595751 - DNA, 20 bp, Homo sapiens
taaaatttcataattctgaa

SEQ ID NO: 3595752 - DNA, 16 bp, Homo sapiens
taaaatttgtcttaaa

SEQ ID NO: 3595753 - DNA, 15 bp, Homo sapiens
taaacaaaaaaccca

SEQ ID NO: 3595754 - DNA, 13 bp, Homo sapiens
taaacaaaggttg

SEQ ID NO: 3595755 - DNA, 16 bp, Homo sapiens
taaacaatctttcatg

SEQ ID NO: 3595756 - DNA, 23 bp, Homo sapiens
taaacaatctttcatgtcttgtc

SEQ ID NO: 3595757 - DNA, 18 bp, Homo sapiens
taaacacaggctgtcctt

SEQ ID NO: 3595758 - DNA, 14 bp, Homo sapiens
taaacactgtttta

SEQ ID NO: 3595759 - DNA, 17 bp, Homo sapiens
taaacagacaggaattt

SEQ ID NO: 3595760 - DNA, 12 bp, Homo sapiens
taaacagggtct

SEQ ID NO: 3595761 - DNA, 17 bp, Homo sapiens
taaacagtaaaccttaa

SEQ ID NO: 3595762 - DNA, 23 bp, Homo sapiens
taaacagtgagcctgaattttgt

SEQ ID NO: 3595763 - DNA, 23 bp, Homo sapiens
taaacataagtgtacgattctta

SEQ ID NO: 3595764 - DNA, 15 bp, Homo sapiens
taaacattcctccag

SEQ ID NO: 3595765 - DNA, 16 bp, Homo sapiens
taaaccaaaaactgaa

SEQ ID NO: 3595766 - DNA, 18 bp, Homo sapiens
taaaccaaatatgttaaa

SEQ ID NO: 3595767 - DNA, 22 bp, Homo sapiens
taaaccaaatatgttaaagttt

SEQ ID NO: 3595768 - DNA, 15 bp, Homo sapiens
taaaccaatgaaatt

SEQ ID NO: 3595769 - DNA, 14 bp, Homo sapiens
taaacggattattt

SEQ ID NO: 3595770 - DNA, 18 bp, Homo sapiens
taaacggattattttttc

SEQ ID NO: 3595771 - DNA, 19 bp, Homo sapiens
taaacggattattttttca

SEQ ID NO: 3595772 - DNA, 20 bp, Homo sapiens
taaacggattattttttcag

SEQ ID NO: 3595773 - DNA, 23 bp, Homo sapiens
taaacggattattttttcagacc

SEQ ID NO: 3595774 - DNA, 14 bp, Homo sapiens
taaacggttcctgg

SEQ ID NO: 3595775 - DNA, 14 bp, Homo sapiens
taaactactctttg

SEQ ID NO: 3595776 - DNA, 22 bp, Homo sapiens
taaactatcttggtgaattttt

SEQ ID NO: 3595777 - DNA, 14 bp, Homo sapiens
taaactcaaaatat

SEQ ID NO: 3595778 - DNA, 22 bp, Homo sapiens
taaactcaaaatatttgtacat

SEQ ID NO: 3595779 - DNA, 14 bp, Homo sapiens
taaactgaattttt

SEQ ID NO: 3595780 - DNA, 14 bp, Homo sapiens
taaactgactatca

SEQ ID NO: 3595781 - DNA, 16 bp, Homo sapiens
taaactgcagcctctc

SEQ ID NO: 3595782 - DNA, 21 bp, Homo sapiens
taaactgcagcctctctggct

SEQ ID NO: 3595783 - DNA, 16 bp, Homo sapiens
taaactggtatgaata

SEQ ID NO: 3595784 - DNA, 20 bp, Homo sapiens
taaactggtatgaataattg

SEQ ID NO: 3595785 - DNA, 14 bp, Homo sapiens
taaacttcacctac

SEQ ID NO: 3595786 - DNA, 13 bp, Homo sapiens
taaacttcagcaa

SEQ ID NO: 3595787 - DNA, 18 bp, Homo sapiens
taaactttgtgctgatct

SEQ ID NO: 3595788 - DNA, 13 bp, Homo sapiens
taaagaaaaccac

SEQ ID NO: 3595789 - DNA, 21 bp, Homo sapiens
taaagaaaattaattatgtgt

SEQ ID NO: 3595790 - DNA, 11 bp, Homo sapiens
taaagaaagtg

SEQ ID NO: 3595791 - DNA, 15 bp, Homo sapiens
taaagaaatgtctta

SEQ ID NO: 3595792 - DNA, 19 bp, Homo sapiens
taaagaagaggagaaaaag

SEQ ID NO: 3595793 - DNA, 18 bp, Homo sapiens
taaagaattaatgactta

SEQ ID NO: 3595794 - DNA, 18 bp, Homo sapiens
taaagacaatcactgcca

SEQ ID NO: 3595795 - DNA, 9 bp, Homo sapiens
taaagacag

SEQ ID NO: 3595796 - DNA, 10 bp, Homo sapiens
taaagacaga

SEQ ID NO: 3595797 - DNA, 15 bp, Homo sapiens
taaagacaggagaca

SEQ ID NO: 3595798 - DNA, 13 bp, Homo sapiens
taaagagcatcct

SEQ ID NO: 3595799 - DNA, 18 bp, Homo sapiens
tacatttctgattctgat

SEQ ID NO: 3595800 - DNA, 16 bp, Homo sapiens
tacatttgaacttgat

SEQ ID NO: 3595801 - DNA, 14 bp, Homo sapiens
tacatttgtattta

SEQ ID NO: 3595802 - DNA, 22 bp, Homo sapiens
taccaaaagacattagagaaaa

SEQ ID NO: 3595803 - DNA, 18 bp, Homo sapiens
taccaaatctgacatatt

SEQ ID NO: 3595804 - DNA, 19 bp, Homo sapiens
taccaaatctgacatatta

SEQ ID NO: 3595805 - DNA, 20 bp, Homo sapiens
taccaaatctgacatattat

SEQ ID NO: 3595806 - DNA, 16 bp, Homo sapiens
taccaacacgagcagg

SEQ ID NO: 3595807 - DNA, 13 bp, Homo sapiens
taccaagctgtca

SEQ ID NO: 3595808 - DNA, 21 bp, Homo sapiens
taccaagctgtcacaggtttt

SEQ ID NO: 3595809 - DNA, 18 bp, Homo sapiens
taccacagctatttagaa

SEQ ID NO: 3595810 - DNA, 18 bp, Homo sapiens
taccacccggtccccact

SEQ ID NO: 3595811 - DNA, 17 bp, Homo sapiens
taccacctaatgtttat

SEQ ID NO: 3595812 - DNA, 15 bp, Homo sapiens
taccacttcctgagg

SEQ ID NO: 3595813 - DNA, 16 bp, Homo sapiens
taccacttcctgaggc

SEQ ID NO: 3595814 - DNA, 11 bp, Homo sapiens
taccagccagc

SEQ ID NO: 3595815 - DNA, 15 bp, Homo sapiens
taccagccagcctca

SEQ ID NO: 3595816 - DNA, 19 bp, Homo sapiens
taccaggtattattatctt

SEQ ID NO: 3595817 - DNA, 18 bp, Homo sapiens
taccagtatttaacttct

SEQ ID NO: 3595818 - DNA, 20 bp, Homo sapiens
taccagtatttagaagccaa

SEQ ID NO: 3595819 - DNA, 17 bp, Homo sapiens
taccatcatctctgaag

SEQ ID NO: 3595820 - DNA, 23 bp, Homo sapiens
taccatgtgaaactctaccctga

SEQ ID NO: 3595821 - DNA, 21 bp, Homo sapiens
taccattctattctccagaca

SEQ ID NO: 3595822 - DNA, 22 bp, Homo sapiens
tacccaaccctgccctgcccca

SEQ ID NO: 3595823 - DNA, 18 bp, Homo sapiens
tacccagcatgactttcc

SEQ ID NO: 3595824 - DNA, 19 bp, Homo sapiens
tacccatctttaatttata

SEQ ID NO: 3595825 - DNA, 15 bp, Homo sapiens
tacccattctgtttt

SEQ ID NO: 3595826 - DNA, 22 bp, Homo sapiens
taccccagactagatgtagtat

SEQ ID NO: 3595827 - DNA, 18 bp, Homo sapiens
taccccagccaggctcct

SEQ ID NO: 3595828 - DNA, 20 bp, Homo sapiens
taccccatggagctgggcta

SEQ ID NO: 3595829 - DNA, 22 bp, Homo sapiens
tacccctaaaaagattgccaat

SEQ ID NO: 3595830 - DNA, 15 bp, Homo sapiens
tacccctcaaactgc

SEQ ID NO: 3595831 - DNA, 14 bp, Homo sapiens
taccctaaccaagt

SEQ ID NO: 3595832 - DNA, 18 bp, Homo sapiens
taccctacagacagctta

SEQ ID NO: 3595833 - DNA, 12 bp, Homo sapiens
taccctcccacc

SEQ ID NO: 3595834 - DNA, 17 bp, Homo sapiens
taccctcccaccagaac

SEQ ID NO: 3595835 - DNA, 18 bp, Homo sapiens
taccctcccaccagaacg

SEQ ID NO: 3595836 - DNA, 14 bp, Homo sapiens
taccctcctctgct

SEQ ID NO: 3595837 - DNA, 20 bp, Homo sapiens
taccctgaagaaagggatgg

SEQ ID NO: 3595838 - DNA, 23 bp, Homo sapiens
taccctggcagggacctgagagc

SEQ ID NO: 3595839 - DNA, 13 bp, Homo sapiens
tacccttggaaat

SEQ ID NO: 3595840 - DNA, 22 bp, Homo sapiens
taccgagtctcttctccactgg

SEQ ID NO: 3595841 - DNA, 18 bp, Homo sapiens
taccgctggccctgccgt

SEQ ID NO: 3595842 - DNA, 17 bp, Homo sapiens
tacctaagattacaaat

SEQ ID NO: 3595843 - DNA, 20 bp, Homo sapiens
tacctaagattacaaatcag

SEQ ID NO: 3595844 - DNA, 16 bp, Homo sapiens
tacctacaataaactg

SEQ ID NO: 3595845 - DNA, 17 bp, Homo sapiens
tacctacaataaactgg

SEQ ID NO: 3595846 - DNA, 19 bp, Homo sapiens
tacctatccttacatttca

SEQ ID NO: 3595847 - DNA, 20 bp, Homo sapiens
tacctatccttacatttcac

SEQ ID NO: 3595848 - DNA, 15 bp, Homo sapiens
tacctcaaactatct

SEQ ID NO: 3595849 - DNA, 18 bp, Homo sapiens
tacctcaagccccatttc

SEQ ID NO: 3595850 - DNA, 21 bp, Homo sapiens
tacctcagtggatcttcagaa

SEQ ID NO: 3595851 - DNA, 13 bp, Homo sapiens
tacctccttgtgt

SEQ ID NO: 3595852 - DNA, 20 bp, Homo sapiens
tacctctaataaacactgtt

SEQ ID NO: 3595853 - DNA, 19 bp, Homo sapiens
tacctctgtctgagacagg

SEQ ID NO: 3595854 - DNA, 21 bp, Homo sapiens
tacctgaaggggttttcttga

SEQ ID NO: 3595855 - DNA, 15 bp, Homo sapiens
tacctggagcagagg

SEQ ID NO: 3595856 - DNA, 19 bp, Homo sapiens
tacctggagcagaggaggg

SEQ ID NO: 3595857 - DNA, 23 bp, Homo sapiens
tacctggtccccactgctgagct

SEQ ID NO: 3595858 - DNA, 18 bp, Homo sapiens
tacctgtctgctgccagc

SEQ ID NO: 3595859 - DNA, 16 bp, Homo sapiens
taccttatagttactg

SEQ ID NO: 3595860 - DNA, 16 bp, Homo sapiens
taccttctatgtatta

SEQ ID NO: 3595861 - DNA, 20 bp, Homo sapiens
taccttgtatactgtaggca

SEQ ID NO: 3595862 - DNA, 14 bp, Homo sapiens
taccttttgtagtt

SEQ ID NO: 3595863 - DNA, 16 bp, Homo sapiens
tacgcagaggaatttt

SEQ ID NO: 3595864 - DNA, 20 bp, Homo sapiens
tacgggcacaactggaagct

SEQ ID NO: 3595865 - DNA, 21 bp, Homo sapiens
tacgtgaagaaataaatgaaa

SEQ ID NO: 3595866 - DNA, 15 bp, Homo sapiens
tactaaaaagtataa

SEQ ID NO: 3595867 - DNA, 19 bp, Homo sapiens
tactaacccagtctttctt

SEQ ID NO: 3595868 - DNA, 20 bp, Homo sapiens
tactaatagaataaaggcag

SEQ ID NO: 3595869 - DNA, 23 bp, Homo sapiens
tactaatagaataaaggcagttt

SEQ ID NO: 3595870 - DNA, 20 bp, Homo sapiens
tactaatgtaaaatgatttg

SEQ ID NO: 3595871 - DNA, 15 bp, Homo sapiens
tactacacattttta

SEQ ID NO: 3595872 - DNA, 22 bp, Homo sapiens
tactacacatttttaaattgtt

SEQ ID NO: 3595873 - DNA, 16 bp, Homo sapiens
tactatagtaccagta

SEQ ID NO: 3595874 - DNA, 22 bp, Homo sapiens
tactatgaaatatgtataactt

SEQ ID NO: 3595875 - DNA, 23 bp, Homo sapiens
tactcccccaccactcaggccac

SEQ ID NO: 3595876 - DNA, 12 bp, Homo sapiens
tactcctcccag

SEQ ID NO: 3595877 - DNA, 9 bp, Homo sapiens
tactcctgg

SEQ ID NO: 3595878 - DNA, 22 bp, Homo sapiens
tactcctggctcaagccctgaa

SEQ ID NO: 3595879 - DNA, 17 bp, Homo sapiens
tactctttgaaagcttt

SEQ ID NO: 3595880 - DNA, 17 bp, Homo sapiens
tactgagaaaacctgtt

SEQ ID NO: 3595881 - DNA, 13 bp, Homo sapiens
tactgcactcaga

SEQ ID NO: 3595882 - DNA, 16 bp, Homo sapiens
tactgcactcagattt

SEQ ID NO: 3595883 - DNA, 14 bp, Homo sapiens
tactgcagtcttta

SEQ ID NO: 3595884 - DNA, 22 bp, Homo sapiens
tactgcattctctcccatcctg

SEQ ID NO: 3595885 - DNA, 12 bp, Homo sapiens
tactgccctttc

SEQ ID NO: 3595886 - DNA, 23 bp, Homo sapiens
tactggaattcttctgcaacatt

SEQ ID NO: 3595887 - DNA, 18 bp, Homo sapiens
tactggtcttgtggaatt

SEQ ID NO: 3595888 - DNA, 16 bp, Homo sapiens
tactggttacctggag

SEQ ID NO: 3595889 - DNA, 16 bp, Homo sapiens
tactgtaatgctgcct

SEQ ID NO: 3595890 - DNA, 23 bp, Homo sapiens
tactgtcagctcccctcggagaa

SEQ ID NO: 3595891 - DNA, 20 bp, Homo sapiens
tactgtctctccagtgaaat

SEQ ID NO: 3595892 - DNA, 21 bp, Homo sapiens
tactgtctctccagtgaaatg

SEQ ID NO: 3595893 - DNA, 22 bp, Homo sapiens
tactgtctctccagtgaaatga

SEQ ID NO: 3595894 - DNA, 15 bp, Homo sapiens
tactgtgggcaaagt

SEQ ID NO: 3595895 - DNA, 13 bp, Homo sapiens
tactgtgtaatta

SEQ ID NO: 3595896 - DNA, 17 bp, Homo sapiens
tactgttacttgataac

SEQ ID NO: 3595897 - DNA, 15 bp, Homo sapiens
tacttaattcaactt

SEQ ID NO: 3595898 - DNA, 18 bp, Homo sapiens
tacttagagtttctgttt

SEQ ID NO: 3595899 - DNA, 19 bp, Homo sapiens
tacttagagtttctgtttg

SEQ ID NO: 3595900 - DNA, 15 bp, Homo sapiens
tacttatttttctga

SEQ ID NO: 3595901 - DNA, 16 bp, Homo sapiens
tacttcaaaagccata

SEQ ID NO: 3595902 - DNA, 22 bp, Homo sapiens
tacttcaaaagtttgtttgctt

SEQ ID NO: 3595903 - DNA, 18 bp, Homo sapiens
tacttcaaagtgcctggg

SEQ ID NO: 3595904 - DNA, 21 bp, Homo sapiens
tacttcaaagtgcctgggctc

SEQ ID NO: 3595905 - DNA, 22 bp, Homo sapiens
tacttcaaagtgcctgggctca

SEQ ID NO: 3595906 - DNA, 23 bp, Homo sapiens
tacttcctgtgacttcagctctg

SEQ ID NO: 3595907 - DNA, 16 bp, Homo sapiens
tacttctctaattctt

SEQ ID NO: 3595908 - DNA, 14 bp, Homo sapiens
tacttcttatacat

SEQ ID NO: 3595909 - DNA, 15 bp, Homo sapiens
tacttcttatacatt

SEQ ID NO: 3595910 - DNA, 18 bp, Homo sapiens
tacttgaagaaacagagt

SEQ ID NO: 3595911 - DNA, 24 bp, Homo sapiens
tacttgaagaaacagagtggcctc

SEQ ID NO: 3595912 - DNA, 11 bp, Homo sapiens
tacttgaaggg

SEQ ID NO: 3595913 - DNA, 14 bp, Homo sapiens
tacttgaagggcca

SEQ ID NO: 3595914 - DNA, 18 bp, Homo sapiens
tacttgaagggccagagc

SEQ ID NO: 3595915 - DNA, 17 bp, Homo sapiens
tacttgataacaatgtt

SEQ ID NO: 3595916 - DNA, 21 bp, Homo sapiens
tacttgataacaatgttttaa

SEQ ID NO: 3595917 - DNA, 14 bp, Homo sapiens
tacttgctcctttt

SEQ ID NO: 3595918 - DNA, 16 bp, Homo sapiens
tacttggaactaggct

SEQ ID NO: 3595919 - DNA, 21 bp, Homo sapiens
tacttggcccccttcaggagc

SEQ ID NO: 3595920 - DNA, 12 bp, Homo sapiens
tactttaaatta

SEQ ID NO: 3595921 - DNA, 21 bp, Homo sapiens
tactttaaattatatgatatg

SEQ ID NO: 3595922 - DNA, 20 bp, Homo sapiens
tactttataactaacatgtc

SEQ ID NO: 3595923 - DNA, 14 bp, Homo sapiens
tactttccatgttt

SEQ ID NO: 3595924 - DNA, 15 bp, Homo sapiens
tactttccatgtttt

SEQ ID NO: 3595925 - DNA, 14 bp, Homo sapiens
tacttttctaaaat

SEQ ID NO: 3595926 - DNA, 16 bp, Homo sapiens
tacttttctaaaatct

SEQ ID NO: 3595927 - DNA, 13 bp, Homo sapiens
tactttttcctgg

SEQ ID NO: 3595928 - DNA, 22 bp, Homo sapiens
tagaaaatgacttatttctgct

SEQ ID NO: 3595929 - DNA, 15 bp, Homo sapiens
tagaaaatgagaaaa

SEQ ID NO: 3595930 - DNA, 23 bp, Homo sapiens
tattataaattctactaagttat

SEQ ID NO: 3595931 - DNA, 20 bp, Homo sapiens
tattataaattgtgtattta

SEQ ID NO: 3595932 - DNA, 18 bp, Homo sapiens
tattataagttgaccttt

SEQ ID NO: 3595933 - DNA, 21 bp, Homo sapiens
tattataagttgacctttatt

SEQ ID NO: 3595934 - DNA, 15 bp, Homo sapiens
tattatagatataaa

SEQ ID NO: 3595935 - DNA, 13 bp, Homo sapiens
tattatattcatt

SEQ ID NO: 3595936 - DNA, 12 bp, Homo sapiens
tattatctttaa

SEQ ID NO: 3595937 - DNA, 22 bp, Homo sapiens
tattatgttcttagcaataaat

SEQ ID NO: 3595938 - DNA, 16 bp, Homo sapiens
tattattatgttctta

SEQ ID NO: 3595939 - DNA, 16 bp, Homo sapiens
tattattcccattcta

SEQ ID NO: 3595940 - DNA, 21 bp, Homo sapiens
tattatttctaatccttttcc

SEQ ID NO: 3595941 - DNA, 23 bp, Homo sapiens
tattcaaacagtctcaggaaatc

SEQ ID NO: 3595942 - DNA, 17 bp, Homo sapiens
tattcaagcaaacatca

SEQ ID NO: 3595943 - DNA, 18 bp, Homo sapiens
tattcaaggagcaagaaa

SEQ ID NO: 3595944 - DNA, 19 bp, Homo sapiens
tattcagcaccaagcatgt

SEQ ID NO: 3595945 - DNA, 23 bp, Homo sapiens
tattcattctttttgaaatgtca

SEQ ID NO: 3595946 - DNA, 15 bp, Homo sapiens
tattccccagtgact

SEQ ID NO: 3595947 - DNA, 17 bp, Homo sapiens
tattccccagtgactcc

SEQ ID NO: 3595948 - DNA, 17 bp, Homo sapiens
tattccccattcttcct

SEQ ID NO: 3595949 - DNA, 13 bp, Homo sapiens
tattccctgccca

SEQ ID NO: 3595950 - DNA, 14 bp, Homo sapiens
tattccctgcccaa

SEQ ID NO: 3595951 - DNA, 21 bp, Homo sapiens
tattcctaatggctatttttg

SEQ ID NO: 3595952 - DNA, 15 bp, Homo sapiens
tattcctccagctgg

SEQ ID NO: 3595953 - DNA, 17 bp, Homo sapiens
tattcctgcatttgtga

SEQ ID NO: 3595954 - DNA, 20 bp, Homo sapiens
tattcctgcatttgtgaaat

SEQ ID NO: 3595955 - DNA, 22 bp, Homo sapiens
tattcctttgttacttctctaa

SEQ ID NO: 3595956 - DNA, 14 bp, Homo sapiens
tattctaatagttt

SEQ ID NO: 3595957 - DNA, 14 bp, Homo sapiens
tattctattttaca

SEQ ID NO: 3595958 - DNA, 14 bp, Homo sapiens
tattctcttttatc

SEQ ID NO: 3595959 - DNA, 18 bp, Homo sapiens
tattctcttttatctgtt

SEQ ID NO: 3595960 - DNA, 14 bp, Homo sapiens
tattctgaaaaaga

SEQ ID NO: 3595961 - DNA, 20 bp, Homo sapiens
tattctgaaaaagacataaa

SEQ ID NO: 3595962 - DNA, 23 bp, Homo sapiens
tattctgagcatactcaacaaaa

SEQ ID NO: 3595963 - DNA, 18 bp, Homo sapiens
tattctgtcagtgttaaa

SEQ ID NO: 3595964 - DNA, 13 bp, Homo sapiens
tattgaaaacttc

SEQ ID NO: 3595965 - DNA, 22 bp, Homo sapiens
tattgatacaatattgtgcatg

SEQ ID NO: 3595966 - DNA, 21 bp, Homo sapiens
tattgatatgcttatacactt

SEQ ID NO: 3595967 - DNA, 14 bp, Homo sapiens
tattgatattcaat

SEQ ID NO: 3595968 - DNA, 13 bp, Homo sapiens
tattgatgttttc

SEQ ID NO: 3595969 - DNA, 15 bp, Homo sapiens
tattgatttttaaga

SEQ ID NO: 3595970 - DNA, 17 bp, Homo sapiens
tattgcacattgtaaaa

SEQ ID NO: 3595971 - DNA, 18 bp, Homo sapiens
tattgccaaaacccagct

SEQ ID NO: 3595972 - DNA, 20 bp, Homo sapiens
tattgccaaaacccagctgc

SEQ ID NO: 3595973 - DNA, 16 bp, Homo sapiens
tattgccctaattaaa

SEQ ID NO: 3595974 - DNA, 22 bp, Homo sapiens
tattgcctaagaataaacattt

SEQ ID NO: 3595975 - DNA, 13 bp, Homo sapiens
tattgctattaaa

SEQ ID NO: 3595976 - DNA, 22 bp, Homo sapiens
tattggaaatttgttataatga

SEQ ID NO: 3595977 - DNA, 18 bp, Homo sapiens
tattggaatagcagcctc

SEQ ID NO: 3595978 - DNA, 17 bp, Homo sapiens
tattggtgtaaggtact

SEQ ID NO: 3595979 - DNA, 16 bp, Homo sapiens
tattgtattttgatga

SEQ ID NO: 3595980 - DNA, 17 bp, Homo sapiens
tattgtgctcagagaca

SEQ ID NO: 3595981 - DNA, 16 bp, Homo sapiens
tattgtttttgtattt

SEQ ID NO: 3595982 - DNA, 20 bp, Homo sapiens
tatttaaaaaaaagaaactt

SEQ ID NO: 3595983 - DNA, 22 bp, Homo sapiens
tatttaaaaaaaagaaactttt

SEQ ID NO: 3595984 - DNA, 21 bp, Homo sapiens
tatttaaaatgctcaatttca

SEQ ID NO: 3595985 - DNA, 23 bp, Homo sapiens
tatttaaaatgctcaatttcagc

SEQ ID NO: 3595986 - DNA, 16 bp, Homo sapiens
tatttaaaatggtgaa

SEQ ID NO: 3595987 - DNA, 13 bp, Homo sapiens
tatttaaagaaat

SEQ ID NO: 3595988 - DNA, 16 bp, Homo sapiens
tatttaactgattaaa

SEQ ID NO: 3595989 - DNA, 13 bp, Homo sapiens
tatttaagacata

SEQ ID NO: 3595990 - DNA, 15 bp, Homo sapiens
tatttaagacataaa

SEQ ID NO: 3595991 - DNA, 23 bp, Homo sapiens
tatttaagatgtacatttaataa

SEQ ID NO: 3595992 - DNA, 17 bp, Homo sapiens
tatttaagcaacatctt

SEQ ID NO: 3595993 - DNA, 16 bp, Homo sapiens
tatttaaggatagtgt

SEQ ID NO: 3595994 - DNA, 17 bp, Homo sapiens
tatttacagctgtgctc

SEQ ID NO: 3595995 - DNA, 15 bp, Homo sapiens
tatttaccaaagtag

SEQ ID NO: 3595996 - DNA, 16 bp, Homo sapiens
tatttactatttcaat

SEQ ID NO: 3595997 - DNA, 20 bp, Homo sapiens
tatttagattcacttaacaa

SEQ ID NO: 3595998 - DNA, 16 bp, Homo sapiens
tatttagtcaacatat

SEQ ID NO: 3595999 - DNA, 17 bp, Homo sapiens
tatttatgctataaatt

SEQ ID NO: 3596000 - DNA, 14 bp, Homo sapiens
tatttattaaactt

SEQ ID NO: 3596001 - DNA, 18 bp, Homo sapiens
tatttattaaacttcagc

SEQ ID NO: 3596002 - DNA, 12 bp, Homo sapiens
tatttattaccg

SEQ ID NO: 3596003 - DNA, 18 bp, Homo sapiens
tatttattagccaactgt

SEQ ID NO: 3596004 - DNA, 19 bp, Homo sapiens
tatttattccccagtgact

SEQ ID NO: 3596005 - DNA, 14 bp, Homo sapiens
tatttattgaaatg

SEQ ID NO: 3596006 - DNA, 16 bp, Homo sapiens
tatttattgaaatgat

SEQ ID NO: 3596007 - DNA, 16 bp, Homo sapiens
tatttattgatgtttt

SEQ ID NO: 3596008 - DNA, 11 bp, Homo sapiens
tatttatttgt

SEQ ID NO: 3596009 - DNA, 13 bp, Homo sapiens
tatttatttgtga

SEQ ID NO: 3596010 - DNA, 14 bp, Homo sapiens
tatttcaatctttt

SEQ ID NO: 3596011 - DNA, 20 bp, Homo sapiens
tatttcaatcttttaaattg

SEQ ID NO: 3596012 - DNA, 12 bp, Homo sapiens
tatttcaattgt

SEQ ID NO: 3596013 - DNA, 13 bp, Homo sapiens
tatttcagtgttt

SEQ ID NO: 3596014 - DNA, 13 bp, Homo sapiens
tatttcattggtc

SEQ ID NO: 3596015 - DNA, 13 bp, Homo sapiens
tatttcatttctt

SEQ ID NO: 3596016 - DNA, 21 bp, Homo sapiens
tatttcctatagctacatgtt

SEQ ID NO: 3596017 - DNA, 17 bp, Homo sapiens
tatttctaagtatttaa

SEQ ID NO: 3596018 - DNA, 19 bp, Homo sapiens
tatttctagttctttcctc

SEQ ID NO: 3596019 - DNA, 21 bp, Homo sapiens
tatttctccatcccctccctg

SEQ ID NO: 3596020 - DNA, 23 bp, Homo sapiens
tatttctccatcccctccctgcc

SEQ ID NO: 3596021 - DNA, 15 bp, Homo sapiens
tatttctgactctta

SEQ ID NO: 3596022 - DNA, 23 bp, Homo sapiens
tatttctgaggagcctgcaacat

SEQ ID NO: 3596023 - DNA, 22 bp, Homo sapiens
tatttctgtaattatatctaaa

SEQ ID NO: 3596024 - DNA, 13 bp, Homo sapiens
tatttcttccctg

SEQ ID NO: 3596025 - DNA, 23 bp, Homo sapiens
tatttgaaaaaaacttcattctc

SEQ ID NO: 3596026 - DNA, 14 bp, Homo sapiens
tatttgaaaattac

SEQ ID NO: 3596027 - DNA, 19 bp, Homo sapiens
tatttgaaaattacatgtt

SEQ ID NO: 3596028 - DNA, 22 bp, Homo sapiens
tatttgaccagaactttttcct

SEQ ID NO: 3596029 - DNA, 17 bp, Homo sapiens
tatttgaggtcagtgtt

SEQ ID NO: 3596030 - DNA, 14 bp, Homo sapiens
tatttgattattta

SEQ ID NO: 3596031 - DNA, 13 bp, Homo sapiens
tatttgcagaggc

SEQ ID NO: 3596032 - DNA, 17 bp, Homo sapiens
tatttgccaataaagct

SEQ ID NO: 3596033 - DNA, 19 bp, Homo sapiens
tatttgccaataaagcttt

SEQ ID NO: 3596034 - DNA, 20 bp, Homo sapiens
tatttgcctgtctgtttgct

SEQ ID NO: 3596035 - DNA, 15 bp, Homo sapiens
tatttgctgttaact

SEQ ID NO: 3596036 - DNA, 17 bp, Homo sapiens
tatttggaaataaagtc

SEQ ID NO: 3596037 - DNA, 14 bp, Homo sapiens
tatttgtaaagtga

SEQ ID NO: 3596038 - DNA, 16 bp, Homo sapiens
tatttgtaaatttatg

SEQ ID NO: 3596039 - DNA, 19 bp, Homo sapiens
tatttgtcttaaaaaatgt

SEQ ID NO: 3596040 - DNA, 21 bp, Homo sapiens
tatttgtcttaaaaaatgtga

SEQ ID NO: 3596041 - DNA, 14 bp, Homo sapiens
tatttgttttaata

SEQ ID NO: 3596042 - DNA, 13 bp, Homo sapiens
tattttaatcctg

SEQ ID NO: 3596043 - DNA, 23 bp, Homo sapiens
tattttaatcctgtaccaaatct

SEQ ID NO: 3596044 - DNA, 22 bp, Homo sapiens
tattttaattaaaattggtaaa

SEQ ID NO: 3596045 - DNA, 22 bp, Homo sapiens
tattttacatgaagctgtataa

SEQ ID NO: 3596046 - DNA, 16 bp, Homo sapiens
tattttagaataaatt

SEQ ID NO: 3596047 - DNA, 22 bp, Homo sapiens
tattttaggtgtaaaataatta

SEQ ID NO: 3596048 - DNA, 20 bp, Homo sapiens
tattttatctattggcctgt

SEQ ID NO: 3596049 - DNA, 20 bp, Homo sapiens
tattttatttttagaatttt

SEQ ID NO: 3596050 - DNA, 19 bp, Homo sapiens
tattttcagtgcatcatta

SEQ ID NO: 3596051 - DNA, 16 bp, Homo sapiens
tattttccgtcactta

SEQ ID NO: 3596052 - DNA, 22 bp, Homo sapiens
tattttccgtcacttaaatttg

SEQ ID NO: 3596053 - DNA, 15 bp, Homo sapiens
tattttccttctgaa

SEQ ID NO: 3596054 - DNA, 20 bp, Homo sapiens
tattttgaatgcagaaaaca

SEQ ID NO: 3596055 - DNA, 20 bp, Homo sapiens
tattttgatgagatattaaa

SEQ ID NO: 3596056 - DNA, 22 bp, Homo sapiens
tattttgatgagatattaaatt

SEQ ID NO: 3596057 - DNA, 22 bp, Homo sapiens
tattttgctaactggttaaaca

SEQ ID NO: 3596058 - DNA, 21 bp, Homo sapiens
tattttgctgcttgatgatga

SEQ ID NO: 3596059 - DNA, 20 bp, Homo sapiens
tattttgtaaactcaaaata

SEQ ID NO: 3596060 - DNA, 14 bp, Homo sapiens
tattttgtaataaa

SEQ ID NO: 3596061 - DNA, 18 bp, Homo sapiens
tattttgtaataaactct

SEQ ID NO: 3596062 - DNA, 15 bp, Homo sapiens
tcaggctcttctcct

SEQ ID NO: 3596063 - DNA, 16 bp, Homo sapiens
tcagggaccggtgctg

SEQ ID NO: 3596064 - DNA, 16 bp, Homo sapiens
tcagggaccgtccagg

SEQ ID NO: 3596065 - DNA, 12 bp, Homo sapiens
tcaggggacccc

SEQ ID NO: 3596066 - DNA, 15 bp, Homo sapiens
tcagggtcatagcat

SEQ ID NO: 3596067 - DNA, 21 bp, Homo sapiens
tcagggtccaggagagcctgg

SEQ ID NO: 3596068 - DNA, 23 bp, Homo sapiens
tcagggtccaggagagcctgggg

SEQ ID NO: 3596069 - DNA, 23 bp, Homo sapiens
tcagggtgagacgtgatgggcta

SEQ ID NO: 3596070 - DNA, 16 bp, Homo sapiens
tcaggtcctcagagaa

SEQ ID NO: 3596071 - DNA, 10 bp, Homo sapiens
tcaggtctgt

SEQ ID NO: 3596072 - DNA, 17 bp, Homo sapiens
tcaggtctgtatgtcat

SEQ ID NO: 3596073 - DNA, 19 bp, Homo sapiens
tcaggtctgtatgtcatgg

SEQ ID NO: 3596074 - DNA, 14 bp, Homo sapiens
tcaggtggctgtgg

SEQ ID NO: 3596075 - DNA, 13 bp, Homo sapiens
tcaggtgtataaa

SEQ ID NO: 3596076 - DNA, 14 bp, Homo sapiens
tcagtaagttatct

SEQ ID NO: 3596077 - DNA, 23 bp, Homo sapiens
tcagtaagttatctttgaatatg

SEQ ID NO: 3596078 - DNA, 15 bp, Homo sapiens
tcagtaatttgagga

SEQ ID NO: 3596079 - DNA, 17 bp, Homo sapiens
tcagtaatttgaggaca

SEQ ID NO: 3596080 - DNA, 15 bp, Homo sapiens
tcagtcattttgggt

SEQ ID NO: 3596081 - DNA, 20 bp, Homo sapiens
tcagtcctttgtctttcttt

SEQ ID NO: 3596082 - DNA, 20 bp, Homo sapiens
tcagtctctcttctctccag

SEQ ID NO: 3596083 - DNA, 16 bp, Homo sapiens
tcagtgaatatttttg

SEQ ID NO: 3596084 - DNA, 15 bp, Homo sapiens
tcagtgagcccctcc

SEQ ID NO: 3596085 - DNA, 17 bp, Homo sapiens
tcagtgagcccctcccc

SEQ ID NO: 3596086 - DNA, 18 bp, Homo sapiens
tcagtgagcccctcccca

SEQ ID NO: 3596087 - DNA, 19 bp, Homo sapiens
tcagtgagcccctccccag

SEQ ID NO: 3596088 - DNA, 22 bp, Homo sapiens
tcagtgagcccctccccagcca

SEQ ID NO: 3596089 - DNA, 21 bp, Homo sapiens
tcagtgatggaatatcatgaa

SEQ ID NO: 3596090 - DNA, 17 bp, Homo sapiens
tcagtggggcagcctct

SEQ ID NO: 3596091 - DNA, 20 bp, Homo sapiens
tcagtggggctggcatcaag

SEQ ID NO: 3596092 - DNA, 20 bp, Homo sapiens
tcagtgtgtcagtttttcct

SEQ ID NO: 3596093 - DNA, 14 bp, Homo sapiens
tcagttcagcttta

SEQ ID NO: 3596094 - DNA, 13 bp, Homo sapiens
tcagttctattta

SEQ ID NO: 3596095 - DNA, 20 bp, Homo sapiens
tcagttgaaaatgcaactct

SEQ ID NO: 3596096 - DNA, 15 bp, Homo sapiens
tcagttgttatttat

SEQ ID NO: 3596097 - DNA, 17 bp, Homo sapiens
tcagttgttatttattg

SEQ ID NO: 3596098 - DNA, 20 bp, Homo sapiens
tcagttgttatttattgaaa

SEQ ID NO: 3596099 - DNA, 16 bp, Homo sapiens
tcagtttatgttgtac

SEQ ID NO: 3596100 - DNA, 13 bp, Homo sapiens
tcagtttttcctc

SEQ ID NO: 3596101 - DNA, 16 bp, Homo sapiens
tcataagatattttat

SEQ ID NO: 3596102 - DNA, 15 bp, Homo sapiens
tcataagtgaatatt

SEQ ID NO: 3596103 - DNA, 14 bp, Homo sapiens
tcataattttgcaa

SEQ ID NO: 3596104 - DNA, 19 bp, Homo sapiens
tcatacactaaccaaatct

SEQ ID NO: 3596105 - DNA, 20 bp, Homo sapiens
tcatagtgatagagtgcagt

SEQ ID NO: 3596106 - DNA, 18 bp, Homo sapiens
tcatataagattcatatt

SEQ ID NO: 3596107 - DNA, 22 bp, Homo sapiens
tcatatggtaggaccctcgaga

SEQ ID NO: 3596108 - DNA, 13 bp, Homo sapiens
tcatatttgaaaa

SEQ ID NO: 3596109 - DNA, 19 bp, Homo sapiens
tcatcaccatttcctcctt

SEQ ID NO: 3596110 - DNA, 16 bp, Homo sapiens
tcatcatgataattca

SEQ ID NO: 3596111 - DNA, 12 bp, Homo sapiens
tcatcatttcag

SEQ ID NO: 3596112 - DNA, 14 bp, Homo sapiens
tcatcatttcagcc

SEQ ID NO: 3596113 - DNA, 18 bp, Homo sapiens
tcatcatttcagccaaag

SEQ ID NO: 3596114 - DNA, 13 bp, Homo sapiens
tcatccaatgtga

SEQ ID NO: 3596115 - DNA, 15 bp, Homo sapiens
tcatccaatgtgaag

SEQ ID NO: 3596116 - DNA, 15 bp, Homo sapiens
tcatccatcctgagc

SEQ ID NO: 3596117 - DNA, 14 bp, Homo sapiens
tcatccgcctgtgg

SEQ ID NO: 3596118 - DNA, 17 bp, Homo sapiens
tcatcctaaagaacaaa

SEQ ID NO: 3596119 - DNA, 18 bp, Homo sapiens
tcatcctcaaagaaagtg

SEQ ID NO: 3596120 - DNA, 15 bp, Homo sapiens
tcatctaccttttct

SEQ ID NO: 3596121 - DNA, 16 bp, Homo sapiens
tcatctccctcctcca

SEQ ID NO: 3596122 - DNA, 16 bp, Homo sapiens
tcatctctctgcccaa

SEQ ID NO: 3596123 - DNA, 19 bp, Homo sapiens
tcatctgggggagtggaat

SEQ ID NO: 3596124 - DNA, 16 bp, Homo sapiens
tcatctgtggagctgc

SEQ ID NO: 3596125 - DNA, 19 bp, Homo sapiens
tcatctgtggagctgccac

SEQ ID NO: 3596126 - DNA, 20 bp, Homo sapiens
tcatcttgcagcatttacta

SEQ ID NO: 3596127 - DNA, 21 bp, Homo sapiens
tcatcttgcagcatttactat

SEQ ID NO: 3596128 - DNA, 21 bp, Homo sapiens
tcatcttgctaccagtattta

SEQ ID NO: 3596129 - DNA, 22 bp, Homo sapiens
tcatcttggaaaggggaggagc

SEQ ID NO: 3596130 - DNA, 20 bp, Homo sapiens
tcatcttggccctcctcagc

SEQ ID NO: 3596131 - DNA, 22 bp, Homo sapiens
tcatcttggccctcctcagctc

SEQ ID NO: 3596132 - DNA, 15 bp, Homo sapiens
tcatcttttgaagag

SEQ ID NO: 3596133 - DNA, 22 bp, Homo sapiens
tcatgatagaaggctatgggga

SEQ ID NO: 3596134 - DNA, 11 bp, Homo sapiens
tcatgattttt

SEQ ID NO: 3596135 - DNA, 17 bp, Homo sapiens
tcatgcacccctgagcc

SEQ ID NO: 3596136 - DNA, 16 bp, Homo sapiens
tcatgcgcaactggag

SEQ ID NO: 3596137 - DNA, 16 bp, Homo sapiens
tcatgcgtacgtccca

SEQ ID NO: 3596138 - DNA, 17 bp, Homo sapiens
tcatggatatttgtcaa

SEQ ID NO: 3596139 - DNA, 15 bp, Homo sapiens
tcatgggtcaagaga

SEQ ID NO: 3596140 - DNA, 18 bp, Homo sapiens
tcatggttcaagtattaa

SEQ ID NO: 3596141 - DNA, 20 bp, Homo sapiens
tcatgtacttttaaattata

SEQ ID NO: 3596142 - DNA, 18 bp, Homo sapiens
tcatgtccagtgagcagt

SEQ ID NO: 3596143 - DNA, 17 bp, Homo sapiens
tcatgtgaccactctgt

SEQ ID NO: 3596144 - DNA, 16 bp, Homo sapiens
tcatgtgagtctggga

SEQ ID NO: 3596145 - DNA, 17 bp, Homo sapiens
tcatgtgagtctgggat

SEQ ID NO: 3596146 - DNA, 21 bp, Homo sapiens
tcatgtgcattattttccaga

SEQ ID NO: 3596147 - DNA, 14 bp, Homo sapiens
tcatgttatgcagt

SEQ ID NO: 3596148 - DNA, 19 bp, Homo sapiens
tcatgttttagcatttgta

SEQ ID NO: 3596149 - DNA, 18 bp, Homo sapiens
tcattaccctacagacag

SEQ ID NO: 3596150 - DNA, 19 bp, Homo sapiens
tcattactgttccagattc

SEQ ID NO: 3596151 - DNA, 14 bp, Homo sapiens
tcattagttttgaa

SEQ ID NO: 3596152 - DNA, 16 bp, Homo sapiens
tcattatgttaatatt

SEQ ID NO: 3596153 - DNA, 13 bp, Homo sapiens
tcattcagttcta

SEQ ID NO: 3596154 - DNA, 16 bp, Homo sapiens
tcattcagttctaggc

SEQ ID NO: 3596155 - DNA, 17 bp, Homo sapiens
tcattcagttctaggcc

SEQ ID NO: 3596156 - DNA, 14 bp, Homo sapiens
tcattccagaggaa

SEQ ID NO: 3596157 - DNA, 23 bp, Homo sapiens
tcattcgctactatgatttaatt

SEQ ID NO: 3596158 - DNA, 18 bp, Homo sapiens
tcattctaccaagctgtc

SEQ ID NO: 3596159 - DNA, 20 bp, Homo sapiens
tcattctgaaccctccaaag

SEQ ID NO: 3596160 - DNA, 21 bp, Homo sapiens
tcattctggttccctgctgcg

SEQ ID NO: 3596161 - DNA, 22 bp, Homo sapiens
tcattctttactgcactcagat

SEQ ID NO: 3596162 - DNA, 13 bp, Homo sapiens
tcattggcaaagt

SEQ ID NO: 3596163 - DNA, 15 bp, Homo sapiens
tcattggcaaagtga

SEQ ID NO: 3596164 - DNA, 18 bp, Homo sapiens
tcatttagtcatgtgacc

SEQ ID NO: 3596165 - DNA, 16 bp, Homo sapiens
tcatttatctataatt

SEQ ID NO: 3596166 - DNA, 16 bp, Homo sapiens
tcatttcagccaaagt

SEQ ID NO: 3596167 - DNA, 19 bp, Homo sapiens
tcatttcagggtcttggct

SEQ ID NO: 3596168 - DNA, 19 bp, Homo sapiens
tcatttctatattcctcca

SEQ ID NO: 3596169 - DNA, 21 bp, Homo sapiens
tcatttctatattcctccagc

SEQ ID NO: 3596170 - DNA, 22 bp, Homo sapiens
tcatttctatattcctccagct

SEQ ID NO: 3596171 - DNA, 14 bp, Homo sapiens
tcatttctttgagt

SEQ ID NO: 3596172 - DNA, 14 bp, Homo sapiens
tcatttgctttgga

SEQ ID NO: 3596173 - DNA, 16 bp, Homo sapiens
tcatttgctttggaag

SEQ ID NO: 3596174 - DNA, 23 bp, Homo sapiens
tcatttgttaatatttcttcgtg

SEQ ID NO: 3596175 - DNA, 15 bp, Homo sapiens
tcatttgttggaatg

SEQ ID NO: 3596176 - DNA, 15 bp, Homo sapiens
tcatttgtttaaaca

SEQ ID NO: 3596177 - DNA, 21 bp, Homo sapiens
tcatttgtttaaacaatcttt

SEQ ID NO: 3596178 - DNA, 23 bp, Homo sapiens
tcattttttttctttgaataaat

SEQ ID NO: 3596179 - DNA, 22 bp, Homo sapiens
tccaaaacatttctggacagta

SEQ ID NO: 3596180 - DNA, 16 bp, Homo sapiens
tccaaaacttctcttg

SEQ ID NO: 3596181 - DNA, 12 bp, Homo sapiens
tccaaagaaatg

SEQ ID NO: 3596182 - DNA, 14 bp, Homo sapiens
tccaaagaagatag

SEQ ID NO: 3596183 - DNA, 22 bp, Homo sapiens
tccaaagaagatagctctctga

SEQ ID NO: 3596184 - DNA, 17 bp, Homo sapiens
tccaaaggaactctaga

SEQ ID NO: 3596185 - DNA, 18 bp, Homo sapiens
tccaaaggaactctagag

SEQ ID NO: 3596186 - DNA, 19 bp, Homo sapiens
tccaaattcaccttcccct

SEQ ID NO: 3596187 - DNA, 21 bp, Homo sapiens
tccaacctgcaaagatctgtc

SEQ ID NO: 3596188 - DNA, 17 bp, Homo sapiens
tccaacgcccctgtggc

SEQ ID NO: 3596189 - DNA, 18 bp, Homo sapiens
tccaacgcccctgtggcc

SEQ ID NO: 3596190 - DNA, 21 bp, Homo sapiens
tccaacgcccctgtggccaac

SEQ ID NO: 3596191 - DNA, 21 bp, Homo sapiens
tccaactactaatagaataaa

SEQ ID NO: 3596192 - DNA, 13 bp, Homo sapiens
tccaagaggctgt

SEQ ID NO: 3596193 - DNA, 19 bp, Homo sapiens
tccaagagggaatggtcaa

SEQ ID NO: 3596194 - DNA, 22 bp, Homo sapiens
tcccctaaagccaggctcagga

SEQ ID NO: 3596195 - DNA, 23 bp, Homo sapiens
tcccctaaagccaggctcaggag

SEQ ID NO: 3596196 - DNA, 22 bp, Homo sapiens
tcccctaaagcctcaaaacaaa

SEQ ID NO: 3596197 - DNA, 16 bp, Homo sapiens
tcccctacccaaccct

SEQ ID NO: 3596198 - DNA, 13 bp, Homo sapiens
tcccctatgctgg

SEQ ID NO: 3596199 - DNA, 16 bp, Homo sapiens
tcccctatgctggtag

SEQ ID NO: 3596200 - DNA, 19 bp, Homo sapiens
tcccctccctgcctgctcc

SEQ ID NO: 3596201 - DNA, 11 bp, Homo sapiens
tcccctcctgc

SEQ ID NO: 3596202 - DNA, 13 bp, Homo sapiens
tcccctcctgcac

SEQ ID NO: 3596203 - DNA, 14 bp, Homo sapiens
tcccctcctgcaca

SEQ ID NO: 3596204 - DNA, 18 bp, Homo sapiens
tcccctcctgcacacagg

SEQ ID NO: 3596205 - DNA, 17 bp, Homo sapiens
tcccctcggagaagagc

SEQ ID NO: 3596206 - DNA, 23 bp, Homo sapiens
tcccctctcgccccatccctgct

SEQ ID NO: 3596207 - DNA, 15 bp, Homo sapiens
tcccctgacagggcc

SEQ ID NO: 3596208 - DNA, 14 bp, Homo sapiens
tcccctggggacgc

SEQ ID NO: 3596209 - DNA, 13 bp, Homo sapiens
tccccttccctta

SEQ ID NO: 3596210 - DNA, 16 bp, Homo sapiens
tccccttcctgtttca

SEQ ID NO: 3596211 - DNA, 21 bp, Homo sapiens
tccccttcctgtttcagaccc

SEQ ID NO: 3596212 - DNA, 22 bp, Homo sapiens
tcccgcacatggtgtggggggc

SEQ ID NO: 3596213 - DNA, 16 bp, Homo sapiens
tcccgccccgcccctc

SEQ ID NO: 3596214 - DNA, 16 bp, Homo sapiens
tcccggagggccctga

SEQ ID NO: 3596215 - DNA, 15 bp, Homo sapiens
tcccggccagctctg

SEQ ID NO: 3596216 - DNA, 15 bp, Homo sapiens
tcccgtaaggctgta

SEQ ID NO: 3596217 - DNA, 13 bp, Homo sapiens
tccctacactgat

SEQ ID NO: 3596218 - DNA, 15 bp, Homo sapiens
tccctacactgatgc

SEQ ID NO: 3596219 - DNA, 13 bp, Homo sapiens
tccctacatgtat

SEQ ID NO: 3596220 - DNA, 19 bp, Homo sapiens
tccctaccgagtctcttct

SEQ ID NO: 3596221 - DNA, 22 bp, Homo sapiens
tccctaccgagtctcttctcca

SEQ ID NO: 3596222 - DNA, 16 bp, Homo sapiens
tccctagtaaaaatac

SEQ ID NO: 3596223 - DNA, 13 bp, Homo sapiens
tccctcacctgta

SEQ ID NO: 3596224 - DNA, 21 bp, Homo sapiens
tccctcaccttggcaccagac

SEQ ID NO: 3596225 - DNA, 16 bp, Homo sapiens
tccctcaggcctatgc

SEQ ID NO: 3596226 - DNA, 16 bp, Homo sapiens
tccctcagtgccctca

SEQ ID NO: 3596227 - DNA, 23 bp, Homo sapiens
tccctccagtattgccccctctc

SEQ ID NO: 3596228 - DNA, 19 bp, Homo sapiens
tccctccatttttctccca

SEQ ID NO: 3596229 - DNA, 23 bp, Homo sapiens
tccctcccagaggagccaccagt

SEQ ID NO: 3596230 - DNA, 16 bp, Homo sapiens
tccctcccccccatgc

SEQ ID NO: 3596231 - DNA, 17 bp, Homo sapiens
tccctccccctccttgt

SEQ ID NO: 3596232 - DNA, 15 bp, Homo sapiens
tccctccgccttctc

SEQ ID NO: 3596233 - DNA, 14 bp, Homo sapiens
tccctcctcaggga

SEQ ID NO: 3596234 - DNA, 13 bp, Homo sapiens
tccctctagtgcc

SEQ ID NO: 3596235 - DNA, 15 bp, Homo sapiens
tccctctcagaggcc

SEQ ID NO: 3596236 - DNA, 19 bp, Homo sapiens
tccctctcagaggcctgct

SEQ ID NO: 3596237 - DNA, 19 bp, Homo sapiens
tccctctcttccccttccc

SEQ ID NO: 3596238 - DNA, 16 bp, Homo sapiens
tccctcttcctctcca

SEQ ID NO: 3596239 - DNA, 18 bp, Homo sapiens
tccctgaacgccctggta

SEQ ID NO: 3596240 - DNA, 14 bp, Homo sapiens
tccctgactggcca

SEQ ID NO: 3596241 - DNA, 15 bp, Homo sapiens
tccctgcaaaactcc

SEQ ID NO: 3596242 - DNA, 19 bp, Homo sapiens
tccctgcaaaactccaggc

SEQ ID NO: 3596243 - DNA, 20 bp, Homo sapiens
tccctgcaaaactccaggca

SEQ ID NO: 3596244 - DNA, 15 bp, Homo sapiens
tccctgcagggccat

SEQ ID NO: 3596245 - DNA, 20 bp, Homo sapiens
tccctgcatctgaccagcag

SEQ ID NO: 3596246 - DNA, 22 bp, Homo sapiens
tccctgcatctgaccagcagcg

SEQ ID NO: 3596247 - DNA, 11 bp, Homo sapiens
tccctgcccaa

SEQ ID NO: 3596248 - DNA, 16 bp, Homo sapiens
tccctgcccaaaccct

SEQ ID NO: 3596249 - DNA, 20 bp, Homo sapiens
tccctgcccctcccttcaac

SEQ ID NO: 3596250 - DNA, 21 bp, Homo sapiens
tccctgcctgctccttggcac

SEQ ID NO: 3596251 - DNA, 14 bp, Homo sapiens
tccctgcctggagg

SEQ ID NO: 3596252 - DNA, 17 bp, Homo sapiens
tccctgcctgtttcccg

SEQ ID NO: 3596253 - DNA, 14 bp, Homo sapiens
tccctgctgaatgc

SEQ ID NO: 3596254 - DNA, 16 bp, Homo sapiens
tccctgctgcgctgct

SEQ ID NO: 3596255 - DNA, 21 bp, Homo sapiens
tccctgctgtgccatgctggg

SEQ ID NO: 3596256 - DNA, 15 bp, Homo sapiens
tccctgcttgcccgc

SEQ ID NO: 3596257 - DNA, 19 bp, Homo sapiens
tccctgcttgcccgctccc

SEQ ID NO: 3596258 - DNA, 15 bp, Homo sapiens
tccctgctttgcatc

SEQ ID NO: 3596259 - DNA, 20 bp, Homo sapiens
tccctggaaaccttccaccc

SEQ ID NO: 3596260 - DNA, 23 bp, Homo sapiens
tccctggaaaccttccacccagt

SEQ ID NO: 3596261 - DNA, 20 bp, Homo sapiens
tccctggaactcctggcctt

SEQ ID NO: 3596262 - DNA, 21 bp, Homo sapiens
tccctggaagctctccgagct

SEQ ID NO: 3596263 - DNA, 14 bp, Homo sapiens
tccctggacacagc

SEQ ID NO: 3596264 - DNA, 16 bp, Homo sapiens
tccctggacacagctc

SEQ ID NO: 3596265 - DNA, 19 bp, Homo sapiens
tccctggacacagctcttc

SEQ ID NO: 3596266 - DNA, 15 bp, Homo sapiens
tccctgggagggagg

SEQ ID NO: 3596267 - DNA, 19 bp, Homo sapiens
tccctggggtcaccttcta

SEQ ID NO: 3596268 - DNA, 20 bp, Homo sapiens
tccctgggtttgggagccag

SEQ ID NO: 3596269 - DNA, 22 bp, Homo sapiens
tccctgggtttgggagccagga

SEQ ID NO: 3596270 - DNA, 23 bp, Homo sapiens
tccctgggtttgggagccaggac

SEQ ID NO: 3596271 - DNA, 15 bp, Homo sapiens
tccctgtccttccct

SEQ ID NO: 3596272 - DNA, 20 bp, Homo sapiens
tccctgtctccagctgcctg

SEQ ID NO: 3596273 - DNA, 21 bp, Homo sapiens
tccctgtggcactcagggagc

SEQ ID NO: 3596274 - DNA, 17 bp, Homo sapiens
tccctgtgtcatttcaa

SEQ ID NO: 3596275 - DNA, 14 bp, Homo sapiens
tccctgttctccct

SEQ ID NO: 3596276 - DNA, 17 bp, Homo sapiens
tccctgttctccctttc

SEQ ID NO: 3596277 - DNA, 18 bp, Homo sapiens
tcccttaataaaatattc

SEQ ID NO: 3596278 - DNA, 19 bp, Homo sapiens
tcccttaccctcctctgct

SEQ ID NO: 3596279 - DNA, 22 bp, Homo sapiens
tcccttaccctcctctgctggg

SEQ ID NO: 3596280 - DNA, 11 bp, Homo sapiens
tcccttcaacc

SEQ ID NO: 3596281 - DNA, 21 bp, Homo sapiens
tcccttcaagacgaggggcag

SEQ ID NO: 3596282 - DNA, 12 bp, Homo sapiens
tcccttcctgga

SEQ ID NO: 3596283 - DNA, 14 bp, Homo sapiens
tcccttcctggaaa

SEQ ID NO: 3596284 - DNA, 21 bp, Homo sapiens
tcccttcctggaaacagcatg

SEQ ID NO: 3596285 - DNA, 22 bp, Homo sapiens
tcccttctagggttattgcatt

SEQ ID NO: 3596286 - DNA, 14 bp, Homo sapiens
tcccttctgctact

SEQ ID NO: 3596287 - DNA, 19 bp, Homo sapiens
tcccttctggacactgaga

SEQ ID NO: 3596288 - DNA, 17 bp, Homo sapiens
tcccttctttttcttct

SEQ ID NO: 3596289 - DNA, 12 bp, Homo sapiens
tcccttgcctct

SEQ ID NO: 3596290 - DNA, 13 bp, Homo sapiens
tcccttgcctctg

SEQ ID NO: 3596291 - DNA, 14 bp, Homo sapiens
tcccttgcctctgc

SEQ ID NO: 3596292 - DNA, 18 bp, Homo sapiens
tcccttgccttcctcagc

SEQ ID NO: 3596293 - DNA, 15 bp, Homo sapiens
tcccttggacatttt

SEQ ID NO: 3596294 - DNA, 16 bp, Homo sapiens
tcccttggacatttta

SEQ ID NO: 3596295 - DNA, 18 bp, Homo sapiens
tcccttggacattttatg

SEQ ID NO: 3596296 - DNA, 14 bp, Homo sapiens
tccctttctctctc

SEQ ID NO: 3596297 - DNA, 23 bp, Homo sapiens
tccgaagtctctgattagttgac

SEQ ID NO: 3596298 - DNA, 12 bp, Homo sapiens
tccgagctctgg

SEQ ID NO: 3596299 - DNA, 16 bp, Homo sapiens
tccgagctctggtgct

SEQ ID NO: 3596300 - DNA, 20 bp, Homo sapiens
tccgagctctggtgctttag

SEQ ID NO: 3596301 - DNA, 18 bp, Homo sapiens
tccgcagttgtagcagaa

SEQ ID NO: 3596302 - DNA, 17 bp, Homo sapiens
tccgcggcggcttcgcg

SEQ ID NO: 3596303 - DNA, 19 bp, Homo sapiens
tccgctgaggggtctcgga

SEQ ID NO: 3596304 - DNA, 21 bp, Homo sapiens
tccgctttgaaagaagcaaga

SEQ ID NO: 3596305 - DNA, 17 bp, Homo sapiens
tccggagcgccctgcag

SEQ ID NO: 3596306 - DNA, 18 bp, Homo sapiens
tccggagcgccctgcagg

SEQ ID NO: 3596307 - DNA, 21 bp, Homo sapiens
tccggagcgccctgcagggcc

SEQ ID NO: 3596308 - DNA, 12 bp, Homo sapiens
tccgggcagaaa

SEQ ID NO: 3596309 - DNA, 18 bp, Homo sapiens
tccgggctttcccccagg

SEQ ID NO: 3596310 - DNA, 14 bp, Homo sapiens
tccgtaaatgtctg

SEQ ID NO: 3596311 - DNA, 15 bp, Homo sapiens
tccgtaaatgtctgc

SEQ ID NO: 3596312 - DNA, 17 bp, Homo sapiens
tccgtacttgggtcaca

SEQ ID NO: 3596313 - DNA, 14 bp, Homo sapiens
tccgtagctctgct

SEQ ID NO: 3596314 - DNA, 20 bp, Homo sapiens
tccgtagctctgctgctgat

SEQ ID NO: 3596315 - DNA, 21 bp, Homo sapiens
tccgtagggtctttcttggga

SEQ ID NO: 3596316 - DNA, 15 bp, Homo sapiens
tccgtcactacctgg

SEQ ID NO: 3596317 - DNA, 17 bp, Homo sapiens
tccgtgaactctggtgc

SEQ ID NO: 3596318 - DNA, 22 bp, Homo sapiens
tccgtgaactctggtgctcctg

SEQ ID NO: 3596319 - DNA, 19 bp, Homo sapiens
tccgtgccccttccctggg

SEQ ID NO: 3596320 - DNA, 16 bp, Homo sapiens
tccgtgcctcttttta

SEQ ID NO: 3596321 - DNA, 19 bp, Homo sapiens
tccgtggccccgccctcag

SEQ ID NO: 3596322 - DNA, 13 bp, Homo sapiens
tcctaaaactggg

SEQ ID NO: 3596323 - DNA, 21 bp, Homo sapiens
tcctaaaactgggattaagaa

SEQ ID NO: 3596324 - DNA, 19 bp, Homo sapiens
tcctaatcaaattctgtct

SEQ ID NO: 3596325 - DNA, 19 bp, Homo sapiens
tcctaatggctatttttga

SEQ ID NO: 3596326 - DNA, 15 bp, Homo sapiens
tcgtgctccgcaggg

SEQ ID NO: 3596327 - DNA, 17 bp, Homo sapiens
tcgtgctccgcagggcg

SEQ ID NO: 3596328 - DNA, 19 bp, Homo sapiens
tcgtgctgtgctctggcac

SEQ ID NO: 3596329 - DNA, 14 bp, Homo sapiens
tcgtgggtcccaga

SEQ ID NO: 3596330 - DNA, 22 bp, Homo sapiens
tcgtttacactgcacattgaat

SEQ ID NO: 3596331 - DNA, 16 bp, Homo sapiens
tctaaaacaataaaga

SEQ ID NO: 3596332 - DNA, 14 bp, Homo sapiens
tctaaaagctctgt

SEQ ID NO: 3596333 - DNA, 22 bp, Homo sapiens
tctaaaatttcataattctgaa

SEQ ID NO: 3596334 - DNA, 12 bp, Homo sapiens
tctaaagagcat

SEQ ID NO: 3596335 - DNA, 18 bp, Homo sapiens
tctaaataggatcctgga

SEQ ID NO: 3596336 - DNA, 22 bp, Homo sapiens
tctaaatatcccttggacattt

SEQ ID NO: 3596337 - DNA, 20 bp, Homo sapiens
tctaaatggtgctgcagatt

SEQ ID NO: 3596338 - DNA, 16 bp, Homo sapiens
tctaaattttctaaat

SEQ ID NO: 3596339 - DNA, 12 bp, Homo sapiens
tctaacaagtca

SEQ ID NO: 3596340 - DNA, 20 bp, Homo sapiens
tctaacagccctcctctgca

SEQ ID NO: 3596341 - DNA, 13 bp, Homo sapiens
tctaacatgaaat

SEQ ID NO: 3596342 - DNA, 15 bp, Homo sapiens
tctaacccaagacat

SEQ ID NO: 3596343 - DNA, 15 bp, Homo sapiens
tctaagcctgaaggg

SEQ ID NO: 3596344 - DNA, 15 bp, Homo sapiens
tctaagtaaaaccac

SEQ ID NO: 3596345 - DNA, 20 bp, Homo sapiens
tctaagtaaaaccacagcag

SEQ ID NO: 3596346 - DNA, 23 bp, Homo sapiens
tctaagtaaaaccacagcagttg

SEQ ID NO: 3596347 - DNA, 12 bp, Homo sapiens
tctaagtattta

SEQ ID NO: 3596348 - DNA, 13 bp, Homo sapiens
tctaagtgatata

SEQ ID NO: 3596349 - DNA, 14 bp, Homo sapiens
tctaagtgctgctg

SEQ ID NO: 3596350 - DNA, 16 bp, Homo sapiens
tctaagtgctgctgtg

SEQ ID NO: 3596351 - DNA, 18 bp, Homo sapiens
tctaagtgctgctgtgga

SEQ ID NO: 3596352 - DNA, 19 bp, Homo sapiens
tctaagtgctgctgtggag

SEQ ID NO: 3596353 - DNA, 16 bp, Homo sapiens
tctaatacaagcatat

SEQ ID NO: 3596354 - DNA, 15 bp, Homo sapiens
tctaatcagtgatta

SEQ ID NO: 3596355 - DNA, 22 bp, Homo sapiens
tctaatccttttccttatttgc

SEQ ID NO: 3596356 - DNA, 20 bp, Homo sapiens
tctaatctgtgctgtttcaa

SEQ ID NO: 3596357 - DNA, 19 bp, Homo sapiens
tctaatgattcaaatgttt

SEQ ID NO: 3596358 - DNA, 21 bp, Homo sapiens
tctaatgccttttgaatacat

SEQ ID NO: 3596359 - DNA, 18 bp, Homo sapiens
tctaatgttattttcctt

SEQ ID NO: 3596360 - DNA, 21 bp, Homo sapiens
tctaatgttattttccttctg

SEQ ID NO: 3596361 - DNA, 21 bp, Homo sapiens
tctaattcttcctttgtaaaa

SEQ ID NO: 3596362 - DNA, 22 bp, Homo sapiens
tctaatttctttagttttctat

SEQ ID NO: 3596363 - DNA, 16 bp, Homo sapiens
tctacagataatgtct

SEQ ID NO: 3596364 - DNA, 23 bp, Homo sapiens
tctacagctaatcagcattctca

SEQ ID NO: 3596365 - DNA, 16 bp, Homo sapiens
tctacatactatggaa

SEQ ID NO: 3596366 - DNA, 14 bp, Homo sapiens
tctaccatttcaga

SEQ ID NO: 3596367 - DNA, 16 bp, Homo sapiens
tctaccccagactaga

SEQ ID NO: 3596368 - DNA, 18 bp, Homo sapiens
tctaccccagactagatg

SEQ ID NO: 3596369 - DNA, 19 bp, Homo sapiens
tctaccgtggatttgtact

SEQ ID NO: 3596370 - DNA, 17 bp, Homo sapiens
tctactagattgtgatc

SEQ ID NO: 3596371 - DNA, 15 bp, Homo sapiens
tctacttttactcat

SEQ ID NO: 3596372 - DNA, 13 bp, Homo sapiens
tctagaaagaata

SEQ ID NO: 3596373 - DNA, 13 bp, Homo sapiens
tctagaggagggg

SEQ ID NO: 3596374 - DNA, 18 bp, Homo sapiens
tctagatggctcctctca

SEQ ID NO: 3596375 - DNA, 20 bp, Homo sapiens
tctagatggctcctctcagt

SEQ ID NO: 3596376 - DNA, 12 bp, Homo sapiens
tctagcctctgg

SEQ ID NO: 3596377 - DNA, 14 bp, Homo sapiens
tctagcctggcaac

SEQ ID NO: 3596378 - DNA, 15 bp, Homo sapiens
tctagctctcacaga

SEQ ID NO: 3596379 - DNA, 21 bp, Homo sapiens
tctagctgggggtgggccagg

SEQ ID NO: 3596380 - DNA, 19 bp, Homo sapiens
tctaggcctttcctctgca

SEQ ID NO: 3596381 - DNA, 21 bp, Homo sapiens
tctagggactgccaggctgtt

SEQ ID NO: 3596382 - DNA, 23 bp, Homo sapiens
tctagggactgccaggctgtttc

SEQ ID NO: 3596383 - DNA, 20 bp, Homo sapiens
tctagtagtgtggcctgtgc

SEQ ID NO: 3596384 - DNA, 14 bp, Homo sapiens
tctagtcatttgtt

SEQ ID NO: 3596385 - DNA, 18 bp, Homo sapiens
tctagtgccttctaaagg

SEQ ID NO: 3596386 - DNA, 23 bp, Homo sapiens
tctagtgccttctaaaggtgttg

SEQ ID NO: 3596387 - DNA, 17 bp, Homo sapiens
tctagtgtccataaata

SEQ ID NO: 3596388 - DNA, 15 bp, Homo sapiens
tctagttctttcctc

SEQ ID NO: 3596389 - DNA, 21 bp, Homo sapiens
tctagttgcccccattcccag

SEQ ID NO: 3596390 - DNA, 22 bp, Homo sapiens
tctagttgcccccattcccagc

SEQ ID NO: 3596391 - DNA, 16 bp, Homo sapiens
tctatacccacccaga

SEQ ID NO: 3596392 - DNA, 22 bp, Homo sapiens
tctatactgtggcctgcaggag

SEQ ID NO: 3596393 - DNA, 15 bp, Homo sapiens
tctatagtgatgatg

SEQ ID NO: 3596394 - DNA, 20 bp, Homo sapiens
tctatataaaatgtattcaa

SEQ ID NO: 3596395 - DNA, 22 bp, Homo sapiens
tctatataaaatgtattcaagc

SEQ ID NO: 3596396 - DNA, 17 bp, Homo sapiens
tctatattcctccagct

SEQ ID NO: 3596397 - DNA, 15 bp, Homo sapiens
tctatcagaaataca

SEQ ID NO: 3596398 - DNA, 13 bp, Homo sapiens
tctatgggaagat

SEQ ID NO: 3596399 - DNA, 22 bp, Homo sapiens
tctatgttaatattttatgtgt

SEQ ID NO: 3596400 - DNA, 23 bp, Homo sapiens
tctatgttaatattttatgtgta

SEQ ID NO: 3596401 - DNA, 14 bp, Homo sapiens
tctattatccagag

SEQ ID NO: 3596402 - DNA, 14 bp, Homo sapiens
tctattctccagac

SEQ ID NO: 3596403 - DNA, 15 bp, Homo sapiens
tctatttatttgtga

SEQ ID NO: 3596404 - DNA, 21 bp, Homo sapiens
tctatttctggatgaatgccc

SEQ ID NO: 3596405 - DNA, 15 bp, Homo sapiens
tctattttaattact

SEQ ID NO: 3596406 - DNA, 16 bp, Homo sapiens
tctattttactgtctt

SEQ ID NO: 3596407 - DNA, 21 bp, Homo sapiens
tctattttactgtcttgaatt

SEQ ID NO: 3596408 - DNA, 17 bp, Homo sapiens
tctattttgtaactgta

SEQ ID NO: 3596409 - DNA, 19 bp, Homo sapiens
tctattttgtaactgtaaa

SEQ ID NO: 3596410 - DNA, 12 bp, Homo sapiens
tctcaaaacaaa

SEQ ID NO: 3596411 - DNA, 13 bp, Homo sapiens
tctcaaaacaaaa

SEQ ID NO: 3596412 - DNA, 15 bp, Homo sapiens
tctcaaaacaaaaca

SEQ ID NO: 3596413 - DNA, 17 bp, Homo sapiens
tctcaaaactgcactgt

SEQ ID NO: 3596414 - DNA, 14 bp, Homo sapiens
tctcaaactcctga

SEQ ID NO: 3596415 - DNA, 13 bp, Homo sapiens
tctcacaggctga

SEQ ID NO: 3596416 - DNA, 17 bp, Homo sapiens
tctcacatatacaagta

SEQ ID NO: 3596417 - DNA, 24 bp, Homo sapiens
tctcacctggacttaagcatctgg

SEQ ID NO: 3596418 - DNA, 21 bp, Homo sapiens
tctcacgcagccagtgcacat

SEQ ID NO: 3596419 - DNA, 24 bp, Homo sapiens
tctcactcaccactaccagccagc

SEQ ID NO: 3596420 - DNA, 13 bp, Homo sapiens
tctcactcctacc

SEQ ID NO: 3596421 - DNA, 20 bp, Homo sapiens
tctcactctgttgcccaggc

SEQ ID NO: 3596422 - DNA, 11 bp, Homo sapiens
tctcactgcca

SEQ ID NO: 3596423 - DNA, 15 bp, Homo sapiens
tctcagaggcctgct

SEQ ID NO: 3596424 - DNA, 14 bp, Homo sapiens
tctcagatttctga

SEQ ID NO: 3596425 - DNA, 21 bp, Homo sapiens
tctcagccataggtgcagttt

SEQ ID NO: 3596426 - DNA, 15 bp, Homo sapiens
tctcagcctctgcca

SEQ ID NO: 3596427 - DNA, 12 bp, Homo sapiens
tctcaggaaatc

SEQ ID NO: 3596428 - DNA, 21 bp, Homo sapiens
tctcagggaactgaccctcag

SEQ ID NO: 3596429 - DNA, 12 bp, Homo sapiens
tctcagggctgg

SEQ ID NO: 3596430 - DNA, 14 bp, Homo sapiens
tctcatctgtctcg

SEQ ID NO: 3596431 - DNA, 18 bp, Homo sapiens
tctcatgttttcaactgc

SEQ ID NO: 3596432 - DNA, 23 bp, Homo sapiens
tctcattcagaagatgcttagct

SEQ ID NO: 3596433 - DNA, 19 bp, Homo sapiens
tctcattgaccttcagatt

SEQ ID NO: 3596434 - DNA, 14 bp, Homo sapiens
tctcattgcttctg

SEQ ID NO: 3596435 - DNA, 15 bp, Homo sapiens
tctcattgcttctga

SEQ ID NO: 3596436 - DNA, 23 bp, Homo sapiens
tctcatttcgggtgaatctgtct

SEQ ID NO: 3596437 - DNA, 14 bp, Homo sapiens
tctccaaagaagat

SEQ ID NO: 3596438 - DNA, 15 bp, Homo sapiens
tctccaaagaagata

SEQ ID NO: 3596439 - DNA, 14 bp, Homo sapiens
tctccactggaccc

SEQ ID NO: 3596440 - DNA, 12 bp, Homo sapiens
tctccagctgcc

SEQ ID NO: 3596441 - DNA, 13 bp, Homo sapiens
tctccagctgcct

SEQ ID NO: 3596442 - DNA, 18 bp, Homo sapiens
tctccagctgcctgggcc

SEQ ID NO: 3596443 - DNA, 23 bp, Homo sapiens
tctccaggcctgtcaagagggag

SEQ ID NO: 3596444 - DNA, 23 bp, Homo sapiens
tctccaggggcctgcagaaggaa

SEQ ID NO: 3596445 - DNA, 18 bp, Homo sapiens
tctccaggtcagcctgga

SEQ ID NO: 3596446 - DNA, 19 bp, Homo sapiens
tctccagtatccactttgc

SEQ ID NO: 3596447 - DNA, 22 bp, Homo sapiens
tctccagttttatcccctgcct

SEQ ID NO: 3596448 - DNA, 20 bp, Homo sapiens
tctccatcccctccctgcct

SEQ ID NO: 3596449 - DNA, 22 bp, Homo sapiens
tctccatcccctccctgcctgc

SEQ ID NO: 3596450 - DNA, 22 bp, Homo sapiens
tctcccagctctagcctctgga

SEQ ID NO: 3596451 - DNA, 15 bp, Homo sapiens
tctcccagtcattta

SEQ ID NO: 3596452 - DNA, 18 bp, Homo sapiens
tctcccattgtccctctg

SEQ ID NO: 3596453 - DNA, 14 bp, Homo sapiens
tctccccagcccag

SEQ ID NO: 3596454 - DNA, 15 bp, Homo sapiens
tctccccagcccaga

SEQ ID NO: 3596455 - DNA, 19 bp, Homo sapiens
tctccccagcccagagaca

SEQ ID NO: 3596456 - DNA, 17 bp, Homo sapiens
tctccccatatataaat

SEQ ID NO: 3596457 - DNA, 21 bp, Homo sapiens
tctccccatatataaattatt

SEQ ID NO: 3596458 - DNA, 19 bp, Homo sapiens
tctgccaaaggatgtgata

SEQ ID NO: 3596459 - DNA, 13 bp, Homo sapiens
tctgccccagcct

SEQ ID NO: 3596460 - DNA, 18 bp, Homo sapiens
tctgccccatcctccagc

SEQ ID NO: 3596461 - DNA, 16 bp, Homo sapiens
tctgccccctagttca

SEQ ID NO: 3596462 - DNA, 15 bp, Homo sapiens
tctgccccctccccc

SEQ ID NO: 3596463 - DNA, 13 bp, Homo sapiens
tctgccctggatt

SEQ ID NO: 3596464 - DNA, 14 bp, Homo sapiens
tctgccctgggctc

SEQ ID NO: 3596465 - DNA, 19 bp, Homo sapiens
tctgccctgggctcctctt

SEQ ID NO: 3596466 - DNA, 15 bp, Homo sapiens
tctgcctctccctgg

SEQ ID NO: 3596467 - DNA, 17 bp, Homo sapiens
tctgcctctccctgggt

SEQ ID NO: 3596468 - DNA, 22 bp, Homo sapiens
tctgcctctccctgggtctggg

SEQ ID NO: 3596469 - DNA, 15 bp, Homo sapiens
tctgcctgggctctg

SEQ ID NO: 3596470 - DNA, 14 bp, Homo sapiens
tctgcctgtctccc

SEQ ID NO: 3596471 - DNA, 15 bp, Homo sapiens
tctgccttctgctga

SEQ ID NO: 3596472 - DNA, 16 bp, Homo sapiens
tctgccttctgctgaa

SEQ ID NO: 3596473 - DNA, 14 bp, Homo sapiens
tctgcgatgcagcg

SEQ ID NO: 3596474 - DNA, 18 bp, Homo sapiens
tctgctcagcttctcctg

SEQ ID NO: 3596475 - DNA, 22 bp, Homo sapiens
tctgctcagtaatttgaggaca

SEQ ID NO: 3596476 - DNA, 12 bp, Homo sapiens
tctgctcctgct

SEQ ID NO: 3596477 - DNA, 13 bp, Homo sapiens
tctgctcctgctt

SEQ ID NO: 3596478 - DNA, 16 bp, Homo sapiens
tctgctctatactgtg

SEQ ID NO: 3596479 - DNA, 20 bp, Homo sapiens
tctgctctatactgtggcct

SEQ ID NO: 3596480 - DNA, 13 bp, Homo sapiens
tctgctctggaat

SEQ ID NO: 3596481 - DNA, 21 bp, Homo sapiens
tctgctctgttttgcatggag

SEQ ID NO: 3596482 - DNA, 23 bp, Homo sapiens
tctgctgaaagactcgagaacca

SEQ ID NO: 3596483 - DNA, 13 bp, Homo sapiens
tctgctgaaggaa

SEQ ID NO: 3596484 - DNA, 22 bp, Homo sapiens
tctgctgagttggcctggccat

SEQ ID NO: 3596485 - DNA, 19 bp, Homo sapiens
tctgctgcagttaccacag

SEQ ID NO: 3596486 - DNA, 12 bp, Homo sapiens
tctgctgccagc

SEQ ID NO: 3596487 - DNA, 18 bp, Homo sapiens
tctgctgccggctctggg

SEQ ID NO: 3596488 - DNA, 14 bp, Homo sapiens
tctgctgttcttca

SEQ ID NO: 3596489 - DNA, 16 bp, Homo sapiens
tctgctgttcttcagt

SEQ ID NO: 3596490 - DNA, 12 bp, Homo sapiens
tctgcttcatcc

SEQ ID NO: 3596491 - DNA, 21 bp, Homo sapiens
tctgcttcatccaatgtgaag

SEQ ID NO: 3596492 - DNA, 16 bp, Homo sapiens
tctgcttgtattccaa

SEQ ID NO: 3596493 - DNA, 17 bp, Homo sapiens
tctggaacctcagcctg

SEQ ID NO: 3596494 - DNA, 21 bp, Homo sapiens
tctggaacctcagcctggcca

SEQ ID NO: 3596495 - DNA, 15 bp, Homo sapiens
tctggaagacgtggc

SEQ ID NO: 3596496 - DNA, 18 bp, Homo sapiens
tctggaagaggccttccc

SEQ ID NO: 3596497 - DNA, 20 bp, Homo sapiens
tctggaagaggccttcccat

SEQ ID NO: 3596498 - DNA, 20 bp, Homo sapiens
tctggacagccccaccctgg

SEQ ID NO: 3596499 - DNA, 22 bp, Homo sapiens
tctggactcctctgtccaggca

SEQ ID NO: 3596500 - DNA, 13 bp, Homo sapiens
tctggactggaaa

SEQ ID NO: 3596501 - DNA, 19 bp, Homo sapiens
tctggactggaaagcacaa

SEQ ID NO: 3596502 - DNA, 15 bp, Homo sapiens
tctggactgttctgt

SEQ ID NO: 3596503 - DNA, 20 bp, Homo sapiens
tctggagcgcttcagttcag

SEQ ID NO: 3596504 - DNA, 19 bp, Homo sapiens
tctggagtggccactaagc

SEQ ID NO: 3596505 - DNA, 15 bp, Homo sapiens
tctggattcatattt

SEQ ID NO: 3596506 - DNA, 19 bp, Homo sapiens
tctggattcatatttaatt

SEQ ID NO: 3596507 - DNA, 19 bp, Homo sapiens
tctggcaaaaaggagcctt

SEQ ID NO: 3596508 - DNA, 18 bp, Homo sapiens
tctggcaaacgtttctca

SEQ ID NO: 3596509 - DNA, 22 bp, Homo sapiens
tctggcaaacgtttctcaaatc

SEQ ID NO: 3596510 - DNA, 19 bp, Homo sapiens
tctggcaccatcagcctgt

SEQ ID NO: 3596511 - DNA, 22 bp, Homo sapiens
tctggccacatcagccccacag

SEQ ID NO: 3596512 - DNA, 11 bp, Homo sapiens
tctggccctat

SEQ ID NO: 3596513 - DNA, 21 bp, Homo sapiens
tctggcgcccctgcctgtgcc

SEQ ID NO: 3596514 - DNA, 12 bp, Homo sapiens
tctggctgagcc

SEQ ID NO: 3596515 - DNA, 18 bp, Homo sapiens
tctggctgagcccctggg

SEQ ID NO: 3596516 - DNA, 16 bp, Homo sapiens
tctggcttccctggaa

SEQ ID NO: 3596517 - DNA, 18 bp, Homo sapiens
tctggcttccctggaagc

SEQ ID NO: 3596518 - DNA, 12 bp, Homo sapiens
tctgggaaggga

SEQ ID NO: 3596519 - DNA, 20 bp, Homo sapiens
tctgggaagggagagttctt

SEQ ID NO: 3596520 - DNA, 18 bp, Homo sapiens
tctgggacccacagaact

SEQ ID NO: 3596521 - DNA, 14 bp, Homo sapiens
tctgggagcccaga

SEQ ID NO: 3596522 - DNA, 18 bp, Homo sapiens
tctgggaggtcttggccg

SEQ ID NO: 3596523 - DNA, 19 bp, Homo sapiens
tctgggagttgctgttaat

SEQ ID NO: 3596524 - DNA, 15 bp, Homo sapiens
tctgggatatttaac

SEQ ID NO: 3596525 - DNA, 14 bp, Homo sapiens
tctgggcctgaggg

SEQ ID NO: 3596526 - DNA, 22 bp, Homo sapiens
tctgggcctgagggtccacctg

SEQ ID NO: 3596527 - DNA, 20 bp, Homo sapiens
tctgggcgtccagctcagcc

SEQ ID NO: 3596528 - DNA, 21 bp, Homo sapiens
tctgggcgtccagctcagccc

SEQ ID NO: 3596529 - DNA, 13 bp, Homo sapiens
tctgggctccaga

SEQ ID NO: 3596530 - DNA, 17 bp, Homo sapiens
tctggggacagcttcct

SEQ ID NO: 3596531 - DNA, 13 bp, Homo sapiens
tctggggacaggc

SEQ ID NO: 3596532 - DNA, 16 bp, Homo sapiens
tctggggagagcggct

SEQ ID NO: 3596533 - DNA, 16 bp, Homo sapiens
tctggggggagaaaaa

SEQ ID NO: 3596534 - DNA, 24 bp, Homo sapiens
tctgggggtcctctctgagtcaaa

SEQ ID NO: 3596535 - DNA, 20 bp, Homo sapiens
tctgggggtggacatctgac

SEQ ID NO: 3596536 - DNA, 15 bp, Homo sapiens
tctgggtccagggag

SEQ ID NO: 3596537 - DNA, 16 bp, Homo sapiens
tctgggtccttggctc

SEQ ID NO: 3596538 - DNA, 21 bp, Homo sapiens
tctggtaaacattcctccagc

SEQ ID NO: 3596539 - DNA, 21 bp, Homo sapiens
tctggtaatattgacttgtat

SEQ ID NO: 3596540 - DNA, 20 bp, Homo sapiens
tctggtactctgtgaaagaa

SEQ ID NO: 3596541 - DNA, 20 bp, Homo sapiens
tctggtgtttggtttcttca

SEQ ID NO: 3596542 - DNA, 20 bp, Homo sapiens
tctggttccctgctgcgctg

SEQ ID NO: 3596543 - DNA, 14 bp, Homo sapiens
tctggttgctaatg

SEQ ID NO: 3596544 - DNA, 23 bp, Homo sapiens
tctgtaacatcgcacagtttacc

SEQ ID NO: 3596545 - DNA, 19 bp, Homo sapiens
tctgtaataatagactgta

SEQ ID NO: 3596546 - DNA, 18 bp, Homo sapiens
tctgtaattatatctaaa

SEQ ID NO: 3596547 - DNA, 20 bp, Homo sapiens
tctgtaattatatctaaaat

SEQ ID NO: 3596548 - DNA, 14 bp, Homo sapiens
tctgtccacctcgg

SEQ ID NO: 3596549 - DNA, 17 bp, Homo sapiens
tctgtccacctcggcct

SEQ ID NO: 3596550 - DNA, 16 bp, Homo sapiens
tctgtccgtgcccctt

SEQ ID NO: 3596551 - DNA, 13 bp, Homo sapiens
tctgtcctcagcc

SEQ ID NO: 3596552 - DNA, 16 bp, Homo sapiens
tctgtcctcttggcca

SEQ ID NO: 3596553 - DNA, 19 bp, Homo sapiens
tctgtctcggctctgcatg

SEQ ID NO: 3596554 - DNA, 20 bp, Homo sapiens
tctgtctctaatttaactta

SEQ ID NO: 3596555 - DNA, 21 bp, Homo sapiens
tctgtctgggctcagacatcc

SEQ ID NO: 3596556 - DNA, 19 bp, Homo sapiens
tctgtcttttggagaacca

SEQ ID NO: 3596557 - DNA, 14 bp, Homo sapiens
tctgtgaaagaaga

SEQ ID NO: 3596558 - DNA, 17 bp, Homo sapiens
tctgtgatgacattccc

SEQ ID NO: 3596559 - DNA, 14 bp, Homo sapiens
tctgtgattggctg

SEQ ID NO: 3596560 - DNA, 22 bp, Homo sapiens
tctgtgatttttttttttaatt

SEQ ID NO: 3596561 - DNA, 18 bp, Homo sapiens
tctgtgcaaacagtaacg

SEQ ID NO: 3596562 - DNA, 14 bp, Homo sapiens
tctgtgctgtttca

SEQ ID NO: 3596563 - DNA, 14 bp, Homo sapiens
tctgtgcttctaat

SEQ ID NO: 3596564 - DNA, 22 bp, Homo sapiens
tctgtggagctgccacagagaa

SEQ ID NO: 3596565 - DNA, 21 bp, Homo sapiens
tctgtggagggagggcagctg

SEQ ID NO: 3596566 - DNA, 22 bp, Homo sapiens
tctgtggagggagggcagctgg

SEQ ID NO: 3596567 - DNA, 17 bp, Homo sapiens
tctgtggtgcagtgtgt

SEQ ID NO: 3596568 - DNA, 13 bp, Homo sapiens
tctgtgtggctcc

SEQ ID NO: 3596569 - DNA, 15 bp, Homo sapiens
tctgtgtgtttatgt

SEQ ID NO: 3596570 - DNA, 19 bp, Homo sapiens
tctgtgtgtttatgtgtgt

SEQ ID NO: 3596571 - DNA, 15 bp, Homo sapiens
tctgttacaaaagaa

SEQ ID NO: 3596572 - DNA, 17 bp, Homo sapiens
tctgttccatgcaactg

SEQ ID NO: 3596573 - DNA, 19 bp, Homo sapiens
tctgttcctttctctgggc

SEQ ID NO: 3596574 - DNA, 16 bp, Homo sapiens
tctgttggagaaagaa

SEQ ID NO: 3596575 - DNA, 18 bp, Homo sapiens
tctgttggtctgccttct

SEQ ID NO: 3596576 - DNA, 22 bp, Homo sapiens
tctgttggtctgccttctgctg

SEQ ID NO: 3596577 - DNA, 23 bp, Homo sapiens
tctgttggtctgccttctgctga

SEQ ID NO: 3596578 - DNA, 16 bp, Homo sapiens
tctgttgtattcattg

SEQ ID NO: 3596579 - DNA, 19 bp, Homo sapiens
tctgtttaaagcatataga

SEQ ID NO: 3596580 - DNA, 22 bp, Homo sapiens
tctgtttaaagcatatagagat

SEQ ID NO: 3596581 - DNA, 17 bp, Homo sapiens
tctgttttgtatcttaa

SEQ ID NO: 3596582 - DNA, 18 bp, Homo sapiens
tctgttttgtatcttaaa

SEQ ID NO: 3596583 - DNA, 17 bp, Homo sapiens
tcttaaaaaatgtgaaa

SEQ ID NO: 3596584 - DNA, 12 bp, Homo sapiens
tcttaaaaattt

SEQ ID NO: 3596585 - DNA, 17 bp, Homo sapiens
tcttaaaaatttataca

SEQ ID NO: 3596586 - DNA, 19 bp, Homo sapiens
tcttaaaaatttatacacc

SEQ ID NO: 3596587 - DNA, 15 bp, Homo sapiens
tcttaaaatgtccta

SEQ ID NO: 3596588 - DNA, 17 bp, Homo sapiens
tcttaaacataataaat

SEQ ID NO: 3596589 - DNA, 15 bp, Homo sapiens
tcttaatatatttga

SEQ ID NO: 3596590 - DNA, 13 bp, Homo sapiens
tctttgcctctgc

SEQ ID NO: 3596591 - DNA, 12 bp, Homo sapiens
tctttgctgccc

SEQ ID NO: 3596592 - DNA, 12 bp, Homo sapiens
tctttgctttgc

SEQ ID NO: 3596593 - DNA, 15 bp, Homo sapiens
tctttgggccagaca

SEQ ID NO: 3596594 - DNA, 15 bp, Homo sapiens
tctttgtcattcagt

SEQ ID NO: 3596595 - DNA, 15 bp, Homo sapiens
tctttgtgcctttgg

SEQ ID NO: 3596596 - DNA, 13 bp, Homo sapiens
tctttgtggccaa

SEQ ID NO: 3596597 - DNA, 14 bp, Homo sapiens
tctttgtggccaag

SEQ ID NO: 3596598 - DNA, 15 bp, Homo sapiens
tctttgtgtagcttt

SEQ ID NO: 3596599 - DNA, 18 bp, Homo sapiens
tctttgtgtagctttgct

SEQ ID NO: 3596600 - DNA, 16 bp, Homo sapiens
tctttgttacttcctt

SEQ ID NO: 3596601 - DNA, 17 bp, Homo sapiens
tctttgttacttcctta

SEQ ID NO: 3596602 - DNA, 23 bp, Homo sapiens
tctttgtttccagcttgcattga

SEQ ID NO: 3596603 - DNA, 16 bp, Homo sapiens
tctttgttttatttag

SEQ ID NO: 3596604 - DNA, 14 bp, Homo sapiens
tcttttaaattgca

SEQ ID NO: 3596605 - DNA, 14 bp, Homo sapiens
tcttttatagagca

SEQ ID NO: 3596606 - DNA, 14 bp, Homo sapiens
tcttttatcctggg

SEQ ID NO: 3596607 - DNA, 12 bp, Homo sapiens
tcttttatctgt

SEQ ID NO: 3596608 - DNA, 21 bp, Homo sapiens
tcttttatctgtttaaagcat

SEQ ID NO: 3596609 - DNA, 13 bp, Homo sapiens
tcttttctttctg

SEQ ID NO: 3596610 - DNA, 15 bp, Homo sapiens
tcttttgaattgttt

SEQ ID NO: 3596611 - DNA, 16 bp, Homo sapiens
tctttttatactatta

SEQ ID NO: 3596612 - DNA, 15 bp, Homo sapiens
tcttttttaaaatca

SEQ ID NO: 3596613 - DNA, 16 bp, Homo sapiens
tctttttttgtgatgt

SEQ ID NO: 3596614 - DNA, 11 bp, Homo sapiens
tgaaaaagaat

SEQ ID NO: 3596615 - DNA, 23 bp, Homo sapiens
tgaaaaagaataaaaacttttga

SEQ ID NO: 3596616 - DNA, 22 bp, Homo sapiens
tgaaaaagtatcctgcttctga

SEQ ID NO: 3596617 - DNA, 17 bp, Homo sapiens
tgaaaactaaggatttt

SEQ ID NO: 3596618 - DNA, 14 bp, Homo sapiens
tgaaaacttcaaag

SEQ ID NO: 3596619 - DNA, 16 bp, Homo sapiens
tgaaaactttgtagta

SEQ ID NO: 3596620 - DNA, 23 bp, Homo sapiens
tgaaaagaaaacttaaagaggaa

SEQ ID NO: 3596621 - DNA, 15 bp, Homo sapiens
tgaaaagactccaaa

SEQ ID NO: 3596622 - DNA, 20 bp, Homo sapiens
tgaaaagttatttatgctat

SEQ ID NO: 3596623 - DNA, 18 bp, Homo sapiens
tgaaaataactgaaccaa

SEQ ID NO: 3596624 - DNA, 15 bp, Homo sapiens
tgaaaatatagacat

SEQ ID NO: 3596625 - DNA, 21 bp, Homo sapiens
tgaaaatatagacattctcac

SEQ ID NO: 3596626 - DNA, 23 bp, Homo sapiens
tgaaaatatagacattctcacat

SEQ ID NO: 3596627 - DNA, 16 bp, Homo sapiens
tgaaaatattgtttta

SEQ ID NO: 3596628 - DNA, 16 bp, Homo sapiens
tgaaaatgaagaagga

SEQ ID NO: 3596629 - DNA, 20 bp, Homo sapiens
tgaaaattaggatttcatga

SEQ ID NO: 3596630 - DNA, 19 bp, Homo sapiens
tgaaacaaaaaaaaaatga

SEQ ID NO: 3596631 - DNA, 17 bp, Homo sapiens
tgaaacagaaaaataag

SEQ ID NO: 3596632 - DNA, 14 bp, Homo sapiens
tgaaacattttgtc

SEQ ID NO: 3596633 - DNA, 15 bp, Homo sapiens
tgaaacattttttct

SEQ ID NO: 3596634 - DNA, 18 bp, Homo sapiens
tgaaacattttttcttct

SEQ ID NO: 3596635 - DNA, 20 bp, Homo sapiens
tgaaactggtttataataaa

SEQ ID NO: 3596636 - DNA, 14 bp, Homo sapiens
tgaaacttaagaat

SEQ ID NO: 3596637 - DNA, 17 bp, Homo sapiens
tgaaacttaagaattga

SEQ ID NO: 3596638 - DNA, 23 bp, Homo sapiens
tgaaagaagcaagacacgtggcc

SEQ ID NO: 3596639 - DNA, 14 bp, Homo sapiens
tgaaagaatgtaaa

SEQ ID NO: 3596640 - DNA, 17 bp, Homo sapiens
tgaaaggcagggcaaga

SEQ ID NO: 3596641 - DNA, 14 bp, Homo sapiens
tgaaaggccagcag

SEQ ID NO: 3596642 - DNA, 15 bp, Homo sapiens
tgaaaggccagcagc

SEQ ID NO: 3596643 - DNA, 23 bp, Homo sapiens
tgaaagttttccagtattgaaaa

SEQ ID NO: 3596644 - DNA, 16 bp, Homo sapiens
tgaaataacaaaatgg

SEQ ID NO: 3596645 - DNA, 17 bp, Homo sapiens
tgaaataacaaaatgga

SEQ ID NO: 3596646 - DNA, 14 bp, Homo sapiens
tgaaataataatat

SEQ ID NO: 3596647 - DNA, 17 bp, Homo sapiens
tgaaatacctttgtagt

SEQ ID NO: 3596648 - DNA, 19 bp, Homo sapiens
tgaaatacctttgtagtta

SEQ ID NO: 3596649 - DNA, 14 bp, Homo sapiens
tgaaatatatttaa

SEQ ID NO: 3596650 - DNA, 17 bp, Homo sapiens
tgaaatatccacccagc

SEQ ID NO: 3596651 - DNA, 18 bp, Homo sapiens
tgaaatatccacccagca

SEQ ID NO: 3596652 - DNA, 17 bp, Homo sapiens
tgaaatatgtataactt

SEQ ID NO: 3596653 - DNA, 15 bp, Homo sapiens
tgaaatccctgcctc

SEQ ID NO: 3596654 - DNA, 14 bp, Homo sapiens
tgaaatccttgaga

SEQ ID NO: 3596655 - DNA, 14 bp, Homo sapiens
tgaaatcttcccag

SEQ ID NO: 3596656 - DNA, 17 bp, Homo sapiens
tgaaatgaggtctgttt

SEQ ID NO: 3596657 - DNA, 19 bp, Homo sapiens
tgaaatgaggtctgtttaa

SEQ ID NO: 3596658 - DNA, 23 bp, Homo sapiens
tgaaatgaggtctgtttaaagtg

SEQ ID NO: 3596659 - DNA, 13 bp, Homo sapiens
tgaaatgctttta

SEQ ID NO: 3596660 - DNA, 15 bp, Homo sapiens
tgaaatgcttttata

SEQ ID NO: 3596661 - DNA, 19 bp, Homo sapiens
tgaaatgcttttatattct

SEQ ID NO: 3596662 - DNA, 23 bp, Homo sapiens
tgaaatgtgtttccttttcagga

SEQ ID NO: 3596663 - DNA, 17 bp, Homo sapiens
tgaaattataactatta

SEQ ID NO: 3596664 - DNA, 20 bp, Homo sapiens
tgaaattatgtgacatttta

SEQ ID NO: 3596665 - DNA, 22 bp, Homo sapiens
tgaaattatgtgacattttaca

SEQ ID NO: 3596666 - DNA, 16 bp, Homo sapiens
tgaaattcaccaagaa

SEQ ID NO: 3596667 - DNA, 21 bp, Homo sapiens
tgaaatttgttatacttcaaa

SEQ ID NO: 3596668 - DNA, 22 bp, Homo sapiens
tgaaatttttaaaaatacactt

SEQ ID NO: 3596669 - DNA, 19 bp, Homo sapiens
tgaaatttttattaaatta

SEQ ID NO: 3596670 - DNA, 14 bp, Homo sapiens
tgaacaagaattgg

SEQ ID NO: 3596671 - DNA, 18 bp, Homo sapiens
tgaacaagaattggaagc

SEQ ID NO: 3596672 - DNA, 11 bp, Homo sapiens
tgaaccaaatt

SEQ ID NO: 3596673 - DNA, 21 bp, Homo sapiens
tgaaccaaattgcactgaagt

SEQ ID NO: 3596674 - DNA, 22 bp, Homo sapiens
tgaaccaaattgcactgaagtt

SEQ ID NO: 3596675 - DNA, 17 bp, Homo sapiens
tgaaccacattcaggga

SEQ ID NO: 3596676 - DNA, 12 bp, Homo sapiens
tgaacctgaata

SEQ ID NO: 3596677 - DNA, 12 bp, Homo sapiens
tgaacctgccct

SEQ ID NO: 3596678 - DNA, 15 bp, Homo sapiens
tgaacctgctactta

SEQ ID NO: 3596679 - DNA, 18 bp, Homo sapiens
tgaacctgggaggcagag

SEQ ID NO: 3596680 - DNA, 17 bp, Homo sapiens
tgaacgtggattgtatt

SEQ ID NO: 3596681 - DNA, 21 bp, Homo sapiens
tgaactcaccctgggagccag

SEQ ID NO: 3596682 - DNA, 14 bp, Homo sapiens
tgaactccaccgac

SEQ ID NO: 3596683 - DNA, 21 bp, Homo sapiens
tgaactccaccgaccaactgc

SEQ ID NO: 3596684 - DNA, 14 bp, Homo sapiens
tgaactccaggcat

SEQ ID NO: 3596685 - DNA, 13 bp, Homo sapiens
tgaactcctattt

SEQ ID NO: 3596686 - DNA, 15 bp, Homo sapiens
tgaactcttcaatct

SEQ ID NO: 3596687 - DNA, 18 bp, Homo sapiens
tgaactcttcaatctctt

SEQ ID NO: 3596688 - DNA, 12 bp, Homo sapiens
tgaacttccagg

SEQ ID NO: 3596689 - DNA, 15 bp, Homo sapiens
tgaacttccaggaaa

SEQ ID NO: 3596690 - DNA, 17 bp, Homo sapiens
tgaacttctttgaattt

SEQ ID NO: 3596691 - DNA, 17 bp, Homo sapiens
tgaacttgactgggtga

SEQ ID NO: 3596692 - DNA, 16 bp, Homo sapiens
tgaactttctccctca

SEQ ID NO: 3596693 - DNA, 16 bp, Homo sapiens
tgaagaaggaagctgt

SEQ ID NO: 3596694 - DNA, 22 bp, Homo sapiens
tgaagaaggaagctgtgttgaa

SEQ ID NO: 3596695 - DNA, 14 bp, Homo sapiens
tgaagaaggcaagg

SEQ ID NO: 3596696 - DNA, 17 bp, Homo sapiens
tgaagaaggcaaggctg

SEQ ID NO: 3596697 - DNA, 23 bp, Homo sapiens
tgaagagagggacaggcactcca

SEQ ID NO: 3596698 - DNA, 12 bp, Homo sapiens
tgaagaggtctg

SEQ ID NO: 3596699 - DNA, 14 bp, Homo sapiens
tgaagaggtctgat

SEQ ID NO: 3596700 - DNA, 19 bp, Homo sapiens
tgaagaggtctgattggct

SEQ ID NO: 3596701 - DNA, 20 bp, Homo sapiens
tgaagaggtctgattggctg

SEQ ID NO: 3596702 - DNA, 15 bp, Homo sapiens
tgaagatgccttgag

SEQ ID NO: 3596703 - DNA, 18 bp, Homo sapiens
tgaagatgctttttgatc

SEQ ID NO: 3596704 - DNA, 19 bp, Homo sapiens
tgaagattcttaaaaattg

SEQ ID NO: 3596705 - DNA, 18 bp, Homo sapiens
tgaagcaattagtctgaa

SEQ ID NO: 3596706 - DNA, 18 bp, Homo sapiens
tgaagcagaaccttcttt

SEQ ID NO: 3596707 - DNA, 12 bp, Homo sapiens
tgaagcttcctt

SEQ ID NO: 3596708 - DNA, 21 bp, Homo sapiens
tgaagcttcggccgcgccacc

SEQ ID NO: 3596709 - DNA, 15 bp, Homo sapiens
tgaaggaattacatt

SEQ ID NO: 3596710 - DNA, 12 bp, Homo sapiens
tgaaggaccctt

SEQ ID NO: 3596711 - DNA, 14 bp, Homo sapiens
tgaaggagaatggc

SEQ ID NO: 3596712 - DNA, 15 bp, Homo sapiens
tgaaggccttgttaa

SEQ ID NO: 3596713 - DNA, 12 bp, Homo sapiens
tgaagggccaga

SEQ ID NO: 3596714 - DNA, 16 bp, Homo sapiens
tgaagggccagagcca

SEQ ID NO: 3596715 - DNA, 19 bp, Homo sapiens
tgaaggtagaatgttttca

SEQ ID NO: 3596716 - DNA, 23 bp, Homo sapiens
tgaaggtctgtcataggactctg

SEQ ID NO: 3596717 - DNA, 15 bp, Homo sapiens
tgaaggtggggagaa

SEQ ID NO: 3596718 - DNA, 20 bp, Homo sapiens
tgaagtctgagcccatttct

SEQ ID NO: 3596719 - DNA, 19 bp, Homo sapiens
tgaagtgcacaggagccaa

SEQ ID NO: 3596720 - DNA, 14 bp, Homo sapiens
tgaagtgcagctca

SEQ ID NO: 3596721 - DNA, 16 bp, Homo sapiens
tgaagttcatcttgca

SEQ ID NO: 3596722 - DNA, 17 bp, Homo sapiens
tgaagttcatcttgcag

SEQ ID NO: 3596723 - DNA, 13 bp, Homo sapiens
tgaagttgaacat

SEQ ID NO: 3596724 - DNA, 21 bp, Homo sapiens
tgactcttagccctcaccaca

SEQ ID NO: 3596725 - DNA, 15 bp, Homo sapiens
tgactgaaggaaaag

SEQ ID NO: 3596726 - DNA, 19 bp, Homo sapiens
tgactgcattgccgctgta

SEQ ID NO: 3596727 - DNA, 20 bp, Homo sapiens
tgactgccaagccagattct

SEQ ID NO: 3596728 - DNA, 20 bp, Homo sapiens
tgactggccaaacccttgct

SEQ ID NO: 3596729 - DNA, 14 bp, Homo sapiens
tgactgggggcaga

SEQ ID NO: 3596730 - DNA, 16 bp, Homo sapiens
tgactgtactcctccc

SEQ ID NO: 3596731 - DNA, 17 bp, Homo sapiens
tgactgtactcctccca

SEQ ID NO: 3596732 - DNA, 18 bp, Homo sapiens
tgactgttgttcttataa

SEQ ID NO: 3596733 - DNA, 18 bp, Homo sapiens
tgacttaaaaaatcagaa

SEQ ID NO: 3596734 - DNA, 21 bp, Homo sapiens
tgacttagaggcaacaggatt

SEQ ID NO: 3596735 - DNA, 16 bp, Homo sapiens
tgacttagtacaaagt

SEQ ID NO: 3596736 - DNA, 13 bp, Homo sapiens
tgacttatagtac

SEQ ID NO: 3596737 - DNA, 14 bp, Homo sapiens
tgacttatagtaca

SEQ ID NO: 3596738 - DNA, 14 bp, Homo sapiens
tgacttatggcatg

SEQ ID NO: 3596739 - DNA, 19 bp, Homo sapiens
tgacttatggcatgactct

SEQ ID NO: 3596740 - DNA, 12 bp, Homo sapiens
tgacttatttct

SEQ ID NO: 3596741 - DNA, 22 bp, Homo sapiens
tgacttcgcagccccgggcgga

SEQ ID NO: 3596742 - DNA, 24 bp, Homo sapiens
tgacttctaagtaaaaccacagca

SEQ ID NO: 3596743 - DNA, 13 bp, Homo sapiens
tgacttgaaaaga

SEQ ID NO: 3596744 - DNA, 19 bp, Homo sapiens
tgacttgtatattttaaga

SEQ ID NO: 3596745 - DNA, 16 bp, Homo sapiens
tgactttccagaatga

SEQ ID NO: 3596746 - DNA, 13 bp, Homo sapiens
tgactttccttag

SEQ ID NO: 3596747 - DNA, 11 bp, Homo sapiens
tgactttgtct

SEQ ID NO: 3596748 - DNA, 18 bp, Homo sapiens
tgagaaaaatatatacta

SEQ ID NO: 3596749 - DNA, 12 bp, Homo sapiens
tgagaaaacatg

SEQ ID NO: 3596750 - DNA, 11 bp, Homo sapiens
tgagaaactgc

SEQ ID NO: 3596751 - DNA, 20 bp, Homo sapiens
tgagaaagactattcaaaca

SEQ ID NO: 3596752 - DNA, 17 bp, Homo sapiens
tgagaaagaggcaggga

SEQ ID NO: 3596753 - DNA, 22 bp, Homo sapiens
tgagaaagggattgctgaggca

SEQ ID NO: 3596754 - DNA, 18 bp, Homo sapiens
tgagaaccagtctcctca

SEQ ID NO: 3596755 - DNA, 23 bp, Homo sapiens
tgagaactcgttcacctccaagc

SEQ ID NO: 3596756 - DNA, 13 bp, Homo sapiens
tgagaagataaaa

SEQ ID NO: 3596757 - DNA, 14 bp, Homo sapiens
tgagaagctgaggc

SEQ ID NO: 3596758 - DNA, 10 bp, Homo sapiens
tgagaatggc

SEQ ID NO: 3596759 - DNA, 13 bp, Homo sapiens
tgagaatggcctg

SEQ ID NO: 3596760 - DNA, 14 bp, Homo sapiens
tgagaatggcctgg

SEQ ID NO: 3596761 - DNA, 16 bp, Homo sapiens
tgagaatggcctggag

SEQ ID NO: 3596762 - DNA, 22 bp, Homo sapiens
tgagaatggcctggagcaggcc

SEQ ID NO: 3596763 - DNA, 19 bp, Homo sapiens
tgagagaaagagagaagcc

SEQ ID NO: 3596764 - DNA, 22 bp, Homo sapiens
tgagagaaagagagaagccagc

SEQ ID NO: 3596765 - DNA, 15 bp, Homo sapiens
tgagagaatgtggaa

SEQ ID NO: 3596766 - DNA, 16 bp, Homo sapiens
tgagagaatgtggaaa

SEQ ID NO: 3596767 - DNA, 17 bp, Homo sapiens
tgagagaccctggcctc

SEQ ID NO: 3596768 - DNA, 20 bp, Homo sapiens
tgagagctgtttttgacagc

SEQ ID NO: 3596769 - DNA, 15 bp, Homo sapiens
tgagaggaacaagaa

SEQ ID NO: 3596770 - DNA, 14 bp, Homo sapiens
tgagaggctctccg

SEQ ID NO: 3596771 - DNA, 22 bp, Homo sapiens
tgagagggcaatctttgccttt

SEQ ID NO: 3596772 - DNA, 18 bp, Homo sapiens
tgagaggtgaaagcataa

SEQ ID NO: 3596773 - DNA, 19 bp, Homo sapiens
tgagagttccggggagaaa

SEQ ID NO: 3596774 - DNA, 12 bp, Homo sapiens
tgagatactgtg

SEQ ID NO: 3596775 - DNA, 14 bp, Homo sapiens
tgagatattaaatt

SEQ ID NO: 3596776 - DNA, 18 bp, Homo sapiens
tgagatattaaattctca

SEQ ID NO: 3596777 - DNA, 13 bp, Homo sapiens
tgagatcaatgtg

SEQ ID NO: 3596778 - DNA, 15 bp, Homo sapiens
tgagatggccatgct

SEQ ID NO: 3596779 - DNA, 16 bp, Homo sapiens
tgagatggccatgctc

SEQ ID NO: 3596780 - DNA, 24 bp, Homo sapiens
tgagatgtgaacacatcagcttgc

SEQ ID NO: 3596781 - DNA, 15 bp, Homo sapiens
tgagattcaagacaa

SEQ ID NO: 3596782 - DNA, 17 bp, Homo sapiens
tgagattcaagacaaga

SEQ ID NO: 3596783 - DNA, 21 bp, Homo sapiens
tgagattcaagacaagagctg

SEQ ID NO: 3596784 - DNA, 22 bp, Homo sapiens
tgagattcaagacaagagctgt

SEQ ID NO: 3596785 - DNA, 16 bp, Homo sapiens
tgagcaaatgtggctc

SEQ ID NO: 3596786 - DNA, 19 bp, Homo sapiens
tgagcaaatgtggctcctg

SEQ ID NO: 3596787 - DNA, 17 bp, Homo sapiens
tgagcaagcaccaacct

SEQ ID NO: 3596788 - DNA, 21 bp, Homo sapiens
tgagcaagcaccaacctccag

SEQ ID NO: 3596789 - DNA, 22 bp, Homo sapiens
tgagcaagcaccaacctccaga

SEQ ID NO: 3596790 - DNA, 23 bp, Homo sapiens
tgagcaagcaccaacctccagac

SEQ ID NO: 3596791 - DNA, 14 bp, Homo sapiens
tgagcaagcccagg

SEQ ID NO: 3596792 - DNA, 13 bp, Homo sapiens
tgagcacaaagaa

SEQ ID NO: 3596793 - DNA, 21 bp, Homo sapiens
tgagcacaactttaagaggac

SEQ ID NO: 3596794 - DNA, 18 bp, Homo sapiens
tgagcacacccgtgtgca

SEQ ID NO: 3596795 - DNA, 18 bp, Homo sapiens
tgagcagagaacctgctc

SEQ ID NO: 3596796 - DNA, 15 bp, Homo sapiens
tgagcagccgccagc

SEQ ID NO: 3596797 - DNA, 16 bp, Homo sapiens
tgagcagccgccagct

SEQ ID NO: 3596798 - DNA, 19 bp, Homo sapiens
tgagcagccgccagctggg

SEQ ID NO: 3596799 - DNA, 23 bp, Homo sapiens
tgagcagccgccagctgggagca

SEQ ID NO: 3596800 - DNA, 15 bp, Homo sapiens
tgagcagggatctgc

SEQ ID NO: 3596801 - DNA, 17 bp, Homo sapiens
tgagcagggtccacagc

SEQ ID NO: 3596802 - DNA, 15 bp, Homo sapiens
tgagcagtcgcctgc

SEQ ID NO: 3596803 - DNA, 18 bp, Homo sapiens
tgagcagtcgcctgcctg

SEQ ID NO: 3596804 - DNA, 17 bp, Homo sapiens
tgagcagtgttgcgttt

SEQ ID NO: 3596805 - DNA, 23 bp, Homo sapiens
tgagcatcgcttaggagaagtct

SEQ ID NO: 3596806 - DNA, 23 bp, Homo sapiens
tgagcatttttttaaaagaagct

SEQ ID NO: 3596807 - DNA, 20 bp, Homo sapiens
tgagccaaatttcttttgct

SEQ ID NO: 3596808 - DNA, 17 bp, Homo sapiens
tgagccactgtgcttgg

SEQ ID NO: 3596809 - DNA, 20 bp, Homo sapiens
tgagccactgtgcttggcca

SEQ ID NO: 3596810 - DNA, 15 bp, Homo sapiens
tgagccactgttccc

SEQ ID NO: 3596811 - DNA, 14 bp, Homo sapiens
tgagccagcagggc

SEQ ID NO: 3596812 - DNA, 22 bp, Homo sapiens
tgagccataggtctaaatagga

SEQ ID NO: 3596813 - DNA, 14 bp, Homo sapiens
tgagcccctcccca

SEQ ID NO: 3596814 - DNA, 21 bp, Homo sapiens
tgagcccctgtctagagaggg

SEQ ID NO: 3596815 - DNA, 23 bp, Homo sapiens
tgagccccttcatccgcctgtgg

SEQ ID NO: 3596816 - DNA, 16 bp, Homo sapiens
tgagcctttgtgcttt

SEQ ID NO: 3596817 - DNA, 23 bp, Homo sapiens
tgagcctttgtgctttttgtcat

SEQ ID NO: 3596818 - DNA, 15 bp, Homo sapiens
tgagcggcaccctgg

SEQ ID NO: 3596819 - DNA, 13 bp, Homo sapiens
tgagctcttccct

SEQ ID NO: 3596820 - DNA, 14 bp, Homo sapiens
tgagctcttccctt

SEQ ID NO: 3596821 - DNA, 20 bp, Homo sapiens
tgagctcttcccttattcct

SEQ ID NO: 3596822 - DNA, 15 bp, Homo sapiens
tgagctcttggcagg

SEQ ID NO: 3596823 - DNA, 13 bp, Homo sapiens
tgagctggccctt

SEQ ID NO: 3596824 - DNA, 12 bp, Homo sapiens
tgagctggcctg

SEQ ID NO: 3596825 - DNA, 17 bp, Homo sapiens
tgagctggggactcagg

SEQ ID NO: 3596826 - DNA, 18 bp, Homo sapiens
tgagctggggactcaggg

SEQ ID NO: 3596827 - DNA, 20 bp, Homo sapiens
tgagctggggatgtctctca

SEQ ID NO: 3596828 - DNA, 15 bp, Homo sapiens
tgagctgtaaaaatg

SEQ ID NO: 3596829 - DNA, 23 bp, Homo sapiens
tgaggaaaaaaatcgtccaggga

SEQ ID NO: 3596830 - DNA, 16 bp, Homo sapiens
tgaggaaatattaatt

SEQ ID NO: 3596831 - DNA, 19 bp, Homo sapiens
tgaggaagtggctgtccct

SEQ ID NO: 3596832 - DNA, 14 bp, Homo sapiens
tgaggaattttctt

SEQ ID NO: 3596833 - DNA, 19 bp, Homo sapiens
tgaggacaaccattccaga

SEQ ID NO: 3596834 - DNA, 17 bp, Homo sapiens
tgaggaccgtaaggcct

SEQ ID NO: 3596835 - DNA, 18 bp, Homo sapiens
tgaggagagaggaggaaa

SEQ ID NO: 3596836 - DNA, 21 bp, Homo sapiens
tgaggagatgaccagggatgc

SEQ ID NO: 3596837 - DNA, 12 bp, Homo sapiens
tgaggatccagg

SEQ ID NO: 3596838 - DNA, 17 bp, Homo sapiens
tgaggatccagggcagc

SEQ ID NO: 3596839 - DNA, 19 bp, Homo sapiens
tgaggatccagggcagcag

SEQ ID NO: 3596840 - DNA, 14 bp, Homo sapiens
tgaggcaaaagaag

SEQ ID NO: 3596841 - DNA, 20 bp, Homo sapiens
tgaggcaccgtccaggcccc

SEQ ID NO: 3596842 - DNA, 15 bp, Homo sapiens
tgaggccagaaaggt

SEQ ID NO: 3596843 - DNA, 17 bp, Homo sapiens
tgaggccatctcaggag

SEQ ID NO: 3596844 - DNA, 19 bp, Homo sapiens
tgaggccatctcaggagat

SEQ ID NO: 3596845 - DNA, 20 bp, Homo sapiens
tgaggccatctcaggagatg

SEQ ID NO: 3596846 - DNA, 17 bp, Homo sapiens
tgaggcccagagaggga

SEQ ID NO: 3596847 - DNA, 20 bp, Homo sapiens
tgaggcccagagagggaaga

SEQ ID NO: 3596848 - DNA, 23 bp, Homo sapiens
tgaggcccctaggtgcccagggc

SEQ ID NO: 3596849 - DNA, 20 bp, Homo sapiens
tgaggcctgccccctgggct

SEQ ID NO: 3596850 - DNA, 21 bp, Homo sapiens
tgaggcctgccccctgggctg

SEQ ID NO: 3596851 - DNA, 14 bp, Homo sapiens
tgaggcctgggctg

SEQ ID NO: 3596852 - DNA, 20 bp, Homo sapiens
tgaggctatggagggtcctc

SEQ ID NO: 3596853 - DNA, 13 bp, Homo sapiens
tgaggctcagaga

SEQ ID NO: 3596854 - DNA, 21 bp, Homo sapiens
tgaggctcagagaggtagcac

SEQ ID NO: 3596855 - DNA, 18 bp, Homo sapiens
tgaggctgacatgctcac

SEQ ID NO: 3596856 - DNA, 17 bp, Homo sapiens
tgcaaaaagaggatccg

SEQ ID NO: 3596857 - DNA, 12 bp, Homo sapiens
tgcaaaatcact

SEQ ID NO: 3596858 - DNA, 22 bp, Homo sapiens
tgcaaagcaaaacagactgtgt

SEQ ID NO: 3596859 - DNA, 18 bp, Homo sapiens
tgcaaagcactgacttct

SEQ ID NO: 3596860 - DNA, 22 bp, Homo sapiens
tgcaaagcactgacttctaagt

SEQ ID NO: 3596861 - DNA, 14 bp, Homo sapiens
tgcaaagccaaggc

SEQ ID NO: 3596862 - DNA, 17 bp, Homo sapiens
tgcaaagccaaggcagc

SEQ ID NO: 3596863 - DNA, 20 bp, Homo sapiens
tgcaaatagattcagagaaa

SEQ ID NO: 3596864 - DNA, 21 bp, Homo sapiens
tgcaaatgctatgagatgcat

SEQ ID NO: 3596865 - DNA, 16 bp, Homo sapiens
tgcaacatttgacaaa

SEQ ID NO: 3596866 - DNA, 16 bp, Homo sapiens
tgcaaccatttgaaac

SEQ ID NO: 3596867 - DNA, 21 bp, Homo sapiens
tgcaacctccgccttccgggt

SEQ ID NO: 3596868 - DNA, 18 bp, Homo sapiens
tgcaactagtaaaatgct

SEQ ID NO: 3596869 - DNA, 19 bp, Homo sapiens
tgcaactctaactctgaga

SEQ ID NO: 3596870 - DNA, 18 bp, Homo sapiens
tgcaacttccgctgaggg

SEQ ID NO: 3596871 - DNA, 18 bp, Homo sapiens
tgcaagaccacggaggga

SEQ ID NO: 3596872 - DNA, 15 bp, Homo sapiens
tgcaagatgcttggt

SEQ ID NO: 3596873 - DNA, 16 bp, Homo sapiens
tgcaaggtactctggt

SEQ ID NO: 3596874 - DNA, 19 bp, Homo sapiens
tgcaaggtcttgcatttaa

SEQ ID NO: 3596875 - DNA, 23 bp, Homo sapiens
tgcaaggtttaggctggtggccc

SEQ ID NO: 3596876 - DNA, 23 bp, Homo sapiens
tgcaagtcagtccaggatgctaa

SEQ ID NO: 3596877 - DNA, 20 bp, Homo sapiens
tgcaagtggagctgtctgtc

SEQ ID NO: 3596878 - DNA, 19 bp, Homo sapiens
tgcaataaatctgacccag

SEQ ID NO: 3596879 - DNA, 19 bp, Homo sapiens
tgcaataatccacccccag

SEQ ID NO: 3596880 - DNA, 15 bp, Homo sapiens
tgcaatctaatctga

SEQ ID NO: 3596881 - DNA, 21 bp, Homo sapiens
tgcaatgacacagtcttggct

SEQ ID NO: 3596882 - DNA, 21 bp, Homo sapiens
tgcaatgtggtgacacctccc

SEQ ID NO: 3596883 - DNA, 17 bp, Homo sapiens
tgcacaaagcccttcca

SEQ ID NO: 3596884 - DNA, 21 bp, Homo sapiens
tgcacaaatatttattttctt

SEQ ID NO: 3596885 - DNA, 18 bp, Homo sapiens
tgcacaacagagtaacta

SEQ ID NO: 3596886 - DNA, 14 bp, Homo sapiens
tgcacaacagccct

SEQ ID NO: 3596887 - DNA, 15 bp, Homo sapiens
tgcacaacagccctg

SEQ ID NO: 3596888 - DNA, 13 bp, Homo sapiens
tgcacacagggca

SEQ ID NO: 3596889 - DNA, 20 bp, Homo sapiens
tgcacacctactagtcacca

SEQ ID NO: 3596890 - DNA, 22 bp, Homo sapiens
tgcacacctactagtcaccaga

SEQ ID NO: 3596891 - DNA, 22 bp, Homo sapiens
tgcacactagtttatgctacct

SEQ ID NO: 3596892 - DNA, 19 bp, Homo sapiens
tgcacactcatacacatgt

SEQ ID NO: 3596893 - DNA, 22 bp, Homo sapiens
tgcacactctcccattatattt

SEQ ID NO: 3596894 - DNA, 17 bp, Homo sapiens
tgcacagacaagcagcc

SEQ ID NO: 3596895 - DNA, 18 bp, Homo sapiens
tgcacagtatctgctgtt

SEQ ID NO: 3596896 - DNA, 19 bp, Homo sapiens
tgcacagtatctgctgttc

SEQ ID NO: 3596897 - DNA, 19 bp, Homo sapiens
tgcacagtgcatctcagcc

SEQ ID NO: 3596898 - DNA, 18 bp, Homo sapiens
tgcacagttgccacattt

SEQ ID NO: 3596899 - DNA, 13 bp, Homo sapiens
tgcaccaaagaca

SEQ ID NO: 3596900 - DNA, 15 bp, Homo sapiens
tgcaccaccatgccc

SEQ ID NO: 3596901 - DNA, 23 bp, Homo sapiens
tgcaccatgctgctggggaagac

SEQ ID NO: 3596902 - DNA, 14 bp, Homo sapiens
tgcacccagaacag

SEQ ID NO: 3596903 - DNA, 17 bp, Homo sapiens
tgcacccagaacagtgg

SEQ ID NO: 3596904 - DNA, 13 bp, Homo sapiens
tgcaccccttcct

SEQ ID NO: 3596905 - DNA, 17 bp, Homo sapiens
tgcacctcctaccctcc

SEQ ID NO: 3596906 - DNA, 19 bp, Homo sapiens
tgcacctcctaccctccca

SEQ ID NO: 3596907 - DNA, 21 bp, Homo sapiens
tgcacctcctaccctcccacc

SEQ ID NO: 3596908 - DNA, 15 bp, Homo sapiens
tgcacctgcctccac

SEQ ID NO: 3596909 - DNA, 16 bp, Homo sapiens
tgcacctgcctccacc

SEQ ID NO: 3596910 - DNA, 22 bp, Homo sapiens
tgcacctgcctccaccagcaag

SEQ ID NO: 3596911 - DNA, 18 bp, Homo sapiens
tgcacgcaggcacagcag

SEQ ID NO: 3596912 - DNA, 17 bp, Homo sapiens
tgcacgtggggcccact

SEQ ID NO: 3596913 - DNA, 23 bp, Homo sapiens
tgcactaaaatgaggatccaggg

SEQ ID NO: 3596914 - DNA, 17 bp, Homo sapiens
tgcactaaggggcccgg

SEQ ID NO: 3596915 - DNA, 22 bp, Homo sapiens
tgcactaaggggcccggccagc

SEQ ID NO: 3596916 - DNA, 22 bp, Homo sapiens
tgcactcacccctagccctggt

SEQ ID NO: 3596917 - DNA, 11 bp, Homo sapiens
tgcactccaga

SEQ ID NO: 3596918 - DNA, 13 bp, Homo sapiens
tgcactccagact

SEQ ID NO: 3596919 - DNA, 15 bp, Homo sapiens
tgcactccagactct

SEQ ID NO: 3596920 - DNA, 18 bp, Homo sapiens
tgcactccagactctggg

SEQ ID NO: 3596921 - DNA, 20 bp, Homo sapiens
tgcactccagactctggggg

SEQ ID NO: 3596922 - DNA, 15 bp, Homo sapiens
tgcactcccacctga

SEQ ID NO: 3596923 - DNA, 14 bp, Homo sapiens
tgcactgaagtttt

SEQ ID NO: 3596924 - DNA, 22 bp, Homo sapiens
tgcactgatatatcatgagtga

SEQ ID NO: 3596925 - DNA, 15 bp, Homo sapiens
tgcactgcctgcatg

SEQ ID NO: 3596926 - DNA, 16 bp, Homo sapiens
tgcactgtcaagatga

SEQ ID NO: 3596927 - DNA, 15 bp, Homo sapiens
tgcactgtgaaggac

SEQ ID NO: 3596928 - DNA, 16 bp, Homo sapiens
tgcagaaaacagggtc

SEQ ID NO: 3596929 - DNA, 20 bp, Homo sapiens
tgcagaaagcatccctcacc

SEQ ID NO: 3596930 - DNA, 16 bp, Homo sapiens
tgcagacccagtccca

SEQ ID NO: 3596931 - DNA, 17 bp, Homo sapiens
tgcagataactttgact

SEQ ID NO: 3596932 - DNA, 19 bp, Homo sapiens
tgcagatactttgaagtgc

SEQ ID NO: 3596933 - DNA, 19 bp, Homo sapiens
tgcagcagggatgccctgg

SEQ ID NO: 3596934 - DNA, 13 bp, Homo sapiens
tgcagcagtcgcc

SEQ ID NO: 3596935 - DNA, 18 bp, Homo sapiens
tgcagcagtcgcccaagc

SEQ ID NO: 3596936 - DNA, 14 bp, Homo sapiens
tgcagcatttacta

SEQ ID NO: 3596937 - DNA, 20 bp, Homo sapiens
tgcagcatttactatgcaca

SEQ ID NO: 3596938 - DNA, 13 bp, Homo sapiens
tgcagcccaggcc

SEQ ID NO: 3596939 - DNA, 12 bp, Homo sapiens
tgcagccccagg

SEQ ID NO: 3596940 - DNA, 17 bp, Homo sapiens
tgcagcccgtgtccagg

SEQ ID NO: 3596941 - DNA, 16 bp, Homo sapiens
tgcagcctaagaagaa

SEQ ID NO: 3596942 - DNA, 18 bp, Homo sapiens
tgcagcctcaacctcctg

SEQ ID NO: 3596943 - DNA, 14 bp, Homo sapiens
tgcagcctgcgcca

SEQ ID NO: 3596944 - DNA, 19 bp, Homo sapiens
tgcagccttcatcagaact

SEQ ID NO: 3596945 - DNA, 16 bp, Homo sapiens
tgcagccttcccctcc

SEQ ID NO: 3596946 - DNA, 16 bp, Homo sapiens
tgcagcggctcctgca

SEQ ID NO: 3596947 - DNA, 15 bp, Homo sapiens
tgcagctcctcagcg

SEQ ID NO: 3596948 - DNA, 21 bp, Homo sapiens
tgcagctgtttgttgccccat

SEQ ID NO: 3596949 - DNA, 15 bp, Homo sapiens
tgcaggagcccccct

SEQ ID NO: 3596950 - DNA, 22 bp, Homo sapiens
tgcaggcctaggtgcagctcct

SEQ ID NO: 3596951 - DNA, 9 bp, Homo sapiens
tgcagggcc

SEQ ID NO: 3596952 - DNA, 16 bp, Homo sapiens
tgcaggtgtcctgagc

SEQ ID NO: 3596953 - DNA, 17 bp, Homo sapiens
tgcaggtgttctgctga

SEQ ID NO: 3596954 - DNA, 16 bp, Homo sapiens
tgcagtacagtcttat

SEQ ID NO: 3596955 - DNA, 15 bp, Homo sapiens
tgcagtactaaaatt

SEQ ID NO: 3596956 - DNA, 16 bp, Homo sapiens
tgcagtctcatttctc

SEQ ID NO: 3596957 - DNA, 14 bp, Homo sapiens
tgcagtctggctga

SEQ ID NO: 3596958 - DNA, 20 bp, Homo sapiens
tgcagtctttatttttttcc

SEQ ID NO: 3596959 - DNA, 21 bp, Homo sapiens
tgcagtctttatttttttccc

SEQ ID NO: 3596960 - DNA, 18 bp, Homo sapiens
tgcagtttacagtatttc

SEQ ID NO: 3596961 - DNA, 14 bp, Homo sapiens
tgcagtttcttttc

SEQ ID NO: 3596962 - DNA, 15 bp, Homo sapiens
tgcagtttcttttca

SEQ ID NO: 3596963 - DNA, 18 bp, Homo sapiens
tgcagtttcttttcacat

SEQ ID NO: 3596964 - DNA, 21 bp, Homo sapiens
tgcagtttggtgtgtcctccg

SEQ ID NO: 3596965 - DNA, 13 bp, Homo sapiens
tgcagttttgaca

SEQ ID NO: 3596966 - DNA, 15 bp, Homo sapiens
tgcataaaaattaaa

SEQ ID NO: 3596967 - DNA, 13 bp, Homo sapiens
tgcataataagca

SEQ ID NO: 3596968 - DNA, 21 bp, Homo sapiens
tgcataataagcaggttgtta

SEQ ID NO: 3596969 - DNA, 12 bp, Homo sapiens
tgcataccaacc

SEQ ID NO: 3596970 - DNA, 19 bp, Homo sapiens
tgcataggctcttaagcag

SEQ ID NO: 3596971 - DNA, 16 bp, Homo sapiens
tgcatataatgaataa

SEQ ID NO: 3596972 - DNA, 20 bp, Homo sapiens
tgcatataatgaataaatca

SEQ ID NO: 3596973 - DNA, 19 bp, Homo sapiens
tgcatatgtcactagaatg

SEQ ID NO: 3596974 - DNA, 18 bp, Homo sapiens
tgcatattttgagaaact

SEQ ID NO: 3596975 - DNA, 19 bp, Homo sapiens
tgcatattttgagaaactg

SEQ ID NO: 3596976 - DNA, 22 bp, Homo sapiens
tgcatcagctgctgaaacaaca

SEQ ID NO: 3596977 - DNA, 15 bp, Homo sapiens
tgcatcattactgtt

SEQ ID NO: 3596978 - DNA, 19 bp, Homo sapiens
tgcatcattactgttccag

SEQ ID NO: 3596979 - DNA, 19 bp, Homo sapiens
tgcatccgggggcagctct

SEQ ID NO: 3596980 - DNA, 18 bp, Homo sapiens
tgcatctagcctcaagct

SEQ ID NO: 3596981 - DNA, 13 bp, Homo sapiens
tgcatctcagccc

SEQ ID NO: 3596982 - DNA, 13 bp, Homo sapiens
tgcatctcctccc

SEQ ID NO: 3596983 - DNA, 12 bp, Homo sapiens
tgcatctctgtg

SEQ ID NO: 3596984 - DNA, 21 bp, Homo sapiens
tgcatctgaccagcagcgcct

SEQ ID NO: 3596985 - DNA, 22 bp, Homo sapiens
tgcatctgaccagcagcgcctt

SEQ ID NO: 3596986 - DNA, 20 bp, Homo sapiens
tgcatctttgttacttcctt

SEQ ID NO: 3596987 - DNA, 17 bp, Homo sapiens
tgcatgctagtgttgta

SEQ ID NO: 3596988 - DNA, 22 bp, Homo sapiens
tgcctccacatgctgcctggca

SEQ ID NO: 3596989 - DNA, 18 bp, Homo sapiens
tgcctcccctctccttcc

SEQ ID NO: 3596990 - DNA, 19 bp, Homo sapiens
tgcctcctcacccccagct

SEQ ID NO: 3596991 - DNA, 13 bp, Homo sapiens
tgcctcctcagga

SEQ ID NO: 3596992 - DNA, 16 bp, Homo sapiens
tgcctcctcaggagcc

SEQ ID NO: 3596993 - DNA, 16 bp, Homo sapiens
tgcctcctcttcaact

SEQ ID NO: 3596994 - DNA, 14 bp, Homo sapiens
tgcctcgctccctt

SEQ ID NO: 3596995 - DNA, 16 bp, Homo sapiens
tgcctcgctcccttca

SEQ ID NO: 3596996 - DNA, 19 bp, Homo sapiens
tgcctcggacagtccgcag

SEQ ID NO: 3596997 - DNA, 16 bp, Homo sapiens
tgcctctcaattcgct

SEQ ID NO: 3596998 - DNA, 14 bp, Homo sapiens
tgcctctccctggg

SEQ ID NO: 3596999 - DNA, 20 bp, Homo sapiens
tgcctctgacagtccacagg

SEQ ID NO: 3597000 - DNA, 22 bp, Homo sapiens
tgcctctgacagtccacagggg

SEQ ID NO: 3597001 - DNA, 22 bp, Homo sapiens
tgcctctgccaaaggatgtgat

SEQ ID NO: 3597002 - DNA, 13 bp, Homo sapiens
tgcctctgccctg

SEQ ID NO: 3597003 - DNA, 14 bp, Homo sapiens
tgcctctgggactg

SEQ ID NO: 3597004 - DNA, 13 bp, Homo sapiens
tgcctcttcctcc

SEQ ID NO: 3597005 - DNA, 20 bp, Homo sapiens
tgcctcttctttgtgccttt

SEQ ID NO: 3597006 - DNA, 21 bp, Homo sapiens
tgcctgaagcttcggccgcgc

SEQ ID NO: 3597007 - DNA, 23 bp, Homo sapiens
tgcctgaccctacttcttttgct

SEQ ID NO: 3597008 - DNA, 17 bp, Homo sapiens
tgcctgagctggggaag

SEQ ID NO: 3597009 - DNA, 17 bp, Homo sapiens
tgcctgatttcattcct

SEQ ID NO: 3597010 - DNA, 15 bp, Homo sapiens
tgcctgccagctgca

SEQ ID NO: 3597011 - DNA, 16 bp, Homo sapiens
tgcctgccagctgcac

SEQ ID NO: 3597012 - DNA, 16 bp, Homo sapiens
tgcctgctccttggca

SEQ ID NO: 3597013 - DNA, 20 bp, Homo sapiens
tgcctggagacaaggtgcta

SEQ ID NO: 3597014 - DNA, 22 bp, Homo sapiens
tgcctggagacaaggtgctaac

SEQ ID NO: 3597015 - DNA, 23 bp, Homo sapiens
tgcctggagacaaggtgctaaca

SEQ ID NO: 3597016 - DNA, 20 bp, Homo sapiens
tgcctggaggctcctctagg

SEQ ID NO: 3597017 - DNA, 22 bp, Homo sapiens
tgcctggatgagaaacagctca

SEQ ID NO: 3597018 - DNA, 23 bp, Homo sapiens
tgcctggatgagaaacagctcag

SEQ ID NO: 3597019 - DNA, 17 bp, Homo sapiens
tgcctggcacagaccag

SEQ ID NO: 3597020 - DNA, 22 bp, Homo sapiens
tgcctgggcccggaagggcttt

SEQ ID NO: 3597021 - DNA, 23 bp, Homo sapiens
tgcctgggccgtggcacagctgg

SEQ ID NO: 3597022 - DNA, 15 bp, Homo sapiens
tgcctgggctcagcc

SEQ ID NO: 3597023 - DNA, 19 bp, Homo sapiens
tgcctgggctcagcctggt

SEQ ID NO: 3597024 - DNA, 14 bp, Homo sapiens
tgcctgtctgaagc

SEQ ID NO: 3597025 - DNA, 23 bp, Homo sapiens
tgcctgttaatttataatgtatt

SEQ ID NO: 3597026 - DNA, 14 bp, Homo sapiens
tgcctgttcccatt

SEQ ID NO: 3597027 - DNA, 15 bp, Homo sapiens
tgcctgttggcaggc

SEQ ID NO: 3597028 - DNA, 20 bp, Homo sapiens
tgcctgttggcaggcccact

SEQ ID NO: 3597029 - DNA, 11 bp, Homo sapiens
tgcctgtttcc

SEQ ID NO: 3597030 - DNA, 14 bp, Homo sapiens
tgccttaaaatgga

SEQ ID NO: 3597031 - DNA, 15 bp, Homo sapiens
tgccttaaaatggaa

SEQ ID NO: 3597032 - DNA, 17 bp, Homo sapiens
tgccttagaacctttct

SEQ ID NO: 3597033 - DNA, 21 bp, Homo sapiens
tgccttagaacctttcttaca

SEQ ID NO: 3597034 - DNA, 18 bp, Homo sapiens
tgccttcagtcttggtaa

SEQ ID NO: 3597035 - DNA, 20 bp, Homo sapiens
tgccttcccctgggccctga

SEQ ID NO: 3597036 - DNA, 19 bp, Homo sapiens
tgccttcggtacccaccac

SEQ ID NO: 3597037 - DNA, 15 bp, Homo sapiens
tgccttctaaaggtg

SEQ ID NO: 3597038 - DNA, 17 bp, Homo sapiens
tgccttctactcccctt

SEQ ID NO: 3597039 - DNA, 19 bp, Homo sapiens
tgccttgtgaaggaattat

SEQ ID NO: 3597040 - DNA, 18 bp, Homo sapiens
tgcctttaagccaaagaa

SEQ ID NO: 3597041 - DNA, 16 bp, Homo sapiens
tgcctttatttgctgt

SEQ ID NO: 3597042 - DNA, 15 bp, Homo sapiens
tgcctttcctatcac

SEQ ID NO: 3597043 - DNA, 14 bp, Homo sapiens
tgcctttctttgcc

SEQ ID NO: 3597044 - DNA, 15 bp, Homo sapiens
tgcctttctttgcct

SEQ ID NO: 3597045 - DNA, 12 bp, Homo sapiens
tgcctttggcct

SEQ ID NO: 3597046 - DNA, 20 bp, Homo sapiens
tgccttttatgtaaattttt

SEQ ID NO: 3597047 - DNA, 19 bp, Homo sapiens
tgccttttgaatacatttg

SEQ ID NO: 3597048 - DNA, 22 bp, Homo sapiens
tgccttttgaatacatttgtat

SEQ ID NO: 3597049 - DNA, 19 bp, Homo sapiens
tgcgcacagagggaagcca

SEQ ID NO: 3597050 - DNA, 21 bp, Homo sapiens
tgcgcacagagggaagccatg

SEQ ID NO: 3597051 - DNA, 15 bp, Homo sapiens
tgcgccaccatgccc

SEQ ID NO: 3597052 - DNA, 22 bp, Homo sapiens
tgcgctcttgggaccccagaga

SEQ ID NO: 3597053 - DNA, 22 bp, Homo sapiens
tgcggaggcggtggcagactag

SEQ ID NO: 3597054 - DNA, 15 bp, Homo sapiens
tgcggatcctgctgg

SEQ ID NO: 3597055 - DNA, 14 bp, Homo sapiens
tgcggcggtcccag

SEQ ID NO: 3597056 - DNA, 17 bp, Homo sapiens
tgcggcggtcccagctc

SEQ ID NO: 3597057 - DNA, 18 bp, Homo sapiens
tgcggcggtcccagctcc

SEQ ID NO: 3597058 - DNA, 13 bp, Homo sapiens
tgcggctgtgcag

SEQ ID NO: 3597059 - DNA, 21 bp, Homo sapiens
tgcggctgtgcagcctgtcct

SEQ ID NO: 3597060 - DNA, 18 bp, Homo sapiens
tgcggggcgggcacacct

SEQ ID NO: 3597061 - DNA, 16 bp, Homo sapiens
tgcggttaattttgaa

SEQ ID NO: 3597062 - DNA, 21 bp, Homo sapiens
tgcggttaattttgaagtgct

SEQ ID NO: 3597063 - DNA, 18 bp, Homo sapiens
tgcgtcccagctgaaggc

SEQ ID NO: 3597064 - DNA, 13 bp, Homo sapiens
tgcgtctgaggcc

SEQ ID NO: 3597065 - DNA, 18 bp, Homo sapiens
tgcgtttataattggctt

SEQ ID NO: 3597066 - DNA, 19 bp, Homo sapiens
tgctaaagcctgtgggttt

SEQ ID NO: 3597067 - DNA, 19 bp, Homo sapiens
tgctaactgggttaaatat

SEQ ID NO: 3597068 - DNA, 12 bp, Homo sapiens
tgctaactggtt

SEQ ID NO: 3597069 - DNA, 15 bp, Homo sapiens
tgctaactggttaaa

SEQ ID NO: 3597070 - DNA, 15 bp, Homo sapiens
tgctaataccaaaat

SEQ ID NO: 3597071 - DNA, 16 bp, Homo sapiens
tgctaatcaaaacttt

SEQ ID NO: 3597072 - DNA, 13 bp, Homo sapiens
tgctaatcttctt

SEQ ID NO: 3597073 - DNA, 15 bp, Homo sapiens
tgctacaaaaacaca

SEQ ID NO: 3597074 - DNA, 18 bp, Homo sapiens
tgctacaaaaacacagca

SEQ ID NO: 3597075 - DNA, 13 bp, Homo sapiens
tgctactactgca

SEQ ID NO: 3597076 - DNA, 21 bp, Homo sapiens
tgctactactgcagtctttat

SEQ ID NO: 3597077 - DNA, 15 bp, Homo sapiens
tgctactgctgctgc

SEQ ID NO: 3597078 - DNA, 22 bp, Homo sapiens
tgctagatccagcccaaacctg

SEQ ID NO: 3597079 - DNA, 14 bp, Homo sapiens
tgctagcaggctgt

SEQ ID NO: 3597080 - DNA, 20 bp, Homo sapiens
tgctagccagcattccatat

SEQ ID NO: 3597081 - DNA, 18 bp, Homo sapiens
tgctataaattttttgaa

SEQ ID NO: 3597082 - DNA, 13 bp, Homo sapiens
tgctatacatgtt

SEQ ID NO: 3597083 - DNA, 13 bp, Homo sapiens
tgctatagtgaca

SEQ ID NO: 3597084 - DNA, 16 bp, Homo sapiens
tgctatctctgtgtgc

SEQ ID NO: 3597085 - DNA, 13 bp, Homo sapiens
tgctatgaaacaa

SEQ ID NO: 3597086 - DNA, 21 bp, Homo sapiens
tgctatgaaacaatcttccaa

SEQ ID NO: 3597087 - DNA, 23 bp, Homo sapiens
tgctatgaaacaatcttccaaag

SEQ ID NO: 3597088 - DNA, 22 bp, Homo sapiens
tgctatgagctggggatgtctc

SEQ ID NO: 3597089 - DNA, 13 bp, Homo sapiens
tgctatttccacc

SEQ ID NO: 3597090 - DNA, 18 bp, Homo sapiens
tgctatttccacccattt

SEQ ID NO: 3597091 - DNA, 19 bp, Homo sapiens
tgctatttttcatcctaaa

SEQ ID NO: 3597092 - DNA, 23 bp, Homo sapiens
tgctcaacagcatatgggtggga

SEQ ID NO: 3597093 - DNA, 13 bp, Homo sapiens
tgctcaacccccc

SEQ ID NO: 3597094 - DNA, 19 bp, Homo sapiens
tgctcaacccccctcccag

SEQ ID NO: 3597095 - DNA, 17 bp, Homo sapiens
tgctcacaacttagtgt

SEQ ID NO: 3597096 - DNA, 16 bp, Homo sapiens
tgctcacacattacaa

SEQ ID NO: 3597097 - DNA, 17 bp, Homo sapiens
tgctcagaccagctctt

SEQ ID NO: 3597098 - DNA, 17 bp, Homo sapiens
tgctcagacccaacagc

SEQ ID NO: 3597099 - DNA, 20 bp, Homo sapiens
tgctcagcttctcctgtgtg

SEQ ID NO: 3597100 - DNA, 19 bp, Homo sapiens
tgctcagggaaaagcagct

SEQ ID NO: 3597101 - DNA, 13 bp, Homo sapiens
tgctcataaattg

SEQ ID NO: 3597102 - DNA, 13 bp, Homo sapiens
tgctcatgctgct

SEQ ID NO: 3597103 - DNA, 14 bp, Homo sapiens
tgctcatgctgctc

SEQ ID NO: 3597104 - DNA, 19 bp, Homo sapiens
tgctccaagatgttctcct

SEQ ID NO: 3597105 - DNA, 17 bp, Homo sapiens
tgctccaatgactgagc

SEQ ID NO: 3597106 - DNA, 17 bp, Homo sapiens
tgctccacactcagaaa

SEQ ID NO: 3597107 - DNA, 19 bp, Homo sapiens
tgctccacactcagaaaat

SEQ ID NO: 3597108 - DNA, 15 bp, Homo sapiens
tgctccaccagcagc

SEQ ID NO: 3597109 - DNA, 16 bp, Homo sapiens
tgctccaccagcagca

SEQ ID NO: 3597110 - DNA, 18 bp, Homo sapiens
tgctccaccagcagcatg

SEQ ID NO: 3597111 - DNA, 12 bp, Homo sapiens
tgctccagacct

SEQ ID NO: 3597112 - DNA, 20 bp, Homo sapiens
tgctccataccttttctctt

SEQ ID NO: 3597113 - DNA, 17 bp, Homo sapiens
tgctcccaaaacatttt

SEQ ID NO: 3597114 - DNA, 18 bp, Homo sapiens
tgctcccctaaagccagg

SEQ ID NO: 3597115 - DNA, 19 bp, Homo sapiens
tgctcccctaaagccaggc

SEQ ID NO: 3597116 - DNA, 20 bp, Homo sapiens
tgctcccctaaagccaggct

SEQ ID NO: 3597117 - DNA, 21 bp, Homo sapiens
tgctccctgactgggggcaga

SEQ ID NO: 3597118 - DNA, 24 bp, Homo sapiens
tgctcctagagggaggggcctagg

SEQ ID NO: 3597119 - DNA, 14 bp, Homo sapiens
tgctcctctcttgg

SEQ ID NO: 3597120 - DNA, 22 bp, Homo sapiens
tggaaaaacaattcctgtaacc

SEQ ID NO: 3597121 - DNA, 19 bp, Homo sapiens
tggaaaaacaggaaaggag

SEQ ID NO: 3597122 - DNA, 21 bp, Homo sapiens
tggaaaaatggttgatggaaa

SEQ ID NO: 3597123 - DNA, 22 bp, Homo sapiens
tggaaaaatggttgatggaaaa

SEQ ID NO: 3597124 - DNA, 23 bp, Homo sapiens
tggaaaaatggttgatggaaaat

SEQ ID NO: 3597125 - DNA, 15 bp, Homo sapiens
tggaaaataaattat

SEQ ID NO: 3597126 - DNA, 15 bp, Homo sapiens
tggaaacagcatgaa

SEQ ID NO: 3597127 - DNA, 18 bp, Homo sapiens
tggaaacagcatgaataa

SEQ ID NO: 3597128 - DNA, 19 bp, Homo sapiens
tggaaacagcatgaataaa

SEQ ID NO: 3597129 - DNA, 20 bp, Homo sapiens
tggaaacatttatattttta

SEQ ID NO: 3597130 - DNA, 16 bp, Homo sapiens
tggaaaccttccaccc

SEQ ID NO: 3597131 - DNA, 14 bp, Homo sapiens
tggaaagacttctc

SEQ ID NO: 3597132 - DNA, 22 bp, Homo sapiens
tggaaagacttctcaaagagaa

SEQ ID NO: 3597133 - DNA, 23 bp, Homo sapiens
tggaaagacttctcaaagagaat

SEQ ID NO: 3597134 - DNA, 17 bp, Homo sapiens
tggaaagcacaagactg

SEQ ID NO: 3597135 - DNA, 22 bp, Homo sapiens
tggaaagcacaagactggccca

SEQ ID NO: 3597136 - DNA, 20 bp, Homo sapiens
tggaaagcagagcctcctgg

SEQ ID NO: 3597137 - DNA, 17 bp, Homo sapiens
tggaaaggggaggagct

SEQ ID NO: 3597138 - DNA, 18 bp, Homo sapiens
tggaaagtcaggctagct

SEQ ID NO: 3597139 - DNA, 23 bp, Homo sapiens
tggaaagtcaggctagctgtgct

SEQ ID NO: 3597140 - DNA, 15 bp, Homo sapiens
tggaaagttgggccc

SEQ ID NO: 3597141 - DNA, 22 bp, Homo sapiens
tggaaagttgggcccctgagga

SEQ ID NO: 3597142 - DNA, 16 bp, Homo sapiens
tggaaataaagtcaga

SEQ ID NO: 3597143 - DNA, 13 bp, Homo sapiens
tggaaataaatgt

SEQ ID NO: 3597144 - DNA, 14 bp, Homo sapiens
tggaaatacacagt

SEQ ID NO: 3597145 - DNA, 16 bp, Homo sapiens
tggaaatacactcatg

SEQ ID NO: 3597146 - DNA, 19 bp, Homo sapiens
tggaaatcaaatgtaaagt

SEQ ID NO: 3597147 - DNA, 13 bp, Homo sapiens
tggaaatggtttc

SEQ ID NO: 3597148 - DNA, 16 bp, Homo sapiens
tggaaattgaaataaa

SEQ ID NO: 3597149 - DNA, 16 bp, Homo sapiens
tggaaattggaagagc

SEQ ID NO: 3597150 - DNA, 17 bp, Homo sapiens
tggaaattggaagagca

SEQ ID NO: 3597151 - DNA, 19 bp, Homo sapiens
tggaacaatcacagggaat

SEQ ID NO: 3597152 - DNA, 20 bp, Homo sapiens
tggaacaatcacagggaatg

SEQ ID NO: 3597153 - DNA, 20 bp, Homo sapiens
tggaacacagaactgaactg

SEQ ID NO: 3597154 - DNA, 20 bp, Homo sapiens
tggaagccaggtacaggaga

SEQ ID NO: 3597155 - DNA, 18 bp, Homo sapiens
tggaagctgccctgccca

SEQ ID NO: 3597156 - DNA, 22 bp, Homo sapiens
tggaagcttgttgaaaacccag

SEQ ID NO: 3597157 - DNA, 22 bp, Homo sapiens
tggaaggagaggggaggtcact

SEQ ID NO: 3597158 - DNA, 22 bp, Homo sapiens
tggaagtatgtatattaaaaaa

SEQ ID NO: 3597159 - DNA, 19 bp, Homo sapiens
tggaagtgaaaactttgta

SEQ ID NO: 3597160 - DNA, 14 bp, Homo sapiens
tggaagtgtgggtc

SEQ ID NO: 3597161 - DNA, 21 bp, Homo sapiens
tggaagtgtgggtctgtgtgt

SEQ ID NO: 3597162 - DNA, 19 bp, Homo sapiens
tggaagtgtgtgccaagag

SEQ ID NO: 3597163 - DNA, 16 bp, Homo sapiens
tggaataaagttgcag

SEQ ID NO: 3597164 - DNA, 14 bp, Homo sapiens
tggaatacatgaaa

SEQ ID NO: 3597165 - DNA, 17 bp, Homo sapiens
tggaatccagaaggaag

SEQ ID NO: 3597166 - DNA, 17 bp, Homo sapiens
tggaatgaattaaataa

SEQ ID NO: 3597167 - DNA, 14 bp, Homo sapiens
tggaattataaata

SEQ ID NO: 3597168 - DNA, 22 bp, Homo sapiens
tggaattatgttggtgtgaatt

SEQ ID NO: 3597169 - DNA, 17 bp, Homo sapiens
tggaattccctcctgag

SEQ ID NO: 3597170 - DNA, 17 bp, Homo sapiens
tggaattgggagcttgg

SEQ ID NO: 3597171 - DNA, 22 bp, Homo sapiens
tggaatttctcccagtcattta

SEQ ID NO: 3597172 - DNA, 23 bp, Homo sapiens
tggaatttgaggtctagagagaa

SEQ ID NO: 3597173 - DNA, 18 bp, Homo sapiens
tggacaatctcacacctt

SEQ ID NO: 3597174 - DNA, 22 bp, Homo sapiens
tggacacaacagcagtctcctt

SEQ ID NO: 3597175 - DNA, 12 bp, Homo sapiens
tggacacagctc

SEQ ID NO: 3597176 - DNA, 16 bp, Homo sapiens
tggacacagctcttca

SEQ ID NO: 3597177 - DNA, 17 bp, Homo sapiens
tggacacagctcttcat

SEQ ID NO: 3597178 - DNA, 18 bp, Homo sapiens
tggacacagctcttcatt

SEQ ID NO: 3597179 - DNA, 18 bp, Homo sapiens
tggacagtacctgattgt

SEQ ID NO: 3597180 - DNA, 19 bp, Homo sapiens
tggacagtacctgattgta

SEQ ID NO: 3597181 - DNA, 13 bp, Homo sapiens
tggacagtggcct

SEQ ID NO: 3597182 - DNA, 14 bp, Homo sapiens
tggacagtggcctc

SEQ ID NO: 3597183 - DNA, 17 bp, Homo sapiens
tggacatgcataaaaat

SEQ ID NO: 3597184 - DNA, 21 bp, Homo sapiens
tggacatgcataaaaattaaa

SEQ ID NO: 3597185 - DNA, 16 bp, Homo sapiens
tggacattttatgtct

SEQ ID NO: 3597186 - DNA, 17 bp, Homo sapiens
tggacattttatgtctt

SEQ ID NO: 3597187 - DNA, 21 bp, Homo sapiens
tggaccaccgttcagtcattt

SEQ ID NO: 3597188 - DNA, 15 bp, Homo sapiens
tggaccactgggcaa

SEQ ID NO: 3597189 - DNA, 21 bp, Homo sapiens
tggacctctatcatctgctaa

SEQ ID NO: 3597190 - DNA, 17 bp, Homo sapiens
tggacgggatgacctcc

SEQ ID NO: 3597191 - DNA, 20 bp, Homo sapiens
tggacgggatgacctccaga

SEQ ID NO: 3597192 - DNA, 23 bp, Homo sapiens
tggacgggatgacctccagaagt

SEQ ID NO: 3597193 - DNA, 14 bp, Homo sapiens
tggactcaggatcc

SEQ ID NO: 3597194 - DNA, 14 bp, Homo sapiens
tggactggaaagca

SEQ ID NO: 3597195 - DNA, 17 bp, Homo sapiens
tggactggaaagcacaa

SEQ ID NO: 3597196 - DNA, 22 bp, Homo sapiens
tggactggaaagcacaagactg

SEQ ID NO: 3597197 - DNA, 19 bp, Homo sapiens
tggacttaagcatctggct

SEQ ID NO: 3597198 - DNA, 17 bp, Homo sapiens
tggacttgtgattggct

SEQ ID NO: 3597199 - DNA, 17 bp, Homo sapiens
tggagaaagaagtggag

SEQ ID NO: 3597200 - DNA, 18 bp, Homo sapiens
tggagaaagaagtggaga

SEQ ID NO: 3597201 - DNA, 14 bp, Homo sapiens
tggagaaagagctg

SEQ ID NO: 3597202 - DNA, 18 bp, Homo sapiens
tggagaaagagctgcctg

SEQ ID NO: 3597203 - DNA, 19 bp, Homo sapiens
tggagaaagagctgcctgg

SEQ ID NO: 3597204 - DNA, 21 bp, Homo sapiens
tggagaaagagctgcctggat

SEQ ID NO: 3597205 - DNA, 21 bp, Homo sapiens
tggagaacagtggttgcctgg

SEQ ID NO: 3597206 - DNA, 22 bp, Homo sapiens
tggagaacagtggttgcctggg

SEQ ID NO: 3597207 - DNA, 22 bp, Homo sapiens
tggagaaccagggctcttctca

SEQ ID NO: 3597208 - DNA, 18 bp, Homo sapiens
tggagaaggcctggaaga

SEQ ID NO: 3597209 - DNA, 18 bp, Homo sapiens
tggagaaggtctgtggtg

SEQ ID NO: 3597210 - DNA, 16 bp, Homo sapiens
tggagacaaggtgcta

SEQ ID NO: 3597211 - DNA, 18 bp, Homo sapiens
tggagacaccctctgggg

SEQ ID NO: 3597212 - DNA, 11 bp, Homo sapiens
tggagagaata

SEQ ID NO: 3597213 - DNA, 17 bp, Homo sapiens
tggagagaatgtgtgtg

SEQ ID NO: 3597214 - DNA, 13 bp, Homo sapiens
tggagagagcagg

SEQ ID NO: 3597215 - DNA, 16 bp, Homo sapiens
tggagagcccagagtc

SEQ ID NO: 3597216 - DNA, 16 bp, Homo sapiens
tggagagtcagatctt

SEQ ID NO: 3597217 - DNA, 15 bp, Homo sapiens
tggagcagcaggcct

SEQ ID NO: 3597218 - DNA, 18 bp, Homo sapiens
tggagcagcaggcctctg

SEQ ID NO: 3597219 - DNA, 21 bp, Homo sapiens
tggagcagcaggcctctggga

SEQ ID NO: 3597220 - DNA, 13 bp, Homo sapiens
tggagcaggagcc

SEQ ID NO: 3597221 - DNA, 22 bp, Homo sapiens
tggagcaggcccaatgctgctt

SEQ ID NO: 3597222 - DNA, 17 bp, Homo sapiens
tggagccaatggagact

SEQ ID NO: 3597223 - DNA, 12 bp, Homo sapiens
tggagccccagg

SEQ ID NO: 3597224 - DNA, 22 bp, Homo sapiens
tggagcctacctctgtctgaga

SEQ ID NO: 3597225 - DNA, 14 bp, Homo sapiens
tggagctgccacag

SEQ ID NO: 3597226 - DNA, 13 bp, Homo sapiens
tggagctgtctgt

SEQ ID NO: 3597227 - DNA, 18 bp, Homo sapiens
tggagctgtctgtctcta

SEQ ID NO: 3597228 - DNA, 19 bp, Homo sapiens
tggagcttcagccaggtct

SEQ ID NO: 3597229 - DNA, 21 bp, Homo sapiens
tggaggaaaaccaagccgtgg

SEQ ID NO: 3597230 - DNA, 18 bp, Homo sapiens
tggaggaggcctgtccca

SEQ ID NO: 3597231 - DNA, 22 bp, Homo sapiens
tggaggctacctcacctgggca

SEQ ID NO: 3597232 - DNA, 11 bp, Homo sapiens
tggaggctcct

SEQ ID NO: 3597233 - DNA, 20 bp, Homo sapiens
tggaggctcctctaggccct

SEQ ID NO: 3597234 - DNA, 13 bp, Homo sapiens
tggagggctcagg

SEQ ID NO: 3597235 - DNA, 18 bp, Homo sapiens
tggaggtctccaggggcc

SEQ ID NO: 3597236 - DNA, 15 bp, Homo sapiens
tggaggtctggctga

SEQ ID NO: 3597237 - DNA, 20 bp, Homo sapiens
tggaggtctggctgagcccc

SEQ ID NO: 3597238 - DNA, 13 bp, Homo sapiens
tggaggtgggcaa

SEQ ID NO: 3597239 - DNA, 19 bp, Homo sapiens
tggagtattattattttaa

SEQ ID NO: 3597240 - DNA, 22 bp, Homo sapiens
tggagtccaggacaggagatgc

SEQ ID NO: 3597241 - DNA, 13 bp, Homo sapiens
tggagtccagtgc

SEQ ID NO: 3597242 - DNA, 15 bp, Homo sapiens
tggagtccagtgctt

SEQ ID NO: 3597243 - DNA, 18 bp, Homo sapiens
tggagtgagtcacctgct

SEQ ID NO: 3597244 - DNA, 17 bp, Homo sapiens
tggagtgcaatgacaca

SEQ ID NO: 3597245 - DNA, 17 bp, Homo sapiens
tggagtgctcttcccac

SEQ ID NO: 3597246 - DNA, 22 bp, Homo sapiens
tggagtgggaagggagcattgc

SEQ ID NO: 3597247 - DNA, 21 bp, Homo sapiens
tggagtgtgagggtcctgcag

SEQ ID NO: 3597248 - DNA, 13 bp, Homo sapiens
tggagttccttat

SEQ ID NO: 3597249 - DNA, 23 bp, Homo sapiens
tggagttccttatccctctcttc

SEQ ID NO: 3597250 - DNA, 14 bp, Homo sapiens
tggagttctctcat

SEQ ID NO: 3597251 - DNA, 19 bp, Homo sapiens
tgggcctgctccagacctg

SEQ ID NO: 3597252 - DNA, 20 bp, Homo sapiens
tgggcctgctccagacctga

SEQ ID NO: 3597253 - DNA, 15 bp, Homo sapiens
tgggccttcaccaag

SEQ ID NO: 3597254 - DNA, 21 bp, Homo sapiens
tgggcctttaagaaccttaat

SEQ ID NO: 3597255 - DNA, 23 bp, Homo sapiens
tgggcggaagtacttccctcagg

SEQ ID NO: 3597256 - DNA, 18 bp, Homo sapiens
tgggcgtccagctcagcc

SEQ ID NO: 3597257 - DNA, 19 bp, Homo sapiens
tgggcgtccagctcagccc

SEQ ID NO: 3597258 - DNA, 22 bp, Homo sapiens
tgggcgtccagctcagccctgg

SEQ ID NO: 3597259 - DNA, 16 bp, Homo sapiens
tgggcgttgggagcct

SEQ ID NO: 3597260 - DNA, 17 bp, Homo sapiens
tgggctattgctgctgc

SEQ ID NO: 3597261 - DNA, 21 bp, Homo sapiens
tgggctattgctgctgcccct

SEQ ID NO: 3597262 - DNA, 18 bp, Homo sapiens
tgggctcaaccagaaaag

SEQ ID NO: 3597263 - DNA, 20 bp, Homo sapiens
tgggctcaagtgatcctcac

SEQ ID NO: 3597264 - DNA, 16 bp, Homo sapiens
tgggctcactgtgctg

SEQ ID NO: 3597265 - DNA, 10 bp, Homo sapiens
tgggctcctc

SEQ ID NO: 3597266 - DNA, 21 bp, Homo sapiens
tgggctcgccgtgtctcagcc

SEQ ID NO: 3597267 - DNA, 12 bp, Homo sapiens
tgggctctggaa

SEQ ID NO: 3597268 - DNA, 20 bp, Homo sapiens
tgggctgacccagcatctcc

SEQ ID NO: 3597269 - DNA, 14 bp, Homo sapiens
tgggctgccctggt

SEQ ID NO: 3597270 - DNA, 17 bp, Homo sapiens
tgggctgccctggtgct

SEQ ID NO: 3597271 - DNA, 19 bp, Homo sapiens
tgggctgccctggtgctgc

SEQ ID NO: 3597272 - DNA, 21 bp, Homo sapiens
tgggctgtgtcctaaggccca

SEQ ID NO: 3597273 - DNA, 18 bp, Homo sapiens
tgggcttcaacagccaag

SEQ ID NO: 3597274 - DNA, 22 bp, Homo sapiens
tgggctttgggaagtttgctgt

SEQ ID NO: 3597275 - DNA, 24 bp, Homo sapiens
tggggaataatttccttcaggcag

SEQ ID NO: 3597276 - DNA, 16 bp, Homo sapiens
tggggacagagggtgt

SEQ ID NO: 3597277 - DNA, 15 bp, Homo sapiens
tggggacagcttcct

SEQ ID NO: 3597278 - DNA, 13 bp, Homo sapiens
tggggacaggccc

SEQ ID NO: 3597279 - DNA, 21 bp, Homo sapiens
tggggacgtgaacgttttaat

SEQ ID NO: 3597280 - DNA, 22 bp, Homo sapiens
tggggagggatttggggctcag

SEQ ID NO: 3597281 - DNA, 17 bp, Homo sapiens
tggggagttaagacctg

SEQ ID NO: 3597282 - DNA, 18 bp, Homo sapiens
tggggagttaagacctgg

SEQ ID NO: 3597283 - DNA, 19 bp, Homo sapiens
tggggagttaagacctggc

SEQ ID NO: 3597284 - DNA, 16 bp, Homo sapiens
tggggatagatgtgtg

SEQ ID NO: 3597285 - DNA, 18 bp, Homo sapiens
tggggatagatgtgtgga

SEQ ID NO: 3597286 - DNA, 21 bp, Homo sapiens
tggggatcttcccacaggagg

SEQ ID NO: 3597287 - DNA, 15 bp, Homo sapiens
tggggattgtacacg

SEQ ID NO: 3597288 - DNA, 13 bp, Homo sapiens
tggggcagcctct

SEQ ID NO: 3597289 - DNA, 18 bp, Homo sapiens
tggggcagctgagcagct

SEQ ID NO: 3597290 - DNA, 14 bp, Homo sapiens
tggggccagatcca

SEQ ID NO: 3597291 - DNA, 16 bp, Homo sapiens
tggggccagatccagc

SEQ ID NO: 3597292 - DNA, 20 bp, Homo sapiens
tggggccagatccagcctgg

SEQ ID NO: 3597293 - DNA, 21 bp, Homo sapiens
tggggccatgcctcctcagga

SEQ ID NO: 3597294 - DNA, 14 bp, Homo sapiens
tggggcctcaggct

SEQ ID NO: 3597295 - DNA, 16 bp, Homo sapiens
tggggcctcaggctcc

SEQ ID NO: 3597296 - DNA, 23 bp, Homo sapiens
tggggctgagccctcctgagggc

SEQ ID NO: 3597297 - DNA, 14 bp, Homo sapiens
tggggctgattgta

SEQ ID NO: 3597298 - DNA, 13 bp, Homo sapiens
tggggctgcaggc

SEQ ID NO: 3597299 - DNA, 13 bp, Homo sapiens
tggggctggcatc

SEQ ID NO: 3597300 - DNA, 15 bp, Homo sapiens
tggggctggcatcaa

SEQ ID NO: 3597301 - DNA, 21 bp, Homo sapiens
tgggggaacactgagaaagag

SEQ ID NO: 3597302 - DNA, 23 bp, Homo sapiens
tgggggaagactttaaaccacct

SEQ ID NO: 3597303 - DNA, 19 bp, Homo sapiens
tgggggacgatcaggagga

SEQ ID NO: 3597304 - DNA, 21 bp, Homo sapiens
tgggggaggagcctctggctt

SEQ ID NO: 3597305 - DNA, 15 bp, Homo sapiens
tgggggagtggaata

SEQ ID NO: 3597306 - DNA, 23 bp, Homo sapiens
tggggggagaaaaaaaaagcaaa

SEQ ID NO: 3597307 - DNA, 20 bp, Homo sapiens
tgggggtaaagtttgctcta

SEQ ID NO: 3597308 - DNA, 13 bp, Homo sapiens
tgggggtgggcca

SEQ ID NO: 3597309 - DNA, 22 bp, Homo sapiens
tgggggttctttcttcctctgc

SEQ ID NO: 3597310 - DNA, 15 bp, Homo sapiens
tggggtaggttggga

SEQ ID NO: 3597311 - DNA, 13 bp, Homo sapiens
tggggtcatgccc

SEQ ID NO: 3597312 - DNA, 12 bp, Homo sapiens
tggggtcctggc

SEQ ID NO: 3597313 - DNA, 15 bp, Homo sapiens
tggggtcctggccat

SEQ ID NO: 3597314 - DNA, 16 bp, Homo sapiens
tggggtcctggccatc

SEQ ID NO: 3597315 - DNA, 15 bp, Homo sapiens
tggggtgaatactta

SEQ ID NO: 3597316 - DNA, 19 bp, Homo sapiens
tggggtgaatacttatttt

SEQ ID NO: 3597317 - DNA, 16 bp, Homo sapiens
tggggtgcatctcctc

SEQ ID NO: 3597318 - DNA, 17 bp, Homo sapiens
tggggtggagtgggaag

SEQ ID NO: 3597319 - DNA, 23 bp, Homo sapiens
tggggttgcgtctgaggcctgcc

SEQ ID NO: 3597320 - DNA, 14 bp, Homo sapiens
tggggttgctgaag

SEQ ID NO: 3597321 - DNA, 19 bp, Homo sapiens
tgggtacttcttgaaggtg

SEQ ID NO: 3597322 - DNA, 24 bp, Homo sapiens
tgggtaggtggttcgtgctgtgct

SEQ ID NO: 3597323 - DNA, 23 bp, Homo sapiens
tgggtatttttataacaatataa

SEQ ID NO: 3597324 - DNA, 19 bp, Homo sapiens
tgggtcaccagacggggct

SEQ ID NO: 3597325 - DNA, 22 bp, Homo sapiens
tgggtcccagagacctcatcag

SEQ ID NO: 3597326 - DNA, 23 bp, Homo sapiens
tgggtcctgaagtgacctcactg

SEQ ID NO: 3597327 - DNA, 22 bp, Homo sapiens
tgggtccttggctcccgggggc

SEQ ID NO: 3597328 - DNA, 18 bp, Homo sapiens
tgggtctgattttctcac

SEQ ID NO: 3597329 - DNA, 13 bp, Homo sapiens
tgggtctgtgtgt

SEQ ID NO: 3597330 - DNA, 15 bp, Homo sapiens
tgggtctgtgtgtgt

SEQ ID NO: 3597331 - DNA, 13 bp, Homo sapiens
tgggtgagagagg

SEQ ID NO: 3597332 - DNA, 18 bp, Homo sapiens
tgggtggcaggggggctg

SEQ ID NO: 3597333 - DNA, 16 bp, Homo sapiens
tgggtggggtattttt

SEQ ID NO: 3597334 - DNA, 16 bp, Homo sapiens
tgggtgggtagattta

SEQ ID NO: 3597335 - DNA, 24 bp, Homo sapiens
tgggttaaatattttgctaactgg

SEQ ID NO: 3597336 - DNA, 22 bp, Homo sapiens
tgggttctgcctgccagctgca

SEQ ID NO: 3597337 - DNA, 16 bp, Homo sapiens
tgggtttgggagccag

SEQ ID NO: 3597338 - DNA, 17 bp, Homo sapiens
tgggtttgggagccagg

SEQ ID NO: 3597339 - DNA, 18 bp, Homo sapiens
tgggtttgggagccagga

SEQ ID NO: 3597340 - DNA, 18 bp, Homo sapiens
tggtaaacattcctccag

SEQ ID NO: 3597341 - DNA, 21 bp, Homo sapiens
tggtaaacattcctccagcct

SEQ ID NO: 3597342 - DNA, 16 bp, Homo sapiens
tggtaacttttgtgaa

SEQ ID NO: 3597343 - DNA, 24 bp, Homo sapiens
tggtaacttttgtgaattaggctg

SEQ ID NO: 3597344 - DNA, 14 bp, Homo sapiens
tggtaagagaagtg

SEQ ID NO: 3597345 - DNA, 13 bp, Homo sapiens
tggtaattgttgc

SEQ ID NO: 3597346 - DNA, 16 bp, Homo sapiens
tggtagatgctgaggc

SEQ ID NO: 3597347 - DNA, 18 bp, Homo sapiens
tggtagatgctgaggccc

SEQ ID NO: 3597348 - DNA, 14 bp, Homo sapiens
tggtagcagcaggc

SEQ ID NO: 3597349 - DNA, 23 bp, Homo sapiens
tggtagctcatgcctgtaaccct

SEQ ID NO: 3597350 - DNA, 13 bp, Homo sapiens
tggtaggaactgc

SEQ ID NO: 3597351 - DNA, 13 bp, Homo sapiens
tggtaggattgct

SEQ ID NO: 3597352 - DNA, 23 bp, Homo sapiens
tggtagggatatggcaggactcc

SEQ ID NO: 3597353 - DNA, 14 bp, Homo sapiens
tggtatctttagat

SEQ ID NO: 3597354 - DNA, 18 bp, Homo sapiens
tggtatggggctgagccc

SEQ ID NO: 3597355 - DNA, 13 bp, Homo sapiens
tggtatttatatt

SEQ ID NO: 3597356 - DNA, 16 bp, Homo sapiens
tggtcaaacaaactct

SEQ ID NO: 3597357 - DNA, 14 bp, Homo sapiens
tggtcaacatttct

SEQ ID NO: 3597358 - DNA, 20 bp, Homo sapiens
tggtcacgtttggtgcttct

SEQ ID NO: 3597359 - DNA, 21 bp, Homo sapiens
tggtcatgtgagtctgggata

SEQ ID NO: 3597360 - DNA, 12 bp, Homo sapiens
tggtccagctct

SEQ ID NO: 3597361 - DNA, 16 bp, Homo sapiens
tggtccagctctgaca

SEQ ID NO: 3597362 - DNA, 18 bp, Homo sapiens
tggtccagctctgacatc

SEQ ID NO: 3597363 - DNA, 23 bp, Homo sapiens
tggtccagctctgacatcccttc

SEQ ID NO: 3597364 - DNA, 13 bp, Homo sapiens
tggtcccttaagg

SEQ ID NO: 3597365 - DNA, 14 bp, Homo sapiens
tggtcggagaggga

SEQ ID NO: 3597366 - DNA, 21 bp, Homo sapiens
tggtctaatgattcaaatgtt

SEQ ID NO: 3597367 - DNA, 23 bp, Homo sapiens
tggtctccccaattctcccctcc

SEQ ID NO: 3597368 - DNA, 20 bp, Homo sapiens
tggtctcgaactcctgacct

SEQ ID NO: 3597369 - DNA, 20 bp, Homo sapiens
tggtctctgccccagcctgt

SEQ ID NO: 3597370 - DNA, 14 bp, Homo sapiens
tggtcttttggtta

SEQ ID NO: 3597371 - DNA, 19 bp, Homo sapiens
tggtgaaattataactatt

SEQ ID NO: 3597372 - DNA, 20 bp, Homo sapiens
tggtgaagtaaattaggcag

SEQ ID NO: 3597373 - DNA, 17 bp, Homo sapiens
tggtgacaaaattcatt

SEQ ID NO: 3597374 - DNA, 17 bp, Homo sapiens
tggtgacacctccccct

SEQ ID NO: 3597375 - DNA, 16 bp, Homo sapiens
tggtgagagtcaaagc

SEQ ID NO: 3597376 - DNA, 18 bp, Homo sapiens
tggtgagagtcaaagctg

SEQ ID NO: 3597377 - DNA, 19 bp, Homo sapiens
tggtgagagtcaaagctga

SEQ ID NO: 3597378 - DNA, 21 bp, Homo sapiens
tggtgaggctgacatgctcac

SEQ ID NO: 3597379 - DNA, 23 bp, Homo sapiens
tggtgaggctgacatgctcacac

SEQ ID NO: 3597380 - DNA, 15 bp, Homo sapiens
tggtgaggggctttc

SEQ ID NO: 3597381 - DNA, 18 bp, Homo sapiens
tggtgaggggctttctct

SEQ ID NO: 3597382 - DNA, 18 bp, Homo sapiens
tgtatattctattttaca

SEQ ID NO: 3597383 - DNA, 21 bp, Homo sapiens
tgtatatttttaaagaatgtt

SEQ ID NO: 3597384 - DNA, 22 bp, Homo sapiens
tgtatatttttatattgttttt

SEQ ID NO: 3597385 - DNA, 20 bp, Homo sapiens
tgtatcaaactgtataactt

SEQ ID NO: 3597386 - DNA, 23 bp, Homo sapiens
tgtatcaaatacatttaaaacat

SEQ ID NO: 3597387 - DNA, 18 bp, Homo sapiens
tgtatcagtgtcctttcc

SEQ ID NO: 3597388 - DNA, 19 bp, Homo sapiens
tgtatcagtgtcctttcca

SEQ ID NO: 3597389 - DNA, 13 bp, Homo sapiens
tgtatccagagct

SEQ ID NO: 3597390 - DNA, 22 bp, Homo sapiens
tgtatccatccatggggctgat

SEQ ID NO: 3597391 - DNA, 22 bp, Homo sapiens
tgtatccattctacctgtcctc

SEQ ID NO: 3597392 - DNA, 12 bp, Homo sapiens
tgtatcctggcc

SEQ ID NO: 3597393 - DNA, 16 bp, Homo sapiens
tgtatcctggccctgg

SEQ ID NO: 3597394 - DNA, 22 bp, Homo sapiens
tgtatgaaagatggctgtgcct

SEQ ID NO: 3597395 - DNA, 14 bp, Homo sapiens
tgtatggaaacact

SEQ ID NO: 3597396 - DNA, 18 bp, Homo sapiens
tgtatggaaataaatgta

SEQ ID NO: 3597397 - DNA, 23 bp, Homo sapiens
tgtatggaaataaatgtatcata

SEQ ID NO: 3597398 - DNA, 22 bp, Homo sapiens
tgtatggtccatagcactgtat

SEQ ID NO: 3597399 - DNA, 17 bp, Homo sapiens
tgtatgtcttaaaacct

SEQ ID NO: 3597400 - DNA, 17 bp, Homo sapiens
tgtatgtgtgtctattt

SEQ ID NO: 3597401 - DNA, 18 bp, Homo sapiens
tgtatgtgtgtctatttt

SEQ ID NO: 3597402 - DNA, 20 bp, Homo sapiens
tgtatgtgtttatgtaactt

SEQ ID NO: 3597403 - DNA, 15 bp, Homo sapiens
tgtattaaatggttt

SEQ ID NO: 3597404 - DNA, 14 bp, Homo sapiens
tgtattcaagcaaa

SEQ ID NO: 3597405 - DNA, 18 bp, Homo sapiens
tgtattccaagcatataa

SEQ ID NO: 3597406 - DNA, 17 bp, Homo sapiens
tgtattcccagttactt

SEQ ID NO: 3597407 - DNA, 13 bp, Homo sapiens
tgtattcctatga

SEQ ID NO: 3597408 - DNA, 18 bp, Homo sapiens
tgtattgatttttaagaa

SEQ ID NO: 3597409 - DNA, 14 bp, Homo sapiens
tgtattgcacattg

SEQ ID NO: 3597410 - DNA, 15 bp, Homo sapiens
tgtattgcacattgt

SEQ ID NO: 3597411 - DNA, 23 bp, Homo sapiens
tgtatttaaaaaaaagaaacttt

SEQ ID NO: 3597412 - DNA, 15 bp, Homo sapiens
tgtatttaagacata

SEQ ID NO: 3597413 - DNA, 21 bp, Homo sapiens
tgtatttggaaataaagtcag

SEQ ID NO: 3597414 - DNA, 16 bp, Homo sapiens
tgtcaacacaaactgg

SEQ ID NO: 3597415 - DNA, 19 bp, Homo sapiens
tgtcaacagatttaaagaa

SEQ ID NO: 3597416 - DNA, 21 bp, Homo sapiens
tgtcaagaatagcattgtaaa

SEQ ID NO: 3597417 - DNA, 20 bp, Homo sapiens
tgtcaagccatttttacatc

SEQ ID NO: 3597418 - DNA, 19 bp, Homo sapiens
tgtcaaggaagacttttgg

SEQ ID NO: 3597419 - DNA, 23 bp, Homo sapiens
tgtcaaggaagacttttggtaga

SEQ ID NO: 3597420 - DNA, 12 bp, Homo sapiens
tgtcaataaatt

SEQ ID NO: 3597421 - DNA, 19 bp, Homo sapiens
tgtcacaattatgtgcaaa

SEQ ID NO: 3597422 - DNA, 22 bp, Homo sapiens
tgtcacatctcagggaactgac

SEQ ID NO: 3597423 - DNA, 16 bp, Homo sapiens
tgtcaccgcaggtgct

SEQ ID NO: 3597424 - DNA, 18 bp, Homo sapiens
tgtcacttgtcgggggcc

SEQ ID NO: 3597425 - DNA, 20 bp, Homo sapiens
tgtcacttgtcgggggccca

SEQ ID NO: 3597426 - DNA, 23 bp, Homo sapiens
tgtcacttttttataaaagttta

SEQ ID NO: 3597427 - DNA, 23 bp, Homo sapiens
tgtcagctcccctcggagaagag

SEQ ID NO: 3597428 - DNA, 22 bp, Homo sapiens
tgtcagggccaggtgcagacct

SEQ ID NO: 3597429 - DNA, 15 bp, Homo sapiens
tgtcagggtccagga

SEQ ID NO: 3597430 - DNA, 20 bp, Homo sapiens
tgtcagtatgtggaagtgtg

SEQ ID NO: 3597431 - DNA, 16 bp, Homo sapiens
tgtcagtggggcagcc

SEQ ID NO: 3597432 - DNA, 17 bp, Homo sapiens
tgtcagtgtgtcagttt

SEQ ID NO: 3597433 - DNA, 20 bp, Homo sapiens
tgtcagtgttaaagattttg

SEQ ID NO: 3597434 - DNA, 22 bp, Homo sapiens
tgtcagtgttaaagattttgtt

SEQ ID NO: 3597435 - DNA, 20 bp, Homo sapiens
tgtcagttgttatttattga

SEQ ID NO: 3597436 - DNA, 16 bp, Homo sapiens
tgtcagtttttcctcc

SEQ ID NO: 3597437 - DNA, 16 bp, Homo sapiens
tgtcatcctcaaagaa

SEQ ID NO: 3597438 - DNA, 22 bp, Homo sapiens
tgtcatcctcaaagaaagtgta

SEQ ID NO: 3597439 - DNA, 20 bp, Homo sapiens
tgtcatgaagtgcacaggag

SEQ ID NO: 3597440 - DNA, 21 bp, Homo sapiens
tgtcatgaagtgcacaggagc

SEQ ID NO: 3597441 - DNA, 23 bp, Homo sapiens
tgtcatggatcgtgttggtattt

SEQ ID NO: 3597442 - DNA, 12 bp, Homo sapiens
tgtcatggtgaa

SEQ ID NO: 3597443 - DNA, 16 bp, Homo sapiens
tgtcatggtgaaatta

SEQ ID NO: 3597444 - DNA, 21 bp, Homo sapiens
tgtcatggtgaaattataact

SEQ ID NO: 3597445 - DNA, 23 bp, Homo sapiens
tgtcattaaatggggctcacaaa

SEQ ID NO: 3597446 - DNA, 15 bp, Homo sapiens
tgtcattcagttcta

SEQ ID NO: 3597447 - DNA, 23 bp, Homo sapiens
tgtcattcgctactatgatttaa

SEQ ID NO: 3597448 - DNA, 13 bp, Homo sapiens
tgtcatttgttaa

SEQ ID NO: 3597449 - DNA, 14 bp, Homo sapiens
tgtccaaacccact

SEQ ID NO: 3597450 - DNA, 17 bp, Homo sapiens
tgtccacactaccagtt

SEQ ID NO: 3597451 - DNA, 15 bp, Homo sapiens
tgtccagcagtctga

SEQ ID NO: 3597452 - DNA, 12 bp, Homo sapiens
tgtccagctcca

SEQ ID NO: 3597453 - DNA, 20 bp, Homo sapiens
tgtccagctccaacctgcaa

SEQ ID NO: 3597454 - DNA, 16 bp, Homo sapiens
tgtccaggagccccgc

SEQ ID NO: 3597455 - DNA, 21 bp, Homo sapiens
tgtccaggcactgctgcccag

SEQ ID NO: 3597456 - DNA, 18 bp, Homo sapiens
tgtccaggctggagtgca

SEQ ID NO: 3597457 - DNA, 14 bp, Homo sapiens
tgtccccaccatct

SEQ ID NO: 3597458 - DNA, 16 bp, Homo sapiens
tgtccccaccatctgc

SEQ ID NO: 3597459 - DNA, 21 bp, Homo sapiens
tgtccctaccgagtctcttct

SEQ ID NO: 3597460 - DNA, 16 bp, Homo sapiens
tgtccctctagtgcct

SEQ ID NO: 3597461 - DNA, 14 bp, Homo sapiens
tgtccctctgcccc

SEQ ID NO: 3597462 - DNA, 14 bp, Homo sapiens
tgtccctgcagggc

SEQ ID NO: 3597463 - DNA, 21 bp, Homo sapiens
tgtccctgcagggccatctga

SEQ ID NO: 3597464 - DNA, 16 bp, Homo sapiens
tgtccctggacacagc

SEQ ID NO: 3597465 - DNA, 19 bp, Homo sapiens
tgtccctggacacagctct

SEQ ID NO: 3597466 - DNA, 22 bp, Homo sapiens
tgtccctggacacagctcttca

SEQ ID NO: 3597467 - DNA, 22 bp, Homo sapiens
tgtccctgtccttccctgttct

SEQ ID NO: 3597468 - DNA, 15 bp, Homo sapiens
tgtcccttgcctctg

SEQ ID NO: 3597469 - DNA, 16 bp, Homo sapiens
tgtcccttttccctta

SEQ ID NO: 3597470 - DNA, 22 bp, Homo sapiens
tgtcctacagtgactccctggg

SEQ ID NO: 3597471 - DNA, 12 bp, Homo sapiens
tgtcctcagcct

SEQ ID NO: 3597472 - DNA, 13 bp, Homo sapiens
tgtcctcttctgc

SEQ ID NO: 3597473 - DNA, 18 bp, Homo sapiens
tgtcctcttctgctcttt

SEQ ID NO: 3597474 - DNA, 14 bp, Homo sapiens
tgtcctgagcacca

SEQ ID NO: 3597475 - DNA, 14 bp, Homo sapiens
tgtcctgggcctgc

SEQ ID NO: 3597476 - DNA, 17 bp, Homo sapiens
tgtcctgggctggtggc

SEQ ID NO: 3597477 - DNA, 14 bp, Homo sapiens
tgtcctgtcctgct

SEQ ID NO: 3597478 - DNA, 18 bp, Homo sapiens
tgtccttaacccacctct

SEQ ID NO: 3597479 - DNA, 22 bp, Homo sapiens
tgtccttgtcacgatcacaggc

SEQ ID NO: 3597480 - DNA, 21 bp, Homo sapiens
tgtcgtcttgaacgagcagcc

SEQ ID NO: 3597481 - DNA, 13 bp, Homo sapiens
tgtctaggcactg

SEQ ID NO: 3597482 - DNA, 18 bp, Homo sapiens
tgtctaggcactgagcag

SEQ ID NO: 3597483 - DNA, 23 bp, Homo sapiens
tgtctaggcactgagcagggatc

SEQ ID NO: 3597484 - DNA, 19 bp, Homo sapiens
tgtctcaacgcctccccct

SEQ ID NO: 3597485 - DNA, 20 bp, Homo sapiens
tgtctcaagagggcactggt

SEQ ID NO: 3597486 - DNA, 13 bp, Homo sapiens
tgtctcagcctct

SEQ ID NO: 3597487 - DNA, 17 bp, Homo sapiens
tgtctcaggtccctgca

SEQ ID NO: 3597488 - DNA, 15 bp, Homo sapiens
tgtctccagctgcct

SEQ ID NO: 3597489 - DNA, 16 bp, Homo sapiens
tgtctccagctgcctg

SEQ ID NO: 3597490 - DNA, 18 bp, Homo sapiens
tgtctccagctgcctggg

SEQ ID NO: 3597491 - DNA, 18 bp, Homo sapiens
tgtctccagggcccccac

SEQ ID NO: 3597492 - DNA, 18 bp, Homo sapiens
tgtctctccagtgaaatg

SEQ ID NO: 3597493 - DNA, 17 bp, Homo sapiens
tgtctgaaaagggactg

SEQ ID NO: 3597494 - DNA, 16 bp, Homo sapiens
tgtctgaagtcactgc

SEQ ID NO: 3597495 - DNA, 17 bp, Homo sapiens
tgtctgaagtcactgca

SEQ ID NO: 3597496 - DNA, 18 bp, Homo sapiens
tgtctgaagtcactgcac

SEQ ID NO: 3597497 - DNA, 22 bp, Homo sapiens
tgtctgcactgaggatttcttt

SEQ ID NO: 3597498 - DNA, 11 bp, Homo sapiens
tgtctgcagct

SEQ ID NO: 3597499 - DNA, 12 bp, Homo sapiens
tgtctgcagctc

SEQ ID NO: 3597500 - DNA, 14 bp, Homo sapiens
tgtctgcagctcaa

SEQ ID NO: 3597501 - DNA, 19 bp, Homo sapiens
tgtctgctgagttggcctg

SEQ ID NO: 3597502 - DNA, 10 bp, Homo sapiens
tgtctgctgc

SEQ ID NO: 3597503 - DNA, 17 bp, Homo sapiens
tgtctggtgtttgtcat

SEQ ID NO: 3597504 - DNA, 20 bp, Homo sapiens
tgtctggtgtttgtcatggt

SEQ ID NO: 3597505 - DNA, 14 bp, Homo sapiens
tgtctgtctctaat

SEQ ID NO: 3597506 - DNA, 21 bp, Homo sapiens
tgtcttaaaacctgcttttca

SEQ ID NO: 3597507 - DNA, 13 bp, Homo sapiens
tgtctttcttgta

SEQ ID NO: 3597508 - DNA, 16 bp, Homo sapiens
tgtctttcttgtaagg

SEQ ID NO: 3597509 - DNA, 15 bp, Homo sapiens
tgtctttctttgtca

SEQ ID NO: 3597510 - DNA, 20 bp, Homo sapiens
tgtctttctttgtcattcag

SEQ ID NO: 3597511 - DNA, 22 bp, Homo sapiens
tgtctttctttgtcattcagtt

SEQ ID NO: 3597512 - DNA, 15 bp, Homo sapiens
tgtcttttaaactgg

SEQ ID NO: 3597513 - DNA, 16 bp, Homo sapiens
tgtgaagttcatcttg

SEQ ID NO: 3597514 - DNA, 13 bp, Homo sapiens
tgtgaatattcct

SEQ ID NO: 3597515 - DNA, 23 bp, Homo sapiens
tgtgaatattcctttattttgct

SEQ ID NO: 3597516 - DNA, 19 bp, Homo sapiens
tgtgaattaggctgtaact

SEQ ID NO: 3597517 - DNA, 17 bp, Homo sapiens
tgtgaatttgccagagg

SEQ ID NO: 3597518 - DNA, 21 bp, Homo sapiens
tgtgaatttgccagaggacca

SEQ ID NO: 3597519 - DNA, 15 bp, Homo sapiens
tgtgacattttacat

SEQ ID NO: 3597520 - DNA, 16 bp, Homo sapiens
tgtgaccagaaagctt

SEQ ID NO: 3597521 - DNA, 22 bp, Homo sapiens
tgtgaccagaaagcttcatcca

SEQ ID NO: 3597522 - DNA, 13 bp, Homo sapiens
tgtgaccctgggc

SEQ ID NO: 3597523 - DNA, 14 bp, Homo sapiens
tgtgaccctgggca

SEQ ID NO: 3597524 - DNA, 15 bp, Homo sapiens
tgtgaccctgggcag

SEQ ID NO: 3597525 - DNA, 19 bp, Homo sapiens
tgtgactcagcatcaccca

SEQ ID NO: 3597526 - DNA, 21 bp, Homo sapiens
tgtgactcctgttgccatgga

SEQ ID NO: 3597527 - DNA, 15 bp, Homo sapiens
tgtgactccttatct

SEQ ID NO: 3597528 - DNA, 21 bp, Homo sapiens
tgtgactccttatctctttcc

SEQ ID NO: 3597529 - DNA, 13 bp, Homo sapiens
tgtgactcttact

SEQ ID NO: 3597530 - DNA, 21 bp, Homo sapiens
tgtgagaatggcctggagcag

SEQ ID NO: 3597531 - DNA, 14 bp, Homo sapiens
tgtgagctcttccc

SEQ ID NO: 3597532 - DNA, 15 bp, Homo sapiens
tgtgagctcttccct

SEQ ID NO: 3597533 - DNA, 18 bp, Homo sapiens
tgtgaggagagaggagga

SEQ ID NO: 3597534 - DNA, 21 bp, Homo sapiens
tgtgagtttaccttgtatact

SEQ ID NO: 3597535 - DNA, 15 bp, Homo sapiens
tgtgatatataagtg

SEQ ID NO: 3597536 - DNA, 16 bp, Homo sapiens
tgtgattgacagcttt

SEQ ID NO: 3597537 - DNA, 15 bp, Homo sapiens
tgtgatttctttctt

SEQ ID NO: 3597538 - DNA, 18 bp, Homo sapiens
tgtgatttttgtttgcag

SEQ ID NO: 3597539 - DNA, 14 bp, Homo sapiens
tgtgcaaaatcact

SEQ ID NO: 3597540 - DNA, 15 bp, Homo sapiens
tgtgcacatctgttt

SEQ ID NO: 3597541 - DNA, 17 bp, Homo sapiens
tgtgcagcatttcactt

SEQ ID NO: 3597542 - DNA, 17 bp, Homo sapiens
tgtgcatgtgctgtgtg

SEQ ID NO: 3597543 - DNA, 17 bp, Homo sapiens
tgtgccaacctgttctt

SEQ ID NO: 3597544 - DNA, 21 bp, Homo sapiens
tgtgccaactgccaggctgcc

SEQ ID NO: 3597545 - DNA, 15 bp, Homo sapiens
tgtgcctaatgtgtt

SEQ ID NO: 3597546 - DNA, 18 bp, Homo sapiens
tgtgcctaatgtgtttga

SEQ ID NO: 3597547 - DNA, 15 bp, Homo sapiens
tgtgcctctgggact

SEQ ID NO: 3597548 - DNA, 16 bp, Homo sapiens
tgtgcctctgggactg

SEQ ID NO: 3597549 - DNA, 13 bp, Homo sapiens
tgtgccttccctt

SEQ ID NO: 3597550 - DNA, 12 bp, Homo sapiens
tgtgcctttcct

SEQ ID NO: 3597551 - DNA, 15 bp, Homo sapiens
tgtgcctttctttgc

SEQ ID NO: 3597552 - DNA, 19 bp, Homo sapiens
tgtgcctttctttgcctct

SEQ ID NO: 3597553 - DNA, 10 bp, Homo sapiens
tgtgcctttg

SEQ ID NO: 3597554 - DNA, 14 bp, Homo sapiens
tgtgctgtttgaaa

SEQ ID NO: 3597555 - DNA, 15 bp, Homo sapiens
tgtgctttttgtcat

SEQ ID NO: 3597556 - DNA, 23 bp, Homo sapiens
tgtgctttttgtcatgttatgca

SEQ ID NO: 3597557 - DNA, 21 bp, Homo sapiens
tgtggaaggaaaatatttcat

SEQ ID NO: 3597558 - DNA, 22 bp, Homo sapiens
tgtggcaaaaagagtcagacat

SEQ ID NO: 3597559 - DNA, 20 bp, Homo sapiens
tgtggcagcctgattcgggg

SEQ ID NO: 3597560 - DNA, 14 bp, Homo sapiens
tgtggccaaggagc

SEQ ID NO: 3597561 - DNA, 14 bp, Homo sapiens
tgtggccaggcctt

SEQ ID NO: 3597562 - DNA, 13 bp, Homo sapiens
tgtggcctatgaa

SEQ ID NO: 3597563 - DNA, 22 bp, Homo sapiens
tgtggcctatgaaactggttta

SEQ ID NO: 3597564 - DNA, 14 bp, Homo sapiens
tgtggcctgcagga

SEQ ID NO: 3597565 - DNA, 19 bp, Homo sapiens
tgtggcctttatgttcttt

SEQ ID NO: 3597566 - DNA, 10 bp, Homo sapiens
tgtggctcac

SEQ ID NO: 3597567 - DNA, 13 bp, Homo sapiens
tgtggctcctggg

SEQ ID NO: 3597568 - DNA, 22 bp, Homo sapiens
tgtggctcctgggccggctgag

SEQ ID NO: 3597569 - DNA, 14 bp, Homo sapiens
tgtgggtctgtgtg

SEQ ID NO: 3597570 - DNA, 13 bp, Homo sapiens
tgtgggtggggcc

SEQ ID NO: 3597571 - DNA, 18 bp, Homo sapiens
tgtggtagggggtgtctc

SEQ ID NO: 3597572 - DNA, 17 bp, Homo sapiens
tgtggtcaacatttctc

SEQ ID NO: 3597573 - DNA, 20 bp, Homo sapiens
tgtggtctctgccccagcct

SEQ ID NO: 3597574 - DNA, 13 bp, Homo sapiens
tgtggtgcagtgt

SEQ ID NO: 3597575 - DNA, 21 bp, Homo sapiens
tgtggtgtttcctgcaggcca

SEQ ID NO: 3597576 - DNA, 23 bp, Homo sapiens
tgtgtaatttaaaattgtgatgt

SEQ ID NO: 3597577 - DNA, 15 bp, Homo sapiens
tgtgtacaatgtgag

SEQ ID NO: 3597578 - DNA, 21 bp, Homo sapiens
tgtgtaccacttcctgaggcc

SEQ ID NO: 3597579 - DNA, 17 bp, Homo sapiens
tgtgtacttttcctttg

SEQ ID NO: 3597580 - DNA, 21 bp, Homo sapiens
tgtgtagagcccctactgtgg

SEQ ID NO: 3597581 - DNA, 15 bp, Homo sapiens
tgtgtatataaacta

SEQ ID NO: 3597582 - DNA, 14 bp, Homo sapiens
tgtgtatatgtatt

SEQ ID NO: 3597583 - DNA, 12 bp, Homo sapiens
tgtgtatgtggg

SEQ ID NO: 3597584 - DNA, 21 bp, Homo sapiens
tgtgtatttaaaaaaaagaaa

SEQ ID NO: 3597585 - DNA, 13 bp, Homo sapiens
tgtgtcatttcaa

SEQ ID NO: 3597586 - DNA, 16 bp, Homo sapiens
tgtgtccaaaactgcc

SEQ ID NO: 3597587 - DNA, 18 bp, Homo sapiens
tgtgtccctggacacagc

SEQ ID NO: 3597588 - DNA, 19 bp, Homo sapiens
tgtgtccctggacacagct

SEQ ID NO: 3597589 - DNA, 17 bp, Homo sapiens
tgtgtcctaaggcccat

SEQ ID NO: 3597590 - DNA, 16 bp, Homo sapiens
tgtgtcctccaccatg

SEQ ID NO: 3597591 - DNA, 13 bp, Homo sapiens
tgtgtctattttg

SEQ ID NO: 3597592 - DNA, 18 bp, Homo sapiens
tgtgtgattgacagcttt

SEQ ID NO: 3597593 - DNA, 20 bp, Homo sapiens
tgtgtgcctggccgcagggc

SEQ ID NO: 3597594 - DNA, 12 bp, Homo sapiens
tgtgtggaattt

SEQ ID NO: 3597595 - DNA, 12 bp, Homo sapiens
tgtgtggctcct

SEQ ID NO: 3597596 - DNA, 14 bp, Homo sapiens
tgtgtgggagtgtg

SEQ ID NO: 3597597 - DNA, 15 bp, Homo sapiens
tgtgtgggagtgtgt

SEQ ID NO: 3597598 - DNA, 16 bp, Homo sapiens
tgtgtgggagtgtgta

SEQ ID NO: 3597599 - DNA, 19 bp, Homo sapiens
tgtgtggtctctgccccag

SEQ ID NO: 3597600 - DNA, 20 bp, Homo sapiens
tgtgtggtgaggggctttct

SEQ ID NO: 3597601 - DNA, 18 bp, Homo sapiens
tgtgtgttgtgtgtggga

SEQ ID NO: 3597602 - DNA, 15 bp, Homo sapiens
tgtgttcatttcatt

SEQ ID NO: 3597603 - DNA, 14 bp, Homo sapiens
tgtgttctgctcca

SEQ ID NO: 3597604 - DNA, 16 bp, Homo sapiens
tgtgtttatgtaactt

SEQ ID NO: 3597605 - DNA, 13 bp, Homo sapiens
tgtgtttatgtgt

SEQ ID NO: 3597606 - DNA, 15 bp, Homo sapiens
tgtgtttccttttca

SEQ ID NO: 3597607 - DNA, 20 bp, Homo sapiens
tgtgtttccttttcaggaga

SEQ ID NO: 3597608 - DNA, 17 bp, Homo sapiens
tgtgtttggttcaattt

SEQ ID NO: 3597609 - DNA, 17 bp, Homo sapiens
tgtgttttcatcatttc

SEQ ID NO: 3597610 - DNA, 20 bp, Homo sapiens
tgtgtttttaataaagacag

SEQ ID NO: 3597611 - DNA, 20 bp, Homo sapiens
tgtgtttttgggaagaagaa

SEQ ID NO: 3597612 - DNA, 21 bp, Homo sapiens
tgttaacatggacatgatctt

SEQ ID NO: 3597613 - DNA, 23 bp, Homo sapiens
tgttaagcagctaaattttctga

SEQ ID NO: 3597614 - DNA, 16 bp, Homo sapiens
tgttaataatctcaca

SEQ ID NO: 3597615 - DNA, 22 bp, Homo sapiens
tgttaatatgcagccatatatg

SEQ ID NO: 3597616 - DNA, 13 bp, Homo sapiens
tgttaatgctttt

SEQ ID NO: 3597617 - DNA, 13 bp, Homo sapiens
tgttaattttgct

SEQ ID NO: 3597618 - DNA, 15 bp, Homo sapiens
tgttacatgtatcaa

SEQ ID NO: 3597619 - DNA, 23 bp, Homo sapiens
tgttaccaaaaataaatatatct

SEQ ID NO: 3597620 - DNA, 18 bp, Homo sapiens
tgttagaaaatgacttat

SEQ ID NO: 3597621 - DNA, 20 bp, Homo sapiens
tgttagaaaatgacttattt

SEQ ID NO: 3597622 - DNA, 22 bp, Homo sapiens
tgttagaaaatgacttatttct

SEQ ID NO: 3597623 - DNA, 13 bp, Homo sapiens
tgttagcaaagat

SEQ ID NO: 3597624 - DNA, 15 bp, Homo sapiens
tgttagcttccttaa

SEQ ID NO: 3597625 - DNA, 18 bp, Homo sapiens
tgttagtattttaatcct

SEQ ID NO: 3597626 - DNA, 14 bp, Homo sapiens
tgttataaataaaa

SEQ ID NO: 3597627 - DNA, 15 bp, Homo sapiens
tgttataaataaaat

SEQ ID NO: 3597628 - DNA, 14 bp, Homo sapiens
tgttatacttcaaa

SEQ ID NO: 3597629 - DNA, 22 bp, Homo sapiens
tgttatatcctgacaagattat

SEQ ID NO: 3597630 - DNA, 17 bp, Homo sapiens
tgttatcaaactgctgt

SEQ ID NO: 3597631 - DNA, 16 bp, Homo sapiens
tgttatcatcctccct

SEQ ID NO: 3597632 - DNA, 18 bp, Homo sapiens
tgttatcccaatcattgt

SEQ ID NO: 3597633 - DNA, 18 bp, Homo sapiens
tgttatgactatgtaaac

SEQ ID NO: 3597634 - DNA, 12 bp, Homo sapiens
tgttatgctgtt

SEQ ID NO: 3597635 - DNA, 17 bp, Homo sapiens
aaactggatatttcaat

SEQ ID NO: 3597636 - DNA, 13 bp, Homo sapiens
aaactggctttgg

SEQ ID NO: 3597637 - DNA, 20 bp, Homo sapiens
aaactgggatgtaagtttgt

SEQ ID NO: 3597638 - DNA, 19 bp, Homo sapiens
aaactgggattaagaaacc

SEQ ID NO: 3597639 - DNA, 15 bp, Homo sapiens
aaactgtatgctcac

SEQ ID NO: 3597640 - DNA, 22 bp, Homo sapiens
aaactgttatttttacagcaaa

SEQ ID NO: 3597641 - DNA, 16 bp, Homo sapiens
aaacttaatttaatat

SEQ ID NO: 3597642 - DNA, 13 bp, Homo sapiens
aaacttcaaagct

SEQ ID NO: 3597643 - DNA, 17 bp, Homo sapiens
aaacttcaaagctgaat

SEQ ID NO: 3597644 - DNA, 18 bp, Homo sapiens
aaacttcaaagctgaata

SEQ ID NO: 3597645 - DNA, 17 bp, Homo sapiens
aaacttcattctcgtga

SEQ ID NO: 3597646 - DNA, 14 bp, Homo sapiens
aaacttctgctcgt

SEQ ID NO: 3597647 - DNA, 17 bp, Homo sapiens
aaactttctcataagca

SEQ ID NO: 3597648 - DNA, 12 bp, Homo sapiens
aaactttgtagt

SEQ ID NO: 3597649 - DNA, 12 bp, Homo sapiens
aaacttttttat

SEQ ID NO: 3597650 - DNA, 15 bp, Homo sapiens
aaactttttttctgt

SEQ ID NO: 3597651 - DNA, 16 bp, Homo sapiens
aaagaaaacccacccc

SEQ ID NO: 3597652 - DNA, 16 bp, Homo sapiens
aaagaaacaagctgtg

SEQ ID NO: 3597653 - DNA, 17 bp, Homo sapiens
aaagaaacaagctgtgc

SEQ ID NO: 3597654 - DNA, 18 bp, Homo sapiens
aaagaaacaagctgtgca

SEQ ID NO: 3597655 - DNA, 20 bp, Homo sapiens
aaagaaacaagctgtgcagg

SEQ ID NO: 3597656 - DNA, 16 bp, Homo sapiens
aaagaaacaccagtgt

SEQ ID NO: 3597657 - DNA, 18 bp, Homo sapiens
aaagaaacaccagtgtta

SEQ ID NO: 3597658 - DNA, 12 bp, Homo sapiens
aaagaaactttt

SEQ ID NO: 3597659 - DNA, 10 bp, Homo sapiens
aaagaaagaa

SEQ ID NO: 3597660 - DNA, 15 bp, Homo sapiens
aaagaaagaggaaaa

SEQ ID NO: 3597661 - DNA, 16 bp, Homo sapiens
aaagaaagaggaaaag

SEQ ID NO: 3597662 - DNA, 12 bp, Homo sapiens
aaagaaagtgta

SEQ ID NO: 3597663 - DNA, 21 bp, Homo sapiens
aaagaaccatgcaggaaggaa

SEQ ID NO: 3597664 - DNA, 20 bp, Homo sapiens
aaagaacttgctgctgcctt

SEQ ID NO: 3597665 - DNA, 13 bp, Homo sapiens
aaagaagcaagac

SEQ ID NO: 3597666 - DNA, 15 bp, Homo sapiens
aaagaaggacccaga

SEQ ID NO: 3597667 - DNA, 14 bp, Homo sapiens
aaagaataaaaact

SEQ ID NO: 3597668 - DNA, 15 bp, Homo sapiens
aaagaataaaaactt

SEQ ID NO: 3597669 - DNA, 13 bp, Homo sapiens
aaagacacctact

SEQ ID NO: 3597670 - DNA, 19 bp, Homo sapiens
aaagacacctactgagtgg

SEQ ID NO: 3597671 - DNA, 16 bp, Homo sapiens
aaagacagcagacaaa

SEQ ID NO: 3597672 - DNA, 17 bp, Homo sapiens
aaagacagctggcggag

SEQ ID NO: 3597673 - DNA, 12 bp, Homo sapiens
aaagacataaaa

SEQ ID NO: 3597674 - DNA, 16 bp, Homo sapiens
aaagacataaaacaga

SEQ ID NO: 3597675 - DNA, 14 bp, Homo sapiens
aaagacattagaga

SEQ ID NO: 3597676 - DNA, 21 bp, Homo sapiens
aaagacattagagaaaacctt

SEQ ID NO: 3597677 - DNA, 14 bp, Homo sapiens
aaagactattcaaa

SEQ ID NO: 3597678 - DNA, 17 bp, Homo sapiens
aaagactcaagagaatt

SEQ ID NO: 3597679 - DNA, 14 bp, Homo sapiens
aaagactccaaaga

SEQ ID NO: 3597680 - DNA, 15 bp, Homo sapiens
aaagactccaaagaa

SEQ ID NO: 3597681 - DNA, 15 bp, Homo sapiens
aaagagacaaagctt

SEQ ID NO: 3597682 - DNA, 13 bp, Homo sapiens
aaagagagaagcc

SEQ ID NO: 3597683 - DNA, 16 bp, Homo sapiens
aaagagagaagccagc

SEQ ID NO: 3597684 - DNA, 20 bp, Homo sapiens
aaagagagaagccagccaca

SEQ ID NO: 3597685 - DNA, 14 bp, Homo sapiens
aaagagcatcctga

SEQ ID NO: 3597686 - DNA, 15 bp, Homo sapiens
aaagagcatcctgat

SEQ ID NO: 3597687 - DNA, 15 bp, Homo sapiens
aaagaggtgaaaatg

SEQ ID NO: 3597688 - DNA, 16 bp, Homo sapiens
aaagaggtgaaaatga

SEQ ID NO: 3597689 - DNA, 21 bp, Homo sapiens
aaagaggtgaaaatgaagaag

SEQ ID NO: 3597690 - DNA, 13 bp, Homo sapiens
aaagagtcagaca

SEQ ID NO: 3597691 - DNA, 21 bp, Homo sapiens
aaagagtccattgtttaaaaa

SEQ ID NO: 3597692 - DNA, 20 bp, Homo sapiens
aaagataatttatttcaata

SEQ ID NO: 3597693 - DNA, 20 bp, Homo sapiens
aaagatacaaaatgttactg

SEQ ID NO: 3597694 - DNA, 18 bp, Homo sapiens
aaagatctgtcctcagcc

SEQ ID NO: 3597695 - DNA, 21 bp, Homo sapiens
aaagatctgtcctcagccttg

SEQ ID NO: 3597696 - DNA, 16 bp, Homo sapiens
aaagatgaaaaagaat

SEQ ID NO: 3597697 - DNA, 19 bp, Homo sapiens
aaagatgcagtcctcagga

SEQ ID NO: 3597698 - DNA, 22 bp, Homo sapiens
aaagattctgaccttaaatgca

SEQ ID NO: 3597699 - DNA, 12 bp, Homo sapiens
aaagattcttct

SEQ ID NO: 3597700 - DNA, 13 bp, Homo sapiens
aaagcaaagaaaa

SEQ ID NO: 3597701 - DNA, 22 bp, Homo sapiens
aaagcaaaggtgcactccagac

SEQ ID NO: 3597702 - DNA, 17 bp, Homo sapiens
aaagcaaatcagaaaac

SEQ ID NO: 3597703 - DNA, 15 bp, Homo sapiens
aaagcaagaaacagt

SEQ ID NO: 3597704 - DNA, 13 bp, Homo sapiens
aaagcaaggcaca

SEQ ID NO: 3597705 - DNA, 14 bp, Homo sapiens
aaagcacttaagtg

SEQ ID NO: 3597706 - DNA, 20 bp, Homo sapiens
aaagcatgtggtcttatagt

SEQ ID NO: 3597707 - DNA, 19 bp, Homo sapiens
aaagcattgtaaatgtgct

SEQ ID NO: 3597708 - DNA, 15 bp, Homo sapiens
aaagcattttgtaat

SEQ ID NO: 3597709 - DNA, 21 bp, Homo sapiens
aaagcattttgtaataataaa

SEQ ID NO: 3597710 - DNA, 14 bp, Homo sapiens
aaagccacatcttg

SEQ ID NO: 3597711 - DNA, 16 bp, Homo sapiens
aaagccaggctcagga

SEQ ID NO: 3597712 - DNA, 17 bp, Homo sapiens
aaagccaggctcaggag

SEQ ID NO: 3597713 - DNA, 21 bp, Homo sapiens
aaagccaggctcaggagaagc

SEQ ID NO: 3597714 - DNA, 23 bp, Homo sapiens
aaagccaggctcaggagaagcca

SEQ ID NO: 3597715 - DNA, 12 bp, Homo sapiens
aaagccccagct

SEQ ID NO: 3597716 - DNA, 18 bp, Homo sapiens
aaagccccagcttggctc

SEQ ID NO: 3597717 - DNA, 17 bp, Homo sapiens
aaagccgaaagggttaa

SEQ ID NO: 3597718 - DNA, 22 bp, Homo sapiens
aaagcctcctgccccctgccag

SEQ ID NO: 3597719 - DNA, 19 bp, Homo sapiens
aaagcggacatcagctggt

SEQ ID NO: 3597720 - DNA, 15 bp, Homo sapiens
aaagcgggcagcccc

SEQ ID NO: 3597721 - DNA, 16 bp, Homo sapiens
aaagcgggcagccccg

SEQ ID NO: 3597722 - DNA, 21 bp, Homo sapiens
aaagctctgttccatgcaact

SEQ ID NO: 3597723 - DNA, 14 bp, Homo sapiens
aaagctgaatattt

SEQ ID NO: 3597724 - DNA, 17 bp, Homo sapiens
aaagctgagagaccctg

SEQ ID NO: 3597725 - DNA, 21 bp, Homo sapiens
aaagctgagagaccctggcct

SEQ ID NO: 3597726 - DNA, 17 bp, Homo sapiens
aaagctttttaaaattt

SEQ ID NO: 3597727 - DNA, 14 bp, Homo sapiens
aaaggataaagaag

SEQ ID NO: 3597728 - DNA, 18 bp, Homo sapiens
aaaggatctgtgattggc

SEQ ID NO: 3597729 - DNA, 17 bp, Homo sapiens
aaaggatgtgatatata

SEQ ID NO: 3597730 - DNA, 23 bp, Homo sapiens
aaaggatgtgatatataagtgta

SEQ ID NO: 3597731 - DNA, 18 bp, Homo sapiens
aaaggattttaccaaagc

SEQ ID NO: 3597732 - DNA, 13 bp, Homo sapiens
aaaggcaaggtcc

SEQ ID NO: 3597733 - DNA, 15 bp, Homo sapiens
aaaggcaggtgcttt

SEQ ID NO: 3597734 - DNA, 13 bp, Homo sapiens
aaaggcagttttc

SEQ ID NO: 3597735 - DNA, 16 bp, Homo sapiens
aaaggcagttttctaa

SEQ ID NO: 3597736 - DNA, 19 bp, Homo sapiens
aaaggctaggtacacagct

SEQ ID NO: 3597737 - DNA, 20 bp, Homo sapiens
aaaggctccagttgggctga

SEQ ID NO: 3597738 - DNA, 11 bp, Homo sapiens
aaagggaagta

SEQ ID NO: 3597739 - DNA, 15 bp, Homo sapiens
aaagggatggacttg

SEQ ID NO: 3597740 - DNA, 14 bp, Homo sapiens
aaagggattgctga

SEQ ID NO: 3597741 - DNA, 13 bp, Homo sapiens
aaagggcagggcc

SEQ ID NO: 3597742 - DNA, 20 bp, Homo sapiens
aaagggcagggcccacgtgt

SEQ ID NO: 3597743 - DNA, 10 bp, Homo sapiens
aaaggggagt

SEQ ID NO: 3597744 - DNA, 14 bp, Homo sapiens
aaagggggattccc

SEQ ID NO: 3597745 - DNA, 14 bp, Homo sapiens
aaagggttaatcat

SEQ ID NO: 3597746 - DNA, 22 bp, Homo sapiens
aaagggttaatcatatttgaaa

SEQ ID NO: 3597747 - DNA, 13 bp, Homo sapiens
aaagggtttgata

SEQ ID NO: 3597748 - DNA, 23 bp, Homo sapiens
aaaggtacactggtatttatatt

SEQ ID NO: 3597749 - DNA, 17 bp, Homo sapiens
aaaggtgtgaggagaga

SEQ ID NO: 3597750 - DNA, 21 bp, Homo sapiens
aaagtaatgacttagaaactg

SEQ ID NO: 3597751 - DNA, 15 bp, Homo sapiens
aaagtattaaaatgc

SEQ ID NO: 3597752 - DNA, 16 bp, Homo sapiens
aaagtcaatgtacttg

SEQ ID NO: 3597753 - DNA, 22 bp, Homo sapiens
aaagtcacttactattgttgct

SEQ ID NO: 3597754 - DNA, 23 bp, Homo sapiens
aaagtctgctctcatataagaca

SEQ ID NO: 3597755 - DNA, 20 bp, Homo sapiens
aaagtgaaagtccagaaact

SEQ ID NO: 3597756 - DNA, 15 bp, Homo sapiens
aaagtgcctgggctc

SEQ ID NO: 3597757 - DNA, 12 bp, Homo sapiens
aaagtgctggga

SEQ ID NO: 3597758 - DNA, 10 bp, Homo sapiens
aaagtgtatt

SEQ ID NO: 3597759 - DNA, 15 bp, Homo sapiens
aaagtgtatttggaa

SEQ ID NO: 3597760 - DNA, 22 bp, Homo sapiens
aaagtgtatttggaaataaagt

SEQ ID NO: 3597761 - DNA, 23 bp, Homo sapiens
aaagtgtgaagacccaaaacagc

SEQ ID NO: 3597762 - DNA, 19 bp, Homo sapiens
aaagtgttattttgtataa

SEQ ID NO: 3597763 - DNA, 20 bp, Homo sapiens
aaagtgttgctgtggctcca

SEQ ID NO: 3597764 - DNA, 18 bp, Homo sapiens
aaagttaatgggatggtc

SEQ ID NO: 3597765 - DNA, 15 bp, Homo sapiens
aaagttatttatgct

SEQ ID NO: 3597766 - DNA, 18 bp, Homo sapiens
aaagttgggcccctgagg

SEQ ID NO: 3597767 - DNA, 11 bp, Homo sapiens
aaagtttcatg

SEQ ID NO: 3597768 - DNA, 19 bp, Homo sapiens
aaagtttctaatgttattt

SEQ ID NO: 3597769 - DNA, 13 bp, Homo sapiens
aactgaggcccag

SEQ ID NO: 3597770 - DNA, 13 bp, Homo sapiens
aactgattaaaaa

SEQ ID NO: 3597771 - DNA, 18 bp, Homo sapiens
aactgattaaaaatacct

SEQ ID NO: 3597772 - DNA, 17 bp, Homo sapiens
aactgcaaaaaaagcct

SEQ ID NO: 3597773 - DNA, 19 bp, Homo sapiens
aactgcaaaaaaagcctcc

SEQ ID NO: 3597774 - DNA, 14 bp, Homo sapiens
aactgcaaagaaag

SEQ ID NO: 3597775 - DNA, 14 bp, Homo sapiens
aactgcagcctctc

SEQ ID NO: 3597776 - DNA, 17 bp, Homo sapiens
aactgcagcctctctgg

SEQ ID NO: 3597777 - DNA, 15 bp, Homo sapiens
aactgccaagaaatt

SEQ ID NO: 3597778 - DNA, 15 bp, Homo sapiens
aactgccctaagccc

SEQ ID NO: 3597779 - DNA, 18 bp, Homo sapiens
aactgccctaagccccca

SEQ ID NO: 3597780 - DNA, 17 bp, Homo sapiens
aactgcccttgctgccc

SEQ ID NO: 3597781 - DNA, 17 bp, Homo sapiens
aactggaaaatcttcta

SEQ ID NO: 3597782 - DNA, 22 bp, Homo sapiens
aactggatatttcaatctttta

SEQ ID NO: 3597783 - DNA, 23 bp, Homo sapiens
aactggcaggggagacaggagcc

SEQ ID NO: 3597784 - DNA, 13 bp, Homo sapiens
aactggcttcccc

SEQ ID NO: 3597785 - DNA, 16 bp, Homo sapiens
aactgggcatttcaat

SEQ ID NO: 3597786 - DNA, 19 bp, Homo sapiens
aactggtttataataaact

SEQ ID NO: 3597787 - DNA, 17 bp, Homo sapiens
aactgtattttctttca

SEQ ID NO: 3597788 - DNA, 11 bp, Homo sapiens
aactgtcctgt

SEQ ID NO: 3597789 - DNA, 18 bp, Homo sapiens
aactgtcctgtcctgctc

SEQ ID NO: 3597790 - DNA, 15 bp, Homo sapiens
aactgtttccctgct

SEQ ID NO: 3597791 - DNA, 18 bp, Homo sapiens
aactgtttccctgctgaa

SEQ ID NO: 3597792 - DNA, 19 bp, Homo sapiens
aacttaaaaccttgaaggt

SEQ ID NO: 3597793 - DNA, 15 bp, Homo sapiens
aacttaaagaggaat

SEQ ID NO: 3597794 - DNA, 15 bp, Homo sapiens
aacttaacatgggct

SEQ ID NO: 3597795 - DNA, 17 bp, Homo sapiens
aacttaaggcatttgtt

SEQ ID NO: 3597796 - DNA, 23 bp, Homo sapiens
aacttaatgttcttatgcaaaat

SEQ ID NO: 3597797 - DNA, 13 bp, Homo sapiens
aacttcaaagctg

SEQ ID NO: 3597798 - DNA, 12 bp, Homo sapiens
aacttcagcaac

SEQ ID NO: 3597799 - DNA, 14 bp, Homo sapiens
aacttccgctgagg

SEQ ID NO: 3597800 - DNA, 14 bp, Homo sapiens
aacttcctgctgca

SEQ ID NO: 3597801 - DNA, 17 bp, Homo sapiens
aacttcctgctgcaccc

SEQ ID NO: 3597802 - DNA, 19 bp, Homo sapiens
aacttcctgtgcctttcct

SEQ ID NO: 3597803 - DNA, 14 bp, Homo sapiens
aacttcctgtggat

SEQ ID NO: 3597804 - DNA, 12 bp, Homo sapiens
aacttcttgctt

SEQ ID NO: 3597805 - DNA, 19 bp, Homo sapiens
aacttcttgcttctttcta

SEQ ID NO: 3597806 - DNA, 14 bp, Homo sapiens
aacttgagattcaa

SEQ ID NO: 3597807 - DNA, 21 bp, Homo sapiens
aacttgagattcaagacaaga

SEQ ID NO: 3597808 - DNA, 10 bp, Homo sapiens
aacttgcatc

SEQ ID NO: 3597809 - DNA, 14 bp, Homo sapiens
aacttgctttcttc

SEQ ID NO: 3597810 - DNA, 16 bp, Homo sapiens
aacttgctttcttctt

SEQ ID NO: 3597811 - DNA, 16 bp, Homo sapiens
aacttgttgaatttat

SEQ ID NO: 3597812 - DNA, 13 bp, Homo sapiens
aactttaacttct

SEQ ID NO: 3597813 - DNA, 13 bp, Homo sapiens
aactttaagagga

SEQ ID NO: 3597814 - DNA, 15 bp, Homo sapiens
aactttaagaggaca

SEQ ID NO: 3597815 - DNA, 16 bp, Homo sapiens
aactttcgttgttatt

SEQ ID NO: 3597816 - DNA, 13 bp, Homo sapiens
aactttctccctc

SEQ ID NO: 3597817 - DNA, 14 bp, Homo sapiens
aactttctccctca

SEQ ID NO: 3597818 - DNA, 16 bp, Homo sapiens
aactttctccctcatc

SEQ ID NO: 3597819 - DNA, 13 bp, Homo sapiens
aacttttaattta

SEQ ID NO: 3597820 - DNA, 11 bp, Homo sapiens
aacttttgtaa

SEQ ID NO: 3597821 - DNA, 19 bp, Homo sapiens
aacttttgtgaattaggct

SEQ ID NO: 3597822 - DNA, 18 bp, Homo sapiens
aacttttttttctctctt

SEQ ID NO: 3597823 - DNA, 21 bp, Homo sapiens
aagaaaaaaaaaaagaaagaa

SEQ ID NO: 3597824 - DNA, 18 bp, Homo sapiens
aagaaaagacttgtaata

SEQ ID NO: 3597825 - DNA, 11 bp, Homo sapiens
aagaaaagatt

SEQ ID NO: 3597826 - DNA, 20 bp, Homo sapiens
aagaaaagccgaaagggtta

SEQ ID NO: 3597827 - DNA, 16 bp, Homo sapiens
aagaaaatgaaatgca

SEQ ID NO: 3597828 - DNA, 20 bp, Homo sapiens
aagaaacaagctgtgcaggc

SEQ ID NO: 3597829 - DNA, 17 bp, Homo sapiens
aagaaaccttgctctcc

SEQ ID NO: 3597830 - DNA, 13 bp, Homo sapiens
aagaaacttttct

SEQ ID NO: 3597831 - DNA, 16 bp, Homo sapiens
aagaaacttttttatt

SEQ ID NO: 3597832 - DNA, 17 bp, Homo sapiens
aagaaagtgggaggtca

SEQ ID NO: 3597833 - DNA, 18 bp, Homo sapiens
aagaaagtgtatttggaa

SEQ ID NO: 3597834 - DNA, 17 bp, Homo sapiens
aagaaataaaccaaagg

SEQ ID NO: 3597835 - DNA, 14 bp, Homo sapiens
aagaaataaatgaa

SEQ ID NO: 3597836 - DNA, 20 bp, Homo sapiens
aagaaatatgtattctgtaa

SEQ ID NO: 3597837 - DNA, 16 bp, Homo sapiens
aagaaatgaaacatcc

SEQ ID NO: 3597838 - DNA, 13 bp, Homo sapiens
aagaaatgtaagg

SEQ ID NO: 3597839 - DNA, 14 bp, Homo sapiens
aagaaatgtaaggg

SEQ ID NO: 3597840 - DNA, 13 bp, Homo sapiens
aagaaatgtctta

SEQ ID NO: 3597841 - DNA, 15 bp, Homo sapiens
aagaaattttttaaa

SEQ ID NO: 3597842 - DNA, 12 bp, Homo sapiens
aagaacaaagta

SEQ ID NO: 3597843 - DNA, 20 bp, Homo sapiens
aagaacaagttttggcagcc

SEQ ID NO: 3597844 - DNA, 22 bp, Homo sapiens
aagaacaagttttggcagccat

SEQ ID NO: 3597845 - DNA, 21 bp, Homo sapiens
aagaaccactccttcatgttt

SEQ ID NO: 3597846 - DNA, 20 bp, Homo sapiens
aagaaccagtccccccaccc

SEQ ID NO: 3597847 - DNA, 16 bp, Homo sapiens
aagaaccatgcaggaa

SEQ ID NO: 3597848 - DNA, 17 bp, Homo sapiens
aagaaccatgcaggaag

SEQ ID NO: 3597849 - DNA, 24 bp, Homo sapiens
aagaactaattcgtacataataag

SEQ ID NO: 3597850 - DNA, 23 bp, Homo sapiens
aagaactattgtgctcagagaca

SEQ ID NO: 3597851 - DNA, 12 bp, Homo sapiens
aagaagaaagct

SEQ ID NO: 3597852 - DNA, 17 bp, Homo sapiens
aagaagaaggccagaga

SEQ ID NO: 3597853 - DNA, 20 bp, Homo sapiens
aagaagaggagaaaaagaag

SEQ ID NO: 3597854 - DNA, 17 bp, Homo sapiens
aagaaggatgatgtctt

SEQ ID NO: 3597855 - DNA, 16 bp, Homo sapiens
aagaaggccagagagg

SEQ ID NO: 3597856 - DNA, 18 bp, Homo sapiens
aagaagggggccctgcta

SEQ ID NO: 3597857 - DNA, 19 bp, Homo sapiens
aagaagtggagacagtcct

SEQ ID NO: 3597858 - DNA, 15 bp, Homo sapiens
aagaataaaaacttt

SEQ ID NO: 3597859 - DNA, 18 bp, Homo sapiens
aagaataaaaacttttga

SEQ ID NO: 3597860 - DNA, 12 bp, Homo sapiens
aagaatacttga

SEQ ID NO: 3597861 - DNA, 15 bp, Homo sapiens
aagaatctttagaga

SEQ ID NO: 3597862 - DNA, 14 bp, Homo sapiens
aagaatgcattcaa

SEQ ID NO: 3597863 - DNA, 12 bp, Homo sapiens
aagaattaatga

SEQ ID NO: 3597864 - DNA, 17 bp, Homo sapiens
aagaatttggggcagga

SEQ ID NO: 3597865 - DNA, 15 bp, Homo sapiens
aagacaagagctgtt

SEQ ID NO: 3597866 - DNA, 23 bp, Homo sapiens
aagacaagtgatgctaaaacctg

SEQ ID NO: 3597867 - DNA, 15 bp, Homo sapiens
aagacaatcactgcc

SEQ ID NO: 3597868 - DNA, 14 bp, Homo sapiens
aagacagaaaagtg

SEQ ID NO: 3597869 - DNA, 19 bp, Homo sapiens
aagacagaaaagtgcctga

SEQ ID NO: 3597870 - DNA, 12 bp, Homo sapiens
aagacagagtct

SEQ ID NO: 3597871 - DNA, 14 bp, Homo sapiens
aagacaggagacaa

SEQ ID NO: 3597872 - DNA, 16 bp, Homo sapiens
aagacagggtcttgct

SEQ ID NO: 3597873 - DNA, 13 bp, Homo sapiens
aagacataaaaca

SEQ ID NO: 3597874 - DNA, 16 bp, Homo sapiens
aagacataaaacagaa

SEQ ID NO: 3597875 - DNA, 23 bp, Homo sapiens
aagacattagagaaaaccttaaa

SEQ ID NO: 3597876 - DNA, 15 bp, Homo sapiens
aagacattgacagca

SEQ ID NO: 3597877 - DNA, 16 bp, Homo sapiens
aagacattgacagcaa

SEQ ID NO: 3597878 - DNA, 18 bp, Homo sapiens
aagacattgacagcaatt

SEQ ID NO: 3597879 - DNA, 13 bp, Homo sapiens
aagaccctccccg

SEQ ID NO: 3597880 - DNA, 13 bp, Homo sapiens
aagaccctgtctc

SEQ ID NO: 3597881 - DNA, 22 bp, Homo sapiens
aagacctcatctgtggagctgc

SEQ ID NO: 3597882 - DNA, 17 bp, Homo sapiens
aagacctggcagctctg

SEQ ID NO: 3597883 - DNA, 15 bp, Homo sapiens
aagacgtctcccctt

SEQ ID NO: 3597884 - DNA, 17 bp, Homo sapiens
aagacgtggctctgggt

SEQ ID NO: 3597885 - DNA, 12 bp, Homo sapiens
aagactaaaagt

SEQ ID NO: 3597886 - DNA, 13 bp, Homo sapiens
aagactattcaaa

SEQ ID NO: 3597887 - DNA, 13 bp, Homo sapiens
aagactctggagg

SEQ ID NO: 3597888 - DNA, 14 bp, Homo sapiens
aagactctggaggt

SEQ ID NO: 3597889 - DNA, 13 bp, Homo sapiens
aagactggcccag

SEQ ID NO: 3597890 - DNA, 16 bp, Homo sapiens
aagactggcccagtgc

SEQ ID NO: 3597891 - DNA, 17 bp, Homo sapiens
aagacttagattgtgct

SEQ ID NO: 3597892 - DNA, 22 bp, Homo sapiens
aagacttctcaaagagaattgt

SEQ ID NO: 3597893 - DNA, 11 bp, Homo sapiens
aagagaaactt

SEQ ID NO: 3597894 - DNA, 17 bp, Homo sapiens
aagagaagatgcctgtt

SEQ ID NO: 3597895 - DNA, 17 bp, Homo sapiens
aagagaattgtatgtaa

SEQ ID NO: 3597896 - DNA, 15 bp, Homo sapiens
aagagacatccaaat

SEQ ID NO: 3597897 - DNA, 13 bp, Homo sapiens
aagagagaagcca

SEQ ID NO: 3597898 - DNA, 24 bp, Homo sapiens
aagagaggactggttctgaggcca

SEQ ID NO: 3597899 - DNA, 14 bp, Homo sapiens
aagagatacagagg

SEQ ID NO: 3597900 - DNA, 20 bp, Homo sapiens
aagagatattgatattgaag

SEQ ID NO: 3597901 - DNA, 15 bp, Homo sapiens
aagagatctgtgtgg

SEQ ID NO: 3597902 - DNA, 13 bp, Homo sapiens
aagagcacactgc

SEQ ID NO: 3597903 - DNA, 18 bp, Homo sapiens
aagagcagtggtaagaat

SEQ ID NO: 3597904 - DNA, 17 bp, Homo sapiens
aagtccaagcataccaa

SEQ ID NO: 3597905 - DNA, 14 bp, Homo sapiens
aagtccaataagac

SEQ ID NO: 3597906 - DNA, 16 bp, Homo sapiens
aagtcctaacttcctg

SEQ ID NO: 3597907 - DNA, 21 bp, Homo sapiens
aagtccttcagtgagcccctc

SEQ ID NO: 3597908 - DNA, 22 bp, Homo sapiens
aagtccttcagtgagcccctcc

SEQ ID NO: 3597909 - DNA, 17 bp, Homo sapiens
aagtccttccacctgcc

SEQ ID NO: 3597910 - DNA, 21 bp, Homo sapiens
aagtctgagcccatttctggg

SEQ ID NO: 3597911 - DNA, 16 bp, Homo sapiens
aagtcttcaaattttt

SEQ ID NO: 3597912 - DNA, 13 bp, Homo sapiens
aagtcttctattt

SEQ ID NO: 3597913 - DNA, 14 bp, Homo sapiens
aagtcttctattta

SEQ ID NO: 3597914 - DNA, 17 bp, Homo sapiens
aagtcttctatttattt

SEQ ID NO: 3597915 - DNA, 12 bp, Homo sapiens
aagtgaaaactt

SEQ ID NO: 3597916 - DNA, 14 bp, Homo sapiens
aagtgaaaatatag

SEQ ID NO: 3597917 - DNA, 14 bp, Homo sapiens
aagtgaaaatctta

SEQ ID NO: 3597918 - DNA, 18 bp, Homo sapiens
aagtgaaataacaaaatg

SEQ ID NO: 3597919 - DNA, 23 bp, Homo sapiens
aagtgacatgcattcacatatct

SEQ ID NO: 3597920 - DNA, 19 bp, Homo sapiens
aagtgacctcactggcctg

SEQ ID NO: 3597921 - DNA, 21 bp, Homo sapiens
aagtgattctcctgcctcagc

SEQ ID NO: 3597922 - DNA, 21 bp, Homo sapiens
aagtgatttttggtcttctgt

SEQ ID NO: 3597923 - DNA, 23 bp, Homo sapiens
aagtgcaataaatctgacccagt

SEQ ID NO: 3597924 - DNA, 17 bp, Homo sapiens
aagtgccaaatgctctc

SEQ ID NO: 3597925 - DNA, 15 bp, Homo sapiens
aagtgcctcggacag

SEQ ID NO: 3597926 - DNA, 13 bp, Homo sapiens
aagtgcctgagct

SEQ ID NO: 3597927 - DNA, 17 bp, Homo sapiens
aagtgcctgggctcagc

SEQ ID NO: 3597928 - DNA, 20 bp, Homo sapiens
aagtgctcttggctgacccc

SEQ ID NO: 3597929 - DNA, 14 bp, Homo sapiens
aagtgctgctgtgg

SEQ ID NO: 3597930 - DNA, 15 bp, Homo sapiens
aagtgctgctgtgga

SEQ ID NO: 3597931 - DNA, 17 bp, Homo sapiens
aagtgctgtttattaat

SEQ ID NO: 3597932 - DNA, 16 bp, Homo sapiens
aagtggaagtatgtat

SEQ ID NO: 3597933 - DNA, 18 bp, Homo sapiens
aagtggacgttaggccag

SEQ ID NO: 3597934 - DNA, 19 bp, Homo sapiens
aagtggacgttaggccagg

SEQ ID NO: 3597935 - DNA, 20 bp, Homo sapiens
aagtggagctgtctgtctct

SEQ ID NO: 3597936 - DNA, 22 bp, Homo sapiens
aagtggcaatctcagatgcagt

SEQ ID NO: 3597937 - DNA, 23 bp, Homo sapiens
aagtggcctccgtcactacctgg

SEQ ID NO: 3597938 - DNA, 13 bp, Homo sapiens
aagtggctgcctt

SEQ ID NO: 3597939 - DNA, 13 bp, Homo sapiens
aagtggctgtccc

SEQ ID NO: 3597940 - DNA, 20 bp, Homo sapiens
aagtgggaggtcaggaaact

SEQ ID NO: 3597941 - DNA, 17 bp, Homo sapiens
aagtggtaattgggaac

SEQ ID NO: 3597942 - DNA, 15 bp, Homo sapiens
aagtggtgagcaagc

SEQ ID NO: 3597943 - DNA, 17 bp, Homo sapiens
aagtggtggtaaccctg

SEQ ID NO: 3597944 - DNA, 15 bp, Homo sapiens
aagtgtatttggaaa

SEQ ID NO: 3597945 - DNA, 21 bp, Homo sapiens
aagtgtgaagacccaaaacag

SEQ ID NO: 3597946 - DNA, 18 bp, Homo sapiens
aagtgtgagctcttccct

SEQ ID NO: 3597947 - DNA, 10 bp, Homo sapiens
aagtgtgggt

SEQ ID NO: 3597948 - DNA, 18 bp, Homo sapiens
aagttagttccactgaga

SEQ ID NO: 3597949 - DNA, 13 bp, Homo sapiens
aagttatctttga

SEQ ID NO: 3597950 - DNA, 14 bp, Homo sapiens
aagttatttatgct

SEQ ID NO: 3597951 - DNA, 14 bp, Homo sapiens
aagttattttatga

SEQ ID NO: 3597952 - DNA, 15 bp, Homo sapiens
aagttattttatgac

SEQ ID NO: 3597953 - DNA, 13 bp, Homo sapiens
aagttcagggacc

SEQ ID NO: 3597954 - DNA, 14 bp, Homo sapiens
aagttcatcttgca

SEQ ID NO: 3597955 - DNA, 20 bp, Homo sapiens
aagttccttggccatgcaga

SEQ ID NO: 3597956 - DNA, 22 bp, Homo sapiens
aagttctaggcatacttttcaa

SEQ ID NO: 3597957 - DNA, 23 bp, Homo sapiens
aagttctaggcatacttttcaaa

SEQ ID NO: 3597958 - DNA, 18 bp, Homo sapiens
aagttctatttcttgaag

SEQ ID NO: 3597959 - DNA, 13 bp, Homo sapiens
aagttgaccttta

SEQ ID NO: 3597960 - DNA, 23 bp, Homo sapiens
aagttgacttatagtacatgata

SEQ ID NO: 3597961 - DNA, 17 bp, Homo sapiens
aagttgaggattgttga

SEQ ID NO: 3597962 - DNA, 12 bp, Homo sapiens
aagtttctattc

SEQ ID NO: 3597963 - DNA, 14 bp, Homo sapiens
aagtttctattctg

SEQ ID NO: 3597964 - DNA, 17 bp, Homo sapiens
aagtttctattctgtca

SEQ ID NO: 3597965 - DNA, 15 bp, Homo sapiens
aagtttgctgtgctt

SEQ ID NO: 3597966 - DNA, 13 bp, Homo sapiens
aagttttccagta

SEQ ID NO: 3597967 - DNA, 21 bp, Homo sapiens
aagttttcccttgaggaaaca

SEQ ID NO: 3597968 - DNA, 23 bp, Homo sapiens
aataaaaaagaacttttgtatct

SEQ ID NO: 3597969 - DNA, 18 bp, Homo sapiens
aataaaaacttttgagga

SEQ ID NO: 3597970 - DNA, 14 bp, Homo sapiens
aataaaaatatatt

SEQ ID NO: 3597971 - DNA, 12 bp, Homo sapiens
aataaaagcaca

SEQ ID NO: 3597972 - DNA, 16 bp, Homo sapiens
aataaaagtggtaatt

SEQ ID NO: 3597973 - DNA, 14 bp, Homo sapiens
aataaactactctt

SEQ ID NO: 3597974 - DNA, 10 bp, Homo sapiens
aataaactgg

SEQ ID NO: 3597975 - DNA, 13 bp, Homo sapiens
aataaagaaaaac

SEQ ID NO: 3597976 - DNA, 12 bp, Homo sapiens
aataaagaggag

SEQ ID NO: 3597977 - DNA, 23 bp, Homo sapiens
aataaagatacaaaatgttactg

SEQ ID NO: 3597978 - DNA, 11 bp, Homo sapiens
aataaagcaat

SEQ ID NO: 3597979 - DNA, 12 bp, Homo sapiens
aataaagctttt

SEQ ID NO: 3597980 - DNA, 18 bp, Homo sapiens
aataaaggactgtaatct

SEQ ID NO: 3597981 - DNA, 22 bp, Homo sapiens
aataaaggactgtaatcttatt

SEQ ID NO: 3597982 - DNA, 17 bp, Homo sapiens
aataaagtcagatggaa

SEQ ID NO: 3597983 - DNA, 22 bp, Homo sapiens
aataaatagggaagatggagac

SEQ ID NO: 3597984 - DNA, 23 bp, Homo sapiens
aataaatatatctaccccagact

SEQ ID NO: 3597985 - DNA, 13 bp, Homo sapiens
aataaatcacaca

SEQ ID NO: 3597986 - DNA, 13 bp, Homo sapiens
aataaatcacaga

SEQ ID NO: 3597987 - DNA, 16 bp, Homo sapiens
aataaatcataaaact

SEQ ID NO: 3597988 - DNA, 17 bp, Homo sapiens
aataaatctgacccagt

SEQ ID NO: 3597989 - DNA, 20 bp, Homo sapiens
aataaatctgacccagtgcc

SEQ ID NO: 3597990 - DNA, 22 bp, Homo sapiens
aataaatggcccggacatgtct

SEQ ID NO: 3597991 - DNA, 11 bp, Homo sapiens
aataaatgtca

SEQ ID NO: 3597992 - DNA, 12 bp, Homo sapiens
aataaatgtctt

SEQ ID NO: 3597993 - DNA, 11 bp, Homo sapiens
aataaattcta

SEQ ID NO: 3597994 - DNA, 23 bp, Homo sapiens
aataaattctacctccttgtgtt

SEQ ID NO: 3597995 - DNA, 20 bp, Homo sapiens
aataaattgctccttgacat

SEQ ID NO: 3597996 - DNA, 21 bp, Homo sapiens
aataaattgcttactgatatt

SEQ ID NO: 3597997 - DNA, 12 bp, Homo sapiens
aataaatttctg

SEQ ID NO: 3597998 - DNA, 23 bp, Homo sapiens
aataaatttctgggatatttaac

SEQ ID NO: 3597999 - DNA, 13 bp, Homo sapiens
aataaatttgctt

SEQ ID NO: 3598000 - DNA, 13 bp, Homo sapiens
aataacaatgtgc

SEQ ID NO: 3598001 - DNA, 19 bp, Homo sapiens
aataacaatgtgctctcgg

SEQ ID NO: 3598002 - DNA, 15 bp, Homo sapiens
aataacagatttctc

SEQ ID NO: 3598003 - DNA, 17 bp, Homo sapiens
aataactgaaccaaatt

SEQ ID NO: 3598004 - DNA, 17 bp, Homo sapiens
aataaggttatgattga

SEQ ID NO: 3598005 - DNA, 21 bp, Homo sapiens
aataagtcaaaaggaacaaaa

SEQ ID NO: 3598006 - DNA, 22 bp, Homo sapiens
aataagtcaaaaggaacaaaaa

SEQ ID NO: 3598007 - DNA, 13 bp, Homo sapiens
aataatagactgt

SEQ ID NO: 3598008 - DNA, 19 bp, Homo sapiens
aataatttccttcaggcag

SEQ ID NO: 3598009 - DNA, 20 bp, Homo sapiens
aataatttccttcaggcagc

SEQ ID NO: 3598010 - DNA, 13 bp, Homo sapiens
aataattttgtaa

SEQ ID NO: 3598011 - DNA, 19 bp, Homo sapiens
aataatttttgctgaattc

SEQ ID NO: 3598012 - DNA, 21 bp, Homo sapiens
aataatttttgctgaattcct

SEQ ID NO: 3598013 - DNA, 17 bp, Homo sapiens
aatacaagcatatgtta

SEQ ID NO: 3598014 - DNA, 18 bp, Homo sapiens
aatacaccgtttagaaaa

SEQ ID NO: 3598015 - DNA, 22 bp, Homo sapiens
aatacactcatggggaagcttc

SEQ ID NO: 3598016 - DNA, 17 bp, Homo sapiens
aatacagttctgtcata

SEQ ID NO: 3598017 - DNA, 19 bp, Homo sapiens
aatacattaacggtgctaa

SEQ ID NO: 3598018 - DNA, 23 bp, Homo sapiens
aatacatttaaaacattaaaata

SEQ ID NO: 3598019 - DNA, 19 bp, Homo sapiens
aataccactagtggaaagt

SEQ ID NO: 3598020 - DNA, 20 bp, Homo sapiens
aataccactagtggaaagtc

SEQ ID NO: 3598021 - DNA, 23 bp, Homo sapiens
aatacccgtcctctcggctgcca

SEQ ID NO: 3598022 - DNA, 20 bp, Homo sapiens
aatacctacaataaactggt

SEQ ID NO: 3598023 - DNA, 13 bp, Homo sapiens
aatacctttgtag

SEQ ID NO: 3598024 - DNA, 18 bp, Homo sapiens
aatacctttgtagttact

SEQ ID NO: 3598025 - DNA, 19 bp, Homo sapiens
aatacctttgtagttactc

SEQ ID NO: 3598026 - DNA, 16 bp, Homo sapiens
aatactgagaaaacct

SEQ ID NO: 3598027 - DNA, 18 bp, Homo sapiens
aatactgagaaaacctgt

SEQ ID NO: 3598028 - DNA, 12 bp, Homo sapiens
aatacttatttt

SEQ ID NO: 3598029 - DNA, 23 bp, Homo sapiens
aatactttctatgtgacatttct

SEQ ID NO: 3598030 - DNA, 12 bp, Homo sapiens
aatagaaaaagt

SEQ ID NO: 3598031 - DNA, 22 bp, Homo sapiens
aatagaagctaaggtttagata

SEQ ID NO: 3598032 - DNA, 15 bp, Homo sapiens
aatagaataaaggca

SEQ ID NO: 3598033 - DNA, 15 bp, Homo sapiens
aatagatcagtattt

SEQ ID NO: 3598034 - DNA, 20 bp, Homo sapiens
aatagatgtgcagtttggaa

SEQ ID NO: 3598035 - DNA, 18 bp, Homo sapiens
aatagattgagttattaa

SEQ ID NO: 3598036 - DNA, 15 bp, Homo sapiens
aatagctttaatgat

SEQ ID NO: 3598037 - DNA, 15 bp, Homo sapiens
acaaaagaaaagact

SEQ ID NO: 3598038 - DNA, 14 bp, Homo sapiens
acaaaagatacaaa

SEQ ID NO: 3598039 - DNA, 15 bp, Homo sapiens
acaaaagctttttaa

SEQ ID NO: 3598040 - DNA, 22 bp, Homo sapiens
acaaaatgtagggttataataa

SEQ ID NO: 3598041 - DNA, 11 bp, Homo sapiens
acaaacaaaac

SEQ ID NO: 3598042 - DNA, 10 bp, Homo sapiens
acaaacaaac

SEQ ID NO: 3598043 - DNA, 14 bp, Homo sapiens
acaaacaaacaaaa

SEQ ID NO: 3598044 - DNA, 15 bp, Homo sapiens
acaaacacctcccag

SEQ ID NO: 3598045 - DNA, 14 bp, Homo sapiens
acaaactcagatcc

SEQ ID NO: 3598046 - DNA, 15 bp, Homo sapiens
acaaactctctgaac

SEQ ID NO: 3598047 - DNA, 15 bp, Homo sapiens
acaaactgcttcctt

SEQ ID NO: 3598048 - DNA, 21 bp, Homo sapiens
acaaactgcttcctttcttga

SEQ ID NO: 3598049 - DNA, 20 bp, Homo sapiens
acaaagaaccatgcaggaag

SEQ ID NO: 3598050 - DNA, 19 bp, Homo sapiens
acaaagaacttgctgctgc

SEQ ID NO: 3598051 - DNA, 16 bp, Homo sapiens
acaaagacattgacag

SEQ ID NO: 3598052 - DNA, 19 bp, Homo sapiens
acaaagattctctatgtat

SEQ ID NO: 3598053 - DNA, 20 bp, Homo sapiens
acaaagcccaagggatctgg

SEQ ID NO: 3598054 - DNA, 18 bp, Homo sapiens
acaaagccttaaaatgca

SEQ ID NO: 3598055 - DNA, 18 bp, Homo sapiens
acaaagccttaagcaaat

SEQ ID NO: 3598056 - DNA, 18 bp, Homo sapiens
acaaagggaaagcctctg

SEQ ID NO: 3598057 - DNA, 19 bp, Homo sapiens
acaaagtttcaatttgttt

SEQ ID NO: 3598058 - DNA, 13 bp, Homo sapiens
acaaatgaaattt

SEQ ID NO: 3598059 - DNA, 21 bp, Homo sapiens
acaaatgcaggtgtcctgagc

SEQ ID NO: 3598060 - DNA, 20 bp, Homo sapiens
acaaatgccttaaaatggaa

SEQ ID NO: 3598061 - DNA, 23 bp, Homo sapiens
acaacaaatatgttctctgaatg

SEQ ID NO: 3598062 - DNA, 23 bp, Homo sapiens
acaacagcagtctccttcagcac

SEQ ID NO: 3598063 - DNA, 21 bp, Homo sapiens
acaacatcgcaatagtttttt

SEQ ID NO: 3598064 - DNA, 18 bp, Homo sapiens
acaaccccctccaccccc

SEQ ID NO: 3598065 - DNA, 18 bp, Homo sapiens
acaaccctaccctggcag

SEQ ID NO: 3598066 - DNA, 22 bp, Homo sapiens
acaacctccattctattttaga

SEQ ID NO: 3598067 - DNA, 13 bp, Homo sapiens
acaactaaataac

SEQ ID NO: 3598068 - DNA, 15 bp, Homo sapiens
acaagaaagtggtct

SEQ ID NO: 3598069 - DNA, 15 bp, Homo sapiens
acaagactggcccag

SEQ ID NO: 3598070 - DNA, 13 bp, Homo sapiens
acaagagctgtta

SEQ ID NO: 3598071 - DNA, 20 bp, Homo sapiens
acaagagctgttatgctgtt

SEQ ID NO: 3598072 - DNA, 21 bp, Homo sapiens
acaagagctgttatgctgttt

SEQ ID NO: 3598073 - DNA, 22 bp, Homo sapiens
acaagagctgttatgctgtttc

SEQ ID NO: 3598074 - DNA, 17 bp, Homo sapiens
acaagcctcctgtacct

SEQ ID NO: 3598075 - DNA, 18 bp, Homo sapiens
acaagctgtccctgcagg

SEQ ID NO: 3598076 - DNA, 19 bp, Homo sapiens
acaagctgtccctgcaggg

SEQ ID NO: 3598077 - DNA, 12 bp, Homo sapiens
acaagctgtgca

SEQ ID NO: 3598078 - DNA, 18 bp, Homo sapiens
acaaggatagatgctggc

SEQ ID NO: 3598079 - DNA, 22 bp, Homo sapiens
acaaggatagatgctggcccag

SEQ ID NO: 3598080 - DNA, 16 bp, Homo sapiens
acaaggcccaggagac

SEQ ID NO: 3598081 - DNA, 19 bp, Homo sapiens
acaaggcccaggagacctc

SEQ ID NO: 3598082 - DNA, 13 bp, Homo sapiens
acaagtacttttg

SEQ ID NO: 3598083 - DNA, 21 bp, Homo sapiens
acaagtatgaataaagacacc

SEQ ID NO: 3598084 - DNA, 15 bp, Homo sapiens
acaagttaaataaat

SEQ ID NO: 3598085 - DNA, 14 bp, Homo sapiens
acaagttctatttc

SEQ ID NO: 3598086 - DNA, 17 bp, Homo sapiens
acaataaattttttttg

SEQ ID NO: 3598087 - DNA, 22 bp, Homo sapiens
acaataaattttttttggtcaa

SEQ ID NO: 3598088 - DNA, 16 bp, Homo sapiens
acaataagaacaagtt

SEQ ID NO: 3598089 - DNA, 16 bp, Homo sapiens
acaataagcaaaaaca

SEQ ID NO: 3598090 - DNA, 13 bp, Homo sapiens
acaatcactgcca

SEQ ID NO: 3598091 - DNA, 14 bp, Homo sapiens
acaatcactgccaa

SEQ ID NO: 3598092 - DNA, 21 bp, Homo sapiens
acaatgtaataaaaagcctct

SEQ ID NO: 3598093 - DNA, 14 bp, Homo sapiens
acaatgtacacact

SEQ ID NO: 3598094 - DNA, 21 bp, Homo sapiens
acaatgttggagcagcaggcc

SEQ ID NO: 3598095 - DNA, 15 bp, Homo sapiens
acaattaggaactga

SEQ ID NO: 3598096 - DNA, 19 bp, Homo sapiens
acaattattggcaaagttt

SEQ ID NO: 3598097 - DNA, 19 bp, Homo sapiens
acaattatttttgctctgc

SEQ ID NO: 3598098 - DNA, 13 bp, Homo sapiens
acaattcctgtaa

SEQ ID NO: 3598099 - DNA, 15 bp, Homo sapiens
acaattcttgaattc

SEQ ID NO: 3598100 - DNA, 16 bp, Homo sapiens
acaattgaacttccag

SEQ ID NO: 3598101 - DNA, 17 bp, Homo sapiens
acaattttacctattct

SEQ ID NO: 3598102 - DNA, 23 bp, Homo sapiens
acaattttttttaattggccatg

SEQ ID NO: 3598103 - DNA, 19 bp, Homo sapiens
acacaaggatagatgctgg

SEQ ID NO: 3598104 - DNA, 23 bp, Homo sapiens
acacaaggatagatgctggccca

SEQ ID NO: 3598105 - DNA, 13 bp, Homo sapiens
acacaataagcaa

SEQ ID NO: 3598106 - DNA, 23 bp, Homo sapiens
acacaataggtctttctctcagt

SEQ ID NO: 3598107 - DNA, 21 bp, Homo sapiens
acacacacgcactctccccgc

SEQ ID NO: 3598108 - DNA, 16 bp, Homo sapiens
acacacagacatatat

SEQ ID NO: 3598109 - DNA, 17 bp, Homo sapiens
acacaccaggcgctaat

SEQ ID NO: 3598110 - DNA, 14 bp, Homo sapiens
acacacgctgcctt

SEQ ID NO: 3598111 - DNA, 13 bp, Homo sapiens
acacagatattgt

SEQ ID NO: 3598112 - DNA, 14 bp, Homo sapiens
acacagctcttcat

SEQ ID NO: 3598113 - DNA, 18 bp, Homo sapiens
acacagctcttcattcca

SEQ ID NO: 3598114 - DNA, 18 bp, Homo sapiens
acacagctgccctagctg

SEQ ID NO: 3598115 - DNA, 16 bp, Homo sapiens
acacagctgggctgtg

SEQ ID NO: 3598116 - DNA, 12 bp, Homo sapiens
acacaggctgtc

SEQ ID NO: 3598117 - DNA, 15 bp, Homo sapiens
acacaggtctttcct

SEQ ID NO: 3598118 - DNA, 16 bp, Homo sapiens
acacaggtctttccta

SEQ ID NO: 3598119 - DNA, 16 bp, Homo sapiens
acacatacataatggt

SEQ ID NO: 3598120 - DNA, 15 bp, Homo sapiens
acacataccctcttc

SEQ ID NO: 3598121 - DNA, 13 bp, Homo sapiens
acacatatgaggg

SEQ ID NO: 3598122 - DNA, 22 bp, Homo sapiens
acacatcagcttgccctgttaa

SEQ ID NO: 3598123 - DNA, 14 bp, Homo sapiens
acacatctggctgc

SEQ ID NO: 3598124 - DNA, 14 bp, Homo sapiens
acacattaaatgtg

SEQ ID NO: 3598125 - DNA, 22 bp, Homo sapiens
acacattacaaagttaaaattg

SEQ ID NO: 3598126 - DNA, 20 bp, Homo sapiens
acacattgcagcttcaactt

SEQ ID NO: 3598127 - DNA, 15 bp, Homo sapiens
acacatttccattca

SEQ ID NO: 3598128 - DNA, 15 bp, Homo sapiens
acaccaagctcaccc

SEQ ID NO: 3598129 - DNA, 14 bp, Homo sapiens
acaccagcattcct

SEQ ID NO: 3598130 - DNA, 11 bp, Homo sapiens
acaccagtgtt

SEQ ID NO: 3598131 - DNA, 12 bp, Homo sapiens
acaccagtgtta

SEQ ID NO: 3598132 - DNA, 15 bp, Homo sapiens
acaccagtgttagct

SEQ ID NO: 3598133 - DNA, 16 bp, Homo sapiens
acaccattttgtaaat

SEQ ID NO: 3598134 - DNA, 19 bp, Homo sapiens
acacccaaagaggtattta

SEQ ID NO: 3598135 - DNA, 20 bp, Homo sapiens
acacccaaagaggtatttat

SEQ ID NO: 3598136 - DNA, 12 bp, Homo sapiens
acacccaccccc

SEQ ID NO: 3598137 - DNA, 13 bp, Homo sapiens
acacccaggaagg

SEQ ID NO: 3598138 - DNA, 14 bp, Homo sapiens
acacccaggaaggg

SEQ ID NO: 3598139 - DNA, 15 bp, Homo sapiens
acacccagttctgaa

SEQ ID NO: 3598140 - DNA, 14 bp, Homo sapiens
acacccatgccaga

SEQ ID NO: 3598141 - DNA, 17 bp, Homo sapiens
acaccctggcctgaact

SEQ ID NO: 3598142 - DNA, 13 bp, Homo sapiens
acacctcccagga

SEQ ID NO: 3598143 - DNA, 12 bp, Homo sapiens
acacctccccct

SEQ ID NO: 3598144 - DNA, 15 bp, Homo sapiens
acacctcctcccact

SEQ ID NO: 3598145 - DNA, 20 bp, Homo sapiens
acacctcctcccactgccca

SEQ ID NO: 3598146 - DNA, 21 bp, Homo sapiens
acacctcctcccgaaaaatgt

SEQ ID NO: 3598147 - DNA, 17 bp, Homo sapiens
acaccttagagaagcta

SEQ ID NO: 3598148 - DNA, 19 bp, Homo sapiens
acaccttagagaagctacc

SEQ ID NO: 3598149 - DNA, 14 bp, Homo sapiens
acacgagcaggcta

SEQ ID NO: 3598150 - DNA, 12 bp, Homo sapiens
acacgctgcctt

SEQ ID NO: 3598151 - DNA, 18 bp, Homo sapiens
acacgctgctctgcccca

SEQ ID NO: 3598152 - DNA, 23 bp, Homo sapiens
acacgctgctctgccccagcttg

SEQ ID NO: 3598153 - DNA, 13 bp, Homo sapiens
acacgtggctggc

SEQ ID NO: 3598154 - DNA, 18 bp, Homo sapiens
acactaaccaaatctctc

SEQ ID NO: 3598155 - DNA, 16 bp, Homo sapiens
acactaacgaaatatc

SEQ ID NO: 3598156 - DNA, 13 bp, Homo sapiens
acactcaaatcaa

SEQ ID NO: 3598157 - DNA, 18 bp, Homo sapiens
acactcagaaaattccct

SEQ ID NO: 3598158 - DNA, 20 bp, Homo sapiens
acactcagaaaattccctgg

SEQ ID NO: 3598159 - DNA, 24 bp, Homo sapiens
acactcagaaaattccctggggtc

SEQ ID NO: 3598160 - DNA, 21 bp, Homo sapiens
acactcatggggaagcttcca

SEQ ID NO: 3598161 - DNA, 20 bp, Homo sapiens
acactctgggctccagagtg

SEQ ID NO: 3598162 - DNA, 23 bp, Homo sapiens
acactctgtattgaaaatggctt

SEQ ID NO: 3598163 - DNA, 12 bp, Homo sapiens
acactgagaaag

SEQ ID NO: 3598164 - DNA, 15 bp, Homo sapiens
acactgatgcaagga

SEQ ID NO: 3598165 - DNA, 13 bp, Homo sapiens
acactgctctaac

SEQ ID NO: 3598166 - DNA, 23 bp, Homo sapiens
acactgtaagctttgttctggga

SEQ ID NO: 3598167 - DNA, 16 bp, Homo sapiens
acactgtggccaggcc

SEQ ID NO: 3598168 - DNA, 18 bp, Homo sapiens
acactgtggccaggcctt

SEQ ID NO: 3598169 - DNA, 17 bp, Homo sapiens
acactgttgataaaaac

SEQ ID NO: 3598170 - DNA, 15 bp, Homo sapiens
acccccatgctgcct

SEQ ID NO: 3598171 - DNA, 17 bp, Homo sapiens
acccccctcccagacag

SEQ ID NO: 3598172 - DNA, 15 bp, Homo sapiens
acccccctctgctgc

SEQ ID NO: 3598173 - DNA, 20 bp, Homo sapiens
accccctccccgcccctgtg

SEQ ID NO: 3598174 - DNA, 23 bp, Homo sapiens
accccctccccgcccctgtggcc

SEQ ID NO: 3598175 - DNA, 13 bp, Homo sapiens
accccctcctccc

SEQ ID NO: 3598176 - DNA, 21 bp, Homo sapiens
accccctctggagaaggcctg

SEQ ID NO: 3598177 - DNA, 12 bp, Homo sapiens
accccctgcagc

SEQ ID NO: 3598178 - DNA, 16 bp, Homo sapiens
accccctgcagcccag

SEQ ID NO: 3598179 - DNA, 19 bp, Homo sapiens
acccccttgattcccaccg

SEQ ID NO: 3598180 - DNA, 15 bp, Homo sapiens
accccgagaagtgct

SEQ ID NO: 3598181 - DNA, 16 bp, Homo sapiens
accccgcacccggctc

SEQ ID NO: 3598182 - DNA, 18 bp, Homo sapiens
accccgccatgcatgcag

SEQ ID NO: 3598183 - DNA, 13 bp, Homo sapiens
acccctagccctg

SEQ ID NO: 3598184 - DNA, 15 bp, Homo sapiens
acccctcactcccca

SEQ ID NO: 3598185 - DNA, 20 bp, Homo sapiens
acccctccagttttgcctga

SEQ ID NO: 3598186 - DNA, 15 bp, Homo sapiens
acccctctccaggcc

SEQ ID NO: 3598187 - DNA, 16 bp, Homo sapiens
acccctctccaggcct

SEQ ID NO: 3598188 - DNA, 17 bp, Homo sapiens
acccctctccaggcctg

SEQ ID NO: 3598189 - DNA, 11 bp, Homo sapiens
acccctctggt

SEQ ID NO: 3598190 - DNA, 22 bp, Homo sapiens
acccctctggtgtgtggtgagg

SEQ ID NO: 3598191 - DNA, 20 bp, Homo sapiens
acccctgacctaccccagcc

SEQ ID NO: 3598192 - DNA, 18 bp, Homo sapiens
acccctggcttttcactg

SEQ ID NO: 3598193 - DNA, 17 bp, Homo sapiens
acccctgtaggcctcag

SEQ ID NO: 3598194 - DNA, 21 bp, Homo sapiens
acccctgtcccacccacacag

SEQ ID NO: 3598195 - DNA, 19 bp, Homo sapiens
accccttggaggagagaga

SEQ ID NO: 3598196 - DNA, 20 bp, Homo sapiens
accccttggaggagagagac

SEQ ID NO: 3598197 - DNA, 21 bp, Homo sapiens
accccttggaggagagagacc

SEQ ID NO: 3598198 - DNA, 22 bp, Homo sapiens
accccttggaggagagagaccc

SEQ ID NO: 3598199 - DNA, 15 bp, Homo sapiens
acccggaggggcctg

SEQ ID NO: 3598200 - DNA, 21 bp, Homo sapiens
acccggaggggcctggcagcc

SEQ ID NO: 3598201 - DNA, 17 bp, Homo sapiens
acccggctcgtgtattt

SEQ ID NO: 3598202 - DNA, 18 bp, Homo sapiens
acccgggggagcccagtg

SEQ ID NO: 3598203 - DNA, 14 bp, Homo sapiens
acccggtccccact

SEQ ID NO: 3598204 - DNA, 14 bp, Homo sapiens
accctaaccaagtt

SEQ ID NO: 3598205 - DNA, 21 bp, Homo sapiens
accctacagtatataagcttt

SEQ ID NO: 3598206 - DNA, 16 bp, Homo sapiens
accctaccctggcagg

SEQ ID NO: 3598207 - DNA, 13 bp, Homo sapiens
accctacctgtgc

SEQ ID NO: 3598208 - DNA, 18 bp, Homo sapiens
accctacttcttttgctc

SEQ ID NO: 3598209 - DNA, 16 bp, Homo sapiens
accctcaggcacacct

SEQ ID NO: 3598210 - DNA, 17 bp, Homo sapiens
accctcaggcacacctt

SEQ ID NO: 3598211 - DNA, 19 bp, Homo sapiens
accctcaggcacaccttgc

SEQ ID NO: 3598212 - DNA, 20 bp, Homo sapiens
accctcaggcacaccttgca

SEQ ID NO: 3598213 - DNA, 14 bp, Homo sapiens
accctcaggccacc

SEQ ID NO: 3598214 - DNA, 14 bp, Homo sapiens
accctccaaaggaa

SEQ ID NO: 3598215 - DNA, 21 bp, Homo sapiens
accctccaaaggaactctaga

SEQ ID NO: 3598216 - DNA, 20 bp, Homo sapiens
accctcccctatgctggtag

SEQ ID NO: 3598217 - DNA, 11 bp, Homo sapiens
accctccctcc

SEQ ID NO: 3598218 - DNA, 20 bp, Homo sapiens
accctccggcgggtgacagc

SEQ ID NO: 3598219 - DNA, 13 bp, Homo sapiens
accctcctctgct

SEQ ID NO: 3598220 - DNA, 16 bp, Homo sapiens
accctcctctgctggg

SEQ ID NO: 3598221 - DNA, 17 bp, Homo sapiens
accctcctctgctggga

SEQ ID NO: 3598222 - DNA, 18 bp, Homo sapiens
accctcctctgctgggaa

SEQ ID NO: 3598223 - DNA, 20 bp, Homo sapiens
accctctgggggtcctctct

SEQ ID NO: 3598224 - DNA, 12 bp, Homo sapiens
accctgaagggg

SEQ ID NO: 3598225 - DNA, 22 bp, Homo sapiens
accctgaatccgtacttgggtc

SEQ ID NO: 3598226 - DNA, 20 bp, Homo sapiens
accctgacctccgcccctgc

SEQ ID NO: 3598227 - DNA, 20 bp, Homo sapiens
accctgatttaggagaagcc

SEQ ID NO: 3598228 - DNA, 23 bp, Homo sapiens
accctgatttaggagaagccagg

SEQ ID NO: 3598229 - DNA, 20 bp, Homo sapiens
accctgcaagaccacggagg

SEQ ID NO: 3598230 - DNA, 16 bp, Homo sapiens
accctgcgcctccaga

SEQ ID NO: 3598231 - DNA, 22 bp, Homo sapiens
accctgcgcctccagaggtcct

SEQ ID NO: 3598232 - DNA, 21 bp, Homo sapiens
accctggcagggacctgagag

SEQ ID NO: 3598233 - DNA, 23 bp, Homo sapiens
accctggcagggacctgagagca

SEQ ID NO: 3598234 - DNA, 16 bp, Homo sapiens
accctggcctgaactg

SEQ ID NO: 3598235 - DNA, 17 bp, Homo sapiens
accctggtggttgctgt

SEQ ID NO: 3598236 - DNA, 15 bp, Homo sapiens
acccttaactgacat

SEQ ID NO: 3598237 - DNA, 22 bp, Homo sapiens
acccttcccgcctccctctcag

SEQ ID NO: 3598238 - DNA, 15 bp, Homo sapiens
acccttcctgctgct

SEQ ID NO: 3598239 - DNA, 19 bp, Homo sapiens
acccttcctgctgctgcta

SEQ ID NO: 3598240 - DNA, 20 bp, Homo sapiens
acccttctgggtccagggag

SEQ ID NO: 3598241 - DNA, 16 bp, Homo sapiens
acccttgattcattct

SEQ ID NO: 3598242 - DNA, 17 bp, Homo sapiens
acccttgattcattctg

SEQ ID NO: 3598243 - DNA, 14 bp, Homo sapiens
acccttgctttcct

SEQ ID NO: 3598244 - DNA, 15 bp, Homo sapiens
acccttgctttcctg

SEQ ID NO: 3598245 - DNA, 18 bp, Homo sapiens
acccttgctttcctgggc

SEQ ID NO: 3598246 - DNA, 22 bp, Homo sapiens
accctttcagaatcttttcaat

SEQ ID NO: 3598247 - DNA, 14 bp, Homo sapiens
acccttttccccct

SEQ ID NO: 3598248 - DNA, 21 bp, Homo sapiens
acccttttcccccttcccatt

SEQ ID NO: 3598249 - DNA, 17 bp, Homo sapiens
accgaccaactgcccta

SEQ ID NO: 3598250 - DNA, 16 bp, Homo sapiens
accgagccctggagag

SEQ ID NO: 3598251 - DNA, 17 bp, Homo sapiens
accgagccctggagagc

SEQ ID NO: 3598252 - DNA, 14 bp, Homo sapiens
accgaggttcccag

SEQ ID NO: 3598253 - DNA, 18 bp, Homo sapiens
accgatgtgtctcccaga

SEQ ID NO: 3598254 - DNA, 20 bp, Homo sapiens
accgcagaagcctccccagc

SEQ ID NO: 3598255 - DNA, 15 bp, Homo sapiens
accgcaggtgctcat

SEQ ID NO: 3598256 - DNA, 22 bp, Homo sapiens
accgcaggtgctcatgctgctc

SEQ ID NO: 3598257 - DNA, 16 bp, Homo sapiens
accgccacgtcccagc

SEQ ID NO: 3598258 - DNA, 15 bp, Homo sapiens
accgctggccctgcc

SEQ ID NO: 3598259 - DNA, 19 bp, Homo sapiens
accgctggccctgccgttt

SEQ ID NO: 3598260 - DNA, 15 bp, Homo sapiens
accggaaggaggcca

SEQ ID NO: 3598261 - DNA, 14 bp, Homo sapiens
accggattctctct

SEQ ID NO: 3598262 - DNA, 13 bp, Homo sapiens
accggccaggccg

SEQ ID NO: 3598263 - DNA, 23 bp, Homo sapiens
accggcggaccccagccatccag

SEQ ID NO: 3598264 - DNA, 13 bp, Homo sapiens
accgggacccgag

SEQ ID NO: 3598265 - DNA, 15 bp, Homo sapiens
accggtgctgcagga

SEQ ID NO: 3598266 - DNA, 16 bp, Homo sapiens
accgtacaaccccctc

SEQ ID NO: 3598267 - DNA, 15 bp, Homo sapiens
accgttcagtcattt

SEQ ID NO: 3598268 - DNA, 17 bp, Homo sapiens
accgtttagaaaaaaca

SEQ ID NO: 3598269 - DNA, 21 bp, Homo sapiens
acctaaagggactacctctgt

SEQ ID NO: 3598270 - DNA, 20 bp, Homo sapiens
acctaacaacattgtagcct

SEQ ID NO: 3598271 - DNA, 20 bp, Homo sapiens
acctaacacattaaatgtgg

SEQ ID NO: 3598272 - DNA, 22 bp, Homo sapiens
acctaatccaggcagatccagg

SEQ ID NO: 3598273 - DNA, 18 bp, Homo sapiens
acctaccccagccaggct

SEQ ID NO: 3598274 - DNA, 20 bp, Homo sapiens
acctagagacttcacccggg

SEQ ID NO: 3598275 - DNA, 21 bp, Homo sapiens
acctatgagatggccatgctc

SEQ ID NO: 3598276 - DNA, 22 bp, Homo sapiens
acctatgagatggccatgctca

SEQ ID NO: 3598277 - DNA, 21 bp, Homo sapiens
acctattctgaaaaagacata

SEQ ID NO: 3598278 - DNA, 14 bp, Homo sapiens
acctatttttcctt

SEQ ID NO: 3598279 - DNA, 15 bp, Homo sapiens
acctcaaggaagcta

SEQ ID NO: 3598280 - DNA, 22 bp, Homo sapiens
acctcaagtaataggcatttta

SEQ ID NO: 3598281 - DNA, 16 bp, Homo sapiens
acctcacctctttgtt

SEQ ID NO: 3598282 - DNA, 14 bp, Homo sapiens
acctcactggcctg

SEQ ID NO: 3598283 - DNA, 16 bp, Homo sapiens
acctcactggcctgcc

SEQ ID NO: 3598284 - DNA, 18 bp, Homo sapiens
acctcactggcctgccat

SEQ ID NO: 3598285 - DNA, 17 bp, Homo sapiens
acctcagattcttcatt

SEQ ID NO: 3598286 - DNA, 17 bp, Homo sapiens
acctcagcctggccaga

SEQ ID NO: 3598287 - DNA, 22 bp, Homo sapiens
acctcaggctcctaaagagaca

SEQ ID NO: 3598288 - DNA, 21 bp, Homo sapiens
acctcagtggatcttcagaac

SEQ ID NO: 3598289 - DNA, 13 bp, Homo sapiens
acctcatcagcct

SEQ ID NO: 3598290 - DNA, 14 bp, Homo sapiens
acctcatcagcctt

SEQ ID NO: 3598291 - DNA, 15 bp, Homo sapiens
acctcattctggttc

SEQ ID NO: 3598292 - DNA, 12 bp, Homo sapiens
acctccacaccc

SEQ ID NO: 3598293 - DNA, 10 bp, Homo sapiens
acctccagaa

SEQ ID NO: 3598294 - DNA, 14 bp, Homo sapiens
acctccagactcag

SEQ ID NO: 3598295 - DNA, 16 bp, Homo sapiens
acctccagactcagca

SEQ ID NO: 3598296 - DNA, 17 bp, Homo sapiens
acctccagactcagcag

SEQ ID NO: 3598297 - DNA, 21 bp, Homo sapiens
acctccagactcagcagagtg

SEQ ID NO: 3598298 - DNA, 14 bp, Homo sapiens
acctccagcctccc

SEQ ID NO: 3598299 - DNA, 18 bp, Homo sapiens
acctccagtgtcagggtc

SEQ ID NO: 3598300 - DNA, 22 bp, Homo sapiens
acctccccctttcacactggat

SEQ ID NO: 3598301 - DNA, 15 bp, Homo sapiens
acctccccgctggga

SEQ ID NO: 3598302 - DNA, 13 bp, Homo sapiens
actgccaagccag

SEQ ID NO: 3598303 - DNA, 14 bp, Homo sapiens
actgccaagccaga

SEQ ID NO: 3598304 - DNA, 13 bp, Homo sapiens
actgccagcaacg

SEQ ID NO: 3598305 - DNA, 12 bp, Homo sapiens
actgcccccaga

SEQ ID NO: 3598306 - DNA, 22 bp, Homo sapiens
actgcccctgctgtgctgctca

SEQ ID NO: 3598307 - DNA, 19 bp, Homo sapiens
actgccctaagcccccagg

SEQ ID NO: 3598308 - DNA, 16 bp, Homo sapiens
actgcccttgctgccc

SEQ ID NO: 3598309 - DNA, 15 bp, Homo sapiens
actgcctcttcctcc

SEQ ID NO: 3598310 - DNA, 12 bp, Homo sapiens
actgctattttt

SEQ ID NO: 3598311 - DNA, 22 bp, Homo sapiens
actgctcgtggactgtgctggt

SEQ ID NO: 3598312 - DNA, 18 bp, Homo sapiens
actgctctaacagccctc

SEQ ID NO: 3598313 - DNA, 18 bp, Homo sapiens
actgctctataaatagta

SEQ ID NO: 3598314 - DNA, 21 bp, Homo sapiens
actgctctcctccacctcaac

SEQ ID NO: 3598315 - DNA, 17 bp, Homo sapiens
actgctgagctggccct

SEQ ID NO: 3598316 - DNA, 13 bp, Homo sapiens
actgctgcagggt

SEQ ID NO: 3598317 - DNA, 14 bp, Homo sapiens
actgctggctgcct

SEQ ID NO: 3598318 - DNA, 23 bp, Homo sapiens
actgctgtcgttgttgtggaagc

SEQ ID NO: 3598319 - DNA, 15 bp, Homo sapiens
actgctgttatattt

SEQ ID NO: 3598320 - DNA, 18 bp, Homo sapiens
actgctgttatatttcat

SEQ ID NO: 3598321 - DNA, 17 bp, Homo sapiens
actgcttcctttcttga

SEQ ID NO: 3598322 - DNA, 23 bp, Homo sapiens
actggaaaggatctgtgattggc

SEQ ID NO: 3598323 - DNA, 18 bp, Homo sapiens
actggaattcttctgcaa

SEQ ID NO: 3598324 - DNA, 21 bp, Homo sapiens
actggaccactgggcaatgat

SEQ ID NO: 3598325 - DNA, 23 bp, Homo sapiens
actggacccttgattcattctga

SEQ ID NO: 3598326 - DNA, 12 bp, Homo sapiens
actggaggaggc

SEQ ID NO: 3598327 - DNA, 21 bp, Homo sapiens
actggagttccttatccctct

SEQ ID NO: 3598328 - DNA, 21 bp, Homo sapiens
actggatatttcaatctttta

SEQ ID NO: 3598329 - DNA, 22 bp, Homo sapiens
actggcaaaaggatctttgtgg

SEQ ID NO: 3598330 - DNA, 13 bp, Homo sapiens
actggcacagttt

SEQ ID NO: 3598331 - DNA, 19 bp, Homo sapiens
actggcacagttttctgag

SEQ ID NO: 3598332 - DNA, 20 bp, Homo sapiens
actggcacagttttctgaga

SEQ ID NO: 3598333 - DNA, 22 bp, Homo sapiens
actggcaggggagacaggagcc

SEQ ID NO: 3598334 - DNA, 16 bp, Homo sapiens
actggcccagtgccag

SEQ ID NO: 3598335 - DNA, 19 bp, Homo sapiens
actggccggagtcagtgcc

SEQ ID NO: 3598336 - DNA, 16 bp, Homo sapiens
actggcttccccactc

SEQ ID NO: 3598337 - DNA, 18 bp, Homo sapiens
actggctttggcttcttg

SEQ ID NO: 3598338 - DNA, 19 bp, Homo sapiens
actgggacagctggctggg

SEQ ID NO: 3598339 - DNA, 15 bp, Homo sapiens
actgggcactggggc

SEQ ID NO: 3598340 - DNA, 16 bp, Homo sapiens
actgggcatttcaatc

SEQ ID NO: 3598341 - DNA, 13 bp, Homo sapiens
actgggtctgcga

SEQ ID NO: 3598342 - DNA, 13 bp, Homo sapiens
actgggttaaata

SEQ ID NO: 3598343 - DNA, 20 bp, Homo sapiens
actggtggcccgacagcctg

SEQ ID NO: 3598344 - DNA, 23 bp, Homo sapiens
actggtggcccgacagcctggca

SEQ ID NO: 3598345 - DNA, 12 bp, Homo sapiens
actggtgggcca

SEQ ID NO: 3598346 - DNA, 11 bp, Homo sapiens
actggttaaac

SEQ ID NO: 3598347 - DNA, 15 bp, Homo sapiens
actggttctgaggcc

SEQ ID NO: 3598348 - DNA, 16 bp, Homo sapiens
actggttctgaggcca

SEQ ID NO: 3598349 - DNA, 13 bp, Homo sapiens
actggtttataat

SEQ ID NO: 3598350 - DNA, 17 bp, Homo sapiens
actggtttataataaac

SEQ ID NO: 3598351 - DNA, 17 bp, Homo sapiens
actggtttgttccctgt

SEQ ID NO: 3598352 - DNA, 12 bp, Homo sapiens
actgtaagcttt

SEQ ID NO: 3598353 - DNA, 21 bp, Homo sapiens
actgtaatacgtagctctctt

SEQ ID NO: 3598354 - DNA, 15 bp, Homo sapiens
actgtaatgctgcct

SEQ ID NO: 3598355 - DNA, 15 bp, Homo sapiens
actgtagcaggggaa

SEQ ID NO: 3598356 - DNA, 19 bp, Homo sapiens
actgtagctctaaaatctg

SEQ ID NO: 3598357 - DNA, 12 bp, Homo sapiens
actgtaggtgtt

SEQ ID NO: 3598358 - DNA, 14 bp, Homo sapiens
actgtatggaaaca

SEQ ID NO: 3598359 - DNA, 22 bp, Homo sapiens
actgtatggaaacactgatttt

SEQ ID NO: 3598360 - DNA, 21 bp, Homo sapiens
actgtcagctcccctcggaga

SEQ ID NO: 3598361 - DNA, 23 bp, Homo sapiens
actgtcagctcccctcggagaag

SEQ ID NO: 3598362 - DNA, 14 bp, Homo sapiens
actgtcagtggggc

SEQ ID NO: 3598363 - DNA, 16 bp, Homo sapiens
actgtcctattatatt

SEQ ID NO: 3598364 - DNA, 18 bp, Homo sapiens
actgtcctccaagccagc

SEQ ID NO: 3598365 - DNA, 14 bp, Homo sapiens
actgtcctgggcct

SEQ ID NO: 3598366 - DNA, 19 bp, Homo sapiens
actgtcctgggcctgcaga

SEQ ID NO: 3598367 - DNA, 12 bp, Homo sapiens
actgtcctgtcc

SEQ ID NO: 3598368 - DNA, 13 bp, Homo sapiens
actgtcctgtcct

SEQ ID NO: 3598369 - DNA, 17 bp, Homo sapiens
actgtcctgtcctgctc

SEQ ID NO: 3598370 - DNA, 19 bp, Homo sapiens
actgtctcaagagggcact

SEQ ID NO: 3598371 - DNA, 20 bp, Homo sapiens
actgtctcaagagggcactg

SEQ ID NO: 3598372 - DNA, 23 bp, Homo sapiens
actgtctcaagagggcactggtg

SEQ ID NO: 3598373 - DNA, 21 bp, Homo sapiens
actgtgaacttgactgggtga

SEQ ID NO: 3598374 - DNA, 16 bp, Homo sapiens
actgtgaaggaccctt

SEQ ID NO: 3598375 - DNA, 24 bp, Homo sapiens
actgtgcagacccagtcccacact

SEQ ID NO: 3598376 - DNA, 20 bp, Homo sapiens
actgtggacctctatcatct

SEQ ID NO: 3598377 - DNA, 13 bp, Homo sapiens
actgtggccaggc

SEQ ID NO: 3598378 - DNA, 15 bp, Homo sapiens
actgtggccaggcct

SEQ ID NO: 3598379 - DNA, 14 bp, Homo sapiens
actgtggcctgcag

SEQ ID NO: 3598380 - DNA, 16 bp, Homo sapiens
actgttaactatgaca

SEQ ID NO: 3598381 - DNA, 19 bp, Homo sapiens
actgttaactatgacagat

SEQ ID NO: 3598382 - DNA, 18 bp, Homo sapiens
actgttcttcattttatt

SEQ ID NO: 3598383 - DNA, 16 bp, Homo sapiens
actgttgggacagcca

SEQ ID NO: 3598384 - DNA, 16 bp, Homo sapiens
actgtttccctgctga

SEQ ID NO: 3598385 - DNA, 14 bp, Homo sapiens
actgtttctttaaa

SEQ ID NO: 3598386 - DNA, 16 bp, Homo sapiens
acttaaaaaatcagaa

SEQ ID NO: 3598387 - DNA, 12 bp, Homo sapiens
acttaaaagtat

SEQ ID NO: 3598388 - DNA, 18 bp, Homo sapiens
acttaaaagtattcatac

SEQ ID NO: 3598389 - DNA, 13 bp, Homo sapiens
acttaaacaaaaa

SEQ ID NO: 3598390 - DNA, 19 bp, Homo sapiens
acttaaatttgttctttgt

SEQ ID NO: 3598391 - DNA, 15 bp, Homo sapiens
acttaagagtggcat

SEQ ID NO: 3598392 - DNA, 17 bp, Homo sapiens
acttaagcatctggctc

SEQ ID NO: 3598393 - DNA, 13 bp, Homo sapiens
acttaatgtatgt

SEQ ID NO: 3598394 - DNA, 18 bp, Homo sapiens
acttaattgccagcaaat

SEQ ID NO: 3598395 - DNA, 17 bp, Homo sapiens
acttacactttatgcac

SEQ ID NO: 3598396 - DNA, 19 bp, Homo sapiens
acttacatatttattttta

SEQ ID NO: 3598397 - DNA, 18 bp, Homo sapiens
acttactgcgactaaact

SEQ ID NO: 3598398 - DNA, 16 bp, Homo sapiens
acttagaaattgcatt

SEQ ID NO: 3598399 - DNA, 20 bp, Homo sapiens
acttagaggtggggagcaga

SEQ ID NO: 3598400 - DNA, 20 bp, Homo sapiens
acttagagtttctgtttgat

SEQ ID NO: 3598401 - DNA, 20 bp, Homo sapiens
acttaggactagaagattag

SEQ ID NO: 3598402 - DNA, 17 bp, Homo sapiens
acttaggagaagtcttc

SEQ ID NO: 3598403 - DNA, 20 bp, Homo sapiens
acttataaaataacttgcat

SEQ ID NO: 3598404 - DNA, 14 bp, Homo sapiens
acttatagtacatg

SEQ ID NO: 3598405 - DNA, 18 bp, Homo sapiens
acttatagtacatgataa

SEQ ID NO: 3598406 - DNA, 19 bp, Homo sapiens
acttattattaataatgaa

SEQ ID NO: 3598407 - DNA, 20 bp, Homo sapiens
acttattattaataatgaag

SEQ ID NO: 3598408 - DNA, 17 bp, Homo sapiens
acttatttatgaacctg

SEQ ID NO: 3598409 - DNA, 11 bp, Homo sapiens
acttatttctg

SEQ ID NO: 3598410 - DNA, 16 bp, Homo sapiens
acttatttttgacagt

SEQ ID NO: 3598411 - DNA, 17 bp, Homo sapiens
acttcaaagtgcctggg

SEQ ID NO: 3598412 - DNA, 20 bp, Homo sapiens
acttcaggctcttctccttt

SEQ ID NO: 3598413 - DNA, 22 bp, Homo sapiens
acttcagtgaatatttttgtat

SEQ ID NO: 3598414 - DNA, 22 bp, Homo sapiens
acttcagtgtggtacaaggtgg

SEQ ID NO: 3598415 - DNA, 18 bp, Homo sapiens
acttccaatttacatact

SEQ ID NO: 3598416 - DNA, 19 bp, Homo sapiens
acttccaggaaagtgtgaa

SEQ ID NO: 3598417 - DNA, 19 bp, Homo sapiens
acttccccctcttcttctg

SEQ ID NO: 3598418 - DNA, 20 bp, Homo sapiens
acttcctctggctccccaag

SEQ ID NO: 3598419 - DNA, 15 bp, Homo sapiens
acttcctgaggcctc

SEQ ID NO: 3598420 - DNA, 18 bp, Homo sapiens
acttcctgctgcaccctg

SEQ ID NO: 3598421 - DNA, 19 bp, Homo sapiens
acttcctgctgcaccctgc

SEQ ID NO: 3598422 - DNA, 21 bp, Homo sapiens
acttctaagtaaaaccacagc

SEQ ID NO: 3598423 - DNA, 17 bp, Homo sapiens
acttctcaaagagaatt

SEQ ID NO: 3598424 - DNA, 17 bp, Homo sapiens
acttctcttgctttcta

SEQ ID NO: 3598425 - DNA, 21 bp, Homo sapiens
acttctcttgttaggtaattt

SEQ ID NO: 3598426 - DNA, 22 bp, Homo sapiens
acttctctttcttattttgtaa

SEQ ID NO: 3598427 - DNA, 14 bp, Homo sapiens
acttctggccacat

SEQ ID NO: 3598428 - DNA, 23 bp, Homo sapiens
acttcttagggattaaatataga

SEQ ID NO: 3598429 - DNA, 11 bp, Homo sapiens
acttcttcctg

SEQ ID NO: 3598430 - DNA, 20 bp, Homo sapiens
acttcttgaaggtgctgacg

SEQ ID NO: 3598431 - DNA, 11 bp, Homo sapiens
acttcttgctt

SEQ ID NO: 3598432 - DNA, 22 bp, Homo sapiens
acttgaagggccagagccaggg

SEQ ID NO: 3598433 - DNA, 21 bp, Homo sapiens
acttgatatttaagcagcttg

SEQ ID NO: 3598434 - DNA, 18 bp, Homo sapiens
agcagggaccgggcgcag

SEQ ID NO: 3598435 - DNA, 21 bp, Homo sapiens
agcagggaccgggcgcagccc

SEQ ID NO: 3598436 - DNA, 22 bp, Homo sapiens
agcagggaccgggcgcagccct

SEQ ID NO: 3598437 - DNA, 17 bp, Homo sapiens
agcagggatgccctgga

SEQ ID NO: 3598438 - DNA, 22 bp, Homo sapiens
agcaggggaattccctccccct

SEQ ID NO: 3598439 - DNA, 15 bp, Homo sapiens
agcaggggggctgtg

SEQ ID NO: 3598440 - DNA, 17 bp, Homo sapiens
agcaggggggctgtgcc

SEQ ID NO: 3598441 - DNA, 19 bp, Homo sapiens
agcaggggggctgtgccaa

SEQ ID NO: 3598442 - DNA, 20 bp, Homo sapiens
agcaggggggctgtgccaac

SEQ ID NO: 3598443 - DNA, 23 bp, Homo sapiens
agcaggggggctgtgccaacctg

SEQ ID NO: 3598444 - DNA, 13 bp, Homo sapiens
agcagggtccaca

SEQ ID NO: 3598445 - DNA, 19 bp, Homo sapiens
agcaggtacatttctgatt

SEQ ID NO: 3598446 - DNA, 20 bp, Homo sapiens
agcaggttccccaagggccc

SEQ ID NO: 3598447 - DNA, 21 bp, Homo sapiens
agcaggttccccaagggccct

SEQ ID NO: 3598448 - DNA, 16 bp, Homo sapiens
agcagtctaaattttc

SEQ ID NO: 3598449 - DNA, 19 bp, Homo sapiens
agcagtctccttcagcacg

SEQ ID NO: 3598450 - DNA, 19 bp, Homo sapiens
agcagtctgataaactgac

SEQ ID NO: 3598451 - DNA, 19 bp, Homo sapiens
agcagtgttgcgtttttcc

SEQ ID NO: 3598452 - DNA, 21 bp, Homo sapiens
agcagtgttgcgtttttcctt

SEQ ID NO: 3598453 - DNA, 13 bp, Homo sapiens
agcagttcattct

SEQ ID NO: 3598454 - DNA, 17 bp, Homo sapiens
agcagttcctgtcccac

SEQ ID NO: 3598455 - DNA, 22 bp, Homo sapiens
agcagtttccagagagtggaga

SEQ ID NO: 3598456 - DNA, 17 bp, Homo sapiens
agcagtttcctcagtga

SEQ ID NO: 3598457 - DNA, 14 bp, Homo sapiens
agcagtttgctttg

SEQ ID NO: 3598458 - DNA, 21 bp, Homo sapiens
agcataatttaaaaatatatt

SEQ ID NO: 3598459 - DNA, 18 bp, Homo sapiens
agcatataaatgtttata

SEQ ID NO: 3598460 - DNA, 14 bp, Homo sapiens
agcatatcccacca

SEQ ID NO: 3598461 - DNA, 17 bp, Homo sapiens
agcatatgttagcatta

SEQ ID NO: 3598462 - DNA, 21 bp, Homo sapiens
agcatatgttagcattaaagt

SEQ ID NO: 3598463 - DNA, 19 bp, Homo sapiens
agcatatttgccaataaag

SEQ ID NO: 3598464 - DNA, 14 bp, Homo sapiens
agcatcacccacct

SEQ ID NO: 3598465 - DNA, 16 bp, Homo sapiens
agcatccagtgtgaga

SEQ ID NO: 3598466 - DNA, 21 bp, Homo sapiens
agcatccagtgtgagatactg

SEQ ID NO: 3598467 - DNA, 13 bp, Homo sapiens
agcatccctggag

SEQ ID NO: 3598468 - DNA, 21 bp, Homo sapiens
agcatccctggagcaggagcc

SEQ ID NO: 3598469 - DNA, 11 bp, Homo sapiens
agcatcctgat

SEQ ID NO: 3598470 - DNA, 18 bp, Homo sapiens
agcatcctgataccattc

SEQ ID NO: 3598471 - DNA, 20 bp, Homo sapiens
agcatcctgataccattcta

SEQ ID NO: 3598472 - DNA, 19 bp, Homo sapiens
agcatcgcttaggagaagt

SEQ ID NO: 3598473 - DNA, 22 bp, Homo sapiens
agcatcgggagcacccagagca

SEQ ID NO: 3598474 - DNA, 16 bp, Homo sapiens
agcatctggctctaat

SEQ ID NO: 3598475 - DNA, 19 bp, Homo sapiens
agcatcttgcatccaaacc

SEQ ID NO: 3598476 - DNA, 19 bp, Homo sapiens
agcatgaaataaaatatat

SEQ ID NO: 3598477 - DNA, 15 bp, Homo sapiens
agcatgaataaaaca

SEQ ID NO: 3598478 - DNA, 20 bp, Homo sapiens
agcatgaataaaacactcat

SEQ ID NO: 3598479 - DNA, 23 bp, Homo sapiens
agcatgaataaaacactcatccc

SEQ ID NO: 3598480 - DNA, 13 bp, Homo sapiens
agcatgcacatgc

SEQ ID NO: 3598481 - DNA, 21 bp, Homo sapiens
agcatgctgtgattgtgccta

SEQ ID NO: 3598482 - DNA, 20 bp, Homo sapiens
agcatgcttgggctgaccca

SEQ ID NO: 3598483 - DNA, 13 bp, Homo sapiens
agcatggaaaaat

SEQ ID NO: 3598484 - DNA, 16 bp, Homo sapiens
agcatggaaaaatggt

SEQ ID NO: 3598485 - DNA, 17 bp, Homo sapiens
agcatggagacagcagt

SEQ ID NO: 3598486 - DNA, 13 bp, Homo sapiens
agcatggcagctg

SEQ ID NO: 3598487 - DNA, 17 bp, Homo sapiens
agcatggcatagccccg

SEQ ID NO: 3598488 - DNA, 20 bp, Homo sapiens
agcatggcatagccccggcc

SEQ ID NO: 3598489 - DNA, 13 bp, Homo sapiens
agcatggggccag

SEQ ID NO: 3598490 - DNA, 14 bp, Homo sapiens
agcatggggccagg

SEQ ID NO: 3598491 - DNA, 15 bp, Homo sapiens
agcatggggccagga

SEQ ID NO: 3598492 - DNA, 16 bp, Homo sapiens
agcatggggccaggaa

SEQ ID NO: 3598493 - DNA, 14 bp, Homo sapiens
agcattatcttatc

SEQ ID NO: 3598494 - DNA, 15 bp, Homo sapiens
agcattatcttatca

SEQ ID NO: 3598495 - DNA, 13 bp, Homo sapiens
agcattgcagcct

SEQ ID NO: 3598496 - DNA, 21 bp, Homo sapiens
agcattgcagcctaagaagaa

SEQ ID NO: 3598497 - DNA, 17 bp, Homo sapiens
agcattgtaaatgtgct

SEQ ID NO: 3598498 - DNA, 21 bp, Homo sapiens
agcattgtcaccgcaggtgct

SEQ ID NO: 3598499 - DNA, 15 bp, Homo sapiens
agcattgtgtggaat

SEQ ID NO: 3598500 - DNA, 16 bp, Homo sapiens
agcattgtgtggaatt

SEQ ID NO: 3598501 - DNA, 12 bp, Homo sapiens
agcatttactat

SEQ ID NO: 3598502 - DNA, 11 bp, Homo sapiens
agcatttcatg

SEQ ID NO: 3598503 - DNA, 23 bp, Homo sapiens
agcatttttaagggagtggcctc

SEQ ID NO: 3598504 - DNA, 15 bp, Homo sapiens
agccaaacccactct

SEQ ID NO: 3598505 - DNA, 19 bp, Homo sapiens
agccaaagaaacaagctgt

SEQ ID NO: 3598506 - DNA, 22 bp, Homo sapiens
agccaaagaaacaagctgtgca

SEQ ID NO: 3598507 - DNA, 19 bp, Homo sapiens
agccaaatgaccgagccct

SEQ ID NO: 3598508 - DNA, 22 bp, Homo sapiens
agccaaatgaccgagccctgga

SEQ ID NO: 3598509 - DNA, 17 bp, Homo sapiens
agccaactatgattatt

SEQ ID NO: 3598510 - DNA, 20 bp, Homo sapiens
agccaactatgattattaac

SEQ ID NO: 3598511 - DNA, 17 bp, Homo sapiens
agccaactgtttccctg

SEQ ID NO: 3598512 - DNA, 20 bp, Homo sapiens
agccaactgtttccctgctg

SEQ ID NO: 3598513 - DNA, 14 bp, Homo sapiens
agccaagctggcac

SEQ ID NO: 3598514 - DNA, 18 bp, Homo sapiens
agccaagctggcacaaaa

SEQ ID NO: 3598515 - DNA, 20 bp, Homo sapiens
agccaagctggcacaaaaga

SEQ ID NO: 3598516 - DNA, 14 bp, Homo sapiens
agccaaggcagcga

SEQ ID NO: 3598517 - DNA, 19 bp, Homo sapiens
agccaaggcagcgacccca

SEQ ID NO: 3598518 - DNA, 18 bp, Homo sapiens
agccaagggatggacatc

SEQ ID NO: 3598519 - DNA, 20 bp, Homo sapiens
agccaagggatggacatctt

SEQ ID NO: 3598520 - DNA, 18 bp, Homo sapiens
agccaagtgccaaatgct

SEQ ID NO: 3598521 - DNA, 19 bp, Homo sapiens
agccaagttccaaaataaa

SEQ ID NO: 3598522 - DNA, 13 bp, Homo sapiens
agccaatgctgtc

SEQ ID NO: 3598523 - DNA, 13 bp, Homo sapiens
agccacatcttgc

SEQ ID NO: 3598524 - DNA, 14 bp, Homo sapiens
agccaccctgggct

SEQ ID NO: 3598525 - DNA, 15 bp, Homo sapiens
agccaccgaagccgc

SEQ ID NO: 3598526 - DNA, 12 bp, Homo sapiens
agccacctggga

SEQ ID NO: 3598527 - DNA, 22 bp, Homo sapiens
agccactccccagccagcctgg

SEQ ID NO: 3598528 - DNA, 13 bp, Homo sapiens
agccactgtgata

SEQ ID NO: 3598529 - DNA, 17 bp, Homo sapiens
agccactgtgcttggcc

SEQ ID NO: 3598530 - DNA, 14 bp, Homo sapiens
agccacttccccct

SEQ ID NO: 3598531 - DNA, 22 bp, Homo sapiens
agccacttccccctcttcttct

SEQ ID NO: 3598532 - DNA, 17 bp, Homo sapiens
agccagattctcttgaa

SEQ ID NO: 3598533 - DNA, 20 bp, Homo sapiens
agccagattctcttgaataa

SEQ ID NO: 3598534 - DNA, 22 bp, Homo sapiens
agccagcagagggggagtagcc

SEQ ID NO: 3598535 - DNA, 10 bp, Homo sapiens
agccagccac

SEQ ID NO: 3598536 - DNA, 20 bp, Homo sapiens
agccagccacagacccctgg

SEQ ID NO: 3598537 - DNA, 14 bp, Homo sapiens
agccagcccttccc

SEQ ID NO: 3598538 - DNA, 21 bp, Homo sapiens
agccagcccttccctggcccc

SEQ ID NO: 3598539 - DNA, 19 bp, Homo sapiens
agccagcctgcttcccaca

SEQ ID NO: 3598540 - DNA, 16 bp, Homo sapiens
agccagcctggctctg

SEQ ID NO: 3598541 - DNA, 17 bp, Homo sapiens
agccagcctggctggga

SEQ ID NO: 3598542 - DNA, 17 bp, Homo sapiens
agccaggaatttcccag

SEQ ID NO: 3598543 - DNA, 11 bp, Homo sapiens
agccaggactc

SEQ ID NO: 3598544 - DNA, 12 bp, Homo sapiens
agccaggactcc

SEQ ID NO: 3598545 - DNA, 20 bp, Homo sapiens
agccaggactcccagaacct

SEQ ID NO: 3598546 - DNA, 21 bp, Homo sapiens
agccaggactcccagaacctc

SEQ ID NO: 3598547 - DNA, 18 bp, Homo sapiens
agccaggccaacagcacc

SEQ ID NO: 3598548 - DNA, 14 bp, Homo sapiens
agccaggctcagga

SEQ ID NO: 3598549 - DNA, 15 bp, Homo sapiens
agccaggctcaggag

SEQ ID NO: 3598550 - DNA, 17 bp, Homo sapiens
agccaggctcaggagaa

SEQ ID NO: 3598551 - DNA, 20 bp, Homo sapiens
agccaggctcaggagaagcc

SEQ ID NO: 3598552 - DNA, 21 bp, Homo sapiens
agccaggctcaggagaagcca

SEQ ID NO: 3598553 - DNA, 22 bp, Homo sapiens
agccaggctcaggagaagccag

SEQ ID NO: 3598554 - DNA, 11 bp, Homo sapiens
agccaggctcc

SEQ ID NO: 3598555 - DNA, 13 bp, Homo sapiens
agccaggctccta

SEQ ID NO: 3598556 - DNA, 19 bp, Homo sapiens
agccagggcccctggatct

SEQ ID NO: 3598557 - DNA, 13 bp, Homo sapiens
agccagggctcaa

SEQ ID NO: 3598558 - DNA, 18 bp, Homo sapiens
agccaggtacaggagagg

SEQ ID NO: 3598559 - DNA, 20 bp, Homo sapiens
agccagtgtctaggcactga

SEQ ID NO: 3598560 - DNA, 18 bp, Homo sapiens
agccatacataaaagaaa

SEQ ID NO: 3598561 - DNA, 22 bp, Homo sapiens
agccatacataaaagaaataaa

SEQ ID NO: 3598562 - DNA, 15 bp, Homo sapiens
agccataggtgcagt

SEQ ID NO: 3598563 - DNA, 21 bp, Homo sapiens
agccatccctttttttacatt

SEQ ID NO: 3598564 - DNA, 14 bp, Homo sapiens
agccatgataatag

SEQ ID NO: 3598565 - DNA, 15 bp, Homo sapiens
agccatgtataaatg

SEQ ID NO: 3598566 - DNA, 18 bp, Homo sapiens
aggactcctggcagggcc

SEQ ID NO: 3598567 - DNA, 18 bp, Homo sapiens
aggactctctccaggagg

SEQ ID NO: 3598568 - DNA, 12 bp, Homo sapiens
aggactctgcct

SEQ ID NO: 3598569 - DNA, 17 bp, Homo sapiens
aggactctgcctcctct

SEQ ID NO: 3598570 - DNA, 18 bp, Homo sapiens
aggactggttctgaggcc

SEQ ID NO: 3598571 - DNA, 19 bp, Homo sapiens
aggactggttctgaggcca

SEQ ID NO: 3598572 - DNA, 20 bp, Homo sapiens
aggactggttctgaggccag

SEQ ID NO: 3598573 - DNA, 20 bp, Homo sapiens
aggacttcctgtccagctcc

SEQ ID NO: 3598574 - DNA, 16 bp, Homo sapiens
aggacttgtgtctctg

SEQ ID NO: 3598575 - DNA, 16 bp, Homo sapiens
aggagaaaaagaagaa

SEQ ID NO: 3598576 - DNA, 18 bp, Homo sapiens
aggagaaagcaaaataca

SEQ ID NO: 3598577 - DNA, 14 bp, Homo sapiens
aggagaagcaatgg

SEQ ID NO: 3598578 - DNA, 13 bp, Homo sapiens
aggagaagccagg

SEQ ID NO: 3598579 - DNA, 21 bp, Homo sapiens
aggagaagtcttctatttatt

SEQ ID NO: 3598580 - DNA, 12 bp, Homo sapiens
aggagaatcact

SEQ ID NO: 3598581 - DNA, 20 bp, Homo sapiens
aggagaatggcatggcagga

SEQ ID NO: 3598582 - DNA, 22 bp, Homo sapiens
aggagaatggcatggcaggagt

SEQ ID NO: 3598583 - DNA, 18 bp, Homo sapiens
aggagagactgagcagcc

SEQ ID NO: 3598584 - DNA, 12 bp, Homo sapiens
aggagagagacc

SEQ ID NO: 3598585 - DNA, 15 bp, Homo sapiens
aggagagagccagga

SEQ ID NO: 3598586 - DNA, 15 bp, Homo sapiens
aggagagcctggggg

SEQ ID NO: 3598587 - DNA, 20 bp, Homo sapiens
aggagagggcgctcctctct

SEQ ID NO: 3598588 - DNA, 16 bp, Homo sapiens
aggagataaggtggct

SEQ ID NO: 3598589 - DNA, 22 bp, Homo sapiens
aggagatgaccagggatgctgg

SEQ ID NO: 3598590 - DNA, 23 bp, Homo sapiens
aggagccaaatgaccgagccctg

SEQ ID NO: 3598591 - DNA, 14 bp, Homo sapiens
aggagccaccagtt

SEQ ID NO: 3598592 - DNA, 17 bp, Homo sapiens
aggagccaccagttctc

SEQ ID NO: 3598593 - DNA, 13 bp, Homo sapiens
aggagccagcctg

SEQ ID NO: 3598594 - DNA, 20 bp, Homo sapiens
aggagccagcctgcttccca

SEQ ID NO: 3598595 - DNA, 20 bp, Homo sapiens
aggagccccgccaggtgccc

SEQ ID NO: 3598596 - DNA, 21 bp, Homo sapiens
aggagccccgccaggtgcccg

SEQ ID NO: 3598597 - DNA, 16 bp, Homo sapiens
aggagccgaagcccag

SEQ ID NO: 3598598 - DNA, 18 bp, Homo sapiens
aggagcctagcggagccc

SEQ ID NO: 3598599 - DNA, 19 bp, Homo sapiens
aggagcctggccaggcagg

SEQ ID NO: 3598600 - DNA, 22 bp, Homo sapiens
aggagcctggccaggcagggag

SEQ ID NO: 3598601 - DNA, 20 bp, Homo sapiens
aggagcctgtgcgtcccagc

SEQ ID NO: 3598602 - DNA, 23 bp, Homo sapiens
aggagcctgtgcgtcccagctga

SEQ ID NO: 3598603 - DNA, 19 bp, Homo sapiens
aggagccttttgctctctg

SEQ ID NO: 3598604 - DNA, 13 bp, Homo sapiens
aggagcgcaggca

SEQ ID NO: 3598605 - DNA, 18 bp, Homo sapiens
aggagctagtaggaatgt

SEQ ID NO: 3598606 - DNA, 19 bp, Homo sapiens
aggagctgctatagcctgg

SEQ ID NO: 3598607 - DNA, 12 bp, Homo sapiens
aggagctgggga

SEQ ID NO: 3598608 - DNA, 19 bp, Homo sapiens
aggagcttctcccagtgtg

SEQ ID NO: 3598609 - DNA, 13 bp, Homo sapiens
aggaggaagctta

SEQ ID NO: 3598610 - DNA, 18 bp, Homo sapiens
aggaggattcgagcatca

SEQ ID NO: 3598611 - DNA, 14 bp, Homo sapiens
aggaggcctgtccc

SEQ ID NO: 3598612 - DNA, 16 bp, Homo sapiens
aggaggctgaggcagg

SEQ ID NO: 3598613 - DNA, 12 bp, Homo sapiens
aggagggccagc

SEQ ID NO: 3598614 - DNA, 19 bp, Homo sapiens
aggagggggcaggctgagg

SEQ ID NO: 3598615 - DNA, 14 bp, Homo sapiens
aggaggggggaggg

SEQ ID NO: 3598616 - DNA, 17 bp, Homo sapiens
aggaggggggagggaag

SEQ ID NO: 3598617 - DNA, 19 bp, Homo sapiens
aggagggttggagtgctct

SEQ ID NO: 3598618 - DNA, 22 bp, Homo sapiens
aggaggtgaaatccctgcctca

SEQ ID NO: 3598619 - DNA, 13 bp, Homo sapiens
aggaggtgggcca

SEQ ID NO: 3598620 - DNA, 21 bp, Homo sapiens
aggagtccctgccatcatgtt

SEQ ID NO: 3598621 - DNA, 16 bp, Homo sapiens
aggagtctgattgcag

SEQ ID NO: 3598622 - DNA, 18 bp, Homo sapiens
aggagtttatccatcctg

SEQ ID NO: 3598623 - DNA, 12 bp, Homo sapiens
aggataaaataa

SEQ ID NO: 3598624 - DNA, 17 bp, Homo sapiens
aggataacttgctttct

SEQ ID NO: 3598625 - DNA, 19 bp, Homo sapiens
aggatagatgctggcccag

SEQ ID NO: 3598626 - DNA, 21 bp, Homo sapiens
aggatagatgctggcccaggg

SEQ ID NO: 3598627 - DNA, 22 bp, Homo sapiens
aggatagatgctggcccagggc

SEQ ID NO: 3598628 - DNA, 13 bp, Homo sapiens
aggatatatttta

SEQ ID NO: 3598629 - DNA, 21 bp, Homo sapiens
aggatatcggcatttgtttct

SEQ ID NO: 3598630 - DNA, 18 bp, Homo sapiens
aggatccagggcagcagg

SEQ ID NO: 3598631 - DNA, 20 bp, Homo sapiens
aggatccagggcagcaggcc

SEQ ID NO: 3598632 - DNA, 21 bp, Homo sapiens
aggatccagggcagcaggcca

SEQ ID NO: 3598633 - DNA, 22 bp, Homo sapiens
aggatccagggcagcaggccag

SEQ ID NO: 3598634 - DNA, 15 bp, Homo sapiens
aggatccgtgctgtc

SEQ ID NO: 3598635 - DNA, 19 bp, Homo sapiens
aggatctctaaagagcatc

SEQ ID NO: 3598636 - DNA, 13 bp, Homo sapiens
aggatctttgtgg

SEQ ID NO: 3598637 - DNA, 16 bp, Homo sapiens
aggatgctaacatcta

SEQ ID NO: 3598638 - DNA, 21 bp, Homo sapiens
aggatgtgatatataagtgta

SEQ ID NO: 3598639 - DNA, 16 bp, Homo sapiens
aggattaactaaagaa

SEQ ID NO: 3598640 - DNA, 14 bp, Homo sapiens
aggattctctgcag

SEQ ID NO: 3598641 - DNA, 21 bp, Homo sapiens
aggcaaacaatcccaatcttt

SEQ ID NO: 3598642 - DNA, 21 bp, Homo sapiens
aggcaaagataatttatttca

SEQ ID NO: 3598643 - DNA, 14 bp, Homo sapiens
aggcaaaggcctgg

SEQ ID NO: 3598644 - DNA, 15 bp, Homo sapiens
aggcaaggccctgcc

SEQ ID NO: 3598645 - DNA, 16 bp, Homo sapiens
aggcaaggccctgccc

SEQ ID NO: 3598646 - DNA, 12 bp, Homo sapiens
aggcaattagac

SEQ ID NO: 3598647 - DNA, 15 bp, Homo sapiens
aggcacaccttgcag

SEQ ID NO: 3598648 - DNA, 14 bp, Homo sapiens
aggcacactttctg

SEQ ID NO: 3598649 - DNA, 19 bp, Homo sapiens
aggcacactttctggcaaa

SEQ ID NO: 3598650 - DNA, 18 bp, Homo sapiens
aggcacagtgggagctga

SEQ ID NO: 3598651 - DNA, 19 bp, Homo sapiens
aggcacagtgggagctgag

SEQ ID NO: 3598652 - DNA, 20 bp, Homo sapiens
aggcacagtgggagctgagc

SEQ ID NO: 3598653 - DNA, 22 bp, Homo sapiens
aggcacagtgggagctgagctg

SEQ ID NO: 3598654 - DNA, 18 bp, Homo sapiens
aggcaccgtccaggcccc

SEQ ID NO: 3598655 - DNA, 20 bp, Homo sapiens
aggcacctcacaggccccag

SEQ ID NO: 3598656 - DNA, 16 bp, Homo sapiens
aggcactccaaacctg

SEQ ID NO: 3598657 - DNA, 14 bp, Homo sapiens
aggcactgagcagg

SEQ ID NO: 3598658 - DNA, 16 bp, Homo sapiens
aggcactgagcaggga

SEQ ID NO: 3598659 - DNA, 19 bp, Homo sapiens
aggcactgagcagggatct

SEQ ID NO: 3598660 - DNA, 14 bp, Homo sapiens
aggcactgctgccc

SEQ ID NO: 3598661 - DNA, 20 bp, Homo sapiens
aggcagagtggcgtggcctc

SEQ ID NO: 3598662 - DNA, 20 bp, Homo sapiens
aggcagcatgcttgggctga

SEQ ID NO: 3598663 - DNA, 13 bp, Homo sapiens
aggcagcgcaggg

SEQ ID NO: 3598664 - DNA, 14 bp, Homo sapiens
aggcagctgaaatt

SEQ ID NO: 3598665 - DNA, 23 bp, Homo sapiens
aggcaggaccttcgggctgtgcc

SEQ ID NO: 3598666 - DNA, 14 bp, Homo sapiens
aggcaggcggctcc

SEQ ID NO: 3598667 - DNA, 15 bp, Homo sapiens
aggcaggcggctcct

SEQ ID NO: 3598668 - DNA, 18 bp, Homo sapiens
aggcaggcggctcctcct

SEQ ID NO: 3598669 - DNA, 18 bp, Homo sapiens
aggcagggacctaaaggg

SEQ ID NO: 3598670 - DNA, 22 bp, Homo sapiens
aggcagggacctaaagggacta

SEQ ID NO: 3598671 - DNA, 14 bp, Homo sapiens
aggcaggggaatgt

SEQ ID NO: 3598672 - DNA, 16 bp, Homo sapiens
aggcaggggaatgtat

SEQ ID NO: 3598673 - DNA, 15 bp, Homo sapiens
aggcagggggccctg

SEQ ID NO: 3598674 - DNA, 20 bp, Homo sapiens
aggcagggggccctgcccca

SEQ ID NO: 3598675 - DNA, 22 bp, Homo sapiens
aggcaggtgcttttggcagaga

SEQ ID NO: 3598676 - DNA, 21 bp, Homo sapiens
aggcatactgccttgtttaat

SEQ ID NO: 3598677 - DNA, 15 bp, Homo sapiens
aggcatacttttcaa

SEQ ID NO: 3598678 - DNA, 17 bp, Homo sapiens
aggcatacttttcaaag

SEQ ID NO: 3598679 - DNA, 13 bp, Homo sapiens
aggcatgagccac

SEQ ID NO: 3598680 - DNA, 11 bp, Homo sapiens
aggcatgagct

SEQ ID NO: 3598681 - DNA, 20 bp, Homo sapiens
aggcatggtcccttaaggca

SEQ ID NO: 3598682 - DNA, 21 bp, Homo sapiens
aggcatggtcccttaaggcac

SEQ ID NO: 3598683 - DNA, 17 bp, Homo sapiens
aggcatgtgtctggccc

SEQ ID NO: 3598684 - DNA, 17 bp, Homo sapiens
aggccaaaatcaagagt

SEQ ID NO: 3598685 - DNA, 18 bp, Homo sapiens
aggccaagtcaggccctt

SEQ ID NO: 3598686 - DNA, 21 bp, Homo sapiens
aggccacagtggggctgcagg

SEQ ID NO: 3598687 - DNA, 23 bp, Homo sapiens
aggccacagtggggctgcaggca

SEQ ID NO: 3598688 - DNA, 18 bp, Homo sapiens
aggccacattgctggctg

SEQ ID NO: 3598689 - DNA, 21 bp, Homo sapiens
aggccaccccaaaccccagcc

SEQ ID NO: 3598690 - DNA, 14 bp, Homo sapiens
aggccaccctccac

SEQ ID NO: 3598691 - DNA, 13 bp, Homo sapiens
aggccagaaaggt

SEQ ID NO: 3598692 - DNA, 14 bp, Homo sapiens
aggccagagaggga

SEQ ID NO: 3598693 - DNA, 15 bp, Homo sapiens
aggccagcagctgat

SEQ ID NO: 3598694 - DNA, 16 bp, Homo sapiens
aggccagcagctgatg

SEQ ID NO: 3598695 - DNA, 12 bp, Homo sapiens
aggccagcccag

SEQ ID NO: 3598696 - DNA, 16 bp, Homo sapiens
aggccagcccagccag

SEQ ID NO: 3598697 - DNA, 17 bp, Homo sapiens
aggccagcccagccagg

SEQ ID NO: 3598698 - DNA, 17 bp, Homo sapiens
agtgactccccagccca

SEQ ID NO: 3598699 - DNA, 16 bp, Homo sapiens
agtgactccctgggag

SEQ ID NO: 3598700 - DNA, 15 bp, Homo sapiens
agtgactcctgctgg

SEQ ID NO: 3598701 - DNA, 16 bp, Homo sapiens
agtgactcctgctggt

SEQ ID NO: 3598702 - DNA, 18 bp, Homo sapiens
agtgagcagtcgcctgcc

SEQ ID NO: 3598703 - DNA, 19 bp, Homo sapiens
agtgagcagtcgcctgcct

SEQ ID NO: 3598704 - DNA, 18 bp, Homo sapiens
agtgagcccctccccagc

SEQ ID NO: 3598705 - DNA, 22 bp, Homo sapiens
agtgagtcacctgctccagaag

SEQ ID NO: 3598706 - DNA, 23 bp, Homo sapiens
agtgagttcaactacatgttctg

SEQ ID NO: 3598707 - DNA, 20 bp, Homo sapiens
agtgatcctcacgccttggc

SEQ ID NO: 3598708 - DNA, 22 bp, Homo sapiens
agtgatggaatatcatgaatgt

SEQ ID NO: 3598709 - DNA, 16 bp, Homo sapiens
agtgattatttttcca

SEQ ID NO: 3598710 - DNA, 22 bp, Homo sapiens
agtgattctcctgcctcagcct

SEQ ID NO: 3598711 - DNA, 18 bp, Homo sapiens
agtgcaagcccctgctcc

SEQ ID NO: 3598712 - DNA, 20 bp, Homo sapiens
agtgcaataaatctgaccca

SEQ ID NO: 3598713 - DNA, 16 bp, Homo sapiens
agtgcaatgacacagt

SEQ ID NO: 3598714 - DNA, 21 bp, Homo sapiens
agtgcacctgcctccaccagc

SEQ ID NO: 3598715 - DNA, 15 bp, Homo sapiens
agtgcagccactggc

SEQ ID NO: 3598716 - DNA, 21 bp, Homo sapiens
agtgcagctcatgtttttaac

SEQ ID NO: 3598717 - DNA, 17 bp, Homo sapiens
agtgcagtccatttcct

SEQ ID NO: 3598718 - DNA, 17 bp, Homo sapiens
agtgcatctcagcccac

SEQ ID NO: 3598719 - DNA, 14 bp, Homo sapiens
agtgccaaatgctc

SEQ ID NO: 3598720 - DNA, 14 bp, Homo sapiens
agtgccacttaatg

SEQ ID NO: 3598721 - DNA, 16 bp, Homo sapiens
agtgccccacttctgg

SEQ ID NO: 3598722 - DNA, 16 bp, Homo sapiens
agtgcccccactgacc

SEQ ID NO: 3598723 - DNA, 19 bp, Homo sapiens
agtgcctggagtcaggtgt

SEQ ID NO: 3598724 - DNA, 16 bp, Homo sapiens
agtgcggttcctcatc

SEQ ID NO: 3598725 - DNA, 18 bp, Homo sapiens
agtgcggttcctcatctg

SEQ ID NO: 3598726 - DNA, 13 bp, Homo sapiens
agtgctcttccca

SEQ ID NO: 3598727 - DNA, 14 bp, Homo sapiens
agtgctcttcccac

SEQ ID NO: 3598728 - DNA, 21 bp, Homo sapiens
agtgctcttcccactccagct

SEQ ID NO: 3598729 - DNA, 20 bp, Homo sapiens
agtgctgggattacaggcgt

SEQ ID NO: 3598730 - DNA, 21 bp, Homo sapiens
agtgctgtttattaatcttag

SEQ ID NO: 3598731 - DNA, 14 bp, Homo sapiens
agtggaaaatgacc

SEQ ID NO: 3598732 - DNA, 22 bp, Homo sapiens
agtggaagtatgtatattaaaa

SEQ ID NO: 3598733 - DNA, 19 bp, Homo sapiens
agtggacgttaggccaggc

SEQ ID NO: 3598734 - DNA, 15 bp, Homo sapiens
agtggagagagcagg

SEQ ID NO: 3598735 - DNA, 13 bp, Homo sapiens
agtggagctgtct

SEQ ID NO: 3598736 - DNA, 18 bp, Homo sapiens
agtggatcttcagaactg

SEQ ID NO: 3598737 - DNA, 19 bp, Homo sapiens
agtggatcttcagaactgc

SEQ ID NO: 3598738 - DNA, 22 bp, Homo sapiens
agtggatcttcagaactgccct

SEQ ID NO: 3598739 - DNA, 23 bp, Homo sapiens
agtggatcttcagaactgccctt

SEQ ID NO: 3598740 - DNA, 15 bp, Homo sapiens
agtggcagcagcccc

SEQ ID NO: 3598741 - DNA, 18 bp, Homo sapiens
agtggcaggggagcaggt

SEQ ID NO: 3598742 - DNA, 22 bp, Homo sapiens
agtggccactaagcagaggagg

SEQ ID NO: 3598743 - DNA, 15 bp, Homo sapiens
agtggcctccctgct

SEQ ID NO: 3598744 - DNA, 19 bp, Homo sapiens
agtggccttccccagcatg

SEQ ID NO: 3598745 - DNA, 15 bp, Homo sapiens
agtggcgtggcctcc

SEQ ID NO: 3598746 - DNA, 17 bp, Homo sapiens
agtggctcctcccggtg

SEQ ID NO: 3598747 - DNA, 23 bp, Homo sapiens
agtgggaagggagcattgcagcc

SEQ ID NO: 3598748 - DNA, 18 bp, Homo sapiens
agtgggaatgttctttct

SEQ ID NO: 3598749 - DNA, 19 bp, Homo sapiens
agtgggacagggcatggcc

SEQ ID NO: 3598750 - DNA, 16 bp, Homo sapiens
agtgggagctgagctg

SEQ ID NO: 3598751 - DNA, 17 bp, Homo sapiens
agtgggagctgagctgg

SEQ ID NO: 3598752 - DNA, 19 bp, Homo sapiens
agtgggccccgggctggag

SEQ ID NO: 3598753 - DNA, 15 bp, Homo sapiens
agtgggcgttgggag

SEQ ID NO: 3598754 - DNA, 18 bp, Homo sapiens
agtgggcgttgggagcct

SEQ ID NO: 3598755 - DNA, 16 bp, Homo sapiens
agtggggctgcaggca

SEQ ID NO: 3598756 - DNA, 19 bp, Homo sapiens
agtggggctgcaggcaggc

SEQ ID NO: 3598757 - DNA, 14 bp, Homo sapiens
agtggggctggcat

SEQ ID NO: 3598758 - DNA, 17 bp, Homo sapiens
agtggtatggggctgag

SEQ ID NO: 3598759 - DNA, 15 bp, Homo sapiens
agtggtgagcaagca

SEQ ID NO: 3598760 - DNA, 22 bp, Homo sapiens
agtggtgcgtttataattggct

SEQ ID NO: 3598761 - DNA, 18 bp, Homo sapiens
agtggtgggtaattgtac

SEQ ID NO: 3598762 - DNA, 18 bp, Homo sapiens
agtggtggtaaccctggt

SEQ ID NO: 3598763 - DNA, 20 bp, Homo sapiens
agtggtggtaaccctggtgg

SEQ ID NO: 3598764 - DNA, 16 bp, Homo sapiens
agtggttaggcagcaa

SEQ ID NO: 3598765 - DNA, 12 bp, Homo sapiens
agtgtaaaattg

SEQ ID NO: 3598766 - DNA, 18 bp, Homo sapiens
agtgtacccatctttaat

SEQ ID NO: 3598767 - DNA, 16 bp, Homo sapiens
agtgtacgattcttaa

SEQ ID NO: 3598768 - DNA, 12 bp, Homo sapiens
agtgtagctgta

SEQ ID NO: 3598769 - DNA, 13 bp, Homo sapiens
agtgtagctgtaa

SEQ ID NO: 3598770 - DNA, 14 bp, Homo sapiens
agtgtagctgtaag

SEQ ID NO: 3598771 - DNA, 21 bp, Homo sapiens
agtgtatggaaataaatgtat

SEQ ID NO: 3598772 - DNA, 17 bp, Homo sapiens
agtgtattaggaagtgt

SEQ ID NO: 3598773 - DNA, 14 bp, Homo sapiens
agtgtatttggaaa

SEQ ID NO: 3598774 - DNA, 15 bp, Homo sapiens
agtgtctaggcactg

SEQ ID NO: 3598775 - DNA, 23 bp, Homo sapiens
agtgtctaggcactgagcaggga

SEQ ID NO: 3598776 - DNA, 17 bp, Homo sapiens
agtgtcttaattaaaag

SEQ ID NO: 3598777 - DNA, 14 bp, Homo sapiens
agtgtgaagatctt

SEQ ID NO: 3598778 - DNA, 15 bp, Homo sapiens
agtgtgaagctttgc

SEQ ID NO: 3598779 - DNA, 17 bp, Homo sapiens
agtgtgagctcttccct

SEQ ID NO: 3598780 - DNA, 19 bp, Homo sapiens
agtgtgagggtcctgcagc

SEQ ID NO: 3598781 - DNA, 11 bp, Homo sapiens
agtgtggcctg

SEQ ID NO: 3598782 - DNA, 13 bp, Homo sapiens
agtgtgtcagttt

SEQ ID NO: 3598783 - DNA, 20 bp, Homo sapiens
agtgtgtgaaaattcaggtg

SEQ ID NO: 3598784 - DNA, 22 bp, Homo sapiens
agtgtgtgaaaattcaggtgct

SEQ ID NO: 3598785 - DNA, 15 bp, Homo sapiens
agtgtgtgccaagag

SEQ ID NO: 3598786 - DNA, 20 bp, Homo sapiens
agtgttagcttaatcttaat

SEQ ID NO: 3598787 - DNA, 23 bp, Homo sapiens
agtgttatttattccccagtgac

SEQ ID NO: 3598788 - DNA, 23 bp, Homo sapiens
agtgttcaaaacaaaatgaaaca

SEQ ID NO: 3598789 - DNA, 23 bp, Homo sapiens
agtgttcacatggctctcatgta

SEQ ID NO: 3598790 - DNA, 14 bp, Homo sapiens
agtgttctgctcct

SEQ ID NO: 3598791 - DNA, 18 bp, Homo sapiens
agtgttgcgtttttcctt

SEQ ID NO: 3598792 - DNA, 19 bp, Homo sapiens
agtgttgcgtttttccttg

SEQ ID NO: 3598793 - DNA, 16 bp, Homo sapiens
agttaaaagcatttta

SEQ ID NO: 3598794 - DNA, 17 bp, Homo sapiens
agttaacacatcaaata

SEQ ID NO: 3598795 - DNA, 20 bp, Homo sapiens
agttaactattgcatttata

SEQ ID NO: 3598796 - DNA, 24 bp, Homo sapiens
agttaactattgcatttatatgta

SEQ ID NO: 3598797 - DNA, 13 bp, Homo sapiens
agttaagacctgg

SEQ ID NO: 3598798 - DNA, 16 bp, Homo sapiens
agttaagacctggcag

SEQ ID NO: 3598799 - DNA, 15 bp, Homo sapiens
agttacagttctgtg

SEQ ID NO: 3598800 - DNA, 18 bp, Homo sapiens
agttacatgctgtatatg

SEQ ID NO: 3598801 - DNA, 20 bp, Homo sapiens
agttaccttatagttactgt

SEQ ID NO: 3598802 - DNA, 19 bp, Homo sapiens
agttactccctacactgat

SEQ ID NO: 3598803 - DNA, 20 bp, Homo sapiens
agttactccctacactgatg

SEQ ID NO: 3598804 - DNA, 11 bp, Homo sapiens
agttactgtgt

SEQ ID NO: 3598805 - DNA, 21 bp, Homo sapiens
agttagttcaatcctgattca

SEQ ID NO: 3598806 - DNA, 15 bp, Homo sapiens
agttagttccactga

SEQ ID NO: 3598807 - DNA, 17 bp, Homo sapiens
agttagttccactgaga

SEQ ID NO: 3598808 - DNA, 21 bp, Homo sapiens
agttataagtagcaggccaag

SEQ ID NO: 3598809 - DNA, 15 bp, Homo sapiens
agttatatatatgtg

SEQ ID NO: 3598810 - DNA, 23 bp, Homo sapiens
agttatattggaattataaatat

SEQ ID NO: 3598811 - DNA, 15 bp, Homo sapiens
agttattaactgtat

SEQ ID NO: 3598812 - DNA, 19 bp, Homo sapiens
agttattaactgtattttc

SEQ ID NO: 3598813 - DNA, 15 bp, Homo sapiens
agttattaattaaag

SEQ ID NO: 3598814 - DNA, 21 bp, Homo sapiens
agttatttatttattggagat

SEQ ID NO: 3598815 - DNA, 13 bp, Homo sapiens
agttattttatga

SEQ ID NO: 3598816 - DNA, 24 bp, Homo sapiens
agttcaatctggattcatatttaa

SEQ ID NO: 3598817 - DNA, 13 bp, Homo sapiens
agttcatgagaat

SEQ ID NO: 3598818 - DNA, 22 bp, Homo sapiens
agttcatgcagctgtggcagag

SEQ ID NO: 3598819 - DNA, 23 bp, Homo sapiens
agttcattctaccaagctgtcac

SEQ ID NO: 3598820 - DNA, 15 bp, Homo sapiens
agttccactgagacc

SEQ ID NO: 3598821 - DNA, 19 bp, Homo sapiens
agttccatggcaattttgt

SEQ ID NO: 3598822 - DNA, 15 bp, Homo sapiens
agttccctacttcct

SEQ ID NO: 3598823 - DNA, 11 bp, Homo sapiens
agttcctctgc

SEQ ID NO: 3598824 - DNA, 18 bp, Homo sapiens
agttccttatccctctct

SEQ ID NO: 3598825 - DNA, 13 bp, Homo sapiens
agttctaaaattg

SEQ ID NO: 3598826 - DNA, 23 bp, Homo sapiens
agttctaggcatacttttcaaag

SEQ ID NO: 3598827 - DNA, 17 bp, Homo sapiens
agttctgtggttccagt

SEQ ID NO: 3598828 - DNA, 21 bp, Homo sapiens
agttcttgggggaggccaccc

SEQ ID NO: 3598829 - DNA, 13 bp, Homo sapiens
agttctttcctcc

SEQ ID NO: 3598830 - DNA, 17 bp, Homo sapiens
atcctccaggtttttca

SEQ ID NO: 3598831 - DNA, 18 bp, Homo sapiens
atcctccaggtttttcaa

SEQ ID NO: 3598832 - DNA, 20 bp, Homo sapiens
atcctccaggtttttcaatt

SEQ ID NO: 3598833 - DNA, 17 bp, Homo sapiens
atcctcttgagagaaac

SEQ ID NO: 3598834 - DNA, 17 bp, Homo sapiens
atcctgaactttctccc

SEQ ID NO: 3598835 - DNA, 13 bp, Homo sapiens
atcctgaagagca

SEQ ID NO: 3598836 - DNA, 16 bp, Homo sapiens
atcctgaatctgtgca

SEQ ID NO: 3598837 - DNA, 12 bp, Homo sapiens
atcctgagccaa

SEQ ID NO: 3598838 - DNA, 21 bp, Homo sapiens
atcctgcttctgatatgcagt

SEQ ID NO: 3598839 - DNA, 19 bp, Homo sapiens
atcctggggcagcactccc

SEQ ID NO: 3598840 - DNA, 17 bp, Homo sapiens
atcctgtaccaaatctg

SEQ ID NO: 3598841 - DNA, 18 bp, Homo sapiens
atcctgtaccaaatctga

SEQ ID NO: 3598842 - DNA, 20 bp, Homo sapiens
atcctgtaccaaatctgaca

SEQ ID NO: 3598843 - DNA, 23 bp, Homo sapiens
atcctgtaccaaatctgacatat

SEQ ID NO: 3598844 - DNA, 16 bp, Homo sapiens
atccttcactgctcac

SEQ ID NO: 3598845 - DNA, 22 bp, Homo sapiens
atccttccctgtctgccagggc

SEQ ID NO: 3598846 - DNA, 17 bp, Homo sapiens
atccttctcactgccat

SEQ ID NO: 3598847 - DNA, 14 bp, Homo sapiens
atccttctttgtaa

SEQ ID NO: 3598848 - DNA, 12 bp, Homo sapiens
atccttggcagt

SEQ ID NO: 3598849 - DNA, 21 bp, Homo sapiens
atccttggctttcagagccag

SEQ ID NO: 3598850 - DNA, 12 bp, Homo sapiens
atccttttcctt

SEQ ID NO: 3598851 - DNA, 13 bp, Homo sapiens
atccttttcctta

SEQ ID NO: 3598852 - DNA, 22 bp, Homo sapiens
atccttttccttatttgccttc

SEQ ID NO: 3598853 - DNA, 18 bp, Homo sapiens
atcgaagggattgtgtat

SEQ ID NO: 3598854 - DNA, 19 bp, Homo sapiens
atcgcctctttgacatttt

SEQ ID NO: 3598855 - DNA, 16 bp, Homo sapiens
atcgcttgaacctggg

SEQ ID NO: 3598856 - DNA, 21 bp, Homo sapiens
atcgctttatgtttttggtta

SEQ ID NO: 3598857 - DNA, 21 bp, Homo sapiens
atcggccatcaagggaagaac

SEQ ID NO: 3598858 - DNA, 13 bp, Homo sapiens
atcgtccagggag

SEQ ID NO: 3598859 - DNA, 13 bp, Homo sapiens
atctaatctgaac

SEQ ID NO: 3598860 - DNA, 16 bp, Homo sapiens
atctaatctgaactga

SEQ ID NO: 3598861 - DNA, 14 bp, Homo sapiens
atctaccccagact

SEQ ID NO: 3598862 - DNA, 21 bp, Homo sapiens
atctataggaagattgaacct

SEQ ID NO: 3598863 - DNA, 17 bp, Homo sapiens
atctatgggaagatact

SEQ ID NO: 3598864 - DNA, 14 bp, Homo sapiens
atctatgttttacc

SEQ ID NO: 3598865 - DNA, 16 bp, Homo sapiens
atctatttgagattga

SEQ ID NO: 3598866 - DNA, 13 bp, Homo sapiens
atctcaaaacaaa

SEQ ID NO: 3598867 - DNA, 15 bp, Homo sapiens
atctcaaaactgcac

SEQ ID NO: 3598868 - DNA, 19 bp, Homo sapiens
atctcaaaactgcactgtc

SEQ ID NO: 3598869 - DNA, 11 bp, Homo sapiens
atctcaagtaa

SEQ ID NO: 3598870 - DNA, 15 bp, Homo sapiens
atctcaagtaaaaca

SEQ ID NO: 3598871 - DNA, 21 bp, Homo sapiens
atctcaagtaaaacaaatgaa

SEQ ID NO: 3598872 - DNA, 13 bp, Homo sapiens
atctcacaggctg

SEQ ID NO: 3598873 - DNA, 18 bp, Homo sapiens
atctcacatatacaagta

SEQ ID NO: 3598874 - DNA, 14 bp, Homo sapiens
atctcaggagatgg

SEQ ID NO: 3598875 - DNA, 22 bp, Homo sapiens
atctcaggaggggcagcgcatg

SEQ ID NO: 3598876 - DNA, 19 bp, Homo sapiens
atctcatccccaaactgta

SEQ ID NO: 3598877 - DNA, 13 bp, Homo sapiens
atctcatctgtct

SEQ ID NO: 3598878 - DNA, 17 bp, Homo sapiens
atctcccccactccact

SEQ ID NO: 3598879 - DNA, 18 bp, Homo sapiens
atctcccccactccacta

SEQ ID NO: 3598880 - DNA, 13 bp, Homo sapiens
atctccctggctc

SEQ ID NO: 3598881 - DNA, 18 bp, Homo sapiens
atctccctggctcactgg

SEQ ID NO: 3598882 - DNA, 21 bp, Homo sapiens
atctcccttttccatgactgt

SEQ ID NO: 3598883 - DNA, 23 bp, Homo sapiens
atctcctcccttaccctcctctg

SEQ ID NO: 3598884 - DNA, 20 bp, Homo sapiens
atctccttgtggcctatgaa

SEQ ID NO: 3598885 - DNA, 15 bp, Homo sapiens
atctcctttgaagaa

SEQ ID NO: 3598886 - DNA, 16 bp, Homo sapiens
atctcggctcactgca

SEQ ID NO: 3598887 - DNA, 15 bp, Homo sapiens
atctctaaagagcat

SEQ ID NO: 3598888 - DNA, 20 bp, Homo sapiens
atctctatcagaaatacaaa

SEQ ID NO: 3598889 - DNA, 15 bp, Homo sapiens
atctctcaaatctgt

SEQ ID NO: 3598890 - DNA, 16 bp, Homo sapiens
atctctcaaatctgtt

SEQ ID NO: 3598891 - DNA, 14 bp, Homo sapiens
atctctctgcccaa

SEQ ID NO: 3598892 - DNA, 19 bp, Homo sapiens
atctctcttgtcctcttct

SEQ ID NO: 3598893 - DNA, 21 bp, Homo sapiens
atctctgggggctgaggagca

SEQ ID NO: 3598894 - DNA, 18 bp, Homo sapiens
atctctgttacaaaagaa

SEQ ID NO: 3598895 - DNA, 18 bp, Homo sapiens
atctcttctggtgttgac

SEQ ID NO: 3598896 - DNA, 16 bp, Homo sapiens
atctcttgcccttcct

SEQ ID NO: 3598897 - DNA, 19 bp, Homo sapiens
atctgaaaggccagcagct

SEQ ID NO: 3598898 - DNA, 16 bp, Homo sapiens
atctgaatgaaaataa

SEQ ID NO: 3598899 - DNA, 21 bp, Homo sapiens
atctgacccagtgcccccact

SEQ ID NO: 3598900 - DNA, 12 bp, Homo sapiens
atctgactgcca

SEQ ID NO: 3598901 - DNA, 18 bp, Homo sapiens
atctgactgccaagccag

SEQ ID NO: 3598902 - DNA, 13 bp, Homo sapiens
atctgatgtataa

SEQ ID NO: 3598903 - DNA, 16 bp, Homo sapiens
atctgatgtataatgt

SEQ ID NO: 3598904 - DNA, 20 bp, Homo sapiens
atctgctagggaatatcaat

SEQ ID NO: 3598905 - DNA, 20 bp, Homo sapiens
atctgctgcagttaccacag

SEQ ID NO: 3598906 - DNA, 13 bp, Homo sapiens
atctgctgtcttt

SEQ ID NO: 3598907 - DNA, 19 bp, Homo sapiens
atctgctgttcttcagtcc

SEQ ID NO: 3598908 - DNA, 11 bp, Homo sapiens
atctggaaccc

SEQ ID NO: 3598909 - DNA, 17 bp, Homo sapiens
atctggaacccagactc

SEQ ID NO: 3598910 - DNA, 18 bp, Homo sapiens
atctggaacccagactca

SEQ ID NO: 3598911 - DNA, 23 bp, Homo sapiens
atctggaacccagactcagacat

SEQ ID NO: 3598912 - DNA, 22 bp, Homo sapiens
atctggactcctctgtccaggc

SEQ ID NO: 3598913 - DNA, 22 bp, Homo sapiens
atctggcggaggtctctgggag

SEQ ID NO: 3598914 - DNA, 14 bp, Homo sapiens
atctggctgcacag

SEQ ID NO: 3598915 - DNA, 16 bp, Homo sapiens
atctggctgcacaggc

SEQ ID NO: 3598916 - DNA, 15 bp, Homo sapiens
atctggcttccctgg

SEQ ID NO: 3598917 - DNA, 20 bp, Homo sapiens
atctggggagagcggctgga

SEQ ID NO: 3598918 - DNA, 21 bp, Homo sapiens
atctggggagagcggctggag

SEQ ID NO: 3598919 - DNA, 15 bp, Homo sapiens
atctgggggagtgga

SEQ ID NO: 3598920 - DNA, 18 bp, Homo sapiens
atctgggggagtggaata

SEQ ID NO: 3598921 - DNA, 14 bp, Homo sapiens
atctggtcctaccc

SEQ ID NO: 3598922 - DNA, 14 bp, Homo sapiens
atctgtcctcagcc

SEQ ID NO: 3598923 - DNA, 15 bp, Homo sapiens
atctgtcctcagcct

SEQ ID NO: 3598924 - DNA, 16 bp, Homo sapiens
atctgtcctcagcctt

SEQ ID NO: 3598925 - DNA, 18 bp, Homo sapiens
atctgtcctcagccttgc

SEQ ID NO: 3598926 - DNA, 21 bp, Homo sapiens
atctgtcctcagccttgccag

SEQ ID NO: 3598927 - DNA, 20 bp, Homo sapiens
atctgtgaagaaagaggtta

SEQ ID NO: 3598928 - DNA, 21 bp, Homo sapiens
atctgtgatgacattccctgc

SEQ ID NO: 3598929 - DNA, 15 bp, Homo sapiens
atctgtgattggctg

SEQ ID NO: 3598930 - DNA, 21 bp, Homo sapiens
atctgtgctgtttcaaagttc

SEQ ID NO: 3598931 - DNA, 19 bp, Homo sapiens
atctgtgcttctaatatta

SEQ ID NO: 3598932 - DNA, 15 bp, Homo sapiens
atctgtgtggctcct

SEQ ID NO: 3598933 - DNA, 16 bp, Homo sapiens
atctgttctaacatgt

SEQ ID NO: 3598934 - DNA, 14 bp, Homo sapiens
atctgtttaaagca

SEQ ID NO: 3598935 - DNA, 19 bp, Homo sapiens
atctgttttggatgttgct

SEQ ID NO: 3598936 - DNA, 15 bp, Homo sapiens
atcttaatgtatcaa

SEQ ID NO: 3598937 - DNA, 15 bp, Homo sapiens
atcttaatgtctggt

SEQ ID NO: 3598938 - DNA, 15 bp, Homo sapiens
atcttaatttattat

SEQ ID NO: 3598939 - DNA, 21 bp, Homo sapiens
atcttacaacaggcttatgaa

SEQ ID NO: 3598940 - DNA, 15 bp, Homo sapiens
atcttagtgtatgat

SEQ ID NO: 3598941 - DNA, 24 bp, Homo sapiens
atcttataaagtggaagtatgtat

SEQ ID NO: 3598942 - DNA, 16 bp, Homo sapiens
atcttcagaactgccc

SEQ ID NO: 3598943 - DNA, 12 bp, Homo sapiens
atcttcctggca

SEQ ID NO: 3598944 - DNA, 14 bp, Homo sapiens
atcttctgaagagg

SEQ ID NO: 3598945 - DNA, 12 bp, Homo sapiens
atcttctttctt

SEQ ID NO: 3598946 - DNA, 15 bp, Homo sapiens
atcttgaatttctgc

SEQ ID NO: 3598947 - DNA, 21 bp, Homo sapiens
atcttgaccaacagaaacctt

SEQ ID NO: 3598948 - DNA, 23 bp, Homo sapiens
atcttgagccacagtcactggat

SEQ ID NO: 3598949 - DNA, 19 bp, Homo sapiens
atcttgagtataagaaatg

SEQ ID NO: 3598950 - DNA, 14 bp, Homo sapiens
atcttgctaccagt

SEQ ID NO: 3598951 - DNA, 16 bp, Homo sapiens
atcttgctaccagtat

SEQ ID NO: 3598952 - DNA, 19 bp, Homo sapiens
atcttgctaccagtattta

SEQ ID NO: 3598953 - DNA, 19 bp, Homo sapiens
atcttggccctcctcagct

SEQ ID NO: 3598954 - DNA, 20 bp, Homo sapiens
atcttggccctcctcagctc

SEQ ID NO: 3598955 - DNA, 21 bp, Homo sapiens
atcttggccctcctcagctcc

SEQ ID NO: 3598956 - DNA, 22 bp, Homo sapiens
atcttgtgctatgaaacaatct

SEQ ID NO: 3598957 - DNA, 15 bp, Homo sapiens
atctttaaaatacac

SEQ ID NO: 3598958 - DNA, 14 bp, Homo sapiens
atctttagcagttt

SEQ ID NO: 3598959 - DNA, 17 bp, Homo sapiens
atctttagcagtttcct

SEQ ID NO: 3598960 - DNA, 19 bp, Homo sapiens
atctttagcagtttcctca

SEQ ID NO: 3598961 - DNA, 15 bp, Homo sapiens
atctttctacagaga

SEQ ID NO: 3598962 - DNA, 15 bp, Homo sapiens
atctttctttccaaa

SEQ ID NO: 3598963 - DNA, 10 bp, Homo sapiens
attattttct

SEQ ID NO: 3598964 - DNA, 20 bp, Homo sapiens
attatttttgttagcaaaga

SEQ ID NO: 3598965 - DNA, 18 bp, Homo sapiens
attattttttaaaaaggt

SEQ ID NO: 3598966 - DNA, 13 bp, Homo sapiens
attattttttcag

SEQ ID NO: 3598967 - DNA, 15 bp, Homo sapiens
attattttttcagac

SEQ ID NO: 3598968 - DNA, 21 bp, Homo sapiens
attattttttcagaccgaaaa

SEQ ID NO: 3598969 - DNA, 23 bp, Homo sapiens
attcaaaaagacagcagacaaaa

SEQ ID NO: 3598970 - DNA, 18 bp, Homo sapiens
attcaaacagtctcagga

SEQ ID NO: 3598971 - DNA, 19 bp, Homo sapiens
attcaaacagtctcaggaa

SEQ ID NO: 3598972 - DNA, 17 bp, Homo sapiens
attcaagcaaacatcaa

SEQ ID NO: 3598973 - DNA, 22 bp, Homo sapiens
attcaataaagcagttaattta

SEQ ID NO: 3598974 - DNA, 16 bp, Homo sapiens
attcaatatcctttgc

SEQ ID NO: 3598975 - DNA, 18 bp, Homo sapiens
attcacaagcctcctgta

SEQ ID NO: 3598976 - DNA, 22 bp, Homo sapiens
attcacagttctttgggccaga

SEQ ID NO: 3598977 - DNA, 20 bp, Homo sapiens
attcacgtgctttgtgttca

SEQ ID NO: 3598978 - DNA, 16 bp, Homo sapiens
attcactagaaaatga

SEQ ID NO: 3598979 - DNA, 18 bp, Homo sapiens
attcagactaaaaataca

SEQ ID NO: 3598980 - DNA, 20 bp, Homo sapiens
attcagactaaaaatacacc

SEQ ID NO: 3598981 - DNA, 12 bp, Homo sapiens
attcagccttat

SEQ ID NO: 3598982 - DNA, 18 bp, Homo sapiens
attcagccttatccaggt

SEQ ID NO: 3598983 - DNA, 15 bp, Homo sapiens
attcagctctggaga

SEQ ID NO: 3598984 - DNA, 17 bp, Homo sapiens
attcagctctggagaac

SEQ ID NO: 3598985 - DNA, 16 bp, Homo sapiens
attcaggccagcccag

SEQ ID NO: 3598986 - DNA, 17 bp, Homo sapiens
attcaggccagcccagc

SEQ ID NO: 3598987 - DNA, 23 bp, Homo sapiens
attcaggccagcccagccaggcc

SEQ ID NO: 3598988 - DNA, 18 bp, Homo sapiens
attcaggggaaacttgat

SEQ ID NO: 3598989 - DNA, 21 bp, Homo sapiens
attcaggtgctagaagcctac

SEQ ID NO: 3598990 - DNA, 22 bp, Homo sapiens
attcaggtgctagaagcctact

SEQ ID NO: 3598991 - DNA, 14 bp, Homo sapiens
attcagttctaggc

SEQ ID NO: 3598992 - DNA, 20 bp, Homo sapiens
attcagttctaggcctttcc

SEQ ID NO: 3598993 - DNA, 22 bp, Homo sapiens
attcagttctaggcctttcctc

SEQ ID NO: 3598994 - DNA, 24 bp, Homo sapiens
attcagttctaggcctttcctctg

SEQ ID NO: 3598995 - DNA, 18 bp, Homo sapiens
attcagttcttacacatt

SEQ ID NO: 3598996 - DNA, 18 bp, Homo sapiens
attcatatttacttctta

SEQ ID NO: 3598997 - DNA, 17 bp, Homo sapiens
attcatggatatttgtc

SEQ ID NO: 3598998 - DNA, 16 bp, Homo sapiens
attcatggttcaagta

SEQ ID NO: 3598999 - DNA, 17 bp, Homo sapiens
attcatggttcaagtat

SEQ ID NO: 3599000 - DNA, 22 bp, Homo sapiens
attcattctgaaccctccaaag

SEQ ID NO: 3599001 - DNA, 13 bp, Homo sapiens
attcattctttat

SEQ ID NO: 3599002 - DNA, 16 bp, Homo sapiens
attcattctttataaa

SEQ ID NO: 3599003 - DNA, 12 bp, Homo sapiens
attcattggtga

SEQ ID NO: 3599004 - DNA, 23 bp, Homo sapiens
attccaaagctttattaccagtg

SEQ ID NO: 3599005 - DNA, 20 bp, Homo sapiens
attccaactgggcatttcaa

SEQ ID NO: 3599006 - DNA, 15 bp, Homo sapiens
attccactgaaaatt

SEQ ID NO: 3599007 - DNA, 18 bp, Homo sapiens
attccagagagtggctcc

SEQ ID NO: 3599008 - DNA, 15 bp, Homo sapiens
attccatttgcttgt

SEQ ID NO: 3599009 - DNA, 22 bp, Homo sapiens
attcccaagggagactgaccat

SEQ ID NO: 3599010 - DNA, 12 bp, Homo sapiens
attcccagcctg

SEQ ID NO: 3599011 - DNA, 20 bp, Homo sapiens
attccccagtgactccaggg

SEQ ID NO: 3599012 - DNA, 23 bp, Homo sapiens
attccccccattttgcctctgtc

SEQ ID NO: 3599013 - DNA, 15 bp, Homo sapiens
attcccctcccacct

SEQ ID NO: 3599014 - DNA, 21 bp, Homo sapiens
attcccctcccacctctcctt

SEQ ID NO: 3599015 - DNA, 20 bp, Homo sapiens
attcccgggtgcagaattgt

SEQ ID NO: 3599016 - DNA, 23 bp, Homo sapiens
attcccgttttgtcactttttct

SEQ ID NO: 3599017 - DNA, 13 bp, Homo sapiens
attccctccattt

SEQ ID NO: 3599018 - DNA, 13 bp, Homo sapiens
attccctccccct

SEQ ID NO: 3599019 - DNA, 17 bp, Homo sapiens
attccctccccctcctt

SEQ ID NO: 3599020 - DNA, 13 bp, Homo sapiens
attccctgcccaa

SEQ ID NO: 3599021 - DNA, 18 bp, Homo sapiens
attccctgcccaaaccct

SEQ ID NO: 3599022 - DNA, 20 bp, Homo sapiens
attccctgcccaaaccctta

SEQ ID NO: 3599023 - DNA, 21 bp, Homo sapiens
attccctgcccaaacccttaa

SEQ ID NO: 3599024 - DNA, 16 bp, Homo sapiens
attcctccagcctccc

SEQ ID NO: 3599025 - DNA, 20 bp, Homo sapiens
attcctccagcctcccctcc

SEQ ID NO: 3599026 - DNA, 18 bp, Homo sapiens
attcctctttgctttgct

SEQ ID NO: 3599027 - DNA, 15 bp, Homo sapiens
attcctgaagaacca

SEQ ID NO: 3599028 - DNA, 19 bp, Homo sapiens
attcctgaagaaccagtcc

SEQ ID NO: 3599029 - DNA, 18 bp, Homo sapiens
attcctgagctggcctgt

SEQ ID NO: 3599030 - DNA, 15 bp, Homo sapiens
attcctgcatttgtg

SEQ ID NO: 3599031 - DNA, 13 bp, Homo sapiens
attcctgtgccct

SEQ ID NO: 3599032 - DNA, 20 bp, Homo sapiens
attcctttacaactaaataa

SEQ ID NO: 3599033 - DNA, 21 bp, Homo sapiens
attcctttacaactaaataac

SEQ ID NO: 3599034 - DNA, 23 bp, Homo sapiens
attcctttacaactaaataacac

SEQ ID NO: 3599035 - DNA, 17 bp, Homo sapiens
attcctttttcttcact

SEQ ID NO: 3599036 - DNA, 18 bp, Homo sapiens
attcggggctgacctttc

SEQ ID NO: 3599037 - DNA, 22 bp, Homo sapiens
attcgtgagctggggactcagg

SEQ ID NO: 3599038 - DNA, 17 bp, Homo sapiens
attctaaattacaaagg

SEQ ID NO: 3599039 - DNA, 20 bp, Homo sapiens
attctaccaagctgtcacag

SEQ ID NO: 3599040 - DNA, 22 bp, Homo sapiens
attctactaagttattttatga

SEQ ID NO: 3599041 - DNA, 21 bp, Homo sapiens
attctatgttaatattttatg

SEQ ID NO: 3599042 - DNA, 22 bp, Homo sapiens
attctatgttaatattttatgt

SEQ ID NO: 3599043 - DNA, 13 bp, Homo sapiens
attctattctcca

SEQ ID NO: 3599044 - DNA, 15 bp, Homo sapiens
attctattctccaga

SEQ ID NO: 3599045 - DNA, 14 bp, Homo sapiens
attctcaaagtttt

SEQ ID NO: 3599046 - DNA, 16 bp, Homo sapiens
attctcaaagttttat

SEQ ID NO: 3599047 - DNA, 17 bp, Homo sapiens
attctcaaagttttatt

SEQ ID NO: 3599048 - DNA, 23 bp, Homo sapiens
attctcccagctctagcctctgg

SEQ ID NO: 3599049 - DNA, 18 bp, Homo sapiens
attctcctgcctcagcct

SEQ ID NO: 3599050 - DNA, 19 bp, Homo sapiens
attctcgtgagtcatttaa

SEQ ID NO: 3599051 - DNA, 20 bp, Homo sapiens
attctctcccatcctggggc

SEQ ID NO: 3599052 - DNA, 12 bp, Homo sapiens
attctctcttta

SEQ ID NO: 3599053 - DNA, 14 bp, Homo sapiens
attctctgcagccc

SEQ ID NO: 3599054 - DNA, 14 bp, Homo sapiens
attctcttatccaa

SEQ ID NO: 3599055 - DNA, 15 bp, Homo sapiens
attctgaaaaagaca

SEQ ID NO: 3599056 - DNA, 20 bp, Homo sapiens
attctgattgctatcagcaa

SEQ ID NO: 3599057 - DNA, 22 bp, Homo sapiens
attctgattgctatcagcaatg

SEQ ID NO: 3599058 - DNA, 17 bp, Homo sapiens
attctgcctagagtgta

SEQ ID NO: 3599059 - DNA, 14 bp, Homo sapiens
attctgggaaggga

SEQ ID NO: 3599060 - DNA, 23 bp, Homo sapiens
attctggtagggatatggcagga

SEQ ID NO: 3599061 - DNA, 17 bp, Homo sapiens
attctgtaaaagaaaaa

SEQ ID NO: 3599062 - DNA, 14 bp, Homo sapiens
attctgtctgggga

SEQ ID NO: 3599063 - DNA, 23 bp, Homo sapiens
attcttaccctgtacatatgtaa

SEQ ID NO: 3599064 - DNA, 17 bp, Homo sapiens
attcttcctagttttct

SEQ ID NO: 3599065 - DNA, 19 bp, Homo sapiens
attcttcctagttttctcc

SEQ ID NO: 3599066 - DNA, 13 bp, Homo sapiens
attcttcctttgt

SEQ ID NO: 3599067 - DNA, 20 bp, Homo sapiens
attcttgttgctgtacaaaa

SEQ ID NO: 3599068 - DNA, 22 bp, Homo sapiens
attcttgttgctgtacaaaagc

SEQ ID NO: 3599069 - DNA, 16 bp, Homo sapiens
attgaaaaactcttta

SEQ ID NO: 3599070 - DNA, 17 bp, Homo sapiens
attgaaaaactctttat

SEQ ID NO: 3599071 - DNA, 17 bp, Homo sapiens
attgaaaacttcaaagc

SEQ ID NO: 3599072 - DNA, 20 bp, Homo sapiens
attgaaggaatttgggagga

SEQ ID NO: 3599073 - DNA, 17 bp, Homo sapiens
attgaattcatttcact

SEQ ID NO: 3599074 - DNA, 13 bp, Homo sapiens
attgacagcaatt

SEQ ID NO: 3599075 - DNA, 14 bp, Homo sapiens
attgacagctttgc

SEQ ID NO: 3599076 - DNA, 14 bp, Homo sapiens
attgactgatgatt

SEQ ID NO: 3599077 - DNA, 20 bp, Homo sapiens
attgactgatgattttcctt

SEQ ID NO: 3599078 - DNA, 19 bp, Homo sapiens
attgactttcagtaaacat

SEQ ID NO: 3599079 - DNA, 9 bp, Homo sapiens
attgagatt

SEQ ID NO: 3599080 - DNA, 22 bp, Homo sapiens
attgagcaaataaacttacaga

SEQ ID NO: 3599081 - DNA, 14 bp, Homo sapiens
attgagcttacaat

SEQ ID NO: 3599082 - DNA, 21 bp, Homo sapiens
attgaggaaaaactgacagat

SEQ ID NO: 3599083 - DNA, 14 bp, Homo sapiens
attgaggtaagttt

SEQ ID NO: 3599084 - DNA, 16 bp, Homo sapiens
attgaggtaagttttt

SEQ ID NO: 3599085 - DNA, 17 bp, Homo sapiens
attgataacatggaaat

SEQ ID NO: 3599086 - DNA, 21 bp, Homo sapiens
attgcacctatctcagccata

SEQ ID NO: 3599087 - DNA, 17 bp, Homo sapiens
attgcacctggatgtac

SEQ ID NO: 3599088 - DNA, 16 bp, Homo sapiens
attgcactccagcctg

SEQ ID NO: 3599089 - DNA, 14 bp, Homo sapiens
attgcagcctaaga

SEQ ID NO: 3599090 - DNA, 18 bp, Homo sapiens
attgcagcctaagaagaa

SEQ ID NO: 3599091 - DNA, 21 bp, Homo sapiens
attgcagtttacagtatttct

SEQ ID NO: 3599092 - DNA, 17 bp, Homo sapiens
attgcatttttaccttt

SEQ ID NO: 3599093 - DNA, 17 bp, Homo sapiens
attgccaaaacccagct

SEQ ID NO: 3599094 - DNA, 13 bp, Homo sapiens
caaactccaggct

SEQ ID NO: 3599095 - DNA, 15 bp, Homo sapiens
caaactccaggctgg

SEQ ID NO: 3599096 - DNA, 18 bp, Homo sapiens
caaactccaggctggaag

SEQ ID NO: 3599097 - DNA, 12 bp, Homo sapiens
caaactgacaat

SEQ ID NO: 3599098 - DNA, 13 bp, Homo sapiens
caaactgcacatc

SEQ ID NO: 3599099 - DNA, 14 bp, Homo sapiens
caaactgcacatct

SEQ ID NO: 3599100 - DNA, 15 bp, Homo sapiens
caaactgcacatcta

SEQ ID NO: 3599101 - DNA, 15 bp, Homo sapiens
caaactggtgcatga

SEQ ID NO: 3599102 - DNA, 16 bp, Homo sapiens
caaactgtataacttg

SEQ ID NO: 3599103 - DNA, 18 bp, Homo sapiens
caaactttctcataagca

SEQ ID NO: 3599104 - DNA, 14 bp, Homo sapiens
caaagaaaatgaaa

SEQ ID NO: 3599105 - DNA, 18 bp, Homo sapiens
caaagaaaatgaaatgca

SEQ ID NO: 3599106 - DNA, 23 bp, Homo sapiens
caaagaaacaagctgtgcaggca

SEQ ID NO: 3599107 - DNA, 15 bp, Homo sapiens
caaagaaccatgcag

SEQ ID NO: 3599108 - DNA, 19 bp, Homo sapiens
caaagaacttgctgctgcc

SEQ ID NO: 3599109 - DNA, 20 bp, Homo sapiens
caaagaacttgctgctgcct

SEQ ID NO: 3599110 - DNA, 13 bp, Homo sapiens
caaagaagatagc

SEQ ID NO: 3599111 - DNA, 12 bp, Homo sapiens
caaagacaggca

SEQ ID NO: 3599112 - DNA, 16 bp, Homo sapiens
caaagactctggaggt

SEQ ID NO: 3599113 - DNA, 21 bp, Homo sapiens
caaagactctggaggtcatct

SEQ ID NO: 3599114 - DNA, 18 bp, Homo sapiens
caaagacttcctctggct

SEQ ID NO: 3599115 - DNA, 20 bp, Homo sapiens
caaagagaagatgcctgtta

SEQ ID NO: 3599116 - DNA, 13 bp, Homo sapiens
caaagaggtattt

SEQ ID NO: 3599117 - DNA, 21 bp, Homo sapiens
caaagattaaatgtgtcattg

SEQ ID NO: 3599118 - DNA, 20 bp, Homo sapiens
caaagattaggtcgttttcc

SEQ ID NO: 3599119 - DNA, 22 bp, Homo sapiens
caaagcactgacttctaagtaa

SEQ ID NO: 3599120 - DNA, 16 bp, Homo sapiens
caaagcccctcacact

SEQ ID NO: 3599121 - DNA, 22 bp, Homo sapiens
caaagcccctcacactgcaagg

SEQ ID NO: 3599122 - DNA, 24 bp, Homo sapiens
caaagcccctcacactgcaaggga

SEQ ID NO: 3599123 - DNA, 18 bp, Homo sapiens
caaagccttaagcaaatt

SEQ ID NO: 3599124 - DNA, 21 bp, Homo sapiens
caaagccttaagcaaattttg

SEQ ID NO: 3599125 - DNA, 19 bp, Homo sapiens
caaagcggtccctgtccct

SEQ ID NO: 3599126 - DNA, 18 bp, Homo sapiens
caaagctcaaataaaaat

SEQ ID NO: 3599127 - DNA, 14 bp, Homo sapiens
caaagctgaatatt

SEQ ID NO: 3599128 - DNA, 15 bp, Homo sapiens
caaagctgaatattt

SEQ ID NO: 3599129 - DNA, 16 bp, Homo sapiens
caaagctttttccaga

SEQ ID NO: 3599130 - DNA, 19 bp, Homo sapiens
caaagggaaaaaagagttt

SEQ ID NO: 3599131 - DNA, 21 bp, Homo sapiens
caaagggaaagcctctggccg

SEQ ID NO: 3599132 - DNA, 20 bp, Homo sapiens
caaagggaagtaacagacac

SEQ ID NO: 3599133 - DNA, 18 bp, Homo sapiens
caaaggtgcactccagac

SEQ ID NO: 3599134 - DNA, 22 bp, Homo sapiens
caaaggtgcactccagactctg

SEQ ID NO: 3599135 - DNA, 14 bp, Homo sapiens
caaaggtggcagct

SEQ ID NO: 3599136 - DNA, 11 bp, Homo sapiens
caaaggttttc

SEQ ID NO: 3599137 - DNA, 15 bp, Homo sapiens
caaagtgcctgggct

SEQ ID NO: 3599138 - DNA, 16 bp, Homo sapiens
caaagtgcctgggctc

SEQ ID NO: 3599139 - DNA, 18 bp, Homo sapiens
caaagtgcctgggctcag

SEQ ID NO: 3599140 - DNA, 22 bp, Homo sapiens
caaagtgcctgggctcagcctg

SEQ ID NO: 3599141 - DNA, 19 bp, Homo sapiens
caaagtgctgggattacag

SEQ ID NO: 3599142 - DNA, 17 bp, Homo sapiens
caaagtgttgctgtggc

SEQ ID NO: 3599143 - DNA, 19 bp, Homo sapiens
caaagtgttgctgtggctc

SEQ ID NO: 3599144 - DNA, 21 bp, Homo sapiens
caaagtgttgctgtggctcca

SEQ ID NO: 3599145 - DNA, 22 bp, Homo sapiens
caaagtgttgctgtggctccat

SEQ ID NO: 3599146 - DNA, 20 bp, Homo sapiens
caaagttccctacttcctgt

SEQ ID NO: 3599147 - DNA, 21 bp, Homo sapiens
caaagttccctacttcctgtg

SEQ ID NO: 3599148 - DNA, 22 bp, Homo sapiens
caaagttccctacttcctgtga

SEQ ID NO: 3599149 - DNA, 13 bp, Homo sapiens
caaatatattatt

SEQ ID NO: 3599150 - DNA, 14 bp, Homo sapiens
caaatatgcaaagc

SEQ ID NO: 3599151 - DNA, 18 bp, Homo sapiens
caaatatgcaaagcactg

SEQ ID NO: 3599152 - DNA, 21 bp, Homo sapiens
caaatatgcaaagcactgact

SEQ ID NO: 3599153 - DNA, 13 bp, Homo sapiens
caaatatgttaaa

SEQ ID NO: 3599154 - DNA, 16 bp, Homo sapiens
caaatatgttaaagtt

SEQ ID NO: 3599155 - DNA, 17 bp, Homo sapiens
caaatatgttaaagttt

SEQ ID NO: 3599156 - DNA, 15 bp, Homo sapiens
caaatatgttctctg

SEQ ID NO: 3599157 - DNA, 14 bp, Homo sapiens
caaatatttatttt

SEQ ID NO: 3599158 - DNA, 15 bp, Homo sapiens
caaatatttattttc

SEQ ID NO: 3599159 - DNA, 20 bp, Homo sapiens
caaatatttattttctttct

SEQ ID NO: 3599160 - DNA, 13 bp, Homo sapiens
caaatcagaaaac

SEQ ID NO: 3599161 - DNA, 22 bp, Homo sapiens
caaatcagaagtcatcttgcta

SEQ ID NO: 3599162 - DNA, 18 bp, Homo sapiens
caaatccagtggtgggta

SEQ ID NO: 3599163 - DNA, 19 bp, Homo sapiens
caaatcctagactgctcct

SEQ ID NO: 3599164 - DNA, 20 bp, Homo sapiens
caaatcctagactgctcctg

SEQ ID NO: 3599165 - DNA, 21 bp, Homo sapiens
caaatctgacatattatgcct

SEQ ID NO: 3599166 - DNA, 18 bp, Homo sapiens
caaatcttgaatttctgc

SEQ ID NO: 3599167 - DNA, 19 bp, Homo sapiens
caaatctttaagaatagtt

SEQ ID NO: 3599168 - DNA, 18 bp, Homo sapiens
caaatgaaatatatttaa

SEQ ID NO: 3599169 - DNA, 14 bp, Homo sapiens
caaatgaccgagcc

SEQ ID NO: 3599170 - DNA, 21 bp, Homo sapiens
caaatgaccgagccctggaga

SEQ ID NO: 3599171 - DNA, 15 bp, Homo sapiens
caaatgcctgactca

SEQ ID NO: 3599172 - DNA, 19 bp, Homo sapiens
caaatgccttaaaatggaa

SEQ ID NO: 3599173 - DNA, 22 bp, Homo sapiens
caaatgctctctcaaattgtca

SEQ ID NO: 3599174 - DNA, 19 bp, Homo sapiens
caaatggccattttaaaat

SEQ ID NO: 3599175 - DNA, 18 bp, Homo sapiens
caaatggggccagatcca

SEQ ID NO: 3599176 - DNA, 12 bp, Homo sapiens
caaatgtttaaa

SEQ ID NO: 3599177 - DNA, 13 bp, Homo sapiens
caaatgttttaaa

SEQ ID NO: 3599178 - DNA, 14 bp, Homo sapiens
caaattctgtctgg

SEQ ID NO: 3599179 - DNA, 17 bp, Homo sapiens
caaattctgtctgggga

SEQ ID NO: 3599180 - DNA, 18 bp, Homo sapiens
caaattctgtctggggac

SEQ ID NO: 3599181 - DNA, 15 bp, Homo sapiens
caaatttcacttata

SEQ ID NO: 3599182 - DNA, 14 bp, Homo sapiens
caacaaagaacact

SEQ ID NO: 3599183 - DNA, 18 bp, Homo sapiens
caacaacgtgagagaaag

SEQ ID NO: 3599184 - DNA, 22 bp, Homo sapiens
caacaacgtgagagaaagagag

SEQ ID NO: 3599185 - DNA, 14 bp, Homo sapiens
caacaagaaccact

SEQ ID NO: 3599186 - DNA, 19 bp, Homo sapiens
caacaatgaatcagaacag

SEQ ID NO: 3599187 - DNA, 16 bp, Homo sapiens
caacacagaggaattt

SEQ ID NO: 3599188 - DNA, 17 bp, Homo sapiens
caacagagaggggcagg

SEQ ID NO: 3599189 - DNA, 23 bp, Homo sapiens
caacagatctggaacctcagcct

SEQ ID NO: 3599190 - DNA, 14 bp, Homo sapiens
caacagatttaaag

SEQ ID NO: 3599191 - DNA, 16 bp, Homo sapiens
caacagatttaaagaa

SEQ ID NO: 3599192 - DNA, 17 bp, Homo sapiens
caacagcaaaggaacta

SEQ ID NO: 3599193 - DNA, 17 bp, Homo sapiens
caacagcacctccccgc

SEQ ID NO: 3599194 - DNA, 20 bp, Homo sapiens
caacagcacctccccgctgg

SEQ ID NO: 3599195 - DNA, 22 bp, Homo sapiens
caacagcacctccccgctggga

SEQ ID NO: 3599196 - DNA, 14 bp, Homo sapiens
caacagcagtctcc

SEQ ID NO: 3599197 - DNA, 14 bp, Homo sapiens
caacagccaagctg

SEQ ID NO: 3599198 - DNA, 22 bp, Homo sapiens
caacatatactatttagtctca

SEQ ID NO: 3599199 - DNA, 22 bp, Homo sapiens
caacatgatccccgtctctgcc

SEQ ID NO: 3599200 - DNA, 23 bp, Homo sapiens
caacatgatccccgtctctgccc

SEQ ID NO: 3599201 - DNA, 13 bp, Homo sapiens
caacatgtttctg

SEQ ID NO: 3599202 - DNA, 15 bp, Homo sapiens
caacatttctcatgt

SEQ ID NO: 3599203 - DNA, 16 bp, Homo sapiens
caacatttctcatgtt

SEQ ID NO: 3599204 - DNA, 18 bp, Homo sapiens
caacatttctcatgttga

SEQ ID NO: 3599205 - DNA, 23 bp, Homo sapiens
caacatttctcatgttgaagctt

SEQ ID NO: 3599206 - DNA, 18 bp, Homo sapiens
caaccaaggaatttaaaa

SEQ ID NO: 3599207 - DNA, 16 bp, Homo sapiens
caaccacactgcttgg

SEQ ID NO: 3599208 - DNA, 12 bp, Homo sapiens
caaccagccagc

SEQ ID NO: 3599209 - DNA, 14 bp, Homo sapiens
caaccagccagcgt

SEQ ID NO: 3599210 - DNA, 11 bp, Homo sapiens
caaccagcccg

SEQ ID NO: 3599211 - DNA, 13 bp, Homo sapiens
caaccatcatgtg

SEQ ID NO: 3599212 - DNA, 16 bp, Homo sapiens
caaccattccagactg

SEQ ID NO: 3599213 - DNA, 22 bp, Homo sapiens
caaccattccagactgcttcca

SEQ ID NO: 3599214 - DNA, 14 bp, Homo sapiens
caacccccctccca

SEQ ID NO: 3599215 - DNA, 16 bp, Homo sapiens
caacccccctcccaga

SEQ ID NO: 3599216 - DNA, 13 bp, Homo sapiens
caacccctctcca

SEQ ID NO: 3599217 - DNA, 21 bp, Homo sapiens
caacccctctccaggcctgtc

SEQ ID NO: 3599218 - DNA, 22 bp, Homo sapiens
caacccctctttcgtctactgc

SEQ ID NO: 3599219 - DNA, 17 bp, Homo sapiens
caacccttccctcacct

SEQ ID NO: 3599220 - DNA, 19 bp, Homo sapiens
caacccttcctgctgctgc

SEQ ID NO: 3599221 - DNA, 20 bp, Homo sapiens
caacctctgtggtcacccat

SEQ ID NO: 3599222 - DNA, 23 bp, Homo sapiens
caacctctgtggtcacccatgca

SEQ ID NO: 3599223 - DNA, 15 bp, Homo sapiens
caacctgttcttaga

SEQ ID NO: 3599224 - DNA, 19 bp, Homo sapiens
caaccttctgtggctcaca

SEQ ID NO: 3599225 - DNA, 21 bp, Homo sapiens
caacgcccctccaaacctcca

SEQ ID NO: 3599226 - DNA, 15 bp, Homo sapiens
cacccacacagctgc

SEQ ID NO: 3599227 - DNA, 17 bp, Homo sapiens
cacccacacagctgccc

SEQ ID NO: 3599228 - DNA, 24 bp, Homo sapiens
cacccacacagctgccctagctga

SEQ ID NO: 3599229 - DNA, 14 bp, Homo sapiens
cacccaccccctct

SEQ ID NO: 3599230 - DNA, 16 bp, Homo sapiens
cacccacctccctgcc

SEQ ID NO: 3599231 - DNA, 18 bp, Homo sapiens
cacccacctccctgcctc

SEQ ID NO: 3599232 - DNA, 17 bp, Homo sapiens
cacccactctgcactgg

SEQ ID NO: 3599233 - DNA, 13 bp, Homo sapiens
cacccagcaggca

SEQ ID NO: 3599234 - DNA, 19 bp, Homo sapiens
cacccagcaggcagagtgg

SEQ ID NO: 3599235 - DNA, 18 bp, Homo sapiens
cacccaggaactcctgac

SEQ ID NO: 3599236 - DNA, 18 bp, Homo sapiens
cacccatgaaagaaaact

SEQ ID NO: 3599237 - DNA, 14 bp, Homo sapiens
cacccatgccagag

SEQ ID NO: 3599238 - DNA, 12 bp, Homo sapiens
cacccatttaaa

SEQ ID NO: 3599239 - DNA, 23 bp, Homo sapiens
cacccccacaagctgtccctgca

SEQ ID NO: 3599240 - DNA, 13 bp, Homo sapiens
cacccccaggtgc

SEQ ID NO: 3599241 - DNA, 14 bp, Homo sapiens
cacccccaggtgca

SEQ ID NO: 3599242 - DNA, 14 bp, Homo sapiens
cacccccatgctgc

SEQ ID NO: 3599243 - DNA, 16 bp, Homo sapiens
cacccccatgctgcct

SEQ ID NO: 3599244 - DNA, 20 bp, Homo sapiens
cacccccatgctgccttcag

SEQ ID NO: 3599245 - DNA, 14 bp, Homo sapiens
caccccccaagctg

SEQ ID NO: 3599246 - DNA, 16 bp, Homo sapiens
cacccccctctgctgc

SEQ ID NO: 3599247 - DNA, 17 bp, Homo sapiens
cacccccctctgctgcc

SEQ ID NO: 3599248 - DNA, 13 bp, Homo sapiens
caccccctccccg

SEQ ID NO: 3599249 - DNA, 15 bp, Homo sapiens
caccccctcctcccc

SEQ ID NO: 3599250 - DNA, 23 bp, Homo sapiens
caccccctctggagaaggcctgg

SEQ ID NO: 3599251 - DNA, 19 bp, Homo sapiens
caccccctgctccaccagc

SEQ ID NO: 3599252 - DNA, 22 bp, Homo sapiens
caccccctgctccaccagcagc

SEQ ID NO: 3599253 - DNA, 13 bp, Homo sapiens
cacccctagccct

SEQ ID NO: 3599254 - DNA, 17 bp, Homo sapiens
cacccctagccctggtt

SEQ ID NO: 3599255 - DNA, 14 bp, Homo sapiens
cacccctcactccc

SEQ ID NO: 3599256 - DNA, 16 bp, Homo sapiens
cacccctcactcccca

SEQ ID NO: 3599257 - DNA, 16 bp, Homo sapiens
caccccttcctcgtgg

SEQ ID NO: 3599258 - DNA, 19 bp, Homo sapiens
caccccttcctgggcacac

SEQ ID NO: 3599259 - DNA, 21 bp, Homo sapiens
caccccttggaggagagagac

SEQ ID NO: 3599260 - DNA, 18 bp, Homo sapiens
cacccgggggagcccagt

SEQ ID NO: 3599261 - DNA, 23 bp, Homo sapiens
cacccggtccccactttattgcc

SEQ ID NO: 3599262 - DNA, 20 bp, Homo sapiens
caccctctgggggtcctctc

SEQ ID NO: 3599263 - DNA, 15 bp, Homo sapiens
caccctgcgcctcca

SEQ ID NO: 3599264 - DNA, 19 bp, Homo sapiens
caccctgcgcctccagagg

SEQ ID NO: 3599265 - DNA, 13 bp, Homo sapiens
caccctggcctga

SEQ ID NO: 3599266 - DNA, 12 bp, Homo sapiens
caccctgggagc

SEQ ID NO: 3599267 - DNA, 16 bp, Homo sapiens
caccctgggagccagt

SEQ ID NO: 3599268 - DNA, 15 bp, Homo sapiens
caccctggtctgtgg

SEQ ID NO: 3599269 - DNA, 16 bp, Homo sapiens
caccctggtgggccaa

SEQ ID NO: 3599270 - DNA, 14 bp, Homo sapiens
caccctttccagga

SEQ ID NO: 3599271 - DNA, 13 bp, Homo sapiens
caccgaccaactg

SEQ ID NO: 3599272 - DNA, 15 bp, Homo sapiens
caccgaccaactgcc

SEQ ID NO: 3599273 - DNA, 15 bp, Homo sapiens
caccgactgaaaata

SEQ ID NO: 3599274 - DNA, 17 bp, Homo sapiens
caccgagggcgaccccg

SEQ ID NO: 3599275 - DNA, 15 bp, Homo sapiens
caccgaggttcccag

SEQ ID NO: 3599276 - DNA, 21 bp, Homo sapiens
caccgccacaataaagatcgc

SEQ ID NO: 3599277 - DNA, 23 bp, Homo sapiens
caccgtggcagcttgctgggctt

SEQ ID NO: 3599278 - DNA, 17 bp, Homo sapiens
cacctagagctccagtt

SEQ ID NO: 3599279 - DNA, 12 bp, Homo sapiens
cacctagcagcc

SEQ ID NO: 3599280 - DNA, 17 bp, Homo sapiens
cacctagcagcctcaaa

SEQ ID NO: 3599281 - DNA, 13 bp, Homo sapiens
cacctatctcagc

SEQ ID NO: 3599282 - DNA, 14 bp, Homo sapiens
cacctatctcagcc

SEQ ID NO: 3599283 - DNA, 17 bp, Homo sapiens
cacctatgagatggcca

SEQ ID NO: 3599284 - DNA, 21 bp, Homo sapiens
cacctatgagatggccatgct

SEQ ID NO: 3599285 - DNA, 23 bp, Homo sapiens
cacctcaaaataccatgccattt

SEQ ID NO: 3599286 - DNA, 13 bp, Homo sapiens
cacctcacagcta

SEQ ID NO: 3599287 - DNA, 17 bp, Homo sapiens
cacctccaagcatttca

SEQ ID NO: 3599288 - DNA, 22 bp, Homo sapiens
cacctccaagcatttcatgaaa

SEQ ID NO: 3599289 - DNA, 12 bp, Homo sapiens
cacctccccctt

SEQ ID NO: 3599290 - DNA, 22 bp, Homo sapiens
cacctccccctttcacactgga

SEQ ID NO: 3599291 - DNA, 13 bp, Homo sapiens
cacctccctgcct

SEQ ID NO: 3599292 - DNA, 17 bp, Homo sapiens
cacctcctaccctccca

SEQ ID NO: 3599293 - DNA, 20 bp, Homo sapiens
cacctcggagggatggagaa

SEQ ID NO: 3599294 - DNA, 17 bp, Homo sapiens
cacctcggcacacactg

SEQ ID NO: 3599295 - DNA, 16 bp, Homo sapiens
cacctctcctgccctg

SEQ ID NO: 3599296 - DNA, 22 bp, Homo sapiens
cacctctgggtccttggctccc

SEQ ID NO: 3599297 - DNA, 16 bp, Homo sapiens
cacctgaatcagctgg

SEQ ID NO: 3599298 - DNA, 17 bp, Homo sapiens
cacctgaatcagctgga

SEQ ID NO: 3599299 - DNA, 19 bp, Homo sapiens
cacctgagtcaccctacct

SEQ ID NO: 3599300 - DNA, 23 bp, Homo sapiens
cacctgagtcaccctacctgtgc

SEQ ID NO: 3599301 - DNA, 13 bp, Homo sapiens
cacctgcaggacc

SEQ ID NO: 3599302 - DNA, 13 bp, Homo sapiens
cacctgcccaacc

SEQ ID NO: 3599303 - DNA, 15 bp, Homo sapiens
cacctgctccagaag

SEQ ID NO: 3599304 - DNA, 10 bp, Homo sapiens
cacctggaga

SEQ ID NO: 3599305 - DNA, 19 bp, Homo sapiens
cacctggatctatccctgc

SEQ ID NO: 3599306 - DNA, 22 bp, Homo sapiens
cacctggattgcgcctaatgtg

SEQ ID NO: 3599307 - DNA, 18 bp, Homo sapiens
cacctgtaatcccagcac

SEQ ID NO: 3599308 - DNA, 15 bp, Homo sapiens
cacctgtagcagcca

SEQ ID NO: 3599309 - DNA, 22 bp, Homo sapiens
cacctgtggatgtttttgagta

SEQ ID NO: 3599310 - DNA, 18 bp, Homo sapiens
caccttagagaagctacc

SEQ ID NO: 3599311 - DNA, 22 bp, Homo sapiens
cacctttcataatctttgcttt

SEQ ID NO: 3599312 - DNA, 22 bp, Homo sapiens
cacgagggtctcccctcctgca

SEQ ID NO: 3599313 - DNA, 15 bp, Homo sapiens
cacgatcacaggcct

SEQ ID NO: 3599314 - DNA, 22 bp, Homo sapiens
cacgcactctccccgctcaggg

SEQ ID NO: 3599315 - DNA, 15 bp, Homo sapiens
cacgcaggcacagca

SEQ ID NO: 3599316 - DNA, 20 bp, Homo sapiens
cacgcggatgctactactgc

SEQ ID NO: 3599317 - DNA, 21 bp, Homo sapiens
cacgctgctctgccccagctt

SEQ ID NO: 3599318 - DNA, 23 bp, Homo sapiens
cacggcctgcccagtcgacccca

SEQ ID NO: 3599319 - DNA, 19 bp, Homo sapiens
cacggcgggatcctccaca

SEQ ID NO: 3599320 - DNA, 18 bp, Homo sapiens
cacgggacggaagtgctt

SEQ ID NO: 3599321 - DNA, 12 bp, Homo sapiens
cacgtcccagca

SEQ ID NO: 3599322 - DNA, 20 bp, Homo sapiens
cacgtcccagcatccctgga

SEQ ID NO: 3599323 - DNA, 15 bp, Homo sapiens
cacgtgacaggctcg

SEQ ID NO: 3599324 - DNA, 12 bp, Homo sapiens
cacgtggctggc

SEQ ID NO: 3599325 - DNA, 20 bp, Homo sapiens
cacgtggggcccactgctcg

SEQ ID NO: 3599326 - DNA, 19 bp, Homo sapiens
cacgtgtggcctgttcttc

SEQ ID NO: 3599327 - DNA, 19 bp, Homo sapiens
cactaaaatgaggatccag

SEQ ID NO: 3599328 - DNA, 20 bp, Homo sapiens
cactaaaatgaggatccagg

SEQ ID NO: 3599329 - DNA, 21 bp, Homo sapiens
cactaaattgcagtttacagt

SEQ ID NO: 3599330 - DNA, 21 bp, Homo sapiens
cactaagcagaggaggggccg

SEQ ID NO: 3599331 - DNA, 12 bp, Homo sapiens
cactaaggggcc

SEQ ID NO: 3599332 - DNA, 13 bp, Homo sapiens
cactaaggggccc

SEQ ID NO: 3599333 - DNA, 23 bp, Homo sapiens
cactaaggggcccggccagccat

SEQ ID NO: 3599334 - DNA, 22 bp, Homo sapiens
cactaagtagaataaagaaaaa

SEQ ID NO: 3599335 - DNA, 15 bp, Homo sapiens
cactaccaaaagaca

SEQ ID NO: 3599336 - DNA, 16 bp, Homo sapiens
cactaccaaaagacat

SEQ ID NO: 3599337 - DNA, 18 bp, Homo sapiens
cactaccaaaagacatta

SEQ ID NO: 3599338 - DNA, 17 bp, Homo sapiens
cactaccagccagcctc

SEQ ID NO: 3599339 - DNA, 12 bp, Homo sapiens
cactagagacaa

SEQ ID NO: 3599340 - DNA, 20 bp, Homo sapiens
cactagtggaaagtcaggct

SEQ ID NO: 3599341 - DNA, 14 bp, Homo sapiens
cactattatttcct

SEQ ID NO: 3599342 - DNA, 16 bp, Homo sapiens
cactatttgcagaggc

SEQ ID NO: 3599343 - DNA, 18 bp, Homo sapiens
cactcaccactaccagcc

SEQ ID NO: 3599344 - DNA, 18 bp, Homo sapiens
cactcacccctagccctg

SEQ ID NO: 3599345 - DNA, 14 bp, Homo sapiens
cactcagatttaag

SEQ ID NO: 3599346 - DNA, 22 bp, Homo sapiens
cactcagctcttggctccactg

SEQ ID NO: 3599347 - DNA, 15 bp, Homo sapiens
cactcaggggacccc

SEQ ID NO: 3599348 - DNA, 19 bp, Homo sapiens
cactcagtgcctccacatg

SEQ ID NO: 3599349 - DNA, 14 bp, Homo sapiens
cactccaagtgccc

SEQ ID NO: 3599350 - DNA, 22 bp, Homo sapiens
cactccaagtgccccaccactc

SEQ ID NO: 3599351 - DNA, 12 bp, Homo sapiens
cactccactgcc

SEQ ID NO: 3599352 - DNA, 11 bp, Homo sapiens
cactccagact

SEQ ID NO: 3599353 - DNA, 12 bp, Homo sapiens
cactcccaccac

SEQ ID NO: 3599354 - DNA, 13 bp, Homo sapiens
cactcccaggatg

SEQ ID NO: 3599355 - DNA, 13 bp, Homo sapiens
cactcccagtgct

SEQ ID NO: 3599356 - DNA, 21 bp, Homo sapiens
cactccccaacccctctccag

SEQ ID NO: 3599357 - DNA, 23 bp, Homo sapiens
cactccccagagctgtgccagca

SEQ ID NO: 3599358 - DNA, 14 bp, Homo sapiens
cactccccagccag

SEQ ID NO: 3599359 - DNA, 24 bp, Homo sapiens
cagcccagcaccccttcctcgtgg

SEQ ID NO: 3599360 - DNA, 12 bp, Homo sapiens
cagcccagccag

SEQ ID NO: 3599361 - DNA, 13 bp, Homo sapiens
cagcccagccagg

SEQ ID NO: 3599362 - DNA, 12 bp, Homo sapiens
cagcccaggcca

SEQ ID NO: 3599363 - DNA, 17 bp, Homo sapiens
cagccccaactccaggg

SEQ ID NO: 3599364 - DNA, 15 bp, Homo sapiens
cagccccagccaggg

SEQ ID NO: 3599365 - DNA, 18 bp, Homo sapiens
cagccccgttttggggac

SEQ ID NO: 3599366 - DNA, 22 bp, Homo sapiens
cagccccgttttggggacgtga

SEQ ID NO: 3599367 - DNA, 20 bp, Homo sapiens
cagcccggggccagcttggc

SEQ ID NO: 3599368 - DNA, 23 bp, Homo sapiens
cagccctaagtggctgccttctt

SEQ ID NO: 3599369 - DNA, 17 bp, Homo sapiens
cagccctccctgcccct

SEQ ID NO: 3599370 - DNA, 17 bp, Homo sapiens
cagccctgcaccatgct

SEQ ID NO: 3599371 - DNA, 15 bp, Homo sapiens
cagccctgcctgaga

SEQ ID NO: 3599372 - DNA, 15 bp, Homo sapiens
cagccctggcctggc

SEQ ID NO: 3599373 - DNA, 16 bp, Homo sapiens
cagccctggcctggct

SEQ ID NO: 3599374 - DNA, 17 bp, Homo sapiens
cagccctggcctggctg

SEQ ID NO: 3599375 - DNA, 18 bp, Homo sapiens
cagccctggcctggctgg

SEQ ID NO: 3599376 - DNA, 23 bp, Homo sapiens
cagccctgggggattcctgagct

SEQ ID NO: 3599377 - DNA, 17 bp, Homo sapiens
cagccgcagagaaatgc

SEQ ID NO: 3599378 - DNA, 18 bp, Homo sapiens
cagccgcagagaaatgcc

SEQ ID NO: 3599379 - DNA, 21 bp, Homo sapiens
cagccgcagagaaatgcccca

SEQ ID NO: 3599380 - DNA, 22 bp, Homo sapiens
cagccgcagagaaatgccccag

SEQ ID NO: 3599381 - DNA, 13 bp, Homo sapiens
cagccgccagctg

SEQ ID NO: 3599382 - DNA, 16 bp, Homo sapiens
cagccgccggaagtgg

SEQ ID NO: 3599383 - DNA, 14 bp, Homo sapiens
cagccgtattttac

SEQ ID NO: 3599384 - DNA, 14 bp, Homo sapiens
cagccgtgccttca

SEQ ID NO: 3599385 - DNA, 18 bp, Homo sapiens
cagccgtgccttcagctc

SEQ ID NO: 3599386 - DNA, 20 bp, Homo sapiens
cagccgtgccttcagctcta

SEQ ID NO: 3599387 - DNA, 13 bp, Homo sapiens
cagcctaagaaga

SEQ ID NO: 3599388 - DNA, 14 bp, Homo sapiens
cagcctaagaagaa

SEQ ID NO: 3599389 - DNA, 15 bp, Homo sapiens
cagcctaagaagaag

SEQ ID NO: 3599390 - DNA, 22 bp, Homo sapiens
cagcctaccgctggccctgccg

SEQ ID NO: 3599391 - DNA, 17 bp, Homo sapiens
cagcctagcctggctct

SEQ ID NO: 3599392 - DNA, 18 bp, Homo sapiens
cagcctatagtaaatgtg

SEQ ID NO: 3599393 - DNA, 18 bp, Homo sapiens
cagcctcagaaggcccca

SEQ ID NO: 3599394 - DNA, 19 bp, Homo sapiens
cagcctcagaaggccccag

SEQ ID NO: 3599395 - DNA, 14 bp, Homo sapiens
cagcctcccctccc

SEQ ID NO: 3599396 - DNA, 14 bp, Homo sapiens
cagcctccctgaag

SEQ ID NO: 3599397 - DNA, 17 bp, Homo sapiens
cagcctccctgaagcct

SEQ ID NO: 3599398 - DNA, 13 bp, Homo sapiens
cagcctccctgtc

SEQ ID NO: 3599399 - DNA, 23 bp, Homo sapiens
cagcctccctgtctccagctgcc

SEQ ID NO: 3599400 - DNA, 17 bp, Homo sapiens
cagcctccgggcgtgtg

SEQ ID NO: 3599401 - DNA, 16 bp, Homo sapiens
cagcctcctcatctgg

SEQ ID NO: 3599402 - DNA, 17 bp, Homo sapiens
cagcctcctcatctggg

SEQ ID NO: 3599403 - DNA, 23 bp, Homo sapiens
cagcctcctcatctgggggagtg

SEQ ID NO: 3599404 - DNA, 16 bp, Homo sapiens
cagcctcctgtttggt

SEQ ID NO: 3599405 - DNA, 19 bp, Homo sapiens
cagcctctccgactctgca

SEQ ID NO: 3599406 - DNA, 12 bp, Homo sapiens
cagcctctctgg

SEQ ID NO: 3599407 - DNA, 19 bp, Homo sapiens
cagcctgactagaactcct

SEQ ID NO: 3599408 - DNA, 14 bp, Homo sapiens
cagcctgcttccca

SEQ ID NO: 3599409 - DNA, 20 bp, Homo sapiens
cagcctgctttcctgcagca

SEQ ID NO: 3599410 - DNA, 21 bp, Homo sapiens
cagcctgctttcctgcagcag

SEQ ID NO: 3599411 - DNA, 12 bp, Homo sapiens
cagcctggaagg

SEQ ID NO: 3599412 - DNA, 13 bp, Homo sapiens
cagcctggcacag

SEQ ID NO: 3599413 - DNA, 21 bp, Homo sapiens
cagcctggcacagggcagtgg

SEQ ID NO: 3599414 - DNA, 20 bp, Homo sapiens
cagcctggccagacacaggc

SEQ ID NO: 3599415 - DNA, 18 bp, Homo sapiens
cagcctggctctgccccc

SEQ ID NO: 3599416 - DNA, 22 bp, Homo sapiens
cagcctggctctgccccctccc

SEQ ID NO: 3599417 - DNA, 19 bp, Homo sapiens
cagcctgggagcccagagg

SEQ ID NO: 3599418 - DNA, 19 bp, Homo sapiens
cagcctgggcgacaaaaac

SEQ ID NO: 3599419 - DNA, 15 bp, Homo sapiens
cagcctggggtctgg

SEQ ID NO: 3599420 - DNA, 12 bp, Homo sapiens
cagcctgtcctg

SEQ ID NO: 3599421 - DNA, 19 bp, Homo sapiens
cagcctgttccagaaggag

SEQ ID NO: 3599422 - DNA, 20 bp, Homo sapiens
cagccttaaggccctcattc

SEQ ID NO: 3599423 - DNA, 13 bp, Homo sapiens
cagccttagagct

SEQ ID NO: 3599424 - DNA, 16 bp, Homo sapiens
cagccttccccagctc

SEQ ID NO: 3599425 - DNA, 18 bp, Homo sapiens
cagccttgcaacccaagg

SEQ ID NO: 3599426 - DNA, 20 bp, Homo sapiens
cagccttgcagcggctcctg

SEQ ID NO: 3599427 - DNA, 13 bp, Homo sapiens
cagccttgccaga

SEQ ID NO: 3599428 - DNA, 16 bp, Homo sapiens
cagccttgccagagat

SEQ ID NO: 3599429 - DNA, 21 bp, Homo sapiens
cagccttgtacagtctgctcc

SEQ ID NO: 3599430 - DNA, 15 bp, Homo sapiens
cagcctttgcccaaa

SEQ ID NO: 3599431 - DNA, 19 bp, Homo sapiens
cagccttttatgtattttc

SEQ ID NO: 3599432 - DNA, 15 bp, Homo sapiens
cagcgaacagcctta

SEQ ID NO: 3599433 - DNA, 22 bp, Homo sapiens
cagcgaactctcagaaataaat

SEQ ID NO: 3599434 - DNA, 12 bp, Homo sapiens
cagcgcagggct

SEQ ID NO: 3599435 - DNA, 18 bp, Homo sapiens
cagcgcagggctggcacg

SEQ ID NO: 3599436 - DNA, 16 bp, Homo sapiens
cagcgcatcctgcagg

SEQ ID NO: 3599437 - DNA, 24 bp, Homo sapiens
cagcgccaagtaaacagggtacct

SEQ ID NO: 3599438 - DNA, 22 bp, Homo sapiens
cagcgggaatggcagctgccac

SEQ ID NO: 3599439 - DNA, 23 bp, Homo sapiens
cagcgggaatggcagctgccacg

SEQ ID NO: 3599440 - DNA, 18 bp, Homo sapiens
cagctaagaacctggaac

SEQ ID NO: 3599441 - DNA, 15 bp, Homo sapiens
cagctaagctaggaa

SEQ ID NO: 3599442 - DNA, 21 bp, Homo sapiens
cagctacaaccctaccctggc

SEQ ID NO: 3599443 - DNA, 24 bp, Homo sapiens
cagctactcagtggggctggcatc

SEQ ID NO: 3599444 - DNA, 22 bp, Homo sapiens
cagctagaaaacacaaaatctt

SEQ ID NO: 3599445 - DNA, 23 bp, Homo sapiens
cagctagatttgtgtccacacta

SEQ ID NO: 3599446 - DNA, 12 bp, Homo sapiens
cagctagtgcct

SEQ ID NO: 3599447 - DNA, 16 bp, Homo sapiens
cagctatttcagcctc

SEQ ID NO: 3599448 - DNA, 19 bp, Homo sapiens
cagctatttcagcctcctg

SEQ ID NO: 3599449 - DNA, 16 bp, Homo sapiens
cagctcaagggctggc

SEQ ID NO: 3599450 - DNA, 18 bp, Homo sapiens
cagctcaagggctggcac

SEQ ID NO: 3599451 - DNA, 19 bp, Homo sapiens
cagctcaagggctggcact

SEQ ID NO: 3599452 - DNA, 15 bp, Homo sapiens
cagctcagccagtgg

SEQ ID NO: 3599453 - DNA, 14 bp, Homo sapiens
cagctcagccctgg

SEQ ID NO: 3599454 - DNA, 16 bp, Homo sapiens
cagctcagccctggcc

SEQ ID NO: 3599455 - DNA, 18 bp, Homo sapiens
cagctcagccctggcctg

SEQ ID NO: 3599456 - DNA, 18 bp, Homo sapiens
cagctcaggacagatgcc

SEQ ID NO: 3599457 - DNA, 14 bp, Homo sapiens
cagctccaacctgc

SEQ ID NO: 3599458 - DNA, 20 bp, Homo sapiens
cagctccaacctgcaaagat

SEQ ID NO: 3599459 - DNA, 23 bp, Homo sapiens
cagctccaacctgcaaagatctg

SEQ ID NO: 3599460 - DNA, 21 bp, Homo sapiens
cagctcccaaggctctgagca

SEQ ID NO: 3599461 - DNA, 20 bp, Homo sapiens
cagctcccctcggagaagag

SEQ ID NO: 3599462 - DNA, 21 bp, Homo sapiens
cagctcccctcggagaagagc

SEQ ID NO: 3599463 - DNA, 22 bp, Homo sapiens
cagctcccctcggagaagagct

SEQ ID NO: 3599464 - DNA, 13 bp, Homo sapiens
cagctccctcctc

SEQ ID NO: 3599465 - DNA, 11 bp, Homo sapiens
cagctccctgc

SEQ ID NO: 3599466 - DNA, 16 bp, Homo sapiens
cagctccctgcctgtt

SEQ ID NO: 3599467 - DNA, 17 bp, Homo sapiens
cagctccgtgtttctct

SEQ ID NO: 3599468 - DNA, 20 bp, Homo sapiens
cagctcctccatgcctgacc

SEQ ID NO: 3599469 - DNA, 21 bp, Homo sapiens
cagctcctccatgcctgacca

SEQ ID NO: 3599470 - DNA, 13 bp, Homo sapiens
cagctcctgacct

SEQ ID NO: 3599471 - DNA, 20 bp, Homo sapiens
cagctctagacactgccaca

SEQ ID NO: 3599472 - DNA, 15 bp, Homo sapiens
cagctctagcctctg

SEQ ID NO: 3599473 - DNA, 19 bp, Homo sapiens
cagctctagcctctggact

SEQ ID NO: 3599474 - DNA, 16 bp, Homo sapiens
cagctctgacatccct

SEQ ID NO: 3599475 - DNA, 17 bp, Homo sapiens
cagctctgacatccctt

SEQ ID NO: 3599476 - DNA, 23 bp, Homo sapiens
cagctctgtcctcttggccatcc

SEQ ID NO: 3599477 - DNA, 23 bp, Homo sapiens
cagctcttccagggcagcggctc

SEQ ID NO: 3599478 - DNA, 17 bp, Homo sapiens
cagctcttggctccact

SEQ ID NO: 3599479 - DNA, 22 bp, Homo sapiens
cagctgaaatatgctggctgga

SEQ ID NO: 3599480 - DNA, 22 bp, Homo sapiens
cagctgaaattcaccaagaaca

SEQ ID NO: 3599481 - DNA, 14 bp, Homo sapiens
cagctgaaggcagt

SEQ ID NO: 3599482 - DNA, 15 bp, Homo sapiens
cagctgaaggcagtg

SEQ ID NO: 3599483 - DNA, 17 bp, Homo sapiens
cagctgaaggcagtggc

SEQ ID NO: 3599484 - DNA, 19 bp, Homo sapiens
cagctgaaggcagtggcag

SEQ ID NO: 3599485 - DNA, 11 bp, Homo sapiens
cagctgacagc

SEQ ID NO: 3599486 - DNA, 20 bp, Homo sapiens
cagctgacagccacaccgtg

SEQ ID NO: 3599487 - DNA, 13 bp, Homo sapiens
cagctgactaaac

SEQ ID NO: 3599488 - DNA, 18 bp, Homo sapiens
cagctgactaaacttttt

SEQ ID NO: 3599489 - DNA, 14 bp, Homo sapiens
cagctgccctagct

SEQ ID NO: 3599490 - DNA, 16 bp, Homo sapiens
cagctgccctagctga

SEQ ID NO: 3599491 - DNA, 23 bp, Homo sapiens
catattatttcattggtcttctt

SEQ ID NO: 3599492 - DNA, 16 bp, Homo sapiens
catatttacttcttat

SEQ ID NO: 3599493 - DNA, 24 bp, Homo sapiens
catatttctaattggctttactat

SEQ ID NO: 3599494 - DNA, 16 bp, Homo sapiens
catatttgccaataaa

SEQ ID NO: 3599495 - DNA, 18 bp, Homo sapiens
catatttgccaataaagc

SEQ ID NO: 3599496 - DNA, 20 bp, Homo sapiens
catatttgccaataaagctt

SEQ ID NO: 3599497 - DNA, 21 bp, Homo sapiens
catatttgccaataaagcttt

SEQ ID NO: 3599498 - DNA, 16 bp, Homo sapiens
catattttattgtatt

SEQ ID NO: 3599499 - DNA, 13 bp, Homo sapiens
catatttttacaa

SEQ ID NO: 3599500 - DNA, 14 bp, Homo sapiens
catcaacatcttgg

SEQ ID NO: 3599501 - DNA, 17 bp, Homo sapiens
catcaatacaaccagcc

SEQ ID NO: 3599502 - DNA, 13 bp, Homo sapiens
catcacccacctt

SEQ ID NO: 3599503 - DNA, 16 bp, Homo sapiens
catcacgacacatttg

SEQ ID NO: 3599504 - DNA, 19 bp, Homo sapiens
catcactgtatccattcta

SEQ ID NO: 3599505 - DNA, 21 bp, Homo sapiens
catcagaactcttcctcctcc

SEQ ID NO: 3599506 - DNA, 15 bp, Homo sapiens
catcagctgctgaaa

SEQ ID NO: 3599507 - DNA, 20 bp, Homo sapiens
catcaggctaagaccctgtg

SEQ ID NO: 3599508 - DNA, 23 bp, Homo sapiens
catcagtcaacagagaggggcag

SEQ ID NO: 3599509 - DNA, 18 bp, Homo sapiens
catcatcacgacacattt

SEQ ID NO: 3599510 - DNA, 11 bp, Homo sapiens
catcatccctt

SEQ ID NO: 3599511 - DNA, 22 bp, Homo sapiens
catcatctgggaacttgtcaca

SEQ ID NO: 3599512 - DNA, 16 bp, Homo sapiens
catcattactgttcca

SEQ ID NO: 3599513 - DNA, 23 bp, Homo sapiens
catcattgtttagatgaggctca

SEQ ID NO: 3599514 - DNA, 13 bp, Homo sapiens
catcatttcagcc

SEQ ID NO: 3599515 - DNA, 15 bp, Homo sapiens
catcatttcagccaa

SEQ ID NO: 3599516 - DNA, 19 bp, Homo sapiens
catccaaggcaaacaatcc

SEQ ID NO: 3599517 - DNA, 15 bp, Homo sapiens
catccaatgtgaagt

SEQ ID NO: 3599518 - DNA, 16 bp, Homo sapiens
catccacataaccctg

SEQ ID NO: 3599519 - DNA, 19 bp, Homo sapiens
catccacataaccctgtca

SEQ ID NO: 3599520 - DNA, 15 bp, Homo sapiens
catccagacctggct

SEQ ID NO: 3599521 - DNA, 23 bp, Homo sapiens
catccagcagatttccagccttc

SEQ ID NO: 3599522 - DNA, 19 bp, Homo sapiens
catccatcagcaccccagt

SEQ ID NO: 3599523 - DNA, 13 bp, Homo sapiens
catccatcctgag

SEQ ID NO: 3599524 - DNA, 12 bp, Homo sapiens
catccattccta

SEQ ID NO: 3599525 - DNA, 15 bp, Homo sapiens
catcccacaagtggt

SEQ ID NO: 3599526 - DNA, 19 bp, Homo sapiens
catccccgcagtgtgcact

SEQ ID NO: 3599527 - DNA, 21 bp, Homo sapiens
catcccctccctgcctgctcc

SEQ ID NO: 3599528 - DNA, 22 bp, Homo sapiens
catcccctccctgcctgctcct

SEQ ID NO: 3599529 - DNA, 13 bp, Homo sapiens
catccctcaccca

SEQ ID NO: 3599530 - DNA, 17 bp, Homo sapiens
catccctgactggccaa

SEQ ID NO: 3599531 - DNA, 20 bp, Homo sapiens
catccctgactggccaaacc

SEQ ID NO: 3599532 - DNA, 14 bp, Homo sapiens
catccctgcctgga

SEQ ID NO: 3599533 - DNA, 23 bp, Homo sapiens
catccctgcttgcccgctcccac

SEQ ID NO: 3599534 - DNA, 20 bp, Homo sapiens
catccctggagcaggagccc

SEQ ID NO: 3599535 - DNA, 11 bp, Homo sapiens
catcccttcct

SEQ ID NO: 3599536 - DNA, 14 bp, Homo sapiens
catcccttcctgga

SEQ ID NO: 3599537 - DNA, 21 bp, Homo sapiens
catcccttcctggaaacagca

SEQ ID NO: 3599538 - DNA, 20 bp, Homo sapiens
catccgaagatggtggccac

SEQ ID NO: 3599539 - DNA, 20 bp, Homo sapiens
catccgactgcccctgctgt

SEQ ID NO: 3599540 - DNA, 17 bp, Homo sapiens
catccgtgcctcttttt

SEQ ID NO: 3599541 - DNA, 19 bp, Homo sapiens
catcctaaagaacaaagta

SEQ ID NO: 3599542 - DNA, 17 bp, Homo sapiens
catcctaagacagagga

SEQ ID NO: 3599543 - DNA, 15 bp, Homo sapiens
catcctaggaaccag

SEQ ID NO: 3599544 - DNA, 18 bp, Homo sapiens
catcctaggaaccagcca

SEQ ID NO: 3599545 - DNA, 22 bp, Homo sapiens
catcctcaaagaaagtgtattg

SEQ ID NO: 3599546 - DNA, 13 bp, Homo sapiens
catcctccagcag

SEQ ID NO: 3599547 - DNA, 17 bp, Homo sapiens
catcctgataccattct

SEQ ID NO: 3599548 - DNA, 12 bp, Homo sapiens
catcctggccaa

SEQ ID NO: 3599549 - DNA, 17 bp, Homo sapiens
catcctggggcagcact

SEQ ID NO: 3599550 - DNA, 19 bp, Homo sapiens
catcctggggcagcactcc

SEQ ID NO: 3599551 - DNA, 15 bp, Homo sapiens
catccttccctgtct

SEQ ID NO: 3599552 - DNA, 21 bp, Homo sapiens
catccttccctgtctgccagg

SEQ ID NO: 3599553 - DNA, 22 bp, Homo sapiens
catccttccctgtctgccaggg

SEQ ID NO: 3599554 - DNA, 21 bp, Homo sapiens
catccttgattacttccactg

SEQ ID NO: 3599555 - DNA, 19 bp, Homo sapiens
catcgaggagctagaacat

SEQ ID NO: 3599556 - DNA, 21 bp, Homo sapiens
catcgattgtgtacttttcct

SEQ ID NO: 3599557 - DNA, 16 bp, Homo sapiens
catcgccgggactcca

SEQ ID NO: 3599558 - DNA, 21 bp, Homo sapiens
catcggccaagaatacttgaa

SEQ ID NO: 3599559 - DNA, 19 bp, Homo sapiens
catcgggagcacccagagc

SEQ ID NO: 3599560 - DNA, 12 bp, Homo sapiens
catctaagcctg

SEQ ID NO: 3599561 - DNA, 16 bp, Homo sapiens
catctaagcctgaagg

SEQ ID NO: 3599562 - DNA, 15 bp, Homo sapiens
catctcaaaacaaaa

SEQ ID NO: 3599563 - DNA, 17 bp, Homo sapiens
catctcaaaacaaaaca

SEQ ID NO: 3599564 - DNA, 21 bp, Homo sapiens
catctcaggaggggcagcgca

SEQ ID NO: 3599565 - DNA, 12 bp, Homo sapiens
catctcagggaa

SEQ ID NO: 3599566 - DNA, 17 bp, Homo sapiens
catctccctcctccagg

SEQ ID NO: 3599567 - DNA, 19 bp, Homo sapiens
catctcctcccgcccttcc

SEQ ID NO: 3599568 - DNA, 13 bp, Homo sapiens
catctctctgccc

SEQ ID NO: 3599569 - DNA, 18 bp, Homo sapiens
catctctctgcccaaccc

SEQ ID NO: 3599570 - DNA, 12 bp, Homo sapiens
catctctgctcc

SEQ ID NO: 3599571 - DNA, 14 bp, Homo sapiens
catctctttgtaca

SEQ ID NO: 3599572 - DNA, 14 bp, Homo sapiens
catctgaaagtaga

SEQ ID NO: 3599573 - DNA, 19 bp, Homo sapiens
catctgaatgaaaataact

SEQ ID NO: 3599574 - DNA, 17 bp, Homo sapiens
catctgaccagcagcgc

SEQ ID NO: 3599575 - DNA, 21 bp, Homo sapiens
catctgagaggctctccgtgc

SEQ ID NO: 3599576 - DNA, 14 bp, Homo sapiens
catctgctgcagtt

SEQ ID NO: 3599577 - DNA, 14 bp, Homo sapiens
catctggcggaggt

SEQ ID NO: 3599578 - DNA, 15 bp, Homo sapiens
catctggctgcacag

SEQ ID NO: 3599579 - DNA, 17 bp, Homo sapiens
catctgggggagtggaa

SEQ ID NO: 3599580 - DNA, 19 bp, Homo sapiens
catctgtataccctctgtt

SEQ ID NO: 3599581 - DNA, 19 bp, Homo sapiens
catctgtggagctgccaca

SEQ ID NO: 3599582 - DNA, 15 bp, Homo sapiens
catcttattcagcac

SEQ ID NO: 3599583 - DNA, 13 bp, Homo sapiens
catcttctttctt

SEQ ID NO: 3599584 - DNA, 22 bp, Homo sapiens
catcttgctaccagtatttaga

SEQ ID NO: 3599585 - DNA, 19 bp, Homo sapiens
catcttggccctcctcagc

SEQ ID NO: 3599586 - DNA, 22 bp, Homo sapiens
catcttggccctcctcagctcc

SEQ ID NO: 3599587 - DNA, 23 bp, Homo sapiens
catcttggccctcctcagctccc

SEQ ID NO: 3599588 - DNA, 16 bp, Homo sapiens
catctttagcagtttc

SEQ ID NO: 3599589 - DNA, 22 bp, Homo sapiens
catctttagcagtttcctcagt

SEQ ID NO: 3599590 - DNA, 21 bp, Homo sapiens
catctttttaacctgcaaaat

SEQ ID NO: 3599591 - DNA, 22 bp, Homo sapiens
catgaaaagttatttatgctat

SEQ ID NO: 3599592 - DNA, 22 bp, Homo sapiens
catgaaatatagatcagttata

SEQ ID NO: 3599593 - DNA, 21 bp, Homo sapiens
catgaaatatattttctcttt

SEQ ID NO: 3599594 - DNA, 13 bp, Homo sapiens
catgaaatgccct

SEQ ID NO: 3599595 - DNA, 22 bp, Homo sapiens
catgaacgtggattgtatttaa

SEQ ID NO: 3599596 - DNA, 14 bp, Homo sapiens
catgaagaatgcat

SEQ ID NO: 3599597 - DNA, 18 bp, Homo sapiens
catgaagaatgcattcaa

SEQ ID NO: 3599598 - DNA, 13 bp, Homo sapiens
catgaagcagaac

SEQ ID NO: 3599599 - DNA, 16 bp, Homo sapiens
catgaagcagaacctt

SEQ ID NO: 3599600 - DNA, 21 bp, Homo sapiens
catgaagcagaaccttctttg

SEQ ID NO: 3599601 - DNA, 16 bp, Homo sapiens
catgaagtgcacagga

SEQ ID NO: 3599602 - DNA, 18 bp, Homo sapiens
catgaagtgcacaggagc

SEQ ID NO: 3599603 - DNA, 19 bp, Homo sapiens
catgaagtgcacaggagcc

SEQ ID NO: 3599604 - DNA, 16 bp, Homo sapiens
catgacaagtactgta

SEQ ID NO: 3599605 - DNA, 17 bp, Homo sapiens
catgacaagtactgtat

SEQ ID NO: 3599606 - DNA, 17 bp, Homo sapiens
catgacggagccgagcc

SEQ ID NO: 3599607 - DNA, 19 bp, Homo sapiens
catgagaatctatatttaa

SEQ ID NO: 3599608 - DNA, 14 bp, Homo sapiens
catgagctggcaac

SEQ ID NO: 3599609 - DNA, 23 bp, Homo sapiens
catgagctggcaaccagccagcg

SEQ ID NO: 3599610 - DNA, 16 bp, Homo sapiens
catgaggccatctcag

SEQ ID NO: 3599611 - DNA, 18 bp, Homo sapiens
catgaggccatctcagga

SEQ ID NO: 3599612 - DNA, 14 bp, Homo sapiens
catgagtcaaaaca

SEQ ID NO: 3599613 - DNA, 14 bp, Homo sapiens
catgagtgaataaa

SEQ ID NO: 3599614 - DNA, 18 bp, Homo sapiens
catgagtggaaatacact

SEQ ID NO: 3599615 - DNA, 14 bp, Homo sapiens
catgagtgtgcccc

SEQ ID NO: 3599616 - DNA, 17 bp, Homo sapiens
catgataataggtcata

SEQ ID NO: 3599617 - DNA, 20 bp, Homo sapiens
catgatgacttagtacaaag

SEQ ID NO: 3599618 - DNA, 22 bp, Homo sapiens
catgatgacttagtacaaagtt

SEQ ID NO: 3599619 - DNA, 24 bp, Homo sapiens
catgatgcacagtatctgctgttc

SEQ ID NO: 3599620 - DNA, 20 bp, Homo sapiens
catgatgtccttggactcca

SEQ ID NO: 3599621 - DNA, 21 bp, Homo sapiens
catgattcatgccaattagca

SEQ ID NO: 3599622 - DNA, 21 bp, Homo sapiens
catgcacatgctgtctggccc

SEQ ID NO: 3599623 - DNA, 22 bp, Homo sapiens
ccaccccttggaggagagagac

SEQ ID NO: 3599624 - DNA, 23 bp, Homo sapiens
ccaccccttggaggagagagacc

SEQ ID NO: 3599625 - DNA, 20 bp, Homo sapiens
ccacccgggggagcccagtg

SEQ ID NO: 3599626 - DNA, 18 bp, Homo sapiens
ccaccctccacgaggtgt

SEQ ID NO: 3599627 - DNA, 18 bp, Homo sapiens
ccaccctgggctacagaa

SEQ ID NO: 3599628 - DNA, 18 bp, Homo sapiens
ccaccgaagccgcctgtg

SEQ ID NO: 3599629 - DNA, 16 bp, Homo sapiens
ccaccgaccaactgcc

SEQ ID NO: 3599630 - DNA, 19 bp, Homo sapiens
ccaccgaccaactgcccta

SEQ ID NO: 3599631 - DNA, 16 bp, Homo sapiens
ccaccgaggttcccag

SEQ ID NO: 3599632 - DNA, 17 bp, Homo sapiens
ccaccgcccagagaccc

SEQ ID NO: 3599633 - DNA, 19 bp, Homo sapiens
ccacctcacctctttgttc

SEQ ID NO: 3599634 - DNA, 17 bp, Homo sapiens
ccacctccacacccacc

SEQ ID NO: 3599635 - DNA, 15 bp, Homo sapiens
ccacctcggcacaca

SEQ ID NO: 3599636 - DNA, 23 bp, Homo sapiens
ccacctctgtgggcactggtggg

SEQ ID NO: 3599637 - DNA, 11 bp, Homo sapiens
ccacctggcaa

SEQ ID NO: 3599638 - DNA, 23 bp, Homo sapiens
ccacctggcaaaggacccttgag

SEQ ID NO: 3599639 - DNA, 15 bp, Homo sapiens
ccacctgggaacaca

SEQ ID NO: 3599640 - DNA, 14 bp, Homo sapiens
ccacgccccaggac

SEQ ID NO: 3599641 - DNA, 16 bp, Homo sapiens
ccacgccccaggacct

SEQ ID NO: 3599642 - DNA, 21 bp, Homo sapiens
ccacgcctcaccagccccccg

SEQ ID NO: 3599643 - DNA, 21 bp, Homo sapiens
ccacggaggatccactcccag

SEQ ID NO: 3599644 - DNA, 14 bp, Homo sapiens
ccacggcctgccca

SEQ ID NO: 3599645 - DNA, 19 bp, Homo sapiens
ccacggcctggctggtggg

SEQ ID NO: 3599646 - DNA, 23 bp, Homo sapiens
ccacggcctggctggtgggaagg

SEQ ID NO: 3599647 - DNA, 21 bp, Homo sapiens
ccacgtcccagcatccctgga

SEQ ID NO: 3599648 - DNA, 15 bp, Homo sapiens
ccacgttaagtccaa

SEQ ID NO: 3599649 - DNA, 21 bp, Homo sapiens
ccactaaagcttcagactcaa

SEQ ID NO: 3599650 - DNA, 22 bp, Homo sapiens
ccactaaagcttcagactcaag

SEQ ID NO: 3599651 - DNA, 14 bp, Homo sapiens
ccactaagcagagg

SEQ ID NO: 3599652 - DNA, 16 bp, Homo sapiens
ccactaccagccagcc

SEQ ID NO: 3599653 - DNA, 17 bp, Homo sapiens
ccactaccagccagcct

SEQ ID NO: 3599654 - DNA, 19 bp, Homo sapiens
ccactaccagccagcctca

SEQ ID NO: 3599655 - DNA, 12 bp, Homo sapiens
ccactcaggcca

SEQ ID NO: 3599656 - DNA, 17 bp, Homo sapiens
ccactccagacccctgg

SEQ ID NO: 3599657 - DNA, 13 bp, Homo sapiens
ccactccagctga

SEQ ID NO: 3599658 - DNA, 14 bp, Homo sapiens
ccactcccagtgct

SEQ ID NO: 3599659 - DNA, 14 bp, Homo sapiens
ccactccccaaccc

SEQ ID NO: 3599660 - DNA, 22 bp, Homo sapiens
ccactccccaacccctctccag

SEQ ID NO: 3599661 - DNA, 22 bp, Homo sapiens
ccactccccagccagcctggct

SEQ ID NO: 3599662 - DNA, 15 bp, Homo sapiens
ccactccccagcccc

SEQ ID NO: 3599663 - DNA, 16 bp, Homo sapiens
ccactcccctcacaca

SEQ ID NO: 3599664 - DNA, 20 bp, Homo sapiens
ccactcgacccagaatggag

SEQ ID NO: 3599665 - DNA, 23 bp, Homo sapiens
ccactcgacccagaatggagcct

SEQ ID NO: 3599666 - DNA, 19 bp, Homo sapiens
ccactctgggcaaagcccc

SEQ ID NO: 3599667 - DNA, 22 bp, Homo sapiens
ccactctgggcaaagcccctca

SEQ ID NO: 3599668 - DNA, 15 bp, Homo sapiens
ccactcttgatctct

SEQ ID NO: 3599669 - DNA, 13 bp, Homo sapiens
ccactgaccagaa

SEQ ID NO: 3599670 - DNA, 13 bp, Homo sapiens
ccactgcctcttc

SEQ ID NO: 3599671 - DNA, 13 bp, Homo sapiens
ccactggaccctt

SEQ ID NO: 3599672 - DNA, 18 bp, Homo sapiens
ccactgggacagctggct

SEQ ID NO: 3599673 - DNA, 19 bp, Homo sapiens
ccactgggacagctggctg

SEQ ID NO: 3599674 - DNA, 15 bp, Homo sapiens
ccactgtcctgggcc

SEQ ID NO: 3599675 - DNA, 13 bp, Homo sapiens
ccactgtgcttgg

SEQ ID NO: 3599676 - DNA, 20 bp, Homo sapiens
ccacttaatgtatgttacca

SEQ ID NO: 3599677 - DNA, 23 bp, Homo sapiens
ccacttccccctcttcttctgaa

SEQ ID NO: 3599678 - DNA, 13 bp, Homo sapiens
ccacttcctttta

SEQ ID NO: 3599679 - DNA, 14 bp, Homo sapiens
ccacttctggccac

SEQ ID NO: 3599680 - DNA, 15 bp, Homo sapiens
ccacttctggccaca

SEQ ID NO: 3599681 - DNA, 14 bp, Homo sapiens
ccactttattgcca

SEQ ID NO: 3599682 - DNA, 15 bp, Homo sapiens
ccagaaagcctcctg

SEQ ID NO: 3599683 - DNA, 21 bp, Homo sapiens
ccagaaagcctcctgccccct

SEQ ID NO: 3599684 - DNA, 14 bp, Homo sapiens
ccagaaaggtgtga

SEQ ID NO: 3599685 - DNA, 19 bp, Homo sapiens
ccagaaaggtgtgaggaga

SEQ ID NO: 3599686 - DNA, 16 bp, Homo sapiens
ccagaactttttcctc

SEQ ID NO: 3599687 - DNA, 17 bp, Homo sapiens
ccagaagatgccagctt

SEQ ID NO: 3599688 - DNA, 19 bp, Homo sapiens
ccagaagatgccagcttct

SEQ ID NO: 3599689 - DNA, 22 bp, Homo sapiens
ccagaagtcccttcaatttcta

SEQ ID NO: 3599690 - DNA, 17 bp, Homo sapiens
ccagacaattccattca

SEQ ID NO: 3599691 - DNA, 14 bp, Homo sapiens
ccagacacaggccc

SEQ ID NO: 3599692 - DNA, 15 bp, Homo sapiens
ccagacacccaggac

SEQ ID NO: 3599693 - DNA, 12 bp, Homo sapiens
ccagacaggccc

SEQ ID NO: 3599694 - DNA, 17 bp, Homo sapiens
ccagacaggccctccct

SEQ ID NO: 3599695 - DNA, 18 bp, Homo sapiens
ccagacaggccctccctg

SEQ ID NO: 3599696 - DNA, 14 bp, Homo sapiens
ccagacatggaggg

SEQ ID NO: 3599697 - DNA, 17 bp, Homo sapiens
ccagacctgatcctgga

SEQ ID NO: 3599698 - DNA, 19 bp, Homo sapiens
ccagacctgatcctggagg

SEQ ID NO: 3599699 - DNA, 23 bp, Homo sapiens
ccagacctgatcctggaggccca

SEQ ID NO: 3599700 - DNA, 24 bp, Homo sapiens
ccagacctgatcctggaggcccag

SEQ ID NO: 3599701 - DNA, 15 bp, Homo sapiens
ccagacggggctgga

SEQ ID NO: 3599702 - DNA, 14 bp, Homo sapiens
ccagactcagcaga

SEQ ID NO: 3599703 - DNA, 12 bp, Homo sapiens
ccagactctggg

SEQ ID NO: 3599704 - DNA, 19 bp, Homo sapiens
ccagactgtctccacggcc

SEQ ID NO: 3599705 - DNA, 12 bp, Homo sapiens
ccagagaaagca

SEQ ID NO: 3599706 - DNA, 16 bp, Homo sapiens
ccagagaaagcaaagg

SEQ ID NO: 3599707 - DNA, 18 bp, Homo sapiens
ccagagaaagcaaaggtg

SEQ ID NO: 3599708 - DNA, 19 bp, Homo sapiens
ccagagaaaggggagccca

SEQ ID NO: 3599709 - DNA, 18 bp, Homo sapiens
ccagagacatacttgaag

SEQ ID NO: 3599710 - DNA, 20 bp, Homo sapiens
ccagagacatacttgaaggg

SEQ ID NO: 3599711 - DNA, 21 bp, Homo sapiens
ccagagagggaaaaggcaggt

SEQ ID NO: 3599712 - DNA, 20 bp, Homo sapiens
ccagagagggaagatgacct

SEQ ID NO: 3599713 - DNA, 16 bp, Homo sapiens
ccagagagtggagaga

SEQ ID NO: 3599714 - DNA, 17 bp, Homo sapiens
ccagagataaaaatcat

SEQ ID NO: 3599715 - DNA, 18 bp, Homo sapiens
ccagagataaaaatcata

SEQ ID NO: 3599716 - DNA, 20 bp, Homo sapiens
ccagagatccaaaagaagcc

SEQ ID NO: 3599717 - DNA, 15 bp, Homo sapiens
ccagagatgcctgat

SEQ ID NO: 3599718 - DNA, 13 bp, Homo sapiens
ccagagcaaaata

SEQ ID NO: 3599719 - DNA, 19 bp, Homo sapiens
ccagagcaaccagaaggag

SEQ ID NO: 3599720 - DNA, 23 bp, Homo sapiens
ccagagcaccccctgctccacca

SEQ ID NO: 3599721 - DNA, 12 bp, Homo sapiens
ccagagccacct

SEQ ID NO: 3599722 - DNA, 12 bp, Homo sapiens
ccagagccaggg

SEQ ID NO: 3599723 - DNA, 23 bp, Homo sapiens
ccagagcgaggaaaggattttac

SEQ ID NO: 3599724 - DNA, 17 bp, Homo sapiens
ccagagctccgatgccc

SEQ ID NO: 3599725 - DNA, 12 bp, Homo sapiens
ccagagctgtgc

SEQ ID NO: 3599726 - DNA, 19 bp, Homo sapiens
ccagagctgtgccagcagg

SEQ ID NO: 3599727 - DNA, 15 bp, Homo sapiens
ccagagctgtttgga

SEQ ID NO: 3599728 - DNA, 12 bp, Homo sapiens
ccagaggaccaa

SEQ ID NO: 3599729 - DNA, 12 bp, Homo sapiens
ccagaggccctg

SEQ ID NO: 3599730 - DNA, 16 bp, Homo sapiens
ccagaggccctggagg

SEQ ID NO: 3599731 - DNA, 17 bp, Homo sapiens
ccagaggccctggaggt

SEQ ID NO: 3599732 - DNA, 18 bp, Homo sapiens
ccagagggttgctggtcc

SEQ ID NO: 3599733 - DNA, 23 bp, Homo sapiens
ccagagggttgctggtcctgcac

SEQ ID NO: 3599734 - DNA, 15 bp, Homo sapiens
ccagatccagcctgg

SEQ ID NO: 3599735 - DNA, 16 bp, Homo sapiens
ccagatgaactgactg

SEQ ID NO: 3599736 - DNA, 24 bp, Homo sapiens
ccagattttttacagctgcctgca

SEQ ID NO: 3599737 - DNA, 10 bp, Homo sapiens
ccagcaacat

SEQ ID NO: 3599738 - DNA, 15 bp, Homo sapiens
ccagcaacgcccctc

SEQ ID NO: 3599739 - DNA, 13 bp, Homo sapiens
ccagcaagacctc

SEQ ID NO: 3599740 - DNA, 17 bp, Homo sapiens
ccagcaagcgggagccc

SEQ ID NO: 3599741 - DNA, 15 bp, Homo sapiens
ccagcaaggggaccc

SEQ ID NO: 3599742 - DNA, 23 bp, Homo sapiens
ccagcaagtccttaggctactgt

SEQ ID NO: 3599743 - DNA, 19 bp, Homo sapiens
ccagcacagtaggtcccgg

SEQ ID NO: 3599744 - DNA, 24 bp, Homo sapiens
ccagcactttgggaggccgaggtg

SEQ ID NO: 3599745 - DNA, 17 bp, Homo sapiens
ccagcagcgcctttccc

SEQ ID NO: 3599746 - DNA, 18 bp, Homo sapiens
ccagcagcgcctttccca

SEQ ID NO: 3599747 - DNA, 15 bp, Homo sapiens
ccagcaggaatttct

SEQ ID NO: 3599748 - DNA, 21 bp, Homo sapiens
ccagcaggagagactgagcag

SEQ ID NO: 3599749 - DNA, 12 bp, Homo sapiens
ccagcaggcaga

SEQ ID NO: 3599750 - DNA, 17 bp, Homo sapiens
ccagcaggcccatggga

SEQ ID NO: 3599751 - DNA, 21 bp, Homo sapiens
ccagcaggggggctgtgccaa

SEQ ID NO: 3599752 - DNA, 13 bp, Homo sapiens
ccagcatccctgg

SEQ ID NO: 3599753 - DNA, 19 bp, Homo sapiens
ccagcatccctggagcagg

SEQ ID NO: 3599754 - DNA, 19 bp, Homo sapiens
ccagcatgactttccttag

SEQ ID NO: 3599755 - DNA, 18 bp, Homo sapiens
ccagcatgcaccacgggc

SEQ ID NO: 3599756 - DNA, 18 bp, Homo sapiens
ccatttagtgtgaatatt

SEQ ID NO: 3599757 - DNA, 13 bp, Homo sapiens
ccatttcagagag

SEQ ID NO: 3599758 - DNA, 21 bp, Homo sapiens
ccatttcaggactctctccag

SEQ ID NO: 3599759 - DNA, 18 bp, Homo sapiens
ccatttcccgcacatggt

SEQ ID NO: 3599760 - DNA, 14 bp, Homo sapiens
ccatttctctacac

SEQ ID NO: 3599761 - DNA, 12 bp, Homo sapiens
ccatttctgatg

SEQ ID NO: 3599762 - DNA, 15 bp, Homo sapiens
ccatttctgtggagg

SEQ ID NO: 3599763 - DNA, 17 bp, Homo sapiens
ccatttgggcagagagg

SEQ ID NO: 3599764 - DNA, 22 bp, Homo sapiens
ccatttttctcccaagaaacct

SEQ ID NO: 3599765 - DNA, 21 bp, Homo sapiens
ccattttttaaaaaagcaagg

SEQ ID NO: 3599766 - DNA, 14 bp, Homo sapiens
cccaaaccccagcc

SEQ ID NO: 3599767 - DNA, 15 bp, Homo sapiens
cccaaaccccctgca

SEQ ID NO: 3599768 - DNA, 22 bp, Homo sapiens
cccaaaccccctgcagcccagg

SEQ ID NO: 3599769 - DNA, 20 bp, Homo sapiens
cccaaacctgggaaggccag

SEQ ID NO: 3599770 - DNA, 23 bp, Homo sapiens
cccaaactgtagtaattgttaca

SEQ ID NO: 3599771 - DNA, 19 bp, Homo sapiens
cccaaagcggtccctgtcc

SEQ ID NO: 3599772 - DNA, 18 bp, Homo sapiens
cccaaaggaacactgaca

SEQ ID NO: 3599773 - DNA, 24 bp, Homo sapiens
cccaaatcctagactgctcctggg

SEQ ID NO: 3599774 - DNA, 18 bp, Homo sapiens
cccaaatggccattttaa

SEQ ID NO: 3599775 - DNA, 20 bp, Homo sapiens
cccaacccctctccaggcct

SEQ ID NO: 3599776 - DNA, 22 bp, Homo sapiens
cccaacccctctccaggcctgt

SEQ ID NO: 3599777 - DNA, 17 bp, Homo sapiens
cccaacccttccctcac

SEQ ID NO: 3599778 - DNA, 17 bp, Homo sapiens
cccaacctacattccac

SEQ ID NO: 3599779 - DNA, 14 bp, Homo sapiens
cccaacctgctctc

SEQ ID NO: 3599780 - DNA, 21 bp, Homo sapiens
cccaacctgctctcctcttgc

SEQ ID NO: 3599781 - DNA, 16 bp, Homo sapiens
cccaactccaggggca

SEQ ID NO: 3599782 - DNA, 15 bp, Homo sapiens
cccaactctagctgg

SEQ ID NO: 3599783 - DNA, 21 bp, Homo sapiens
cccaactctagctgggggtgg

SEQ ID NO: 3599784 - DNA, 14 bp, Homo sapiens
cccaactctttatc

SEQ ID NO: 3599785 - DNA, 20 bp, Homo sapiens
cccaacttctcttgctttct

SEQ ID NO: 3599786 - DNA, 13 bp, Homo sapiens
cccaacttcttcc

SEQ ID NO: 3599787 - DNA, 17 bp, Homo sapiens
cccaaggcattctccca

SEQ ID NO: 3599788 - DNA, 13 bp, Homo sapiens
cccaagggatctg

SEQ ID NO: 3599789 - DNA, 12 bp, Homo sapiens
cccaagggccct

SEQ ID NO: 3599790 - DNA, 23 bp, Homo sapiens
cccaagggggctgctgctcctct

SEQ ID NO: 3599791 - DNA, 22 bp, Homo sapiens
cccaaggtgaggtgaactccag

SEQ ID NO: 3599792 - DNA, 23 bp, Homo sapiens
cccaagtggacgttaggccaggc

SEQ ID NO: 3599793 - DNA, 18 bp, Homo sapiens
cccaagtggtgagcaagc

SEQ ID NO: 3599794 - DNA, 19 bp, Homo sapiens
cccaatcccagctacctca

SEQ ID NO: 3599795 - DNA, 13 bp, Homo sapiens
cccaatctttcta

SEQ ID NO: 3599796 - DNA, 14 bp, Homo sapiens
cccaatctttctat

SEQ ID NO: 3599797 - DNA, 23 bp, Homo sapiens
cccaatctttctatataaaatgt

SEQ ID NO: 3599798 - DNA, 14 bp, Homo sapiens
cccaattctgcccg

SEQ ID NO: 3599799 - DNA, 15 bp, Homo sapiens
cccaattgagaaaaa

SEQ ID NO: 3599800 - DNA, 20 bp, Homo sapiens
cccacaaactccaggctgga

SEQ ID NO: 3599801 - DNA, 13 bp, Homo sapiens
cccacacacagat

SEQ ID NO: 3599802 - DNA, 15 bp, Homo sapiens
cccacacagctgccc

SEQ ID NO: 3599803 - DNA, 11 bp, Homo sapiens
cccacacctgg

SEQ ID NO: 3599804 - DNA, 19 bp, Homo sapiens
cccacactgtgcagaccca

SEQ ID NO: 3599805 - DNA, 19 bp, Homo sapiens
cccacactgtggccaggcc

SEQ ID NO: 3599806 - DNA, 11 bp, Homo sapiens
cccacagaact

SEQ ID NO: 3599807 - DNA, 23 bp, Homo sapiens
cccacagactcaaatgctcagac

SEQ ID NO: 3599808 - DNA, 15 bp, Homo sapiens
cccacagcttcctga

SEQ ID NO: 3599809 - DNA, 17 bp, Homo sapiens
cccacagcttcctgagg

SEQ ID NO: 3599810 - DNA, 13 bp, Homo sapiens
cccacaggagggc

SEQ ID NO: 3599811 - DNA, 19 bp, Homo sapiens
cccacataaaagccccagc

SEQ ID NO: 3599812 - DNA, 20 bp, Homo sapiens
cccacatccttctcactgcc

SEQ ID NO: 3599813 - DNA, 14 bp, Homo sapiens
cccacatgaggcca

SEQ ID NO: 3599814 - DNA, 23 bp, Homo sapiens
cccacatgaggccatctcaggag

SEQ ID NO: 3599815 - DNA, 18 bp, Homo sapiens
cccacatgccaggggcct

SEQ ID NO: 3599816 - DNA, 23 bp, Homo sapiens
cccacatggccatcttctttctt

SEQ ID NO: 3599817 - DNA, 14 bp, Homo sapiens
cccaccacacaaca

SEQ ID NO: 3599818 - DNA, 13 bp, Homo sapiens
cccaccactcagg

SEQ ID NO: 3599819 - DNA, 13 bp, Homo sapiens
cccaccactcccc

SEQ ID NO: 3599820 - DNA, 20 bp, Homo sapiens
cccaccagaacgcaccccac

SEQ ID NO: 3599821 - DNA, 15 bp, Homo sapiens
cccaccagagccggg

SEQ ID NO: 3599822 - DNA, 13 bp, Homo sapiens
cccaccagggtcc

SEQ ID NO: 3599823 - DNA, 19 bp, Homo sapiens
cccaccatctgctgtcttt

SEQ ID NO: 3599824 - DNA, 21 bp, Homo sapiens
cccaccatctgctgtcttttc

SEQ ID NO: 3599825 - DNA, 18 bp, Homo sapiens
cccacccacacagctgcc

SEQ ID NO: 3599826 - DNA, 13 bp, Homo sapiens
cccaccccctcct

SEQ ID NO: 3599827 - DNA, 17 bp, Homo sapiens
cccaccccctctggaga

SEQ ID NO: 3599828 - DNA, 23 bp, Homo sapiens
cccaccccctctggagaaggcct

SEQ ID NO: 3599829 - DNA, 17 bp, Homo sapiens
cccacccctcactcccc

SEQ ID NO: 3599830 - DNA, 19 bp, Homo sapiens
cccaccgaggttcccaggg

SEQ ID NO: 3599831 - DNA, 22 bp, Homo sapiens
cccacctcacagctactcagtg

SEQ ID NO: 3599832 - DNA, 16 bp, Homo sapiens
cccacctccctgcctc

SEQ ID NO: 3599833 - DNA, 17 bp, Homo sapiens
cccacctcggcacacac

SEQ ID NO: 3599834 - DNA, 18 bp, Homo sapiens
cccacctctcctgccctg

SEQ ID NO: 3599835 - DNA, 21 bp, Homo sapiens
cccacctctcctgccctgtga

SEQ ID NO: 3599836 - DNA, 14 bp, Homo sapiens
cccacctggctgcc

SEQ ID NO: 3599837 - DNA, 12 bp, Homo sapiens
cccaccttccca

SEQ ID NO: 3599838 - DNA, 15 bp, Homo sapiens
cccactcagtgcctc

SEQ ID NO: 3599839 - DNA, 17 bp, Homo sapiens
cccactcagtgcctcca

SEQ ID NO: 3599840 - DNA, 13 bp, Homo sapiens
cccactccccagc

SEQ ID NO: 3599841 - DNA, 21 bp, Homo sapiens
cccactcccccgtttctcctt

SEQ ID NO: 3599842 - DNA, 16 bp, Homo sapiens
cccactgtcctgggcc

SEQ ID NO: 3599843 - DNA, 22 bp, Homo sapiens
cccactgtcctgggcctgcaga

SEQ ID NO: 3599844 - DNA, 14 bp, Homo sapiens
cccacttctggcca

SEQ ID NO: 3599845 - DNA, 15 bp, Homo sapiens
cccacttctggccac

SEQ ID NO: 3599846 - DNA, 17 bp, Homo sapiens
cccactttcatctacct

SEQ ID NO: 3599847 - DNA, 22 bp, Homo sapiens
cccagaaagcctcctgccccct

SEQ ID NO: 3599848 - DNA, 12 bp, Homo sapiens
cccagaatgaga

SEQ ID NO: 3599849 - DNA, 16 bp, Homo sapiens
cccagactcagacatt

SEQ ID NO: 3599850 - DNA, 21 bp, Homo sapiens
cccagactgtctccacggcct

SEQ ID NO: 3599851 - DNA, 22 bp, Homo sapiens
cccagacttctctttcttattt

SEQ ID NO: 3599852 - DNA, 21 bp, Homo sapiens
cccagagacatacttgaaggg

SEQ ID NO: 3599853 - DNA, 22 bp, Homo sapiens
cccagagacatacttgaagggc

SEQ ID NO: 3599854 - DNA, 14 bp, Homo sapiens
cccagagacctcat

SEQ ID NO: 3599855 - DNA, 16 bp, Homo sapiens
cccagagatgcctgat

SEQ ID NO: 3599856 - DNA, 19 bp, Homo sapiens
cccagagcaccccctgctc

SEQ ID NO: 3599857 - DNA, 20 bp, Homo sapiens
cccagagcaccccctgctcc

SEQ ID NO: 3599858 - DNA, 13 bp, Homo sapiens
cccagagccacct

SEQ ID NO: 3599859 - DNA, 14 bp, Homo sapiens
cccagagccacctg

SEQ ID NO: 3599860 - DNA, 16 bp, Homo sapiens
cccagagcccagctcc

SEQ ID NO: 3599861 - DNA, 17 bp, Homo sapiens
cccagagctgtgccagc

SEQ ID NO: 3599862 - DNA, 20 bp, Homo sapiens
cccagaggacagcacagact

SEQ ID NO: 3599863 - DNA, 20 bp, Homo sapiens
cccagaggagccaccagttc

SEQ ID NO: 3599864 - DNA, 12 bp, Homo sapiens
cccagaggccct

SEQ ID NO: 3599865 - DNA, 13 bp, Homo sapiens
cccagaggccctg

SEQ ID NO: 3599866 - DNA, 15 bp, Homo sapiens
cccagagtcccccca

SEQ ID NO: 3599867 - DNA, 12 bp, Homo sapiens
cccagattccct

SEQ ID NO: 3599868 - DNA, 15 bp, Homo sapiens
cccagcaagacctca

SEQ ID NO: 3599869 - DNA, 23 bp, Homo sapiens
cccagcaagacctcatctgtgga

SEQ ID NO: 3599870 - DNA, 17 bp, Homo sapiens
cccagcaagcgggagcc

SEQ ID NO: 3599871 - DNA, 18 bp, Homo sapiens
cccagcacttgtgttgtc

SEQ ID NO: 3599872 - DNA, 13 bp, Homo sapiens
cccagcaggcaga

SEQ ID NO: 3599873 - DNA, 14 bp, Homo sapiens
cccagcatccctgg

SEQ ID NO: 3599874 - DNA, 15 bp, Homo sapiens
cccagcatccctgga

SEQ ID NO: 3599875 - DNA, 17 bp, Homo sapiens
cccagcatccctggagc

SEQ ID NO: 3599876 - DNA, 15 bp, Homo sapiens
cccagcatctcccag

SEQ ID NO: 3599877 - DNA, 17 bp, Homo sapiens
cccagcatctcccagca

SEQ ID NO: 3599878 - DNA, 19 bp, Homo sapiens
cccagccagggctcaatct

SEQ ID NO: 3599879 - DNA, 11 bp, Homo sapiens
cccagcccaga

SEQ ID NO: 3599880 - DNA, 13 bp, Homo sapiens
cccagcccagaga

SEQ ID NO: 3599881 - DNA, 13 bp, Homo sapiens
cccagcccagcac

SEQ ID NO: 3599882 - DNA, 14 bp, Homo sapiens
cccagcccagcacc

SEQ ID NO: 3599883 - DNA, 15 bp, Homo sapiens
cccagcccagcaccc

SEQ ID NO: 3599884 - DNA, 14 bp, Homo sapiens
cccagccccaactc

SEQ ID NO: 3599885 - DNA, 15 bp, Homo sapiens
cccagccccaactcc

SEQ ID NO: 3599886 - DNA, 16 bp, Homo sapiens
cccagccccagcccct

SEQ ID NO: 3599887 - DNA, 13 bp, Homo sapiens
cccagccctggga

SEQ ID NO: 3599888 - DNA, 20 bp, Homo sapiens
cccagccctgggggattcct

SEQ ID NO: 3599889 - DNA, 15 bp, Homo sapiens
ccctacccaaccctg

SEQ ID NO: 3599890 - DNA, 18 bp, Homo sapiens
ccctaccgagtctcttct

SEQ ID NO: 3599891 - DNA, 16 bp, Homo sapiens
ccctagccctgctcca

SEQ ID NO: 3599892 - DNA, 12 bp, Homo sapiens
ccctagccctgg

SEQ ID NO: 3599893 - DNA, 13 bp, Homo sapiens
ccctagccctggt

SEQ ID NO: 3599894 - DNA, 16 bp, Homo sapiens
ccctagccctggttag

SEQ ID NO: 3599895 - DNA, 12 bp, Homo sapiens
ccctagttcagg

SEQ ID NO: 3599896 - DNA, 13 bp, Homo sapiens
ccctattgctgct

SEQ ID NO: 3599897 - DNA, 14 bp, Homo sapiens
ccctattgctgcta

SEQ ID NO: 3599898 - DNA, 15 bp, Homo sapiens
ccctattgctgctaa

SEQ ID NO: 3599899 - DNA, 20 bp, Homo sapiens
ccctcacacacaccccccca

SEQ ID NO: 3599900 - DNA, 23 bp, Homo sapiens
ccctcacacacacccccccacaa

SEQ ID NO: 3599901 - DNA, 15 bp, Homo sapiens
ccctcacactgcaag

SEQ ID NO: 3599902 - DNA, 12 bp, Homo sapiens
ccctcaccacag

SEQ ID NO: 3599903 - DNA, 14 bp, Homo sapiens
ccctcaccacagcc

SEQ ID NO: 3599904 - DNA, 15 bp, Homo sapiens
ccctcaccacagcct

SEQ ID NO: 3599905 - DNA, 20 bp, Homo sapiens
ccctcaccttggcaccagac

SEQ ID NO: 3599906 - DNA, 13 bp, Homo sapiens
ccctcactcccca

SEQ ID NO: 3599907 - DNA, 15 bp, Homo sapiens
ccctcactccccagg

SEQ ID NO: 3599908 - DNA, 15 bp, Homo sapiens
ccctcagccttggga

SEQ ID NO: 3599909 - DNA, 15 bp, Homo sapiens
ccctcaggaattcag

SEQ ID NO: 3599910 - DNA, 15 bp, Homo sapiens
ccctcaggcacacct

SEQ ID NO: 3599911 - DNA, 19 bp, Homo sapiens
ccctcaggcacaccttgca

SEQ ID NO: 3599912 - DNA, 14 bp, Homo sapiens
ccctcaggccaccc

SEQ ID NO: 3599913 - DNA, 16 bp, Homo sapiens
ccctcaggccaccctc

SEQ ID NO: 3599914 - DNA, 17 bp, Homo sapiens
ccctcaggcctatgcaa

SEQ ID NO: 3599915 - DNA, 18 bp, Homo sapiens
ccctccaaacctccagcc

SEQ ID NO: 3599916 - DNA, 16 bp, Homo sapiens
ccctccaaaggaactc

SEQ ID NO: 3599917 - DNA, 21 bp, Homo sapiens
ccctccaaaggaactctagag

SEQ ID NO: 3599918 - DNA, 12 bp, Homo sapiens
ccctcccaccca

SEQ ID NO: 3599919 - DNA, 15 bp, Homo sapiens
ccctcccacccaccg

SEQ ID NO: 3599920 - DNA, 13 bp, Homo sapiens
ccctcccacgcct

SEQ ID NO: 3599921 - DNA, 16 bp, Homo sapiens
ccctcccagacaggcc

SEQ ID NO: 3599922 - DNA, 18 bp, Homo sapiens
ccctcccagacaggccct

SEQ ID NO: 3599923 - DNA, 12 bp, Homo sapiens
ccctccccagcc

SEQ ID NO: 3599924 - DNA, 21 bp, Homo sapiens
ccctccccgcccctgtggccc

SEQ ID NO: 3599925 - DNA, 14 bp, Homo sapiens
ccctccctctccag

SEQ ID NO: 3599926 - DNA, 13 bp, Homo sapiens
ccctccctgcctg

SEQ ID NO: 3599927 - DNA, 18 bp, Homo sapiens
ccctcctaaatgtcagct

SEQ ID NO: 3599928 - DNA, 15 bp, Homo sapiens
ccctcctcagctccc

SEQ ID NO: 3599929 - DNA, 22 bp, Homo sapiens
ccctcctcagctccctgcctgt

SEQ ID NO: 3599930 - DNA, 16 bp, Homo sapiens
ccctcctcccccagtg

SEQ ID NO: 3599931 - DNA, 13 bp, Homo sapiens
ccctcctctccca

SEQ ID NO: 3599932 - DNA, 14 bp, Homo sapiens
ccctcctctcccat

SEQ ID NO: 3599933 - DNA, 15 bp, Homo sapiens
ccctcctgcacacag

SEQ ID NO: 3599934 - DNA, 18 bp, Homo sapiens
ccctccttgtgccttctt

SEQ ID NO: 3599935 - DNA, 13 bp, Homo sapiens
ccctcggagaaga

SEQ ID NO: 3599936 - DNA, 14 bp, Homo sapiens
ccctctagtgcctt

SEQ ID NO: 3599937 - DNA, 23 bp, Homo sapiens
ccctctagttttttcttcctttt

SEQ ID NO: 3599938 - DNA, 18 bp, Homo sapiens
ccctctatttattagcca

SEQ ID NO: 3599939 - DNA, 20 bp, Homo sapiens
ccctctatttattagccaac

SEQ ID NO: 3599940 - DNA, 17 bp, Homo sapiens
ccctctcagaggcctgc

SEQ ID NO: 3599941 - DNA, 19 bp, Homo sapiens
ccctctcagaggcctgctg

SEQ ID NO: 3599942 - DNA, 14 bp, Homo sapiens
ccctctccaggcct

SEQ ID NO: 3599943 - DNA, 14 bp, Homo sapiens
ccctctccttcctg

SEQ ID NO: 3599944 - DNA, 17 bp, Homo sapiens
ccctctccttcctgtgt

SEQ ID NO: 3599945 - DNA, 15 bp, Homo sapiens
ccctctgccccatcc

SEQ ID NO: 3599946 - DNA, 18 bp, Homo sapiens
ccctctgccccatcctcc

SEQ ID NO: 3599947 - DNA, 11 bp, Homo sapiens
ccctctgctgc

SEQ ID NO: 3599948 - DNA, 18 bp, Homo sapiens
ccctctggagaaggcctg

SEQ ID NO: 3599949 - DNA, 20 bp, Homo sapiens
ccctctgggggtcctctctg

SEQ ID NO: 3599950 - DNA, 16 bp, Homo sapiens
ccctgaatccgtactt

SEQ ID NO: 3599951 - DNA, 13 bp, Homo sapiens
ccctgacagggcc

SEQ ID NO: 3599952 - DNA, 16 bp, Homo sapiens
ccctgacagggccagt

SEQ ID NO: 3599953 - DNA, 17 bp, Homo sapiens
ccctgacctaccccagc

SEQ ID NO: 3599954 - DNA, 18 bp, Homo sapiens
ccctgacctaccccagcc

SEQ ID NO: 3599955 - DNA, 19 bp, Homo sapiens
ccctgacctaccccagcca

SEQ ID NO: 3599956 - DNA, 15 bp, Homo sapiens
ccctgacctccgccc

SEQ ID NO: 3599957 - DNA, 20 bp, Homo sapiens
ccctgagcagggtccacagc

SEQ ID NO: 3599958 - DNA, 23 bp, Homo sapiens
ccctgagcagggtccacagctgg

SEQ ID NO: 3599959 - DNA, 15 bp, Homo sapiens
ccctgagccagcagg

SEQ ID NO: 3599960 - DNA, 14 bp, Homo sapiens
ccctgagctgaggg

SEQ ID NO: 3599961 - DNA, 15 bp, Homo sapiens
ccctgaggtcactgc

SEQ ID NO: 3599962 - DNA, 18 bp, Homo sapiens
ccctgatcccaccccctc

SEQ ID NO: 3599963 - DNA, 23 bp, Homo sapiens
ccctgatttaggagaagccagga

SEQ ID NO: 3599964 - DNA, 22 bp, Homo sapiens
ccctgcaaaactccaggcagga

SEQ ID NO: 3599965 - DNA, 19 bp, Homo sapiens
ccctgcaacttccgctgag

SEQ ID NO: 3599966 - DNA, 16 bp, Homo sapiens
ccctgcacaggtggct

SEQ ID NO: 3599967 - DNA, 16 bp, Homo sapiens
ccctgcagcccaggcc

SEQ ID NO: 3599968 - DNA, 18 bp, Homo sapiens
ccctgcatctgaccagca

SEQ ID NO: 3599969 - DNA, 14 bp, Homo sapiens
ccctgccagtgaag

SEQ ID NO: 3599970 - DNA, 20 bp, Homo sapiens
ccctgccatcatgtttacag

SEQ ID NO: 3599971 - DNA, 13 bp, Homo sapiens
ccctgcccaacct

SEQ ID NO: 3599972 - DNA, 17 bp, Homo sapiens
ccctgccccaccccatc

SEQ ID NO: 3599973 - DNA, 14 bp, Homo sapiens
ccctgccctgccca

SEQ ID NO: 3599974 - DNA, 12 bp, Homo sapiens
ccctgcctggag

SEQ ID NO: 3599975 - DNA, 14 bp, Homo sapiens
ccctgcctggaggc

SEQ ID NO: 3599976 - DNA, 17 bp, Homo sapiens
ccctgcctgtgcccgca

SEQ ID NO: 3599977 - DNA, 21 bp, Homo sapiens
ccctgcgcctccagaggtcct

SEQ ID NO: 3599978 - DNA, 22 bp, Homo sapiens
ccctgcggccccgtctgtggct

SEQ ID NO: 3599979 - DNA, 16 bp, Homo sapiens
ccctgctacctgttct

SEQ ID NO: 3599980 - DNA, 13 bp, Homo sapiens
ccctgctgaatgc

SEQ ID NO: 3599981 - DNA, 16 bp, Homo sapiens
ccctgctgcgctgctt

SEQ ID NO: 3599982 - DNA, 21 bp, Homo sapiens
ccctgctgtgccatgctgggc

SEQ ID NO: 3599983 - DNA, 16 bp, Homo sapiens
ccctgctgtgctgctc

SEQ ID NO: 3599984 - DNA, 21 bp, Homo sapiens
ccctgcttgcccgctcccaca

SEQ ID NO: 3599985 - DNA, 17 bp, Homo sapiens
ccctgctttgggctgcc

SEQ ID NO: 3599986 - DNA, 20 bp, Homo sapiens
ccctgctttgggctgccctg

SEQ ID NO: 3599987 - DNA, 23 bp, Homo sapiens
ccctgctttgggctgccctggtg

SEQ ID NO: 3599988 - DNA, 21 bp, Homo sapiens
ccctggaaggacatccatgtt

SEQ ID NO: 3599989 - DNA, 11 bp, Homo sapiens
ccctggacaca

SEQ ID NO: 3599990 - DNA, 18 bp, Homo sapiens
ccctggacacagctcttc

SEQ ID NO: 3599991 - DNA, 10 bp, Homo sapiens
ccctggagag

SEQ ID NO: 3599992 - DNA, 21 bp, Homo sapiens
ccctggagaggccctctggag

SEQ ID NO: 3599993 - DNA, 15 bp, Homo sapiens
ccctggatgcccagg

SEQ ID NO: 3599994 - DNA, 17 bp, Homo sapiens
ccctggctcccacaggc

SEQ ID NO: 3599995 - DNA, 19 bp, Homo sapiens
ccctggctcccacaggccc

SEQ ID NO: 3599996 - DNA, 20 bp, Homo sapiens
ccctggctcccacaggccct

SEQ ID NO: 3599997 - DNA, 16 bp, Homo sapiens
ccctggctttgcctct

SEQ ID NO: 3599998 - DNA, 17 bp, Homo sapiens
ccctggcttttcactgc

SEQ ID NO: 3599999 - DNA, 18 bp, Homo sapiens
ccctggcttttcactgct

SEQ ID NO: 3600000 - DNA, 14 bp, Homo sapiens
ccctgggagggagg

SEQ ID NO: 3600001 - DNA, 15 bp, Homo sapiens
ccctgggctcctctt

SEQ ID NO: 3600002 - DNA, 17 bp, Homo sapiens
ccctgggctggggcctc

SEQ ID NO: 3600003 - DNA, 20 bp, Homo sapiens
ccctgggctggggcctcaga

SEQ ID NO: 3600004 - DNA, 23 bp, Homo sapiens
ccctgggtctggggacaggcccg

SEQ ID NO: 3600005 - DNA, 19 bp, Homo sapiens
ccctgggtttgggagccag

SEQ ID NO: 3600006 - DNA, 22 bp, Homo sapiens
ccctgggtttgggagccaggac

SEQ ID NO: 3600007 - DNA, 15 bp, Homo sapiens
ccctggtcggagagg

SEQ ID NO: 3600008 - DNA, 17 bp, Homo sapiens
ccctggtgctgccacac

SEQ ID NO: 3600009 - DNA, 22 bp, Homo sapiens
ccctggttagctgacagtcagc

SEQ ID NO: 3600010 - DNA, 14 bp, Homo sapiens
ccctgtaggcctca

SEQ ID NO: 3600011 - DNA, 20 bp, Homo sapiens
ccctgtcatttgaacctgga

SEQ ID NO: 3600012 - DNA, 19 bp, Homo sapiens
ccctgtcccacccacacag

SEQ ID NO: 3600013 - DNA, 20 bp, Homo sapiens
ccctgtcctctctggctggg

SEQ ID NO: 3600014 - DNA, 20 bp, Homo sapiens
ccctgtcctgcagtcccaca

SEQ ID NO: 3600015 - DNA, 15 bp, Homo sapiens
ccctgtctccagctg

SEQ ID NO: 3600016 - DNA, 13 bp, Homo sapiens
ccctgtctccagg

SEQ ID NO: 3600017 - DNA, 20 bp, Homo sapiens
ccctgtctccagggccccca

SEQ ID NO: 3600018 - DNA, 23 bp, Homo sapiens
ccctgtctccagggcccccaccg

SEQ ID NO: 3600019 - DNA, 16 bp, Homo sapiens
ccctgtctgccagggc

SEQ ID NO: 3600020 - DNA, 14 bp, Homo sapiens
ccctgtctggaaga

SEQ ID NO: 3600021 - DNA, 24 bp, Homo sapiens
ccctgtgccttggtgtgctgtatc

SEQ ID NO: 3600022 - DNA, 13 bp, Homo sapiens
ccctgtggccaac

SEQ ID NO: 3600023 - DNA, 20 bp, Homo sapiens
cctcacctctcccccaaggc

SEQ ID NO: 3600024 - DNA, 15 bp, Homo sapiens
cctcactccccaggg

SEQ ID NO: 3600025 - DNA, 19 bp, Homo sapiens
cctcactccccagggagct

SEQ ID NO: 3600026 - DNA, 15 bp, Homo sapiens
cctcactggcctgcc

SEQ ID NO: 3600027 - DNA, 17 bp, Homo sapiens
cctcactggcctgccat

SEQ ID NO: 3600028 - DNA, 18 bp, Homo sapiens
cctcagaaggccccagag

SEQ ID NO: 3600029 - DNA, 21 bp, Homo sapiens
cctcagaaggccccagagaga

SEQ ID NO: 3600030 - DNA, 11 bp, Homo sapiens
cctcagccaga

SEQ ID NO: 3600031 - DNA, 16 bp, Homo sapiens
cctcagccagagaagc

SEQ ID NO: 3600032 - DNA, 15 bp, Homo sapiens
cctcagcctcctggg

SEQ ID NO: 3600033 - DNA, 13 bp, Homo sapiens
cctcagcctgctt

SEQ ID NO: 3600034 - DNA, 12 bp, Homo sapiens
cctcagcctggc

SEQ ID NO: 3600035 - DNA, 13 bp, Homo sapiens
cctcagcctggcc

SEQ ID NO: 3600036 - DNA, 19 bp, Homo sapiens
cctcagcctggccagacac

SEQ ID NO: 3600037 - DNA, 21 bp, Homo sapiens
cctcagcctggccagacacag

SEQ ID NO: 3600038 - DNA, 19 bp, Homo sapiens
cctcagccttgccagagat

SEQ ID NO: 3600039 - DNA, 22 bp, Homo sapiens
cctcagccttgccagagatcca

SEQ ID NO: 3600040 - DNA, 14 bp, Homo sapiens
cctcagctccctgc

SEQ ID NO: 3600041 - DNA, 22 bp, Homo sapiens
cctcagctccctgcctgtttcc

SEQ ID NO: 3600042 - DNA, 21 bp, Homo sapiens
cctcagcttcttcacaggcac

SEQ ID NO: 3600043 - DNA, 19 bp, Homo sapiens
cctcaggagccgaagccca

SEQ ID NO: 3600044 - DNA, 17 bp, Homo sapiens
cctcaggcacaccttgc

SEQ ID NO: 3600045 - DNA, 20 bp, Homo sapiens
cctcaggcacaccttgcaga

SEQ ID NO: 3600046 - DNA, 11 bp, Homo sapiens
cctcaggctcc

SEQ ID NO: 3600047 - DNA, 13 bp, Homo sapiens
cctcaggctccta

SEQ ID NO: 3600048 - DNA, 16 bp, Homo sapiens
cctcagtggatcttca

SEQ ID NO: 3600049 - DNA, 21 bp, Homo sapiens
cctcagtggatcttcagaact

SEQ ID NO: 3600050 - DNA, 23 bp, Homo sapiens
cctcatctccaaggcagggacca

SEQ ID NO: 3600051 - DNA, 22 bp, Homo sapiens
cctcatctgtggagctgccaca

SEQ ID NO: 3600052 - DNA, 23 bp, Homo sapiens
cctcattcagtaagttctgtggt

SEQ ID NO: 3600053 - DNA, 16 bp, Homo sapiens
cctccaaacctccagc

SEQ ID NO: 3600054 - DNA, 18 bp, Homo sapiens
cctccaaacctccagcct

SEQ ID NO: 3600055 - DNA, 21 bp, Homo sapiens
cctccaacgcccctgtggcca

SEQ ID NO: 3600056 - DNA, 18 bp, Homo sapiens
cctccaagcatttcatga

SEQ ID NO: 3600057 - DNA, 15 bp, Homo sapiens
cctccaagggtttcg

SEQ ID NO: 3600058 - DNA, 23 bp, Homo sapiens
cctccaagggtttcgactggtcc

SEQ ID NO: 3600059 - DNA, 18 bp, Homo sapiens
cctccacacccaccccct

SEQ ID NO: 3600060 - DNA, 22 bp, Homo sapiens
cctccacacccaccccctctgg

SEQ ID NO: 3600061 - DNA, 23 bp, Homo sapiens
cctccacacccaccccctctgga

SEQ ID NO: 3600062 - DNA, 16 bp, Homo sapiens
cctccacacctgaact

SEQ ID NO: 3600063 - DNA, 14 bp, Homo sapiens
cctccacagagagg

SEQ ID NO: 3600064 - DNA, 21 bp, Homo sapiens
cctccacagagaggaggggac

SEQ ID NO: 3600065 - DNA, 20 bp, Homo sapiens
cctccacatgctgcctggca

SEQ ID NO: 3600066 - DNA, 22 bp, Homo sapiens
cctccaccatgcactcacccct

SEQ ID NO: 3600067 - DNA, 18 bp, Homo sapiens
cctccaccccccactcag

SEQ ID NO: 3600068 - DNA, 15 bp, Homo sapiens
cctccactcgaccca

SEQ ID NO: 3600069 - DNA, 19 bp, Homo sapiens
cctccagaagtcccttcaa

SEQ ID NO: 3600070 - DNA, 18 bp, Homo sapiens
cctccagcctcccctccc

SEQ ID NO: 3600071 - DNA, 22 bp, Homo sapiens
cctccagcctcccctcccctgg

SEQ ID NO: 3600072 - DNA, 17 bp, Homo sapiens
cctccagcctccctgtc

SEQ ID NO: 3600073 - DNA, 23 bp, Homo sapiens
cctccagctaaacaccaacccct

SEQ ID NO: 3600074 - DNA, 14 bp, Homo sapiens
cctccaggagagag

SEQ ID NO: 3600075 - DNA, 23 bp, Homo sapiens
cctccaggtcggagtgcctggag

SEQ ID NO: 3600076 - DNA, 12 bp, Homo sapiens
cctccaggtttt

SEQ ID NO: 3600077 - DNA, 20 bp, Homo sapiens
cctccaggtttttcaattaa

SEQ ID NO: 3600078 - DNA, 23 bp, Homo sapiens
cctcccaaagtgctgggattaca

SEQ ID NO: 3600079 - DNA, 21 bp, Homo sapiens
cctcccaaggcattctcccag

SEQ ID NO: 3600080 - DNA, 20 bp, Homo sapiens
cctcccaatttcagactccc

SEQ ID NO: 3600081 - DNA, 13 bp, Homo sapiens
cctcccaccagag

SEQ ID NO: 3600082 - DNA, 13 bp, Homo sapiens
cctcccacgcctc

SEQ ID NO: 3600083 - DNA, 17 bp, Homo sapiens
cctcccagacaggccct

SEQ ID NO: 3600084 - DNA, 19 bp, Homo sapiens
cctcccagacaggccctcc

SEQ ID NO: 3600085 - DNA, 22 bp, Homo sapiens
cctcccagacaggccctccctg

SEQ ID NO: 3600086 - DNA, 12 bp, Homo sapiens
cctccccagcca

SEQ ID NO: 3600087 - DNA, 14 bp, Homo sapiens
cctcccccattccc

SEQ ID NO: 3600088 - DNA, 11 bp, Homo sapiens
cctccccctgc

SEQ ID NO: 3600089 - DNA, 13 bp, Homo sapiens
cctccccctgcaa

SEQ ID NO: 3600090 - DNA, 15 bp, Homo sapiens
cctcccccttcccct

SEQ ID NO: 3600091 - DNA, 12 bp, Homo sapiens
cctccccgcccc

SEQ ID NO: 3600092 - DNA, 13 bp, Homo sapiens
cctccccgcccct

SEQ ID NO: 3600093 - DNA, 23 bp, Homo sapiens
cctccccgcccctgtggccctgg

SEQ ID NO: 3600094 - DNA, 15 bp, Homo sapiens
cctcccctatgctgg

SEQ ID NO: 3600095 - DNA, 17 bp, Homo sapiens
cctcccctctccttcct

SEQ ID NO: 3600096 - DNA, 16 bp, Homo sapiens
cctcccgcccttccat

SEQ ID NO: 3600097 - DNA, 23 bp, Homo sapiens
cctccctctcagaggcctgctgc

SEQ ID NO: 3600098 - DNA, 14 bp, Homo sapiens
cctccctgcatctg

SEQ ID NO: 3600099 - DNA, 20 bp, Homo sapiens
cctccctgcatctgaccagc

SEQ ID NO: 3600100 - DNA, 18 bp, Homo sapiens
cctccctgcccctccctt

SEQ ID NO: 3600101 - DNA, 21 bp, Homo sapiens
cctccctgcccctcccttcaa

SEQ ID NO: 3600102 - DNA, 15 bp, Homo sapiens
cctccctgcctccag

SEQ ID NO: 3600103 - DNA, 15 bp, Homo sapiens
cctccctgcctgctc

SEQ ID NO: 3600104 - DNA, 15 bp, Homo sapiens
cctccctgctgtgcc

SEQ ID NO: 3600105 - DNA, 23 bp, Homo sapiens
cctccctgctgtgccatgctggg

SEQ ID NO: 3600106 - DNA, 17 bp, Homo sapiens
cctccctgtctccagct

SEQ ID NO: 3600107 - DNA, 22 bp, Homo sapiens
cctccctgtctccagctgcctg

SEQ ID NO: 3600108 - DNA, 23 bp, Homo sapiens
cctccctgtctccagctgcctgg

SEQ ID NO: 3600109 - DNA, 20 bp, Homo sapiens
cctccctgttccccagagaa

SEQ ID NO: 3600110 - DNA, 17 bp, Homo sapiens
cctccgccttctcccac

SEQ ID NO: 3600111 - DNA, 16 bp, Homo sapiens
cctccgtcactacctg

SEQ ID NO: 3600112 - DNA, 21 bp, Homo sapiens
cctcctaaatgtcagctgttg

SEQ ID NO: 3600113 - DNA, 17 bp, Homo sapiens
cctcctaccctcccacc

SEQ ID NO: 3600114 - DNA, 22 bp, Homo sapiens
cctcctacctcagcctcctggg

SEQ ID NO: 3600115 - DNA, 19 bp, Homo sapiens
cctcctatcagaagtttct

SEQ ID NO: 3600116 - DNA, 19 bp, Homo sapiens
cctcctcacccacctctgg

SEQ ID NO: 3600117 - DNA, 12 bp, Homo sapiens
cctcctcagctc

SEQ ID NO: 3600118 - DNA, 17 bp, Homo sapiens
cctcctcagctccctgc

SEQ ID NO: 3600119 - DNA, 20 bp, Homo sapiens
cctcctcagctccctgcctg

SEQ ID NO: 3600120 - DNA, 14 bp, Homo sapiens
cctcctcccactgc

SEQ ID NO: 3600121 - DNA, 15 bp, Homo sapiens
cctcctcccactgcc

SEQ ID NO: 3600122 - DNA, 15 bp, Homo sapiens
cctcctcccccagtg

SEQ ID NO: 3600123 - DNA, 13 bp, Homo sapiens
cctcctccctgca

SEQ ID NO: 3600124 - DNA, 14 bp, Homo sapiens
cctcctccctgcat

SEQ ID NO: 3600125 - DNA, 16 bp, Homo sapiens
cctcctccctgcatct

SEQ ID NO: 3600126 - DNA, 19 bp, Homo sapiens
cctcctcggagagcagcag

SEQ ID NO: 3600127 - DNA, 20 bp, Homo sapiens
cctcctcggagagcagcagc

SEQ ID NO: 3600128 - DNA, 21 bp, Homo sapiens
cctcctctgcactcccacctg

SEQ ID NO: 3600129 - DNA, 12 bp, Homo sapiens
cctcctctgctg

SEQ ID NO: 3600130 - DNA, 19 bp, Homo sapiens
cctcctgagtgccccactt

SEQ ID NO: 3600131 - DNA, 16 bp, Homo sapiens
cctcctgcacacaggg

SEQ ID NO: 3600132 - DNA, 17 bp, Homo sapiens
cctcctgccccctgcca

SEQ ID NO: 3600133 - DNA, 18 bp, Homo sapiens
cctcctgccccctgccag

SEQ ID NO: 3600134 - DNA, 12 bp, Homo sapiens
cctcctgccctt

SEQ ID NO: 3600135 - DNA, 18 bp, Homo sapiens
cctccttgtgccttcttt

SEQ ID NO: 3600136 - DNA, 22 bp, Homo sapiens
cctcgacagggcctggagcccc

SEQ ID NO: 3600137 - DNA, 22 bp, Homo sapiens
cctcgacctccccacccgctcc

SEQ ID NO: 3600138 - DNA, 12 bp, Homo sapiens
cctcgagagcct

SEQ ID NO: 3600139 - DNA, 13 bp, Homo sapiens
cctcgagagcctt

SEQ ID NO: 3600140 - DNA, 14 bp, Homo sapiens
cctcgctcccttca

SEQ ID NO: 3600141 - DNA, 15 bp, Homo sapiens
cctcgctcccttcaa

SEQ ID NO: 3600142 - DNA, 19 bp, Homo sapiens
cctcggagagcagcagcac

SEQ ID NO: 3600143 - DNA, 22 bp, Homo sapiens
cctcggagggatggagaaagaa

SEQ ID NO: 3600144 - DNA, 16 bp, Homo sapiens
cctcggatccccttcc

SEQ ID NO: 3600145 - DNA, 17 bp, Homo sapiens
cctcggatccccttcct

SEQ ID NO: 3600146 - DNA, 14 bp, Homo sapiens
cctcggcacacact

SEQ ID NO: 3600147 - DNA, 16 bp, Homo sapiens
cctcggcacacactgt

SEQ ID NO: 3600148 - DNA, 18 bp, Homo sapiens
cctcgggccccatcctca

SEQ ID NO: 3600149 - DNA, 18 bp, Homo sapiens
cctcggtatctggcttcc

SEQ ID NO: 3600150 - DNA, 16 bp, Homo sapiens
cctctaagtgctgctg

SEQ ID NO: 3600151 - DNA, 18 bp, Homo sapiens
cctctaataaacactgtt

SEQ ID NO: 3600152 - DNA, 15 bp, Homo sapiens
cctctagtgccttct

SEQ ID NO: 3600153 - DNA, 18 bp, Homo sapiens
cctctagttgagtttctg

SEQ ID NO: 3600154 - DNA, 22 bp, Homo sapiens
cctctagttttttcttcctttt

SEQ ID NO: 3600155 - DNA, 15 bp, Homo sapiens
ccttatttgccttct

SEQ ID NO: 3600156 - DNA, 19 bp, Homo sapiens
ccttatttgccttctactc

SEQ ID NO: 3600157 - DNA, 18 bp, Homo sapiens
ccttcaagggtcagggtg

SEQ ID NO: 3600158 - DNA, 12 bp, Homo sapiens
ccttcacaaagc

SEQ ID NO: 3600159 - DNA, 17 bp, Homo sapiens
ccttcacctcggaggga

SEQ ID NO: 3600160 - DNA, 16 bp, Homo sapiens
ccttcagactggccct

SEQ ID NO: 3600161 - DNA, 11 bp, Homo sapiens
ccttcagcacg

SEQ ID NO: 3600162 - DNA, 13 bp, Homo sapiens
ccttcaggagcct

SEQ ID NO: 3600163 - DNA, 17 bp, Homo sapiens
ccttcaggagcctggcc

SEQ ID NO: 3600164 - DNA, 22 bp, Homo sapiens
ccttcaggagcctggccaggca

SEQ ID NO: 3600165 - DNA, 20 bp, Homo sapiens
ccttcatcagaactcttcct

SEQ ID NO: 3600166 - DNA, 19 bp, Homo sapiens
ccttcatccatcctgagcc

SEQ ID NO: 3600167 - DNA, 20 bp, Homo sapiens
ccttcatccatcctgagcca

SEQ ID NO: 3600168 - DNA, 13 bp, Homo sapiens
ccttccacctgcc

SEQ ID NO: 3600169 - DNA, 18 bp, Homo sapiens
ccttccatgtcgcctctg

SEQ ID NO: 3600170 - DNA, 21 bp, Homo sapiens
ccttccatgtcgcctctgcat

SEQ ID NO: 3600171 - DNA, 16 bp, Homo sapiens
ccttccatgtgccttt

SEQ ID NO: 3600172 - DNA, 17 bp, Homo sapiens
ccttcccatttctctac

SEQ ID NO: 3600173 - DNA, 22 bp, Homo sapiens
ccttccccctcccccagccact

SEQ ID NO: 3600174 - DNA, 14 bp, Homo sapiens
ccttcccctccctg

SEQ ID NO: 3600175 - DNA, 15 bp, Homo sapiens
ccttcccctccctgt

SEQ ID NO: 3600176 - DNA, 14 bp, Homo sapiens
ccttcccgggcggg

SEQ ID NO: 3600177 - DNA, 23 bp, Homo sapiens
ccttccctcaccttggcaccaga

SEQ ID NO: 3600178 - DNA, 15 bp, Homo sapiens
ccttccctggccccg

SEQ ID NO: 3600179 - DNA, 13 bp, Homo sapiens
ccttccctgggag

SEQ ID NO: 3600180 - DNA, 18 bp, Homo sapiens
ccttcctcagctgcctcc

SEQ ID NO: 3600181 - DNA, 14 bp, Homo sapiens
ccttcctctccact

SEQ ID NO: 3600182 - DNA, 16 bp, Homo sapiens
ccttcctctccactgc

SEQ ID NO: 3600183 - DNA, 16 bp, Homo sapiens
ccttcctgctgctgct

SEQ ID NO: 3600184 - DNA, 11 bp, Homo sapiens
ccttcctggaa

SEQ ID NO: 3600185 - DNA, 13 bp, Homo sapiens
ccttcctgggcac

SEQ ID NO: 3600186 - DNA, 17 bp, Homo sapiens
ccttcctgggcacacgc

SEQ ID NO: 3600187 - DNA, 22 bp, Homo sapiens
ccttcctgggcacacgctgctc

SEQ ID NO: 3600188 - DNA, 22 bp, Homo sapiens
ccttcgatacaccgggcctgga

SEQ ID NO: 3600189 - DNA, 23 bp, Homo sapiens
ccttcgatacaccgggcctggag

SEQ ID NO: 3600190 - DNA, 15 bp, Homo sapiens
ccttcggtacccacc

SEQ ID NO: 3600191 - DNA, 17 bp, Homo sapiens
ccttcggtacccaccac

SEQ ID NO: 3600192 - DNA, 13 bp, Homo sapiens
ccttctaaaggtg

SEQ ID NO: 3600193 - DNA, 14 bp, Homo sapiens
ccttctaaaggtgt

SEQ ID NO: 3600194 - DNA, 21 bp, Homo sapiens
ccttctaaattcccaaatcct

SEQ ID NO: 3600195 - DNA, 15 bp, Homo sapiens
ccttctactcccctt

SEQ ID NO: 3600196 - DNA, 17 bp, Homo sapiens
ccttctagttgccccca

SEQ ID NO: 3600197 - DNA, 14 bp, Homo sapiens
ccttctcactgcca

SEQ ID NO: 3600198 - DNA, 14 bp, Homo sapiens
ccttctccttccca

SEQ ID NO: 3600199 - DNA, 22 bp, Homo sapiens
ccttctccttcccatttctcta

SEQ ID NO: 3600200 - DNA, 20 bp, Homo sapiens
ccttctgaaaaagtatcctg

SEQ ID NO: 3600201 - DNA, 11 bp, Homo sapiens
ccttctgctga

SEQ ID NO: 3600202 - DNA, 17 bp, Homo sapiens
ccttctgctgaaagact

SEQ ID NO: 3600203 - DNA, 17 bp, Homo sapiens
ccttctggcctcccaca

SEQ ID NO: 3600204 - DNA, 14 bp, Homo sapiens
ccttctgggtccag

SEQ ID NO: 3600205 - DNA, 14 bp, Homo sapiens
ccttgacacctgct

SEQ ID NO: 3600206 - DNA, 23 bp, Homo sapiens
ccttgacattgtagagcttctgg

SEQ ID NO: 3600207 - DNA, 18 bp, Homo sapiens
ccttgaggaaacaacagc

SEQ ID NO: 3600208 - DNA, 19 bp, Homo sapiens
ccttgagttaacaggacag

SEQ ID NO: 3600209 - DNA, 14 bp, Homo sapiens
ccttgattcattct

SEQ ID NO: 3600210 - DNA, 14 bp, Homo sapiens
ccttgcaacccaag

SEQ ID NO: 3600211 - DNA, 21 bp, Homo sapiens
ccttgcaacccaaggtgaggt

SEQ ID NO: 3600212 - DNA, 16 bp, Homo sapiens
ccttgccagagatcca

SEQ ID NO: 3600213 - DNA, 18 bp, Homo sapiens
ccttgcctctgccctgga

SEQ ID NO: 3600214 - DNA, 13 bp, Homo sapiens
ccttgctctcctc

SEQ ID NO: 3600215 - DNA, 18 bp, Homo sapiens
ccttgctctcctcatctc

SEQ ID NO: 3600216 - DNA, 11 bp, Homo sapiens
ccttgctgccc

SEQ ID NO: 3600217 - DNA, 19 bp, Homo sapiens
ccttgctttcctgggcctt

SEQ ID NO: 3600218 - DNA, 20 bp, Homo sapiens
ccttgctttgagactcctca

SEQ ID NO: 3600219 - DNA, 23 bp, Homo sapiens
ccttgctttgagactcctcagca

SEQ ID NO: 3600220 - DNA, 18 bp, Homo sapiens
ccttggaacaccctggat

SEQ ID NO: 3600221 - DNA, 21 bp, Homo sapiens
ccttggaacaccctggatgct

SEQ ID NO: 3600222 - DNA, 18 bp, Homo sapiens
ccttggacattttatgtc

SEQ ID NO: 3600223 - DNA, 21 bp, Homo sapiens
ccttggacattttatgtcttt

SEQ ID NO: 3600224 - DNA, 18 bp, Homo sapiens
ccttggaggagagagacc

SEQ ID NO: 3600225 - DNA, 20 bp, Homo sapiens
ccttggcaccagacacccag

SEQ ID NO: 3600226 - DNA, 19 bp, Homo sapiens
ccttggcacccccatgctg

SEQ ID NO: 3600227 - DNA, 17 bp, Homo sapiens
ccttggccacagactga

SEQ ID NO: 3600228 - DNA, 16 bp, Homo sapiens
ccttggctcccggggg

SEQ ID NO: 3600229 - DNA, 20 bp, Homo sapiens
ccttggggtccctccacccc

SEQ ID NO: 3600230 - DNA, 12 bp, Homo sapiens
ccttggtgggga

SEQ ID NO: 3600231 - DNA, 20 bp, Homo sapiens
ccttggtttagaggaaccca

SEQ ID NO: 3600232 - DNA, 21 bp, Homo sapiens
ccttgtacagtctgctcctct

SEQ ID NO: 3600233 - DNA, 18 bp, Homo sapiens
ccttgtcagtgtgtcagt

SEQ ID NO: 3600234 - DNA, 11 bp, Homo sapiens
ccttgtggcct

SEQ ID NO: 3600235 - DNA, 21 bp, Homo sapiens
ccttgtgttgcactgaacagg

SEQ ID NO: 3600236 - DNA, 13 bp, Homo sapiens
ccttgtttaatgg

SEQ ID NO: 3600237 - DNA, 21 bp, Homo sapiens
cctttaacttttttttctctc

SEQ ID NO: 3600238 - DNA, 19 bp, Homo sapiens
cctttaagaaccttaatga

SEQ ID NO: 3600239 - DNA, 21 bp, Homo sapiens
cctttaagaaccttaatgaca

SEQ ID NO: 3600240 - DNA, 13 bp, Homo sapiens
cctttactcctgg

SEQ ID NO: 3600241 - DNA, 11 bp, Homo sapiens
cctttatttat

SEQ ID NO: 3600242 - DNA, 19 bp, Homo sapiens
cctttatttattaaacttc

SEQ ID NO: 3600243 - DNA, 21 bp, Homo sapiens
cctttatttattaaacttcag

SEQ ID NO: 3600244 - DNA, 15 bp, Homo sapiens
cctttcacaaccttc

SEQ ID NO: 3600245 - DNA, 18 bp, Homo sapiens
cctttcattaccctacag

SEQ ID NO: 3600246 - DNA, 15 bp, Homo sapiens
cctttcccaccattc

SEQ ID NO: 3600247 - DNA, 19 bp, Homo sapiens
cctttctctctcctctctg

SEQ ID NO: 3600248 - DNA, 21 bp, Homo sapiens
cctttctctctcctctctgct

SEQ ID NO: 3600249 - DNA, 14 bp, Homo sapiens
cctttctgtcccac

SEQ ID NO: 3600250 - DNA, 14 bp, Homo sapiens
cctttctttgcctc

SEQ ID NO: 3600251 - DNA, 15 bp, Homo sapiens
cctttctttgcctct

SEQ ID NO: 3600252 - DNA, 12 bp, Homo sapiens
cctttgaagaag

SEQ ID NO: 3600253 - DNA, 17 bp, Homo sapiens
cctttgcaagatgcttg

SEQ ID NO: 3600254 - DNA, 22 bp, Homo sapiens
cctttgctagttgtttgggctt

SEQ ID NO: 3600255 - DNA, 12 bp, Homo sapiens
cctttggcctgg

SEQ ID NO: 3600256 - DNA, 16 bp, Homo sapiens
cctttggctggtagca

SEQ ID NO: 3600257 - DNA, 14 bp, Homo sapiens
cctttgtctttctt

SEQ ID NO: 3600258 - DNA, 15 bp, Homo sapiens
cctttgttaaattta

SEQ ID NO: 3600259 - DNA, 20 bp, Homo sapiens
ccttttatctccttgtggcc

SEQ ID NO: 3600260 - DNA, 13 bp, Homo sapiens
ccttttatgtaaa

SEQ ID NO: 3600261 - DNA, 23 bp, Homo sapiens
ccttttgaacgcccccccccacc

SEQ ID NO: 3600262 - DNA, 22 bp, Homo sapiens
ccttttgaatacatttgtattt

SEQ ID NO: 3600263 - DNA, 18 bp, Homo sapiens
ccttttgacactgctcta

SEQ ID NO: 3600264 - DNA, 12 bp, Homo sapiens
ccttttgccaat

SEQ ID NO: 3600265 - DNA, 14 bp, Homo sapiens
ccttttgctctctg

SEQ ID NO: 3600266 - DNA, 19 bp, Homo sapiens
ccttttgctctctgtgacc

SEQ ID NO: 3600267 - DNA, 14 bp, Homo sapiens
ccttttttcaatat

SEQ ID NO: 3600268 - DNA, 17 bp, Homo sapiens
ccttttttcaatatgca

SEQ ID NO: 3600269 - DNA, 14 bp, Homo sapiens
cgaactctcagaaa

SEQ ID NO: 3600270 - DNA, 16 bp, Homo sapiens
cgaagatggtggccac

SEQ ID NO: 3600271 - DNA, 16 bp, Homo sapiens
cgaagcccaggggccg

SEQ ID NO: 3600272 - DNA, 19 bp, Homo sapiens
cgacaggtgggcctgggag

SEQ ID NO: 3600273 - DNA, 20 bp, Homo sapiens
cgacaggtgggcctgggagg

SEQ ID NO: 3600274 - DNA, 14 bp, Homo sapiens
cgaccaactgccct

SEQ ID NO: 3600275 - DNA, 20 bp, Homo sapiens
cgacccagaatggagcctgc

SEQ ID NO: 3600276 - DNA, 14 bp, Homo sapiens
cgaccccaaaggaa

SEQ ID NO: 3600277 - DNA, 22 bp, Homo sapiens
cgaccccaaaggaacactgaca

SEQ ID NO: 3600278 - DNA, 16 bp, Homo sapiens
cgacctccccacccgc

SEQ ID NO: 3600279 - DNA, 13 bp, Homo sapiens
cgactctgacctc

SEQ ID NO: 3600280 - DNA, 16 bp, Homo sapiens
cgactctgcacccgcc

SEQ ID NO: 3600281 - DNA, 23 bp, Homo sapiens
cgactgcccctgctgtgctgctc

SEQ ID NO: 3600282 - DNA, 13 bp, Homo sapiens
cgactggtccagc

SEQ ID NO: 3600283 - DNA, 14 bp, Homo sapiens
cgactggtccagct

SEQ ID NO: 3600284 - DNA, 15 bp, Homo sapiens
cgactggtccagctc

SEQ ID NO: 3600285 - DNA, 16 bp, Homo sapiens
cgactggtccagctct

SEQ ID NO: 3600286 - DNA, 20 bp, Homo sapiens
cgactggtccagctctgaca

SEQ ID NO: 3600287 - DNA, 14 bp, Homo sapiens
cgagaaccctgagc

SEQ ID NO: 3600288 - DNA, 15 bp, Homo sapiens
ctcaggagaagccag

SEQ ID NO: 3600289 - DNA, 18 bp, Homo sapiens
ctcaggagatggagggct

SEQ ID NO: 3600290 - DNA, 19 bp, Homo sapiens
ctcaggaggctgaggcagg

SEQ ID NO: 3600291 - DNA, 12 bp, Homo sapiens
ctcaggatccag

SEQ ID NO: 3600292 - DNA, 14 bp, Homo sapiens
ctcaggatccagtg

SEQ ID NO: 3600293 - DNA, 13 bp, Homo sapiens
ctcaggccacagt

SEQ ID NO: 3600294 - DNA, 12 bp, Homo sapiens
ctcaggcccaga

SEQ ID NO: 3600295 - DNA, 23 bp, Homo sapiens
ctcaggcccagaattgcagttca

SEQ ID NO: 3600296 - DNA, 11 bp, Homo sapiens
ctcaggctctg

SEQ ID NO: 3600297 - DNA, 19 bp, Homo sapiens
ctcaggctctgcacagaca

SEQ ID NO: 3600298 - DNA, 23 bp, Homo sapiens
ctcaggctctgcacagacaagca

SEQ ID NO: 3600299 - DNA, 22 bp, Homo sapiens
ctcagggaaaagcagctctccc

SEQ ID NO: 3600300 - DNA, 23 bp, Homo sapiens
ctcagggaactgaccctcaggca

SEQ ID NO: 3600301 - DNA, 17 bp, Homo sapiens
ctcagggaccggtgctg

SEQ ID NO: 3600302 - DNA, 15 bp, Homo sapiens
ctcagggatggaggg

SEQ ID NO: 3600303 - DNA, 11 bp, Homo sapiens
ctcagggctgg

SEQ ID NO: 3600304 - DNA, 15 bp, Homo sapiens
ctcagggctggagcc

SEQ ID NO: 3600305 - DNA, 23 bp, Homo sapiens
ctcagggctggagcctggggtgt

SEQ ID NO: 3600306 - DNA, 18 bp, Homo sapiens
ctcaggggaccccactcc

SEQ ID NO: 3600307 - DNA, 19 bp, Homo sapiens
ctcaggggaccccactccc

SEQ ID NO: 3600308 - DNA, 15 bp, Homo sapiens
ctcaggggcctggag

SEQ ID NO: 3600309 - DNA, 16 bp, Homo sapiens
ctcaggggcctggagg

SEQ ID NO: 3600310 - DNA, 17 bp, Homo sapiens
ctcaggggcctggaggt

SEQ ID NO: 3600311 - DNA, 20 bp, Homo sapiens
ctcaggggcctggaggtctg

SEQ ID NO: 3600312 - DNA, 16 bp, Homo sapiens
ctcaggggctctaggg

SEQ ID NO: 3600313 - DNA, 14 bp, Homo sapiens
ctcaggttgtctga

SEQ ID NO: 3600314 - DNA, 13 bp, Homo sapiens
ctcagtaccccat

SEQ ID NO: 3600315 - DNA, 12 bp, Homo sapiens
ctcagtactttg

SEQ ID NO: 3600316 - DNA, 18 bp, Homo sapiens
ctcagtactttggaggcc

SEQ ID NO: 3600317 - DNA, 17 bp, Homo sapiens
ctcagtctctcttctct

SEQ ID NO: 3600318 - DNA, 20 bp, Homo sapiens
ctcagtgatggaatatcatg

SEQ ID NO: 3600319 - DNA, 14 bp, Homo sapiens
ctcagtgcctccac

SEQ ID NO: 3600320 - DNA, 19 bp, Homo sapiens
ctcagtgcctccacatgct

SEQ ID NO: 3600321 - DNA, 17 bp, Homo sapiens
ctcagtggatcttcaga

SEQ ID NO: 3600322 - DNA, 21 bp, Homo sapiens
ctcagtggatcttcagaactg

SEQ ID NO: 3600323 - DNA, 16 bp, Homo sapiens
ctcagttttatgcccc

SEQ ID NO: 3600324 - DNA, 18 bp, Homo sapiens
ctcagttttatgccccat

SEQ ID NO: 3600325 - DNA, 16 bp, Homo sapiens
ctcataaatttacttt

SEQ ID NO: 3600326 - DNA, 22 bp, Homo sapiens
ctcataactctgtgatcttgct

SEQ ID NO: 3600327 - DNA, 16 bp, Homo sapiens
ctcataattttgcaaa

SEQ ID NO: 3600328 - DNA, 16 bp, Homo sapiens
ctcataccctccctcc

SEQ ID NO: 3600329 - DNA, 19 bp, Homo sapiens
ctcatatacttgaatatta

SEQ ID NO: 3600330 - DNA, 16 bp, Homo sapiens
ctcatcagccttggga

SEQ ID NO: 3600331 - DNA, 18 bp, Homo sapiens
ctcatccctgactggcca

SEQ ID NO: 3600332 - DNA, 12 bp, Homo sapiens
ctcatcggaggc

SEQ ID NO: 3600333 - DNA, 16 bp, Homo sapiens
ctcatcggaggcccat

SEQ ID NO: 3600334 - DNA, 20 bp, Homo sapiens
ctcatcggaggcccatgccc

SEQ ID NO: 3600335 - DNA, 16 bp, Homo sapiens
ctcatctctctgccca

SEQ ID NO: 3600336 - DNA, 19 bp, Homo sapiens
ctcatctgtctcggctctg

SEQ ID NO: 3600337 - DNA, 16 bp, Homo sapiens
ctcatctgtggagctg

SEQ ID NO: 3600338 - DNA, 17 bp, Homo sapiens
ctcatctgtggagctgc

SEQ ID NO: 3600339 - DNA, 16 bp, Homo sapiens
ctcatgactgcatgac

SEQ ID NO: 3600340 - DNA, 15 bp, Homo sapiens
ctcatgagtgtgccc

SEQ ID NO: 3600341 - DNA, 18 bp, Homo sapiens
ctcatgcacccctgagcc

SEQ ID NO: 3600342 - DNA, 12 bp, Homo sapiens
ctcatgctgctc

SEQ ID NO: 3600343 - DNA, 17 bp, Homo sapiens
ctcatgctgctccccta

SEQ ID NO: 3600344 - DNA, 18 bp, Homo sapiens
ctcatggggaagcttcca

SEQ ID NO: 3600345 - DNA, 15 bp, Homo sapiens
ctcatgggtggcact

SEQ ID NO: 3600346 - DNA, 15 bp, Homo sapiens
ctcatgttctgcttt

SEQ ID NO: 3600347 - DNA, 14 bp, Homo sapiens
ctcatgtttttaac

SEQ ID NO: 3600348 - DNA, 21 bp, Homo sapiens
ctcattccaccttcccatgcc

SEQ ID NO: 3600349 - DNA, 17 bp, Homo sapiens
ctcattccagaggaagg

SEQ ID NO: 3600350 - DNA, 12 bp, Homo sapiens
ctcattcccaac

SEQ ID NO: 3600351 - DNA, 22 bp, Homo sapiens
ctcattctggttccctgctgcg

SEQ ID NO: 3600352 - DNA, 19 bp, Homo sapiens
ctcattgcttacaagccta

SEQ ID NO: 3600353 - DNA, 18 bp, Homo sapiens
ctcatttccataccattg

SEQ ID NO: 3600354 - DNA, 23 bp, Homo sapiens
ctcatttccataccattgtggaa

SEQ ID NO: 3600355 - DNA, 20 bp, Homo sapiens
ctcattttatttacagctgt

SEQ ID NO: 3600356 - DNA, 15 bp, Homo sapiens
ctccaaacctccagc

SEQ ID NO: 3600357 - DNA, 16 bp, Homo sapiens
ctccaaacctccagcc

SEQ ID NO: 3600358 - DNA, 18 bp, Homo sapiens
ctccaaacctccagcctc

SEQ ID NO: 3600359 - DNA, 19 bp, Homo sapiens
ctccaaacctccagcctcc

SEQ ID NO: 3600360 - DNA, 13 bp, Homo sapiens
ctccaaagaaatg

SEQ ID NO: 3600361 - DNA, 19 bp, Homo sapiens
ctccaaccgggatgggagc

SEQ ID NO: 3600362 - DNA, 21 bp, Homo sapiens
ctccaacctgcaaagatctgt

SEQ ID NO: 3600363 - DNA, 16 bp, Homo sapiens
ctccaacgcccctgtg

SEQ ID NO: 3600364 - DNA, 17 bp, Homo sapiens
ctccaacgcccctgtgg

SEQ ID NO: 3600365 - DNA, 18 bp, Homo sapiens
ctccaacgcccctgtggc

SEQ ID NO: 3600366 - DNA, 19 bp, Homo sapiens
ctccaacgcccctgtggcc

SEQ ID NO: 3600367 - DNA, 22 bp, Homo sapiens
ctccaacgcccctgtggccaac

SEQ ID NO: 3600368 - DNA, 16 bp, Homo sapiens
ctccaagatgttctcc

SEQ ID NO: 3600369 - DNA, 16 bp, Homo sapiens
ctccaagcatttcatg

SEQ ID NO: 3600370 - DNA, 22 bp, Homo sapiens
ctccaagcatttcatgaaaaag

SEQ ID NO: 3600371 - DNA, 19 bp, Homo sapiens
ctccaagctccatctccac

SEQ ID NO: 3600372 - DNA, 17 bp, Homo sapiens
ctccaagtgccccacca

SEQ ID NO: 3600373 - DNA, 16 bp, Homo sapiens
ctccaatgactgagca

SEQ ID NO: 3600374 - DNA, 21 bp, Homo sapiens
ctccacacacagctgggctgt

SEQ ID NO: 3600375 - DNA, 13 bp, Homo sapiens
ctccacacccacc

SEQ ID NO: 3600376 - DNA, 17 bp, Homo sapiens
ctccacacccaccccct

SEQ ID NO: 3600377 - DNA, 21 bp, Homo sapiens
ctccacacccaccccctctgg

SEQ ID NO: 3600378 - DNA, 23 bp, Homo sapiens
ctccacacccaccccctctggag

SEQ ID NO: 3600379 - DNA, 13 bp, Homo sapiens
ctccacacctgaa

SEQ ID NO: 3600380 - DNA, 13 bp, Homo sapiens
ctccacagagagg

SEQ ID NO: 3600381 - DNA, 16 bp, Homo sapiens
ctccacagagaggagg

SEQ ID NO: 3600382 - DNA, 20 bp, Homo sapiens
ctccacatatttcagtgagg

SEQ ID NO: 3600383 - DNA, 20 bp, Homo sapiens
ctccacatgctgcctggcac

SEQ ID NO: 3600384 - DNA, 21 bp, Homo sapiens
ctccacatgctgcctggcaca

SEQ ID NO: 3600385 - DNA, 15 bp, Homo sapiens
ctccaccagcagcat

SEQ ID NO: 3600386 - DNA, 21 bp, Homo sapiens
ctccaccccccactcagtgcc

SEQ ID NO: 3600387 - DNA, 22 bp, Homo sapiens
ctccacccgttcccactgccct

SEQ ID NO: 3600388 - DNA, 21 bp, Homo sapiens
ctccaccgaccaactgcccta

SEQ ID NO: 3600389 - DNA, 14 bp, Homo sapiens
ctccactcgaccca

SEQ ID NO: 3600390 - DNA, 19 bp, Homo sapiens
ctccactcgacccagaatg

SEQ ID NO: 3600391 - DNA, 22 bp, Homo sapiens
ctccactcttgatctctcttgt

SEQ ID NO: 3600392 - DNA, 11 bp, Homo sapiens
ctccactgcct

SEQ ID NO: 3600393 - DNA, 14 bp, Homo sapiens
ctccactgccttcg

SEQ ID NO: 3600394 - DNA, 15 bp, Homo sapiens
ctccactgcctttgg

SEQ ID NO: 3600395 - DNA, 13 bp, Homo sapiens
ctccactggatgg

SEQ ID NO: 3600396 - DNA, 21 bp, Homo sapiens
ctccactttctcaatgcttag

SEQ ID NO: 3600397 - DNA, 15 bp, Homo sapiens
ctccagaagatagct

SEQ ID NO: 3600398 - DNA, 14 bp, Homo sapiens
ctccagaagatgcc

SEQ ID NO: 3600399 - DNA, 22 bp, Homo sapiens
ctccagaagatgccagcttctc

SEQ ID NO: 3600400 - DNA, 20 bp, Homo sapiens
ctccagacccctggcttttc

SEQ ID NO: 3600401 - DNA, 11 bp, Homo sapiens
ctccagacctg

SEQ ID NO: 3600402 - DNA, 22 bp, Homo sapiens
ctccagactctgggggtggaca

SEQ ID NO: 3600403 - DNA, 20 bp, Homo sapiens
ctccagagtggggatgacat

SEQ ID NO: 3600404 - DNA, 19 bp, Homo sapiens
ctccagcaggaaggacccc

SEQ ID NO: 3600405 - DNA, 13 bp, Homo sapiens
ctccagcctcccc

SEQ ID NO: 3600406 - DNA, 15 bp, Homo sapiens
ctccagcctcccctc

SEQ ID NO: 3600407 - DNA, 16 bp, Homo sapiens
ctccagcctcccctcc

SEQ ID NO: 3600408 - DNA, 17 bp, Homo sapiens
ctccagcctccctgtct

SEQ ID NO: 3600409 - DNA, 18 bp, Homo sapiens
ctccagcctccctgtctc

SEQ ID NO: 3600410 - DNA, 21 bp, Homo sapiens
ctccagcctccctgtctccag

SEQ ID NO: 3600411 - DNA, 22 bp, Homo sapiens
ctccagcctccctgtctccagc

SEQ ID NO: 3600412 - DNA, 23 bp, Homo sapiens
ctccagcctccctgtctccagct

SEQ ID NO: 3600413 - DNA, 23 bp, Homo sapiens
ctccagctaaacaccaacccctg

SEQ ID NO: 3600414 - DNA, 11 bp, Homo sapiens
ctccagctcct

SEQ ID NO: 3600415 - DNA, 16 bp, Homo sapiens
ctccagctgacagcca

SEQ ID NO: 3600416 - DNA, 17 bp, Homo sapiens
ctccagctgacagccac

SEQ ID NO: 3600417 - DNA, 21 bp, Homo sapiens
ctccagctgacagccacaccg

SEQ ID NO: 3600418 - DNA, 11 bp, Homo sapiens
ctccagctgcc

SEQ ID NO: 3600419 - DNA, 14 bp, Homo sapiens
ctccagctgcctgg

SEQ ID NO: 3600420 - DNA, 13 bp, Homo sapiens
ctgacccagcatc

SEQ ID NO: 3600421 - DNA, 20 bp, Homo sapiens
ctgacccagtgcccccactg

SEQ ID NO: 3600422 - DNA, 23 bp, Homo sapiens
ctgaccccgagaagtgctcttgg

SEQ ID NO: 3600423 - DNA, 19 bp, Homo sapiens
ctgacccctgcctgttggc

SEQ ID NO: 3600424 - DNA, 23 bp, Homo sapiens
ctgacccctgcctgttggcaggc

SEQ ID NO: 3600425 - DNA, 12 bp, Homo sapiens
ctgaccctcagg

SEQ ID NO: 3600426 - DNA, 14 bp, Homo sapiens
ctgaccctcaggca

SEQ ID NO: 3600427 - DNA, 19 bp, Homo sapiens
ctgaccctcaggcacacct

SEQ ID NO: 3600428 - DNA, 20 bp, Homo sapiens
ctgaccgatgtgtctcccag

SEQ ID NO: 3600429 - DNA, 17 bp, Homo sapiens
ctgacctaccccagcca

SEQ ID NO: 3600430 - DNA, 18 bp, Homo sapiens
ctgacctccgcccctgcc

SEQ ID NO: 3600431 - DNA, 12 bp, Homo sapiens
ctgacctgagcg

SEQ ID NO: 3600432 - DNA, 15 bp, Homo sapiens
ctgacggccagggag

SEQ ID NO: 3600433 - DNA, 20 bp, Homo sapiens
ctgacggccagggagaagct

SEQ ID NO: 3600434 - DNA, 21 bp, Homo sapiens
ctgacggccagggagaagctc

SEQ ID NO: 3600435 - DNA, 11 bp, Homo sapiens
ctgactagaac

SEQ ID NO: 3600436 - DNA, 14 bp, Homo sapiens
ctgactagaactcc

SEQ ID NO: 3600437 - DNA, 17 bp, Homo sapiens
ctgactcaattatttgc

SEQ ID NO: 3600438 - DNA, 18 bp, Homo sapiens
ctgactcaattatttgca

SEQ ID NO: 3600439 - DNA, 21 bp, Homo sapiens
ctgactcagtgaccagtgcct

SEQ ID NO: 3600440 - DNA, 14 bp, Homo sapiens
ctgactccaaagct

SEQ ID NO: 3600441 - DNA, 20 bp, Homo sapiens
ctgactcttattttttaaaa

SEQ ID NO: 3600442 - DNA, 22 bp, Homo sapiens
ctgactgaaggaaaagcaagaa

SEQ ID NO: 3600443 - DNA, 16 bp, Homo sapiens
ctgactgccaagccag

SEQ ID NO: 3600444 - DNA, 18 bp, Homo sapiens
ctgactgccaagccagat

SEQ ID NO: 3600445 - DNA, 20 bp, Homo sapiens
ctgactgccaagccagattc

SEQ ID NO: 3600446 - DNA, 15 bp, Homo sapiens
ctgactgggggcaga

SEQ ID NO: 3600447 - DNA, 20 bp, Homo sapiens
ctgacttcagtgaatatttt

SEQ ID NO: 3600448 - DNA, 23 bp, Homo sapiens
ctgagaaagactattcaaacagt

SEQ ID NO: 3600449 - DNA, 11 bp, Homo sapiens
ctgagaaagag

SEQ ID NO: 3600450 - DNA, 20 bp, Homo sapiens
ctgagaactcgttcacctcc

SEQ ID NO: 3600451 - DNA, 14 bp, Homo sapiens
ctgagacaggtgcc

SEQ ID NO: 3600452 - DNA, 17 bp, Homo sapiens
ctgagaccttgctttga

SEQ ID NO: 3600453 - DNA, 14 bp, Homo sapiens
ctgagagaccctgg

SEQ ID NO: 3600454 - DNA, 20 bp, Homo sapiens
ctgagagcatctcaggaggg

SEQ ID NO: 3600455 - DNA, 12 bp, Homo sapiens
ctgagaggccac

SEQ ID NO: 3600456 - DNA, 14 bp, Homo sapiens
ctgagaggctctcc

SEQ ID NO: 3600457 - DNA, 22 bp, Homo sapiens
ctgagaggctctccgtgcaggc

SEQ ID NO: 3600458 - DNA, 16 bp, Homo sapiens
ctgagatgtgaacaca

SEQ ID NO: 3600459 - DNA, 14 bp, Homo sapiens
ctgagcactgaacc

SEQ ID NO: 3600460 - DNA, 15 bp, Homo sapiens
ctgagcactgaacca

SEQ ID NO: 3600461 - DNA, 17 bp, Homo sapiens
ctgagcagccgccagct

SEQ ID NO: 3600462 - DNA, 18 bp, Homo sapiens
ctgagcagccgccagctg

SEQ ID NO: 3600463 - DNA, 19 bp, Homo sapiens
ctgagcagccgccagctgg

SEQ ID NO: 3600464 - DNA, 21 bp, Homo sapiens
ctgagcagggatctgccccct

SEQ ID NO: 3600465 - DNA, 12 bp, Homo sapiens
ctgagcaggtgt

SEQ ID NO: 3600466 - DNA, 17 bp, Homo sapiens
ctgagcagttgttatat

SEQ ID NO: 3600467 - DNA, 16 bp, Homo sapiens
ctgagccaaatttctt

SEQ ID NO: 3600468 - DNA, 15 bp, Homo sapiens
ctgagcccatttctg

SEQ ID NO: 3600469 - DNA, 14 bp, Homo sapiens
ctgagcccctgggg

SEQ ID NO: 3600470 - DNA, 22 bp, Homo sapiens
ctgagcccctgtctagagaggg

SEQ ID NO: 3600471 - DNA, 15 bp, Homo sapiens
ctgagccctcctgag

SEQ ID NO: 3600472 - DNA, 16 bp, Homo sapiens
ctgagcggcaccctgg

SEQ ID NO: 3600473 - DNA, 13 bp, Homo sapiens
ctgagctggccct

SEQ ID NO: 3600474 - DNA, 16 bp, Homo sapiens
ctgaggaattttcttt

SEQ ID NO: 3600475 - DNA, 23 bp, Homo sapiens
ctgaggacaagagaaaaaagcca

SEQ ID NO: 3600476 - DNA, 22 bp, Homo sapiens
ctgaggacttaaaatattcctg

SEQ ID NO: 3600477 - DNA, 19 bp, Homo sapiens
ctgaggagatgaccaggga

SEQ ID NO: 3600478 - DNA, 21 bp, Homo sapiens
ctgaggagatgaccagggatg

SEQ ID NO: 3600479 - DNA, 22 bp, Homo sapiens
ctgaggagatgaccagggatgc

SEQ ID NO: 3600480 - DNA, 14 bp, Homo sapiens
ctgaggagcagcag

SEQ ID NO: 3600481 - DNA, 14 bp, Homo sapiens
ctgaggatttcttt

SEQ ID NO: 3600482 - DNA, 20 bp, Homo sapiens
ctgaggcaccgtccaggccc

SEQ ID NO: 3600483 - DNA, 21 bp, Homo sapiens
ctgaggcaccgtccaggcccc

SEQ ID NO: 3600484 - DNA, 22 bp, Homo sapiens
ctgaggcaccgtccaggcccca

SEQ ID NO: 3600485 - DNA, 15 bp, Homo sapiens
ctgaggccagaaagg

SEQ ID NO: 3600486 - DNA, 16 bp, Homo sapiens
ctgaggccagaaaggt

SEQ ID NO: 3600487 - DNA, 14 bp, Homo sapiens
ctgaggcccagaga

SEQ ID NO: 3600488 - DNA, 18 bp, Homo sapiens
ctgaggcccagagaggga

SEQ ID NO: 3600489 - DNA, 16 bp, Homo sapiens
ctgaggcccctaggtg

SEQ ID NO: 3600490 - DNA, 21 bp, Homo sapiens
ctgaggcccctaggtgcccag

SEQ ID NO: 3600491 - DNA, 23 bp, Homo sapiens
ctgaggcctgccccctgggctgg

SEQ ID NO: 3600492 - DNA, 23 bp, Homo sapiens
ctgagggattgaggggccctggc

SEQ ID NO: 3600493 - DNA, 22 bp, Homo sapiens
ctgagggctaattctgggaagg

SEQ ID NO: 3600494 - DNA, 13 bp, Homo sapiens
ctgagggggagcc

SEQ ID NO: 3600495 - DNA, 20 bp, Homo sapiens
ctgagggggtgggggtgccg

SEQ ID NO: 3600496 - DNA, 17 bp, Homo sapiens
ctgaggggtgggggtgc

SEQ ID NO: 3600497 - DNA, 20 bp, Homo sapiens
ctgaggggtgggggtgccgc

SEQ ID NO: 3600498 - DNA, 16 bp, Homo sapiens
ctgagggtccacctgg

SEQ ID NO: 3600499 - DNA, 18 bp, Homo sapiens
ctgagggtccacctggag

SEQ ID NO: 3600500 - DNA, 20 bp, Homo sapiens
ctgagggtccacctggagag

SEQ ID NO: 3600501 - DNA, 21 bp, Homo sapiens
ctgagggtccacctggagagt

SEQ ID NO: 3600502 - DNA, 22 bp, Homo sapiens
ctgagggtccacctggagagta

SEQ ID NO: 3600503 - DNA, 17 bp, Homo sapiens
ctgagggtcgtgggaaa

SEQ ID NO: 3600504 - DNA, 19 bp, Homo sapiens
ctgagggtcgtgggaaagg

SEQ ID NO: 3600505 - DNA, 21 bp, Homo sapiens
ctgagggtcgtgggaaagggg

SEQ ID NO: 3600506 - DNA, 17 bp, Homo sapiens
ctgaggtcgggagttcg

SEQ ID NO: 3600507 - DNA, 19 bp, Homo sapiens
ctgagtagctctcctgact

SEQ ID NO: 3600508 - DNA, 19 bp, Homo sapiens
ctgagtagctggattacag

SEQ ID NO: 3600509 - DNA, 16 bp, Homo sapiens
ctgagtcaaatccagt

SEQ ID NO: 3600510 - DNA, 14 bp, Homo sapiens
ctgagtgccccact

SEQ ID NO: 3600511 - DNA, 18 bp, Homo sapiens
ctgataaaagatggccat

SEQ ID NO: 3600512 - DNA, 14 bp, Homo sapiens
ctgatatcaacagc

SEQ ID NO: 3600513 - DNA, 15 bp, Homo sapiens
ctgatatcaacagct

SEQ ID NO: 3600514 - DNA, 12 bp, Homo sapiens
ctgatcctggag

SEQ ID NO: 3600515 - DNA, 15 bp, Homo sapiens
ctgatcctggaggcc

SEQ ID NO: 3600516 - DNA, 15 bp, Homo sapiens
ctgatgagagaatgt

SEQ ID NO: 3600517 - DNA, 21 bp, Homo sapiens
ctgatgagagaatgtggaaat

SEQ ID NO: 3600518 - DNA, 15 bp, Homo sapiens
ctgatgattttcctt

SEQ ID NO: 3600519 - DNA, 14 bp, Homo sapiens
ctgatgctgcccct

SEQ ID NO: 3600520 - DNA, 14 bp, Homo sapiens
ctgatgctgtacta

SEQ ID NO: 3600521 - DNA, 22 bp, Homo sapiens
ctgatggggaagggacttttat

SEQ ID NO: 3600522 - DNA, 15 bp, Homo sapiens
ctgatgtactctaaa

SEQ ID NO: 3600523 - DNA, 16 bp, Homo sapiens
ctgatgtactctaaat

SEQ ID NO: 3600524 - DNA, 16 bp, Homo sapiens
ctgatgtataatgtaa

SEQ ID NO: 3600525 - DNA, 22 bp, Homo sapiens
ctgattctgattgctatcagca

SEQ ID NO: 3600526 - DNA, 22 bp, Homo sapiens
ctgattcttgttgctgtacaaa

SEQ ID NO: 3600527 - DNA, 16 bp, Homo sapiens
ctgattgctatcagca

SEQ ID NO: 3600528 - DNA, 20 bp, Homo sapiens
ctgatttctacaactggagt

SEQ ID NO: 3600529 - DNA, 20 bp, Homo sapiens
ctgattttctcactgaactc

SEQ ID NO: 3600530 - DNA, 20 bp, Homo sapiens
ctgcaaaaaaagcctccaag

SEQ ID NO: 3600531 - DNA, 22 bp, Homo sapiens
ctgcaaaaaaagcctccaaggg

SEQ ID NO: 3600532 - DNA, 18 bp, Homo sapiens
ctgcaaaactccaggcag

SEQ ID NO: 3600533 - DNA, 15 bp, Homo sapiens
ctgcaaacacacctt

SEQ ID NO: 3600534 - DNA, 16 bp, Homo sapiens
ctgcaaacacaccttg

SEQ ID NO: 3600535 - DNA, 16 bp, Homo sapiens
ctgcaacttccgctga

SEQ ID NO: 3600536 - DNA, 18 bp, Homo sapiens
ctgcaacttccgctgagg

SEQ ID NO: 3600537 - DNA, 15 bp, Homo sapiens
ctgcaacttctgcct

SEQ ID NO: 3600538 - DNA, 13 bp, Homo sapiens
ctgcaagaccacg

SEQ ID NO: 3600539 - DNA, 14 bp, Homo sapiens
ctgcaagcacagcc

SEQ ID NO: 3600540 - DNA, 17 bp, Homo sapiens
ctgcaaggtactctggt

SEQ ID NO: 3600541 - DNA, 18 bp, Homo sapiens
ctgcaaggtactctggtg

SEQ ID NO: 3600542 - DNA, 17 bp, Homo sapiens
ctgcaaggtctttggtt

SEQ ID NO: 3600543 - DNA, 22 bp, Homo sapiens
ctgcaaggtttaggctggtggc

SEQ ID NO: 3600544 - DNA, 23 bp, Homo sapiens
ctgcaaggtttaggctggtggcc

SEQ ID NO: 3600545 - DNA, 17 bp, Homo sapiens
ctgcacaacagccctgc

SEQ ID NO: 3600546 - DNA, 16 bp, Homo sapiens
ctgcacagacaagcag

SEQ ID NO: 3600547 - DNA, 22 bp, Homo sapiens
ctgcacagacaagcagcccttg

SEQ ID NO: 3600548 - DNA, 21 bp, Homo sapiens
ctgcacagtgcatctcagccc

SEQ ID NO: 3600549 - DNA, 16 bp, Homo sapiens
ctgcacatctacacac

SEQ ID NO: 3600550 - DNA, 18 bp, Homo sapiens
ctgcacatgagtggaaat

SEQ ID NO: 3600551 - DNA, 15 bp, Homo sapiens
ctgcaccaccatgcc

SEQ ID NO: 3600552 - DNA, 15 bp, Homo sapiens
ctggctttgcctctt

SEQ ID NO: 3600553 - DNA, 17 bp, Homo sapiens
ctggctttgcctcttct

SEQ ID NO: 3600554 - DNA, 22 bp, Homo sapiens
ctggctttgcctcttctttgtg

SEQ ID NO: 3600555 - DNA, 11 bp, Homo sapiens
ctggctttggc

SEQ ID NO: 3600556 - DNA, 16 bp, Homo sapiens
ctggcttttcactgct

SEQ ID NO: 3600557 - DNA, 19 bp, Homo sapiens
ctggcttttcactgctggc

SEQ ID NO: 3600558 - DNA, 15 bp, Homo sapiens
ctgggaaacagaggc

SEQ ID NO: 3600559 - DNA, 16 bp, Homo sapiens
ctgggaaacagaggct

SEQ ID NO: 3600560 - DNA, 20 bp, Homo sapiens
ctgggaacacatctggctgc

SEQ ID NO: 3600561 - DNA, 14 bp, Homo sapiens
ctgggaaccactcc

SEQ ID NO: 3600562 - DNA, 22 bp, Homo sapiens
ctgggaacccaagtccaagcat

SEQ ID NO: 3600563 - DNA, 21 bp, Homo sapiens
ctgggaagctcccaccccact

SEQ ID NO: 3600564 - DNA, 13 bp, Homo sapiens
ctgggaaggccag

SEQ ID NO: 3600565 - DNA, 14 bp, Homo sapiens
ctgggaaggccagc

SEQ ID NO: 3600566 - DNA, 23 bp, Homo sapiens
ctgggaaggccagccttgtacag

SEQ ID NO: 3600567 - DNA, 15 bp, Homo sapiens
ctgggaagggagagt

SEQ ID NO: 3600568 - DNA, 20 bp, Homo sapiens
ctgggaagggagagttcttt

SEQ ID NO: 3600569 - DNA, 18 bp, Homo sapiens
ctgggaataagtgccagg

SEQ ID NO: 3600570 - DNA, 14 bp, Homo sapiens
ctgggaatgggaga

SEQ ID NO: 3600571 - DNA, 13 bp, Homo sapiens
ctgggacagctgg

SEQ ID NO: 3600572 - DNA, 17 bp, Homo sapiens
ctgggacagctggctgg

SEQ ID NO: 3600573 - DNA, 16 bp, Homo sapiens
ctgggacctgtggtca

SEQ ID NO: 3600574 - DNA, 14 bp, Homo sapiens
ctgggagccagtcc

SEQ ID NO: 3600575 - DNA, 18 bp, Homo sapiens
ctgggagccgcctgcttc

SEQ ID NO: 3600576 - DNA, 14 bp, Homo sapiens
ctgggagctctgca

SEQ ID NO: 3600577 - DNA, 15 bp, Homo sapiens
ctgggagcttccgct

SEQ ID NO: 3600578 - DNA, 12 bp, Homo sapiens
ctgggaggcaga

SEQ ID NO: 3600579 - DNA, 12 bp, Homo sapiens
ctgggagggagg

SEQ ID NO: 3600580 - DNA, 22 bp, Homo sapiens
ctgggatatggctgcccaggag

SEQ ID NO: 3600581 - DNA, 14 bp, Homo sapiens
ctgggatatttaac

SEQ ID NO: 3600582 - DNA, 17 bp, Homo sapiens
ctgggattataggcatg

SEQ ID NO: 3600583 - DNA, 21 bp, Homo sapiens
ctgggattggggggtgggctt

SEQ ID NO: 3600584 - DNA, 19 bp, Homo sapiens
ctgggcaatgatggcaatt

SEQ ID NO: 3600585 - DNA, 20 bp, Homo sapiens
ctgggcacacgctgctctgc

SEQ ID NO: 3600586 - DNA, 20 bp, Homo sapiens
ctgggcaccacctctgtggg

SEQ ID NO: 3600587 - DNA, 13 bp, Homo sapiens
ctgggcagacctt

SEQ ID NO: 3600588 - DNA, 16 bp, Homo sapiens
ctgggcatgggtccag

SEQ ID NO: 3600589 - DNA, 17 bp, Homo sapiens
ctgggcatgggtccagg

SEQ ID NO: 3600590 - DNA, 18 bp, Homo sapiens
ctgggcatgggtccaggg

SEQ ID NO: 3600591 - DNA, 17 bp, Homo sapiens
ctgggcattagcaaggc

SEQ ID NO: 3600592 - DNA, 22 bp, Homo sapiens
ctgggcatttcaatccattttt

SEQ ID NO: 3600593 - DNA, 18 bp, Homo sapiens
ctgggcatttggtgagag

SEQ ID NO: 3600594 - DNA, 15 bp, Homo sapiens
ctgggccactgggga

SEQ ID NO: 3600595 - DNA, 21 bp, Homo sapiens
ctgggccataatgttgcttct

SEQ ID NO: 3600596 - DNA, 23 bp, Homo sapiens
ctgggccccgacgtttgcggcag

SEQ ID NO: 3600597 - DNA, 19 bp, Homo sapiens
ctgggcccggaagggcttt

SEQ ID NO: 3600598 - DNA, 19 bp, Homo sapiens
ctgggccctctttccctgc

SEQ ID NO: 3600599 - DNA, 20 bp, Homo sapiens
ctgggccctctttccctgcg

SEQ ID NO: 3600600 - DNA, 23 bp, Homo sapiens
ctgggccctctttccctgcgaga

SEQ ID NO: 3600601 - DNA, 15 bp, Homo sapiens
ctgggccggctgagt

SEQ ID NO: 3600602 - DNA, 20 bp, Homo sapiens
ctgggccggctgagtggcag

SEQ ID NO: 3600603 - DNA, 18 bp, Homo sapiens
ctgggccgtggcacagct

SEQ ID NO: 3600604 - DNA, 22 bp, Homo sapiens
ctgggccgtggcacagctggga

SEQ ID NO: 3600605 - DNA, 17 bp, Homo sapiens
ctgggcctgagggtcca

SEQ ID NO: 3600606 - DNA, 18 bp, Homo sapiens
ctgggcctgagggtccac

SEQ ID NO: 3600607 - DNA, 17 bp, Homo sapiens
ctgggcctggggaccca

SEQ ID NO: 3600608 - DNA, 17 bp, Homo sapiens
ctgggcctttgcaagat

SEQ ID NO: 3600609 - DNA, 15 bp, Homo sapiens
ctgggcgacaaaaac

SEQ ID NO: 3600610 - DNA, 16 bp, Homo sapiens
ctgggcgtccagctca

SEQ ID NO: 3600611 - DNA, 14 bp, Homo sapiens
ctgggctcactgtg

SEQ ID NO: 3600612 - DNA, 14 bp, Homo sapiens
ctgggctcagacat

SEQ ID NO: 3600613 - DNA, 12 bp, Homo sapiens
ctgggctcagcc

SEQ ID NO: 3600614 - DNA, 11 bp, Homo sapiens
ctgggctcctc

SEQ ID NO: 3600615 - DNA, 13 bp, Homo sapiens
ctgggctcctctt

SEQ ID NO: 3600616 - DNA, 16 bp, Homo sapiens
ctgggctggggcctca

SEQ ID NO: 3600617 - DNA, 17 bp, Homo sapiens
ctgggctggggcctcag

SEQ ID NO: 3600618 - DNA, 21 bp, Homo sapiens
ctgggctggtggctcccggag

SEQ ID NO: 3600619 - DNA, 14 bp, Homo sapiens
ctggggacagaggg

SEQ ID NO: 3600620 - DNA, 19 bp, Homo sapiens
ctggggacagcttcctcac

SEQ ID NO: 3600621 - DNA, 19 bp, Homo sapiens
ctggggacgccaaggaggt

SEQ ID NO: 3600622 - DNA, 17 bp, Homo sapiens
ctggggactcagggacc

SEQ ID NO: 3600623 - DNA, 12 bp, Homo sapiens
ctggggagccct

SEQ ID NO: 3600624 - DNA, 21 bp, Homo sapiens
ctggggagccctattgctgct

SEQ ID NO: 3600625 - DNA, 22 bp, Homo sapiens
ctggggagccctattgctgcta

SEQ ID NO: 3600626 - DNA, 23 bp, Homo sapiens
ctggggatcttcccacaggaggg

SEQ ID NO: 3600627 - DNA, 14 bp, Homo sapiens
ctggggcacggcgg

SEQ ID NO: 3600628 - DNA, 14 bp, Homo sapiens
ctggggcctcagac

SEQ ID NO: 3600629 - DNA, 21 bp, Homo sapiens
ctggggcgtttcctactgcgc

SEQ ID NO: 3600630 - DNA, 14 bp, Homo sapiens
ctggggctgtgtta

SEQ ID NO: 3600631 - DNA, 23 bp, Homo sapiens
ctgggggattcctgagctggcct

SEQ ID NO: 3600632 - DNA, 15 bp, Homo sapiens
ctgggggcaggccag

SEQ ID NO: 3600633 - DNA, 18 bp, Homo sapiens
ctgggggctgaggagcag

SEQ ID NO: 3600634 - DNA, 22 bp, Homo sapiens
ctggggggatgttctgcctctc

SEQ ID NO: 3600635 - DNA, 23 bp, Homo sapiens
ctgggggtcctctctgagtcaaa

SEQ ID NO: 3600636 - DNA, 18 bp, Homo sapiens
ctgggggtggacatctga

SEQ ID NO: 3600637 - DNA, 17 bp, Homo sapiens
ctgggggtgggccaggc

SEQ ID NO: 3600638 - DNA, 18 bp, Homo sapiens
ctggggtgcatctcctcc

SEQ ID NO: 3600639 - DNA, 14 bp, Homo sapiens
ctggggtggggtca

SEQ ID NO: 3600640 - DNA, 20 bp, Homo sapiens
ctggggtggggtcatgccct

SEQ ID NO: 3600641 - DNA, 14 bp, Homo sapiens
ctgggtccagggag

SEQ ID NO: 3600642 - DNA, 19 bp, Homo sapiens
ctgggtccttggctcccgg

SEQ ID NO: 3600643 - DNA, 13 bp, Homo sapiens
ctgggtctgcgat

SEQ ID NO: 3600644 - DNA, 18 bp, Homo sapiens
ctgggtgagagaggaata

SEQ ID NO: 3600645 - DNA, 20 bp, Homo sapiens
ctgggtggtattctggtagg

SEQ ID NO: 3600646 - DNA, 14 bp, Homo sapiens
ctgggttaaatatt

SEQ ID NO: 3600647 - DNA, 22 bp, Homo sapiens
ctgggttcaagcaatcctccta

SEQ ID NO: 3600648 - DNA, 19 bp, Homo sapiens
ctgggtttgggagccagga

SEQ ID NO: 3600649 - DNA, 13 bp, Homo sapiens
ctggtacctgccc

SEQ ID NO: 3600650 - DNA, 16 bp, Homo sapiens
ctggtacctgccctct

SEQ ID NO: 3600651 - DNA, 20 bp, Homo sapiens
ctggtacttagagtttctgt

SEQ ID NO: 3600652 - DNA, 13 bp, Homo sapiens
ctggtagcagcag

SEQ ID NO: 3600653 - DNA, 19 bp, Homo sapiens
ctggtagggatatggcagg

SEQ ID NO: 3600654 - DNA, 18 bp, Homo sapiens
ctggtatttatatttcaa

SEQ ID NO: 3600655 - DNA, 22 bp, Homo sapiens
ctggtcacaggactctgcctcc

SEQ ID NO: 3600656 - DNA, 12 bp, Homo sapiens
ctggtccagctc

SEQ ID NO: 3600657 - DNA, 13 bp, Homo sapiens
ctggtccagctct

SEQ ID NO: 3600658 - DNA, 15 bp, Homo sapiens
ctggtccagctctga

SEQ ID NO: 3600659 - DNA, 19 bp, Homo sapiens
ctggtccatgtaaatactt

SEQ ID NO: 3600660 - DNA, 20 bp, Homo sapiens
ctggtccccactgctgagct

SEQ ID NO: 3600661 - DNA, 16 bp, Homo sapiens
ctggtcctacccatcc

SEQ ID NO: 3600662 - DNA, 17 bp, Homo sapiens
ctggtcctacccatccc

SEQ ID NO: 3600663 - DNA, 23 bp, Homo sapiens
ctggtcctgcacatgagtggaaa

SEQ ID NO: 3600664 - DNA, 21 bp, Homo sapiens
ctggtcgccaatccatgctct

SEQ ID NO: 3600665 - DNA, 16 bp, Homo sapiens
ctggtctcctcagcct

SEQ ID NO: 3600666 - DNA, 21 bp, Homo sapiens
ctggtctgtggagatggactc

SEQ ID NO: 3600667 - DNA, 13 bp, Homo sapiens
ctggtgactcctg

SEQ ID NO: 3600668 - DNA, 17 bp, Homo sapiens
ctggtgccctggatgcc

SEQ ID NO: 3600669 - DNA, 20 bp, Homo sapiens
ctggtgccctggatgcccag

SEQ ID NO: 3600670 - DNA, 17 bp, Homo sapiens
ctggtgctcctgcatct

SEQ ID NO: 3600671 - DNA, 13 bp, Homo sapiens
ctggtgctgccac

SEQ ID NO: 3600672 - DNA, 12 bp, Homo sapiens
ctggtgctttag

SEQ ID NO: 3600673 - DNA, 12 bp, Homo sapiens
ctggtggcccag

SEQ ID NO: 3600674 - DNA, 13 bp, Homo sapiens
ctggtggcccagg

SEQ ID NO: 3600675 - DNA, 14 bp, Homo sapiens
ctggtgggccccca

SEQ ID NO: 3600676 - DNA, 15 bp, Homo sapiens
ctggtggttgctgtt

SEQ ID NO: 3600677 - DNA, 20 bp, Homo sapiens
ctggtggttgctgttttcct

SEQ ID NO: 3600678 - DNA, 17 bp, Homo sapiens
ctggtgtgaactcaccc

SEQ ID NO: 3600679 - DNA, 20 bp, Homo sapiens
ctggtgtgtggtgaggggct

SEQ ID NO: 3600680 - DNA, 23 bp, Homo sapiens
ctggtgtgtggtgaggggctttc

SEQ ID NO: 3600681 - DNA, 14 bp, Homo sapiens
ctggttacctggag

SEQ ID NO: 3600682 - DNA, 17 bp, Homo sapiens
ctggttacctggagaag

SEQ ID NO: 3600683 - DNA, 16 bp, Homo sapiens
ctggttccctgctgcg

SEQ ID NO: 3600684 - DNA, 18 bp, Homo sapiens
ctggttccctgctgcgct

SEQ ID NO: 3600685 - DNA, 18 bp, Homo sapiens
cttgaccaacagaaacct

SEQ ID NO: 3600686 - DNA, 12 bp, Homo sapiens
cttgactgcatt

SEQ ID NO: 3600687 - DNA, 19 bp, Homo sapiens
cttgagagttccggggaga

SEQ ID NO: 3600688 - DNA, 16 bp, Homo sapiens
cttgagattcaagaca

SEQ ID NO: 3600689 - DNA, 18 bp, Homo sapiens
cttgagattcaagacaag

SEQ ID NO: 3600690 - DNA, 23 bp, Homo sapiens
cttgaggtaccagttgtatttaa

SEQ ID NO: 3600691 - DNA, 16 bp, Homo sapiens
cttgatctctcttgtc

SEQ ID NO: 3600692 - DNA, 22 bp, Homo sapiens
cttgatgtacataactcctgtc

SEQ ID NO: 3600693 - DNA, 15 bp, Homo sapiens
cttgatgtgttatct

SEQ ID NO: 3600694 - DNA, 14 bp, Homo sapiens
cttgattcattctg

SEQ ID NO: 3600695 - DNA, 14 bp, Homo sapiens
cttgcaacccaagg

SEQ ID NO: 3600696 - DNA, 18 bp, Homo sapiens
cttgcaacccaaggtgag

SEQ ID NO: 3600697 - DNA, 20 bp, Homo sapiens
cttgcaacccaaggtgaggt

SEQ ID NO: 3600698 - DNA, 17 bp, Homo sapiens
cttgcaatctaatctga

SEQ ID NO: 3600699 - DNA, 22 bp, Homo sapiens
cttgcaatctaatctgaactga

SEQ ID NO: 3600700 - DNA, 22 bp, Homo sapiens
cttgcacttgttatattataat

SEQ ID NO: 3600701 - DNA, 18 bp, Homo sapiens
cttgcagaaggcaaggcc

SEQ ID NO: 3600702 - DNA, 22 bp, Homo sapiens
cttgcagaaggcaaggccctgc

SEQ ID NO: 3600703 - DNA, 23 bp, Homo sapiens
cttgcagcatttactatgcacaa

SEQ ID NO: 3600704 - DNA, 15 bp, Homo sapiens
cttgcatggagaatg

SEQ ID NO: 3600705 - DNA, 18 bp, Homo sapiens
cttgcatttaaaagacag

SEQ ID NO: 3600706 - DNA, 19 bp, Homo sapiens
cttgccacattaaattgat

SEQ ID NO: 3600707 - DNA, 14 bp, Homo sapiens
cttgccactgcctc

SEQ ID NO: 3600708 - DNA, 11 bp, Homo sapiens
cttgccagaga

SEQ ID NO: 3600709 - DNA, 16 bp, Homo sapiens
cttgccagagatccaa

SEQ ID NO: 3600710 - DNA, 12 bp, Homo sapiens
cttgccagtttt

SEQ ID NO: 3600711 - DNA, 18 bp, Homo sapiens
cttgccatttgtagcttt

SEQ ID NO: 3600712 - DNA, 22 bp, Homo sapiens
cttgccccacctcccccttccc

SEQ ID NO: 3600713 - DNA, 14 bp, Homo sapiens
cttgcccgctccca

SEQ ID NO: 3600714 - DNA, 15 bp, Homo sapiens
cttgcccgctcccac

SEQ ID NO: 3600715 - DNA, 14 bp, Homo sapiens
cttgccctgttaaa

SEQ ID NO: 3600716 - DNA, 22 bp, Homo sapiens
cttgccctgttaaaagatgaaa

SEQ ID NO: 3600717 - DNA, 15 bp, Homo sapiens
cttgcccttcctact

SEQ ID NO: 3600718 - DNA, 17 bp, Homo sapiens
cttgccctttcccccca

SEQ ID NO: 3600719 - DNA, 17 bp, Homo sapiens
cttgcctaaatttaatg

SEQ ID NO: 3600720 - DNA, 21 bp, Homo sapiens
cttgcctaaatttaatgctgc

SEQ ID NO: 3600721 - DNA, 21 bp, Homo sapiens
cttgcctaactaactggcagg

SEQ ID NO: 3600722 - DNA, 19 bp, Homo sapiens
cttgcctctgccctggatt

SEQ ID NO: 3600723 - DNA, 12 bp, Homo sapiens
cttgcctgaagc

SEQ ID NO: 3600724 - DNA, 18 bp, Homo sapiens
cttgccttcctcagctgc

SEQ ID NO: 3600725 - DNA, 17 bp, Homo sapiens
cttgctaccagtattta

SEQ ID NO: 3600726 - DNA, 18 bp, Homo sapiens
cttgctaccagtatttag

SEQ ID NO: 3600727 - DNA, 20 bp, Homo sapiens
cttgctaccagtatttagaa

SEQ ID NO: 3600728 - DNA, 18 bp, Homo sapiens
cttgctctcttttattct

SEQ ID NO: 3600729 - DNA, 18 bp, Homo sapiens
cttgctgagctgtttata

SEQ ID NO: 3600730 - DNA, 19 bp, Homo sapiens
cttgctgccatgatgtata

SEQ ID NO: 3600731 - DNA, 11 bp, Homo sapiens
cttgctgcctc

SEQ ID NO: 3600732 - DNA, 13 bp, Homo sapiens
cttgctgcctcgg

SEQ ID NO: 3600733 - DNA, 16 bp, Homo sapiens
cttgctgggctttggg

SEQ ID NO: 3600734 - DNA, 14 bp, Homo sapiens
cttgcttctttcta

SEQ ID NO: 3600735 - DNA, 15 bp, Homo sapiens
cttgcttctttctag

SEQ ID NO: 3600736 - DNA, 17 bp, Homo sapiens
cttgcttggaagccagg

SEQ ID NO: 3600737 - DNA, 16 bp, Homo sapiens
cttgctttcctgggcc

SEQ ID NO: 3600738 - DNA, 15 bp, Homo sapiens
cttgctttcggagct

SEQ ID NO: 3600739 - DNA, 21 bp, Homo sapiens
cttgctttgagactcctcagc

SEQ ID NO: 3600740 - DNA, 15 bp, Homo sapiens
cttggaacaccctgg

SEQ ID NO: 3600741 - DNA, 21 bp, Homo sapiens
cttggaacaccctggatgctg

SEQ ID NO: 3600742 - DNA, 20 bp, Homo sapiens
cttggacattttatgtcttt

SEQ ID NO: 3600743 - DNA, 19 bp, Homo sapiens
cttggaggagagagacccc

SEQ ID NO: 3600744 - DNA, 13 bp, Homo sapiens
cttggccacagac

SEQ ID NO: 3600745 - DNA, 19 bp, Homo sapiens
cttggccacagactgaact

SEQ ID NO: 3600746 - DNA, 14 bp, Homo sapiens
cttggccaggattt

SEQ ID NO: 3600747 - DNA, 15 bp, Homo sapiens
cttggccatgcagaa

SEQ ID NO: 3600748 - DNA, 18 bp, Homo sapiens
cttggccatgcagaaagc

SEQ ID NO: 3600749 - DNA, 17 bp, Homo sapiens
cttggcccccttcagga

SEQ ID NO: 3600750 - DNA, 15 bp, Homo sapiens
cttggccctcctcag

SEQ ID NO: 3600751 - DNA, 23 bp, Homo sapiens
cttggccctcctcagctccctgc

SEQ ID NO: 3600752 - DNA, 18 bp, Homo sapiens
cttggccgactcagggac

SEQ ID NO: 3600753 - DNA, 19 bp, Homo sapiens
cttggctcacaaggcccag

SEQ ID NO: 3600754 - DNA, 20 bp, Homo sapiens
cttggctcacaaggcccagg

SEQ ID NO: 3600755 - DNA, 21 bp, Homo sapiens
cttggctcacaaggcccagga

SEQ ID NO: 3600756 - DNA, 12 bp, Homo sapiens
cttggctgaccc

SEQ ID NO: 3600757 - DNA, 14 bp, Homo sapiens
cttggctgacccct

SEQ ID NO: 3600758 - DNA, 19 bp, Homo sapiens
cttggctgacccctctggt

SEQ ID NO: 3600759 - DNA, 21 bp, Homo sapiens
cttggctgcctgtgggcttcc

SEQ ID NO: 3600760 - DNA, 18 bp, Homo sapiens
cttggctttcagagccag

SEQ ID NO: 3600761 - DNA, 20 bp, Homo sapiens
cttgggatagtgttctgctc

SEQ ID NO: 3600762 - DNA, 21 bp, Homo sapiens
cttgggatagtgttctgctcc

SEQ ID NO: 3600763 - DNA, 22 bp, Homo sapiens
cttgggatagtgttctgctcct

SEQ ID NO: 3600764 - DNA, 17 bp, Homo sapiens
cttgggcctcaggctct

SEQ ID NO: 3600765 - DNA, 18 bp, Homo sapiens
cttgggcctcaggctctg

SEQ ID NO: 3600766 - DNA, 19 bp, Homo sapiens
cttgggcctcaggctctgc

SEQ ID NO: 3600767 - DNA, 17 bp, Homo sapiens
cttgggctgacccagca

SEQ ID NO: 3600768 - DNA, 19 bp, Homo sapiens
cttgggctgacccagcatc

SEQ ID NO: 3600769 - DNA, 22 bp, Homo sapiens
cttgggctgacccagcatctcc

SEQ ID NO: 3600770 - DNA, 21 bp, Homo sapiens
cttgggcttcaacagccaagc

SEQ ID NO: 3600771 - DNA, 20 bp, Homo sapiens
cttggggagttaagacctgg

SEQ ID NO: 3600772 - DNA, 21 bp, Homo sapiens
cttggggagttaagacctggc

SEQ ID NO: 3600773 - DNA, 22 bp, Homo sapiens
cttggggagttaagacctggca

SEQ ID NO: 3600774 - DNA, 15 bp, Homo sapiens
cttggggattgtaca

SEQ ID NO: 3600775 - DNA, 17 bp, Homo sapiens
cttggggattgtacacg

SEQ ID NO: 3600776 - DNA, 18 bp, Homo sapiens
cttgggggaggccacccc

SEQ ID NO: 3600777 - DNA, 23 bp, Homo sapiens
cttgggtagggtagtggctgggg

SEQ ID NO: 3600778 - DNA, 15 bp, Homo sapiens
cttgggtcacatgac

SEQ ID NO: 3600779 - DNA, 23 bp, Homo sapiens
cttgggttcaagtgattctcctg

SEQ ID NO: 3600780 - DNA, 22 bp, Homo sapiens
cttggtgaatttttttttccta

SEQ ID NO: 3600781 - DNA, 16 bp, Homo sapiens
cttggttctgtgaaca

SEQ ID NO: 3600782 - DNA, 14 bp, Homo sapiens
cttggttgtctcca

SEQ ID NO: 3600783 - DNA, 17 bp, Homo sapiens
cttggtttagaggaacc

SEQ ID NO: 3600784 - DNA, 18 bp, Homo sapiens
cttgtaaaaattaaaagt

SEQ ID NO: 3600785 - DNA, 16 bp, Homo sapiens
cttgtaactaaaataa

SEQ ID NO: 3600786 - DNA, 16 bp, Homo sapiens
cttgtaataaatactg

SEQ ID NO: 3600787 - DNA, 12 bp, Homo sapiens
cttgtacaaaat

SEQ ID NO: 3600788 - DNA, 20 bp, Homo sapiens
cttgtacagtctgctcctct

SEQ ID NO: 3600789 - DNA, 13 bp, Homo sapiens
cttgtactgggac

SEQ ID NO: 3600790 - DNA, 18 bp, Homo sapiens
cttgtattatctcctttg

SEQ ID NO: 3600791 - DNA, 22 bp, Homo sapiens
cttgtattatctcctttgaaga

SEQ ID NO: 3600792 - DNA, 16 bp, Homo sapiens
cttgtattccaagcat

SEQ ID NO: 3600793 - DNA, 23 bp, Homo sapiens
cttgtcagtgtgtcagtttttcc

SEQ ID NO: 3600794 - DNA, 14 bp, Homo sapiens
cttgtcatgtgaca

SEQ ID NO: 3600795 - DNA, 14 bp, Homo sapiens
cttgtccctttccc

SEQ ID NO: 3600796 - DNA, 18 bp, Homo sapiens
cttgtccctttccctacc

SEQ ID NO: 3600797 - DNA, 17 bp, Homo sapiens
cttgtcctcttctgctc

SEQ ID NO: 3600798 - DNA, 17 bp, Homo sapiens
cttgtctcacgcagcca

SEQ ID NO: 3600799 - DNA, 17 bp, Homo sapiens
cttgtcttttcaaaata

SEQ ID NO: 3600800 - DNA, 18 bp, Homo sapiens
cttgtcttttcaaaatat

SEQ ID NO: 3600801 - DNA, 13 bp, Homo sapiens
cttgtgattggct

SEQ ID NO: 3600802 - DNA, 20 bp, Homo sapiens
cttgtgatttccatttctga

SEQ ID NO: 3600803 - DNA, 14 bp, Homo sapiens
cttgtggcagcctg

SEQ ID NO: 3600804 - DNA, 14 bp, Homo sapiens
cttgtggcctatga

SEQ ID NO: 3600805 - DNA, 15 bp, Homo sapiens
cttgtgtctctgtgc

SEQ ID NO: 3600806 - DNA, 21 bp, Homo sapiens
cttgtgtctctgtgcttttaa

SEQ ID NO: 3600807 - DNA, 16 bp, Homo sapiens
cttgtgttcagaagaa

SEQ ID NO: 3600808 - DNA, 19 bp, Homo sapiens
cttgtgttcagaagaatct

SEQ ID NO: 3600809 - DNA, 20 bp, Homo sapiens
cttgtgttcagaagaatctt

SEQ ID NO: 3600810 - DNA, 20 bp, Homo sapiens
cttgtgttgcactgaacagg

SEQ ID NO: 3600811 - DNA, 15 bp, Homo sapiens
cttgttcctgaaatg

SEQ ID NO: 3600812 - DNA, 16 bp, Homo sapiens
cttgtttaatggtagt

SEQ ID NO: 3600813 - DNA, 22 bp, Homo sapiens
cttgtttaatgttaattatgca

SEQ ID NO: 3600814 - DNA, 20 bp, Homo sapiens
cttgttttttttttccactt

SEQ ID NO: 3600815 - DNA, 18 bp, Homo sapiens
ctttaaaaatgtcttatt

SEQ ID NO: 3600816 - DNA, 23 bp, Homo sapiens
ctttaaaacaaagggaaaaaaga

SEQ ID NO: 3600817 - DNA, 19 bp, Homo sapiens
gaacttgctgctgccttca

SEQ ID NO: 3600818 - DNA, 21 bp, Homo sapiens
gaacttgctgctgccttcaca

SEQ ID NO: 3600819 - DNA, 15 bp, Homo sapiens
gaagaaagctgattt

SEQ ID NO: 3600820 - DNA, 14 bp, Homo sapiens
gaagaaataaatga

SEQ ID NO: 3600821 - DNA, 19 bp, Homo sapiens
gaagaacatgattttacaa

SEQ ID NO: 3600822 - DNA, 13 bp, Homo sapiens
gaagaaccagtcc

SEQ ID NO: 3600823 - DNA, 19 bp, Homo sapiens
gaagaaccagtccccccac

SEQ ID NO: 3600824 - DNA, 16 bp, Homo sapiens
gaagaagaaaggactg

SEQ ID NO: 3600825 - DNA, 13 bp, Homo sapiens
gaagaagagaggc

SEQ ID NO: 3600826 - DNA, 21 bp, Homo sapiens
gaagaaggaagctgtgttgaa

SEQ ID NO: 3600827 - DNA, 17 bp, Homo sapiens
gaagaaggccagagagg

SEQ ID NO: 3600828 - DNA, 20 bp, Homo sapiens
gaagaaggccagagagggaa

SEQ ID NO: 3600829 - DNA, 16 bp, Homo sapiens
gaagaataaattctac

SEQ ID NO: 3600830 - DNA, 16 bp, Homo sapiens
gaagaatccagtatta

SEQ ID NO: 3600831 - DNA, 15 bp, Homo sapiens
gaagaatcttcctgg

SEQ ID NO: 3600832 - DNA, 13 bp, Homo sapiens
gaagacagaggca

SEQ ID NO: 3600833 - DNA, 10 bp, Homo sapiens
gaagacagtg

SEQ ID NO: 3600834 - DNA, 12 bp, Homo sapiens
gaagacagtggc

SEQ ID NO: 3600835 - DNA, 13 bp, Homo sapiens
gaagacagtggcc

SEQ ID NO: 3600836 - DNA, 17 bp, Homo sapiens
gaagacccaaaacagct

SEQ ID NO: 3600837 - DNA, 15 bp, Homo sapiens
gaagagctgttcaca

SEQ ID NO: 3600838 - DNA, 18 bp, Homo sapiens
gaagaggcctagcctgag

SEQ ID NO: 3600839 - DNA, 15 bp, Homo sapiens
gaagagggcccagcc

SEQ ID NO: 3600840 - DNA, 14 bp, Homo sapiens
gaagagtcctctga

SEQ ID NO: 3600841 - DNA, 14 bp, Homo sapiens
gaagatagaagaac

SEQ ID NO: 3600842 - DNA, 14 bp, Homo sapiens
gaagatagctctct

SEQ ID NO: 3600843 - DNA, 15 bp, Homo sapiens
gaagatagctctctg

SEQ ID NO: 3600844 - DNA, 22 bp, Homo sapiens
gaagatccgagtgtgatttgaa

SEQ ID NO: 3600845 - DNA, 13 bp, Homo sapiens
gaagatgaaattt

SEQ ID NO: 3600846 - DNA, 15 bp, Homo sapiens
gaagatggtggccac

SEQ ID NO: 3600847 - DNA, 16 bp, Homo sapiens
gaagatgtttacattt

SEQ ID NO: 3600848 - DNA, 19 bp, Homo sapiens
gaagatgtttacattttta

SEQ ID NO: 3600849 - DNA, 14 bp, Homo sapiens
gaagattctatgtt

SEQ ID NO: 3600850 - DNA, 20 bp, Homo sapiens
gaagattctatgttaatatt

SEQ ID NO: 3600851 - DNA, 20 bp, Homo sapiens
gaagattcttgtatttatta

SEQ ID NO: 3600852 - DNA, 22 bp, Homo sapiens
gaagcaacattttagctctatt

SEQ ID NO: 3600853 - DNA, 17 bp, Homo sapiens
gaagcaactgtgaattc

SEQ ID NO: 3600854 - DNA, 14 bp, Homo sapiens
gaagccagccacag

SEQ ID NO: 3600855 - DNA, 21 bp, Homo sapiens
gaagccagccacagacccctg

SEQ ID NO: 3600856 - DNA, 23 bp, Homo sapiens
gaagccaggaatttcccaggacc

SEQ ID NO: 3600857 - DNA, 22 bp, Homo sapiens
gaagccaggtacaggagaggca

SEQ ID NO: 3600858 - DNA, 13 bp, Homo sapiens
gaagccagtgtct

SEQ ID NO: 3600859 - DNA, 14 bp, Homo sapiens
gaagccatgtgggg

SEQ ID NO: 3600860 - DNA, 22 bp, Homo sapiens
gaagccatgtggggttgctgaa

SEQ ID NO: 3600861 - DNA, 16 bp, Homo sapiens
gaagcccaggggccgg

SEQ ID NO: 3600862 - DNA, 14 bp, Homo sapiens
gaagcccccagcta

SEQ ID NO: 3600863 - DNA, 17 bp, Homo sapiens
gaagcccccagctaaga

SEQ ID NO: 3600864 - DNA, 16 bp, Homo sapiens
gaagccccgacacacg

SEQ ID NO: 3600865 - DNA, 23 bp, Homo sapiens
gaagccggggtgtaacttcctgc

SEQ ID NO: 3600866 - DNA, 21 bp, Homo sapiens
gaagcctactggtagaaaaac

SEQ ID NO: 3600867 - DNA, 19 bp, Homo sapiens
gaagcctctctccttggcc

SEQ ID NO: 3600868 - DNA, 17 bp, Homo sapiens
gaagctcctctccccag

SEQ ID NO: 3600869 - DNA, 20 bp, Homo sapiens
gaagctcctctccccagccc

SEQ ID NO: 3600870 - DNA, 23 bp, Homo sapiens
gaagctcctctccccagcccaga

SEQ ID NO: 3600871 - DNA, 14 bp, Homo sapiens
gaagctctccgagc

SEQ ID NO: 3600872 - DNA, 16 bp, Homo sapiens
gaagctgccctgccca

SEQ ID NO: 3600873 - DNA, 13 bp, Homo sapiens
gaagctgctgtgt

SEQ ID NO: 3600874 - DNA, 15 bp, Homo sapiens
gaagctgctgtgtcc

SEQ ID NO: 3600875 - DNA, 15 bp, Homo sapiens
gaagctgtgttgaaa

SEQ ID NO: 3600876 - DNA, 21 bp, Homo sapiens
gaagctgtgttgaaacagaaa

SEQ ID NO: 3600877 - DNA, 22 bp, Homo sapiens
gaagctgtgttgaaacagaaaa

SEQ ID NO: 3600878 - DNA, 20 bp, Homo sapiens
gaagcttccatgatgcacag

SEQ ID NO: 3600879 - DNA, 22 bp, Homo sapiens
gaagcttctaaatggtgctgca

SEQ ID NO: 3600880 - DNA, 16 bp, Homo sapiens
gaagctttgtagaaat

SEQ ID NO: 3600881 - DNA, 22 bp, Homo sapiens
gaaggaataaattgctccttga

SEQ ID NO: 3600882 - DNA, 22 bp, Homo sapiens
gaaggcagtggcaggggagcag

SEQ ID NO: 3600883 - DNA, 21 bp, Homo sapiens
gaaggccagagagggaaaagg

SEQ ID NO: 3600884 - DNA, 16 bp, Homo sapiens
gaaggccagcaacatt

SEQ ID NO: 3600885 - DNA, 16 bp, Homo sapiens
gaaggccccagagaga

SEQ ID NO: 3600886 - DNA, 21 bp, Homo sapiens
gaaggccccagagagaccctg

SEQ ID NO: 3600887 - DNA, 16 bp, Homo sapiens
gaagggaaagcgggca

SEQ ID NO: 3600888 - DNA, 20 bp, Homo sapiens
gaagggaaagcgggcagccc

SEQ ID NO: 3600889 - DNA, 23 bp, Homo sapiens
gaagggagagttctttgctgccc

SEQ ID NO: 3600890 - DNA, 15 bp, Homo sapiens
gaagggagccaaggg

SEQ ID NO: 3600891 - DNA, 16 bp, Homo sapiens
gaagggagccaaggga

SEQ ID NO: 3600892 - DNA, 23 bp, Homo sapiens
gaagggagccaagggatggacat

SEQ ID NO: 3600893 - DNA, 19 bp, Homo sapiens
gaagggcagggctgaggcc

SEQ ID NO: 3600894 - DNA, 14 bp, Homo sapiens
gaagggccagagcc

SEQ ID NO: 3600895 - DNA, 16 bp, Homo sapiens
gaagggccagagccag

SEQ ID NO: 3600896 - DNA, 17 bp, Homo sapiens
gaagggccagagccagg

SEQ ID NO: 3600897 - DNA, 20 bp, Homo sapiens
gaagggggccctgctacctg

SEQ ID NO: 3600898 - DNA, 14 bp, Homo sapiens
gaaggggttttctt

SEQ ID NO: 3600899 - DNA, 23 bp, Homo sapiens
gaagggtctctctccaggtcagc

SEQ ID NO: 3600900 - DNA, 17 bp, Homo sapiens
gaaggtagaatgttttc

SEQ ID NO: 3600901 - DNA, 20 bp, Homo sapiens
gaaggtagaatgttttcaaa

SEQ ID NO: 3600902 - DNA, 14 bp, Homo sapiens
gaaggtctgtggtg

SEQ ID NO: 3600903 - DNA, 20 bp, Homo sapiens
gaaggtctgtggtgcagtgt

SEQ ID NO: 3600904 - DNA, 22 bp, Homo sapiens
gaagtaagtttatccaaatctt

SEQ ID NO: 3600905 - DNA, 22 bp, Homo sapiens
gaagtacttggcccccttcagg

SEQ ID NO: 3600906 - DNA, 22 bp, Homo sapiens
gaagtcacccctttctgtccca

SEQ ID NO: 3600907 - DNA, 15 bp, Homo sapiens
gaagtcatcttgcta

SEQ ID NO: 3600908 - DNA, 18 bp, Homo sapiens
gaagtcatcttgctacca

SEQ ID NO: 3600909 - DNA, 21 bp, Homo sapiens
gaagtccttcagtgagcccct

SEQ ID NO: 3600910 - DNA, 11 bp, Homo sapiens
gaagtctctga

SEQ ID NO: 3600911 - DNA, 12 bp, Homo sapiens
gaagtctctgat

SEQ ID NO: 3600912 - DNA, 13 bp, Homo sapiens
gaagtctgagccc

SEQ ID NO: 3600913 - DNA, 15 bp, Homo sapiens
gaagtcttctattta

SEQ ID NO: 3600914 - DNA, 16 bp, Homo sapiens
gaagtcttctatttat

SEQ ID NO: 3600915 - DNA, 20 bp, Homo sapiens
gaagtgacctcactggcctg

SEQ ID NO: 3600916 - DNA, 21 bp, Homo sapiens
gaagtgagcagtcgcctgcct

SEQ ID NO: 3600917 - DNA, 16 bp, Homo sapiens
gaagtgcacaggagcc

SEQ ID NO: 3600918 - DNA, 24 bp, Homo sapiens
gaagtgcagtcagcagatgctgtt

SEQ ID NO: 3600919 - DNA, 18 bp, Homo sapiens
gaagtgctcttggctgac

SEQ ID NO: 3600920 - DNA, 18 bp, Homo sapiens
gaagtgctgtttattaat

SEQ ID NO: 3600921 - DNA, 23 bp, Homo sapiens
gaagtggagacagtcctttccca

SEQ ID NO: 3600922 - DNA, 17 bp, Homo sapiens
gaagtgtgggtctgtgt

SEQ ID NO: 3600923 - DNA, 18 bp, Homo sapiens
gaagtgtgggtctgtgtg

SEQ ID NO: 3600924 - DNA, 21 bp, Homo sapiens
gaagtgtgggtctgtgtgtgt

SEQ ID NO: 3600925 - DNA, 16 bp, Homo sapiens
gaagttctatttattt

SEQ ID NO: 3600926 - DNA, 16 bp, Homo sapiens
gaagtttgctgtgctt

SEQ ID NO: 3600927 - DNA, 14 bp, Homo sapiens
gaagtttgtagcca

SEQ ID NO: 3600928 - DNA, 17 bp, Homo sapiens
gaagtttgtagccaggt

SEQ ID NO: 3600929 - DNA, 17 bp, Homo sapiens
gaagtttttgaaatacc

SEQ ID NO: 3600930 - DNA, 19 bp, Homo sapiens
gaagtttttgaaatacctt

SEQ ID NO: 3600931 - DNA, 15 bp, Homo sapiens
gaataaacatttgtt

SEQ ID NO: 3600932 - DNA, 16 bp, Homo sapiens
gaataaaggcagtttt

SEQ ID NO: 3600933 - DNA, 14 bp, Homo sapiens
gaataaatgtcact

SEQ ID NO: 3600934 - DNA, 16 bp, Homo sapiens
gaataaatgtcacttt

SEQ ID NO: 3600935 - DNA, 12 bp, Homo sapiens
gaataaggccca

SEQ ID NO: 3600936 - DNA, 20 bp, Homo sapiens
gaatacattaacggtgctaa

SEQ ID NO: 3600937 - DNA, 21 bp, Homo sapiens
gaatacattaacggtgctaaa

SEQ ID NO: 3600938 - DNA, 16 bp, Homo sapiens
gaatacatttgtattt

SEQ ID NO: 3600939 - DNA, 16 bp, Homo sapiens
gaatagtatcctccag

SEQ ID NO: 3600940 - DNA, 19 bp, Homo sapiens
gaatagtatcctccaggtt

SEQ ID NO: 3600941 - DNA, 20 bp, Homo sapiens
gaatagtatcctccaggttt

SEQ ID NO: 3600942 - DNA, 16 bp, Homo sapiens
gaatatatttaagcaa

SEQ ID NO: 3600943 - DNA, 16 bp, Homo sapiens
gaatattttaacttcc

SEQ ID NO: 3600944 - DNA, 21 bp, Homo sapiens
gaatcaaaacaaacgagcagg

SEQ ID NO: 3600945 - DNA, 12 bp, Homo sapiens
gaatcagctgga

SEQ ID NO: 3600946 - DNA, 16 bp, Homo sapiens
gaatccagaaggaagc

SEQ ID NO: 3600947 - DNA, 19 bp, Homo sapiens
gaatcgcttgaacctggga

SEQ ID NO: 3600948 - DNA, 16 bp, Homo sapiens
gaatctagaggagggg

SEQ ID NO: 3600949 - DNA, 21 bp, Homo sapiens
gagagggcaatctttgccttt

SEQ ID NO: 3600950 - DNA, 17 bp, Homo sapiens
gagaggtgaaagcataa

SEQ ID NO: 3600951 - DNA, 17 bp, Homo sapiens
gagagtacaccctttcc

SEQ ID NO: 3600952 - DNA, 24 bp, Homo sapiens
gagagtcagactgatagacaccat

SEQ ID NO: 3600953 - DNA, 13 bp, Homo sapiens
gagagtggagaga

SEQ ID NO: 3600954 - DNA, 13 bp, Homo sapiens
gagagtggctcct

SEQ ID NO: 3600955 - DNA, 16 bp, Homo sapiens
gagagtggctcctccc

SEQ ID NO: 3600956 - DNA, 21 bp, Homo sapiens
gagagtggctcctcccggtgc

SEQ ID NO: 3600957 - DNA, 18 bp, Homo sapiens
gagagttccggggagaaa

SEQ ID NO: 3600958 - DNA, 20 bp, Homo sapiens
gagatcaggagtgacagatc

SEQ ID NO: 3600959 - DNA, 18 bp, Homo sapiens
gagatccagggcaaggcc

SEQ ID NO: 3600960 - DNA, 20 bp, Homo sapiens
gagatccctgcagaacccac

SEQ ID NO: 3600961 - DNA, 15 bp, Homo sapiens
gagatctgtgtggct

SEQ ID NO: 3600962 - DNA, 18 bp, Homo sapiens
gagatctttctttccaaa

SEQ ID NO: 3600963 - DNA, 14 bp, Homo sapiens
gagatgaccaggga

SEQ ID NO: 3600964 - DNA, 21 bp, Homo sapiens
gagatgaccagggatgctggg

SEQ ID NO: 3600965 - DNA, 22 bp, Homo sapiens
gagatgaccagggatgctgggc

SEQ ID NO: 3600966 - DNA, 15 bp, Homo sapiens
gagatgagtgtctgg

SEQ ID NO: 3600967 - DNA, 16 bp, Homo sapiens
gagatggagggcttgg

SEQ ID NO: 3600968 - DNA, 17 bp, Homo sapiens
gagatgtaaaaggtatt

SEQ ID NO: 3600969 - DNA, 14 bp, Homo sapiens
gagattcaagacaa

SEQ ID NO: 3600970 - DNA, 17 bp, Homo sapiens
gagattcaagacaagag

SEQ ID NO: 3600971 - DNA, 20 bp, Homo sapiens
gagatttacccagactggtt

SEQ ID NO: 3600972 - DNA, 22 bp, Homo sapiens
gagcaagcaccaacctccagac

SEQ ID NO: 3600973 - DNA, 12 bp, Homo sapiens
gagcacaaagaa

SEQ ID NO: 3600974 - DNA, 22 bp, Homo sapiens
gagcacaaagaagaaagctgat

SEQ ID NO: 3600975 - DNA, 17 bp, Homo sapiens
gagcacacccgtgtgca

SEQ ID NO: 3600976 - DNA, 19 bp, Homo sapiens
gagcacccattccaaagct

SEQ ID NO: 3600977 - DNA, 22 bp, Homo sapiens
gagcaccccctgctccaccagc

SEQ ID NO: 3600978 - DNA, 23 bp, Homo sapiens
gagcactggtgtgaactcaccct

SEQ ID NO: 3600979 - DNA, 14 bp, Homo sapiens
gagcacttagcagg

SEQ ID NO: 3600980 - DNA, 13 bp, Homo sapiens
gagcagaggaggg

SEQ ID NO: 3600981 - DNA, 22 bp, Homo sapiens
gagcagcagcaccaaccacagc

SEQ ID NO: 3600982 - DNA, 18 bp, Homo sapiens
gagcagcaggagggggga

SEQ ID NO: 3600983 - DNA, 22 bp, Homo sapiens
gagcagcaggaggggggaggga

SEQ ID NO: 3600984 - DNA, 11 bp, Homo sapiens
gagcagcccag

SEQ ID NO: 3600985 - DNA, 21 bp, Homo sapiens
gagcagccgccagctgggagc

SEQ ID NO: 3600986 - DNA, 11 bp, Homo sapiens
gagcaggagcc

SEQ ID NO: 3600987 - DNA, 16 bp, Homo sapiens
gagcaggcccaatgct

SEQ ID NO: 3600988 - DNA, 21 bp, Homo sapiens
gagcaggctactgtcagctcc

SEQ ID NO: 3600989 - DNA, 20 bp, Homo sapiens
gagcaggcttgtggcagcct

SEQ ID NO: 3600990 - DNA, 23 bp, Homo sapiens
gagcaggcttgtggcagcctgat

SEQ ID NO: 3600991 - DNA, 16 bp, Homo sapiens
gagcagggtccacagc

SEQ ID NO: 3600992 - DNA, 19 bp, Homo sapiens
gagcagggtccacagctgg

SEQ ID NO: 3600993 - DNA, 22 bp, Homo sapiens
gagcagggtccacagctggaaa

SEQ ID NO: 3600994 - DNA, 23 bp, Homo sapiens
gagcaggttccccaagggccctg

SEQ ID NO: 3600995 - DNA, 15 bp, Homo sapiens
gagcagtcgcctgcc

SEQ ID NO: 3600996 - DNA, 12 bp, Homo sapiens
gagcataattta

SEQ ID NO: 3600997 - DNA, 21 bp, Homo sapiens
gagcatcaggctaagaccctg

SEQ ID NO: 3600998 - DNA, 22 bp, Homo sapiens
gagcatcaggctaagaccctgt

SEQ ID NO: 3600999 - DNA, 12 bp, Homo sapiens
gagcatcctgat

SEQ ID NO: 3601000 - DNA, 17 bp, Homo sapiens
gagcatgaaatttttaa

SEQ ID NO: 3601001 - DNA, 15 bp, Homo sapiens
gagcatggagacagc

SEQ ID NO: 3601002 - DNA, 17 bp, Homo sapiens
gagcatggggccaggaa

SEQ ID NO: 3601003 - DNA, 17 bp, Homo sapiens
gagcatttaatggcagc

SEQ ID NO: 3601004 - DNA, 18 bp, Homo sapiens
gagccaagggatggacat

SEQ ID NO: 3601005 - DNA, 15 bp, Homo sapiens
gagccacagtcactg

SEQ ID NO: 3601006 - DNA, 12 bp, Homo sapiens
gagccaccagtt

SEQ ID NO: 3601007 - DNA, 13 bp, Homo sapiens
gagccaccagttc

SEQ ID NO: 3601008 - DNA, 23 bp, Homo sapiens
gagccacctggatctatccctgc

SEQ ID NO: 3601009 - DNA, 19 bp, Homo sapiens
gagccagcctgcttcccac

SEQ ID NO: 3601010 - DNA, 20 bp, Homo sapiens
gagccagcctgcttcccaca

SEQ ID NO: 3601011 - DNA, 14 bp, Homo sapiens
gagccagcctggct

SEQ ID NO: 3601012 - DNA, 20 bp, Homo sapiens
gagccagcctggctctgccc

SEQ ID NO: 3601013 - DNA, 12 bp, Homo sapiens
gagccaggactc

SEQ ID NO: 3601014 - DNA, 14 bp, Homo sapiens
gagccaggactccc

SEQ ID NO: 3601015 - DNA, 23 bp, Homo sapiens
gagccagtcctccactcgaccca

SEQ ID NO: 3601016 - DNA, 19 bp, Homo sapiens
gagcccagagggtggcaag

SEQ ID NO: 3601017 - DNA, 14 bp, Homo sapiens
gagcccagctccaa

SEQ ID NO: 3601018 - DNA, 17 bp, Homo sapiens
gagcccagtgaagcctc

SEQ ID NO: 3601019 - DNA, 18 bp, Homo sapiens
gagccccatggtgggtag

SEQ ID NO: 3601020 - DNA, 14 bp, Homo sapiens
gagccccctctgcc

SEQ ID NO: 3601021 - DNA, 13 bp, Homo sapiens
gagcccctgggga

SEQ ID NO: 3601022 - DNA, 22 bp, Homo sapiens
gagcccgggagctgctgccctg

SEQ ID NO: 3601023 - DNA, 15 bp, Homo sapiens
gagccctagccctgc

SEQ ID NO: 3601024 - DNA, 12 bp, Homo sapiens
gagccctcctga

SEQ ID NO: 3601025 - DNA, 19 bp, Homo sapiens
gagccctcctgagggccgg

SEQ ID NO: 3601026 - DNA, 19 bp, Homo sapiens
gagccctggagagccccat

SEQ ID NO: 3601027 - DNA, 21 bp, Homo sapiens
gagcccttctatacccaccca

SEQ ID NO: 3601028 - DNA, 14 bp, Homo sapiens
gagccgaagcccag

SEQ ID NO: 3601029 - DNA, 17 bp, Homo sapiens
gagccggtaactgtcct

SEQ ID NO: 3601030 - DNA, 18 bp, Homo sapiens
gagccggtaactgtcctg

SEQ ID NO: 3601031 - DNA, 19 bp, Homo sapiens
gagccggtaactgtcctgt

SEQ ID NO: 3601032 - DNA, 21 bp, Homo sapiens
gagccggtaactgtcctgtcc

SEQ ID NO: 3601033 - DNA, 22 bp, Homo sapiens
gagccggtaactgtcctgtcct

SEQ ID NO: 3601034 - DNA, 15 bp, Homo sapiens
gagcctacctctgtc

SEQ ID NO: 3601035 - DNA, 21 bp, Homo sapiens
gagcctacctctgtctgagac

SEQ ID NO: 3601036 - DNA, 18 bp, Homo sapiens
gagcctagcggagcccag

SEQ ID NO: 3601037 - DNA, 21 bp, Homo sapiens
gagcctagcggagcccagcct

SEQ ID NO: 3601038 - DNA, 23 bp, Homo sapiens
gagcctagcggagcccagcctgg

SEQ ID NO: 3601039 - DNA, 15 bp, Homo sapiens
gagcctagctcctgc

SEQ ID NO: 3601040 - DNA, 12 bp, Homo sapiens
gagcctcccacc

SEQ ID NO: 3601041 - DNA, 13 bp, Homo sapiens
gagcctcccacca

SEQ ID NO: 3601042 - DNA, 21 bp, Homo sapiens
gagcctcccaccagagccggg

SEQ ID NO: 3601043 - DNA, 12 bp, Homo sapiens
gagcctcctggg

SEQ ID NO: 3601044 - DNA, 15 bp, Homo sapiens
gagcctctggcttcc

SEQ ID NO: 3601045 - DNA, 13 bp, Homo sapiens
gagcctggccagg

SEQ ID NO: 3601046 - DNA, 21 bp, Homo sapiens
gagcctggccaggcagggaga

SEQ ID NO: 3601047 - DNA, 23 bp, Homo sapiens
gagcctggctccgtccaggagcc

SEQ ID NO: 3601048 - DNA, 11 bp, Homo sapiens
gagcctggggg

SEQ ID NO: 3601049 - DNA, 19 bp, Homo sapiens
gagcctggtcccacgaggg

SEQ ID NO: 3601050 - DNA, 23 bp, Homo sapiens
gagcctggtcccacgagggtgcc

SEQ ID NO: 3601051 - DNA, 21 bp, Homo sapiens
gagcctggttcagacacagct

SEQ ID NO: 3601052 - DNA, 21 bp, Homo sapiens
gagccttacttcaaagtgcct

SEQ ID NO: 3601053 - DNA, 14 bp, Homo sapiens
gagccttttgctct

SEQ ID NO: 3601054 - DNA, 18 bp, Homo sapiens
gagcgagcaagccggcaa

SEQ ID NO: 3601055 - DNA, 13 bp, Homo sapiens
gagcgaggaaagg

SEQ ID NO: 3601056 - DNA, 14 bp, Homo sapiens
gagcgagtaaagtc

SEQ ID NO: 3601057 - DNA, 13 bp, Homo sapiens
gagcgcaggcagc

SEQ ID NO: 3601058 - DNA, 21 bp, Homo sapiens
gagcgcaggcagcgcagggct

SEQ ID NO: 3601059 - DNA, 20 bp, Homo sapiens
gagctaaaaaggcccttaga

SEQ ID NO: 3601060 - DNA, 16 bp, Homo sapiens
gagctactcccacagc

SEQ ID NO: 3601061 - DNA, 23 bp, Homo sapiens
gagctccatacacacgctgcctt

SEQ ID NO: 3601062 - DNA, 17 bp, Homo sapiens
gagctctggtgctttag

SEQ ID NO: 3601063 - DNA, 21 bp, Homo sapiens
gagctcttgtgttcagaagaa

SEQ ID NO: 3601064 - DNA, 13 bp, Homo sapiens
gagctgccacaga

SEQ ID NO: 3601065 - DNA, 13 bp, Homo sapiens
gagctgctgggtg

SEQ ID NO: 3601066 - DNA, 22 bp, Homo sapiens
gagctggaaggggccacgtgga

SEQ ID NO: 3601067 - DNA, 17 bp, Homo sapiens
gagctggggactcaggg

SEQ ID NO: 3601068 - DNA, 22 bp, Homo sapiens
gagctgtgagggccaccggtgg

SEQ ID NO: 3601069 - DNA, 18 bp, Homo sapiens
gagctgttatgctgtttc

SEQ ID NO: 3601070 - DNA, 20 bp, Homo sapiens
gagctgttatgctgtttcct

SEQ ID NO: 3601071 - DNA, 21 bp, Homo sapiens
gagctgtttggatacagctgc

SEQ ID NO: 3601072 - DNA, 16 bp, Homo sapiens
gagcttctcccagtgt

SEQ ID NO: 3601073 - DNA, 20 bp, Homo sapiens
gagcttgctcattaattttg

SEQ ID NO: 3601074 - DNA, 13 bp, Homo sapiens
gagcttgggaatg

SEQ ID NO: 3601075 - DNA, 15 bp, Homo sapiens
gaggaaaagaaacct

SEQ ID NO: 3601076 - DNA, 23 bp, Homo sapiens
gaggaaaaggcccctgcaatgtg

SEQ ID NO: 3601077 - DNA, 14 bp, Homo sapiens
gaggaaaggatttt

SEQ ID NO: 3601078 - DNA, 22 bp, Homo sapiens
gaggacagtatttgtggggagg

SEQ ID NO: 3601079 - DNA, 17 bp, Homo sapiens
gaggacatttgtgggca

SEQ ID NO: 3601080 - DNA, 21 bp, Homo sapiens
gaggacatttgtgggcaagca

SEQ ID NO: 3601081 - DNA, 13 bp, Homo sapiens
gatttcctaatac

SEQ ID NO: 3601082 - DNA, 22 bp, Homo sapiens
gatttctttctttgcaccaaag

SEQ ID NO: 3601083 - DNA, 16 bp, Homo sapiens
gatttggaatacacat

SEQ ID NO: 3601084 - DNA, 16 bp, Homo sapiens
gatttggggggggagg

SEQ ID NO: 3601085 - DNA, 12 bp, Homo sapiens
gattttaccaaa

SEQ ID NO: 3601086 - DNA, 19 bp, Homo sapiens
gattttcaaagctttttcc

SEQ ID NO: 3601087 - DNA, 22 bp, Homo sapiens
gattttccaggactgtttcaaa

SEQ ID NO: 3601088 - DNA, 21 bp, Homo sapiens
gattttgaaatttttattaaa

SEQ ID NO: 3601089 - DNA, 11 bp, Homo sapiens
gattttgcaaa

SEQ ID NO: 3601090 - DNA, 21 bp, Homo sapiens
gattttgtaaagttgccttta

SEQ ID NO: 3601091 - DNA, 22 bp, Homo sapiens
gattttgtaaagttgcctttat

SEQ ID NO: 3601092 - DNA, 14 bp, Homo sapiens
gcaaaaaaagcctc

SEQ ID NO: 3601093 - DNA, 16 bp, Homo sapiens
gcaaaaaaagcctcca

SEQ ID NO: 3601094 - DNA, 16 bp, Homo sapiens
gcaaaaagagtcagac

SEQ ID NO: 3601095 - DNA, 20 bp, Homo sapiens
gcaaaaagagtcagacattt

SEQ ID NO: 3601096 - DNA, 16 bp, Homo sapiens
gcaaaagaaacaccag

SEQ ID NO: 3601097 - DNA, 13 bp, Homo sapiens
gcaaaataatttt

SEQ ID NO: 3601098 - DNA, 12 bp, Homo sapiens
gcaaaatacatc

SEQ ID NO: 3601099 - DNA, 22 bp, Homo sapiens
gcaaaatggaacgctaatgaaa

SEQ ID NO: 3601100 - DNA, 18 bp, Homo sapiens
gcaaacacaccttggaga

SEQ ID NO: 3601101 - DNA, 21 bp, Homo sapiens
gcaaacaggatcagttaacta

SEQ ID NO: 3601102 - DNA, 12 bp, Homo sapiens
gcaaacatcaaa

SEQ ID NO: 3601103 - DNA, 19 bp, Homo sapiens
gcaaacatcaaataaattt

SEQ ID NO: 3601104 - DNA, 12 bp, Homo sapiens
gcaaactccagg

SEQ ID NO: 3601105 - DNA, 13 bp, Homo sapiens
gcaaactccaggt

SEQ ID NO: 3601106 - DNA, 18 bp, Homo sapiens
gcaaacttaatgttctta

SEQ ID NO: 3601107 - DNA, 23 bp, Homo sapiens
gcaaagaaagtgggaggtcagga

SEQ ID NO: 3601108 - DNA, 18 bp, Homo sapiens
gcaaagataatttatttc

SEQ ID NO: 3601109 - DNA, 21 bp, Homo sapiens
gcaaagatctgtcctcagcct

SEQ ID NO: 3601110 - DNA, 22 bp, Homo sapiens
gcaaagcccttggaacaccctg

SEQ ID NO: 3601111 - DNA, 16 bp, Homo sapiens
gcaaaggtgcactcca

SEQ ID NO: 3601112 - DNA, 18 bp, Homo sapiens
gcaaaggtgcactccaga

SEQ ID NO: 3601113 - DNA, 19 bp, Homo sapiens
gcaaaggtgcactccagac

SEQ ID NO: 3601114 - DNA, 20 bp, Homo sapiens
gcaaaggtgcactccagact

SEQ ID NO: 3601115 - DNA, 22 bp, Homo sapiens
gcaaaggtgcactccagactct

SEQ ID NO: 3601116 - DNA, 15 bp, Homo sapiens
gcaaagtttaaatgt

SEQ ID NO: 3601117 - DNA, 17 bp, Homo sapiens
gcaaagtttaaatgtat

SEQ ID NO: 3601118 - DNA, 20 bp, Homo sapiens
gcaaagtttaaatgtatttt

SEQ ID NO: 3601119 - DNA, 19 bp, Homo sapiens
gcaaataaatacgtgtcaa

SEQ ID NO: 3601120 - DNA, 20 bp, Homo sapiens
gcaaataaatacgtgtcaaa

SEQ ID NO: 3601121 - DNA, 22 bp, Homo sapiens
gcaaatagattcagagaaattt

SEQ ID NO: 3601122 - DNA, 15 bp, Homo sapiens
gcaaatcagaaaacc

SEQ ID NO: 3601123 - DNA, 14 bp, Homo sapiens
gcaaatggcctcat

SEQ ID NO: 3601124 - DNA, 14 bp, Homo sapiens
gcaacagagcactt

SEQ ID NO: 3601125 - DNA, 12 bp, Homo sapiens
gcaacagatctg

SEQ ID NO: 3601126 - DNA, 14 bp, Homo sapiens
gcaacagatctgga

SEQ ID NO: 3601127 - DNA, 16 bp, Homo sapiens
gcaacagatctggaac

SEQ ID NO: 3601128 - DNA, 17 bp, Homo sapiens
gcaacagatctggaacc

SEQ ID NO: 3601129 - DNA, 20 bp, Homo sapiens
gcaacagatctggaacctca

SEQ ID NO: 3601130 - DNA, 22 bp, Homo sapiens
gcaacagatctggaacctcagc

SEQ ID NO: 3601131 - DNA, 20 bp, Homo sapiens
gcaacaggattgatcattct

SEQ ID NO: 3601132 - DNA, 18 bp, Homo sapiens
gcaaccatatagaaagct

SEQ ID NO: 3601133 - DNA, 22 bp, Homo sapiens
gcaaccctacagtatataagct

SEQ ID NO: 3601134 - DNA, 15 bp, Homo sapiens
gcaacgcccctccaa

SEQ ID NO: 3601135 - DNA, 22 bp, Homo sapiens
gcaactggagccagcaaccagc

SEQ ID NO: 3601136 - DNA, 13 bp, Homo sapiens
gcaagaaatgaac

SEQ ID NO: 3601137 - DNA, 14 bp, Homo sapiens
gcaagaacagaagt

SEQ ID NO: 3601138 - DNA, 20 bp, Homo sapiens
gcaagacagaaaagtgcctg

SEQ ID NO: 3601139 - DNA, 24 bp, Homo sapiens
gcaagacctcatctgtggagctgc

SEQ ID NO: 3601140 - DNA, 15 bp, Homo sapiens
gcaagcacagccctt

SEQ ID NO: 3601141 - DNA, 15 bp, Homo sapiens
gcaagcaccaacctc

SEQ ID NO: 3601142 - DNA, 22 bp, Homo sapiens
gcaagcaccaacctccagactc

SEQ ID NO: 3601143 - DNA, 18 bp, Homo sapiens
gcaagcagatgacagagg

SEQ ID NO: 3601144 - DNA, 15 bp, Homo sapiens
gcaagcaggagtgtg

SEQ ID NO: 3601145 - DNA, 19 bp, Homo sapiens
gcaagcgagcacagtatta

SEQ ID NO: 3601146 - DNA, 16 bp, Homo sapiens
gcaagctaggccccag

SEQ ID NO: 3601147 - DNA, 23 bp, Homo sapiens
gcaagctaggccccagaggccct

SEQ ID NO: 3601148 - DNA, 14 bp, Homo sapiens
gcaaggcagagcct

SEQ ID NO: 3601149 - DNA, 16 bp, Homo sapiens
gcaaggcagagccttt

SEQ ID NO: 3601150 - DNA, 13 bp, Homo sapiens
gcaaggccctgcc

SEQ ID NO: 3601151 - DNA, 16 bp, Homo sapiens
gcaagtggagctgtct

SEQ ID NO: 3601152 - DNA, 22 bp, Homo sapiens
gcaagtggagctgtctgtctct

SEQ ID NO: 3601153 - DNA, 16 bp, Homo sapiens
gcaataaatctgaccc

SEQ ID NO: 3601154 - DNA, 22 bp, Homo sapiens
gcaataacagtagtgttacatg

SEQ ID NO: 3601155 - DNA, 23 bp, Homo sapiens
gcaataggtagctggggagccct

SEQ ID NO: 3601156 - DNA, 21 bp, Homo sapiens
gcaatagttttttacttctct

SEQ ID NO: 3601157 - DNA, 22 bp, Homo sapiens
gcaatattccttagtcaaatca

SEQ ID NO: 3601158 - DNA, 22 bp, Homo sapiens
gcaatcacagctcactgcagcc

SEQ ID NO: 3601159 - DNA, 19 bp, Homo sapiens
gcaatggtgcaatcacagc

SEQ ID NO: 3601160 - DNA, 18 bp, Homo sapiens
gcaattagtctgaaactg

SEQ ID NO: 3601161 - DNA, 21 bp, Homo sapiens
gcaattagtctgaaactggct

SEQ ID NO: 3601162 - DNA, 13 bp, Homo sapiens
gcaattcatggtt

SEQ ID NO: 3601163 - DNA, 16 bp, Homo sapiens
gcaattcatggttcaa

SEQ ID NO: 3601164 - DNA, 19 bp, Homo sapiens
gcaattcatggttcaagta

SEQ ID NO: 3601165 - DNA, 20 bp, Homo sapiens
gcaattcatggttcaagtat

SEQ ID NO: 3601166 - DNA, 17 bp, Homo sapiens
gcaatttaacaatgtct

SEQ ID NO: 3601167 - DNA, 14 bp, Homo sapiens
gcaattttgtaacg

SEQ ID NO: 3601168 - DNA, 21 bp, Homo sapiens
gcacaaaactacttttctaaa

SEQ ID NO: 3601169 - DNA, 15 bp, Homo sapiens
gcacaaacagaattt

SEQ ID NO: 3601170 - DNA, 16 bp, Homo sapiens
gcacaaagaagaaagc

SEQ ID NO: 3601171 - DNA, 14 bp, Homo sapiens
gcacaacagccctg

SEQ ID NO: 3601172 - DNA, 15 bp, Homo sapiens
gcacaacagccctgc

SEQ ID NO: 3601173 - DNA, 24 bp, Homo sapiens
gcacaacagccctgcctgagaagc

SEQ ID NO: 3601174 - DNA, 19 bp, Homo sapiens
gcacaagactggcccagtg

SEQ ID NO: 3601175 - DNA, 14 bp, Homo sapiens
gcacacactgtgcc

SEQ ID NO: 3601176 - DNA, 15 bp, Homo sapiens
gcacacagctgagca

SEQ ID NO: 3601177 - DNA, 22 bp, Homo sapiens
gcacacagctgagcacttagca

SEQ ID NO: 3601178 - DNA, 23 bp, Homo sapiens
gcacacagctgagcacttagcag

SEQ ID NO: 3601179 - DNA, 13 bp, Homo sapiens
gcacacatatata

SEQ ID NO: 3601180 - DNA, 14 bp, Homo sapiens
gcacacgctgctct

SEQ ID NO: 3601181 - DNA, 21 bp, Homo sapiens
gcacacgctgctctgccccag

SEQ ID NO: 3601182 - DNA, 17 bp, Homo sapiens
gcacactcatacacatg

SEQ ID NO: 3601183 - DNA, 20 bp, Homo sapiens
gcacactcatcccctcactt

SEQ ID NO: 3601184 - DNA, 19 bp, Homo sapiens
gcacactctcccattatat

SEQ ID NO: 3601185 - DNA, 14 bp, Homo sapiens
gcacactttctggc

SEQ ID NO: 3601186 - DNA, 16 bp, Homo sapiens
gcacactttctggcaa

SEQ ID NO: 3601187 - DNA, 22 bp, Homo sapiens
gcacactttctggcaaacgttt

SEQ ID NO: 3601188 - DNA, 19 bp, Homo sapiens
gcacagacaagcagccctt

SEQ ID NO: 3601189 - DNA, 22 bp, Homo sapiens
gcacagacaagcagcccttgct

SEQ ID NO: 3601190 - DNA, 19 bp, Homo sapiens
gcacagctgggagcctggt

SEQ ID NO: 3601191 - DNA, 23 bp, Homo sapiens
gcacaggtggctgtttcttgtct

SEQ ID NO: 3601192 - DNA, 22 bp, Homo sapiens
gcacagtatctgctgttcttca

SEQ ID NO: 3601193 - DNA, 23 bp, Homo sapiens
gcacagtatctgctgttcttcag

SEQ ID NO: 3601194 - DNA, 23 bp, Homo sapiens
gcacagtattatttctccatccc

SEQ ID NO: 3601195 - DNA, 13 bp, Homo sapiens
gcacagtgcatct

SEQ ID NO: 3601196 - DNA, 14 bp, Homo sapiens
gcacagtgggagct

SEQ ID NO: 3601197 - DNA, 17 bp, Homo sapiens
gcacagttttctgagaa

SEQ ID NO: 3601198 - DNA, 20 bp, Homo sapiens
gcacagttttctgagaaaga

SEQ ID NO: 3601199 - DNA, 20 bp, Homo sapiens
gcacatgctgtctggccctg

SEQ ID NO: 3601200 - DNA, 21 bp, Homo sapiens
gcacatgctgtctggccctgg

SEQ ID NO: 3601201 - DNA, 22 bp, Homo sapiens
gcacatgctgtctggccctggg

SEQ ID NO: 3601202 - DNA, 23 bp, Homo sapiens
gcaccaaacctaagtccttccac

SEQ ID NO: 3601203 - DNA, 24 bp, Homo sapiens
gcaccaaacctaagtccttccacc

SEQ ID NO: 3601204 - DNA, 10 bp, Homo sapiens
gcaccaaaga

SEQ ID NO: 3601205 - DNA, 14 bp, Homo sapiens
gcaccaacctccag

SEQ ID NO: 3601206 - DNA, 15 bp, Homo sapiens
gcaccaacctccaga

SEQ ID NO: 3601207 - DNA, 16 bp, Homo sapiens
gcaccaacctccagac

SEQ ID NO: 3601208 - DNA, 18 bp, Homo sapiens
gcaccaacctccagactc

SEQ ID NO: 3601209 - DNA, 21 bp, Homo sapiens
gcaccaacctccagactcagc

SEQ ID NO: 3601210 - DNA, 15 bp, Homo sapiens
gcaccacgggcccgg

SEQ ID NO: 3601211 - DNA, 16 bp, Homo sapiens
gcaccagacacccagg

SEQ ID NO: 3601212 - DNA, 13 bp, Homo sapiens
gcatgggctcgcc

SEQ ID NO: 3601213 - DNA, 16 bp, Homo sapiens
gcatggggccaggaaa

SEQ ID NO: 3601214 - DNA, 17 bp, Homo sapiens
gcatgggtccagggcct

SEQ ID NO: 3601215 - DNA, 21 bp, Homo sapiens
gcatgggtccagggcctgaca

SEQ ID NO: 3601216 - DNA, 16 bp, Homo sapiens
gcatggtgccccagga

SEQ ID NO: 3601217 - DNA, 17 bp, Homo sapiens
gcatggtgccccaggac

SEQ ID NO: 3601218 - DNA, 18 bp, Homo sapiens
gcatggtgccccaggacc

SEQ ID NO: 3601219 - DNA, 19 bp, Homo sapiens
gcatggtgccccaggacca

SEQ ID NO: 3601220 - DNA, 17 bp, Homo sapiens
gcatgtagcatataaat

SEQ ID NO: 3601221 - DNA, 23 bp, Homo sapiens
gcatgtccctaccgagtctcttc

SEQ ID NO: 3601222 - DNA, 14 bp, Homo sapiens
gcatgtgctgtgtg

SEQ ID NO: 3601223 - DNA, 15 bp, Homo sapiens
gcatgtgctgtgtga

SEQ ID NO: 3601224 - DNA, 22 bp, Homo sapiens
gcatgtgctgtgtgagtgagca

SEQ ID NO: 3601225 - DNA, 13 bp, Homo sapiens
gcatgttcctcct

SEQ ID NO: 3601226 - DNA, 15 bp, Homo sapiens
gcatgtttgaaatga

SEQ ID NO: 3601227 - DNA, 12 bp, Homo sapiens
gcatgttttcca

SEQ ID NO: 3601228 - DNA, 17 bp, Homo sapiens
gcatgttttccagggtg

SEQ ID NO: 3601229 - DNA, 20 bp, Homo sapiens
gcattaccagcttaaaacac

SEQ ID NO: 3601230 - DNA, 12 bp, Homo sapiens
gcattagcaagg

SEQ ID NO: 3601231 - DNA, 20 bp, Homo sapiens
gcattagcaaggcagagcct

SEQ ID NO: 3601232 - DNA, 22 bp, Homo sapiens
gcattagcaaggcagagccttt

SEQ ID NO: 3601233 - DNA, 14 bp, Homo sapiens
gcattattctcttt

SEQ ID NO: 3601234 - DNA, 18 bp, Homo sapiens
gcattcctgtgccctaga

SEQ ID NO: 3601235 - DNA, 13 bp, Homo sapiens
gcattctcccagc

SEQ ID NO: 3601236 - DNA, 16 bp, Homo sapiens
gcattctctcccatcc

SEQ ID NO: 3601237 - DNA, 19 bp, Homo sapiens
gcattctctcccatcctgg

SEQ ID NO: 3601238 - DNA, 12 bp, Homo sapiens
gcattgcagcct

SEQ ID NO: 3601239 - DNA, 17 bp, Homo sapiens
gcatttaatggcagcta

SEQ ID NO: 3601240 - DNA, 17 bp, Homo sapiens
gcatttcccccagggaa

SEQ ID NO: 3601241 - DNA, 16 bp, Homo sapiens
gcatttccttgtcccg

SEQ ID NO: 3601242 - DNA, 16 bp, Homo sapiens
gcatttggattggggt

SEQ ID NO: 3601243 - DNA, 15 bp, Homo sapiens
gcatttgtataaaga

SEQ ID NO: 3601244 - DNA, 12 bp, Homo sapiens
gcatttgtgaaa

SEQ ID NO: 3601245 - DNA, 18 bp, Homo sapiens
gcattttagaaactacaa

SEQ ID NO: 3601246 - DNA, 19 bp, Homo sapiens
gcattttagaaactacaaa

SEQ ID NO: 3601247 - DNA, 23 bp, Homo sapiens
gcattttggagagtttcctgaaa

SEQ ID NO: 3601248 - DNA, 16 bp, Homo sapiens
gccaaaaaaagacagg

SEQ ID NO: 3601249 - DNA, 15 bp, Homo sapiens
gccaaaatcaagagt

SEQ ID NO: 3601250 - DNA, 19 bp, Homo sapiens
gccaaacccttgctttcct

SEQ ID NO: 3601251 - DNA, 23 bp, Homo sapiens
gccaaacccttgctttcctgggc

SEQ ID NO: 3601252 - DNA, 16 bp, Homo sapiens
gccaaactcaggccca

SEQ ID NO: 3601253 - DNA, 17 bp, Homo sapiens
gccaaactcaggcccag

SEQ ID NO: 3601254 - DNA, 16 bp, Homo sapiens
gccaaagaaacaagct

SEQ ID NO: 3601255 - DNA, 20 bp, Homo sapiens
gccaaagaaacaagctgtgc

SEQ ID NO: 3601256 - DNA, 21 bp, Homo sapiens
gccaaagaaacaagctgtgca

SEQ ID NO: 3601257 - DNA, 23 bp, Homo sapiens
gccaaagaaacaagctgtgcagg

SEQ ID NO: 3601258 - DNA, 15 bp, Homo sapiens
gccaaatttcttttg

SEQ ID NO: 3601259 - DNA, 18 bp, Homo sapiens
gccaacctcaggctccta

SEQ ID NO: 3601260 - DNA, 21 bp, Homo sapiens
gccaacctcaggctcctaaag

SEQ ID NO: 3601261 - DNA, 22 bp, Homo sapiens
gccaacctgttcttagagtgta

SEQ ID NO: 3601262 - DNA, 18 bp, Homo sapiens
gccaacggcaacagcatg

SEQ ID NO: 3601263 - DNA, 17 bp, Homo sapiens
gccaactgtttccctgc

SEQ ID NO: 3601264 - DNA, 20 bp, Homo sapiens
gccaactgtttccctgctga

SEQ ID NO: 3601265 - DNA, 22 bp, Homo sapiens
gccaactgtttccctgctgaat

SEQ ID NO: 3601266 - DNA, 21 bp, Homo sapiens
gccaactttccccacgttaaa

SEQ ID NO: 3601267 - DNA, 22 bp, Homo sapiens
gccaagcacctagcctcgctct

SEQ ID NO: 3601268 - DNA, 12 bp, Homo sapiens
gccaagccagat

SEQ ID NO: 3601269 - DNA, 20 bp, Homo sapiens
gccaagccagattctcttga

SEQ ID NO: 3601270 - DNA, 14 bp, Homo sapiens
gccaagctggcaca

SEQ ID NO: 3601271 - DNA, 16 bp, Homo sapiens
gccaaggagcatcctt

SEQ ID NO: 3601272 - DNA, 21 bp, Homo sapiens
gccaaggagggtgagtgcaag

SEQ ID NO: 3601273 - DNA, 14 bp, Homo sapiens
gccaaggaggtggg

SEQ ID NO: 3601274 - DNA, 20 bp, Homo sapiens
gccaaggcagcgaccccagg

SEQ ID NO: 3601275 - DNA, 17 bp, Homo sapiens
gccaaggctctcccctc

SEQ ID NO: 3601276 - DNA, 14 bp, Homo sapiens
gccaagggaccagg

SEQ ID NO: 3601277 - DNA, 14 bp, Homo sapiens
gccaaggtgccacc

SEQ ID NO: 3601278 - DNA, 22 bp, Homo sapiens
gccaaggtgccaccaccctgcc

SEQ ID NO: 3601279 - DNA, 16 bp, Homo sapiens
gccaagtaaacagggt

SEQ ID NO: 3601280 - DNA, 17 bp, Homo sapiens
gccaagtgccaaatgct

SEQ ID NO: 3601281 - DNA, 17 bp, Homo sapiens
gccaataaattctaaat

SEQ ID NO: 3601282 - DNA, 17 bp, Homo sapiens
gccaatctaaaatggca

SEQ ID NO: 3601283 - DNA, 16 bp, Homo sapiens
gccaatggagactgtc

SEQ ID NO: 3601284 - DNA, 16 bp, Homo sapiens
gccacacccaggaagg

SEQ ID NO: 3601285 - DNA, 17 bp, Homo sapiens
gccacacccaggaaggg

SEQ ID NO: 3601286 - DNA, 21 bp, Homo sapiens
gccacaccgtggcagcttgct

SEQ ID NO: 3601287 - DNA, 23 bp, Homo sapiens
gccacaccgtggcagcttgctgg

SEQ ID NO: 3601288 - DNA, 12 bp, Homo sapiens
gccacacctggc

SEQ ID NO: 3601289 - DNA, 20 bp, Homo sapiens
gccacacgtggctggcggcc

SEQ ID NO: 3601290 - DNA, 18 bp, Homo sapiens
gccacagacccctgggag

SEQ ID NO: 3601291 - DNA, 21 bp, Homo sapiens
gccacagagaagtttgtagcc

SEQ ID NO: 3601292 - DNA, 23 bp, Homo sapiens
gccacagagaagtttgtagccag

SEQ ID NO: 3601293 - DNA, 23 bp, Homo sapiens
gccacagccttcggacagacata

SEQ ID NO: 3601294 - DNA, 15 bp, Homo sapiens
gccacatggagcccc

SEQ ID NO: 3601295 - DNA, 11 bp, Homo sapiens
gccaccagttc

SEQ ID NO: 3601296 - DNA, 14 bp, Homo sapiens
gccaccatgcttgc

SEQ ID NO: 3601297 - DNA, 17 bp, Homo sapiens
gccaccatgcttgcctg

SEQ ID NO: 3601298 - DNA, 22 bp, Homo sapiens
gccaccatgcttgcctgaagct

SEQ ID NO: 3601299 - DNA, 14 bp, Homo sapiens
gccacccagcccca

SEQ ID NO: 3601300 - DNA, 23 bp, Homo sapiens
gccacccagccccagccagggct

SEQ ID NO: 3601301 - DNA, 19 bp, Homo sapiens
gccaccccaaaccccagcc

SEQ ID NO: 3601302 - DNA, 18 bp, Homo sapiens
gccacccccttccctggg

SEQ ID NO: 3601303 - DNA, 16 bp, Homo sapiens
gccaccccgagggctg

SEQ ID NO: 3601304 - DNA, 17 bp, Homo sapiens
gccaccccgagggctga

SEQ ID NO: 3601305 - DNA, 22 bp, Homo sapiens
gccaccctcccctatgctggta

SEQ ID NO: 3601306 - DNA, 17 bp, Homo sapiens
gccaccgcgcccagcct

SEQ ID NO: 3601307 - DNA, 18 bp, Homo sapiens
gccacctccacacccacc

SEQ ID NO: 3601308 - DNA, 13 bp, Homo sapiens
gccacctggatct

SEQ ID NO: 3601309 - DNA, 18 bp, Homo sapiens
gccacgtcccagcatccc

SEQ ID NO: 3601310 - DNA, 15 bp, Homo sapiens
gccacgttaagtcca

SEQ ID NO: 3601311 - DNA, 23 bp, Homo sapiens
gccactaaagcttcagactcaag

SEQ ID NO: 3601312 - DNA, 15 bp, Homo sapiens
gccactaagcagagg

SEQ ID NO: 3601313 - DNA, 17 bp, Homo sapiens
gccactaagcagaggag

SEQ ID NO: 3601314 - DNA, 19 bp, Homo sapiens
gccactaagcagaggaggg

SEQ ID NO: 3601315 - DNA, 23 bp, Homo sapiens
gccactaagcagaggaggggccg

SEQ ID NO: 3601316 - DNA, 18 bp, Homo sapiens
gccactccagacccctgg

SEQ ID NO: 3601317 - DNA, 21 bp, Homo sapiens
gccactccagacccctggctt

SEQ ID NO: 3601318 - DNA, 17 bp, Homo sapiens
gccactgcctcttcctc

SEQ ID NO: 3601319 - DNA, 21 bp, Homo sapiens
gccactgggacagctggctgg

SEQ ID NO: 3601320 - DNA, 13 bp, Homo sapiens
gccacttaatgta

SEQ ID NO: 3601321 - DNA, 19 bp, Homo sapiens
gccacttaatgtatgttac

SEQ ID NO: 3601322 - DNA, 24 bp, Homo sapiens
gccacttctcactcaccactacca

SEQ ID NO: 3601323 - DNA, 23 bp, Homo sapiens
gccactttcagagcccccagccc

SEQ ID NO: 3601324 - DNA, 15 bp, Homo sapiens
gccagaaaggtgtga

SEQ ID NO: 3601325 - DNA, 22 bp, Homo sapiens
gccagaaaggtgtgaggagaga

SEQ ID NO: 3601326 - DNA, 18 bp, Homo sapiens
gccagacatgccacaagg

SEQ ID NO: 3601327 - DNA, 20 bp, Homo sapiens
gccagaccccacgctgacca

SEQ ID NO: 3601328 - DNA, 15 bp, Homo sapiens
gccagactggcacag

SEQ ID NO: 3601329 - DNA, 11 bp, Homo sapiens
gccagagaaag

SEQ ID NO: 3601330 - DNA, 20 bp, Homo sapiens
gccagagaatagatcagtat

SEQ ID NO: 3601331 - DNA, 23 bp, Homo sapiens
gccagagaatagatcagtatttc

SEQ ID NO: 3601332 - DNA, 13 bp, Homo sapiens
gccagaggccaga

SEQ ID NO: 3601333 - DNA, 11 bp, Homo sapiens
gccagatccag

SEQ ID NO: 3601334 - DNA, 16 bp, Homo sapiens
gccagatgatcaactc

SEQ ID NO: 3601335 - DNA, 19 bp, Homo sapiens
gccagcaacattggcacat

SEQ ID NO: 3601336 - DNA, 14 bp, Homo sapiens
gccagcaagtcctt

SEQ ID NO: 3601337 - DNA, 18 bp, Homo sapiens
gccagcaagtccttaggc

SEQ ID NO: 3601338 - DNA, 18 bp, Homo sapiens
gccagcacagtaggtccc

SEQ ID NO: 3601339 - DNA, 23 bp, Homo sapiens
gccagcacagtaggtcccggcca

SEQ ID NO: 3601340 - DNA, 13 bp, Homo sapiens
gccagcaccacag

SEQ ID NO: 3601341 - DNA, 14 bp, Homo sapiens
gccagcaccacagc

SEQ ID NO: 3601342 - DNA, 16 bp, Homo sapiens
gccagcaccacagccg

SEQ ID NO: 3601343 - DNA, 16 bp, Homo sapiens
gccagcagctgatgct

SEQ ID NO: 3601344 - DNA, 17 bp, Homo sapiens
gcctgcctgcagcaggc

SEQ ID NO: 3601345 - DNA, 18 bp, Homo sapiens
gcctgcctgcagcaggca

SEQ ID NO: 3601346 - DNA, 21 bp, Homo sapiens
gcctgcctgcagcaggcagct

SEQ ID NO: 3601347 - DNA, 14 bp, Homo sapiens
gcctgctccagacc

SEQ ID NO: 3601348 - DNA, 20 bp, Homo sapiens
gcctgctccttggcaccccc

SEQ ID NO: 3601349 - DNA, 18 bp, Homo sapiens
gcctgctgccagtgcagc

SEQ ID NO: 3601350 - DNA, 22 bp, Homo sapiens
gcctgctgccagtgcagccact

SEQ ID NO: 3601351 - DNA, 13 bp, Homo sapiens
gcctgctgtgctg

SEQ ID NO: 3601352 - DNA, 16 bp, Homo sapiens
gcctgctgtgctggga

SEQ ID NO: 3601353 - DNA, 17 bp, Homo sapiens
gcctgcttcccacaact

SEQ ID NO: 3601354 - DNA, 18 bp, Homo sapiens
gcctgcttgactttccag

SEQ ID NO: 3601355 - DNA, 15 bp, Homo sapiens
gcctgctttcctgca

SEQ ID NO: 3601356 - DNA, 18 bp, Homo sapiens
gcctggaagagctgagac

SEQ ID NO: 3601357 - DNA, 15 bp, Homo sapiens
gcctggagcaggccc

SEQ ID NO: 3601358 - DNA, 12 bp, Homo sapiens
gcctggagcccc

SEQ ID NO: 3601359 - DNA, 13 bp, Homo sapiens
gcctggagcccca

SEQ ID NO: 3601360 - DNA, 19 bp, Homo sapiens
gcctggaggcaaaggcctg

SEQ ID NO: 3601361 - DNA, 20 bp, Homo sapiens
gcctggaggtctggctgagc

SEQ ID NO: 3601362 - DNA, 21 bp, Homo sapiens
gcctggaggtctggctgagcc

SEQ ID NO: 3601363 - DNA, 22 bp, Homo sapiens
gcctggaggtctggctgagccc

SEQ ID NO: 3601364 - DNA, 16 bp, Homo sapiens
gcctggatgagaaaca

SEQ ID NO: 3601365 - DNA, 17 bp, Homo sapiens
gcctggatgagaaacag

SEQ ID NO: 3601366 - DNA, 21 bp, Homo sapiens
gcctggatgagaaacagctca

SEQ ID NO: 3601367 - DNA, 22 bp, Homo sapiens
gcctggatgagaaacagctcag

SEQ ID NO: 3601368 - DNA, 18 bp, Homo sapiens
gcctggcaacagagcgag

SEQ ID NO: 3601369 - DNA, 19 bp, Homo sapiens
gcctggcaacagagcgaga

SEQ ID NO: 3601370 - DNA, 16 bp, Homo sapiens
gcctggcacagaccag

SEQ ID NO: 3601371 - DNA, 18 bp, Homo sapiens
gcctggcacagggcagtg

SEQ ID NO: 3601372 - DNA, 19 bp, Homo sapiens
gcctggcacagggcagtgg

SEQ ID NO: 3601373 - DNA, 12 bp, Homo sapiens
gcctggcagccg

SEQ ID NO: 3601374 - DNA, 20 bp, Homo sapiens
gcctggccagacacaggccc

SEQ ID NO: 3601375 - DNA, 12 bp, Homo sapiens
gcctggccaggc

SEQ ID NO: 3601376 - DNA, 16 bp, Homo sapiens
gcctggctctgccccc

SEQ ID NO: 3601377 - DNA, 23 bp, Homo sapiens
gcctggctctgccccctccccca

SEQ ID NO: 3601378 - DNA, 21 bp, Homo sapiens
gcctggctgggtggtattctg

SEQ ID NO: 3601379 - DNA, 16 bp, Homo sapiens
gcctgggagcccagag

SEQ ID NO: 3601380 - DNA, 19 bp, Homo sapiens
gcctgggaggaagatgttt

SEQ ID NO: 3601381 - DNA, 19 bp, Homo sapiens
gcctgggctcactgtgctg

SEQ ID NO: 3601382 - DNA, 22 bp, Homo sapiens
gcctgggctcactgtgctgggg

SEQ ID NO: 3601383 - DNA, 16 bp, Homo sapiens
gcctgggctctggaag

SEQ ID NO: 3601384 - DNA, 22 bp, Homo sapiens
gcctggggctgaggctgaggca

SEQ ID NO: 3601385 - DNA, 16 bp, Homo sapiens
gcctggggtggggtca

SEQ ID NO: 3601386 - DNA, 21 bp, Homo sapiens
gcctggggtgtcctacagtga

SEQ ID NO: 3601387 - DNA, 21 bp, Homo sapiens
gcctgggtgatctgctgctga

SEQ ID NO: 3601388 - DNA, 21 bp, Homo sapiens
gcctggtgtgaggaggacaaa

SEQ ID NO: 3601389 - DNA, 19 bp, Homo sapiens
gcctggttcagacacagct

SEQ ID NO: 3601390 - DNA, 21 bp, Homo sapiens
gcctggttcagacacagctct

SEQ ID NO: 3601391 - DNA, 17 bp, Homo sapiens
gcctggtttctgggtgc

SEQ ID NO: 3601392 - DNA, 13 bp, Homo sapiens
gcctgtaacaatg

SEQ ID NO: 3601393 - DNA, 16 bp, Homo sapiens
gcctgtcccttgcctc

SEQ ID NO: 3601394 - DNA, 17 bp, Homo sapiens
gcctgtcccttgcctct

SEQ ID NO: 3601395 - DNA, 22 bp, Homo sapiens
gcctgtctcatcttctgaagag

SEQ ID NO: 3601396 - DNA, 21 bp, Homo sapiens
gcctgtgagcatggggccagg

SEQ ID NO: 3601397 - DNA, 13 bp, Homo sapiens
gcctgtgcccgca

SEQ ID NO: 3601398 - DNA, 21 bp, Homo sapiens
gcctgtgcccgcatgtgtgcc

SEQ ID NO: 3601399 - DNA, 21 bp, Homo sapiens
gcctgttaatttataatgtat

SEQ ID NO: 3601400 - DNA, 19 bp, Homo sapiens
gcctgttcccattcttgca

SEQ ID NO: 3601401 - DNA, 14 bp, Homo sapiens
gcctgttggcaggc

SEQ ID NO: 3601402 - DNA, 16 bp, Homo sapiens
gcctgttggcaggccc

SEQ ID NO: 3601403 - DNA, 19 bp, Homo sapiens
gcctgttggcaggcccact

SEQ ID NO: 3601404 - DNA, 14 bp, Homo sapiens
gccttaaaatggaa

SEQ ID NO: 3601405 - DNA, 19 bp, Homo sapiens
gccttaaaatggaattgaa

SEQ ID NO: 3601406 - DNA, 22 bp, Homo sapiens
gccttaaaatggaattgaaaaa

SEQ ID NO: 3601407 - DNA, 14 bp, Homo sapiens
gccttaagcaaatt

SEQ ID NO: 3601408 - DNA, 17 bp, Homo sapiens
gccttataaaccaatct

SEQ ID NO: 3601409 - DNA, 20 bp, Homo sapiens
gccttataaaccaatcttaa

SEQ ID NO: 3601410 - DNA, 23 bp, Homo sapiens
gccttatccaggttggttttgct

SEQ ID NO: 3601411 - DNA, 23 bp, Homo sapiens
gccttatctccaagaccagagat

SEQ ID NO: 3601412 - DNA, 14 bp, Homo sapiens
gccttatctgaaag

SEQ ID NO: 3601413 - DNA, 14 bp, Homo sapiens
gccttcccatggcc

SEQ ID NO: 3601414 - DNA, 15 bp, Homo sapiens
gccttcccatggcca

SEQ ID NO: 3601415 - DNA, 20 bp, Homo sapiens
gccttccccagctccagcag

SEQ ID NO: 3601416 - DNA, 12 bp, Homo sapiens
gccttcccctcc

SEQ ID NO: 3601417 - DNA, 12 bp, Homo sapiens
gccttctttcca

SEQ ID NO: 3601418 - DNA, 16 bp, Homo sapiens
gccttgcaacccaagg

SEQ ID NO: 3601419 - DNA, 19 bp, Homo sapiens
gccttgcagcggctcctgc

SEQ ID NO: 3601420 - DNA, 12 bp, Homo sapiens
gccttgccagag

SEQ ID NO: 3601421 - DNA, 15 bp, Homo sapiens
gccttgccagttttc

SEQ ID NO: 3601422 - DNA, 17 bp, Homo sapiens
gccttgccagttttccg

SEQ ID NO: 3601423 - DNA, 23 bp, Homo sapiens
gccttgggatagcaaactccagg

SEQ ID NO: 3601424 - DNA, 19 bp, Homo sapiens
gccttgggatccaggcccc

SEQ ID NO: 3601425 - DNA, 11 bp, Homo sapiens
gccttgtcagt

SEQ ID NO: 3601426 - DNA, 14 bp, Homo sapiens
gccttgtcagtgtg

SEQ ID NO: 3601427 - DNA, 17 bp, Homo sapiens
gccttgtttaatgttaa

SEQ ID NO: 3601428 - DNA, 19 bp, Homo sapiens
gcctttcccaactctagct

SEQ ID NO: 3601429 - DNA, 17 bp, Homo sapiens
gcctttcctctgcacgc

SEQ ID NO: 3601430 - DNA, 14 bp, Homo sapiens
gcctttctttgcct

SEQ ID NO: 3601431 - DNA, 14 bp, Homo sapiens
gcctttgcaagatg

SEQ ID NO: 3601432 - DNA, 18 bp, Homo sapiens
gcctttgcaagatgcttg

SEQ ID NO: 3601433 - DNA, 19 bp, Homo sapiens
gcctttggaagggtctctc

SEQ ID NO: 3601434 - DNA, 22 bp, Homo sapiens
gcctttgggtgctgttttgcca

SEQ ID NO: 3601435 - DNA, 14 bp, Homo sapiens
gcctttgtgctttt

SEQ ID NO: 3601436 - DNA, 15 bp, Homo sapiens
gcctttgtgcttttt

SEQ ID NO: 3601437 - DNA, 19 bp, Homo sapiens
gcctttgtgctttttgtca

SEQ ID NO: 3601438 - DNA, 21 bp, Homo sapiens
gcctttgtgctttttgtcatg

SEQ ID NO: 3601439 - DNA, 16 bp, Homo sapiens
gccttttatgtatttt

SEQ ID NO: 3601440 - DNA, 16 bp, Homo sapiens
gccttttgaatacatt

SEQ ID NO: 3601441 - DNA, 13 bp, Homo sapiens
gccttttgctctc

SEQ ID NO: 3601442 - DNA, 14 bp, Homo sapiens
gccttttgctctct

SEQ ID NO: 3601443 - DNA, 18 bp, Homo sapiens
gccttttgctctctgtga

SEQ ID NO: 3601444 - DNA, 20 bp, Homo sapiens
gccttttgctctctgtgacc

SEQ ID NO: 3601445 - DNA, 17 bp, Homo sapiens
gcctttttcatttatct

SEQ ID NO: 3601446 - DNA, 18 bp, Homo sapiens
gcctttttcatttatcta

SEQ ID NO: 3601447 - DNA, 19 bp, Homo sapiens
gcctttttcatttatctat

SEQ ID NO: 3601448 - DNA, 17 bp, Homo sapiens
gcgaccccgtcacagcc

SEQ ID NO: 3601449 - DNA, 20 bp, Homo sapiens
gcgagggatgatgagggaag

SEQ ID NO: 3601450 - DNA, 18 bp, Homo sapiens
gcgatggggcaagacaga

SEQ ID NO: 3601451 - DNA, 13 bp, Homo sapiens
gcgcagctgccta

SEQ ID NO: 3601452 - DNA, 21 bp, Homo sapiens
gcgcaggcagcgcagggctgg

SEQ ID NO: 3601453 - DNA, 12 bp, Homo sapiens
gcgcagggctgg

SEQ ID NO: 3601454 - DNA, 14 bp, Homo sapiens
gcgcagggctggca

SEQ ID NO: 3601455 - DNA, 16 bp, Homo sapiens
gcgcagggctggcacg

SEQ ID NO: 3601456 - DNA, 22 bp, Homo sapiens
gcgccaaaacaagccaaagagc

SEQ ID NO: 3601457 - DNA, 13 bp, Homo sapiens
gcgccccttcccc

SEQ ID NO: 3601458 - DNA, 19 bp, Homo sapiens
gcgccctgcagggccgggc

SEQ ID NO: 3601459 - DNA, 24 bp, Homo sapiens
gcgcctacccttcccgcctccctc

SEQ ID NO: 3601460 - DNA, 13 bp, Homo sapiens
gcgcctccagagg

SEQ ID NO: 3601461 - DNA, 14 bp, Homo sapiens
gcgcctttcccaac

SEQ ID NO: 3601462 - DNA, 22 bp, Homo sapiens
gcgctaattcaaggaatttctt

SEQ ID NO: 3601463 - DNA, 14 bp, Homo sapiens
gcgctcgcccagca

SEQ ID NO: 3601464 - DNA, 11 bp, Homo sapiens
gcgcttcctgg

SEQ ID NO: 3601465 - DNA, 19 bp, Homo sapiens
gcggaagtacttccctcag

SEQ ID NO: 3601466 - DNA, 16 bp, Homo sapiens
gcggacatcagctggt

SEQ ID NO: 3601467 - DNA, 19 bp, Homo sapiens
gcggagcccagcctgggag

SEQ ID NO: 3601468 - DNA, 20 bp, Homo sapiens
gcggaggggatccagccact

SEQ ID NO: 3601469 - DNA, 15 bp, Homo sapiens
gcggaggtctctggg

SEQ ID NO: 3601470 - DNA, 19 bp, Homo sapiens
gcggaggtctctgggagcc

SEQ ID NO: 3601471 - DNA, 14 bp, Homo sapiens
gcggatcctgctgg

SEQ ID NO: 3601472 - DNA, 15 bp, Homo sapiens
gcggatcctgctggg

SEQ ID NO: 3601473 - DNA, 21 bp, Homo sapiens
gcggatgctactactgcagtc

SEQ ID NO: 3601474 - DNA, 20 bp, Homo sapiens
gcggcaccctggtctgtgga

SEQ ID NO: 3601475 - DNA, 16 bp, Homo sapiens
gcggccccgccgcaga

SEQ ID NO: 3601476 - DNA, 12 bp, Homo sapiens
ggaaggagaggg

SEQ ID NO: 3601477 - DNA, 21 bp, Homo sapiens
ggaaggaggccaaccagcccg

SEQ ID NO: 3601478 - DNA, 20 bp, Homo sapiens
ggaagggctttggttccttc

SEQ ID NO: 3601479 - DNA, 22 bp, Homo sapiens
ggaagtgtgggtctgtgtgtgt

SEQ ID NO: 3601480 - DNA, 19 bp, Homo sapiens
ggaagtgtgtgccaagagc

SEQ ID NO: 3601481 - DNA, 17 bp, Homo sapiens
ggaagtttgctgtgctt

SEQ ID NO: 3601482 - DNA, 17 bp, Homo sapiens
ggaataaagttgcagat

SEQ ID NO: 3601483 - DNA, 18 bp, Homo sapiens
ggaataaagttgcagatg

SEQ ID NO: 3601484 - DNA, 21 bp, Homo sapiens
ggaataaagttgcagatgatt

SEQ ID NO: 3601485 - DNA, 18 bp, Homo sapiens
ggaataaggcccagagcg

SEQ ID NO: 3601486 - DNA, 18 bp, Homo sapiens
ggaataatttccttcagg

SEQ ID NO: 3601487 - DNA, 19 bp, Homo sapiens
ggaataatttccttcaggc

SEQ ID NO: 3601488 - DNA, 22 bp, Homo sapiens
ggaataatttccttcaggcagc

SEQ ID NO: 3601489 - DNA, 15 bp, Homo sapiens
ggaatacacatgcag

SEQ ID NO: 3601490 - DNA, 17 bp, Homo sapiens
ggaatagtatcctccag

SEQ ID NO: 3601491 - DNA, 20 bp, Homo sapiens
ggaatagtatcctccaggtt

SEQ ID NO: 3601492 - DNA, 23 bp, Homo sapiens
ggaatcctatatagaatgctgca

SEQ ID NO: 3601493 - DNA, 14 bp, Homo sapiens
ggaatctagcccaa

SEQ ID NO: 3601494 - DNA, 14 bp, Homo sapiens
ggaatgcagcagga

SEQ ID NO: 3601495 - DNA, 15 bp, Homo sapiens
ggaatgccgctgtct

SEQ ID NO: 3601496 - DNA, 16 bp, Homo sapiens
ggaatgggagaggggt

SEQ ID NO: 3601497 - DNA, 19 bp, Homo sapiens
ggaatgtcagggccaggtg

SEQ ID NO: 3601498 - DNA, 15 bp, Homo sapiens
ggaatgttctttctg

SEQ ID NO: 3601499 - DNA, 20 bp, Homo sapiens
ggaatgttctttctgctcta

SEQ ID NO: 3601500 - DNA, 13 bp, Homo sapiens
ggaattacatttt

SEQ ID NO: 3601501 - DNA, 19 bp, Homo sapiens
ggaattacgtgctctgtgg

SEQ ID NO: 3601502 - DNA, 17 bp, Homo sapiens
ggaattataaatatttt

SEQ ID NO: 3601503 - DNA, 18 bp, Homo sapiens
ggaattcaccagtgttcc

SEQ ID NO: 3601504 - DNA, 14 bp, Homo sapiens
ggaattcagtgcct

SEQ ID NO: 3601505 - DNA, 16 bp, Homo sapiens
ggaatttcccaggacc

SEQ ID NO: 3601506 - DNA, 19 bp, Homo sapiens
ggaatttcccaggaccctg

SEQ ID NO: 3601507 - DNA, 18 bp, Homo sapiens
ggaatttcttaacttctt

SEQ ID NO: 3601508 - DNA, 22 bp, Homo sapiens
ggaatttcttaacttcttgctt

SEQ ID NO: 3601509 - DNA, 23 bp, Homo sapiens
ggacacaataggtctttctctca

SEQ ID NO: 3601510 - DNA, 14 bp, Homo sapiens
ggacacagatcccg

SEQ ID NO: 3601511 - DNA, 11 bp, Homo sapiens
ggacacagctc

SEQ ID NO: 3601512 - DNA, 13 bp, Homo sapiens
ggacacagctctt

SEQ ID NO: 3601513 - DNA, 14 bp, Homo sapiens
ggacacagctcttc

SEQ ID NO: 3601514 - DNA, 16 bp, Homo sapiens
ggacacagctcttcat

SEQ ID NO: 3601515 - DNA, 18 bp, Homo sapiens
ggacagaggccccagcct

SEQ ID NO: 3601516 - DNA, 14 bp, Homo sapiens
ggacagccccaccc

SEQ ID NO: 3601517 - DNA, 16 bp, Homo sapiens
ggacagccccaccctg

SEQ ID NO: 3601518 - DNA, 17 bp, Homo sapiens
ggacagctgataaattt

SEQ ID NO: 3601519 - DNA, 12 bp, Homo sapiens
ggacagctggct

SEQ ID NO: 3601520 - DNA, 15 bp, Homo sapiens
ggacagctggctggg

SEQ ID NO: 3601521 - DNA, 13 bp, Homo sapiens
ggacagcttcctc

SEQ ID NO: 3601522 - DNA, 15 bp, Homo sapiens
ggacagcttcctcac

SEQ ID NO: 3601523 - DNA, 15 bp, Homo sapiens
ggacaggaccccagc

SEQ ID NO: 3601524 - DNA, 16 bp, Homo sapiens
ggacaggaccccagct

SEQ ID NO: 3601525 - DNA, 17 bp, Homo sapiens
ggacaggaccccagctc

SEQ ID NO: 3601526 - DNA, 20 bp, Homo sapiens
ggacaggaccccagctctgc

SEQ ID NO: 3601527 - DNA, 15 bp, Homo sapiens
ggacaggaccctcag

SEQ ID NO: 3601528 - DNA, 19 bp, Homo sapiens
ggacaggagatgctgtgcc

SEQ ID NO: 3601529 - DNA, 15 bp, Homo sapiens
ggacaggctgaagag

SEQ ID NO: 3601530 - DNA, 19 bp, Homo sapiens
ggacaggctgaagagaggg

SEQ ID NO: 3601531 - DNA, 19 bp, Homo sapiens
ggacagtacctgattgtat

SEQ ID NO: 3601532 - DNA, 18 bp, Homo sapiens
ggacagtatttgtgggga

SEQ ID NO: 3601533 - DNA, 23 bp, Homo sapiens
ggacagtccgcagttgtagcaga

SEQ ID NO: 3601534 - DNA, 22 bp, Homo sapiens
ggacagttgatggagccccagg

SEQ ID NO: 3601535 - DNA, 19 bp, Homo sapiens
ggacataatggggtcctgg

SEQ ID NO: 3601536 - DNA, 15 bp, Homo sapiens
ggacatactgctgga

SEQ ID NO: 3601537 - DNA, 14 bp, Homo sapiens
ggacatcagcaaac

SEQ ID NO: 3601538 - DNA, 20 bp, Homo sapiens
ggacatgcttttctgccact

SEQ ID NO: 3601539 - DNA, 21 bp, Homo sapiens
ggacatttgtgggcaagcaga

SEQ ID NO: 3601540 - DNA, 16 bp, Homo sapiens
ggacattttatgtctt

SEQ ID NO: 3601541 - DNA, 19 bp, Homo sapiens
ggaccagctcaggacagat

SEQ ID NO: 3601542 - DNA, 18 bp, Homo sapiens
ggaccaggtttgcaggag

SEQ ID NO: 3601543 - DNA, 16 bp, Homo sapiens
ggaccatctgctgcag

SEQ ID NO: 3601544 - DNA, 17 bp, Homo sapiens
ggaccatctgctgcagt

SEQ ID NO: 3601545 - DNA, 21 bp, Homo sapiens
ggaccatctgctgcagttacc

SEQ ID NO: 3601546 - DNA, 22 bp, Homo sapiens
ggacccaaaccccctgcagccc

SEQ ID NO: 3601547 - DNA, 21 bp, Homo sapiens
ggacccatccctgcctggagg

SEQ ID NO: 3601548 - DNA, 16 bp, Homo sapiens
ggaccccacatccttc

SEQ ID NO: 3601549 - DNA, 12 bp, Homo sapiens
ggaccccagaga

SEQ ID NO: 3601550 - DNA, 12 bp, Homo sapiens
ggaccccagctc

SEQ ID NO: 3601551 - DNA, 13 bp, Homo sapiens
ggaccccagctct

SEQ ID NO: 3601552 - DNA, 14 bp, Homo sapiens
ggaccgggcgcagc

SEQ ID NO: 3601553 - DNA, 18 bp, Homo sapiens
ggaccgggcgcagccctc

SEQ ID NO: 3601554 - DNA, 15 bp, Homo sapiens
ggaccggtgctgcag

SEQ ID NO: 3601555 - DNA, 16 bp, Homo sapiens
ggaccggtgctgcagg

SEQ ID NO: 3601556 - DNA, 20 bp, Homo sapiens
ggacctccggagcgccctgc

SEQ ID NO: 3601557 - DNA, 21 bp, Homo sapiens
ggacctccggagcgccctgca

SEQ ID NO: 3601558 - DNA, 22 bp, Homo sapiens
ggacctccggagcgccctgcag

SEQ ID NO: 3601559 - DNA, 17 bp, Homo sapiens
ggaccttcgggctgtgc

SEQ ID NO: 3601560 - DNA, 16 bp, Homo sapiens
ggaccttttgttttct

SEQ ID NO: 3601561 - DNA, 18 bp, Homo sapiens
ggacgggatgacctccag

SEQ ID NO: 3601562 - DNA, 19 bp, Homo sapiens
ggacgggatgacctccaga

SEQ ID NO: 3601563 - DNA, 15 bp, Homo sapiens
ggacgttaggccagg

SEQ ID NO: 3601564 - DNA, 16 bp, Homo sapiens
ggacgttaggccaggc

SEQ ID NO: 3601565 - DNA, 18 bp, Homo sapiens
ggacgttaggccaggcct

SEQ ID NO: 3601566 - DNA, 19 bp, Homo sapiens
ggacgttaggccaggcctt

SEQ ID NO: 3601567 - DNA, 23 bp, Homo sapiens
ggactatatttgggcctgctcca

SEQ ID NO: 3601568 - DNA, 19 bp, Homo sapiens
ggactattgtgccaactgc

SEQ ID NO: 3601569 - DNA, 15 bp, Homo sapiens
ggactcacttgccca

SEQ ID NO: 3601570 - DNA, 14 bp, Homo sapiens
ggactcccagaacc

SEQ ID NO: 3601571 - DNA, 22 bp, Homo sapiens
ggactcctgccaccagcatcca

SEQ ID NO: 3601572 - DNA, 14 bp, Homo sapiens
ggactcctggcagg

SEQ ID NO: 3601573 - DNA, 18 bp, Homo sapiens
ggactcctggcagggcca

SEQ ID NO: 3601574 - DNA, 15 bp, Homo sapiens
ggactctctccagga

SEQ ID NO: 3601575 - DNA, 11 bp, Homo sapiens
ggactctgcct

SEQ ID NO: 3601576 - DNA, 22 bp, Homo sapiens
ggactgactttccgagcctcca

SEQ ID NO: 3601577 - DNA, 17 bp, Homo sapiens
ggactgcccccagaaag

SEQ ID NO: 3601578 - DNA, 21 bp, Homo sapiens
ggactggaaagcacaagactg

SEQ ID NO: 3601579 - DNA, 23 bp, Homo sapiens
ggactggaaagcacaagactggc

SEQ ID NO: 3601580 - DNA, 17 bp, Homo sapiens
ggactgggaacagaact

SEQ ID NO: 3601581 - DNA, 16 bp, Homo sapiens
ggactgtgctggtgca

SEQ ID NO: 3601582 - DNA, 23 bp, Homo sapiens
ggacttcctgtccagctccaacc

SEQ ID NO: 3601583 - DNA, 21 bp, Homo sapiens
ggacttgtgattggctgcagg

SEQ ID NO: 3601584 - DNA, 16 bp, Homo sapiens
ggagaaaaagaagaaa

SEQ ID NO: 3601585 - DNA, 20 bp, Homo sapiens
ggagaaagaagtggagacag

SEQ ID NO: 3601586 - DNA, 22 bp, Homo sapiens
ggagaaagagctgcctggatga

SEQ ID NO: 3601587 - DNA, 18 bp, Homo sapiens
ggagaacagtggttgcct

SEQ ID NO: 3601588 - DNA, 13 bp, Homo sapiens
ggagaactagaga

SEQ ID NO: 3601589 - DNA, 14 bp, Homo sapiens
ggagaaggcctgga

SEQ ID NO: 3601590 - DNA, 18 bp, Homo sapiens
ggagaagtcttctattta

SEQ ID NO: 3601591 - DNA, 21 bp, Homo sapiens
ggagaatggcatggcaggagt

SEQ ID NO: 3601592 - DNA, 17 bp, Homo sapiens
ggagacaccagtggtgc

SEQ ID NO: 3601593 - DNA, 18 bp, Homo sapiens
ggagacagcagtttccag

SEQ ID NO: 3601594 - DNA, 18 bp, Homo sapiens
ggagacagcttctctgca

SEQ ID NO: 3601595 - DNA, 13 bp, Homo sapiens
ggagagagcaggg

SEQ ID NO: 3601596 - DNA, 14 bp, Homo sapiens
ggagagagcagggc

SEQ ID NO: 3601597 - DNA, 13 bp, Homo sapiens
ggagagagccagg

SEQ ID NO: 3601598 - DNA, 19 bp, Homo sapiens
ggagagagtagctgcagcc

SEQ ID NO: 3601599 - DNA, 12 bp, Homo sapiens
ggagagcagcag

SEQ ID NO: 3601600 - DNA, 14 bp, Homo sapiens
ggagagcagcagca

SEQ ID NO: 3601601 - DNA, 21 bp, Homo sapiens
ggagagccccatggtgggtag

SEQ ID NO: 3601602 - DNA, 14 bp, Homo sapiens
ggagagcctggggg

SEQ ID NO: 3601603 - DNA, 17 bp, Homo sapiens
ggagagcggctggagaa

SEQ ID NO: 3601604 - DNA, 14 bp, Homo sapiens
ggagaggcagcatg

SEQ ID NO: 3601605 - DNA, 15 bp, Homo sapiens
ggagaggcagcatgc

SEQ ID NO: 3601606 - DNA, 20 bp, Homo sapiens
ggagagggacatagaatctg

SEQ ID NO: 3601607 - DNA, 16 bp, Homo sapiens
ggagaggtggccgcca

SEQ ID NO: 3601608 - DNA, 12 bp, Homo sapiens
gggaagacagtg

SEQ ID NO: 3601609 - DNA, 15 bp, Homo sapiens
gggaagacctgaaag

SEQ ID NO: 3601610 - DNA, 19 bp, Homo sapiens
gggaagatgacctgcccca

SEQ ID NO: 3601611 - DNA, 14 bp, Homo sapiens
gggaagatggagac

SEQ ID NO: 3601612 - DNA, 13 bp, Homo sapiens
gggaaggacagga

SEQ ID NO: 3601613 - DNA, 14 bp, Homo sapiens
gggaaggacaggac

SEQ ID NO: 3601614 - DNA, 22 bp, Homo sapiens
gggaaggacaggaccctcagga

SEQ ID NO: 3601615 - DNA, 22 bp, Homo sapiens
gggaaggccggcagcgggcgga

SEQ ID NO: 3601616 - DNA, 22 bp, Homo sapiens
gggaagggagccaagggatgga

SEQ ID NO: 3601617 - DNA, 16 bp, Homo sapiens
gggaagtttctgggtg

SEQ ID NO: 3601618 - DNA, 22 bp, Homo sapiens
gggaagtttgctgtgctttgga

SEQ ID NO: 3601619 - DNA, 12 bp, Homo sapiens
gggaatgggaga

SEQ ID NO: 3601620 - DNA, 13 bp, Homo sapiens
gggaatgggagag

SEQ ID NO: 3601621 - DNA, 17 bp, Homo sapiens
gggaattccctccccct

SEQ ID NO: 3601622 - DNA, 22 bp, Homo sapiens
gggacaacaatgaatcagaaca

SEQ ID NO: 3601623 - DNA, 20 bp, Homo sapiens
gggacaccaagccttggctc

SEQ ID NO: 3601624 - DNA, 21 bp, Homo sapiens
gggacagaggccccagcctcc

SEQ ID NO: 3601625 - DNA, 14 bp, Homo sapiens
gggacagcagggac

SEQ ID NO: 3601626 - DNA, 12 bp, Homo sapiens
gggacagctggc

SEQ ID NO: 3601627 - DNA, 13 bp, Homo sapiens
gggacagctggct

SEQ ID NO: 3601628 - DNA, 17 bp, Homo sapiens
gggacaggaccccagct

SEQ ID NO: 3601629 - DNA, 18 bp, Homo sapiens
gggaccaattctggacag

SEQ ID NO: 3601630 - DNA, 22 bp, Homo sapiens
gggaccactgggtgagagagga

SEQ ID NO: 3601631 - DNA, 18 bp, Homo sapiens
gggaccatctgctgcagt

SEQ ID NO: 3601632 - DNA, 22 bp, Homo sapiens
gggacccaaaccccctgcagcc

SEQ ID NO: 3601633 - DNA, 23 bp, Homo sapiens
gggacccaaaccccctgcagccc

SEQ ID NO: 3601634 - DNA, 20 bp, Homo sapiens
gggaccggcggaccccagcc

SEQ ID NO: 3601635 - DNA, 13 bp, Homo sapiens
gggaccggtgctg

SEQ ID NO: 3601636 - DNA, 12 bp, Homo sapiens
gggacctctccc

SEQ ID NO: 3601637 - DNA, 15 bp, Homo sapiens
gggactcagggaccg

SEQ ID NO: 3601638 - DNA, 19 bp, Homo sapiens
gggagaaaaaaaaagcaaa

SEQ ID NO: 3601639 - DNA, 19 bp, Homo sapiens
gggagaatgtcagtatgtg

SEQ ID NO: 3601640 - DNA, 19 bp, Homo sapiens
gggagacagcttctctgca

SEQ ID NO: 3601641 - DNA, 21 bp, Homo sapiens
gggagacagcttctctgcagt

SEQ ID NO: 3601642 - DNA, 23 bp, Homo sapiens
gggagacagcttctctgcagtaa

SEQ ID NO: 3601643 - DNA, 14 bp, Homo sapiens
gggagatggggagg

SEQ ID NO: 3601644 - DNA, 21 bp, Homo sapiens
gggagcaggttccccaagggc

SEQ ID NO: 3601645 - DNA, 9 bp, Homo sapiens
gggagccaa

SEQ ID NO: 3601646 - DNA, 12 bp, Homo sapiens
gggagccaaggg

SEQ ID NO: 3601647 - DNA, 12 bp, Homo sapiens
gggagccaggac

SEQ ID NO: 3601648 - DNA, 14 bp, Homo sapiens
gggagccaggactc

SEQ ID NO: 3601649 - DNA, 12 bp, Homo sapiens
gggagcccagaa

SEQ ID NO: 3601650 - DNA, 12 bp, Homo sapiens
gggagcctagct

SEQ ID NO: 3601651 - DNA, 18 bp, Homo sapiens
gggagctctggggacagc

SEQ ID NO: 3601652 - DNA, 14 bp, Homo sapiens
gggagctgagctgg

SEQ ID NO: 3601653 - DNA, 15 bp, Homo sapiens
gggagctgagctgga

SEQ ID NO: 3601654 - DNA, 13 bp, Homo sapiens
gggaggagcctct

SEQ ID NO: 3601655 - DNA, 19 bp, Homo sapiens
gggaggagcctctggcttc

SEQ ID NO: 3601656 - DNA, 22 bp, Homo sapiens
gggaggagcctgtgcgtcccag

SEQ ID NO: 3601657 - DNA, 16 bp, Homo sapiens
gggaggccaccccaaa

SEQ ID NO: 3601658 - DNA, 18 bp, Homo sapiens
gggaggccgaggtgggca

SEQ ID NO: 3601659 - DNA, 13 bp, Homo sapiens
gggaggcggcctc

SEQ ID NO: 3601660 - DNA, 18 bp, Homo sapiens
gggagggaagggagccaa

SEQ ID NO: 3601661 - DNA, 15 bp, Homo sapiens
gggagggcagctggc

SEQ ID NO: 3601662 - DNA, 13 bp, Homo sapiens
gggaggtccaagc

SEQ ID NO: 3601663 - DNA, 16 bp, Homo sapiens
gggaggttgtggggcc

SEQ ID NO: 3601664 - DNA, 21 bp, Homo sapiens
gggagtggttaggcagcaagc

SEQ ID NO: 3601665 - DNA, 17 bp, Homo sapiens
gggagttaagacctggc

SEQ ID NO: 3601666 - DNA, 16 bp, Homo sapiens
gggagttgctgttaat

SEQ ID NO: 3601667 - DNA, 19 bp, Homo sapiens
gggatagcaaactccaggt

SEQ ID NO: 3601668 - DNA, 15 bp, Homo sapiens
gggatccagccactt

SEQ ID NO: 3601669 - DNA, 17 bp, Homo sapiens
gggatcctccacagaga

SEQ ID NO: 3601670 - DNA, 19 bp, Homo sapiens
gggatctggtcctacccat

SEQ ID NO: 3601671 - DNA, 23 bp, Homo sapiens
gggatctggtcctacccatcccc

SEQ ID NO: 3601672 - DNA, 16 bp, Homo sapiens
gggatctgtttgaaca

SEQ ID NO: 3601673 - DNA, 13 bp, Homo sapiens
gggatcttcccac

SEQ ID NO: 3601674 - DNA, 23 bp, Homo sapiens
gggatgaccttcccagggagaaa

SEQ ID NO: 3601675 - DNA, 19 bp, Homo sapiens
gggatgactaaaatattta

SEQ ID NO: 3601676 - DNA, 23 bp, Homo sapiens
gggatgaggtcaccaggggagga

SEQ ID NO: 3601677 - DNA, 15 bp, Homo sapiens
gggatgatgagggaa

SEQ ID NO: 3601678 - DNA, 18 bp, Homo sapiens
gggatgcggatcctgctg

SEQ ID NO: 3601679 - DNA, 14 bp, Homo sapiens
gggatgctgggctg

SEQ ID NO: 3601680 - DNA, 15 bp, Homo sapiens
gggatggagaaagaa

SEQ ID NO: 3601681 - DNA, 16 bp, Homo sapiens
gggatggagaaagaag

SEQ ID NO: 3601682 - DNA, 17 bp, Homo sapiens
gggatgttctgcctctc

SEQ ID NO: 3601683 - DNA, 14 bp, Homo sapiens
gggattaagaaacc

SEQ ID NO: 3601684 - DNA, 20 bp, Homo sapiens
gggcaagctaggccccagag

SEQ ID NO: 3601685 - DNA, 13 bp, Homo sapiens
gggcacaaacaga

SEQ ID NO: 3601686 - DNA, 19 bp, Homo sapiens
gggcacacgctgctctgcc

SEQ ID NO: 3601687 - DNA, 14 bp, Homo sapiens
gggcaccaggggcc

SEQ ID NO: 3601688 - DNA, 22 bp, Homo sapiens
gggcacctatgagatggccatg

SEQ ID NO: 3601689 - DNA, 23 bp, Homo sapiens
gggcacggcgggatcctccacag

SEQ ID NO: 3601690 - DNA, 18 bp, Homo sapiens
gggcagactgtgaacttg

SEQ ID NO: 3601691 - DNA, 12 bp, Homo sapiens
gggcagcaggcc

SEQ ID NO: 3601692 - DNA, 13 bp, Homo sapiens
gggcagccagcag

SEQ ID NO: 3601693 - DNA, 18 bp, Homo sapiens
gggcagcgcatgtgtgca

SEQ ID NO: 3601694 - DNA, 20 bp, Homo sapiens
gggcagctggcccccagccc

SEQ ID NO: 3601695 - DNA, 21 bp, Homo sapiens
gggcaggctgagggtcgtggg

SEQ ID NO: 3601696 - DNA, 22 bp, Homo sapiens
gggcagggaaggacaggaccct

SEQ ID NO: 3601697 - DNA, 14 bp, Homo sapiens
gggcagggcccacg

SEQ ID NO: 3601698 - DNA, 19 bp, Homo sapiens
gggcaggggaggccatctg

SEQ ID NO: 3601699 - DNA, 20 bp, Homo sapiens
gggcaggggaggccatctgg

SEQ ID NO: 3601700 - DNA, 21 bp, Homo sapiens
gggcagtccttactcccccac

SEQ ID NO: 3601701 - DNA, 20 bp, Homo sapiens
gggcagtgggtggatcctgg

SEQ ID NO: 3601702 - DNA, 17 bp, Homo sapiens
gggcatggccaggtggc

SEQ ID NO: 3601703 - DNA, 18 bp, Homo sapiens
gggcatgggtccagggcc

SEQ ID NO: 3601704 - DNA, 21 bp, Homo sapiens
gggcatggtggctcatgcctg

SEQ ID NO: 3601705 - DNA, 21 bp, Homo sapiens
gggcatttcttgcgagcctcg

SEQ ID NO: 3601706 - DNA, 19 bp, Homo sapiens
gggcatttggtgagagtca

SEQ ID NO: 3601707 - DNA, 18 bp, Homo sapiens
gggccaacctcaggctcc

SEQ ID NO: 3601708 - DNA, 15 bp, Homo sapiens
gggccaagagatctg

SEQ ID NO: 3601709 - DNA, 20 bp, Homo sapiens
gggccacacccaggaaggga

SEQ ID NO: 3601710 - DNA, 18 bp, Homo sapiens
gggccacacgtggctggc

SEQ ID NO: 3601711 - DNA, 18 bp, Homo sapiens
gggccaccacctttggct

SEQ ID NO: 3601712 - DNA, 19 bp, Homo sapiens
gggccaccggtgggcagtg

SEQ ID NO: 3601713 - DNA, 14 bp, Homo sapiens
gggccacctgcagg

SEQ ID NO: 3601714 - DNA, 17 bp, Homo sapiens
gggccacctgcaggacc

SEQ ID NO: 3601715 - DNA, 22 bp, Homo sapiens
gggccactggggactttattta

SEQ ID NO: 3601716 - DNA, 19 bp, Homo sapiens
gggccagatccagcctggg

SEQ ID NO: 3601717 - DNA, 17 bp, Homo sapiens
gggccagcttggcaggg

SEQ ID NO: 3601718 - DNA, 20 bp, Homo sapiens
gggccataaacggttcctgg

SEQ ID NO: 3601719 - DNA, 24 bp, Homo sapiens
gggccatctgactgccaagccaga

SEQ ID NO: 3601720 - DNA, 16 bp, Homo sapiens
gggcccaagtggggtg

SEQ ID NO: 3601721 - DNA, 14 bp, Homo sapiens
gggcccacacctgg

SEQ ID NO: 3601722 - DNA, 15 bp, Homo sapiens
gggcccacacctggt

SEQ ID NO: 3601723 - DNA, 11 bp, Homo sapiens
gggcccagagc

SEQ ID NO: 3601724 - DNA, 15 bp, Homo sapiens
gggcccagagcccag

SEQ ID NO: 3601725 - DNA, 20 bp, Homo sapiens
gggcccagagcccagctcca

SEQ ID NO: 3601726 - DNA, 17 bp, Homo sapiens
gggcccagcccagagcc

SEQ ID NO: 3601727 - DNA, 21 bp, Homo sapiens
gggccccgacgtttgcggcag

SEQ ID NO: 3601728 - DNA, 17 bp, Homo sapiens
gggccccgccagggctg

SEQ ID NO: 3601729 - DNA, 21 bp, Homo sapiens
gggccccgccagggctgggga

SEQ ID NO: 3601730 - DNA, 18 bp, Homo sapiens
gggccccgggctggagaa

SEQ ID NO: 3601731 - DNA, 14 bp, Homo sapiens
gggcccctccatcc

SEQ ID NO: 3601732 - DNA, 13 bp, Homo sapiens
gggcccctgagga

SEQ ID NO: 3601733 - DNA, 15 bp, Homo sapiens
gggcccgacaggtgg

SEQ ID NO: 3601734 - DNA, 22 bp, Homo sapiens
gggcccgacaggtgggcctggg

SEQ ID NO: 3601735 - DNA, 13 bp, Homo sapiens
gggcccggccagc

SEQ ID NO: 3601736 - DNA, 16 bp, Homo sapiens
gggcccggccagccat

SEQ ID NO: 3601737 - DNA, 9 bp, Homo sapiens
gggccctgc

SEQ ID NO: 3601738 - DNA, 13 bp, Homo sapiens
gggccctgcccca

SEQ ID NO: 3601739 - DNA, 21 bp, Homo sapiens
gggccctgccccaccccatcc

SEQ ID NO: 3601740 - DNA, 14 bp, Homo sapiens
gggccgccacggcc

SEQ ID NO: 3601741 - DNA, 14 bp, Homo sapiens
gtacaggagaggca

SEQ ID NO: 3601742 - DNA, 14 bp, Homo sapiens
gtacagtctgctcc

SEQ ID NO: 3601743 - DNA, 14 bp, Homo sapiens
gtacatagtccttt

SEQ ID NO: 3601744 - DNA, 17 bp, Homo sapiens
gtacatatgtaaacata

SEQ ID NO: 3601745 - DNA, 19 bp, Homo sapiens
gtacatatttattttcttt

SEQ ID NO: 3601746 - DNA, 23 bp, Homo sapiens
gtacattactaaatatataaagt

SEQ ID NO: 3601747 - DNA, 21 bp, Homo sapiens
gtacattctgcctagagtgta

SEQ ID NO: 3601748 - DNA, 18 bp, Homo sapiens
gtaccaattgtcaaatta

SEQ ID NO: 3601749 - DNA, 12 bp, Homo sapiens
gtacctcagtgg

SEQ ID NO: 3601750 - DNA, 16 bp, Homo sapiens
gtacctggtccccact

SEQ ID NO: 3601751 - DNA, 14 bp, Homo sapiens
gtacctgtgactct

SEQ ID NO: 3601752 - DNA, 13 bp, Homo sapiens
gtactaacccagt

SEQ ID NO: 3601753 - DNA, 23 bp, Homo sapiens
gtactacacatttttaaattgtt

SEQ ID NO: 3601754 - DNA, 15 bp, Homo sapiens
gtactacccagctct

SEQ ID NO: 3601755 - DNA, 14 bp, Homo sapiens
gtactcccaaactg

SEQ ID NO: 3601756 - DNA, 15 bp, Homo sapiens
gtactcccaaactga

SEQ ID NO: 3601757 - DNA, 14 bp, Homo sapiens
gtactcctcccagg

SEQ ID NO: 3601758 - DNA, 14 bp, Homo sapiens
gtactctgtgaaag

SEQ ID NO: 3601759 - DNA, 21 bp, Homo sapiens
gtactgtatggaaacactgat

SEQ ID NO: 3601760 - DNA, 20 bp, Homo sapiens
gtacttagagtttctgtttg

SEQ ID NO: 3601761 - DNA, 19 bp, Homo sapiens
gtacttatttctcagctgt

SEQ ID NO: 3601762 - DNA, 18 bp, Homo sapiens
gtacttgctccttttgct

SEQ ID NO: 3601763 - DNA, 20 bp, Homo sapiens
gtacttgggtcacatgactc

SEQ ID NO: 3601764 - DNA, 23 bp, Homo sapiens
gtactttctatctcatctgtctc

SEQ ID NO: 3601765 - DNA, 12 bp, Homo sapiens
gtacttttcctt

SEQ ID NO: 3601766 - DNA, 19 bp, Homo sapiens
gtacttttcctttgctagt

SEQ ID NO: 3601767 - DNA, 18 bp, Homo sapiens
gtagaaactgaggcccag

SEQ ID NO: 3601768 - DNA, 22 bp, Homo sapiens
gtagaaagttgtaaaatagaaa

SEQ ID NO: 3601769 - DNA, 22 bp, Homo sapiens
gtagaaattaaacatattcaag

SEQ ID NO: 3601770 - DNA, 14 bp, Homo sapiens
gtagatgctgaggc

SEQ ID NO: 3601771 - DNA, 15 bp, Homo sapiens
gtagatgctgaggcc

SEQ ID NO: 3601772 - DNA, 14 bp, Homo sapiens
gtagcactctcaga

SEQ ID NO: 3601773 - DNA, 15 bp, Homo sapiens
gtagcagcaggctca

SEQ ID NO: 3601774 - DNA, 13 bp, Homo sapiens
gtagcatataaat

SEQ ID NO: 3601775 - DNA, 14 bp, Homo sapiens
gtagcatataaatg

SEQ ID NO: 3601776 - DNA, 13 bp, Homo sapiens
gtagccagctgtg

SEQ ID NO: 3601777 - DNA, 17 bp, Homo sapiens
gtagcctaaagggcagg

SEQ ID NO: 3601778 - DNA, 20 bp, Homo sapiens
gtagcctaaagggcagggcc

SEQ ID NO: 3601779 - DNA, 17 bp, Homo sapiens
gtagcgttttttaaatg

SEQ ID NO: 3601780 - DNA, 17 bp, Homo sapiens
gtagctatttttataca

SEQ ID NO: 3601781 - DNA, 21 bp, Homo sapiens
gtagctatttttatacactgt

SEQ ID NO: 3601782 - DNA, 17 bp, Homo sapiens
gtagctctgctgctgat

SEQ ID NO: 3601783 - DNA, 21 bp, Homo sapiens
gtagcttgaaattgattaact

SEQ ID NO: 3601784 - DNA, 16 bp, Homo sapiens
gtaggaactgctgggc

SEQ ID NO: 3601785 - DNA, 15 bp, Homo sapiens
gtaggaccctcgaga

SEQ ID NO: 3601786 - DNA, 13 bp, Homo sapiens
gtaggattgctgg

SEQ ID NO: 3601787 - DNA, 16 bp, Homo sapiens
gtagggatatggcagg

SEQ ID NO: 3601788 - DNA, 14 bp, Homo sapiens
gtaggggctcctga

SEQ ID NO: 3601789 - DNA, 14 bp, Homo sapiens
gtagggtctttctt

SEQ ID NO: 3601790 - DNA, 14 bp, Homo sapiens
gtaggtcccggcca

SEQ ID NO: 3601791 - DNA, 17 bp, Homo sapiens
gtaggtcccggccagct

SEQ ID NO: 3601792 - DNA, 19 bp, Homo sapiens
gtaggtcccggccagctct

SEQ ID NO: 3601793 - DNA, 17 bp, Homo sapiens
gtaggtgttatgtattc

SEQ ID NO: 3601794 - DNA, 19 bp, Homo sapiens
gtagtatttgcctatttcc

SEQ ID NO: 3601795 - DNA, 22 bp, Homo sapiens
gtagtgaaataatagaatgagc

SEQ ID NO: 3601796 - DNA, 16 bp, Homo sapiens
gtagttataaaccaat

SEQ ID NO: 3601797 - DNA, 18 bp, Homo sapiens
gtataactttaacttctg

SEQ ID NO: 3601798 - DNA, 18 bp, Homo sapiens
gtataattaattgtcatt

SEQ ID NO: 3601799 - DNA, 15 bp, Homo sapiens
gtatagaccaaagca

SEQ ID NO: 3601800 - DNA, 21 bp, Homo sapiens
gtatagaccaaagcaaagaaa

SEQ ID NO: 3601801 - DNA, 20 bp, Homo sapiens
gtatagcatgaaataaaata

SEQ ID NO: 3601802 - DNA, 15 bp, Homo sapiens
gtatagtatctgtat

SEQ ID NO: 3601803 - DNA, 21 bp, Homo sapiens
gtatataagtactgaccactg

SEQ ID NO: 3601804 - DNA, 17 bp, Homo sapiens
gtatatgcacaaaacta

SEQ ID NO: 3601805 - DNA, 24 bp, Homo sapiens
gtatatgtatttaagatgtacatt

SEQ ID NO: 3601806 - DNA, 14 bp, Homo sapiens
gtatattacaatga

SEQ ID NO: 3601807 - DNA, 23 bp, Homo sapiens
gtatatttttatattgtttttgt

SEQ ID NO: 3601808 - DNA, 13 bp, Homo sapiens
gtatcaaatacat

SEQ ID NO: 3601809 - DNA, 19 bp, Homo sapiens
gtatcaaatacatttaaaa

SEQ ID NO: 3601810 - DNA, 12 bp, Homo sapiens
gtatcatagaaa

SEQ ID NO: 3601811 - DNA, 14 bp, Homo sapiens
gtatccactttgca

SEQ ID NO: 3601812 - DNA, 19 bp, Homo sapiens
gtatccactttgcacagct

SEQ ID NO: 3601813 - DNA, 16 bp, Homo sapiens
gtatccccttctcatc

SEQ ID NO: 3601814 - DNA, 13 bp, Homo sapiens
gtatcctccaggt

SEQ ID NO: 3601815 - DNA, 16 bp, Homo sapiens
gtatcctccaggtttt

SEQ ID NO: 3601816 - DNA, 17 bp, Homo sapiens
gtatcctccaggttttt

SEQ ID NO: 3601817 - DNA, 20 bp, Homo sapiens
gtatcctccaggtttttcaa

SEQ ID NO: 3601818 - DNA, 21 bp, Homo sapiens
gtatcctccaggtttttcaat

SEQ ID NO: 3601819 - DNA, 14 bp, Homo sapiens
gtatcctggccctg

SEQ ID NO: 3601820 - DNA, 15 bp, Homo sapiens
gtatctgctgttctt

SEQ ID NO: 3601821 - DNA, 21 bp, Homo sapiens
gtatctggcttccctggaagc

SEQ ID NO: 3601822 - DNA, 15 bp, Homo sapiens
gtatctgtgaactga

SEQ ID NO: 3601823 - DNA, 17 bp, Homo sapiens
gtatcttttatcctggg

SEQ ID NO: 3601824 - DNA, 15 bp, Homo sapiens
gtatgaagacagagg

SEQ ID NO: 3601825 - DNA, 21 bp, Homo sapiens
gtatgattactggcctttttc

SEQ ID NO: 3601826 - DNA, 19 bp, Homo sapiens
gtatgcagtactaaaatta

SEQ ID NO: 3601827 - DNA, 13 bp, Homo sapiens
gtatgtctccagt

SEQ ID NO: 3601828 - DNA, 16 bp, Homo sapiens
gtatgtggaagtgtgg

SEQ ID NO: 3601829 - DNA, 21 bp, Homo sapiens
gtatgtggaagtgtgggtctg

SEQ ID NO: 3601830 - DNA, 20 bp, Homo sapiens
gtatgtgggggtctgtgtgt

SEQ ID NO: 3601831 - DNA, 13 bp, Homo sapiens
gtattaaatggtt

SEQ ID NO: 3601832 - DNA, 14 bp, Homo sapiens
gtattaacactaaa

SEQ ID NO: 3601833 - DNA, 16 bp, Homo sapiens
gtattaatttagaatg

SEQ ID NO: 3601834 - DNA, 20 bp, Homo sapiens
gtattatttctccatcccct

SEQ ID NO: 3601835 - DNA, 19 bp, Homo sapiens
gtattcaaaaattatctat

SEQ ID NO: 3601836 - DNA, 14 bp, Homo sapiens
gtattgaaaacttc

SEQ ID NO: 3601837 - DNA, 18 bp, Homo sapiens
gtattgaaaacttcaaag

SEQ ID NO: 3601838 - DNA, 10 bp, Homo sapiens
gtattgtaca

SEQ ID NO: 3601839 - DNA, 20 bp, Homo sapiens
gtatttaaaaaaaagaaact

SEQ ID NO: 3601840 - DNA, 13 bp, Homo sapiens
gtatttaagacat

SEQ ID NO: 3601841 - DNA, 15 bp, Homo sapiens
gtatttaagacataa

SEQ ID NO: 3601842 - DNA, 17 bp, Homo sapiens
gtatttattaatttgaa

SEQ ID NO: 3601843 - DNA, 18 bp, Homo sapiens
gtatttattaatttgaaa

SEQ ID NO: 3601844 - DNA, 14 bp, Homo sapiens
gtatttcagtgttt

SEQ ID NO: 3601845 - DNA, 21 bp, Homo sapiens
gtatttggaaataaagtcaga

SEQ ID NO: 3601846 - DNA, 16 bp, Homo sapiens
gtattttaatcctgta

SEQ ID NO: 3601847 - DNA, 24 bp, Homo sapiens
gtattttaatcctgtaccaaatct

SEQ ID NO: 3601848 - DNA, 19 bp, Homo sapiens
gtattttacatgggccagt

SEQ ID NO: 3601849 - DNA, 17 bp, Homo sapiens
gtatttttctttaacca

SEQ ID NO: 3601850 - DNA, 22 bp, Homo sapiens
gtattttttttttaaataaaag

SEQ ID NO: 3601851 - DNA, 12 bp, Homo sapiens
gtcaaaacaaag

SEQ ID NO: 3601852 - DNA, 20 bp, Homo sapiens
gtcaaacaaactctctgaac

SEQ ID NO: 3601853 - DNA, 14 bp, Homo sapiens
gtcaaatccagtgg

SEQ ID NO: 3601854 - DNA, 15 bp, Homo sapiens
gtcaaatccagtggt

SEQ ID NO: 3601855 - DNA, 17 bp, Homo sapiens
gtcaaatccagtggtgg

SEQ ID NO: 3601856 - DNA, 18 bp, Homo sapiens
gtcaacagagaggggcag

SEQ ID NO: 3601857 - DNA, 17 bp, Homo sapiens
gtcaagagggaggaagg

SEQ ID NO: 3601858 - DNA, 21 bp, Homo sapiens
gtcaagctcctcctccctgca

SEQ ID NO: 3601859 - DNA, 17 bp, Homo sapiens
gtcacaacccttctctg

SEQ ID NO: 3601860 - DNA, 19 bp, Homo sapiens
gtcacacattacaaagtta

SEQ ID NO: 3601861 - DNA, 18 bp, Homo sapiens
gtcacactcttcagtgac

SEQ ID NO: 3601862 - DNA, 12 bp, Homo sapiens
gtcacagcctca

SEQ ID NO: 3601863 - DNA, 18 bp, Homo sapiens
gtcacaggactctgcctc

SEQ ID NO: 3601864 - DNA, 19 bp, Homo sapiens
gtcacatgactctcatttt

SEQ ID NO: 3601865 - DNA, 17 bp, Homo sapiens
gtcaccagacggggctg

SEQ ID NO: 3601866 - DNA, 18 bp, Homo sapiens
gtcaccaggggaggagcc

SEQ ID NO: 3601867 - DNA, 22 bp, Homo sapiens
gtcaccaggggaggagcctgtg

SEQ ID NO: 3601868 - DNA, 16 bp, Homo sapiens
gtcacccactctgcac

SEQ ID NO: 3601869 - DNA, 19 bp, Homo sapiens
gtcacccctttctgtccca

SEQ ID NO: 3601870 - DNA, 15 bp, Homo sapiens
gtcaccgcaggtgct

SEQ ID NO: 3601871 - DNA, 14 bp, Homo sapiens
gtcacctgctccag

SEQ ID NO: 3601872 - DNA, 15 bp, Homo sapiens
gtcacctgctccaga

SEQ ID NO: 3601873 - DNA, 16 bp, Homo sapiens
gtcacctgctccagaa

SEQ ID NO: 3601874 - DNA, 17 bp, Homo sapiens
gtggccttccccagcat

SEQ ID NO: 3601875 - DNA, 18 bp, Homo sapiens
gtggccttccccagcatg

SEQ ID NO: 3601876 - DNA, 19 bp, Homo sapiens
gtggccttccccagcatgc

SEQ ID NO: 3601877 - DNA, 20 bp, Homo sapiens
gtggctagtcaagctcctcc

SEQ ID NO: 3601878 - DNA, 14 bp, Homo sapiens
gtggctcatgcctg

SEQ ID NO: 3601879 - DNA, 15 bp, Homo sapiens
gtggctcctgggccg

SEQ ID NO: 3601880 - DNA, 19 bp, Homo sapiens
gtggcttcccgctcagccc

SEQ ID NO: 3601881 - DNA, 21 bp, Homo sapiens
gtggcttctctgtgaattgcc

SEQ ID NO: 3601882 - DNA, 22 bp, Homo sapiens
gtgggcaaagtcctcctttcat

SEQ ID NO: 3601883 - DNA, 15 bp, Homo sapiens
gtgggccccgggctg

SEQ ID NO: 3601884 - DNA, 19 bp, Homo sapiens
gtgggcggcacagccttct

SEQ ID NO: 3601885 - DNA, 17 bp, Homo sapiens
gtggggaacggaggagg

SEQ ID NO: 3601886 - DNA, 20 bp, Homo sapiens
gtggggcaggattctctgca

SEQ ID NO: 3601887 - DNA, 23 bp, Homo sapiens
gtggggccataaacggttcctgg

SEQ ID NO: 3601888 - DNA, 21 bp, Homo sapiens
gtggggccatgcctcctcagg

SEQ ID NO: 3601889 - DNA, 13 bp, Homo sapiens
gtggggctgcagg

SEQ ID NO: 3601890 - DNA, 14 bp, Homo sapiens
gtgggggaggagcc

SEQ ID NO: 3601891 - DNA, 19 bp, Homo sapiens
gtggggtaggttgggagaa

SEQ ID NO: 3601892 - DNA, 21 bp, Homo sapiens
gtggggtcatgccctcctctc

SEQ ID NO: 3601893 - DNA, 20 bp, Homo sapiens
gtggggtctcctcaggacca

SEQ ID NO: 3601894 - DNA, 21 bp, Homo sapiens
gtgggtttttgtatccagagc

SEQ ID NO: 3601895 - DNA, 18 bp, Homo sapiens
gtggtaacttgagattca

SEQ ID NO: 3601896 - DNA, 20 bp, Homo sapiens
gtggtaacttgagattcaag

SEQ ID NO: 3601897 - DNA, 16 bp, Homo sapiens
gtggtattctggtagg

SEQ ID NO: 3601898 - DNA, 23 bp, Homo sapiens
gtggtcaacatttctcatgttga

SEQ ID NO: 3601899 - DNA, 16 bp, Homo sapiens
gtggtcacccatgcat

SEQ ID NO: 3601900 - DNA, 20 bp, Homo sapiens
gtggtcctcctatctccctg

SEQ ID NO: 3601901 - DNA, 20 bp, Homo sapiens
gtggtctctgccccagcctg

SEQ ID NO: 3601902 - DNA, 21 bp, Homo sapiens
gtggtctctgccccagcctgt

SEQ ID NO: 3601903 - DNA, 21 bp, Homo sapiens
gtggtgcgtttataattggct

SEQ ID NO: 3601904 - DNA, 23 bp, Homo sapiens
gtggtgggggaggagcctctggc

SEQ ID NO: 3601905 - DNA, 19 bp, Homo sapiens
gtggtggtaaccctggtgg

SEQ ID NO: 3601906 - DNA, 12 bp, Homo sapiens
gtggttcttttt

SEQ ID NO: 3601907 - DNA, 20 bp, Homo sapiens
gtggttgctgttttcctccc

SEQ ID NO: 3601908 - DNA, 15 bp, Homo sapiens
gtgtaaaatgtatat

SEQ ID NO: 3601909 - DNA, 11 bp, Homo sapiens
gtgtaaaattg

SEQ ID NO: 3601910 - DNA, 17 bp, Homo sapiens
gtgtaaaggaaaataat

SEQ ID NO: 3601911 - DNA, 13 bp, Homo sapiens
gtgtaacttcctg

SEQ ID NO: 3601912 - DNA, 14 bp, Homo sapiens
gtgtaacttcctgc

SEQ ID NO: 3601913 - DNA, 15 bp, Homo sapiens
gtgtaacttcctgct

SEQ ID NO: 3601914 - DNA, 15 bp, Homo sapiens
gtgtaatcattttaa

SEQ ID NO: 3601915 - DNA, 22 bp, Homo sapiens
gtgtaatcattttaaattccac

SEQ ID NO: 3601916 - DNA, 20 bp, Homo sapiens
gtgtacaatgtacacactgg

SEQ ID NO: 3601917 - DNA, 15 bp, Homo sapiens
gtgtacatatgtgct

SEQ ID NO: 3601918 - DNA, 21 bp, Homo sapiens
gtgtaccacttcctgaggcct

SEQ ID NO: 3601919 - DNA, 22 bp, Homo sapiens
gtgtaccacttcctgaggcctc

SEQ ID NO: 3601920 - DNA, 16 bp, Homo sapiens
gtgtagcctaaagggc

SEQ ID NO: 3601921 - DNA, 18 bp, Homo sapiens
gtgtagcctaaagggcag

SEQ ID NO: 3601922 - DNA, 22 bp, Homo sapiens
gtgtagcctaaagggcagggcc

SEQ ID NO: 3601923 - DNA, 16 bp, Homo sapiens
gtgtagctgtaagggc

SEQ ID NO: 3601924 - DNA, 18 bp, Homo sapiens
gtgtagctgtaagggcag

SEQ ID NO: 3601925 - DNA, 19 bp, Homo sapiens
gtgtagctgtaagggcagt

SEQ ID NO: 3601926 - DNA, 22 bp, Homo sapiens
gtgtagctgtaagggcagtgcc

SEQ ID NO: 3601927 - DNA, 16 bp, Homo sapiens
gtgtataaatgtacat

SEQ ID NO: 3601928 - DNA, 14 bp, Homo sapiens
gtgtatcctggccc

SEQ ID NO: 3601929 - DNA, 21 bp, Homo sapiens
gtgtatttaaaaaaaagaaac

SEQ ID NO: 3601930 - DNA, 15 bp, Homo sapiens
gtgtatttattacat

SEQ ID NO: 3601931 - DNA, 16 bp, Homo sapiens
gtgtatttattacatt

SEQ ID NO: 3601932 - DNA, 21 bp, Homo sapiens
gtgtatttggaaataaagtca

SEQ ID NO: 3601933 - DNA, 19 bp, Homo sapiens
gtgtcatgaagtgcacagg

SEQ ID NO: 3601934 - DNA, 13 bp, Homo sapiens
gtgtcatttcaaa

SEQ ID NO: 3601935 - DNA, 23 bp, Homo sapiens
gtgtcatttctatattcctccag

SEQ ID NO: 3601936 - DNA, 17 bp, Homo sapiens
gtgtcatttcttcactt

SEQ ID NO: 3601937 - DNA, 12 bp, Homo sapiens
gtgtccccacca

SEQ ID NO: 3601938 - DNA, 18 bp, Homo sapiens
gtgtccccaccatctgct

SEQ ID NO: 3601939 - DNA, 22 bp, Homo sapiens
gtgtcccccataaaagatatgt

SEQ ID NO: 3601940 - DNA, 18 bp, Homo sapiens
gtgtcccctgacagggcc

SEQ ID NO: 3601941 - DNA, 18 bp, Homo sapiens
gtgtccctggacacagct

SEQ ID NO: 3601942 - DNA, 16 bp, Homo sapiens
gtgtcctaaggcccat

SEQ ID NO: 3601943 - DNA, 16 bp, Homo sapiens
gtgtcctctgcctggg

SEQ ID NO: 3601944 - DNA, 17 bp, Homo sapiens
gtgtcctctgcctgggc

SEQ ID NO: 3601945 - DNA, 22 bp, Homo sapiens
gtgtcctctgcctgggctctgg

SEQ ID NO: 3601946 - DNA, 19 bp, Homo sapiens
gtgtctaggcactgagcag

SEQ ID NO: 3601947 - DNA, 14 bp, Homo sapiens
gtgtctcagcctct

SEQ ID NO: 3601948 - DNA, 14 bp, Homo sapiens
gtgtctcccagaac

SEQ ID NO: 3601949 - DNA, 20 bp, Homo sapiens
gtgtctggccctaactccta

SEQ ID NO: 3601950 - DNA, 23 bp, Homo sapiens
gtgtctggccctaactcctataa

SEQ ID NO: 3601951 - DNA, 20 bp, Homo sapiens
gtgtgaactcaccctgggag

SEQ ID NO: 3601952 - DNA, 21 bp, Homo sapiens
gtgtgaagacccaaaacagct

SEQ ID NO: 3601953 - DNA, 21 bp, Homo sapiens
gtgtgaatttgccagaggacc

SEQ ID NO: 3601954 - DNA, 16 bp, Homo sapiens
gtgtgaccctgggcag

SEQ ID NO: 3601955 - DNA, 19 bp, Homo sapiens
gtgtgactaactatgcaat

SEQ ID NO: 3601956 - DNA, 15 bp, Homo sapiens
gtgtgactccttatc

SEQ ID NO: 3601957 - DNA, 21 bp, Homo sapiens
gtgtgatcttaatatatttga

SEQ ID NO: 3601958 - DNA, 16 bp, Homo sapiens
gtgtgattgacagctt

SEQ ID NO: 3601959 - DNA, 23 bp, Homo sapiens
gtgtgattgacagctttgctgct

SEQ ID NO: 3601960 - DNA, 15 bp, Homo sapiens
gtgtgcatgtgctgt

SEQ ID NO: 3601961 - DNA, 17 bp, Homo sapiens
gtgtgctgtttgaaaat

SEQ ID NO: 3601962 - DNA, 11 bp, Homo sapiens
gtgtggctcct

SEQ ID NO: 3601963 - DNA, 17 bp, Homo sapiens
gtgtgggagtgtgtaat

SEQ ID NO: 3601964 - DNA, 22 bp, Homo sapiens
gtgtgggatctggggagagcgg

SEQ ID NO: 3601965 - DNA, 19 bp, Homo sapiens
gtgtggggggctgggggag

SEQ ID NO: 3601966 - DNA, 14 bp, Homo sapiens
gtgtgggtctgtgt

SEQ ID NO: 3601967 - DNA, 15 bp, Homo sapiens
gtgtgtatgtggggg

SEQ ID NO: 3601968 - DNA, 18 bp, Homo sapiens
gtgtgtccaaaactgcct

SEQ ID NO: 3601969 - DNA, 19 bp, Homo sapiens
gtgtgtccaaaactgcctc

SEQ ID NO: 3601970 - DNA, 22 bp, Homo sapiens
gtgtgtccctggacacagctct

SEQ ID NO: 3601971 - DNA, 13 bp, Homo sapiens
gtgtgtctatttt

SEQ ID NO: 3601972 - DNA, 16 bp, Homo sapiens
gtgtgtctgctcagta

SEQ ID NO: 3601973 - DNA, 22 bp, Homo sapiens
gtgtgtctgttcacttttcctc

SEQ ID NO: 3601974 - DNA, 13 bp, Homo sapiens
gtgtgtggcaggg

SEQ ID NO: 3601975 - DNA, 16 bp, Homo sapiens
gtgtgtgggagtgtgt

SEQ ID NO: 3601976 - DNA, 17 bp, Homo sapiens
gtgtgttgtgtgtggga

SEQ ID NO: 3601977 - DNA, 15 bp, Homo sapiens
gtgtgtttatgtgtg

SEQ ID NO: 3601978 - DNA, 14 bp, Homo sapiens
gtgttaattttgct

SEQ ID NO: 3601979 - DNA, 17 bp, Homo sapiens
gtgttaattttgctaac

SEQ ID NO: 3601980 - DNA, 23 bp, Homo sapiens
gtgttcaaggccatccttccctg

SEQ ID NO: 3601981 - DNA, 14 bp, Homo sapiens
gtgttcagaagaat

SEQ ID NO: 3601982 - DNA, 21 bp, Homo sapiens
gtgttcagaagaatcttcctg

SEQ ID NO: 3601983 - DNA, 17 bp, Homo sapiens
gtgttcctgaagctgct

SEQ ID NO: 3601984 - DNA, 12 bp, Homo sapiens
gtgttctgctga

SEQ ID NO: 3601985 - DNA, 18 bp, Homo sapiens
gtgttctgtttgaaacta

SEQ ID NO: 3601986 - DNA, 17 bp, Homo sapiens
gtgttgaaaatgttcag

SEQ ID NO: 3601987 - DNA, 17 bp, Homo sapiens
gtgttgcactgaacagg

SEQ ID NO: 3601988 - DNA, 15 bp, Homo sapiens
gtgttgtatttctat

SEQ ID NO: 3601989 - DNA, 16 bp, Homo sapiens
gtgttgtatttctata

SEQ ID NO: 3601990 - DNA, 18 bp, Homo sapiens
gtgtttctctaaggaatt

SEQ ID NO: 3601991 - DNA, 14 bp, Homo sapiens
gttaaaaataaggt

SEQ ID NO: 3601992 - DNA, 23 bp, Homo sapiens
gttaaaacataaacacatttcca

SEQ ID NO: 3601993 - DNA, 14 bp, Homo sapiens
gttaaaagcatttt

SEQ ID NO: 3601994 - DNA, 22 bp, Homo sapiens
gttaaaatacagttctgtcata

SEQ ID NO: 3601995 - DNA, 18 bp, Homo sapiens
gttaaaggtgaacattgg

SEQ ID NO: 3601996 - DNA, 13 bp, Homo sapiens
gttaaagtttaag

SEQ ID NO: 3601997 - DNA, 17 bp, Homo sapiens
gttaactatgacagata

SEQ ID NO: 3601998 - DNA, 18 bp, Homo sapiens
gttaactatgacagatat

SEQ ID NO: 3601999 - DNA, 17 bp, Homo sapiens
gttaatcatatttgaaa

SEQ ID NO: 3602000 - DNA, 15 bp, Homo sapiens
gttaattttgctaac

SEQ ID NO: 3602001 - DNA, 20 bp, Homo sapiens
gttaattttgctaactgggt

SEQ ID NO: 3602002 - DNA, 17 bp, Homo sapiens
gttacactttttggaag

SEQ ID NO: 3602003 - DNA, 14 bp, Homo sapiens
gttacagttctgtg

SEQ ID NO: 3602004 - DNA, 15 bp, Homo sapiens
gttacattaaaataa

SEQ ID NO: 3602005 - DNA, 23 bp, Homo sapiens
gttacattaaaataaaccaaata

SEQ ID NO: 3602006 - DNA, 15 bp, Homo sapiens
taaattgctccttga

SEQ ID NO: 3602007 - DNA, 21 bp, Homo sapiens
taaattgttagcttccttaag

SEQ ID NO: 3602008 - DNA, 16 bp, Homo sapiens
taaatttaatgctgcc

SEQ ID NO: 3602009 - DNA, 16 bp, Homo sapiens
taaatttcagctttgg

SEQ ID NO: 3602010 - DNA, 11 bp, Homo sapiens
taaatttctgg

SEQ ID NO: 3602011 - DNA, 22 bp, Homo sapiens
taaatttgatttacatatatta

SEQ ID NO: 3602012 - DNA, 14 bp, Homo sapiens
taaatttgttcttt

SEQ ID NO: 3602013 - DNA, 14 bp, Homo sapiens
taaattttctaaat

SEQ ID NO: 3602014 - DNA, 23 bp, Homo sapiens
taaattttttacgtagctatttt

SEQ ID NO: 3602015 - DNA, 14 bp, Homo sapiens
taaattttttgaaa

SEQ ID NO: 3602016 - DNA, 17 bp, Homo sapiens
taaattttttgaaacac

SEQ ID NO: 3602017 - DNA, 22 bp, Homo sapiens
taaattttttttggtcaaattt

SEQ ID NO: 3602018 - DNA, 13 bp, Homo sapiens
taacaaaatggac

SEQ ID NO: 3602019 - DNA, 18 bp, Homo sapiens
taacaatccattcacaag

SEQ ID NO: 3602020 - DNA, 21 bp, Homo sapiens
taacaatccattcacaagcct

SEQ ID NO: 3602021 - DNA, 12 bp, Homo sapiens
taacacagatat

SEQ ID NO: 3602022 - DNA, 17 bp, Homo sapiens
taacacattaaatgtgg

SEQ ID NO: 3602023 - DNA, 13 bp, Homo sapiens
taacactaaattg

SEQ ID NO: 3602024 - DNA, 17 bp, Homo sapiens
taacactaaattgcagt

SEQ ID NO: 3602025 - DNA, 11 bp, Homo sapiens
taacactgact

SEQ ID NO: 3602026 - DNA, 14 bp, Homo sapiens
taacaggtattttg

SEQ ID NO: 3602027 - DNA, 19 bp, Homo sapiens
taacaggtattttgtttct

SEQ ID NO: 3602028 - DNA, 21 bp, Homo sapiens
taacagttttgagtaattcaa

SEQ ID NO: 3602029 - DNA, 15 bp, Homo sapiens
taacatattatttca

SEQ ID NO: 3602030 - DNA, 15 bp, Homo sapiens
taacatcgcacagtt

SEQ ID NO: 3602031 - DNA, 11 bp, Homo sapiens
taacatgaaat

SEQ ID NO: 3602032 - DNA, 23 bp, Homo sapiens
taacatggacatgatcttcttta

SEQ ID NO: 3602033 - DNA, 22 bp, Homo sapiens
taacatgtcctgcctattatct

SEQ ID NO: 3602034 - DNA, 12 bp, Homo sapiens
taaccaagttcc

SEQ ID NO: 3602035 - DNA, 18 bp, Homo sapiens
taacccacctctcctgcc

SEQ ID NO: 3602036 - DNA, 22 bp, Homo sapiens
taacccacctctcctgccctgt

SEQ ID NO: 3602037 - DNA, 15 bp, Homo sapiens
taacccagtctttct

SEQ ID NO: 3602038 - DNA, 17 bp, Homo sapiens
taaccctgtcacccaca

SEQ ID NO: 3602039 - DNA, 14 bp, Homo sapiens
taacctgggacctg

SEQ ID NO: 3602040 - DNA, 13 bp, Homo sapiens
taacgatgttgta

SEQ ID NO: 3602041 - DNA, 13 bp, Homo sapiens
taacggtgctaaa

SEQ ID NO: 3602042 - DNA, 14 bp, Homo sapiens
taacggtgctaaaa

SEQ ID NO: 3602043 - DNA, 21 bp, Homo sapiens
taacgtaaatccaccaccaaa

SEQ ID NO: 3602044 - DNA, 18 bp, Homo sapiens
taacgtgttccagtgtct

SEQ ID NO: 3602045 - DNA, 24 bp, Homo sapiens
taacgtgttccagtgtctgtctga

SEQ ID NO: 3602046 - DNA, 22 bp, Homo sapiens
taactaaagaagaggagaaaaa

SEQ ID NO: 3602047 - DNA, 22 bp, Homo sapiens
taactaattggaaggagagggg

SEQ ID NO: 3602048 - DNA, 16 bp, Homo sapiens
taactatcgaaatgac

SEQ ID NO: 3602049 - DNA, 22 bp, Homo sapiens
taactatcgaaatgacggtgtt

SEQ ID NO: 3602050 - DNA, 23 bp, Homo sapiens
taactatgacagatatatttaag

SEQ ID NO: 3602051 - DNA, 13 bp, Homo sapiens
taactatgcaata

SEQ ID NO: 3602052 - DNA, 22 bp, Homo sapiens
taactattacagtgttggagaa

SEQ ID NO: 3602053 - DNA, 23 bp, Homo sapiens
taactattgcatttatatgtacc

SEQ ID NO: 3602054 - DNA, 13 bp, Homo sapiens
taactatttcaca

SEQ ID NO: 3602055 - DNA, 21 bp, Homo sapiens
taactcaaagacttcctctgg

SEQ ID NO: 3602056 - DNA, 14 bp, Homo sapiens
taactcctgtccct

SEQ ID NO: 3602057 - DNA, 12 bp, Homo sapiens
taactctgagag

SEQ ID NO: 3602058 - DNA, 13 bp, Homo sapiens
taactgaaccaaa

SEQ ID NO: 3602059 - DNA, 14 bp, Homo sapiens
taactgaaccaaat

SEQ ID NO: 3602060 - DNA, 18 bp, Homo sapiens
taactgaaccaaattgca

SEQ ID NO: 3602061 - DNA, 20 bp, Homo sapiens
taactgagtagctctcctga

SEQ ID NO: 3602062 - DNA, 23 bp, Homo sapiens
taactgagtagctctcctgactt

SEQ ID NO: 3602063 - DNA, 19 bp, Homo sapiens
taactgagttatattggaa

SEQ ID NO: 3602064 - DNA, 13 bp, Homo sapiens
taactggttaaac

SEQ ID NO: 3602065 - DNA, 12 bp, Homo sapiens
taactgtatttt

SEQ ID NO: 3602066 - DNA, 13 bp, Homo sapiens
taactgtattttc

SEQ ID NO: 3602067 - DNA, 18 bp, Homo sapiens
taactgtattttctttca

SEQ ID NO: 3602068 - DNA, 11 bp, Homo sapiens
taactgtcctg

SEQ ID NO: 3602069 - DNA, 17 bp, Homo sapiens
taactgtcctgtcctgc

SEQ ID NO: 3602070 - DNA, 17 bp, Homo sapiens
taactgtgctgtactga

SEQ ID NO: 3602071 - DNA, 20 bp, Homo sapiens
taactgtgctgtactgagca

SEQ ID NO: 3602072 - DNA, 22 bp, Homo sapiens
taacttaaaagaacatgtatat

SEQ ID NO: 3602073 - DNA, 14 bp, Homo sapiens
taacttacaaagat

SEQ ID NO: 3602074 - DNA, 13 bp, Homo sapiens
taacttcctgctg

SEQ ID NO: 3602075 - DNA, 14 bp, Homo sapiens
taacttcctgctgc

SEQ ID NO: 3602076 - DNA, 18 bp, Homo sapiens
taacttcctgctgcaccc

SEQ ID NO: 3602077 - DNA, 17 bp, Homo sapiens
taacttggccgctgtat

SEQ ID NO: 3602078 - DNA, 22 bp, Homo sapiens
taacttttttttctctcttttg

SEQ ID NO: 3602079 - DNA, 22 bp, Homo sapiens
taagaaagtaatttaatttgta

SEQ ID NO: 3602080 - DNA, 20 bp, Homo sapiens
taagaacaagttttggcagc

SEQ ID NO: 3602081 - DNA, 21 bp, Homo sapiens
taagaacaagttttggcagcc

SEQ ID NO: 3602082 - DNA, 22 bp, Homo sapiens
taagaacaagttttggcagcca

SEQ ID NO: 3602083 - DNA, 16 bp, Homo sapiens
taagaaccttaatgac

SEQ ID NO: 3602084 - DNA, 18 bp, Homo sapiens
taagaaccttaatgacaa

SEQ ID NO: 3602085 - DNA, 17 bp, Homo sapiens
taagaagaagagaggca

SEQ ID NO: 3602086 - DNA, 19 bp, Homo sapiens
taagaagaaggccagagag

SEQ ID NO: 3602087 - DNA, 14 bp, Homo sapiens
taagacataaacaa

SEQ ID NO: 3602088 - DNA, 15 bp, Homo sapiens
taagacataaacaaa

SEQ ID NO: 3602089 - DNA, 13 bp, Homo sapiens
taagaccctgtgt

SEQ ID NO: 3602090 - DNA, 11 bp, Homo sapiens
taagacctggc

SEQ ID NO: 3602091 - DNA, 13 bp, Homo sapiens
taagacctggcag

SEQ ID NO: 3602092 - DNA, 18 bp, Homo sapiens
taagacctggcagctctg

SEQ ID NO: 3602093 - DNA, 11 bp, Homo sapiens
taagactggct

SEQ ID NO: 3602094 - DNA, 12 bp, Homo sapiens
taagagaaacct

SEQ ID NO: 3602095 - DNA, 21 bp, Homo sapiens
taagagaaacctgccaaggag

SEQ ID NO: 3602096 - DNA, 23 bp, Homo sapiens
taagagaaacctgccaaggagca

SEQ ID NO: 3602097 - DNA, 21 bp, Homo sapiens
taagaggacataatggggtcc

SEQ ID NO: 3602098 - DNA, 15 bp, Homo sapiens
taagagggcagactg

SEQ ID NO: 3602099 - DNA, 18 bp, Homo sapiens
taagatcgttctctgcct

SEQ ID NO: 3602100 - DNA, 17 bp, Homo sapiens
taagatctatgggaaga

SEQ ID NO: 3602101 - DNA, 15 bp, Homo sapiens
taagatgtacattta

SEQ ID NO: 3602102 - DNA, 16 bp, Homo sapiens
taagatgtacatttaa

SEQ ID NO: 3602103 - DNA, 21 bp, Homo sapiens
taagatgtgcagcatttcact

SEQ ID NO: 3602104 - DNA, 14 bp, Homo sapiens
taagattcatattt

SEQ ID NO: 3602105 - DNA, 23 bp, Homo sapiens
taagcaaaaacaaaaagaaaaga

SEQ ID NO: 3602106 - DNA, 13 bp, Homo sapiens
taagcagaggagg

SEQ ID NO: 3602107 - DNA, 16 bp, Homo sapiens
taagcagaggaggggc

SEQ ID NO: 3602108 - DNA, 15 bp, Homo sapiens
taagcagcatggaaa

SEQ ID NO: 3602109 - DNA, 16 bp, Homo sapiens
taagcagcatggaaaa

SEQ ID NO: 3602110 - DNA, 18 bp, Homo sapiens
taagcagcatggaaaaat

SEQ ID NO: 3602111 - DNA, 17 bp, Homo sapiens
taagcagctaaattttc

SEQ ID NO: 3602112 - DNA, 16 bp, Homo sapiens
taagcagttcattcta

SEQ ID NO: 3602113 - DNA, 18 bp, Homo sapiens
taagcatctggctctaat

SEQ ID NO: 3602114 - DNA, 22 bp, Homo sapiens
taagccaaactcaggcccagaa

SEQ ID NO: 3602115 - DNA, 11 bp, Homo sapiens
taagccaaaga

SEQ ID NO: 3602116 - DNA, 16 bp, Homo sapiens
taagccaaagaaacaa

SEQ ID NO: 3602117 - DNA, 17 bp, Homo sapiens
taagccaaagaaacaag

SEQ ID NO: 3602118 - DNA, 20 bp, Homo sapiens
taagccagggcccctggatc

SEQ ID NO: 3602119 - DNA, 14 bp, Homo sapiens
taagcccccagggc

SEQ ID NO: 3602120 - DNA, 16 bp, Homo sapiens
taagcccccagggcct

SEQ ID NO: 3602121 - DNA, 22 bp, Homo sapiens
taagcccccagggcctccaggg

SEQ ID NO: 3602122 - DNA, 18 bp, Homo sapiens
taagccgcagacctggag

SEQ ID NO: 3602123 - DNA, 19 bp, Homo sapiens
taaggatatgattaatatt

SEQ ID NO: 3602124 - DNA, 17 bp, Homo sapiens
taaggatttttatgtac

SEQ ID NO: 3602125 - DNA, 23 bp, Homo sapiens
taaggcacagtgggagctgagct

SEQ ID NO: 3602126 - DNA, 17 bp, Homo sapiens
taaggctgtacatagtc

SEQ ID NO: 3602127 - DNA, 22 bp, Homo sapiens
taagggagtggcctcatttcac

SEQ ID NO: 3602128 - DNA, 12 bp, Homo sapiens
taaggtggcttc

SEQ ID NO: 3602129 - DNA, 13 bp, Homo sapiens
taaggtggcttct

SEQ ID NO: 3602130 - DNA, 17 bp, Homo sapiens
taagtaaaaccacagca

SEQ ID NO: 3602131 - DNA, 16 bp, Homo sapiens
taagtaatttagaaga

SEQ ID NO: 3602132 - DNA, 17 bp, Homo sapiens
taagtaatttagaagat

SEQ ID NO: 3602133 - DNA, 23 bp, Homo sapiens
taagtaatttagaagatattatt

SEQ ID NO: 3602134 - DNA, 18 bp, Homo sapiens
taagtacacaataagcaa

SEQ ID NO: 3602135 - DNA, 19 bp, Homo sapiens
taagtactacacattttta

SEQ ID NO: 3602136 - DNA, 22 bp, Homo sapiens
taagtatatcatgtaaagaaat

SEQ ID NO: 3602137 - DNA, 16 bp, Homo sapiens
taagtatttaaatgtt

SEQ ID NO: 3602138 - DNA, 12 bp, Homo sapiens
taagtatttagg

SEQ ID NO: 3602139 - DNA, 19 bp, Homo sapiens
tagatgaggctcagagagg

SEQ ID NO: 3602140 - DNA, 23 bp, Homo sapiens
tagatgctgactgtactcctccc

SEQ ID NO: 3602141 - DNA, 14 bp, Homo sapiens
tagatgctgaggcc

SEQ ID NO: 3602142 - DNA, 17 bp, Homo sapiens
tagatgctgaggcccct

SEQ ID NO: 3602143 - DNA, 16 bp, Homo sapiens
tagatgctggcccagg

SEQ ID NO: 3602144 - DNA, 18 bp, Homo sapiens
tagatgtgcagtttggaa

SEQ ID NO: 3602145 - DNA, 14 bp, Homo sapiens
tagatttagtgtaa

SEQ ID NO: 3602146 - DNA, 16 bp, Homo sapiens
tagcaagcttttgctc

SEQ ID NO: 3602147 - DNA, 16 bp, Homo sapiens
tagcaaggcagagcct

SEQ ID NO: 3602148 - DNA, 15 bp, Homo sapiens
tagcaataaatgctt

SEQ ID NO: 3602149 - DNA, 23 bp, Homo sapiens
tagcaataaatgcttttctaatg

SEQ ID NO: 3602150 - DNA, 23 bp, Homo sapiens
tagcacacctgaatcagctggac

SEQ ID NO: 3602151 - DNA, 13 bp, Homo sapiens
tagcaccagggct

SEQ ID NO: 3602152 - DNA, 13 bp, Homo sapiens
tagcatataaatg

SEQ ID NO: 3602153 - DNA, 15 bp, Homo sapiens
tagcatataaatgtt

SEQ ID NO: 3602154 - DNA, 20 bp, Homo sapiens
tagcatataaatgtttatat

SEQ ID NO: 3602155 - DNA, 16 bp, Homo sapiens
tagcattatcttatca

SEQ ID NO: 3602156 - DNA, 17 bp, Homo sapiens
tagcattatcttatcat

SEQ ID NO: 3602157 - DNA, 22 bp, Homo sapiens
tagcattgtctatttttctctt

SEQ ID NO: 3602158 - DNA, 14 bp, Homo sapiens
tagcatttgtataa

SEQ ID NO: 3602159 - DNA, 18 bp, Homo sapiens
tagcatttgtataaagaa

SEQ ID NO: 3602160 - DNA, 14 bp, Homo sapiens
tagccaacatagta

SEQ ID NO: 3602161 - DNA, 20 bp, Homo sapiens
tagccaactgtttccctgct

SEQ ID NO: 3602162 - DNA, 21 bp, Homo sapiens
tagccaactgtttccctgctg

SEQ ID NO: 3602163 - DNA, 22 bp, Homo sapiens
tagccaactgtttccctgctga

SEQ ID NO: 3602164 - DNA, 23 bp, Homo sapiens
tagccaactgtttccctgctgaa

SEQ ID NO: 3602165 - DNA, 17 bp, Homo sapiens
tagccattgatcataaa

SEQ ID NO: 3602166 - DNA, 22 bp, Homo sapiens
tagcccaacctacattccaccc

SEQ ID NO: 3602167 - DNA, 22 bp, Homo sapiens
tagcccaggatatattttattt

SEQ ID NO: 3602168 - DNA, 15 bp, Homo sapiens
tagccccggcccccc

SEQ ID NO: 3602169 - DNA, 17 bp, Homo sapiens
tagcctaaagggcaggg

SEQ ID NO: 3602170 - DNA, 14 bp, Homo sapiens
tagcctggggtggg

SEQ ID NO: 3602171 - DNA, 14 bp, Homo sapiens
tagcggagcccagc

SEQ ID NO: 3602172 - DNA, 15 bp, Homo sapiens
tagcggagcccagcc

SEQ ID NO: 3602173 - DNA, 19 bp, Homo sapiens
tagctatttttatacactg

SEQ ID NO: 3602174 - DNA, 23 bp, Homo sapiens
tagctatttttatacactgtaag

SEQ ID NO: 3602175 - DNA, 23 bp, Homo sapiens
tagctcctataaagggcccacac

SEQ ID NO: 3602176 - DNA, 22 bp, Homo sapiens
tagctctaaaatctgcttgtat

SEQ ID NO: 3602177 - DNA, 21 bp, Homo sapiens
tagctctaggagggctggcaa

SEQ ID NO: 3602178 - DNA, 16 bp, Homo sapiens
tagctctcacagacat

SEQ ID NO: 3602179 - DNA, 11 bp, Homo sapiens
tagctctgggg

SEQ ID NO: 3602180 - DNA, 12 bp, Homo sapiens
tagctctttctc

SEQ ID NO: 3602181 - DNA, 14 bp, Homo sapiens
tagctcttttccta

SEQ ID NO: 3602182 - DNA, 14 bp, Homo sapiens
tagctggggagccc

SEQ ID NO: 3602183 - DNA, 15 bp, Homo sapiens
tagctggggagccct

SEQ ID NO: 3602184 - DNA, 17 bp, Homo sapiens
tagctgtaagggcagtg

SEQ ID NO: 3602185 - DNA, 20 bp, Homo sapiens
tagctgtaagggcagtgccc

SEQ ID NO: 3602186 - DNA, 21 bp, Homo sapiens
tagctgtcgtacattgagcaa

SEQ ID NO: 3602187 - DNA, 23 bp, Homo sapiens
tagcttacctgggcacaaacaga

SEQ ID NO: 3602188 - DNA, 21 bp, Homo sapiens
tagcttcaccccaatcccagc

SEQ ID NO: 3602189 - DNA, 21 bp, Homo sapiens
tagctttctgagcaagaggat

SEQ ID NO: 3602190 - DNA, 15 bp, Homo sapiens
tagctttgctctttg

SEQ ID NO: 3602191 - DNA, 14 bp, Homo sapiens
taggaaccctggag

SEQ ID NO: 3602192 - DNA, 19 bp, Homo sapiens
taggaagttaaaagcacaa

SEQ ID NO: 3602193 - DNA, 19 bp, Homo sapiens
taggaccctcgagagcctt

SEQ ID NO: 3602194 - DNA, 23 bp, Homo sapiens
taggacgcatgaaggtcactcgt

SEQ ID NO: 3602195 - DNA, 23 bp, Homo sapiens
taggactagaagattagaaacta

SEQ ID NO: 3602196 - DNA, 20 bp, Homo sapiens
taggactccatttctttctt

SEQ ID NO: 3602197 - DNA, 12 bp, Homo sapiens
taggagaagcca

SEQ ID NO: 3602198 - DNA, 16 bp, Homo sapiens
taggagaagccaggaa

SEQ ID NO: 3602199 - DNA, 18 bp, Homo sapiens
taggagaagtcttctatt

SEQ ID NO: 3602200 - DNA, 20 bp, Homo sapiens
taggagaagtcttctattta

SEQ ID NO: 3602201 - DNA, 21 bp, Homo sapiens
taggagacagatcactcctgg

SEQ ID NO: 3602202 - DNA, 16 bp, Homo sapiens
taggagatgttgggaa

SEQ ID NO: 3602203 - DNA, 13 bp, Homo sapiens
taggagcaggctt

SEQ ID NO: 3602204 - DNA, 19 bp, Homo sapiens
taggcaaagataatttatt

SEQ ID NO: 3602205 - DNA, 21 bp, Homo sapiens
taggcagggggccctgcccca

SEQ ID NO: 3602206 - DNA, 12 bp, Homo sapiens
taggccaggcct

SEQ ID NO: 3602207 - DNA, 13 bp, Homo sapiens
taggccccagagg

SEQ ID NO: 3602208 - DNA, 22 bp, Homo sapiens
taggccctgtgagcacaaagaa

SEQ ID NO: 3602209 - DNA, 14 bp, Homo sapiens
taggcctcagccag

SEQ ID NO: 3602210 - DNA, 22 bp, Homo sapiens
taggcctcagccagagaagcta

SEQ ID NO: 3602211 - DNA, 15 bp, Homo sapiens
taggcctgtcccttg

SEQ ID NO: 3602212 - DNA, 20 bp, Homo sapiens
taggcctgtcccttgcctct

SEQ ID NO: 3602213 - DNA, 16 bp, Homo sapiens
taggccttgccagttt

SEQ ID NO: 3602214 - DNA, 18 bp, Homo sapiens
taggcctttcctctgcac

SEQ ID NO: 3602215 - DNA, 20 bp, Homo sapiens
taggctattttctaaagact

SEQ ID NO: 3602216 - DNA, 21 bp, Homo sapiens
taggctcttaagcagcatgga

SEQ ID NO: 3602217 - DNA, 19 bp, Homo sapiens
taggctgtaactactttat

SEQ ID NO: 3602218 - DNA, 19 bp, Homo sapiens
tagggacaggaccccagct

SEQ ID NO: 3602219 - DNA, 21 bp, Homo sapiens
tagggactgccaggctgtttc

SEQ ID NO: 3602220 - DNA, 14 bp, Homo sapiens
tagggagagaagat

SEQ ID NO: 3602221 - DNA, 22 bp, Homo sapiens
taggggcttataataaaggact

SEQ ID NO: 3602222 - DNA, 23 bp, Homo sapiens
taggggcttataataaaggactg

SEQ ID NO: 3602223 - DNA, 13 bp, Homo sapiens
taggggtcctggg

SEQ ID NO: 3602224 - DNA, 15 bp, Homo sapiens
tagggttataataat

SEQ ID NO: 3602225 - DNA, 21 bp, Homo sapiens
tagggttttttcttctttctt

SEQ ID NO: 3602226 - DNA, 22 bp, Homo sapiens
taggtaaatttttaggcaaaga

SEQ ID NO: 3602227 - DNA, 13 bp, Homo sapiens
taggtaacacatt

SEQ ID NO: 3602228 - DNA, 14 bp, Homo sapiens
taggtacacagctc

SEQ ID NO: 3602229 - DNA, 20 bp, Homo sapiens
taggtcattgcacctatctc

SEQ ID NO: 3602230 - DNA, 19 bp, Homo sapiens
taggtcccggccagctctg

SEQ ID NO: 3602231 - DNA, 14 bp, Homo sapiens
taggtgcagctcct

SEQ ID NO: 3602232 - DNA, 14 bp, Homo sapiens
taggttttacagat

SEQ ID NO: 3602233 - DNA, 15 bp, Homo sapiens
taggtttttgtttgt

SEQ ID NO: 3602234 - DNA, 16 bp, Homo sapiens
tagtacatgcagaaat

SEQ ID NO: 3602235 - DNA, 18 bp, Homo sapiens
tagtacattactaaatat

SEQ ID NO: 3602236 - DNA, 19 bp, Homo sapiens
tagtagcgttttttaaatg

SEQ ID NO: 3602237 - DNA, 23 bp, Homo sapiens
tagtagcgttttttaaatgtata

SEQ ID NO: 3602238 - DNA, 15 bp, Homo sapiens
tagtaggaatgtaca

SEQ ID NO: 3602239 - DNA, 18 bp, Homo sapiens
tagtatcctccaggtttt

SEQ ID NO: 3602240 - DNA, 13 bp, Homo sapiens
tagtatgaaaatg

SEQ ID NO: 3602241 - DNA, 13 bp, Homo sapiens
tagtatttcagtg

SEQ ID NO: 3602242 - DNA, 20 bp, Homo sapiens
tagtatttcagtgttttcat

SEQ ID NO: 3602243 - DNA, 17 bp, Homo sapiens
tagtattttaatcctgt

SEQ ID NO: 3602244 - DNA, 13 bp, Homo sapiens
tagtcaagctcct

SEQ ID NO: 3602245 - DNA, 15 bp, Homo sapiens
tagtcaagctcctcc

SEQ ID NO: 3602246 - DNA, 15 bp, Homo sapiens
tagtcaccagagact

SEQ ID NO: 3602247 - DNA, 15 bp, Homo sapiens
tagtcattcttccct

SEQ ID NO: 3602248 - DNA, 17 bp, Homo sapiens
tagtcatttgttaatat

SEQ ID NO: 3602249 - DNA, 23 bp, Homo sapiens
tagtcatttgttaatatttcttc

SEQ ID NO: 3602250 - DNA, 21 bp, Homo sapiens
tagtccgtgctgacagctgct

SEQ ID NO: 3602251 - DNA, 22 bp, Homo sapiens
tagtccgtgctgacagctgctc

SEQ ID NO: 3602252 - DNA, 23 bp, Homo sapiens
tagtccgtgctgacagctgctcc

SEQ ID NO: 3602253 - DNA, 20 bp, Homo sapiens
tagtccttttatctccttgt

SEQ ID NO: 3602254 - DNA, 18 bp, Homo sapiens
tagtctagatggctcctc

SEQ ID NO: 3602255 - DNA, 13 bp, Homo sapiens
tagtgatggttcc

SEQ ID NO: 3602256 - DNA, 18 bp, Homo sapiens
tagtgatggttcccctgt

SEQ ID NO: 3602257 - DNA, 14 bp, Homo sapiens
tagtggaaagtcag

SEQ ID NO: 3602258 - DNA, 13 bp, Homo sapiens
tagtggctggggt

SEQ ID NO: 3602259 - DNA, 14 bp, Homo sapiens
tagtgtaataagac

SEQ ID NO: 3602260 - DNA, 17 bp, Homo sapiens
tagtgtaataagactta

SEQ ID NO: 3602261 - DNA, 19 bp, Homo sapiens
tagtgtatgattactggcc

SEQ ID NO: 3602262 - DNA, 15 bp, Homo sapiens
tagtgttctgctcct

SEQ ID NO: 3602263 - DNA, 16 bp, Homo sapiens
tagtgttctgctcctg

SEQ ID NO: 3602264 - DNA, 17 bp, Homo sapiens
tagtgttgtatttctat

SEQ ID NO: 3602265 - DNA, 18 bp, Homo sapiens
tagtgtttggacagctga

SEQ ID NO: 3602266 - DNA, 12 bp, Homo sapiens
tagttactcaag

SEQ ID NO: 3602267 - DNA, 14 bp, Homo sapiens
tagttatatatatg

SEQ ID NO: 3602268 - DNA, 15 bp, Homo sapiens
tagttatatgtacag

SEQ ID NO: 3602269 - DNA, 23 bp, Homo sapiens
tagttcaatcctgattcatattt

SEQ ID NO: 3602270 - DNA, 14 bp, Homo sapiens
tagttccactgaga

SEQ ID NO: 3602271 - DNA, 14 bp, Homo sapiens
tcaaaactgaagct

SEQ ID NO: 3602272 - DNA, 13 bp, Homo sapiens
tcaaaactgcact

SEQ ID NO: 3602273 - DNA, 18 bp, Homo sapiens
tcaaaagccataacttga

SEQ ID NO: 3602274 - DNA, 14 bp, Homo sapiens
tcaaaaggaacaaa

SEQ ID NO: 3602275 - DNA, 21 bp, Homo sapiens
tcaaaaggaacaaaaattaca

SEQ ID NO: 3602276 - DNA, 14 bp, Homo sapiens
tcaaaagtttgttt

SEQ ID NO: 3602277 - DNA, 23 bp, Homo sapiens
tcaaaataccatgccatttaaag

SEQ ID NO: 3602278 - DNA, 17 bp, Homo sapiens
tcaaaatatttgtacat

SEQ ID NO: 3602279 - DNA, 15 bp, Homo sapiens
tcaaaattgcttcta

SEQ ID NO: 3602280 - DNA, 13 bp, Homo sapiens
tcaaacagtctca

SEQ ID NO: 3602281 - DNA, 13 bp, Homo sapiens
tcaaacattttgt

SEQ ID NO: 3602282 - DNA, 14 bp, Homo sapiens
tcaaactgcacatc

SEQ ID NO: 3602283 - DNA, 14 bp, Homo sapiens
tcaaacttaaacaa

SEQ ID NO: 3602284 - DNA, 15 bp, Homo sapiens
tcaaagaaagtgtat

SEQ ID NO: 3602285 - DNA, 16 bp, Homo sapiens
tcaaagaaagtgtatt

SEQ ID NO: 3602286 - DNA, 15 bp, Homo sapiens
tcaaagagaagatgc

SEQ ID NO: 3602287 - DNA, 18 bp, Homo sapiens
tcaaagagaagatgcctg

SEQ ID NO: 3602288 - DNA, 15 bp, Homo sapiens
tcaaagagaattgta

SEQ ID NO: 3602289 - DNA, 16 bp, Homo sapiens
tcaaagagaattgtat

SEQ ID NO: 3602290 - DNA, 13 bp, Homo sapiens
tcaaagctgaata

SEQ ID NO: 3602291 - DNA, 16 bp, Homo sapiens
tcaaagctgaatattt

SEQ ID NO: 3602292 - DNA, 20 bp, Homo sapiens
tcaaataaatttctgggata

SEQ ID NO: 3602293 - DNA, 21 bp, Homo sapiens
tcaaatacatttaaaacatta

SEQ ID NO: 3602294 - DNA, 17 bp, Homo sapiens
tcaaatatgcaaagcac

SEQ ID NO: 3602295 - DNA, 20 bp, Homo sapiens
tcaaatcaagaaacttaagg

SEQ ID NO: 3602296 - DNA, 15 bp, Homo sapiens
tcaaatccagtggtg

SEQ ID NO: 3602297 - DNA, 17 bp, Homo sapiens
tcaaatccagtggtggg

SEQ ID NO: 3602298 - DNA, 19 bp, Homo sapiens
tcaaatccagtggtgggta

SEQ ID NO: 3602299 - DNA, 21 bp, Homo sapiens
tcaaatccagtggtgggtaat

SEQ ID NO: 3602300 - DNA, 14 bp, Homo sapiens
tcaaatgctcagac

SEQ ID NO: 3602301 - DNA, 21 bp, Homo sapiens
tcaaatgctcagaccagctct

SEQ ID NO: 3602302 - DNA, 23 bp, Homo sapiens
tcaaatgctggcaaatccaggct

SEQ ID NO: 3602303 - DNA, 15 bp, Homo sapiens
tcaaatgcttttcct

SEQ ID NO: 3602304 - DNA, 19 bp, Homo sapiens
tcaaatggggccagatcca

SEQ ID NO: 3602305 - DNA, 12 bp, Homo sapiens
tcaaattctgtc

SEQ ID NO: 3602306 - DNA, 18 bp, Homo sapiens
tcaaattctgtctgggga

SEQ ID NO: 3602307 - DNA, 18 bp, Homo sapiens
tcaacagccaagctggca

SEQ ID NO: 3602308 - DNA, 14 bp, Homo sapiens
tcaacagcttccct

SEQ ID NO: 3602309 - DNA, 17 bp, Homo sapiens
tcaacatatactattta

SEQ ID NO: 3602310 - DNA, 15 bp, Homo sapiens
tcaacatttctcatg

SEQ ID NO: 3602311 - DNA, 14 bp, Homo sapiens
tcaaccagcagatg

SEQ ID NO: 3602312 - DNA, 14 bp, Homo sapiens
tcaacccccctccc

SEQ ID NO: 3602313 - DNA, 20 bp, Homo sapiens
tcaacccccctcccagacag

SEQ ID NO: 3602314 - DNA, 21 bp, Homo sapiens
tcaacccccctcccagacagg

SEQ ID NO: 3602315 - DNA, 15 bp, Homo sapiens
tcaacgcctccccct

SEQ ID NO: 3602316 - DNA, 11 bp, Homo sapiens
tcaactcccaa

SEQ ID NO: 3602317 - DNA, 18 bp, Homo sapiens
tcaactgaccagcctcca

SEQ ID NO: 3602318 - DNA, 24 bp, Homo sapiens
tcaactgaccagcctccatgctgc

SEQ ID NO: 3602319 - DNA, 21 bp, Homo sapiens
tcaagaaagcttcaaactgca

SEQ ID NO: 3602320 - DNA, 19 bp, Homo sapiens
tcaagacaagagctgttat

SEQ ID NO: 3602321 - DNA, 17 bp, Homo sapiens
tcaagacgaggggcagg

SEQ ID NO: 3602322 - DNA, 18 bp, Homo sapiens
tcaagacgaggggcaggg

SEQ ID NO: 3602323 - DNA, 13 bp, Homo sapiens
tcaagagaaactt

SEQ ID NO: 3602324 - DNA, 23 bp, Homo sapiens
tcaagagggaggaaggggcccca

SEQ ID NO: 3602325 - DNA, 22 bp, Homo sapiens
tcaagatgatgatgatctttaa

SEQ ID NO: 3602326 - DNA, 15 bp, Homo sapiens
tcaagatttttttcc

SEQ ID NO: 3602327 - DNA, 12 bp, Homo sapiens
tcaagcaaacat

SEQ ID NO: 3602328 - DNA, 22 bp, Homo sapiens
tcaagcaaacatcaaataaatt

SEQ ID NO: 3602329 - DNA, 19 bp, Homo sapiens
tcaagcaatcctcctacct

SEQ ID NO: 3602330 - DNA, 20 bp, Homo sapiens
tcaagccatgtataaatgtg

SEQ ID NO: 3602331 - DNA, 13 bp, Homo sapiens
tcaagcctctaaa

SEQ ID NO: 3602332 - DNA, 14 bp, Homo sapiens
tcaagcctctaaac

SEQ ID NO: 3602333 - DNA, 15 bp, Homo sapiens
tcaagctcctcctcc

SEQ ID NO: 3602334 - DNA, 16 bp, Homo sapiens
tcaagctcctcctccc

SEQ ID NO: 3602335 - DNA, 18 bp, Homo sapiens
tcaagctgaccttgctga

SEQ ID NO: 3602336 - DNA, 23 bp, Homo sapiens
tcaagctgttatttcttccctgc

SEQ ID NO: 3602337 - DNA, 14 bp, Homo sapiens
tcaaggaaacgttt

SEQ ID NO: 3602338 - DNA, 16 bp, Homo sapiens
tcaaggaatttcttaa

SEQ ID NO: 3602339 - DNA, 18 bp, Homo sapiens
tcaaggagcaagaaatga

SEQ ID NO: 3602340 - DNA, 11 bp, Homo sapiens
tcaaggctcag

SEQ ID NO: 3602341 - DNA, 16 bp, Homo sapiens
tcaagggagacaccag

SEQ ID NO: 3602342 - DNA, 13 bp, Homo sapiens
tcaagtaaaacaa

SEQ ID NO: 3602343 - DNA, 15 bp, Homo sapiens
tcaagtaaaacaaat

SEQ ID NO: 3602344 - DNA, 20 bp, Homo sapiens
tcaagtaaaacaaatgaaat

SEQ ID NO: 3602345 - DNA, 15 bp, Homo sapiens
tcaagtaaaagaaaa

SEQ ID NO: 3602346 - DNA, 19 bp, Homo sapiens
tcaagtaatccacctgcct

SEQ ID NO: 3602347 - DNA, 16 bp, Homo sapiens
tcaagtattaagcagt

SEQ ID NO: 3602348 - DNA, 17 bp, Homo sapiens
tcaagtattaagcagtt

SEQ ID NO: 3602349 - DNA, 12 bp, Homo sapiens
tcaagtattttg

SEQ ID NO: 3602350 - DNA, 21 bp, Homo sapiens
tcaagtgactctcctgcctca

SEQ ID NO: 3602351 - DNA, 15 bp, Homo sapiens
tcaataaatttgctt

SEQ ID NO: 3602352 - DNA, 14 bp, Homo sapiens
tcaatatcctttgc

SEQ ID NO: 3602353 - DNA, 17 bp, Homo sapiens
tcaatatgcaagcagct

SEQ ID NO: 3602354 - DNA, 17 bp, Homo sapiens
tcaatcaagccatgtat

SEQ ID NO: 3602355 - DNA, 18 bp, Homo sapiens
tcaatctcaattgctttg

SEQ ID NO: 3602356 - DNA, 15 bp, Homo sapiens
tcaatcttttaaatt

SEQ ID NO: 3602357 - DNA, 14 bp, Homo sapiens
tcaatgcccagtaa

SEQ ID NO: 3602358 - DNA, 17 bp, Homo sapiens
tcaatgcccagtaaaat

SEQ ID NO: 3602359 - DNA, 23 bp, Homo sapiens
tcaatgcccagtaaaatttcagg

SEQ ID NO: 3602360 - DNA, 17 bp, Homo sapiens
tcaatgcttaggagaca

SEQ ID NO: 3602361 - DNA, 17 bp, Homo sapiens
tcaatgtacttgtttga

SEQ ID NO: 3602362 - DNA, 19 bp, Homo sapiens
tcaattaaacggattattt

SEQ ID NO: 3602363 - DNA, 21 bp, Homo sapiens
tcaattaaacggattattttt

SEQ ID NO: 3602364 - DNA, 14 bp, Homo sapiens
tcaattgctttgta

SEQ ID NO: 3602365 - DNA, 19 bp, Homo sapiens
tcaattgtttatatggata

SEQ ID NO: 3602366 - DNA, 22 bp, Homo sapiens
tcaattttatccctcacctgta

SEQ ID NO: 3602367 - DNA, 19 bp, Homo sapiens
tcaattttttttccgtaaa

SEQ ID NO: 3602368 - DNA, 15 bp, Homo sapiens
tcacaaaatatcacc

SEQ ID NO: 3602369 - DNA, 16 bp, Homo sapiens
tcacaaagcccaaggg

SEQ ID NO: 3602370 - DNA, 16 bp, Homo sapiens
tcacaacaacctggtc

SEQ ID NO: 3602371 - DNA, 14 bp, Homo sapiens
tcacaagcctcctg

SEQ ID NO: 3602372 - DNA, 15 bp, Homo sapiens
tcacaaggcccagga

SEQ ID NO: 3602373 - DNA, 21 bp, Homo sapiens
tcacaagttctatttcttgaa

SEQ ID NO: 3602374 - DNA, 16 bp, Homo sapiens
tcacacccatttaaaa

SEQ ID NO: 3602375 - DNA, 13 bp, Homo sapiens
tcacacccctgtc

SEQ ID NO: 3602376 - DNA, 15 bp, Homo sapiens
tcacacccctgtccc

SEQ ID NO: 3602377 - DNA, 19 bp, Homo sapiens
tcacacgaggggccccgtg

SEQ ID NO: 3602378 - DNA, 21 bp, Homo sapiens
tcacagaacccttggagccaa

SEQ ID NO: 3602379 - DNA, 18 bp, Homo sapiens
tcacagatgcatatagac

SEQ ID NO: 3602380 - DNA, 19 bp, Homo sapiens
tcacagatgcatatagaca

SEQ ID NO: 3602381 - DNA, 21 bp, Homo sapiens
tcacagatgcatatagacaca

SEQ ID NO: 3602382 - DNA, 23 bp, Homo sapiens
tcacagatgcatatagacacaca

SEQ ID NO: 3602383 - DNA, 16 bp, Homo sapiens
tcacaggactctgcct

SEQ ID NO: 3602384 - DNA, 19 bp, Homo sapiens
tcacaggactctgcctcct

SEQ ID NO: 3602385 - DNA, 17 bp, Homo sapiens
tcacaggccttgctttt

SEQ ID NO: 3602386 - DNA, 23 bp, Homo sapiens
tcacagggaatggccacaaacct

SEQ ID NO: 3602387 - DNA, 16 bp, Homo sapiens
tcacaggtgactctaa

SEQ ID NO: 3602388 - DNA, 20 bp, Homo sapiens
tcacaggttttcagagaatt

SEQ ID NO: 3602389 - DNA, 13 bp, Homo sapiens
tcacatctcaggg

SEQ ID NO: 3602390 - DNA, 18 bp, Homo sapiens
tcacatgagtcaaaacaa

SEQ ID NO: 3602391 - DNA, 17 bp, Homo sapiens
tcacatggctctcatgt

SEQ ID NO: 3602392 - DNA, 17 bp, Homo sapiens
tcaccaagcaagtccct

SEQ ID NO: 3602393 - DNA, 23 bp, Homo sapiens
tcaccaagcaagtcccttcagac

SEQ ID NO: 3602394 - DNA, 14 bp, Homo sapiens
tcaccagagacttt

SEQ ID NO: 3602395 - DNA, 15 bp, Homo sapiens
tcaccagagacttta

SEQ ID NO: 3602396 - DNA, 14 bp, Homo sapiens
tcaccaggggagga

SEQ ID NO: 3602397 - DNA, 16 bp, Homo sapiens
tcaccaggggaggagc

SEQ ID NO: 3602398 - DNA, 18 bp, Homo sapiens
tcaccaggggaggagcct

SEQ ID NO: 3602399 - DNA, 15 bp, Homo sapiens
tcaccatgatgtgaa

SEQ ID NO: 3602400 - DNA, 14 bp, Homo sapiens
tcacccatcctagg

SEQ ID NO: 3602401 - DNA, 20 bp, Homo sapiens
tcacccatcctaggaaccag

SEQ ID NO: 3602402 - DNA, 13 bp, Homo sapiens
tcacccccagctt

SEQ ID NO: 3602403 - DNA, 15 bp, Homo sapiens
tcacccccctctgct

SEQ ID NO: 3602404 - DNA, 21 bp, Homo sapiens
tccatgcaactggagttcctt

SEQ ID NO: 3602405 - DNA, 16 bp, Homo sapiens
tccatgtcgcctctgc

SEQ ID NO: 3602406 - DNA, 17 bp, Homo sapiens
tccatgtcgcctctgca

SEQ ID NO: 3602407 - DNA, 13 bp, Homo sapiens
tccatgtgccttt

SEQ ID NO: 3602408 - DNA, 22 bp, Homo sapiens
tccatgtgcctttctttgcctc

SEQ ID NO: 3602409 - DNA, 17 bp, Homo sapiens
tccattaaaaagttgtt

SEQ ID NO: 3602410 - DNA, 14 bp, Homo sapiens
tccattacaccaca

SEQ ID NO: 3602411 - DNA, 15 bp, Homo sapiens
tccattacaccacag

SEQ ID NO: 3602412 - DNA, 23 bp, Homo sapiens
tccattatgactgttgttcttat

SEQ ID NO: 3602413 - DNA, 15 bp, Homo sapiens
tccattcacaagcct

SEQ ID NO: 3602414 - DNA, 19 bp, Homo sapiens
tccattcacaagcctcctg

SEQ ID NO: 3602415 - DNA, 19 bp, Homo sapiens
tccattctacctgtcctcc

SEQ ID NO: 3602416 - DNA, 15 bp, Homo sapiens
tccatttcaggactc

SEQ ID NO: 3602417 - DNA, 12 bp, Homo sapiens
tccatttcctaa

SEQ ID NO: 3602418 - DNA, 13 bp, Homo sapiens
tccattttataaa

SEQ ID NO: 3602419 - DNA, 16 bp, Homo sapiens
tcccaaactgacaatt

SEQ ID NO: 3602420 - DNA, 21 bp, Homo sapiens
tcccaacttctcttgctttct

SEQ ID NO: 3602421 - DNA, 15 bp, Homo sapiens
tcccaacttcttcct

SEQ ID NO: 3602422 - DNA, 14 bp, Homo sapiens
tcccaacttgtaaa

SEQ ID NO: 3602423 - DNA, 17 bp, Homo sapiens
tcccaatttcagactcc

SEQ ID NO: 3602424 - DNA, 22 bp, Homo sapiens
tcccacactgtgcagacccagt

SEQ ID NO: 3602425 - DNA, 20 bp, Homo sapiens
tcccacagcagccccaggag

SEQ ID NO: 3602426 - DNA, 13 bp, Homo sapiens
tcccacaggaggg

SEQ ID NO: 3602427 - DNA, 14 bp, Homo sapiens
tcccacaggagggc

SEQ ID NO: 3602428 - DNA, 17 bp, Homo sapiens
tcccacaggagggccag

SEQ ID NO: 3602429 - DNA, 19 bp, Homo sapiens
tcccaccaaccctcagagc

SEQ ID NO: 3602430 - DNA, 18 bp, Homo sapiens
tcccaccaacctccagtg

SEQ ID NO: 3602431 - DNA, 19 bp, Homo sapiens
tcccaccagagccgggagg

SEQ ID NO: 3602432 - DNA, 19 bp, Homo sapiens
tcccaccattcctgccttt

SEQ ID NO: 3602433 - DNA, 22 bp, Homo sapiens
tcccacccacacagctgcccta

SEQ ID NO: 3602434 - DNA, 23 bp, Homo sapiens
tcccacccacacagctgccctag

SEQ ID NO: 3602435 - DNA, 12 bp, Homo sapiens
tcccacccaccg

SEQ ID NO: 3602436 - DNA, 20 bp, Homo sapiens
tcccacctctccttttgagg

SEQ ID NO: 3602437 - DNA, 13 bp, Homo sapiens
tcccacctgacac

SEQ ID NO: 3602438 - DNA, 12 bp, Homo sapiens
tcccaccttccc

SEQ ID NO: 3602439 - DNA, 14 bp, Homo sapiens
tcccaccttcccac

SEQ ID NO: 3602440 - DNA, 15 bp, Homo sapiens
tcccaccttcccacc

SEQ ID NO: 3602441 - DNA, 18 bp, Homo sapiens
tcccacgagggtgccgtg

SEQ ID NO: 3602442 - DNA, 21 bp, Homo sapiens
tcccacgcctcaccagccccc

SEQ ID NO: 3602443 - DNA, 23 bp, Homo sapiens
tcccactctgggcaaagcccctc

SEQ ID NO: 3602444 - DNA, 11 bp, Homo sapiens
tcccagaacct

SEQ ID NO: 3602445 - DNA, 12 bp, Homo sapiens
tcccagaacctc

SEQ ID NO: 3602446 - DNA, 15 bp, Homo sapiens
tcccagcatccctgg

SEQ ID NO: 3602447 - DNA, 21 bp, Homo sapiens
tcccagcatccctggagcagg

SEQ ID NO: 3602448 - DNA, 15 bp, Homo sapiens
tcccagcgctgctgg

SEQ ID NO: 3602449 - DNA, 15 bp, Homo sapiens
tcccagctctagcct

SEQ ID NO: 3602450 - DNA, 22 bp, Homo sapiens
tcccagctctagcctctggact

SEQ ID NO: 3602451 - DNA, 15 bp, Homo sapiens
tcccagctgaaggca

SEQ ID NO: 3602452 - DNA, 11 bp, Homo sapiens
tcccaggaccc

SEQ ID NO: 3602453 - DNA, 13 bp, Homo sapiens
tcccaggaccctg

SEQ ID NO: 3602454 - DNA, 16 bp, Homo sapiens
tcccaggaccctgaag

SEQ ID NO: 3602455 - DNA, 22 bp, Homo sapiens
tcccaggagacagttcaagaaa

SEQ ID NO: 3602456 - DNA, 18 bp, Homo sapiens
tcccaggcactgtactaa

SEQ ID NO: 3602457 - DNA, 16 bp, Homo sapiens
tcccaggcgccccttc

SEQ ID NO: 3602458 - DNA, 20 bp, Homo sapiens
tcccaggcgccccttccccc

SEQ ID NO: 3602459 - DNA, 21 bp, Homo sapiens
tcccaggcgccccttccccct

SEQ ID NO: 3602460 - DNA, 17 bp, Homo sapiens
tcccagggagaaaccca

SEQ ID NO: 3602461 - DNA, 20 bp, Homo sapiens
tcccaggttcccccagcaag

SEQ ID NO: 3602462 - DNA, 14 bp, Homo sapiens
tcccagtgacaaca

SEQ ID NO: 3602463 - DNA, 13 bp, Homo sapiens
tcccatcctgggg

SEQ ID NO: 3602464 - DNA, 14 bp, Homo sapiens
tcccatcggaagtt

SEQ ID NO: 3602465 - DNA, 18 bp, Homo sapiens
tcccattatatttattgt

SEQ ID NO: 3602466 - DNA, 13 bp, Homo sapiens
tcccattcctgaa

SEQ ID NO: 3602467 - DNA, 13 bp, Homo sapiens
tcccattgtccct

SEQ ID NO: 3602468 - DNA, 17 bp, Homo sapiens
tcccattgtccctctgc

SEQ ID NO: 3602469 - DNA, 18 bp, Homo sapiens
tcccattgtccctctgcc

SEQ ID NO: 3602470 - DNA, 21 bp, Homo sapiens
tcccattgtccctctgcccca

SEQ ID NO: 3602471 - DNA, 13 bp, Homo sapiens
tccccaacccctc

SEQ ID NO: 3602472 - DNA, 15 bp, Homo sapiens
tccccaacccctctc

SEQ ID NO: 3602473 - DNA, 16 bp, Homo sapiens
tccccaacccctctcc

SEQ ID NO: 3602474 - DNA, 24 bp, Homo sapiens
tccccaacccctctccaggcctgt

SEQ ID NO: 3602475 - DNA, 12 bp, Homo sapiens
tccccaaggctg

SEQ ID NO: 3602476 - DNA, 13 bp, Homo sapiens
tccccaaggctgc

SEQ ID NO: 3602477 - DNA, 13 bp, Homo sapiens
tccccaagggccc

SEQ ID NO: 3602478 - DNA, 16 bp, Homo sapiens
tccccaagggccctgg

SEQ ID NO: 3602479 - DNA, 17 bp, Homo sapiens
tccccaagggccctggc

SEQ ID NO: 3602480 - DNA, 20 bp, Homo sapiens
tccccaagggccctggcacc

SEQ ID NO: 3602481 - DNA, 18 bp, Homo sapiens
tccccaccatctgctgtc

SEQ ID NO: 3602482 - DNA, 20 bp, Homo sapiens
tccccagacttctctttctt

SEQ ID NO: 3602483 - DNA, 23 bp, Homo sapiens
tccccagagaaaggggagcccac

SEQ ID NO: 3602484 - DNA, 17 bp, Homo sapiens
tccccagagctgtgcca

SEQ ID NO: 3602485 - DNA, 19 bp, Homo sapiens
tccccagcatgcaccacgg

SEQ ID NO: 3602486 - DNA, 20 bp, Homo sapiens
tccccagcatgcaccacggg

SEQ ID NO: 3602487 - DNA, 13 bp, Homo sapiens
tccccagccagcc

SEQ ID NO: 3602488 - DNA, 15 bp, Homo sapiens
tccccagccagccct

SEQ ID NO: 3602489 - DNA, 19 bp, Homo sapiens
tccccagccagcccttccc

SEQ ID NO: 3602490 - DNA, 22 bp, Homo sapiens
tccccagccagcccttccctgg

SEQ ID NO: 3602491 - DNA, 13 bp, Homo sapiens
tccccagcccaga

SEQ ID NO: 3602492 - DNA, 14 bp, Homo sapiens
tccccagcccagag

SEQ ID NO: 3602493 - DNA, 22 bp, Homo sapiens
tccccagcccagcaccccttcc

SEQ ID NO: 3602494 - DNA, 14 bp, Homo sapiens
tccccagctccagc

SEQ ID NO: 3602495 - DNA, 18 bp, Homo sapiens
tccccaggaggcctgggc

SEQ ID NO: 3602496 - DNA, 16 bp, Homo sapiens
tccccaggcacctcac

SEQ ID NO: 3602497 - DNA, 17 bp, Homo sapiens
tccccagggagctctgg

SEQ ID NO: 3602498 - DNA, 20 bp, Homo sapiens
tccccagtagctgggattac

SEQ ID NO: 3602499 - DNA, 21 bp, Homo sapiens
tccccagtagctgggattaca

SEQ ID NO: 3602500 - DNA, 19 bp, Homo sapiens
tccccagtgactccagggt

SEQ ID NO: 3602501 - DNA, 16 bp, Homo sapiens
tccccatatataaatt

SEQ ID NO: 3602502 - DNA, 17 bp, Homo sapiens
tccccatatataaatta

SEQ ID NO: 3602503 - DNA, 19 bp, Homo sapiens
tccccatatataaattatt

SEQ ID NO: 3602504 - DNA, 22 bp, Homo sapiens
tccccatatataaattattact

SEQ ID NO: 3602505 - DNA, 17 bp, Homo sapiens
tccccattcttcctagt

SEQ ID NO: 3602506 - DNA, 16 bp, Homo sapiens
tcccccaccactcagg

SEQ ID NO: 3602507 - DNA, 13 bp, Homo sapiens
tcccccagccact

SEQ ID NO: 3602508 - DNA, 13 bp, Homo sapiens
tcccccccatgca

SEQ ID NO: 3602509 - DNA, 19 bp, Homo sapiens
tcccccgtttctccttttc

SEQ ID NO: 3602510 - DNA, 15 bp, Homo sapiens
tcccccttcacaaag

SEQ ID NO: 3602511 - DNA, 22 bp, Homo sapiens
tcccccttcatccatcctgagc

SEQ ID NO: 3602512 - DNA, 14 bp, Homo sapiens
tccccgcacccccc

SEQ ID NO: 3602513 - DNA, 20 bp, Homo sapiens
tccccgcagtgtgcactaag

SEQ ID NO: 3602514 - DNA, 20 bp, Homo sapiens
tccccgctcaggggcctgga

SEQ ID NO: 3602515 - DNA, 22 bp, Homo sapiens
tccccgctcaggggcctggagg

SEQ ID NO: 3602516 - DNA, 15 bp, Homo sapiens
tccccgtctctgccc

SEQ ID NO: 3602517 - DNA, 18 bp, Homo sapiens
tccccgtctctgccctgg

SEQ ID NO: 3602518 - DNA, 19 bp, Homo sapiens
tccccgtctctgccctggg

SEQ ID NO: 3602519 - DNA, 17 bp, Homo sapiens
tcccctaaagccaggct

SEQ ID NO: 3602520 - DNA, 15 bp, Homo sapiens
tcccctatgctggta

SEQ ID NO: 3602521 - DNA, 13 bp, Homo sapiens
tcccctccttggc

SEQ ID NO: 3602522 - DNA, 16 bp, Homo sapiens
tcccctctccttcctg

SEQ ID NO: 3602523 - DNA, 18 bp, Homo sapiens
tcccctctcgccccatcc

SEQ ID NO: 3602524 - DNA, 15 bp, Homo sapiens
tcccctgggccctga

SEQ ID NO: 3602525 - DNA, 12 bp, Homo sapiens
tccccttccctt

SEQ ID NO: 3602526 - DNA, 14 bp, Homo sapiens
tccccttcctgttt

SEQ ID NO: 3602527 - DNA, 12 bp, Homo sapiens
tccccttctctg

SEQ ID NO: 3602528 - DNA, 21 bp, Homo sapiens
tcccgcacatggtgtgggggg

SEQ ID NO: 3602529 - DNA, 17 bp, Homo sapiens
tcccgccccgcccctcc

SEQ ID NO: 3602530 - DNA, 18 bp, Homo sapiens
tcccgcctccctctcaga

SEQ ID NO: 3602531 - DNA, 15 bp, Homo sapiens
tcccgctcagccctc

SEQ ID NO: 3602532 - DNA, 9 bp, Homo sapiens
tcccgctcc

SEQ ID NO: 3602533 - DNA, 22 bp, Homo sapiens
tcccggagaggtggccgccatg

SEQ ID NO: 3602534 - DNA, 19 bp, Homo sapiens
tcccggccagctctggagt

SEQ ID NO: 3602535 - DNA, 18 bp, Homo sapiens
tcccgtctggacctgggg

SEQ ID NO: 3602536 - DNA, 14 bp, Homo sapiens
tccctaaactgcag

SEQ ID NO: 3602537 - DNA, 11 bp, Homo sapiens
tctctccagga

SEQ ID NO: 3602538 - DNA, 17 bp, Homo sapiens
tctctccaggtcagcct

SEQ ID NO: 3602539 - DNA, 16 bp, Homo sapiens
tctctccccatatata

SEQ ID NO: 3602540 - DNA, 20 bp, Homo sapiens
tctctccccatatataaatt

SEQ ID NO: 3602541 - DNA, 15 bp, Homo sapiens
tctctcctctctgct

SEQ ID NO: 3602542 - DNA, 13 bp, Homo sapiens
tctctccttggcc

SEQ ID NO: 3602543 - DNA, 14 bp, Homo sapiens
tctctccttggcca

SEQ ID NO: 3602544 - DNA, 14 bp, Homo sapiens
tctctctgcccaac

SEQ ID NO: 3602545 - DNA, 14 bp, Homo sapiens
tctctcttctgcct

SEQ ID NO: 3602546 - DNA, 18 bp, Homo sapiens
tctctctttaaccctccc

SEQ ID NO: 3602547 - DNA, 11 bp, Homo sapiens
tctctcttttg

SEQ ID NO: 3602548 - DNA, 23 bp, Homo sapiens
tctctgaatgagcctttgtgctt

SEQ ID NO: 3602549 - DNA, 15 bp, Homo sapiens
tctctgactgctttg

SEQ ID NO: 3602550 - DNA, 15 bp, Homo sapiens
tctctgagtcaaatc

SEQ ID NO: 3602551 - DNA, 18 bp, Homo sapiens
tctctgagtcaaatccag

SEQ ID NO: 3602552 - DNA, 21 bp, Homo sapiens
tctctgattagttgacagtat

SEQ ID NO: 3602553 - DNA, 20 bp, Homo sapiens
tctctgattttcaaagcttt

SEQ ID NO: 3602554 - DNA, 14 bp, Homo sapiens
tctctgcagcccat

SEQ ID NO: 3602555 - DNA, 20 bp, Homo sapiens
tctctgcaggcagcctgcct

SEQ ID NO: 3602556 - DNA, 13 bp, Homo sapiens
tctctgcagtaaa

SEQ ID NO: 3602557 - DNA, 14 bp, Homo sapiens
tctctgcagtaaaa

SEQ ID NO: 3602558 - DNA, 20 bp, Homo sapiens
tctctgcatttaaaaaaatc

SEQ ID NO: 3602559 - DNA, 13 bp, Homo sapiens
tctctgccccagc

SEQ ID NO: 3602560 - DNA, 14 bp, Homo sapiens
tctctgccccagcc

SEQ ID NO: 3602561 - DNA, 14 bp, Homo sapiens
tctctgcctcacct

SEQ ID NO: 3602562 - DNA, 12 bp, Homo sapiens
tctctggctggg

SEQ ID NO: 3602563 - DNA, 15 bp, Homo sapiens
tctctgggagcccag

SEQ ID NO: 3602564 - DNA, 20 bp, Homo sapiens
tctctgggagcccagaaccc

SEQ ID NO: 3602565 - DNA, 19 bp, Homo sapiens
tctctgggtctgattttct

SEQ ID NO: 3602566 - DNA, 17 bp, Homo sapiens
tctctggtaatattgac

SEQ ID NO: 3602567 - DNA, 13 bp, Homo sapiens
tctctgtctactc

SEQ ID NO: 3602568 - DNA, 22 bp, Homo sapiens
tctctgttggtctgccttctgc

SEQ ID NO: 3602569 - DNA, 18 bp, Homo sapiens
tctcttaaatataacact

SEQ ID NO: 3602570 - DNA, 15 bp, Homo sapiens
tctcttaagtggtct

SEQ ID NO: 3602571 - DNA, 13 bp, Homo sapiens
tctcttatgcatt

SEQ ID NO: 3602572 - DNA, 19 bp, Homo sapiens
tctcttccccttagaaaca

SEQ ID NO: 3602573 - DNA, 14 bp, Homo sapiens
tctcttctccactg

SEQ ID NO: 3602574 - DNA, 13 bp, Homo sapiens
tctcttctttaaa

SEQ ID NO: 3602575 - DNA, 20 bp, Homo sapiens
tctcttgaaaagttcaggga

SEQ ID NO: 3602576 - DNA, 23 bp, Homo sapiens
tctcttgaaaagttcagggaccg

SEQ ID NO: 3602577 - DNA, 15 bp, Homo sapiens
tctctttcatgagtt

SEQ ID NO: 3602578 - DNA, 14 bp, Homo sapiens
tctctttcttattt

SEQ ID NO: 3602579 - DNA, 13 bp, Homo sapiens
tctcttttctttc

SEQ ID NO: 3602580 - DNA, 16 bp, Homo sapiens
tctgaaaaagacataa

SEQ ID NO: 3602581 - DNA, 12 bp, Homo sapiens
tctgaaaacaag

SEQ ID NO: 3602582 - DNA, 11 bp, Homo sapiens
tctgaaactgg

SEQ ID NO: 3602583 - DNA, 13 bp, Homo sapiens
tctgaaactggct

SEQ ID NO: 3602584 - DNA, 15 bp, Homo sapiens
tctgaaactggcttc

SEQ ID NO: 3602585 - DNA, 14 bp, Homo sapiens
tctgaaaggccagc

SEQ ID NO: 3602586 - DNA, 21 bp, Homo sapiens
tctgaaaggccagcagctgat

SEQ ID NO: 3602587 - DNA, 22 bp, Homo sapiens
tctgaactgaccttgaatcttt

SEQ ID NO: 3602588 - DNA, 13 bp, Homo sapiens
tctgaagatcaga

SEQ ID NO: 3602589 - DNA, 23 bp, Homo sapiens
tctgaagatcagaacattcagct

SEQ ID NO: 3602590 - DNA, 14 bp, Homo sapiens
tctgaagctgctgc

SEQ ID NO: 3602591 - DNA, 16 bp, Homo sapiens
tctgaagtctgagccc

SEQ ID NO: 3602592 - DNA, 18 bp, Homo sapiens
tctgaagtctgagcccat

SEQ ID NO: 3602593 - DNA, 20 bp, Homo sapiens
tctgaagtctgagcccattt

SEQ ID NO: 3602594 - DNA, 13 bp, Homo sapiens
tctgaataacttg

SEQ ID NO: 3602595 - DNA, 20 bp, Homo sapiens
tctgaatgaaaataactgaa

SEQ ID NO: 3602596 - DNA, 18 bp, Homo sapiens
tctgaatgagcctttgtg

SEQ ID NO: 3602597 - DNA, 19 bp, Homo sapiens
tctgacaactgtgaagcca

SEQ ID NO: 3602598 - DNA, 13 bp, Homo sapiens
tctgacatccctt

SEQ ID NO: 3602599 - DNA, 16 bp, Homo sapiens
tctgacatcccttcct

SEQ ID NO: 3602600 - DNA, 20 bp, Homo sapiens
tctgacatcccttcctggaa

SEQ ID NO: 3602601 - DNA, 16 bp, Homo sapiens
tctgaccagcagcgcc

SEQ ID NO: 3602602 - DNA, 17 bp, Homo sapiens
tctgaccagcagcgcct

SEQ ID NO: 3602603 - DNA, 14 bp, Homo sapiens
tctgacccagtgcc

SEQ ID NO: 3602604 - DNA, 23 bp, Homo sapiens
tctgacccttacagcctctgact

SEQ ID NO: 3602605 - DNA, 16 bp, Homo sapiens
tctgacctcttggcca

SEQ ID NO: 3602606 - DNA, 14 bp, Homo sapiens
tctgaccttaaatg

SEQ ID NO: 3602607 - DNA, 12 bp, Homo sapiens
tctgactccaaa

SEQ ID NO: 3602608 - DNA, 13 bp, Homo sapiens
tctgactgccaag

SEQ ID NO: 3602609 - DNA, 14 bp, Homo sapiens
tctgactgccaagc

SEQ ID NO: 3602610 - DNA, 19 bp, Homo sapiens
tctgactgccaagccagat

SEQ ID NO: 3602611 - DNA, 20 bp, Homo sapiens
tctgacttaagctgcctcaa

SEQ ID NO: 3602612 - DNA, 15 bp, Homo sapiens
tctgagaaagactat

SEQ ID NO: 3602613 - DNA, 14 bp, Homo sapiens
tctgagatgccccg

SEQ ID NO: 3602614 - DNA, 15 bp, Homo sapiens
tctgagcaggtacat

SEQ ID NO: 3602615 - DNA, 22 bp, Homo sapiens
tctgagcaggtacatttctgat

SEQ ID NO: 3602616 - DNA, 14 bp, Homo sapiens
tctgagcccatttc

SEQ ID NO: 3602617 - DNA, 14 bp, Homo sapiens
tctgaggacaagag

SEQ ID NO: 3602618 - DNA, 17 bp, Homo sapiens
tctgaggacaagagaaa

SEQ ID NO: 3602619 - DNA, 12 bp, Homo sapiens
tctgaggccaga

SEQ ID NO: 3602620 - DNA, 15 bp, Homo sapiens
tctgaggccagaaag

SEQ ID NO: 3602621 - DNA, 17 bp, Homo sapiens
tctgaggccagaaaggt

SEQ ID NO: 3602622 - DNA, 23 bp, Homo sapiens
tctgaggggtgggggtgccgctg

SEQ ID NO: 3602623 - DNA, 18 bp, Homo sapiens
tctgaggtgacttaaaaa

SEQ ID NO: 3602624 - DNA, 17 bp, Homo sapiens
tctgagtcaaatccagt

SEQ ID NO: 3602625 - DNA, 19 bp, Homo sapiens
tctgagtcaaatccagtgg

SEQ ID NO: 3602626 - DNA, 21 bp, Homo sapiens
tctgagtcaaatccagtggtg

SEQ ID NO: 3602627 - DNA, 22 bp, Homo sapiens
tctgagtcaaatccagtggtgg

SEQ ID NO: 3602628 - DNA, 13 bp, Homo sapiens
tctgatgaatctc

SEQ ID NO: 3602629 - DNA, 17 bp, Homo sapiens
tctgatgtactctaaat

SEQ ID NO: 3602630 - DNA, 12 bp, Homo sapiens
tctgattctgat

SEQ ID NO: 3602631 - DNA, 20 bp, Homo sapiens
tctgattgctatcagcaatg

SEQ ID NO: 3602632 - DNA, 21 bp, Homo sapiens
tctgcacagacaagcagccct

SEQ ID NO: 3602633 - DNA, 22 bp, Homo sapiens
tctgcacagacaagcagccctt

SEQ ID NO: 3602634 - DNA, 17 bp, Homo sapiens
tctgcaccaccatgccc

SEQ ID NO: 3602635 - DNA, 15 bp, Homo sapiens
tctgcacccagaaca

SEQ ID NO: 3602636 - DNA, 15 bp, Homo sapiens
tctgcacgctcaatg

SEQ ID NO: 3602637 - DNA, 20 bp, Homo sapiens
tctgcactcctttatctgta

SEQ ID NO: 3602638 - DNA, 21 bp, Homo sapiens
tctgcactcctttatctgtaa

SEQ ID NO: 3602639 - DNA, 19 bp, Homo sapiens
tctgcactgaggatttctt

SEQ ID NO: 3602640 - DNA, 15 bp, Homo sapiens
tctgcagaaacagaa

SEQ ID NO: 3602641 - DNA, 22 bp, Homo sapiens
tctgcagctcaagggctggcac

SEQ ID NO: 3602642 - DNA, 23 bp, Homo sapiens
tctgcaggcctaggtgcagctcc

SEQ ID NO: 3602643 - DNA, 16 bp, Homo sapiens
tctgcagtctcatttc

SEQ ID NO: 3602644 - DNA, 19 bp, Homo sapiens
tctgcatcagctgctgaaa

SEQ ID NO: 3602645 - DNA, 21 bp, Homo sapiens
tctgcatcagctgctgaaaca

SEQ ID NO: 3602646 - DNA, 15 bp, Homo sapiens
tctgcatttcggtgg

SEQ ID NO: 3602647 - DNA, 18 bp, Homo sapiens
tctgcatttcggtggcta

SEQ ID NO: 3602648 - DNA, 19 bp, Homo sapiens
tctgcatttcggtggctag

SEQ ID NO: 3602649 - DNA, 16 bp, Homo sapiens
tctgccaataaattct

SEQ ID NO: 3602650 - DNA, 18 bp, Homo sapiens
tctgccagttacttgggc

SEQ ID NO: 3602651 - DNA, 22 bp, Homo sapiens
tctgccagttacttgggcttca

SEQ ID NO: 3602652 - DNA, 12 bp, Homo sapiens
tctgcccaaccc

SEQ ID NO: 3602653 - DNA, 19 bp, Homo sapiens
tctgccccatcctccagca

SEQ ID NO: 3602654 - DNA, 21 bp, Homo sapiens
tctgccccatcctccagcagg

SEQ ID NO: 3602655 - DNA, 13 bp, Homo sapiens
tctgccccctccc

SEQ ID NO: 3602656 - DNA, 20 bp, Homo sapiens
tctgccggtcgggcagccag

SEQ ID NO: 3602657 - DNA, 19 bp, Homo sapiens
tctgcctagagtgtagcct

SEQ ID NO: 3602658 - DNA, 12 bp, Homo sapiens
tctgcctcacct

SEQ ID NO: 3602659 - DNA, 17 bp, Homo sapiens
tctgcctgccagctgca

SEQ ID NO: 3602660 - DNA, 23 bp, Homo sapiens
tctgcctggagacaaggtgctaa

SEQ ID NO: 3602661 - DNA, 11 bp, Homo sapiens
tctgcctgggc

SEQ ID NO: 3602662 - DNA, 23 bp, Homo sapiens
tctgcctgggccgtggcacagct

SEQ ID NO: 3602663 - DNA, 14 bp, Homo sapiens
tctgcctgggctct

SEQ ID NO: 3602664 - DNA, 13 bp, Homo sapiens
tctgccttctgct

SEQ ID NO: 3602665 - DNA, 14 bp, Homo sapiens
tctgccttctgctg

SEQ ID NO: 3602666 - DNA, 11 bp, Homo sapiens
tctgccttttc

SEQ ID NO: 3602667 - DNA, 21 bp, Homo sapiens
tctgcgctgtgtacaatgtga

SEQ ID NO: 3602668 - DNA, 20 bp, Homo sapiens
tctgcgtcggtcctggtgcc

SEQ ID NO: 3602669 - DNA, 14 bp, Homo sapiens
tctgctcagcttct

SEQ ID NO: 3602670 - DNA, 15 bp, Homo sapiens
tctgctcagcttctc

SEQ ID NO: 3602671 - DNA, 21 bp, Homo sapiens
tgacttcagtgaatatttttg

SEQ ID NO: 3602672 - DNA, 23 bp, Homo sapiens
tgacttctaagtaaaaccacagc

SEQ ID NO: 3602673 - DNA, 15 bp, Homo sapiens
tgagaaagactattc

SEQ ID NO: 3602674 - DNA, 17 bp, Homo sapiens
tgagaaccagtctcctc

SEQ ID NO: 3602675 - DNA, 23 bp, Homo sapiens
tgagaatctatatttaacaagat

SEQ ID NO: 3602676 - DNA, 17 bp, Homo sapiens
tgagaatggcctggagc

SEQ ID NO: 3602677 - DNA, 20 bp, Homo sapiens
tgagaatggcctggagcagg

SEQ ID NO: 3602678 - DNA, 23 bp, Homo sapiens
tgagaatggcctggagcaggccc

SEQ ID NO: 3602679 - DNA, 22 bp, Homo sapiens
tgagacaggtgcctaacctggg

SEQ ID NO: 3602680 - DNA, 10 bp, Homo sapiens
tgagacatcc

SEQ ID NO: 3602681 - DNA, 12 bp, Homo sapiens
tgagacatccag

SEQ ID NO: 3602682 - DNA, 23 bp, Homo sapiens
tgagaccccaaagactctggagg

SEQ ID NO: 3602683 - DNA, 15 bp, Homo sapiens
tgagactcctcagca

SEQ ID NO: 3602684 - DNA, 16 bp, Homo sapiens
tgagactcctcagcac

SEQ ID NO: 3602685 - DNA, 21 bp, Homo sapiens
tgagactcctcagcacccctc

SEQ ID NO: 3602686 - DNA, 17 bp, Homo sapiens
tgagagaaagagagaag

SEQ ID NO: 3602687 - DNA, 21 bp, Homo sapiens
tgagagaaagagagaagccag

SEQ ID NO: 3602688 - DNA, 18 bp, Homo sapiens
tgagagaatgtggaaata

SEQ ID NO: 3602689 - DNA, 16 bp, Homo sapiens
tgagagaccctggcct

SEQ ID NO: 3602690 - DNA, 18 bp, Homo sapiens
tgagagaccctggcctca

SEQ ID NO: 3602691 - DNA, 17 bp, Homo sapiens
tgagagctttctgcctt

SEQ ID NO: 3602692 - DNA, 19 bp, Homo sapiens
tgagagctttctgccttag

SEQ ID NO: 3602693 - DNA, 22 bp, Homo sapiens
tgagagctttctgccttagcct

SEQ ID NO: 3602694 - DNA, 21 bp, Homo sapiens
tgagaggtgaaagcataacat

SEQ ID NO: 3602695 - DNA, 13 bp, Homo sapiens
tgagatactgtgt

SEQ ID NO: 3602696 - DNA, 15 bp, Homo sapiens
tgagatcaatgtgac

SEQ ID NO: 3602697 - DNA, 19 bp, Homo sapiens
tgagatgtgaacacatcag

SEQ ID NO: 3602698 - DNA, 12 bp, Homo sapiens
tgagattcaaga

SEQ ID NO: 3602699 - DNA, 19 bp, Homo sapiens
tgagattcaagacaagagc

SEQ ID NO: 3602700 - DNA, 20 bp, Homo sapiens
tgagcaaataaacttacaga

SEQ ID NO: 3602701 - DNA, 19 bp, Homo sapiens
tgagcaaatattaaaattg

SEQ ID NO: 3602702 - DNA, 15 bp, Homo sapiens
tgagcaaatgtggct

SEQ ID NO: 3602703 - DNA, 14 bp, Homo sapiens
tgagcacaaagaag

SEQ ID NO: 3602704 - DNA, 17 bp, Homo sapiens
tgagcacaaagaagaaa

SEQ ID NO: 3602705 - DNA, 19 bp, Homo sapiens
tgagcacaaagaagaaagc

SEQ ID NO: 3602706 - DNA, 20 bp, Homo sapiens
tgagcaccacacccagtggg

SEQ ID NO: 3602707 - DNA, 15 bp, Homo sapiens
tgagcacttagcagg

SEQ ID NO: 3602708 - DNA, 16 bp, Homo sapiens
tgagcagggtccacag

SEQ ID NO: 3602709 - DNA, 18 bp, Homo sapiens
tgagcagggtccacagct

SEQ ID NO: 3602710 - DNA, 20 bp, Homo sapiens
tgagcagggtccacagctgg

SEQ ID NO: 3602711 - DNA, 21 bp, Homo sapiens
tgagcagggtccacagctgga

SEQ ID NO: 3602712 - DNA, 20 bp, Homo sapiens
tgagcaggtacatttctgat

SEQ ID NO: 3602713 - DNA, 12 bp, Homo sapiens
tgagcagtgttg

SEQ ID NO: 3602714 - DNA, 22 bp, Homo sapiens
tgagcagtgttgcgtttttcct

SEQ ID NO: 3602715 - DNA, 18 bp, Homo sapiens
tgagcatggagacagcag

SEQ ID NO: 3602716 - DNA, 19 bp, Homo sapiens
tgagcatggagacagcagt

SEQ ID NO: 3602717 - DNA, 15 bp, Homo sapiens
tgagcatggggccag

SEQ ID NO: 3602718 - DNA, 15 bp, Homo sapiens
tgagcccctccccag

SEQ ID NO: 3602719 - DNA, 22 bp, Homo sapiens
tgagcccctccccagccagccc

SEQ ID NO: 3602720 - DNA, 14 bp, Homo sapiens
tgagcccctgggga

SEQ ID NO: 3602721 - DNA, 15 bp, Homo sapiens
tgagcctttgtgctt

SEQ ID NO: 3602722 - DNA, 22 bp, Homo sapiens
tgagcctttgtgctttttgtca

SEQ ID NO: 3602723 - DNA, 19 bp, Homo sapiens
tgagctggaaggggccacg

SEQ ID NO: 3602724 - DNA, 17 bp, Homo sapiens
tgaggaagagggactgt

SEQ ID NO: 3602725 - DNA, 20 bp, Homo sapiens
tgaggacaaccattccagac

SEQ ID NO: 3602726 - DNA, 22 bp, Homo sapiens
tgaggacaagagaaaaaagcca

SEQ ID NO: 3602727 - DNA, 23 bp, Homo sapiens
tgaggacttaaaatattcctgca

SEQ ID NO: 3602728 - DNA, 12 bp, Homo sapiens
tgaggagagagg

SEQ ID NO: 3602729 - DNA, 22 bp, Homo sapiens
tgaggagatgaccagggatgct

SEQ ID NO: 3602730 - DNA, 14 bp, Homo sapiens
tgaggataggacag

SEQ ID NO: 3602731 - DNA, 14 bp, Homo sapiens
tgaggatccagggc

SEQ ID NO: 3602732 - DNA, 21 bp, Homo sapiens
tgaggatccagggcagcaggc

SEQ ID NO: 3602733 - DNA, 23 bp, Homo sapiens
tgaggatccagggcagcaggcca

SEQ ID NO: 3602734 - DNA, 12 bp, Homo sapiens
tgaggcaaaaga

SEQ ID NO: 3602735 - DNA, 16 bp, Homo sapiens
tgaggccatctcagga

SEQ ID NO: 3602736 - DNA, 22 bp, Homo sapiens
tgaggccatctcaggagatgga

SEQ ID NO: 3602737 - DNA, 18 bp, Homo sapiens
tgaggcccagagagggaa

SEQ ID NO: 3602738 - DNA, 23 bp, Homo sapiens
tgaggcccagagagggaagatga

SEQ ID NO: 3602739 - DNA, 14 bp, Homo sapiens
tgaggcccctaggt

SEQ ID NO: 3602740 - DNA, 21 bp, Homo sapiens
tgaggcccctaggtgcccagg

SEQ ID NO: 3602741 - DNA, 20 bp, Homo sapiens
tgagggccaccggtgggcag

SEQ ID NO: 3602742 - DNA, 20 bp, Homo sapiens
tgagggccacctccacaccc

SEQ ID NO: 3602743 - DNA, 15 bp, Homo sapiens
tgaggggcaggtcta

SEQ ID NO: 3602744 - DNA, 19 bp, Homo sapiens
tgaggggccctggccagga

SEQ ID NO: 3602745 - DNA, 16 bp, Homo sapiens
tgagggggtaaagcag

SEQ ID NO: 3602746 - DNA, 16 bp, Homo sapiens
tgaggggtctcggatg

SEQ ID NO: 3602747 - DNA, 15 bp, Homo sapiens
tgagggtccacctgg

SEQ ID NO: 3602748 - DNA, 22 bp, Homo sapiens
tgagggtgactatggagctgag

SEQ ID NO: 3602749 - DNA, 12 bp, Homo sapiens
tgaggtcagtgt

SEQ ID NO: 3602750 - DNA, 15 bp, Homo sapiens
tgaggtcagtgtttg

SEQ ID NO: 3602751 - DNA, 13 bp, Homo sapiens
tgaggtccttatg

SEQ ID NO: 3602752 - DNA, 21 bp, Homo sapiens
tgaggtccttatgtcctgtca

SEQ ID NO: 3602753 - DNA, 16 bp, Homo sapiens
tgaggtctagagagaa

SEQ ID NO: 3602754 - DNA, 14 bp, Homo sapiens
tgaggtctgtttaa

SEQ ID NO: 3602755 - DNA, 17 bp, Homo sapiens
tgaggtctgtttaaagt

SEQ ID NO: 3602756 - DNA, 15 bp, Homo sapiens
tgaggtgaactccag

SEQ ID NO: 3602757 - DNA, 19 bp, Homo sapiens
tgaggtgaactccaggcat

SEQ ID NO: 3602758 - DNA, 20 bp, Homo sapiens
tgaggtgcaaggagtgtaaa

SEQ ID NO: 3602759 - DNA, 23 bp, Homo sapiens
tgagtaattcaagcctctaaaca

SEQ ID NO: 3602760 - DNA, 13 bp, Homo sapiens
tgagtagctggat

SEQ ID NO: 3602761 - DNA, 15 bp, Homo sapiens
tgagtcaaaacaaag

SEQ ID NO: 3602762 - DNA, 14 bp, Homo sapiens
tgagtcaaatccag

SEQ ID NO: 3602763 - DNA, 15 bp, Homo sapiens
tgagtcaaatccagt

SEQ ID NO: 3602764 - DNA, 22 bp, Homo sapiens
tgagtcaccctacctgtgcctg

SEQ ID NO: 3602765 - DNA, 16 bp, Homo sapiens
tgagtcacctgctcca

SEQ ID NO: 3602766 - DNA, 19 bp, Homo sapiens
tgagtcacctgctccagaa

SEQ ID NO: 3602767 - DNA, 23 bp, Homo sapiens
tgagtctgggatattctttagct

SEQ ID NO: 3602768 - DNA, 15 bp, Homo sapiens
tgagtgaataaatgt

SEQ ID NO: 3602769 - DNA, 21 bp, Homo sapiens
tgagtgccccacttctggcca

SEQ ID NO: 3602770 - DNA, 15 bp, Homo sapiens
tgagtggaaatacac

SEQ ID NO: 3602771 - DNA, 13 bp, Homo sapiens
tgagtggcagcag

SEQ ID NO: 3602772 - DNA, 17 bp, Homo sapiens
tgagtggcagcagcccc

SEQ ID NO: 3602773 - DNA, 18 bp, Homo sapiens
tgagtgtcttaattaaaa

SEQ ID NO: 3602774 - DNA, 14 bp, Homo sapiens
tgagttaacaggac

SEQ ID NO: 3602775 - DNA, 19 bp, Homo sapiens
tgagttaatgtgctgagca

SEQ ID NO: 3602776 - DNA, 15 bp, Homo sapiens
tgagttcaactacat

SEQ ID NO: 3602777 - DNA, 17 bp, Homo sapiens
tgagttcctctgcagtt

SEQ ID NO: 3602778 - DNA, 17 bp, Homo sapiens
tgagttggctgggaata

SEQ ID NO: 3602779 - DNA, 14 bp, Homo sapiens
tgataaaaactcag

SEQ ID NO: 3602780 - DNA, 15 bp, Homo sapiens
tgataaactgaattt

SEQ ID NO: 3602781 - DNA, 17 bp, Homo sapiens
tgataaaggaaatagga

SEQ ID NO: 3602782 - DNA, 14 bp, Homo sapiens
tgataacatggaaa

SEQ ID NO: 3602783 - DNA, 20 bp, Homo sapiens
tgataaccatagcattaata

SEQ ID NO: 3602784 - DNA, 24 bp, Homo sapiens
tgataagcagtcatcctcagatca

SEQ ID NO: 3602785 - DNA, 21 bp, Homo sapiens
tgataattttcctttaatatg

SEQ ID NO: 3602786 - DNA, 14 bp, Homo sapiens
tgatactgtctctc

SEQ ID NO: 3602787 - DNA, 20 bp, Homo sapiens
tgatactgtctctccagtga

SEQ ID NO: 3602788 - DNA, 21 bp, Homo sapiens
tgatagaaggctatggggata

SEQ ID NO: 3602789 - DNA, 18 bp, Homo sapiens
tgatagacaattgaggta

SEQ ID NO: 3602790 - DNA, 23 bp, Homo sapiens
tgataggtaaatttttaggcaaa

SEQ ID NO: 3602791 - DNA, 22 bp, Homo sapiens
tgataggttattttgatgtaaa

SEQ ID NO: 3602792 - DNA, 12 bp, Homo sapiens
tgatatgcatgt

SEQ ID NO: 3602793 - DNA, 13 bp, Homo sapiens
tgatatgcatgta

SEQ ID NO: 3602794 - DNA, 16 bp, Homo sapiens
tgatatgcatgtagca

SEQ ID NO: 3602795 - DNA, 17 bp, Homo sapiens
tgatatgcatgtagcat

SEQ ID NO: 3602796 - DNA, 17 bp, Homo sapiens
tgatatttgcattgagg

SEQ ID NO: 3602797 - DNA, 19 bp, Homo sapiens
tgatattttcaacgcagcc

SEQ ID NO: 3602798 - DNA, 15 bp, Homo sapiens
tgatcaactcttcga

SEQ ID NO: 3602799 - DNA, 17 bp, Homo sapiens
tgatcaccgactgaaaa

SEQ ID NO: 3602800 - DNA, 16 bp, Homo sapiens
tgatcccaccccctcc

SEQ ID NO: 3602801 - DNA, 19 bp, Homo sapiens
tgatcccaccccctcctcc

SEQ ID NO: 3602802 - DNA, 18 bp, Homo sapiens
tgatccccgtctctgccc

SEQ ID NO: 3602803 - DNA, 14 bp, Homo sapiens
tgccttctgctgaa

SEQ ID NO: 3602804 - DNA, 13 bp, Homo sapiens
tgccttggagagg

SEQ ID NO: 3602805 - DNA, 19 bp, Homo sapiens
tgccttggagagggcccag

SEQ ID NO: 3602806 - DNA, 16 bp, Homo sapiens
tgccttggtgtgctgt

SEQ ID NO: 3602807 - DNA, 14 bp, Homo sapiens
tgcctttaagccaa

SEQ ID NO: 3602808 - DNA, 16 bp, Homo sapiens
tgcctttaagccaaag

SEQ ID NO: 3602809 - DNA, 21 bp, Homo sapiens
tgcctttatttgctgttaact

SEQ ID NO: 3602810 - DNA, 19 bp, Homo sapiens
tgcctttctttgcctctgc

SEQ ID NO: 3602811 - DNA, 22 bp, Homo sapiens
tgcctttctttgcctctgcagt

SEQ ID NO: 3602812 - DNA, 16 bp, Homo sapiens
tgccttttatgtaaat

SEQ ID NO: 3602813 - DNA, 22 bp, Homo sapiens
tgcgagacgcacacagctgagc

SEQ ID NO: 3602814 - DNA, 18 bp, Homo sapiens
tgcgccaccatgccctat

SEQ ID NO: 3602815 - DNA, 16 bp, Homo sapiens
tgcggatcctgctggg

SEQ ID NO: 3602816 - DNA, 15 bp, Homo sapiens
tgcggccttttcatg

SEQ ID NO: 3602817 - DNA, 14 bp, Homo sapiens
tgcggggcgggcac

SEQ ID NO: 3602818 - DNA, 20 bp, Homo sapiens
tgcgtcccagctgaaggcag

SEQ ID NO: 3602819 - DNA, 13 bp, Homo sapiens
tgctaaaacctga

SEQ ID NO: 3602820 - DNA, 16 bp, Homo sapiens
tgctaactgggttaaa

SEQ ID NO: 3602821 - DNA, 14 bp, Homo sapiens
tgctaactggttaa

SEQ ID NO: 3602822 - DNA, 22 bp, Homo sapiens
tgctaactggttaaacattaat

SEQ ID NO: 3602823 - DNA, 21 bp, Homo sapiens
tgctaagtaatttagaagata

SEQ ID NO: 3602824 - DNA, 19 bp, Homo sapiens
tgctaagtcattggcaaag

SEQ ID NO: 3602825 - DNA, 20 bp, Homo sapiens
tgctaatcttcttatgcaat

SEQ ID NO: 3602826 - DNA, 22 bp, Homo sapiens
tgctaatcttcttatgcaattt

SEQ ID NO: 3602827 - DNA, 16 bp, Homo sapiens
tgctaatgtcaaacca

SEQ ID NO: 3602828 - DNA, 14 bp, Homo sapiens
tgctacaaaaacac

SEQ ID NO: 3602829 - DNA, 20 bp, Homo sapiens
tgctacaaaaacacagcaag

SEQ ID NO: 3602830 - DNA, 21 bp, Homo sapiens
tgctacaacatcactaatttg

SEQ ID NO: 3602831 - DNA, 15 bp, Homo sapiens
tgctaccagtattta

SEQ ID NO: 3602832 - DNA, 22 bp, Homo sapiens
tgctaccagtatttagaagcca

SEQ ID NO: 3602833 - DNA, 22 bp, Homo sapiens
tgctactactgcagtctttatt

SEQ ID NO: 3602834 - DNA, 23 bp, Homo sapiens
tgctagatccagcccaaacctgg

SEQ ID NO: 3602835 - DNA, 20 bp, Homo sapiens
tgctagcaaatggcagaacc

SEQ ID NO: 3602836 - DNA, 19 bp, Homo sapiens
tgctagcatgggtattttt

SEQ ID NO: 3602837 - DNA, 23 bp, Homo sapiens
tgctataaattttttgaaacaca

SEQ ID NO: 3602838 - DNA, 15 bp, Homo sapiens
tgctatagtgacatg

SEQ ID NO: 3602839 - DNA, 12 bp, Homo sapiens
tgctatcagcaa

SEQ ID NO: 3602840 - DNA, 19 bp, Homo sapiens
tgctatgagctggggatgt

SEQ ID NO: 3602841 - DNA, 22 bp, Homo sapiens
tgctatgatgttagttttcctt

SEQ ID NO: 3602842 - DNA, 20 bp, Homo sapiens
tgctatgcgggttgattatt

SEQ ID NO: 3602843 - DNA, 18 bp, Homo sapiens
tgctattgtagagccaga

SEQ ID NO: 3602844 - DNA, 18 bp, Homo sapiens
tgctcaacccccctccca

SEQ ID NO: 3602845 - DNA, 12 bp, Homo sapiens
tgctcagcttct

SEQ ID NO: 3602846 - DNA, 17 bp, Homo sapiens
tgctcattatgccactt

SEQ ID NO: 3602847 - DNA, 13 bp, Homo sapiens
tgctccaactcca

SEQ ID NO: 3602848 - DNA, 21 bp, Homo sapiens
tgctccaagatgttctcctga

SEQ ID NO: 3602849 - DNA, 16 bp, Homo sapiens
tgctccacactcagaa

SEQ ID NO: 3602850 - DNA, 22 bp, Homo sapiens
tgctccagaagatgccagcttc

SEQ ID NO: 3602851 - DNA, 17 bp, Homo sapiens
tgctccataccttttct

SEQ ID NO: 3602852 - DNA, 19 bp, Homo sapiens
tgctccataccttttctct

SEQ ID NO: 3602853 - DNA, 16 bp, Homo sapiens
tgctcccctaaagcca

SEQ ID NO: 3602854 - DNA, 13 bp, Homo sapiens
tgctccctgactg

SEQ ID NO: 3602855 - DNA, 14 bp, Homo sapiens
tgctccctgactgg

SEQ ID NO: 3602856 - DNA, 18 bp, Homo sapiens
tgctccgtagctctgctg

SEQ ID NO: 3602857 - DNA, 20 bp, Homo sapiens
tgctccgtagctctgctgct

SEQ ID NO: 3602858 - DNA, 20 bp, Homo sapiens
tgctcctgcttttctgtcct

SEQ ID NO: 3602859 - DNA, 23 bp, Homo sapiens
tgctcctgcttttctgtcctggg

SEQ ID NO: 3602860 - DNA, 22 bp, Homo sapiens
tgctcctgggcattagcaaggc

SEQ ID NO: 3602861 - DNA, 18 bp, Homo sapiens
tgctccttggcaccccca

SEQ ID NO: 3602862 - DNA, 20 bp, Homo sapiens
tgctcggctactggttacct

SEQ ID NO: 3602863 - DNA, 23 bp, Homo sapiens
tgctcggctactggttacctgga

SEQ ID NO: 3602864 - DNA, 18 bp, Homo sapiens
tgctcgtggactgtgctg

SEQ ID NO: 3602865 - DNA, 16 bp, Homo sapiens
tgctcgtttacactgc

SEQ ID NO: 3602866 - DNA, 18 bp, Homo sapiens
tgctctaccaaatagtga

SEQ ID NO: 3602867 - DNA, 19 bp, Homo sapiens
tgctctaccaaatagtgat

SEQ ID NO: 3602868 - DNA, 16 bp, Homo sapiens
tgctctataaatagta

SEQ ID NO: 3602869 - DNA, 14 bp, Homo sapiens
tgctctatactgtg

SEQ ID NO: 3602870 - DNA, 23 bp, Homo sapiens
tgctctatactgtggcctgcagg

SEQ ID NO: 3602871 - DNA, 14 bp, Homo sapiens
tgctctcctcatct

SEQ ID NO: 3602872 - DNA, 13 bp, Homo sapiens
tgctctcctccac

SEQ ID NO: 3602873 - DNA, 17 bp, Homo sapiens
tgctctctcaaattgtc

SEQ ID NO: 3602874 - DNA, 14 bp, Homo sapiens
tgctctctctgagg

SEQ ID NO: 3602875 - DNA, 14 bp, Homo sapiens
tgctctctgtgacc

SEQ ID NO: 3602876 - DNA, 15 bp, Homo sapiens
tgctctgccccagct

SEQ ID NO: 3602877 - DNA, 23 bp, Homo sapiens
tgctctgccccagcttgggcaga

SEQ ID NO: 3602878 - DNA, 12 bp, Homo sapiens
tgctctggaata

SEQ ID NO: 3602879 - DNA, 19 bp, Homo sapiens
tgctctggcaccatcagcc

SEQ ID NO: 3602880 - DNA, 18 bp, Homo sapiens
tgctctgttttgcatgga

SEQ ID NO: 3602881 - DNA, 12 bp, Homo sapiens
tgctcttagctg

SEQ ID NO: 3602882 - DNA, 13 bp, Homo sapiens
tgctcttcccact

SEQ ID NO: 3602883 - DNA, 19 bp, Homo sapiens
tgctcttcccactccagct

SEQ ID NO: 3602884 - DNA, 18 bp, Homo sapiens
tgctcttggctgacccct

SEQ ID NO: 3602885 - DNA, 21 bp, Homo sapiens
tgctcttggctgacccctctg

SEQ ID NO: 3602886 - DNA, 14 bp, Homo sapiens
tgctcttttcctgg

SEQ ID NO: 3602887 - DNA, 23 bp, Homo sapiens
tgctcttttctcctcactgtatc

SEQ ID NO: 3602888 - DNA, 12 bp, Homo sapiens
tgctgaaagact

SEQ ID NO: 3602889 - DNA, 23 bp, Homo sapiens
tgctgaaggaataaattgctcct

SEQ ID NO: 3602890 - DNA, 18 bp, Homo sapiens
tgctgaattcctttacaa

SEQ ID NO: 3602891 - DNA, 14 bp, Homo sapiens
tgctgacagctctt

SEQ ID NO: 3602892 - DNA, 14 bp, Homo sapiens
tgctgacagctgct

SEQ ID NO: 3602893 - DNA, 15 bp, Homo sapiens
tgctgacagctgctc

SEQ ID NO: 3602894 - DNA, 16 bp, Homo sapiens
tgctgacagctgctcc

SEQ ID NO: 3602895 - DNA, 17 bp, Homo sapiens
tgctgacagctgctcct

SEQ ID NO: 3602896 - DNA, 14 bp, Homo sapiens
tgctgacggccagg

SEQ ID NO: 3602897 - DNA, 15 bp, Homo sapiens
tgctgacggccaggg

SEQ ID NO: 3602898 - DNA, 17 bp, Homo sapiens
tgctgacggccagggag

SEQ ID NO: 3602899 - DNA, 14 bp, Homo sapiens
tgctgagctggccc

SEQ ID NO: 3602900 - DNA, 12 bp, Homo sapiens
tgctgaggcacc

SEQ ID NO: 3602901 - DNA, 17 bp, Homo sapiens
tgctgatatcaacagct

SEQ ID NO: 3602902 - DNA, 18 bp, Homo sapiens
tgctgatatttaaattca

SEQ ID NO: 3602903 - DNA, 19 bp, Homo sapiens
tgctgcaagcacagccctt

SEQ ID NO: 3602904 - DNA, 16 bp, Homo sapiens
tgctgcaccctgcgcc

SEQ ID NO: 3602905 - DNA, 21 bp, Homo sapiens
tgctgcaccctgcgcctccag

SEQ ID NO: 3602906 - DNA, 13 bp, Homo sapiens
tgctgcagagatc

SEQ ID NO: 3602907 - DNA, 20 bp, Homo sapiens
tgctgcagctccctcctcag

SEQ ID NO: 3602908 - DNA, 22 bp, Homo sapiens
tgctgcagggtctttttctagg

SEQ ID NO: 3602909 - DNA, 16 bp, Homo sapiens
tgctgccacacttcag

SEQ ID NO: 3602910 - DNA, 14 bp, Homo sapiens
tgctgccagggctt

SEQ ID NO: 3602911 - DNA, 15 bp, Homo sapiens
tgctgccagggcttc

SEQ ID NO: 3602912 - DNA, 19 bp, Homo sapiens
tgctgcccctgtctggaag

SEQ ID NO: 3602913 - DNA, 12 bp, Homo sapiens
tgctgccgccgc

SEQ ID NO: 3602914 - DNA, 16 bp, Homo sapiens
tgctgccggctctggg

SEQ ID NO: 3602915 - DNA, 17 bp, Homo sapiens
tgctgccggctctgggc

SEQ ID NO: 3602916 - DNA, 13 bp, Homo sapiens
tgctgcctcagga

SEQ ID NO: 3602917 - DNA, 19 bp, Homo sapiens
tgctgcctcggatcccctt

SEQ ID NO: 3602918 - DNA, 16 bp, Homo sapiens
tgctgccttcagggag

SEQ ID NO: 3602919 - DNA, 22 bp, Homo sapiens
tgctgctaagtcattggcaaag

SEQ ID NO: 3602920 - DNA, 13 bp, Homo sapiens
tgctgctgctgcc

SEQ ID NO: 3602921 - DNA, 19 bp, Homo sapiens
tgctgctggggaagacagt

SEQ ID NO: 3602922 - DNA, 21 bp, Homo sapiens
tgctgctggggaagacagtgg

SEQ ID NO: 3602923 - DNA, 23 bp, Homo sapiens
tgctgctggggaagacagtggcc

SEQ ID NO: 3602924 - DNA, 23 bp, Homo sapiens
tgctgcttttgggggtcagcatc

SEQ ID NO: 3602925 - DNA, 12 bp, Homo sapiens
tgctggcccagg

SEQ ID NO: 3602926 - DNA, 13 bp, Homo sapiens
tgctggcccaggg

SEQ ID NO: 3602927 - DNA, 19 bp, Homo sapiens
tgctggcccagggcccaga

SEQ ID NO: 3602928 - DNA, 21 bp, Homo sapiens
tgctggcccagggcccagagc

SEQ ID NO: 3602929 - DNA, 23 bp, Homo sapiens
tgctggcccagggcccagagccc

SEQ ID NO: 3602930 - DNA, 19 bp, Homo sapiens
tgctggcggacgcagctgg

SEQ ID NO: 3602931 - DNA, 13 bp, Homo sapiens
tgctggctgcccc

SEQ ID NO: 3602932 - DNA, 14 bp, Homo sapiens
tgctggctgcctta

SEQ ID NO: 3602933 - DNA, 15 bp, Homo sapiens
tgctggctgccttag

SEQ ID NO: 3602934 - DNA, 17 bp, Homo sapiens
tgctgggccactgggga

SEQ ID NO: 3602935 - DNA, 21 bp, Homo sapiens
tggtcacccatgcatcttcca

SEQ ID NO: 3602936 - DNA, 20 bp, Homo sapiens
tggtcatgtgagtctgggat

SEQ ID NO: 3602937 - DNA, 13 bp, Homo sapiens
tggtccagctctg

SEQ ID NO: 3602938 - DNA, 20 bp, Homo sapiens
tggtccccactgctgagctg

SEQ ID NO: 3602939 - DNA, 21 bp, Homo sapiens
tggtcctcctatctccctggc

SEQ ID NO: 3602940 - DNA, 14 bp, Homo sapiens
tggtcctgcacatg

SEQ ID NO: 3602941 - DNA, 17 bp, Homo sapiens
tggtcctgcacatgagt

SEQ ID NO: 3602942 - DNA, 16 bp, Homo sapiens
tggtcggatctcacag

SEQ ID NO: 3602943 - DNA, 20 bp, Homo sapiens
tggtcggatctcacaggctg

SEQ ID NO: 3602944 - DNA, 20 bp, Homo sapiens
tggtctaatgattcaaatgt

SEQ ID NO: 3602945 - DNA, 18 bp, Homo sapiens
tggtctcaaactcctgac

SEQ ID NO: 3602946 - DNA, 23 bp, Homo sapiens
tggtctcctcagcctcctcatct

SEQ ID NO: 3602947 - DNA, 15 bp, Homo sapiens
tggtctctgccccag

SEQ ID NO: 3602948 - DNA, 17 bp, Homo sapiens
tggtctctgccccagcc

SEQ ID NO: 3602949 - DNA, 15 bp, Homo sapiens
tggtctgccttctgc

SEQ ID NO: 3602950 - DNA, 17 bp, Homo sapiens
tggtctgccttctgctg

SEQ ID NO: 3602951 - DNA, 18 bp, Homo sapiens
tggtctgccttctgctga

SEQ ID NO: 3602952 - DNA, 17 bp, Homo sapiens
tggtctggttcctgtgt

SEQ ID NO: 3602953 - DNA, 20 bp, Homo sapiens
tggtctgtggatcagcattt

SEQ ID NO: 3602954 - DNA, 16 bp, Homo sapiens
tggtgaagtaaattag

SEQ ID NO: 3602955 - DNA, 23 bp, Homo sapiens
tggtgaagtaaattaggcagtgc

SEQ ID NO: 3602956 - DNA, 17 bp, Homo sapiens
tggtgaggggctttctc

SEQ ID NO: 3602957 - DNA, 19 bp, Homo sapiens
tggtgaggggctttctctt

SEQ ID NO: 3602958 - DNA, 20 bp, Homo sapiens
tggtgaggggctttctcttc

SEQ ID NO: 3602959 - DNA, 14 bp, Homo sapiens
tggtgcagtgtgtg

SEQ ID NO: 3602960 - DNA, 18 bp, Homo sapiens
tggtgcagtgtgtgaaaa

SEQ ID NO: 3602961 - DNA, 13 bp, Homo sapiens
tggtgcatgggct

SEQ ID NO: 3602962 - DNA, 21 bp, Homo sapiens
tggtgccccaggaccagctca

SEQ ID NO: 3602963 - DNA, 22 bp, Homo sapiens
tggtgcctatctgcctggaggc

SEQ ID NO: 3602964 - DNA, 18 bp, Homo sapiens
tggtggaaaacgaagctc

SEQ ID NO: 3602965 - DNA, 20 bp, Homo sapiens
tggtggcacacgcctgtagt

SEQ ID NO: 3602966 - DNA, 16 bp, Homo sapiens
tggtggctgttcctga

SEQ ID NO: 3602967 - DNA, 13 bp, Homo sapiens
tggtggggtggca

SEQ ID NO: 3602968 - DNA, 16 bp, Homo sapiens
tggtggtaaccctggt

SEQ ID NO: 3602969 - DNA, 17 bp, Homo sapiens
tggtggtaaccctggtg

SEQ ID NO: 3602970 - DNA, 15 bp, Homo sapiens
tggtggtgaaattga

SEQ ID NO: 3602971 - DNA, 13 bp, Homo sapiens
tggtgtaatcatt

SEQ ID NO: 3602972 - DNA, 19 bp, Homo sapiens
tggtgtgaatttgccagag

SEQ ID NO: 3602973 - DNA, 18 bp, Homo sapiens
tggtgtgtccctggacac

SEQ ID NO: 3602974 - DNA, 20 bp, Homo sapiens
tggtgttgcagccgcagaga

SEQ ID NO: 3602975 - DNA, 13 bp, Homo sapiens
tggtgtttgtcat

SEQ ID NO: 3602976 - DNA, 17 bp, Homo sapiens
tggttaaacattaatat

SEQ ID NO: 3602977 - DNA, 14 bp, Homo sapiens
tggttaatgtagta

SEQ ID NO: 3602978 - DNA, 14 bp, Homo sapiens
tggttagaaatgca

SEQ ID NO: 3602979 - DNA, 19 bp, Homo sapiens
tggttcaagtattaagcag

SEQ ID NO: 3602980 - DNA, 19 bp, Homo sapiens
tggttcccctgttcactct

SEQ ID NO: 3602981 - DNA, 15 bp, Homo sapiens
tggttccctgctgcg

SEQ ID NO: 3602982 - DNA, 16 bp, Homo sapiens
tggttccttctctggg

SEQ ID NO: 3602983 - DNA, 17 bp, Homo sapiens
tggttccttctctgggt

SEQ ID NO: 3602984 - DNA, 16 bp, Homo sapiens
tggttcgtgctgtgct

SEQ ID NO: 3602985 - DNA, 19 bp, Homo sapiens
tggttctgaggccagaaag

SEQ ID NO: 3602986 - DNA, 13 bp, Homo sapiens
tggttctgtgaac

SEQ ID NO: 3602987 - DNA, 22 bp, Homo sapiens
tggttgagtgtgtggtctctgc

SEQ ID NO: 3602988 - DNA, 16 bp, Homo sapiens
tggttgatggaaaata

SEQ ID NO: 3602989 - DNA, 17 bp, Homo sapiens
tggttgatggaaaataa

SEQ ID NO: 3602990 - DNA, 18 bp, Homo sapiens
tggttgatggaaaataaa

SEQ ID NO: 3602991 - DNA, 12 bp, Homo sapiens
tggttgcctggg

SEQ ID NO: 3602992 - DNA, 13 bp, Homo sapiens
tggttgcctgggg

SEQ ID NO: 3602993 - DNA, 19 bp, Homo sapiens
tggttgctgttttcctccc

SEQ ID NO: 3602994 - DNA, 13 bp, Homo sapiens
tggttggagaagg

SEQ ID NO: 3602995 - DNA, 20 bp, Homo sapiens
tggttgtatatttttatatt

SEQ ID NO: 3602996 - DNA, 22 bp, Homo sapiens
tggtttatatgccctcaagtaa

SEQ ID NO: 3602997 - DNA, 16 bp, Homo sapiens
tggtttattctttgca

SEQ ID NO: 3602998 - DNA, 18 bp, Homo sapiens
tggtttcccattggttca

SEQ ID NO: 3602999 - DNA, 19 bp, Homo sapiens
tggtttgcctgaggctgta

SEQ ID NO: 3603000 - DNA, 20 bp, Homo sapiens
tggtttgccttttatgtaaa

SEQ ID NO: 3603001 - DNA, 12 bp, Homo sapiens
tggtttttccaa

SEQ ID NO: 3603002 - DNA, 16 bp, Homo sapiens
tgtaaaacttctgctc

SEQ ID NO: 3603003 - DNA, 18 bp, Homo sapiens
tgtaaaagcattttgtaa

SEQ ID NO: 3603004 - DNA, 16 bp, Homo sapiens
tgtaaaatagaaaaag

SEQ ID NO: 3603005 - DNA, 16 bp, Homo sapiens
tgtaaagatgaatgtc

SEQ ID NO: 3603006 - DNA, 19 bp, Homo sapiens
tgtaaagttgcctttattt

SEQ ID NO: 3603007 - DNA, 20 bp, Homo sapiens
tgtaaatcctagacttgaaa

SEQ ID NO: 3603008 - DNA, 15 bp, Homo sapiens
tgtaaatttatgtga

SEQ ID NO: 3603009 - DNA, 17 bp, Homo sapiens
tgtaaatttatgtgatg

SEQ ID NO: 3603010 - DNA, 20 bp, Homo sapiens
tgtaacaagaaagtggtctg

SEQ ID NO: 3603011 - DNA, 17 bp, Homo sapiens
tgtaacttccaaataaa

SEQ ID NO: 3603012 - DNA, 20 bp, Homo sapiens
tgtaacttccaaataaataa

SEQ ID NO: 3603013 - DNA, 15 bp, Homo sapiens
tgtaacttcctgctg

SEQ ID NO: 3603014 - DNA, 22 bp, Homo sapiens
tgtaacttcctgctgcaccctg

SEQ ID NO: 3603015 - DNA, 13 bp, Homo sapiens
tgtaagggaaact

SEQ ID NO: 3603016 - DNA, 22 bp, Homo sapiens
tgtaaggtgttcagtagagcta

SEQ ID NO: 3603017 - DNA, 18 bp, Homo sapiens
tgtaagtgaaaaacatga

SEQ ID NO: 3603018 - DNA, 13 bp, Homo sapiens
tgtaagtttgtgt

SEQ ID NO: 3603019 - DNA, 17 bp, Homo sapiens
tgtaagtttgtgtaaat

SEQ ID NO: 3603020 - DNA, 11 bp, Homo sapiens
tgtaataaact

SEQ ID NO: 3603021 - DNA, 14 bp, Homo sapiens
tgtaataaactctc

SEQ ID NO: 3603022 - DNA, 16 bp, Homo sapiens
tgtaataaactctcta

SEQ ID NO: 3603023 - DNA, 15 bp, Homo sapiens
tgtaataaatactgc

SEQ ID NO: 3603024 - DNA, 14 bp, Homo sapiens
tgtaataatagact

SEQ ID NO: 3603025 - DNA, 19 bp, Homo sapiens
tgtaatataccagcttgta

SEQ ID NO: 3603026 - DNA, 20 bp, Homo sapiens
tgtaatcattttaaattcca

SEQ ID NO: 3603027 - DNA, 20 bp, Homo sapiens
tgtaatcttatttaggaagt

SEQ ID NO: 3603028 - DNA, 22 bp, Homo sapiens
tgtaatgacaaaagatacaaaa

SEQ ID NO: 3603029 - DNA, 12 bp, Homo sapiens
tgtaatgacagg

SEQ ID NO: 3603030 - DNA, 19 bp, Homo sapiens
tgtaatgctgcacttcctg

SEQ ID NO: 3603031 - DNA, 22 bp, Homo sapiens
tgtaatgctgcctcaggaccca

SEQ ID NO: 3603032 - DNA, 22 bp, Homo sapiens
tgtaatgtttttatttcaattg

SEQ ID NO: 3603033 - DNA, 16 bp, Homo sapiens
tgtaattgctttttta

SEQ ID NO: 3603034 - DNA, 16 bp, Homo sapiens
tgtaattgtaattcca

SEQ ID NO: 3603035 - DNA, 17 bp, Homo sapiens
tgtaattgtaattccaa

SEQ ID NO: 3603036 - DNA, 22 bp, Homo sapiens
tgtaatttaaaattgtgatgtg

SEQ ID NO: 3603037 - DNA, 20 bp, Homo sapiens
tgtaattttgtgtaagaaat

SEQ ID NO: 3603038 - DNA, 18 bp, Homo sapiens
tgtaatttttcaaaatcg

SEQ ID NO: 3603039 - DNA, 11 bp, Homo sapiens
tgtacaaaagc

SEQ ID NO: 3603040 - DNA, 13 bp, Homo sapiens
tgtacaaaagcaa

SEQ ID NO: 3603041 - DNA, 17 bp, Homo sapiens
tgtacaaaataaacaaa

SEQ ID NO: 3603042 - DNA, 13 bp, Homo sapiens
tgtacaatgtgag

SEQ ID NO: 3603043 - DNA, 22 bp, Homo sapiens
tgtacacactggtacttagagt

SEQ ID NO: 3603044 - DNA, 16 bp, Homo sapiens
tgtacaggaactgcat

SEQ ID NO: 3603045 - DNA, 17 bp, Homo sapiens
tgtacataactcctgtc

SEQ ID NO: 3603046 - DNA, 20 bp, Homo sapiens
tgtacatatgtgctggaatt

SEQ ID NO: 3603047 - DNA, 14 bp, Homo sapiens
tgtacatttaataa

SEQ ID NO: 3603048 - DNA, 15 bp, Homo sapiens
tgtaccagttaattt

SEQ ID NO: 3603049 - DNA, 18 bp, Homo sapiens
tgtaccatatgatctgtt

SEQ ID NO: 3603050 - DNA, 22 bp, Homo sapiens
tgtaccgtaggctttgtattca

SEQ ID NO: 3603051 - DNA, 22 bp, Homo sapiens
tgtacctcagtggatcttcaga

SEQ ID NO: 3603052 - DNA, 14 bp, Homo sapiens
tgtacctctgcctc

SEQ ID NO: 3603053 - DNA, 15 bp, Homo sapiens
tgtacctgttcctcc

SEQ ID NO: 3603054 - DNA, 16 bp, Homo sapiens
tgtacctgttcctccc

SEQ ID NO: 3603055 - DNA, 20 bp, Homo sapiens
tgtactaacccagtctttct

SEQ ID NO: 3603056 - DNA, 19 bp, Homo sapiens
tgtactaacctacagagat

SEQ ID NO: 3603057 - DNA, 12 bp, Homo sapiens
tgtactcctccc

SEQ ID NO: 3603058 - DNA, 12 bp, Homo sapiens
tgtactgaaaaa

SEQ ID NO: 3603059 - DNA, 14 bp, Homo sapiens
tgtacttgtttgaa

SEQ ID NO: 3603060 - DNA, 18 bp, Homo sapiens
tgtacttgtttgaatatt

SEQ ID NO: 3603061 - DNA, 14 bp, Homo sapiens
tgtacttttccttt

SEQ ID NO: 3603062 - DNA, 21 bp, Homo sapiens
tgtagaaaggggagaatgtca

SEQ ID NO: 3603063 - DNA, 16 bp, Homo sapiens
tgtagaataggcaggg

SEQ ID NO: 3603064 - DNA, 16 bp, Homo sapiens
tgtagaatgatttcat

SEQ ID NO: 3603065 - DNA, 18 bp, Homo sapiens
tgtagagcccctactgtg

SEQ ID NO: 3603066 - DNA, 19 bp, Homo sapiens
tgtagagcccctactgtgg

SEQ ID NO: 3603067 - DNA, 14 bp, Homo sapiens
tgtagagcttctgg

SEQ ID NO: 3603068 - DNA, 16 bp, Homo sapiens
tgttgacacaggtctt

SEQ ID NO: 3603069 - DNA, 18 bp, Homo sapiens
tgttgaggcatcaaaaaa

SEQ ID NO: 3603070 - DNA, 21 bp, Homo sapiens
tgttgatagtgatgtatttta

SEQ ID NO: 3603071 - DNA, 15 bp, Homo sapiens
tgttgattaaagatg

SEQ ID NO: 3603072 - DNA, 14 bp, Homo sapiens
tgttgctatagtga

SEQ ID NO: 3603073 - DNA, 22 bp, Homo sapiens
tgttgctatagtgacatgcagt

SEQ ID NO: 3603074 - DNA, 16 bp, Homo sapiens
tgttgctttcttacct

SEQ ID NO: 3603075 - DNA, 15 bp, Homo sapiens
tgttggaaatgtgtt

SEQ ID NO: 3603076 - DNA, 14 bp, Homo sapiens
tgttggttcaaact

SEQ ID NO: 3603077 - DNA, 17 bp, Homo sapiens
tgttggttcaaactttt

SEQ ID NO: 3603078 - DNA, 15 bp, Homo sapiens
tgttgtaatgctgca

SEQ ID NO: 3603079 - DNA, 16 bp, Homo sapiens
tgttgtaatgctgcac

SEQ ID NO: 3603080 - DNA, 22 bp, Homo sapiens
tgttgtaatgctgcacttcctg

SEQ ID NO: 3603081 - DNA, 14 bp, Homo sapiens
tgttgtattcattg

SEQ ID NO: 3603082 - DNA, 12 bp, Homo sapiens
tgttgtatttct

SEQ ID NO: 3603083 - DNA, 15 bp, Homo sapiens
tgttgtatttctata

SEQ ID NO: 3603084 - DNA, 16 bp, Homo sapiens
tgttgtcaagaatagc

SEQ ID NO: 3603085 - DNA, 19 bp, Homo sapiens
tgttgtcaaggatggtttt

SEQ ID NO: 3603086 - DNA, 13 bp, Homo sapiens
tgttgtcccttct

SEQ ID NO: 3603087 - DNA, 20 bp, Homo sapiens
tgttgtgtgtatatgtattt

SEQ ID NO: 3603088 - DNA, 15 bp, Homo sapiens
tgttgtgtgtgggag

SEQ ID NO: 3603089 - DNA, 22 bp, Homo sapiens
tgttgttctaaaggctgttaaa

SEQ ID NO: 3603090 - DNA, 13 bp, Homo sapiens
tgttgtttacctg

SEQ ID NO: 3603091 - DNA, 20 bp, Homo sapiens
tgttgtttataataaaaata

SEQ ID NO: 3603092 - DNA, 14 bp, Homo sapiens
tgtttaaaatcatt

SEQ ID NO: 3603093 - DNA, 17 bp, Homo sapiens
tgtttaaaatcatttct

SEQ ID NO: 3603094 - DNA, 23 bp, Homo sapiens
tgtttaaaccactagttgatgta

SEQ ID NO: 3603095 - DNA, 15 bp, Homo sapiens
tgtttaaataaaatt

SEQ ID NO: 3603096 - DNA, 12 bp, Homo sapiens
tgtttaatcttt

SEQ ID NO: 3603097 - DNA, 15 bp, Homo sapiens
tgtttaatgttaatt

SEQ ID NO: 3603098 - DNA, 21 bp, Homo sapiens
tgtttacagaggacagtattt

SEQ ID NO: 3603099 - DNA, 19 bp, Homo sapiens
tgtttagaagaagtgtgtc

SEQ ID NO: 3603100 - DNA, 15 bp, Homo sapiens
tgtttagtctttata

SEQ ID NO: 3603101 - DNA, 23 bp, Homo sapiens
tgtttatatggataatctgagca

SEQ ID NO: 3603102 - DNA, 19 bp, Homo sapiens
tgtttatgtaacttcctgt

SEQ ID NO: 3603103 - DNA, 16 bp, Homo sapiens
tgtttatgtgtgtgtg

SEQ ID NO: 3603104 - DNA, 15 bp, Homo sapiens
tgtttattaatctta

SEQ ID NO: 3603105 - DNA, 20 bp, Homo sapiens
tgtttattgaattcatttca

SEQ ID NO: 3603106 - DNA, 23 bp, Homo sapiens
tgtttattgaattcatttcactg

SEQ ID NO: 3603107 - DNA, 14 bp, Homo sapiens
tgtttcaaacatgc

SEQ ID NO: 3603108 - DNA, 13 bp, Homo sapiens
tgtttcaaagttc

SEQ ID NO: 3603109 - DNA, 14 bp, Homo sapiens
tgtttcagaccccc

SEQ ID NO: 3603110 - DNA, 17 bp, Homo sapiens
tgtttccagcttgcatt

SEQ ID NO: 3603111 - DNA, 20 bp, Homo sapiens
tgtttccattttaaggatat

SEQ ID NO: 3603112 - DNA, 22 bp, Homo sapiens
tgtttccccacaaaacaaagca

SEQ ID NO: 3603113 - DNA, 22 bp, Homo sapiens
tgtttctattttttgaaaagca

SEQ ID NO: 3603114 - DNA, 15 bp, Homo sapiens
tgtttctcaaatctt

SEQ ID NO: 3603115 - DNA, 17 bp, Homo sapiens
tgtttctctaaggaatt

SEQ ID NO: 3603116 - DNA, 18 bp, Homo sapiens
tgtttctctaaggaatta

SEQ ID NO: 3603117 - DNA, 20 bp, Homo sapiens
tgtttctttctctgaggaca

SEQ ID NO: 3603118 - DNA, 21 bp, Homo sapiens
tgtttctttctctgaggacaa

SEQ ID NO: 3603119 - DNA, 21 bp, Homo sapiens
tgtttgaaatgaggtctgttt

SEQ ID NO: 3603120 - DNA, 18 bp, Homo sapiens
tgtttgaacacttactgt

SEQ ID NO: 3603121 - DNA, 19 bp, Homo sapiens
tgtttgaagattatatgaa

SEQ ID NO: 3603122 - DNA, 12 bp, Homo sapiens
tgtttgaatatt

SEQ ID NO: 3603123 - DNA, 12 bp, Homo sapiens
tgtttgattggc

SEQ ID NO: 3603124 - DNA, 15 bp, Homo sapiens
tgtttgattggcttt

SEQ ID NO: 3603125 - DNA, 16 bp, Homo sapiens
tgtttgctcaaaattg

SEQ ID NO: 3603126 - DNA, 15 bp, Homo sapiens
tgtttggacagctga

SEQ ID NO: 3603127 - DNA, 19 bp, Homo sapiens
tgtttggtttcttcattct

SEQ ID NO: 3603128 - DNA, 16 bp, Homo sapiens
tgtttgtagtgaaata

SEQ ID NO: 3603129 - DNA, 16 bp, Homo sapiens
tgtttgtcatggtgaa

SEQ ID NO: 3603130 - DNA, 23 bp, Homo sapiens
tgtttgttgccccattcctaaga

SEQ ID NO: 3603131 - DNA, 17 bp, Homo sapiens
tgttttacaatagttct

SEQ ID NO: 3603132 - DNA, 22 bp, Homo sapiens
tgttttacaatagttctgtggg

SEQ ID NO: 3603133 - DNA, 16 bp, Homo sapiens
tgttttagaaccagcc

SEQ ID NO: 3603134 - DNA, 20 bp, Homo sapiens
tgttttagaagattctatgt

SEQ ID NO: 3603135 - DNA, 21 bp, Homo sapiens
tgttttagaagattctatgtt

SEQ ID NO: 3603136 - DNA, 22 bp, Homo sapiens
tgttttagaagattctatgtta

SEQ ID NO: 3603137 - DNA, 16 bp, Homo sapiens
tgttttagcatttgta

SEQ ID NO: 3603138 - DNA, 13 bp, Homo sapiens
tgttttcaaatgt

SEQ ID NO: 3603139 - DNA, 16 bp, Homo sapiens
tgttttcatcatttca

SEQ ID NO: 3603140 - DNA, 18 bp, Homo sapiens
tgttttcatcatttcagc

SEQ ID NO: 3603141 - DNA, 13 bp, Homo sapiens
tgttttcatttta

SEQ ID NO: 3603142 - DNA, 19 bp, Homo sapiens
tgttttcattttagacatt

SEQ ID NO: 3603143 - DNA, 23 bp, Homo sapiens
tgttttcctcccttctgctactg

SEQ ID NO: 3603144 - DNA, 16 bp, Homo sapiens
tgttttcggcagcctt

SEQ ID NO: 3603145 - DNA, 11 bp, Homo sapiens
tgttttcttct

SEQ ID NO: 3603146 - DNA, 11 bp, Homo sapiens
tgttttgaaag

SEQ ID NO: 3603147 - DNA, 18 bp, Homo sapiens
tgttttgaccagtttaag

SEQ ID NO: 3603148 - DNA, 16 bp, Homo sapiens
tgttttgttgtttgat

SEQ ID NO: 3603149 - DNA, 21 bp, Homo sapiens
tgtttttcatgttttagcatt

SEQ ID NO: 3603150 - DNA, 22 bp, Homo sapiens
tgtttttgtatttattaatttg

SEQ ID NO: 3603151 - DNA, 18 bp, Homo sapiens
tgttttttcatttgtaaa

SEQ ID NO: 3603152 - DNA, 14 bp, Homo sapiens
tgtttttttctaaa

SEQ ID NO: 3603153 - DNA, 18 bp, Homo sapiens
tgttttttttttccactt

SEQ ID NO: 3603154 - DNA, 19 bp, Homo sapiens
tgttttttttttccactta

SEQ ID NO: 3603155 - DNA, 13 bp, Homo sapiens
ttaaaaaaaagaa

SEQ ID NO: 3603156 - DNA, 18 bp, Homo sapiens
ttaaaaaaactggatatt

SEQ ID NO: 3603157 - DNA, 15 bp, Homo sapiens
ttaaaaaagagacat

SEQ ID NO: 3603158 - DNA, 13 bp, Homo sapiens
ttaaaaaatgtga

SEQ ID NO: 3603159 - DNA, 20 bp, Homo sapiens
ttaaaaagatgaaaaagaat

SEQ ID NO: 3603160 - DNA, 15 bp, Homo sapiens
ttaaaaataaagcaa

SEQ ID NO: 3603161 - DNA, 22 bp, Homo sapiens
ttaaaaataccttctatgtatt

SEQ ID NO: 3603162 - DNA, 23 bp, Homo sapiens
ttaaaaataccttctatgtatta

SEQ ID NO: 3603163 - DNA, 14 bp, Homo sapiens
ttaaaaatgttagt

SEQ ID NO: 3603164 - DNA, 12 bp, Homo sapiens
ttaaaacacttt

SEQ ID NO: 3603165 - DNA, 18 bp, Homo sapiens
ttaaaacataaacacatt

SEQ ID NO: 3603166 - DNA, 21 bp, Homo sapiens
ttaaaacctgcttttcaatgt

SEQ ID NO: 3603167 - DNA, 21 bp, Homo sapiens
ttaaaacgcgtctgcctgggc

SEQ ID NO: 3603168 - DNA, 19 bp, Homo sapiens
ttaaaactgctcatttcat

SEQ ID NO: 3603169 - DNA, 21 bp, Homo sapiens
ttaaaactgctcatttcatga

SEQ ID NO: 3603170 - DNA, 14 bp, Homo sapiens
ttaaaactgttatt

SEQ ID NO: 3603171 - DNA, 14 bp, Homo sapiens
ttaaaagaagcttt

SEQ ID NO: 3603172 - DNA, 16 bp, Homo sapiens
ttaaaagggggggagc

SEQ ID NO: 3603173 - DNA, 18 bp, Homo sapiens
ttaaaaggtcaaaactga

SEQ ID NO: 3603174 - DNA, 15 bp, Homo sapiens
ttaaaagtaataaag

SEQ ID NO: 3603175 - DNA, 19 bp, Homo sapiens
ttaaaagtaataaagagaa

SEQ ID NO: 3603176 - DNA, 23 bp, Homo sapiens
ttaaaagtaataaagagaaatat

SEQ ID NO: 3603177 - DNA, 12 bp, Homo sapiens
ttaaaagtattc

SEQ ID NO: 3603178 - DNA, 15 bp, Homo sapiens
ttaaaataaaccaaa

SEQ ID NO: 3603179 - DNA, 19 bp, Homo sapiens
ttaaaatattcctgcattt

SEQ ID NO: 3603180 - DNA, 14 bp, Homo sapiens
ttaaaatcatttct

SEQ ID NO: 3603181 - DNA, 21 bp, Homo sapiens
ttaaaatgcattgaaagaatt

SEQ ID NO: 3603182 - DNA, 17 bp, Homo sapiens
ttaaaatgtttggatgg

SEQ ID NO: 3603183 - DNA, 19 bp, Homo sapiens
ttaaaattggtaaaaataa

SEQ ID NO: 3603184 - DNA, 18 bp, Homo sapiens
ttaaaattgtgatgtgtc

SEQ ID NO: 3603185 - DNA, 17 bp, Homo sapiens
ttaaaattgttaatatg

SEQ ID NO: 3603186 - DNA, 15 bp, Homo sapiens
ttaaaatttgtctta

SEQ ID NO: 3603187 - DNA, 17 bp, Homo sapiens
ttaaaatttgtcttaaa

SEQ ID NO: 3603188 - DNA, 15 bp, Homo sapiens
ttaaacaaaaaacta

SEQ ID NO: 3603189 - DNA, 17 bp, Homo sapiens
ttaaacaaaaaactatc

SEQ ID NO: 3603190 - DNA, 16 bp, Homo sapiens
ttaaacaataaagcaa

SEQ ID NO: 3603191 - DNA, 23 bp, Homo sapiens
ttaaacagtgagcctgaattttg

SEQ ID NO: 3603192 - DNA, 13 bp, Homo sapiens
ttaaacataataa

SEQ ID NO: 3603193 - DNA, 17 bp, Homo sapiens
ttaaacatattcaagga

SEQ ID NO: 3603194 - DNA, 13 bp, Homo sapiens
ttaaacggattat

SEQ ID NO: 3603195 - DNA, 15 bp, Homo sapiens
ttaaacggattattt

SEQ ID NO: 3603196 - DNA, 23 bp, Homo sapiens
ttaaacggattattttttcagac

SEQ ID NO: 3603197 - DNA, 12 bp, Homo sapiens
ttaaacttcagc

SEQ ID NO: 3603198 - DNA, 15 bp, Homo sapiens
ttaaacttgtctttt

SEQ ID NO: 3603199 - DNA, 12 bp, Homo sapiens
ttaaagaaagtg

SEQ ID NO: 3603200 - DNA, 20 bp, Homo sapiens
ttaaagaaatatgtattctg

SEQ ID NO: 3603201 - DNA, 14 bp, Homo sapiens
ttgaaaaactcttt

SEQ ID NO: 3603202 - DNA, 14 bp, Homo sapiens
ttgaaaacttcaaa

SEQ ID NO: 3603203 - DNA, 15 bp, Homo sapiens
ttgaaaagaaagaaa

SEQ ID NO: 3603204 - DNA, 23 bp, Homo sapiens
ttgaaaagactccaaagaaatgt

SEQ ID NO: 3603205 - DNA, 23 bp, Homo sapiens
ttgaaaagatgtacctggtggat

SEQ ID NO: 3603206 - DNA, 15 bp, Homo sapiens
ttgaaaagcagacat

SEQ ID NO: 3603207 - DNA, 16 bp, Homo sapiens
ttgaaaatgcaactct

SEQ ID NO: 3603208 - DNA, 12 bp, Homo sapiens
ttgaaacagaaa

SEQ ID NO: 3603209 - DNA, 23 bp, Homo sapiens
ttgaaactgagatgtgaacacat

SEQ ID NO: 3603210 - DNA, 15 bp, Homo sapiens
ttgaaagaagcaaga

SEQ ID NO: 3603211 - DNA, 15 bp, Homo sapiens
ttgaaagaatgtaaa

SEQ ID NO: 3603212 - DNA, 21 bp, Homo sapiens
ttgaaagttttccagtattga

SEQ ID NO: 3603213 - DNA, 20 bp, Homo sapiens
ttgaaatacctttgtagtta

SEQ ID NO: 3603214 - DNA, 14 bp, Homo sapiens
ttgaaatccaggaa

SEQ ID NO: 3603215 - DNA, 18 bp, Homo sapiens
ttgaaatgaggtctgttt

SEQ ID NO: 3603216 - DNA, 16 bp, Homo sapiens
ttgaaatgatttcaca

SEQ ID NO: 3603217 - DNA, 21 bp, Homo sapiens
ttgaaatttttattaaattat

SEQ ID NO: 3603218 - DNA, 15 bp, Homo sapiens
ttgaaccatccactt

SEQ ID NO: 3603219 - DNA, 21 bp, Homo sapiens
ttgaaccatccacttacatat

SEQ ID NO: 3603220 - DNA, 20 bp, Homo sapiens
ttgaacctggatccagcact

SEQ ID NO: 3603221 - DNA, 19 bp, Homo sapiens
ttgaactcttcaatctctt

SEQ ID NO: 3603222 - DNA, 17 bp, Homo sapiens
ttgaagaataaattcta

SEQ ID NO: 3603223 - DNA, 18 bp, Homo sapiens
ttgaagaccaatcaaata

SEQ ID NO: 3603224 - DNA, 13 bp, Homo sapiens
ttgaagattctat

SEQ ID NO: 3603225 - DNA, 22 bp, Homo sapiens
ttgaagattctatgttaatatt

SEQ ID NO: 3603226 - DNA, 15 bp, Homo sapiens
ttgaaggagaatggc

SEQ ID NO: 3603227 - DNA, 19 bp, Homo sapiens
ttgaagggccagagccagg

SEQ ID NO: 3603228 - DNA, 23 bp, Homo sapiens
ttgaagggctttattaaagaaat

SEQ ID NO: 3603229 - DNA, 15 bp, Homo sapiens
ttgaagtgcagctca

SEQ ID NO: 3603230 - DNA, 19 bp, Homo sapiens
ttgaagtgcagctcatgtt

SEQ ID NO: 3603231 - DNA, 21 bp, Homo sapiens
ttgaataaagtattctagtgt

SEQ ID NO: 3603232 - DNA, 14 bp, Homo sapiens
ttgaataaatgtca

SEQ ID NO: 3603233 - DNA, 12 bp, Homo sapiens
ttgaatataata

SEQ ID NO: 3603234 - DNA, 13 bp, Homo sapiens
ttgaatatatgat

SEQ ID NO: 3603235 - DNA, 19 bp, Homo sapiens
ttgaatggatcaatacaca

SEQ ID NO: 3603236 - DNA, 23 bp, Homo sapiens
ttgaattaatatccctacatgta

SEQ ID NO: 3603237 - DNA, 17 bp, Homo sapiens
ttgaattagtatttcag

SEQ ID NO: 3603238 - DNA, 18 bp, Homo sapiens
ttgaattagtatttcagt

SEQ ID NO: 3603239 - DNA, 12 bp, Homo sapiens
ttgaattcattt

SEQ ID NO: 3603240 - DNA, 16 bp, Homo sapiens
ttgaattcatttcact

SEQ ID NO: 3603241 - DNA, 18 bp, Homo sapiens
ttgaatttactggacata

SEQ ID NO: 3603242 - DNA, 12 bp, Homo sapiens
ttgacacctgct

SEQ ID NO: 3603243 - DNA, 14 bp, Homo sapiens
ttgacaccttagag

SEQ ID NO: 3603244 - DNA, 14 bp, Homo sapiens
ttgacactgctcta

SEQ ID NO: 3603245 - DNA, 22 bp, Homo sapiens
ttgacactgctctaacagccct

SEQ ID NO: 3603246 - DNA, 12 bp, Homo sapiens
ttgacagccttc

SEQ ID NO: 3603247 - DNA, 17 bp, Homo sapiens
ttgacagctttgctgct

SEQ ID NO: 3603248 - DNA, 18 bp, Homo sapiens
ttgacaggtacttggagg

SEQ ID NO: 3603249 - DNA, 21 bp, Homo sapiens
ttgacatttttgccaaaatac

SEQ ID NO: 3603250 - DNA, 19 bp, Homo sapiens
ttgaccaacagaaaccttt

SEQ ID NO: 3603251 - DNA, 20 bp, Homo sapiens
ttgaccagaactttttcctc

SEQ ID NO: 3603252 - DNA, 21 bp, Homo sapiens
ttgaccagaactttttcctct

SEQ ID NO: 3603253 - DNA, 13 bp, Homo sapiens
ttgacctttattt

SEQ ID NO: 3603254 - DNA, 21 bp, Homo sapiens
ttgacctttatttattaaact

SEQ ID NO: 3603255 - DNA, 18 bp, Homo sapiens
ttgacttatagtacatga

SEQ ID NO: 3603256 - DNA, 16 bp, Homo sapiens
ttgacttgaaaagaaa

SEQ ID NO: 3603257 - DNA, 13 bp, Homo sapiens
ttgactttccaga

SEQ ID NO: 3603258 - DNA, 21 bp, Homo sapiens
ttgactttccagaatgacctt

SEQ ID NO: 3603259 - DNA, 11 bp, Homo sapiens
ttgactttgtc

SEQ ID NO: 3603260 - DNA, 19 bp, Homo sapiens
ttgagaaaaatatatacta

SEQ ID NO: 3603261 - DNA, 17 bp, Homo sapiens
ttgagaaccagtctcct

SEQ ID NO: 3603262 - DNA, 16 bp, Homo sapiens
ttgagaggaacaagaa

SEQ ID NO: 3603263 - DNA, 18 bp, Homo sapiens
ttgagattcaagacaaga

SEQ ID NO: 3603264 - DNA, 22 bp, Homo sapiens
ttgagattcaagacaagagctg

SEQ ID NO: 3603265 - DNA, 16 bp, Homo sapiens
ttgagatttacccaga

SEQ ID NO: 3603266 - DNA, 16 bp, Homo sapiens
ttgagcatttttaagg

SEQ ID NO: 3603267 - DNA, 12 bp, Homo sapiens
ttgagccacagt

SEQ ID NO: 3603268 - DNA, 21 bp, Homo sapiens
ttgagctcagccccaactctt

SEQ ID NO: 3603269 - DNA, 18 bp, Homo sapiens
ttgaggaaacaacagctt

SEQ ID NO: 3603270 - DNA, 13 bp, Homo sapiens
ttgaggaaatatt

SEQ ID NO: 3603271 - DNA, 20 bp, Homo sapiens
ttgagggcattagtactttg

SEQ ID NO: 3603272 - DNA, 21 bp, Homo sapiens
ttgagggtgggggtgctctct

SEQ ID NO: 3603273 - DNA, 17 bp, Homo sapiens
ttgaggtctagagagaa

SEQ ID NO: 3603274 - DNA, 16 bp, Homo sapiens
ttgagtatgtgaagat

SEQ ID NO: 3603275 - DNA, 14 bp, Homo sapiens
ttgagtgtgtggtc

SEQ ID NO: 3603276 - DNA, 12 bp, Homo sapiens
ttgataaagtaa

SEQ ID NO: 3603277 - DNA, 20 bp, Homo sapiens
ttgatacaatattgtgcatg

SEQ ID NO: 3603278 - DNA, 22 bp, Homo sapiens
ttgatactaccagggtctctca

SEQ ID NO: 3603279 - DNA, 16 bp, Homo sapiens
ttgatatttgcattga

SEQ ID NO: 3603280 - DNA, 18 bp, Homo sapiens
ttgatctctcttgtcctc

SEQ ID NO: 3603281 - DNA, 15 bp, Homo sapiens
ttgatctggaaccca

SEQ ID NO: 3603282 - DNA, 19 bp, Homo sapiens
ttgatgagatattaaattc

SEQ ID NO: 3603283 - DNA, 11 bp, Homo sapiens
ttgatgttttt

SEQ ID NO: 3603284 - DNA, 14 bp, Homo sapiens
ttgattaaagatga

SEQ ID NO: 3603285 - DNA, 14 bp, Homo sapiens
ttgatttttaagaa

SEQ ID NO: 3603286 - DNA, 21 bp, Homo sapiens
ttgcaactagtaaaatgctgg

SEQ ID NO: 3603287 - DNA, 18 bp, Homo sapiens
ttgcaatctaatctgaac

SEQ ID NO: 3603288 - DNA, 13 bp, Homo sapiens
ttgcactgaacag

SEQ ID NO: 3603289 - DNA, 16 bp, Homo sapiens
ttgcactgaagttttt

SEQ ID NO: 3603290 - DNA, 13 bp, Homo sapiens
ttgcagatggaaa

SEQ ID NO: 3603291 - DNA, 17 bp, Homo sapiens
ttgcagccgcagagaaa

SEQ ID NO: 3603292 - DNA, 18 bp, Homo sapiens
ttgcagccgcagagaaat

SEQ ID NO: 3603293 - DNA, 14 bp, Homo sapiens
ttgcagcttcaact

SEQ ID NO: 3603294 - DNA, 14 bp, Homo sapiens
ttgcagtttacagt

SEQ ID NO: 3603295 - DNA, 17 bp, Homo sapiens
ttgcagtttacagtatt

SEQ ID NO: 3603296 - DNA, 18 bp, Homo sapiens
ttgcagtttacagtattt

SEQ ID NO: 3603297 - DNA, 18 bp, Homo sapiens
ttgcatagattccctgag

SEQ ID NO: 3603298 - DNA, 20 bp, Homo sapiens
ttgcataggctcttaagcag

SEQ ID NO: 3603299 - DNA, 21 bp, Homo sapiens
ttgcatattttgagaaactgc

SEQ ID NO: 3603300 - DNA, 13 bp, Homo sapiens
ttgcatcaatttt

SEQ ID NO: 3603301 - DNA, 15 bp, Homo sapiens
ttgcattgaggaaat

SEQ ID NO: 3603302 - DNA, 21 bp, Homo sapiens
ttgcattgaggaaatattaat

SEQ ID NO: 3603303 - DNA, 16 bp, Homo sapiens
ttgcattgattgctac

SEQ ID NO: 3603304 - DNA, 15 bp, Homo sapiens
ttgcatttatatgta

SEQ ID NO: 3603305 - DNA, 22 bp, Homo sapiens
ttgccaaaacccagctgcaccc

SEQ ID NO: 3603306 - DNA, 17 bp, Homo sapiens
ttgccaaggctctcccc

SEQ ID NO: 3603307 - DNA, 18 bp, Homo sapiens
ttgccaaggctctcccct

SEQ ID NO: 3603308 - DNA, 22 bp, Homo sapiens
ttgccaataaagcttttggaag

SEQ ID NO: 3603309 - DNA, 14 bp, Homo sapiens
ttgccacattaaat

SEQ ID NO: 3603310 - DNA, 18 bp, Homo sapiens
ttgccacattaaattgat

SEQ ID NO: 3603311 - DNA, 18 bp, Homo sapiens
ttgccactgcctcttcct

SEQ ID NO: 3603312 - DNA, 19 bp, Homo sapiens
ttgccagagatccaaaaga

SEQ ID NO: 3603313 - DNA, 13 bp, Homo sapiens
ttgccagcaaata

SEQ ID NO: 3603314 - DNA, 15 bp, Homo sapiens
ttgccatctctgctc

SEQ ID NO: 3603315 - DNA, 14 bp, Homo sapiens
ttgccatgggagga

SEQ ID NO: 3603316 - DNA, 12 bp, Homo sapiens
ttgcccacccct

SEQ ID NO: 3603317 - DNA, 15 bp, Homo sapiens
ttgcccacccctcac

SEQ ID NO: 3603318 - DNA, 20 bp, Homo sapiens
ttgcccaggctagagtgcaa

SEQ ID NO: 3603319 - DNA, 15 bp, Homo sapiens
ttgcccccattccca

SEQ ID NO: 3603320 - DNA, 16 bp, Homo sapiens
ttgcccccattcccag

SEQ ID NO: 3603321 - DNA, 17 bp, Homo sapiens
ttgcccccattcccagc

SEQ ID NO: 3603322 - DNA, 14 bp, Homo sapiens
ttgccccctctcac

SEQ ID NO: 3603323 - DNA, 12 bp, Homo sapiens
ttgcccctggct

SEQ ID NO: 3603324 - DNA, 13 bp, Homo sapiens
ttgcccctggctt

SEQ ID NO: 3603325 - DNA, 14 bp, Homo sapiens
ttgcccctggcttt

SEQ ID NO: 3603326 - DNA, 18 bp, Homo sapiens
ttgcccctggctttgcct

SEQ ID NO: 3603327 - DNA, 20 bp, Homo sapiens
ttgcccctggctttgcctct

SEQ ID NO: 3603328 - DNA, 13 bp, Homo sapiens
ttgccctgttaaa

SEQ ID NO: 3603329 - DNA, 18 bp, Homo sapiens
ttgccgcgtcgccctccc

SEQ ID NO: 3603330 - DNA, 21 bp, Homo sapiens
ttgccgcgtcgccctcccagg

SEQ ID NO: 3603331 - DNA, 22 bp, Homo sapiens
ttgccgcgtcgccctcccaggc

SEQ ID NO: 3603332 - DNA, 18 bp, Homo sapiens
ttgcctaactaactggca

SEQ ID NO: 3603333 - DNA, 23 bp, Homo sapiens
ttgcctatgatactgtctctcca

SEQ ID NO: 3603334 - DNA, 17 bp, Homo sapiens
tttcagagcccccagcc

SEQ ID NO: 3603335 - DNA, 23 bp, Homo sapiens
tttcagatgaaaagaaaacttaa

SEQ ID NO: 3603336 - DNA, 22 bp, Homo sapiens
tttcagcagtctaaattttcta

SEQ ID NO: 3603337 - DNA, 17 bp, Homo sapiens
tttcagccaaagtccta

SEQ ID NO: 3603338 - DNA, 22 bp, Homo sapiens
tttcaggattaactaaagaaga

SEQ ID NO: 3603339 - DNA, 20 bp, Homo sapiens
tttcagggtcttggctgcct

SEQ ID NO: 3603340 - DNA, 17 bp, Homo sapiens
tttcagtgcatcattac

SEQ ID NO: 3603341 - DNA, 18 bp, Homo sapiens
tttcataaatcatgttgt

SEQ ID NO: 3603342 - DNA, 19 bp, Homo sapiens
tttcataagatattttatt

SEQ ID NO: 3603343 - DNA, 15 bp, Homo sapiens
tttcatcatttcagc

SEQ ID NO: 3603344 - DNA, 22 bp, Homo sapiens
tttcatcctaaagaacaaagta

SEQ ID NO: 3603345 - DNA, 14 bp, Homo sapiens
tttcatctaccttt

SEQ ID NO: 3603346 - DNA, 19 bp, Homo sapiens
tttcatctaccttttctgg

SEQ ID NO: 3603347 - DNA, 13 bp, Homo sapiens
tttcatgtcttgt

SEQ ID NO: 3603348 - DNA, 19 bp, Homo sapiens
tttcatgttagttacctta

SEQ ID NO: 3603349 - DNA, 17 bp, Homo sapiens
tttcattaccctacaga

SEQ ID NO: 3603350 - DNA, 22 bp, Homo sapiens
tttcattggtacacgtgtaaca

SEQ ID NO: 3603351 - DNA, 20 bp, Homo sapiens
tttcatttatctataattta

SEQ ID NO: 3603352 - DNA, 15 bp, Homo sapiens
tttcatttgtaaaaa

SEQ ID NO: 3603353 - DNA, 19 bp, Homo sapiens
tttccaactactaatagaa

SEQ ID NO: 3603354 - DNA, 15 bp, Homo sapiens
tttccaagtaaaata

SEQ ID NO: 3603355 - DNA, 14 bp, Homo sapiens
tttccacacgcatt

SEQ ID NO: 3603356 - DNA, 13 bp, Homo sapiens
tttccagcctatc

SEQ ID NO: 3603357 - DNA, 19 bp, Homo sapiens
tttccagtattgaaaactt

SEQ ID NO: 3603358 - DNA, 20 bp, Homo sapiens
tttccagtattgaaaacttc

SEQ ID NO: 3603359 - DNA, 23 bp, Homo sapiens
tttccagtattgaaaacttcaaa

SEQ ID NO: 3603360 - DNA, 24 bp, Homo sapiens
tttccataagcttggtgacaaaat

SEQ ID NO: 3603361 - DNA, 23 bp, Homo sapiens
tttccatgcaccctcatacacag

SEQ ID NO: 3603362 - DNA, 18 bp, Homo sapiens
tttccatttctgatgtct

SEQ ID NO: 3603363 - DNA, 13 bp, Homo sapiens
tttccattttata

SEQ ID NO: 3603364 - DNA, 11 bp, Homo sapiens
tttcccaggac

SEQ ID NO: 3603365 - DNA, 14 bp, Homo sapiens
tttcccaggaccct

SEQ ID NO: 3603366 - DNA, 14 bp, Homo sapiens
tttcccccttccca

SEQ ID NO: 3603367 - DNA, 14 bp, Homo sapiens
tttccctaatttat

SEQ ID NO: 3603368 - DNA, 11 bp, Homo sapiens
tttccctgctg

SEQ ID NO: 3603369 - DNA, 13 bp, Homo sapiens
tttcccttctctt

SEQ ID NO: 3603370 - DNA, 17 bp, Homo sapiens
tttcccttgcttcccct

SEQ ID NO: 3603371 - DNA, 19 bp, Homo sapiens
tttccgcccactcctggga

SEQ ID NO: 3603372 - DNA, 13 bp, Homo sapiens
tttccgcggcggc

SEQ ID NO: 3603373 - DNA, 18 bp, Homo sapiens
tttccgctttgcttgctt

SEQ ID NO: 3603374 - DNA, 13 bp, Homo sapiens
tttccgtaaatgt

SEQ ID NO: 3603375 - DNA, 14 bp, Homo sapiens
tttcctatccttat

SEQ ID NO: 3603376 - DNA, 17 bp, Homo sapiens
tttcctcccttctgcta

SEQ ID NO: 3603377 - DNA, 21 bp, Homo sapiens
tttcctcttctattttgtaaa

SEQ ID NO: 3603378 - DNA, 22 bp, Homo sapiens
tttcctcttctattttgtaaac

SEQ ID NO: 3603379 - DNA, 21 bp, Homo sapiens
tttcctgaaacaacttggaaa

SEQ ID NO: 3603380 - DNA, 23 bp, Homo sapiens
tttcctgatggggaagggacttt

SEQ ID NO: 3603381 - DNA, 16 bp, Homo sapiens
tttcctggcagctgct

SEQ ID NO: 3603382 - DNA, 18 bp, Homo sapiens
tttcctgggcctttgcaa

SEQ ID NO: 3603383 - DNA, 22 bp, Homo sapiens
tttccttatcacccccttgttg

SEQ ID NO: 3603384 - DNA, 15 bp, Homo sapiens
tttccttcaggcagc

SEQ ID NO: 3603385 - DNA, 21 bp, Homo sapiens
tttccttctgaagtctgagcc

SEQ ID NO: 3603386 - DNA, 14 bp, Homo sapiens
tttccttcttccca

SEQ ID NO: 3603387 - DNA, 17 bp, Homo sapiens
tttcctttaaatttcag

SEQ ID NO: 3603388 - DNA, 16 bp, Homo sapiens
tttcctttttcttcgc

SEQ ID NO: 3603389 - DNA, 16 bp, Homo sapiens
tttccttttttgttat

SEQ ID NO: 3603390 - DNA, 16 bp, Homo sapiens
tttcgactggtccagc

SEQ ID NO: 3603391 - DNA, 19 bp, Homo sapiens
tttcgatatttattgatgt

SEQ ID NO: 3603392 - DNA, 22 bp, Homo sapiens
tttcgattcgttaagagagcaa

SEQ ID NO: 3603393 - DNA, 21 bp, Homo sapiens
tttcgggtgaatctgtctatc

SEQ ID NO: 3603394 - DNA, 21 bp, Homo sapiens
tttcgttacattgtgtcctgc

SEQ ID NO: 3603395 - DNA, 14 bp, Homo sapiens
tttcgttgttatta

SEQ ID NO: 3603396 - DNA, 19 bp, Homo sapiens
tttctaaaatgttaaaaca

SEQ ID NO: 3603397 - DNA, 12 bp, Homo sapiens
tttctaaagact

SEQ ID NO: 3603398 - DNA, 13 bp, Homo sapiens
tttctaagtattt

SEQ ID NO: 3603399 - DNA, 18 bp, Homo sapiens
tttctaatacaagcatat

SEQ ID NO: 3603400 - DNA, 20 bp, Homo sapiens
tttctaatccttttccttat

SEQ ID NO: 3603401 - DNA, 22 bp, Homo sapiens
tttctaatgccttttgaataca

SEQ ID NO: 3603402 - DNA, 24 bp, Homo sapiens
tttctaatgttattttccttctga

SEQ ID NO: 3603403 - DNA, 18 bp, Homo sapiens
tttctacattacagccat

SEQ ID NO: 3603404 - DNA, 17 bp, Homo sapiens
tttctagggacatgaaa

SEQ ID NO: 3603405 - DNA, 21 bp, Homo sapiens
tttctataattgtagtaattg

SEQ ID NO: 3603406 - DNA, 23 bp, Homo sapiens
tttctataattgtagtaattgct

SEQ ID NO: 3603407 - DNA, 13 bp, Homo sapiens
tttctatacagta

SEQ ID NO: 3603408 - DNA, 22 bp, Homo sapiens
tttctattctgtcagtgttaaa

SEQ ID NO: 3603409 - DNA, 13 bp, Homo sapiens
tttctcaaatctt

SEQ ID NO: 3603410 - DNA, 15 bp, Homo sapiens
tttctcactgaactc

SEQ ID NO: 3603411 - DNA, 13 bp, Homo sapiens
tttctcagctgtg

SEQ ID NO: 3603412 - DNA, 13 bp, Homo sapiens
tttctcatgttga

SEQ ID NO: 3603413 - DNA, 14 bp, Homo sapiens
tttctcatgttgaa

SEQ ID NO: 3603414 - DNA, 17 bp, Homo sapiens
tttctccatcccctccc

SEQ ID NO: 3603415 - DNA, 10 bp, Homo sapiens
tttctccatg

SEQ ID NO: 3603416 - DNA, 18 bp, Homo sapiens
tttctcccagtcatttaa

SEQ ID NO: 3603417 - DNA, 15 bp, Homo sapiens
tttctccttttccta

SEQ ID NO: 3603418 - DNA, 22 bp, Homo sapiens
tttctctgcatttaaaaaaatc

SEQ ID NO: 3603419 - DNA, 13 bp, Homo sapiens
tttctctgggctt

SEQ ID NO: 3603420 - DNA, 19 bp, Homo sapiens
tttctgaatgcctacctgg

SEQ ID NO: 3603421 - DNA, 20 bp, Homo sapiens
tttctgagacagcttgtctg

SEQ ID NO: 3603422 - DNA, 14 bp, Homo sapiens
tttctgatgtctcc

SEQ ID NO: 3603423 - DNA, 22 bp, Homo sapiens
tttctgccaataaattctaaat

SEQ ID NO: 3603424 - DNA, 18 bp, Homo sapiens
tttctggaatacatgaaa

SEQ ID NO: 3603425 - DNA, 22 bp, Homo sapiens
tttctggcaaacgtttctcaaa

SEQ ID NO: 3603426 - DNA, 22 bp, Homo sapiens
tttctggcgcccctgcctgtgc

SEQ ID NO: 3603427 - DNA, 14 bp, Homo sapiens
tttctgggtgctag

SEQ ID NO: 3603428 - DNA, 14 bp, Homo sapiens
tttctgtaccagtt

SEQ ID NO: 3603429 - DNA, 12 bp, Homo sapiens
tttctgtcccac

SEQ ID NO: 3603430 - DNA, 14 bp, Homo sapiens
tttctgtcctgggc

SEQ ID NO: 3603431 - DNA, 18 bp, Homo sapiens
tttcttaaaatgtcctat

SEQ ID NO: 3603432 - DNA, 14 bp, Homo sapiens
tttcttaacttctt

SEQ ID NO: 3603433 - DNA, 18 bp, Homo sapiens
tttcttaacttcttgctt

SEQ ID NO: 3603434 - DNA, 14 bp, Homo sapiens
tttcttaagaaatg

SEQ ID NO: 3603435 - DNA, 17 bp, Homo sapiens
tttcttaccagtctcct

SEQ ID NO: 3603436 - DNA, 18 bp, Homo sapiens
tttcttaccagtctcctc

SEQ ID NO: 3603437 - DNA, 17 bp, Homo sapiens
tttcttattttgtaata

SEQ ID NO: 3603438 - DNA, 20 bp, Homo sapiens
tttcttattttgtaataaac

SEQ ID NO: 3603439 - DNA, 23 bp, Homo sapiens
tttcttattttgtaataaactct

SEQ ID NO: 3603440 - DNA, 16 bp, Homo sapiens
tttcttcacttcaagc

SEQ ID NO: 3603441 - DNA, 23 bp, Homo sapiens
tttcttcacttcaagctgttatt

SEQ ID NO: 3603442 - DNA, 19 bp, Homo sapiens
tttcttccacccacaaact

SEQ ID NO: 3603443 - DNA, 21 bp, Homo sapiens
tttcttccctgctttgcatct

SEQ ID NO: 3603444 - DNA, 11 bp, Homo sapiens
tttcttcctct

SEQ ID NO: 3603445 - DNA, 16 bp, Homo sapiens
tttcttcctctgctga

SEQ ID NO: 3603446 - DNA, 21 bp, Homo sapiens
tttcttgataattttccttta

SEQ ID NO: 3603447 - DNA, 13 bp, Homo sapiens
tttcttgctccct

SEQ ID NO: 3603448 - DNA, 16 bp, Homo sapiens
tttcttgctgcttcta

SEQ ID NO: 3603449 - DNA, 15 bp, Homo sapiens
tttctttcagatttt

SEQ ID NO: 3603450 - DNA, 13 bp, Homo sapiens
tttctttcttcca

SEQ ID NO: 3603451 - DNA, 11 bp, Homo sapiens
tttctttgcct

SEQ ID NO: 3603452 - DNA, 14 bp, Homo sapiens
tttctttggctgca

SEQ ID NO: 3603453 - DNA, 17 bp, Homo sapiens
tttcttttttaaaatca

SEQ ID NO: 3603454 - DNA, 13 bp, Homo sapiens
tttgaaaagcaga

SEQ ID NO: 3603455 - DNA, 22 bp, Homo sapiens
tttgaaacccctgtaggcctca

SEQ ID NO: 3603456 - DNA, 16 bp, Homo sapiens
tttgaaatatggtctt

SEQ ID NO: 3603457 - DNA, 19 bp, Homo sapiens
tttgaagaccaatcaaata

SEQ ID NO: 3603458 - DNA, 16 bp, Homo sapiens
tttgaagattctatgt

SEQ ID NO: 3603459 - DNA, 16 bp, Homo sapiens
tttgaaggagaatggc

SEQ ID NO: 3603460 - DNA, 20 bp, Homo sapiens
tttgaataaatgtcactttt

SEQ ID NO: 3603461 - DNA, 16 bp, Homo sapiens
tttgaattctgtgata

SEQ ID NO: 3603462 - DNA, 23 bp, Homo sapiens
tttgaccagaactttttcctctc

SEQ ID NO: 3603463 - DNA, 15 bp, Homo sapiens
tttgactgtcagcaa

SEQ ID NO: 3603464 - DNA, 17 bp, Homo sapiens
tttgactttcttctgaa

SEQ ID NO: 3603465 - DNA, 13 bp, Homo sapiens
tttgagaaactgc

SEQ ID NO: 3603466 - DNA, 15 bp, Homo sapiens
agcagcgcctttccc

SEQ ID NO: 3603467 - DNA, 12 bp, Homo sapiens
agcagctctccc

SEQ ID NO: 3603468 - DNA, 14 bp, Homo sapiens
agcagctctcccct

SEQ ID NO: 3603469 - DNA, 23 bp, Homo sapiens
agcagctgaaatatgctggctgg

SEQ ID NO: 3603470 - DNA, 16 bp, Homo sapiens
agcaggaatttctttt

SEQ ID NO: 3603471 - DNA, 16 bp, Homo sapiens
agcaggaggggggagg

SEQ ID NO: 3603472 - DNA, 21 bp, Homo sapiens
agcaggaggggggagggaagg

SEQ ID NO: 3603473 - DNA, 16 bp, Homo sapiens
agcaggcaccgccacg

SEQ ID NO: 3603474 - DNA, 12 bp, Homo sapiens
agcaggccagag

SEQ ID NO: 3603475 - DNA, 16 bp, Homo sapiens
agcaggccagagaaag

SEQ ID NO: 3603476 - DNA, 18 bp, Homo sapiens
agcaggcccaatgctgct

SEQ ID NO: 3603477 - DNA, 19 bp, Homo sapiens
agcaggcccaatgctgctt

SEQ ID NO: 3603478 - DNA, 23 bp, Homo sapiens
agcagggaccgggcgcagccctc

SEQ ID NO: 3603479 - DNA, 17 bp, Homo sapiens
agcagggatctgccccc

SEQ ID NO: 3603480 - DNA, 24 bp, Homo sapiens
agcagggatgccctggaggtggct

SEQ ID NO: 3603481 - DNA, 22 bp, Homo sapiens
agcagggctaaataaagaggag

SEQ ID NO: 3603482 - DNA, 23 bp, Homo sapiens
agcagggctaaataaagaggaga

SEQ ID NO: 3603483 - DNA, 21 bp, Homo sapiens
agcaggggaattccctccccc

SEQ ID NO: 3603484 - DNA, 15 bp, Homo sapiens
agcagggtccacagc

SEQ ID NO: 3603485 - DNA, 17 bp, Homo sapiens
agcagggtccacagctg

SEQ ID NO: 3603486 - DNA, 18 bp, Homo sapiens
agcagggtccacagctgg

SEQ ID NO: 3603487 - DNA, 19 bp, Homo sapiens
agcagggtccacagctgga

SEQ ID NO: 3603488 - DNA, 21 bp, Homo sapiens
agcaggtacatttctgattct

SEQ ID NO: 3603489 - DNA, 22 bp, Homo sapiens
agcaggtacatttctgattctg

SEQ ID NO: 3603490 - DNA, 14 bp, Homo sapiens
agcagtcgcctgcc

SEQ ID NO: 3603491 - DNA, 23 bp, Homo sapiens
agcagtcgcctgcctgcagcagg

SEQ ID NO: 3603492 - DNA, 13 bp, Homo sapiens
agcagtctaaatt

SEQ ID NO: 3603493 - DNA, 21 bp, Homo sapiens
agcagttactccctacactga

SEQ ID NO: 3603494 - DNA, 22 bp, Homo sapiens
agcagttactccctacactgat

SEQ ID NO: 3603495 - DNA, 23 bp, Homo sapiens
agcagttactccctacactgatg

SEQ ID NO: 3603496 - DNA, 23 bp, Homo sapiens
agcagttcattctaccaagctgt

SEQ ID NO: 3603497 - DNA, 21 bp, Homo sapiens
agcagttgaaaagactccaaa

SEQ ID NO: 3603498 - DNA, 23 bp, Homo sapiens
agcagttgaaaagactccaaaga

SEQ ID NO: 3603499 - DNA, 15 bp, Homo sapiens
agcagtttcctcagt

SEQ ID NO: 3603500 - DNA, 19 bp, Homo sapiens
agcagtttcctcagtgatg

SEQ ID NO: 3603501 - DNA, 19 bp, Homo sapiens
agcataccaacacgagcag

SEQ ID NO: 3603502 - DNA, 14 bp, Homo sapiens
agcatataaatgtt

SEQ ID NO: 3603503 - DNA, 14 bp, Homo sapiens
agcatatagagatg

SEQ ID NO: 3603504 - DNA, 23 bp, Homo sapiens
agcatatcccaccaacctccagt

SEQ ID NO: 3603505 - DNA, 23 bp, Homo sapiens
agcatcacttaggagaagtcttc

SEQ ID NO: 3603506 - DNA, 14 bp, Homo sapiens
agcatcatcctgca

SEQ ID NO: 3603507 - DNA, 20 bp, Homo sapiens
agcatcatctgggaacttgt

SEQ ID NO: 3603508 - DNA, 19 bp, Homo sapiens
agcatccctggagcaggag

SEQ ID NO: 3603509 - DNA, 14 bp, Homo sapiens
agcatcgcactctg

SEQ ID NO: 3603510 - DNA, 21 bp, Homo sapiens
agcatcgggagcacccagagc

SEQ ID NO: 3603511 - DNA, 17 bp, Homo sapiens
agcatctcccagcaaga

SEQ ID NO: 3603512 - DNA, 13 bp, Homo sapiens
agcatctcccagt

SEQ ID NO: 3603513 - DNA, 13 bp, Homo sapiens
agcatctggctct

SEQ ID NO: 3603514 - DNA, 18 bp, Homo sapiens
agcatctggctctaattc

SEQ ID NO: 3603515 - DNA, 17 bp, Homo sapiens
agcatgaaataaaatat

SEQ ID NO: 3603516 - DNA, 20 bp, Homo sapiens
agcatgaacgtggattgtat

SEQ ID NO: 3603517 - DNA, 22 bp, Homo sapiens
agcatgaacgtggattgtattt

SEQ ID NO: 3603518 - DNA, 21 bp, Homo sapiens
agcatgaataaaacactcatc

SEQ ID NO: 3603519 - DNA, 21 bp, Homo sapiens
agcatgcttgggctgacccag

SEQ ID NO: 3603520 - DNA, 23 bp, Homo sapiens
aggaaccctcaggccaccctcca

SEQ ID NO: 3603521 - DNA, 23 bp, Homo sapiens
aggaactagaaagaaggacccag

SEQ ID NO: 3603522 - DNA, 17 bp, Homo sapiens
aggaagatgtttacatt

SEQ ID NO: 3603523 - DNA, 20 bp, Homo sapiens
aggaagctgtgttgaaacag

SEQ ID NO: 3603524 - DNA, 17 bp, Homo sapiens
aggaagtggctgtccct

SEQ ID NO: 3603525 - DNA, 14 bp, Homo sapiens
aggaagtgtttatg

SEQ ID NO: 3603526 - DNA, 18 bp, Homo sapiens
aggaagttgacttatagt

SEQ ID NO: 3603527 - DNA, 17 bp, Homo sapiens
aggaatggccctcattc

SEQ ID NO: 3603528 - DNA, 17 bp, Homo sapiens
aggaatttcccaggacc

SEQ ID NO: 3603529 - DNA, 13 bp, Homo sapiens
aggacaaaataaa

SEQ ID NO: 3603530 - DNA, 18 bp, Homo sapiens
aggacacagatcccgggg

SEQ ID NO: 3603531 - DNA, 13 bp, Homo sapiens
aggacagagggat

SEQ ID NO: 3603532 - DNA, 15 bp, Homo sapiens
aggacagcacagact

SEQ ID NO: 3603533 - DNA, 17 bp, Homo sapiens
aggacaggaccctcagg

SEQ ID NO: 3603534 - DNA, 19 bp, Homo sapiens
aggacaggaccctcaggaa

SEQ ID NO: 3603535 - DNA, 15 bp, Homo sapiens
aggacataatggggt

SEQ ID NO: 3603536 - DNA, 24 bp, Homo sapiens
aggacataatggggtcctggccat

SEQ ID NO: 3603537 - DNA, 14 bp, Homo sapiens
aggacatcagcaaa

SEQ ID NO: 3603538 - DNA, 23 bp, Homo sapiens
aggacatttgtgggcaagcagat

SEQ ID NO: 3603539 - DNA, 23 bp, Homo sapiens
aggaccaatgcttgcatggagaa

SEQ ID NO: 3603540 - DNA, 23 bp, Homo sapiens
aggaccagctcaggacagatgcc

SEQ ID NO: 3603541 - DNA, 24 bp, Homo sapiens
aggaccagctcaggacagatgcca

SEQ ID NO: 3603542 - DNA, 14 bp, Homo sapiens
aggaccccacatcc

SEQ ID NO: 3603543 - DNA, 13 bp, Homo sapiens
aggaccccagctc

SEQ ID NO: 3603544 - DNA, 13 bp, Homo sapiens
aggaccctgacct

SEQ ID NO: 3603545 - DNA, 22 bp, Homo sapiens
aggaccctgtcctgcagtccca

SEQ ID NO: 3603546 - DNA, 22 bp, Homo sapiens
aggacctccggagcgccctgca

SEQ ID NO: 3603547 - DNA, 23 bp, Homo sapiens
aggacctccggagcgccctgcag

SEQ ID NO: 3603548 - DNA, 19 bp, Homo sapiens
aggacctggcgtgctcaga

SEQ ID NO: 3603549 - DNA, 21 bp, Homo sapiens
aggactagaagattagaaact

SEQ ID NO: 3603550 - DNA, 13 bp, Homo sapiens
aggactcccagaa

SEQ ID NO: 3603551 - DNA, 13 bp, Homo sapiens
aggactcctggca

SEQ ID NO: 3603552 - DNA, 14 bp, Homo sapiens
aggactcctggcag

SEQ ID NO: 3603553 - DNA, 14 bp, Homo sapiens
aggactctctccag

SEQ ID NO: 3603554 - DNA, 23 bp, Homo sapiens
aggactctctccaggagggctcg

SEQ ID NO: 3603555 - DNA, 13 bp, Homo sapiens
aggactctgcctc

SEQ ID NO: 3603556 - DNA, 14 bp, Homo sapiens
aggactctggacaa

SEQ ID NO: 3603557 - DNA, 15 bp, Homo sapiens
aggactgtttcaaac

SEQ ID NO: 3603558 - DNA, 13 bp, Homo sapiens
aggacttgtgtct

SEQ ID NO: 3603559 - DNA, 13 bp, Homo sapiens
aggagaaaaagaa

SEQ ID NO: 3603560 - DNA, 14 bp, Homo sapiens
aggagaaaaagaag

SEQ ID NO: 3603561 - DNA, 19 bp, Homo sapiens
aggagaaaaagaagaaaag

SEQ ID NO: 3603562 - DNA, 18 bp, Homo sapiens
aggagaacttgctgcctc

SEQ ID NO: 3603563 - DNA, 13 bp, Homo sapiens
aggagaagccagt

SEQ ID NO: 3603564 - DNA, 23 bp, Homo sapiens
aggagaagtcttctatttattta

SEQ ID NO: 3603565 - DNA, 20 bp, Homo sapiens
aggagaatcacttgaacccg

SEQ ID NO: 3603566 - DNA, 20 bp, Homo sapiens
aggagaatcgcttgaacctg

SEQ ID NO: 3603567 - DNA, 15 bp, Homo sapiens
aggagaatgagcctc

SEQ ID NO: 3603568 - DNA, 11 bp, Homo sapiens
aggagaatggc

SEQ ID NO: 3603569 - DNA, 12 bp, Homo sapiens
agctctggggac

SEQ ID NO: 3603570 - DNA, 20 bp, Homo sapiens
agctctggggacagcttcct

SEQ ID NO: 3603571 - DNA, 22 bp, Homo sapiens
agctctggggacagcttcctca

SEQ ID NO: 3603572 - DNA, 14 bp, Homo sapiens
agctctggggtggg

SEQ ID NO: 3603573 - DNA, 19 bp, Homo sapiens
agctctggggtgggcagtt

SEQ ID NO: 3603574 - DNA, 21 bp, Homo sapiens
agctctggggtgggcagtttt

SEQ ID NO: 3603575 - DNA, 22 bp, Homo sapiens
agctctggggtgggcagttttt

SEQ ID NO: 3603576 - DNA, 11 bp, Homo sapiens
agctcttcatt

SEQ ID NO: 3603577 - DNA, 18 bp, Homo sapiens
agctcttcattccattga

SEQ ID NO: 3603578 - DNA, 20 bp, Homo sapiens
agctgaaatatgctggctgg

SEQ ID NO: 3603579 - DNA, 22 bp, Homo sapiens
agctgaatattttttatttcta

SEQ ID NO: 3603580 - DNA, 15 bp, Homo sapiens
agctgacagccacac

SEQ ID NO: 3603581 - DNA, 14 bp, Homo sapiens
agctgacagtcagc

SEQ ID NO: 3603582 - DNA, 17 bp, Homo sapiens
agctgaccccgagaagt

SEQ ID NO: 3603583 - DNA, 22 bp, Homo sapiens
agctgaccccgagaagtgctct

SEQ ID NO: 3603584 - DNA, 23 bp, Homo sapiens
agctgactaaactttttttctgt

SEQ ID NO: 3603585 - DNA, 21 bp, Homo sapiens
agctgagagaccctggcctca

SEQ ID NO: 3603586 - DNA, 13 bp, Homo sapiens
agctgagcatgga

SEQ ID NO: 3603587 - DNA, 18 bp, Homo sapiens
agctgatttttgtctttt

SEQ ID NO: 3603588 - DNA, 21 bp, Homo sapiens
agctgcaaggtactctggtga

SEQ ID NO: 3603589 - DNA, 23 bp, Homo sapiens
agctgcaaggtactctggtgagt

SEQ ID NO: 3603590 - DNA, 21 bp, Homo sapiens
agctgcaccccttcctgggca

SEQ ID NO: 3603591 - DNA, 20 bp, Homo sapiens
agctgcactgatgctgcccc

SEQ ID NO: 3603592 - DNA, 22 bp, Homo sapiens
agctgcagaggccacctggatt

SEQ ID NO: 3603593 - DNA, 13 bp, Homo sapiens
agctgccacagag

SEQ ID NO: 3603594 - DNA, 21 bp, Homo sapiens
agctgccacagagaagtttgt

SEQ ID NO: 3603595 - DNA, 14 bp, Homo sapiens
agctgccctagctg

SEQ ID NO: 3603596 - DNA, 16 bp, Homo sapiens
agctgccctagctgac

SEQ ID NO: 3603597 - DNA, 10 bp, Homo sapiens
agctgcctgg

SEQ ID NO: 3603598 - DNA, 13 bp, Homo sapiens
agctgcctggatg

SEQ ID NO: 3603599 - DNA, 14 bp, Homo sapiens
agctgcctggatga

SEQ ID NO: 3603600 - DNA, 15 bp, Homo sapiens
agctgcctgggcccg

SEQ ID NO: 3603601 - DNA, 14 bp, Homo sapiens
agctgcctgtgcct

SEQ ID NO: 3603602 - DNA, 21 bp, Homo sapiens
agctgctcagggaaaagcagc

SEQ ID NO: 3603603 - DNA, 19 bp, Homo sapiens
agctgctcctagagggagg

SEQ ID NO: 3603604 - DNA, 14 bp, Homo sapiens
agctgctgtgtcct

SEQ ID NO: 3603605 - DNA, 13 bp, Homo sapiens
agctggaaggggc

SEQ ID NO: 3603606 - DNA, 17 bp, Homo sapiens
agctggcaaccagccag

SEQ ID NO: 3603607 - DNA, 18 bp, Homo sapiens
agctggcaaccagccagc

SEQ ID NO: 3603608 - DNA, 14 bp, Homo sapiens
agctggcacaaaag

SEQ ID NO: 3603609 - DNA, 20 bp, Homo sapiens
agctggcccccagccctggg

SEQ ID NO: 3603610 - DNA, 12 bp, Homo sapiens
agctggcctgtc

SEQ ID NO: 3603611 - DNA, 15 bp, Homo sapiens
agctggcggaggctg

SEQ ID NO: 3603612 - DNA, 14 bp, Homo sapiens
agctggcgggtgtg

SEQ ID NO: 3603613 - DNA, 14 bp, Homo sapiens
agctggctgggcct

SEQ ID NO: 3603614 - DNA, 19 bp, Homo sapiens
agctgggagcctggttcag

SEQ ID NO: 3603615 - DNA, 17 bp, Homo sapiens
agctgggctaagtaaat

SEQ ID NO: 3603616 - DNA, 11 bp, Homo sapiens
agctgggctgt

SEQ ID NO: 3603617 - DNA, 17 bp, Homo sapiens
agctggggactcaggga

SEQ ID NO: 3603618 - DNA, 13 bp, Homo sapiens
agctggggagccc

SEQ ID NO: 3603619 - DNA, 22 bp, Homo sapiens
agctggggagccctattgctgc

SEQ ID NO: 3603620 - DNA, 15 bp, Homo sapiens
agctggggatgtctc

SEQ ID NO: 3603621 - DNA, 17 bp, Homo sapiens
agctgggggtgggccag

SEQ ID NO: 3603622 - DNA, 18 bp, Homo sapiens
agctggtggcctctgcag

SEQ ID NO: 3603623 - DNA, 15 bp, Homo sapiens
agctggtggtgcagc

SEQ ID NO: 3603624 - DNA, 17 bp, Homo sapiens
agctgtaaaaatgttac

SEQ ID NO: 3603625 - DNA, 15 bp, Homo sapiens
agctgtaagggcagt

SEQ ID NO: 3603626 - DNA, 16 bp, Homo sapiens
agctgtaagggcagtg

SEQ ID NO: 3603627 - DNA, 21 bp, Homo sapiens
ttatactgtaggtgttatgta

SEQ ID NO: 3603628 - DNA, 13 bp, Homo sapiens
ttatacttcaaaa

SEQ ID NO: 3603629 - DNA, 15 bp, Homo sapiens
ttatagaaaacctga

SEQ ID NO: 3603630 - DNA, 18 bp, Homo sapiens
ttatagaaaacctgactt

SEQ ID NO: 3603631 - DNA, 16 bp, Homo sapiens
ttataggagaaagcaa

SEQ ID NO: 3603632 - DNA, 16 bp, Homo sapiens
ttataggatcatttgt

SEQ ID NO: 3603633 - DNA, 13 bp, Homo sapiens
ttatagtacatga

SEQ ID NO: 3603634 - DNA, 16 bp, Homo sapiens
ttatagtacatgataa

SEQ ID NO: 3603635 - DNA, 17 bp, Homo sapiens
ttatagtgtttggacag

SEQ ID NO: 3603636 - DNA, 15 bp, Homo sapiens
ttatagttactgtgt

SEQ ID NO: 3603637 - DNA, 21 bp, Homo sapiens
ttatatacagaggaaatctgt

SEQ ID NO: 3603638 - DNA, 15 bp, Homo sapiens
ttatatactgctatt

SEQ ID NO: 3603639 - DNA, 17 bp, Homo sapiens
ttatatactgctattta

SEQ ID NO: 3603640 - DNA, 21 bp, Homo sapiens
ttatatatataaagtcagtga

SEQ ID NO: 3603641 - DNA, 15 bp, Homo sapiens
ttatatattataagt

SEQ ID NO: 3603642 - DNA, 16 bp, Homo sapiens
ttatatattataagtt

SEQ ID NO: 3603643 - DNA, 23 bp, Homo sapiens
ttatatattataagttgaccttt

SEQ ID NO: 3603644 - DNA, 19 bp, Homo sapiens
ttatatcatccagaaaaga

SEQ ID NO: 3603645 - DNA, 12 bp, Homo sapiens
ttatatgaagtt

SEQ ID NO: 3603646 - DNA, 15 bp, Homo sapiens
ttatatgtactttta

SEQ ID NO: 3603647 - DNA, 14 bp, Homo sapiens
ttatattctaatag

SEQ ID NO: 3603648 - DNA, 20 bp, Homo sapiens
ttatattgtttttatatatt

SEQ ID NO: 3603649 - DNA, 20 bp, Homo sapiens
ttatattgtttttgtattta

SEQ ID NO: 3603650 - DNA, 11 bp, Homo sapiens
ttatatttcat

SEQ ID NO: 3603651 - DNA, 17 bp, Homo sapiens
ttatcaatagcccagga

SEQ ID NO: 3603652 - DNA, 14 bp, Homo sapiens
ttatccaaatcttg

SEQ ID NO: 3603653 - DNA, 23 bp, Homo sapiens
ttatccaaatcttgaatttctgc

SEQ ID NO: 3603654 - DNA, 15 bp, Homo sapiens
ttatccctcacctgt

SEQ ID NO: 3603655 - DNA, 17 bp, Homo sapiens
ttatccctcacctgtag

SEQ ID NO: 3603656 - DNA, 20 bp, Homo sapiens
ttatccctcacctgtagcag

SEQ ID NO: 3603657 - DNA, 12 bp, Homo sapiens
ttatccctctct

SEQ ID NO: 3603658 - DNA, 14 bp, Homo sapiens
ttatccctctcttc

SEQ ID NO: 3603659 - DNA, 20 bp, Homo sapiens
ttatcctgagtcccttaatc

SEQ ID NO: 3603660 - DNA, 17 bp, Homo sapiens
ttatctataatttacct

SEQ ID NO: 3603661 - DNA, 18 bp, Homo sapiens
ttatctatagctaagtac

SEQ ID NO: 3603662 - DNA, 12 bp, Homo sapiens
ttatctcaagta

SEQ ID NO: 3603663 - DNA, 18 bp, Homo sapiens
ttatctcaagtaaaacaa

SEQ ID NO: 3603664 - DNA, 15 bp, Homo sapiens
ttcactgctgttata

SEQ ID NO: 3603665 - DNA, 15 bp, Homo sapiens
ttcactttcctcagt

SEQ ID NO: 3603666 - DNA, 20 bp, Homo sapiens
ttcagaaaggggctcttctg

SEQ ID NO: 3603667 - DNA, 22 bp, Homo sapiens
ttcagaaaggggctcttctgag

SEQ ID NO: 3603668 - DNA, 23 bp, Homo sapiens
ttcagaactgcccttgctgcccg

SEQ ID NO: 3603669 - DNA, 20 bp, Homo sapiens
ttcagaagaatcttcctggc

SEQ ID NO: 3603670 - DNA, 17 bp, Homo sapiens
ttcagaagtcacacatt

SEQ ID NO: 3603671 - DNA, 22 bp, Homo sapiens
ttcagaagtcacacattacaaa

SEQ ID NO: 3603672 - DNA, 20 bp, Homo sapiens
ttcagaatggcagtcctgga

SEQ ID NO: 3603673 - DNA, 23 bp, Homo sapiens
ttcagaatggcagtcctggaggc

SEQ ID NO: 3603674 - DNA, 24 bp, Homo sapiens
ttcagaatggcagtcctggaggca

SEQ ID NO: 3603675 - DNA, 14 bp, Homo sapiens
ttcagacacagctc

SEQ ID NO: 3603676 - DNA, 19 bp, Homo sapiens
ttcagacacagctcttcca

SEQ ID NO: 3603677 - DNA, 24 bp, Homo sapiens
ttcagacacagctcttccagggca

SEQ ID NO: 3603678 - DNA, 21 bp, Homo sapiens
ttcagagaattatctcaagta

SEQ ID NO: 3603679 - DNA, 15 bp, Homo sapiens
ttcagagaggccttt

SEQ ID NO: 3603680 - DNA, 12 bp, Homo sapiens
ttcagaggctca

SEQ ID NO: 3603681 - DNA, 22 bp, Homo sapiens
ttcagattcccagagcaaaata

SEQ ID NO: 3603682 - DNA, 16 bp, Homo sapiens
ttcagatttgccttat

SEQ ID NO: 3603683 - DNA, 18 bp, Homo sapiens
ttcagcaagataaacatt

SEQ ID NO: 3603684 - DNA, 17 bp, Homo sapiens
ttcagcaccaagcatgt

SEQ ID NO: 3603685 - DNA, 11 bp, Homo sapiens
ttcagccaggt

SEQ ID NO: 3603686 - DNA, 13 bp, Homo sapiens
ttcagccaggtct

SEQ ID NO: 3603687 - DNA, 14 bp, Homo sapiens
ttcagccaggtctg

SEQ ID NO: 3603688 - DNA, 21 bp, Homo sapiens
ttcagccaggtctgactccaa

SEQ ID NO: 3603689 - DNA, 11 bp, Homo sapiens
ttcagctctgg

SEQ ID NO: 3603690 - DNA, 20 bp, Homo sapiens
ttcagctttaaaggccagga

SEQ ID NO: 3603691 - DNA, 15 bp, Homo sapiens
ttcaggactctctcc

SEQ ID NO: 3603692 - DNA, 21 bp, Homo sapiens
aagctatcacctagcagcctc

SEQ ID NO: 3603693 - DNA, 14 bp, Homo sapiens
aagctccatctcca

SEQ ID NO: 3603694 - DNA, 16 bp, Homo sapiens
aagctcccaccccact

SEQ ID NO: 3603695 - DNA, 18 bp, Homo sapiens
aagctcctcctccctgca

SEQ ID NO: 3603696 - DNA, 16 bp, Homo sapiens
aagctcctctccccag

SEQ ID NO: 3603697 - DNA, 18 bp, Homo sapiens
aagctcctctccccagcc

SEQ ID NO: 3603698 - DNA, 22 bp, Homo sapiens
aagctcctctccccagcccaga

SEQ ID NO: 3603699 - DNA, 23 bp, Homo sapiens
aagctcctctccccagcccagag

SEQ ID NO: 3603700 - DNA, 18 bp, Homo sapiens
aagctctccgagctctgg

SEQ ID NO: 3603701 - DNA, 13 bp, Homo sapiens
aagctctgaaaac

SEQ ID NO: 3603702 - DNA, 20 bp, Homo sapiens
aagctctgaaaacaaggttt

SEQ ID NO: 3603703 - DNA, 23 bp, Homo sapiens
aagctctgttccatgcaactgga

SEQ ID NO: 3603704 - DNA, 18 bp, Homo sapiens
aagctgaatattttttat

SEQ ID NO: 3603705 - DNA, 23 bp, Homo sapiens
aagctgaatattttttatttcta

SEQ ID NO: 3603706 - DNA, 18 bp, Homo sapiens
aagctgatttttgtcttt

SEQ ID NO: 3603707 - DNA, 15 bp, Homo sapiens
aagctgccctgccca

SEQ ID NO: 3603708 - DNA, 13 bp, Homo sapiens
aagctgctgtgtc

SEQ ID NO: 3603709 - DNA, 19 bp, Homo sapiens
aagctgcttgtcctgggcc

SEQ ID NO: 3603710 - DNA, 16 bp, Homo sapiens
aagctggcaacatgaa

SEQ ID NO: 3603711 - DNA, 13 bp, Homo sapiens
aagctggcacaaa

SEQ ID NO: 3603712 - DNA, 22 bp, Homo sapiens
aagctgggaagaccctttcaga

SEQ ID NO: 3603713 - DNA, 22 bp, Homo sapiens
aagctgtataattaattgtcat

SEQ ID NO: 3603714 - DNA, 13 bp, Homo sapiens
aagctgtccctgc

SEQ ID NO: 3603715 - DNA, 20 bp, Homo sapiens
aagctgtccctgcagggcca

SEQ ID NO: 3603716 - DNA, 21 bp, Homo sapiens
aagctgtccctgcagggccat

SEQ ID NO: 3603717 - DNA, 10 bp, Homo sapiens
aagctgtgca

SEQ ID NO: 3603718 - DNA, 23 bp, Homo sapiens
aagctgtgttgaaacagaaaaat

SEQ ID NO: 3603719 - DNA, 12 bp, Homo sapiens
aagcttcagact

SEQ ID NO: 3603720 - DNA, 14 bp, Homo sapiens
aagcttcccaacag

SEQ ID NO: 3603721 - DNA, 21 bp, Homo sapiens
aagcttggttctgtgaacaag

SEQ ID NO: 3603722 - DNA, 17 bp, Homo sapiens
aagcttgtcaaagatgc

SEQ ID NO: 3603723 - DNA, 21 bp, Homo sapiens
aagctttgggggagtgggcgc

SEQ ID NO: 3603724 - DNA, 14 bp, Homo sapiens
aagctttgttctgg

SEQ ID NO: 3603725 - DNA, 17 bp, Homo sapiens
aagctttgttctgggag

SEQ ID NO: 3603726 - DNA, 21 bp, Homo sapiens
aaggaaaactatgtattaatt

SEQ ID NO: 3603727 - DNA, 14 bp, Homo sapiens
aaggaaaagcaaga

SEQ ID NO: 3603728 - DNA, 19 bp, Homo sapiens
aaggaaaagcaagaaacag

SEQ ID NO: 3603729 - DNA, 16 bp, Homo sapiens
aaggaacacagagcag

SEQ ID NO: 3603730 - DNA, 13 bp, Homo sapiens
aaggaacactgac

SEQ ID NO: 3603731 - DNA, 18 bp, Homo sapiens
aaggaaccctcaggccac

SEQ ID NO: 3603732 - DNA, 18 bp, Homo sapiens
aaggaagctgtgttgaaa

SEQ ID NO: 3603733 - DNA, 21 bp, Homo sapiens
aaggaataaattgctccttga

SEQ ID NO: 3603734 - DNA, 19 bp, Homo sapiens
aaggaatttcttaacttct

SEQ ID NO: 3603735 - DNA, 15 bp, Homo sapiens
aaggacaggaccctc

SEQ ID NO: 3603736 - DNA, 14 bp, Homo sapiens
aaggactgtaatct

SEQ ID NO: 3603737 - DNA, 17 bp, Homo sapiens
aaggacttcctgtccag

SEQ ID NO: 3603738 - DNA, 21 bp, Homo sapiens
aaggacttcctgtccagctcc

SEQ ID NO: 3603739 - DNA, 23 bp, Homo sapiens
aaggacttcctgtccagctccaa

SEQ ID NO: 3603740 - DNA, 17 bp, Homo sapiens
aaggagccttttgctct

SEQ ID NO: 3603741 - DNA, 18 bp, Homo sapiens
aaggagctgctatagcct

SEQ ID NO: 3603742 - DNA, 20 bp, Homo sapiens
aaggagctgctatagcctgg

SEQ ID NO: 3603743 - DNA, 18 bp, Homo sapiens
aaggaggtgggccacacc

SEQ ID NO: 3603744 - DNA, 16 bp, Homo sapiens
aaggagttacagggaa

SEQ ID NO: 3603745 - DNA, 12 bp, Homo sapiens
aaggataaagaa

SEQ ID NO: 3603746 - DNA, 20 bp, Homo sapiens
aaggatagatgctggcccag

SEQ ID NO: 3603747 - DNA, 14 bp, Homo sapiens
aaggatatgattaa

SEQ ID NO: 3603748 - DNA, 23 bp, Homo sapiens
aaggatatgattaatattattaa

SEQ ID NO: 3603749 - DNA, 20 bp, Homo sapiens
aaggatctctataacagatc

SEQ ID NO: 3603750 - DNA, 21 bp, Homo sapiens
aaggatctgtgattggctggt

SEQ ID NO: 3603751 - DNA, 13 bp, Homo sapiens
aaggattataaac

SEQ ID NO: 3603752 - DNA, 14 bp, Homo sapiens
aaggattttaccaa

SEQ ID NO: 3603753 - DNA, 18 bp, Homo sapiens
aaggattttaccaaagca

SEQ ID NO: 3603754 - DNA, 20 bp, Homo sapiens
aaggattttaccaaagcatc

SEQ ID NO: 3603755 - DNA, 19 bp, Homo sapiens
aaggcacagtgggagctga

SEQ ID NO: 3603756 - DNA, 22 bp, Homo sapiens
aaggcacagtgggagctgagct

SEQ ID NO: 3603757 - DNA, 12 bp, Homo sapiens
aaggcagggacc

SEQ ID NO: 3603758 - DNA, 22 bp, Homo sapiens
aaggcagggcaagaacagaagt

SEQ ID NO: 3603759 - DNA, 18 bp, Homo sapiens
aaggcaggtgcttttggc

SEQ ID NO: 3603760 - DNA, 21 bp, Homo sapiens
aaggcagtggcaggggagcag

SEQ ID NO: 3603761 - DNA, 15 bp, Homo sapiens
aaggcagttttctaa

SEQ ID NO: 3603762 - DNA, 19 bp, Homo sapiens
aaggcattctcccagctct

SEQ ID NO: 3603763 - DNA, 17 bp, Homo sapiens
aaggccaaaatcaagag

SEQ ID NO: 3603764 - DNA, 18 bp, Homo sapiens
aaggccaaaatcaagagt

SEQ ID NO: 3603765 - DNA, 16 bp, Homo sapiens
aaggccagagagggaa

SEQ ID NO: 3603766 - DNA, 23 bp, Homo sapiens
aaggccagagagggaaaaggcag

SEQ ID NO: 3603767 - DNA, 15 bp, Homo sapiens
aaggccagcaacatt

SEQ ID NO: 3603768 - DNA, 22 bp, Homo sapiens
aaggccaggacgggccacacgt

SEQ ID NO: 3603769 - DNA, 15 bp, Homo sapiens
aaggccccagagaga

SEQ ID NO: 3603770 - DNA, 16 bp, Homo sapiens
aaggccccagagagac

SEQ ID NO: 3603771 - DNA, 15 bp, Homo sapiens
aaggcccctgcaatg

SEQ ID NO: 3603772 - DNA, 16 bp, Homo sapiens
aaggcccctgcaatgt

SEQ ID NO: 3603773 - DNA, 14 bp, Homo sapiens
aaggccctcattct

SEQ ID NO: 3603774 - DNA, 12 bp, Homo sapiens
aaggctctcccc

SEQ ID NO: 3603775 - DNA, 18 bp, Homo sapiens
aaggctggtaagagaagt

SEQ ID NO: 3603776 - DNA, 13 bp, Homo sapiens
aaggctgtacata

SEQ ID NO: 3603777 - DNA, 18 bp, Homo sapiens
aaggctttaaagctgaga

SEQ ID NO: 3603778 - DNA, 16 bp, Homo sapiens
aagggaaactgccagc

SEQ ID NO: 3603779 - DNA, 23 bp, Homo sapiens
aagggaaactgccagcaacgcag

SEQ ID NO: 3603780 - DNA, 14 bp, Homo sapiens
aagggaaagcctct

SEQ ID NO: 3603781 - DNA, 18 bp, Homo sapiens
aagggaaagcctctggcc

SEQ ID NO: 3603782 - DNA, 19 bp, Homo sapiens
aagggaaagcgggcagccc

SEQ ID NO: 3603783 - DNA, 17 bp, Homo sapiens
aagggaccatctgctgc

SEQ ID NO: 3603784 - DNA, 15 bp, Homo sapiens
aagggactacctctg

SEQ ID NO: 3603785 - DNA, 19 bp, Homo sapiens
aagggactacctctgtgcc

SEQ ID NO: 3603786 - DNA, 15 bp, Homo sapiens
aagggagactgacca

SEQ ID NO: 3603787 - DNA, 22 bp, Homo sapiens
aagggagagttctttgctgccc

SEQ ID NO: 3603788 - DNA, 23 bp, Homo sapiens
aagggagagttctttgctgcccc

SEQ ID NO: 3603789 - DNA, 12 bp, Homo sapiens
aagggagccaag

SEQ ID NO: 3603790 - DNA, 13 bp, Homo sapiens
aagggagccaagg

SEQ ID NO: 3603791 - DNA, 15 bp, Homo sapiens
aagggatctggtcct

SEQ ID NO: 3603792 - DNA, 22 bp, Homo sapiens
aagggcagggcccacgtgtata

SEQ ID NO: 3603793 - DNA, 11 bp, Homo sapiens
aagggcagtgc

SEQ ID NO: 3603794 - DNA, 22 bp, Homo sapiens
aagggcagtgcccatgtgtaca

SEQ ID NO: 3603795 - DNA, 14 bp, Homo sapiens
aagggcataaagta

SEQ ID NO: 3603796 - DNA, 21 bp, Homo sapiens
aagggcataaagtaaatacat

SEQ ID NO: 3603797 - DNA, 14 bp, Homo sapiens
aagggccagagcca

SEQ ID NO: 3603798 - DNA, 15 bp, Homo sapiens
aagggccagagccag

SEQ ID NO: 3603799 - DNA, 16 bp, Homo sapiens
aagggccagagccagg

SEQ ID NO: 3603800 - DNA, 13 bp, Homo sapiens
aaggggagcccac

SEQ ID NO: 3603801 - DNA, 16 bp, Homo sapiens
aaggggagtaggtggg

SEQ ID NO: 3603802 - DNA, 22 bp, Homo sapiens
aaggggagtaggtgggggaaca

SEQ ID NO: 3603803 - DNA, 21 bp, Homo sapiens
aaggggctgagtgagttcaac

SEQ ID NO: 3603804 - DNA, 21 bp, Homo sapiens
aagggggctgctgctcctctc

SEQ ID NO: 3603805 - DNA, 22 bp, Homo sapiens
aaggggttttcttgataatttt

SEQ ID NO: 3603806 - DNA, 12 bp, Homo sapiens
aagggtcctctt

SEQ ID NO: 3603807 - DNA, 18 bp, Homo sapiens
aagggtctctctccaggt

SEQ ID NO: 3603808 - DNA, 19 bp, Homo sapiens
aagggtgatgggaaagcat

SEQ ID NO: 3603809 - DNA, 21 bp, Homo sapiens
aagggtgatgggaaagcattg

SEQ ID NO: 3603810 - DNA, 18 bp, Homo sapiens
aagggtttcgactggtcc

SEQ ID NO: 3603811 - DNA, 12 bp, Homo sapiens
aaggtaaatggt

SEQ ID NO: 3603812 - DNA, 19 bp, Homo sapiens
aaggtactttcatatttta

SEQ ID NO: 3603813 - DNA, 21 bp, Homo sapiens
aaggtatacacccagttctga

SEQ ID NO: 3603814 - DNA, 21 bp, Homo sapiens
aaggtctgtggtgcagtgtgt

SEQ ID NO: 3603815 - DNA, 22 bp, Homo sapiens
aaggtgaggtgaactccaggca

SEQ ID NO: 3603816 - DNA, 15 bp, Homo sapiens
aaggtgcactccaga

SEQ ID NO: 3603817 - DNA, 14 bp, Homo sapiens
aaggtgctaacata

SEQ ID NO: 3603818 - DNA, 18 bp, Homo sapiens
aaggtgctgacggccagg

SEQ ID NO: 3603819 - DNA, 17 bp, Homo sapiens
aaggtggggagaagctg

SEQ ID NO: 3603820 - DNA, 13 bp, Homo sapiens
aaggtttttagca

SEQ ID NO: 3603821 - DNA, 21 bp, Homo sapiens
aagtaaaacaaatgaaattta

SEQ ID NO: 3603822 - DNA, 15 bp, Homo sapiens
aagtaaaaccacagc

SEQ ID NO: 3603823 - DNA, 18 bp, Homo sapiens
aagtaacttttaaaattt

SEQ ID NO: 3603824 - DNA, 14 bp, Homo sapiens
aaaaaataattgga

SEQ ID NO: 3603825 - DNA, 12 bp, Homo sapiens
aaaaaatgaata

SEQ ID NO: 3603826 - DNA, 12 bp, Homo sapiens
aaaaacacagca

SEQ ID NO: 3603827 - DNA, 19 bp, Homo sapiens
aaaaacccacaattgaact

SEQ ID NO: 3603828 - DNA, 12 bp, Homo sapiens
aaaaagaaactt

SEQ ID NO: 3603829 - DNA, 16 bp, Homo sapiens
aaaaagacataaaaca

SEQ ID NO: 3603830 - DNA, 12 bp, Homo sapiens
aaaaagagacat

SEQ ID NO: 3603831 - DNA, 13 bp, Homo sapiens
aaaaagccacagc

SEQ ID NO: 3603832 - DNA, 12 bp, Homo sapiens
aaaaagcctcca

SEQ ID NO: 3603833 - DNA, 14 bp, Homo sapiens
aaaaagctctgaaa

SEQ ID NO: 3603834 - DNA, 22 bp, Homo sapiens
aaaaaggctgctcacaagttct

SEQ ID NO: 3603835 - DNA, 14 bp, Homo sapiens
aaaaaggtaaatgg

SEQ ID NO: 3603836 - DNA, 23 bp, Homo sapiens
aaaaagtaatgacttagaaactg

SEQ ID NO: 3603837 - DNA, 13 bp, Homo sapiens
aaaaagttgttct

SEQ ID NO: 3603838 - DNA, 16 bp, Homo sapiens
aaaaagttttagtttt

SEQ ID NO: 3603839 - DNA, 24 bp, Homo sapiens
aaaaataaatatatctaccccaga

SEQ ID NO: 3603840 - DNA, 13 bp, Homo sapiens
aaaaataattgga

SEQ ID NO: 3603841 - DNA, 22 bp, Homo sapiens
aaaaatacaccgtttagaaaaa

SEQ ID NO: 3603842 - DNA, 15 bp, Homo sapiens
aaaaatatatactaa

SEQ ID NO: 3603843 - DNA, 17 bp, Homo sapiens
aaaaatcaccatctttg

SEQ ID NO: 3603844 - DNA, 20 bp, Homo sapiens
aaaaatcctattctgatgaa

SEQ ID NO: 3603845 - DNA, 12 bp, Homo sapiens
aaaaatgtgtgg

SEQ ID NO: 3603846 - DNA, 23 bp, Homo sapiens
aaaaatgttagtattttaatcct

SEQ ID NO: 3603847 - DNA, 19 bp, Homo sapiens
aaaacaaagggaaaaaaga

SEQ ID NO: 3603848 - DNA, 13 bp, Homo sapiens
aaaacaagacaga

SEQ ID NO: 3603849 - DNA, 15 bp, Homo sapiens
aaaacaagtgaaata

SEQ ID NO: 3603850 - DNA, 21 bp, Homo sapiens
aaaacaccgcttctgcctttt

SEQ ID NO: 3603851 - DNA, 20 bp, Homo sapiens
aaaacagctttgtctccaaa

SEQ ID NO: 3603852 - DNA, 22 bp, Homo sapiens
aaaaccacagttattaattaaa

SEQ ID NO: 3603853 - DNA, 11 bp, Homo sapiens
aaaaccaggcc

SEQ ID NO: 3603854 - DNA, 16 bp, Homo sapiens
aaaaccaggctttcta

SEQ ID NO: 3603855 - DNA, 15 bp, Homo sapiens
aaaaccatattttat

SEQ ID NO: 3603856 - DNA, 19 bp, Homo sapiens
aaaacctatttttccttta

SEQ ID NO: 3603857 - DNA, 21 bp, Homo sapiens
aaaaccttaaaagtaataaag

SEQ ID NO: 3603858 - DNA, 22 bp, Homo sapiens
aaaaccttaaaagtaataaaga

SEQ ID NO: 3603859 - DNA, 23 bp, Homo sapiens
aaaaccttaaaagtaataaagag

SEQ ID NO: 3603860 - DNA, 20 bp, Homo sapiens
aaaactaaggatttttcaag

SEQ ID NO: 3603861 - DNA, 15 bp, Homo sapiens
aaaactatgtattaa

SEQ ID NO: 3603862 - DNA, 20 bp, Homo sapiens
aaaactatgtattaatttag

SEQ ID NO: 3603863 - DNA, 18 bp, Homo sapiens
aaaactcaggcaaagaaa

SEQ ID NO: 3603864 - DNA, 15 bp, Homo sapiens
aaaactgaagctttt

SEQ ID NO: 3603865 - DNA, 14 bp, Homo sapiens
aaaacttcaaagct

SEQ ID NO: 3603866 - DNA, 10 bp, Homo sapiens
aaaacttctg

SEQ ID NO: 3603867 - DNA, 16 bp, Homo sapiens
aaaactttactttcag

SEQ ID NO: 3603868 - DNA, 17 bp, Homo sapiens
aaaagaaacaccagtgt

SEQ ID NO: 3603869 - DNA, 9 bp, Homo sapiens
aaaagaaga

SEQ ID NO: 3603870 - DNA, 13 bp, Homo sapiens
aaaagaagaaaag

SEQ ID NO: 3603871 - DNA, 15 bp, Homo sapiens
aaaagaagaaaagat

SEQ ID NO: 3603872 - DNA, 16 bp, Homo sapiens
aaaagaataaaaactt

SEQ ID NO: 3603873 - DNA, 13 bp, Homo sapiens
aaaagaatatttt

SEQ ID NO: 3603874 - DNA, 16 bp, Homo sapiens
aaaagacataaaacag

SEQ ID NO: 3603875 - DNA, 22 bp, Homo sapiens
aaaagacattagagaaaacctt

SEQ ID NO: 3603876 - DNA, 13 bp, Homo sapiens
aaaagactccaaa

SEQ ID NO: 3603877 - DNA, 15 bp, Homo sapiens
aaaagacttgtttct

SEQ ID NO: 3603878 - DNA, 19 bp, Homo sapiens
aaaagatgaaaaagaataa

SEQ ID NO: 3603879 - DNA, 15 bp, Homo sapiens
aaaagattcttctta

SEQ ID NO: 3603880 - DNA, 16 bp, Homo sapiens
aaaagattcttcttaa

SEQ ID NO: 3603881 - DNA, 13 bp, Homo sapiens
aaaagcaaatcag

SEQ ID NO: 3603882 - DNA, 15 bp, Homo sapiens
aaaagcaatggttga

SEQ ID NO: 3603883 - DNA, 19 bp, Homo sapiens
aaaagcacaagtacttttg

SEQ ID NO: 3603884 - DNA, 13 bp, Homo sapiens
aaaagcagacatt

SEQ ID NO: 3603885 - DNA, 15 bp, Homo sapiens
aaaagcattttgtaa

SEQ ID NO: 3603886 - DNA, 16 bp, Homo sapiens
aaaagcattttgtaat

SEQ ID NO: 3603887 - DNA, 11 bp, Homo sapiens
aaaagccacag

SEQ ID NO: 3603888 - DNA, 17 bp, Homo sapiens
aaaagccataacttgaa

SEQ ID NO: 3603889 - DNA, 21 bp, Homo sapiens
aaaagccctagactggtgcta

SEQ ID NO: 3603890 - DNA, 22 bp, Homo sapiens
aaaagccgaaagggttaatcat

SEQ ID NO: 3603891 - DNA, 13 bp, Homo sapiens
aaaagctgctcag

SEQ ID NO: 3603892 - DNA, 15 bp, Homo sapiens
aaaaggaacaaaaat

SEQ ID NO: 3603893 - DNA, 20 bp, Homo sapiens
aaaaggatctttgtggccaa

SEQ ID NO: 3603894 - DNA, 20 bp, Homo sapiens
aaaaggctaggtacacagct

SEQ ID NO: 3603895 - DNA, 16 bp, Homo sapiens
aaaagtctacctgtgt

SEQ ID NO: 3603896 - DNA, 13 bp, Homo sapiens
aaaagtcttccta

SEQ ID NO: 3603897 - DNA, 23 bp, Homo sapiens
aaaagttgggttttctccattca

SEQ ID NO: 3603898 - DNA, 17 bp, Homo sapiens
aaaagtttattgtttga

SEQ ID NO: 3603899 - DNA, 14 bp, Homo sapiens
aaaataaacaaata

SEQ ID NO: 3603900 - DNA, 14 bp, Homo sapiens
aaaataaatatatc

SEQ ID NO: 3603901 - DNA, 20 bp, Homo sapiens
aaaataaatcttagtgttca

SEQ ID NO: 3603902 - DNA, 13 bp, Homo sapiens
aaaataaatttaa

SEQ ID NO: 3603903 - DNA, 17 bp, Homo sapiens
aaaataatgtttgatag

SEQ ID NO: 3603904 - DNA, 14 bp, Homo sapiens
aaaatacacactca

SEQ ID NO: 3603905 - DNA, 21 bp, Homo sapiens
aaaatacctctaataaacact

SEQ ID NO: 3603906 - DNA, 15 bp, Homo sapiens
aaaatagagaaaatt

SEQ ID NO: 3603907 - DNA, 13 bp, Homo sapiens
aaaatatagctaa

SEQ ID NO: 3603908 - DNA, 17 bp, Homo sapiens
aaaatatatactaaaca

SEQ ID NO: 3603909 - DNA, 12 bp, Homo sapiens
aaaatatatctt

SEQ ID NO: 3603910 - DNA, 21 bp, Homo sapiens
aaaatatcaccaaaaacctat

SEQ ID NO: 3603911 - DNA, 10 bp, Homo sapiens
aaaatcaaga

SEQ ID NO: 3603912 - DNA, 17 bp, Homo sapiens
aaaatcaccatctttgt

SEQ ID NO: 3603913 - DNA, 13 bp, Homo sapiens
aaaatcagaacaa

SEQ ID NO: 3603914 - DNA, 15 bp, Homo sapiens
aaaatcatatagacc

SEQ ID NO: 3603915 - DNA, 12 bp, Homo sapiens
aaaatcatttct

SEQ ID NO: 3603916 - DNA, 13 bp, Homo sapiens
aaaatcttcactt

SEQ ID NO: 3603917 - DNA, 22 bp, Homo sapiens
aaaatcttcactttcttaagca

SEQ ID NO: 3603918 - DNA, 21 bp, Homo sapiens
aaaatcttgtaggtcattgca

SEQ ID NO: 3603919 - DNA, 15 bp, Homo sapiens
aaaatgaaatccttt

SEQ ID NO: 3603920 - DNA, 14 bp, Homo sapiens
aaaatgaaatgcat

SEQ ID NO: 3603921 - DNA, 18 bp, Homo sapiens
aaaatgaaatgcatattt

SEQ ID NO: 3603922 - DNA, 21 bp, Homo sapiens
aaaatgaagaaggaagctgtg

SEQ ID NO: 3603923 - DNA, 16 bp, Homo sapiens
aaaatgacctcaagga

SEQ ID NO: 3603924 - DNA, 18 bp, Homo sapiens
aaaatgagtcatttgttt

SEQ ID NO: 3603925 - DNA, 23 bp, Homo sapiens
aaaatgagtcatttgtttaaaca

SEQ ID NO: 3603926 - DNA, 23 bp, Homo sapiens
aaaatggacatggtggctttgtt

SEQ ID NO: 3603927 - DNA, 15 bp, Homo sapiens
aaaatggcagtgact

SEQ ID NO: 3603928 - DNA, 13 bp, Homo sapiens
aaaatgttaaaac

SEQ ID NO: 3603929 - DNA, 14 bp, Homo sapiens
aaaatgttaaaaca

SEQ ID NO: 3603930 - DNA, 12 bp, Homo sapiens
aaaattcatttg

SEQ ID NO: 3603931 - DNA, 12 bp, Homo sapiens
aaaattcatttt

SEQ ID NO: 3603932 - DNA, 12 bp, Homo sapiens
aaaattgcttct

SEQ ID NO: 3603933 - DNA, 15 bp, Homo sapiens
aaaattggtaaaaat

SEQ ID NO: 3603934 - DNA, 12 bp, Homo sapiens
aaaatttaattt

SEQ ID NO: 3603935 - DNA, 19 bp, Homo sapiens
aaaatttagaaatataatt

SEQ ID NO: 3603936 - DNA, 14 bp, Homo sapiens
aaaatttatacacc

SEQ ID NO: 3603937 - DNA, 20 bp, Homo sapiens
aaaatttatacaccagcaat

SEQ ID NO: 3603938 - DNA, 15 bp, Homo sapiens
aaaatttcaggatta

SEQ ID NO: 3603939 - DNA, 21 bp, Homo sapiens
aaaatttcataattctgaaac

SEQ ID NO: 3603940 - DNA, 14 bp, Homo sapiens
aaacaaaaaaccca

SEQ ID NO: 3603941 - DNA, 12 bp, Homo sapiens
aaacaaaacaaa

SEQ ID NO: 3603942 - DNA, 17 bp, Homo sapiens
aaacaaaacttgcatct

SEQ ID NO: 3603943 - DNA, 16 bp, Homo sapiens
aaacaaacaaacaaaa

SEQ ID NO: 3603944 - DNA, 12 bp, Homo sapiens
aaacaaatgaaa

SEQ ID NO: 3603945 - DNA, 16 bp, Homo sapiens
aaacaacgttgctatt

SEQ ID NO: 3603946 - DNA, 13 bp, Homo sapiens
aaacaagctgtgc

SEQ ID NO: 3603947 - DNA, 20 bp, Homo sapiens
aaacaagctgtgcaggcatg

SEQ ID NO: 3603948 - DNA, 22 bp, Homo sapiens
aaacaatcccaatctttctata

SEQ ID NO: 3603949 - DNA, 14 bp, Homo sapiens
aaacacagcaaggg

SEQ ID NO: 3603950 - DNA, 23 bp, Homo sapiens
aaacacagcttacaatcgcaaat

SEQ ID NO: 3603951 - DNA, 16 bp, Homo sapiens
aaacacatttccattc

SEQ ID NO: 3603952 - DNA, 13 bp, Homo sapiens
aaacaccagtgtt

SEQ ID NO: 3603953 - DNA, 14 bp, Homo sapiens
aaacaccagtgtta

SEQ ID NO: 3603954 - DNA, 16 bp, Homo sapiens
aaacactgaaatgaaa

SEQ ID NO: 3603955 - DNA, 19 bp, Homo sapiens
aaacagaaacaaaaacact

SEQ ID NO: 3603956 - DNA, 20 bp, Homo sapiens
aaacagacaggaatttagaa

SEQ ID NO: 3603957 - DNA, 11 bp, Homo sapiens
aaacagcatga

SEQ ID NO: 3603958 - DNA, 15 bp, Homo sapiens
aaacagcatgaataa

SEQ ID NO: 3603959 - DNA, 15 bp, Homo sapiens
aaacagctttgtctc

SEQ ID NO: 3603960 - DNA, 19 bp, Homo sapiens
aaacagctttgtctccaaa

SEQ ID NO: 3603961 - DNA, 23 bp, Homo sapiens
aaacaggaaaggagcaatgaaga

SEQ ID NO: 3603962 - DNA, 22 bp, Homo sapiens
aaacagttggtaacttttgtga

SEQ ID NO: 3603963 - DNA, 16 bp, Homo sapiens
aaacataaacacattt

SEQ ID NO: 3603964 - DNA, 20 bp, Homo sapiens
aaacataaacacatttccat

SEQ ID NO: 3603965 - DNA, 14 bp, Homo sapiens
aaacataataaatc

SEQ ID NO: 3603966 - DNA, 18 bp, Homo sapiens
aaacataatgaaaatatt

SEQ ID NO: 3603967 - DNA, 14 bp, Homo sapiens
aaacatcagtttct

SEQ ID NO: 3603968 - DNA, 20 bp, Homo sapiens
aaacattaatatttaccaaa

SEQ ID NO: 3603969 - DNA, 19 bp, Homo sapiens
aaacattcctccagcctcc

SEQ ID NO: 3603970 - DNA, 17 bp, Homo sapiens
aaacattcgtgagctgg

SEQ ID NO: 3603971 - DNA, 11 bp, Homo sapiens
aaacatttata

SEQ ID NO: 3603972 - DNA, 15 bp, Homo sapiens
aaacatttcatttcc

SEQ ID NO: 3603973 - DNA, 21 bp, Homo sapiens
aaacatttctggacagtacct

SEQ ID NO: 3603974 - DNA, 19 bp, Homo sapiens
aaacattttgtcatataag

SEQ ID NO: 3603975 - DNA, 14 bp, Homo sapiens
aaaccaagccgtgg

SEQ ID NO: 3603976 - DNA, 14 bp, Homo sapiens
aaaccacagttatt

SEQ ID NO: 3603977 - DNA, 17 bp, Homo sapiens
aaaccatattttattgt

SEQ ID NO: 3603978 - DNA, 15 bp, Homo sapiens
aaacccaaaggtggc

SEQ ID NO: 3603979 - DNA, 19 bp, Homo sapiens
aaacccaaaggtggcagct

SEQ ID NO: 3603980 - DNA, 22 bp, Homo sapiens
aaacccagctgcaccccttcct

SEQ ID NO: 3603981 - DNA, 12 bp, Homo sapiens
aaaccccagccc

SEQ ID NO: 3603982 - DNA, 16 bp, Homo sapiens
aaacccttaactgaca

SEQ ID NO: 3603983 - DNA, 17 bp, Homo sapiens
aaacctaagtccttcca

SEQ ID NO: 3603984 - DNA, 22 bp, Homo sapiens
aaacctctcctcatgttctgct

SEQ ID NO: 3603985 - DNA, 21 bp, Homo sapiens
aaacctgccaaggagcatcct

SEQ ID NO: 3603986 - DNA, 12 bp, Homo sapiens
aaacctgttcta

SEQ ID NO: 3603987 - DNA, 13 bp, Homo sapiens
aaaccttaaaagt

SEQ ID NO: 3603988 - DNA, 14 bp, Homo sapiens
aaaccttaaaagta

SEQ ID NO: 3603989 - DNA, 16 bp, Homo sapiens
aaaccttgaaggtctg

SEQ ID NO: 3603990 - DNA, 22 bp, Homo sapiens
aaaccttgctctcctcatctcc

SEQ ID NO: 3603991 - DNA, 23 bp, Homo sapiens
aaaccttttatttttatttctga

SEQ ID NO: 3603992 - DNA, 16 bp, Homo sapiens
aaacgcgtctgcctgg

SEQ ID NO: 3603993 - DNA, 18 bp, Homo sapiens
aaacggattattttttca

SEQ ID NO: 3603994 - DNA, 23 bp, Homo sapiens
aaacggattattttttcagaccg

SEQ ID NO: 3603995 - DNA, 20 bp, Homo sapiens
aaacggcaacgtagcctggg

SEQ ID NO: 3603996 - DNA, 16 bp, Homo sapiens
aaacgttttgtatagt

SEQ ID NO: 3603997 - DNA, 16 bp, Homo sapiens
aaactaagatgtgcag

SEQ ID NO: 3603998 - DNA, 14 bp, Homo sapiens
aaactactctttga

SEQ ID NO: 3603999 - DNA, 17 bp, Homo sapiens
aaactactctttgattt

SEQ ID NO: 3604000 - DNA, 16 bp, Homo sapiens
aaactacttttctaaa

SEQ ID NO: 3604001 - DNA, 17 bp, Homo sapiens
aaactacttttctaaaa

SEQ ID NO: 3604002 - DNA, 18 bp, Homo sapiens
aaactacttttctaaaat

SEQ ID NO: 3604003 - DNA, 19 bp, Homo sapiens
aaactatgtattaatttag

SEQ ID NO: 3604004 - DNA, 21 bp, Homo sapiens
aaactcaaaatatttgtacat

SEQ ID NO: 3604005 - DNA, 17 bp, Homo sapiens
aaactcaggcaaagaaa

SEQ ID NO: 3604006 - DNA, 16 bp, Homo sapiens
aaactcagggcttcta

SEQ ID NO: 3604007 - DNA, 11 bp, Homo sapiens
aaactccaggc

SEQ ID NO: 3604008 - DNA, 15 bp, Homo sapiens
aaactccaggctgga

SEQ ID NO: 3604009 - DNA, 20 bp, Homo sapiens
aaactccatctcaaaacaaa

SEQ ID NO: 3604010 - DNA, 21 bp, Homo sapiens
aaactccatctcaaaacaaaa

SEQ ID NO: 3604011 - DNA, 23 bp, Homo sapiens
aaactcccacttgtcatgtgaca

SEQ ID NO: 3604012 - DNA, 11 bp, Homo sapiens
aaactcctgac

SEQ ID NO: 3604013 - DNA, 14 bp, Homo sapiens
aaactctaccctga

SEQ ID NO: 3604014 - DNA, 12 bp, Homo sapiens
aaactctgctgt

SEQ ID NO: 3604015 - DNA, 13 bp, Homo sapiens
aaactctgggtct

SEQ ID NO: 3604016 - DNA, 13 bp, Homo sapiens
aaactctttattt

SEQ ID NO: 3604017 - DNA, 17 bp, Homo sapiens
aaactgaagctttttat

SEQ ID NO: 3604018 - DNA, 12 bp, Homo sapiens
aaactgacagat

SEQ ID NO: 3604019 - DNA, 15 bp, Homo sapiens
aaactgcacatctac

SEQ ID NO: 3604020 - DNA, 23 bp, Homo sapiens
aaactgcagcctctctggctggt

SEQ ID NO: 3604021 - DNA, 23 bp, Homo sapiens
aaactgcataagtgaaaatctta

SEQ ID NO: 3604022 - DNA, 21 bp, Homo sapiens
aaactgctgaattcacctgtg

SEQ ID NO: 3604023 - DNA, 15 bp, Homo sapiens
aaactggatatttca

SEQ ID NO: 3604024 - DNA, 19 bp, Homo sapiens
aaactggatatttcaatct

SEQ ID NO: 3604025 - DNA, 20 bp, Homo sapiens
aaactggatatttcaatctt

SEQ ID NO: 3604026 - DNA, 11 bp, Homo sapiens
aaactggttta

SEQ ID NO: 3604027 - DNA, 12 bp, Homo sapiens
aaactgtagtaa

SEQ ID NO: 3604028 - DNA, 13 bp, Homo sapiens
aaactgtatgctc

SEQ ID NO: 3604029 - DNA, 20 bp, Homo sapiens
aaacttaaaagtattcatac

SEQ ID NO: 3604030 - DNA, 13 bp, Homo sapiens
aaacttaagaatt

SEQ ID NO: 3604031 - DNA, 15 bp, Homo sapiens
aaacttcaaagctga

SEQ ID NO: 3604032 - DNA, 11 bp, Homo sapiens
aaacttcagca

SEQ ID NO: 3604033 - DNA, 16 bp, Homo sapiens
aaacttcagcaaccct

SEQ ID NO: 3604034 - DNA, 11 bp, Homo sapiens
aaacttctgct

SEQ ID NO: 3604035 - DNA, 22 bp, Homo sapiens
aaacttgtcttttcaaaatatt

SEQ ID NO: 3604036 - DNA, 14 bp, Homo sapiens
aaacttttttattt

SEQ ID NO: 3604037 - DNA, 19 bp, Homo sapiens
aaactttttttctgtacca

SEQ ID NO: 3604038 - DNA, 23 bp, Homo sapiens
aaactttttttctgtaccagtta

SEQ ID NO: 3604039 - DNA, 13 bp, Homo sapiens
aaagaaaatgaaa

SEQ ID NO: 3604040 - DNA, 13 bp, Homo sapiens
aaagaaaatgtct

SEQ ID NO: 3604041 - DNA, 20 bp, Homo sapiens
aaagaaacctggggtgaata

SEQ ID NO: 3604042 - DNA, 13 bp, Homo sapiens
aaagaaataaacc

SEQ ID NO: 3604043 - DNA, 9 bp, Homo sapiens
aaagaagaa

SEQ ID NO: 3604044 - DNA, 13 bp, Homo sapiens
aaagaagaaaaga

SEQ ID NO: 3604045 - DNA, 13 bp, Homo sapiens
aaagaagagaagt

SEQ ID NO: 3604046 - DNA, 18 bp, Homo sapiens
aaagaagaggagaaaaag

SEQ ID NO: 3604047 - DNA, 13 bp, Homo sapiens
aaagaagatagct

SEQ ID NO: 3604048 - DNA, 18 bp, Homo sapiens
aaagaagggggccctgct

SEQ ID NO: 3604049 - DNA, 13 bp, Homo sapiens
aaagaagtggaga

SEQ ID NO: 3604050 - DNA, 17 bp, Homo sapiens
aaagacaatcactgcca

SEQ ID NO: 3604051 - DNA, 18 bp, Homo sapiens
aaagacaatcactgccaa

SEQ ID NO: 3604052 - DNA, 9 bp, Homo sapiens
aaagacaga

SEQ ID NO: 3604053 - DNA, 22 bp, Homo sapiens
aaagacagggctgataagctaa

SEQ ID NO: 3604054 - DNA, 14 bp, Homo sapiens
aaagacataaaaca

SEQ ID NO: 3604055 - DNA, 10 bp, Homo sapiens
aaagacatta

SEQ ID NO: 3604056 - DNA, 18 bp, Homo sapiens
aaagacattagagaaaac

SEQ ID NO: 3604057 - DNA, 12 bp, Homo sapiens
aaagacattgac

SEQ ID NO: 3604058 - DNA, 15 bp, Homo sapiens
aaagactattcaaac

SEQ ID NO: 3604059 - DNA, 19 bp, Homo sapiens
aaagactattcaaacagtc

SEQ ID NO: 3604060 - DNA, 23 bp, Homo sapiens
aaagactattcaaacagtctcag

SEQ ID NO: 3604061 - DNA, 21 bp, Homo sapiens
aaagactccaaagaaatgtaa

SEQ ID NO: 3604062 - DNA, 17 bp, Homo sapiens
aaagactcgagaaccaa

SEQ ID NO: 3604063 - DNA, 19 bp, Homo sapiens
aaagagaaacagttggtaa

SEQ ID NO: 3604064 - DNA, 22 bp, Homo sapiens
aaagagaaacagttggtaactt

SEQ ID NO: 3604065 - DNA, 14 bp, Homo sapiens
aaagagagaagcca

SEQ ID NO: 3604066 - DNA, 20 bp, Homo sapiens
aaagagagacacagctgcag

SEQ ID NO: 3604067 - DNA, 14 bp, Homo sapiens
aaagagatacagag

SEQ ID NO: 3604068 - DNA, 20 bp, Homo sapiens
aaagagctaggaaccctgga

SEQ ID NO: 3604069 - DNA, 15 bp, Homo sapiens
aaagagctgcctgga

SEQ ID NO: 3604070 - DNA, 19 bp, Homo sapiens
aaagagctgcctggatgag

SEQ ID NO: 3604071 - DNA, 12 bp, Homo sapiens
aaagaggcaggg

SEQ ID NO: 3604072 - DNA, 18 bp, Homo sapiens
aaagaggtcgcttgggaa

SEQ ID NO: 3604073 - DNA, 20 bp, Homo sapiens
aaagagtcagacatttcttt

SEQ ID NO: 3604074 - DNA, 19 bp, Homo sapiens
aaagatacaaaatgttact

SEQ ID NO: 3604075 - DNA, 20 bp, Homo sapiens
aaagatctgtcctcagcctt

SEQ ID NO: 3604076 - DNA, 16 bp, Homo sapiens
aaagatgaaaatattt

SEQ ID NO: 3604077 - DNA, 20 bp, Homo sapiens
aaagatgagctttgtctact

SEQ ID NO: 3604078 - DNA, 21 bp, Homo sapiens
aaagatggctgtgcctctgcc

SEQ ID NO: 3604079 - DNA, 23 bp, Homo sapiens
aaagatggctgtgcctctgcctg

SEQ ID NO: 3604080 - DNA, 19 bp, Homo sapiens
aaagattaaatgtgtcatt

SEQ ID NO: 3604081 - DNA, 14 bp, Homo sapiens
aaagattcttctta

SEQ ID NO: 3604082 - DNA, 21 bp, Homo sapiens
aaagattcttcttaaaagttt

SEQ ID NO: 3604083 - DNA, 18 bp, Homo sapiens
aaagcacaagtacttttg

SEQ ID NO: 3604084 - DNA, 15 bp, Homo sapiens
aaagcagctctcccc

SEQ ID NO: 3604085 - DNA, 14 bp, Homo sapiens
aaagcagttaattt

SEQ ID NO: 3604086 - DNA, 17 bp, Homo sapiens
aaagcagttaatttata

SEQ ID NO: 3604087 - DNA, 18 bp, Homo sapiens
aaagcagttaatttatat

SEQ ID NO: 3604088 - DNA, 15 bp, Homo sapiens
aaagcattgtaaatg

SEQ ID NO: 3604089 - DNA, 17 bp, Homo sapiens
aaagcattgtaaatgtg

SEQ ID NO: 3604090 - DNA, 11 bp, Homo sapiens
aaagccacagc

SEQ ID NO: 3604091 - DNA, 18 bp, Homo sapiens
aaagcccaagggatctgg

SEQ ID NO: 3604092 - DNA, 23 bp, Homo sapiens
aaagcccttccatgtcgcctctg

SEQ ID NO: 3604093 - DNA, 21 bp, Homo sapiens
aaagcccttggaacaccctgg

SEQ ID NO: 3604094 - DNA, 22 bp, Homo sapiens
aaagcccttggaacaccctgga

SEQ ID NO: 3604095 - DNA, 21 bp, Homo sapiens
aaagcctcctgccccctgcca

SEQ ID NO: 3604096 - DNA, 13 bp, Homo sapiens
aaagcctctggcc

SEQ ID NO: 3604097 - DNA, 17 bp, Homo sapiens
aaagcctgggtgacatt

SEQ ID NO: 3604098 - DNA, 18 bp, Homo sapiens
aaagcctgggtgacattt

SEQ ID NO: 3604099 - DNA, 16 bp, Homo sapiens
aaagccttaagcaaat

SEQ ID NO: 3604100 - DNA, 14 bp, Homo sapiens
aaagctctgaaaac

SEQ ID NO: 3604101 - DNA, 18 bp, Homo sapiens
aaagctgagagaccctgg

SEQ ID NO: 3604102 - DNA, 22 bp, Homo sapiens
aaagctgagagaccctggcctc

SEQ ID NO: 3604103 - DNA, 23 bp, Homo sapiens
aaagctgagagaccctggcctca

SEQ ID NO: 3604104 - DNA, 21 bp, Homo sapiens
aaagctgggaagaccctttca

SEQ ID NO: 3604105 - DNA, 18 bp, Homo sapiens
aaagcttggttctgtgaa

SEQ ID NO: 3604106 - DNA, 15 bp, Homo sapiens
aaagcttgttaagat

SEQ ID NO: 3604107 - DNA, 15 bp, Homo sapiens
aaaggaaaataatgt

SEQ ID NO: 3604108 - DNA, 16 bp, Homo sapiens
aaaggaaaatgtctgt

SEQ ID NO: 3604109 - DNA, 18 bp, Homo sapiens
aaaggaacaaaaattaca

SEQ ID NO: 3604110 - DNA, 23 bp, Homo sapiens
aaaggaacaaaaattacaaagaa

SEQ ID NO: 3604111 - DNA, 15 bp, Homo sapiens
aaaggacatcagcaa

SEQ ID NO: 3604112 - DNA, 13 bp, Homo sapiens
aaaggataaagaa

SEQ ID NO: 3604113 - DNA, 13 bp, Homo sapiens
aaaggatctgtga

SEQ ID NO: 3604114 - DNA, 18 bp, Homo sapiens
aaaggatctttgtggcca

SEQ ID NO: 3604115 - DNA, 19 bp, Homo sapiens
aaaggatctttgtggccaa

SEQ ID NO: 3604116 - DNA, 17 bp, Homo sapiens
aaaggatgtataaattt

SEQ ID NO: 3604117 - DNA, 18 bp, Homo sapiens
aaaggatgtataaatttt

SEQ ID NO: 3604118 - DNA, 12 bp, Homo sapiens
aaaggatgtgat

SEQ ID NO: 3604119 - DNA, 19 bp, Homo sapiens
aaaggatgtgatatataag

SEQ ID NO: 3604120 - DNA, 14 bp, Homo sapiens
aaaggattttacca

SEQ ID NO: 3604121 - DNA, 15 bp, Homo sapiens
aaaggccagcagctg

SEQ ID NO: 3604122 - DNA, 18 bp, Homo sapiens
aaaggcccttagagggaa

SEQ ID NO: 3604123 - DNA, 19 bp, Homo sapiens
aaaggcccttagagggaat

SEQ ID NO: 3604124 - DNA, 21 bp, Homo sapiens
aaaggcctaattctatgcctg

SEQ ID NO: 3604125 - DNA, 13 bp, Homo sapiens
aaaggctgttaaa

SEQ ID NO: 3604126 - DNA, 15 bp, Homo sapiens
aaagggcagggccca

SEQ ID NO: 3604127 - DNA, 22 bp, Homo sapiens
aaagggtctccgaaatgctgtc

SEQ ID NO: 3604128 - DNA, 22 bp, Homo sapiens
aaaggtacactggtatttatat

SEQ ID NO: 3604129 - DNA, 15 bp, Homo sapiens
aaaggtgcactccag

SEQ ID NO: 3604130 - DNA, 18 bp, Homo sapiens
aaaggtgcactccagact

SEQ ID NO: 3604131 - DNA, 21 bp, Homo sapiens
aaaggttgagtatgtgaagat

SEQ ID NO: 3604132 - DNA, 23 bp, Homo sapiens
aaaggtttttgaaatccaggaat

SEQ ID NO: 3604133 - DNA, 14 bp, Homo sapiens
aaagtaataaagag

SEQ ID NO: 3604134 - DNA, 15 bp, Homo sapiens
aaagtaataaagaga

SEQ ID NO: 3604135 - DNA, 16 bp, Homo sapiens
aaagtaataaagagaa

SEQ ID NO: 3604136 - DNA, 19 bp, Homo sapiens
aaagtaataaagagaaata

SEQ ID NO: 3604137 - DNA, 21 bp, Homo sapiens
aaagtatcctgcttctgatat

SEQ ID NO: 3604138 - DNA, 16 bp, Homo sapiens
aaagtattggcattca

SEQ ID NO: 3604139 - DNA, 17 bp, Homo sapiens
aaagtcattaaagacag

SEQ ID NO: 3604140 - DNA, 22 bp, Homo sapiens
aaagtcctcctttcattaccct

SEQ ID NO: 3604141 - DNA, 18 bp, Homo sapiens
aaagtctgttgattaaag

SEQ ID NO: 3604142 - DNA, 21 bp, Homo sapiens
aaagtgatcttgagaaccttt

SEQ ID NO: 3604143 - DNA, 12 bp, Homo sapiens
aaagtgcccagc

SEQ ID NO: 3604144 - DNA, 16 bp, Homo sapiens
aaagttaccagtgcct

SEQ ID NO: 3604145 - DNA, 13 bp, Homo sapiens
aaagttcatgttg

SEQ ID NO: 3604146 - DNA, 23 bp, Homo sapiens
aaagttccctacttcctgtgact

SEQ ID NO: 3604147 - DNA, 12 bp, Homo sapiens
aaagttgcagat

SEQ ID NO: 3604148 - DNA, 22 bp, Homo sapiens
aaagttgtaaaatagaaaaagt

SEQ ID NO: 3604149 - DNA, 13 bp, Homo sapiens
aaagttgttcttt

SEQ ID NO: 3604150 - DNA, 12 bp, Homo sapiens
aaagtttaaatg

SEQ ID NO: 3604151 - DNA, 13 bp, Homo sapiens
aaagtttaaatgt

SEQ ID NO: 3604152 - DNA, 21 bp, Homo sapiens
aaagtttaaatgtattttaca

SEQ ID NO: 3604153 - DNA, 23 bp, Homo sapiens
aaagtttctaatgttattttcct

SEQ ID NO: 3604154 - DNA, 13 bp, Homo sapiens
aaagttttattat

SEQ ID NO: 3604155 - DNA, 16 bp, Homo sapiens
aaagttttattataaa

SEQ ID NO: 3604156 - DNA, 14 bp, Homo sapiens
aaagttttccagta

SEQ ID NO: 3604157 - DNA, 12 bp, Homo sapiens
aaataaaagcac

SEQ ID NO: 3604158 - DNA, 14 bp, Homo sapiens
aaataaaatattta

SEQ ID NO: 3604159 - DNA, 22 bp, Homo sapiens
aaataaaccaaaggaaaatgtc

SEQ ID NO: 3604160 - DNA, 15 bp, Homo sapiens
aaataaaccaaatat

SEQ ID NO: 3604161 - DNA, 15 bp, Homo sapiens
aaataaacttacaga

SEQ ID NO: 3604162 - DNA, 12 bp, Homo sapiens
aaataaagagga

SEQ ID NO: 3604163 - DNA, 22 bp, Homo sapiens
aaataaagtttcagcggaacac

SEQ ID NO: 3604164 - DNA, 14 bp, Homo sapiens
aaataaatcacaga

SEQ ID NO: 3604165 - DNA, 15 bp, Homo sapiens
aaataaatcacagat

SEQ ID NO: 3604166 - DNA, 11 bp, Homo sapiens
aaataaatgaa

SEQ ID NO: 3604167 - DNA, 15 bp, Homo sapiens
aaataaatgaaactt

SEQ ID NO: 3604168 - DNA, 16 bp, Homo sapiens
aaataaatgtatcata

SEQ ID NO: 3604169 - DNA, 17 bp, Homo sapiens
aaataacaatgtgctct

SEQ ID NO: 3604170 - DNA, 17 bp, Homo sapiens
aaataacagatttctca

SEQ ID NO: 3604171 - DNA, 23 bp, Homo sapiens
aaataactgaaccaaattgcact

SEQ ID NO: 3604172 - DNA, 15 bp, Homo sapiens
aaataacttgcatct

SEQ ID NO: 3604173 - DNA, 16 bp, Homo sapiens
aaataagtcaaaagga

SEQ ID NO: 3604174 - DNA, 17 bp, Homo sapiens
aaataagtcaaaaggaa

SEQ ID NO: 3604175 - DNA, 15 bp, Homo sapiens
aaatacaaaaaatta

SEQ ID NO: 3604176 - DNA, 23 bp, Homo sapiens
aaatacaatcagcccagtgcaaa

SEQ ID NO: 3604177 - DNA, 19 bp, Homo sapiens
aaatacatgcatataatga

SEQ ID NO: 3604178 - DNA, 22 bp, Homo sapiens
aaatacattccttttagagtta

SEQ ID NO: 3604179 - DNA, 18 bp, Homo sapiens
aaataccactagtggaaa

SEQ ID NO: 3604180 - DNA, 21 bp, Homo sapiens
aaataccatgccatttaaagc

SEQ ID NO: 3604181 - DNA, 19 bp, Homo sapiens
aaataccttctatgtatta

SEQ ID NO: 3604182 - DNA, 15 bp, Homo sapiens
aaatacctttgtagt

SEQ ID NO: 3604183 - DNA, 21 bp, Homo sapiens
aaatacctttgtagttactca

SEQ ID NO: 3604184 - DNA, 20 bp, Homo sapiens
aaatagagcttttaaaaatg

SEQ ID NO: 3604185 - DNA, 18 bp, Homo sapiens
aaatagattcagagaaat

SEQ ID NO: 3604186 - DNA, 19 bp, Homo sapiens
aaatagattcagagaaatt

SEQ ID NO: 3604187 - DNA, 13 bp, Homo sapiens
aaatagcagaaag

SEQ ID NO: 3604188 - DNA, 17 bp, Homo sapiens
aaatagcattatcttat

SEQ ID NO: 3604189 - DNA, 22 bp, Homo sapiens
aaatagcattatcttatcattt

SEQ ID NO: 3604190 - DNA, 14 bp, Homo sapiens
aaatataattgaca

SEQ ID NO: 3604191 - DNA, 18 bp, Homo sapiens
aaatatagatcagttata

SEQ ID NO: 3604192 - DNA, 17 bp, Homo sapiens
aaatatatcttataaag

SEQ ID NO: 3604193 - DNA, 15 bp, Homo sapiens
aaatatatttgtcac

SEQ ID NO: 3604194 - DNA, 22 bp, Homo sapiens
aaatatcaaagtcattaaagac

SEQ ID NO: 3604195 - DNA, 14 bp, Homo sapiens
aaatatccacccag

SEQ ID NO: 3604196 - DNA, 20 bp, Homo sapiens
aaatatcccttggacatttt

SEQ ID NO: 3604197 - DNA, 13 bp, Homo sapiens
aaatatgttctct

SEQ ID NO: 3604198 - DNA, 19 bp, Homo sapiens
aaatattaacatattattt

SEQ ID NO: 3604199 - DNA, 22 bp, Homo sapiens
aaatattaacatattatttcat

SEQ ID NO: 3604200 - DNA, 19 bp, Homo sapiens
aaatattagttaatggatt

SEQ ID NO: 3604201 - DNA, 16 bp, Homo sapiens
aaatattcctttgcat

SEQ ID NO: 3604202 - DNA, 22 bp, Homo sapiens
aaatatttgtacatagttattt

SEQ ID NO: 3604203 - DNA, 15 bp, Homo sapiens
aaatattttttacag

SEQ ID NO: 3604204 - DNA, 16 bp, Homo sapiens
aaatcaaaacaagtga

SEQ ID NO: 3604205 - DNA, 11 bp, Homo sapiens
aaatcaaggat

SEQ ID NO: 3604206 - DNA, 20 bp, Homo sapiens
aaatcacagatgcatataga

SEQ ID NO: 3604207 - DNA, 22 bp, Homo sapiens
aaatcacagatgcatatagaca

SEQ ID NO: 3604208 - DNA, 15 bp, Homo sapiens
aaatcagaaaaccca

SEQ ID NO: 3604209 - DNA, 18 bp, Homo sapiens
aaatcagaagtcatcttg

SEQ ID NO: 3604210 - DNA, 11 bp, Homo sapiens
aaatcatttct

SEQ ID NO: 3604211 - DNA, 20 bp, Homo sapiens
aaatccaaaaagctctgaaa

SEQ ID NO: 3604212 - DNA, 11 bp, Homo sapiens
aaatccagtgg

SEQ ID NO: 3604213 - DNA, 12 bp, Homo sapiens
aaatccagtggt

SEQ ID NO: 3604214 - DNA, 14 bp, Homo sapiens
aaatccagtggtgg

SEQ ID NO: 3604215 - DNA, 14 bp, Homo sapiens
aaatcctcaggaaa

SEQ ID NO: 3604216 - DNA, 15 bp, Homo sapiens
aaatcctcaggaaat

SEQ ID NO: 3604217 - DNA, 14 bp, Homo sapiens
aaatctgacatatt

SEQ ID NO: 3604218 - DNA, 14 bp, Homo sapiens
aaatctgacccagt

SEQ ID NO: 3604219 - DNA, 18 bp, Homo sapiens
aaatctgacccagtgccc

SEQ ID NO: 3604220 - DNA, 20 bp, Homo sapiens
aaatctgcttcatccaatgt

SEQ ID NO: 3604221 - DNA, 13 bp, Homo sapiens
aaatctgcttgta

SEQ ID NO: 3604222 - DNA, 13 bp, Homo sapiens
aaatcttacaaca

SEQ ID NO: 3604223 - DNA, 14 bp, Homo sapiens
aaatcttagtgttc

SEQ ID NO: 3604224 - DNA, 20 bp, Homo sapiens
aaatcttagtgttcaaaaca

SEQ ID NO: 3604225 - DNA, 14 bp, Homo sapiens
aaatcttcactttc

SEQ ID NO: 3604226 - DNA, 20 bp, Homo sapiens
aaatctttaagaatagttct

SEQ ID NO: 3604227 - DNA, 21 bp, Homo sapiens
aaatgaaatatatttaaaata

SEQ ID NO: 3604228 - DNA, 14 bp, Homo sapiens
aaatgaaatgcata

SEQ ID NO: 3604229 - DNA, 18 bp, Homo sapiens
aaatgaacctgctactta

SEQ ID NO: 3604230 - DNA, 20 bp, Homo sapiens
aaatgacttatttctgctct

SEQ ID NO: 3604231 - DNA, 15 bp, Homo sapiens
aaatgagagcagaaa

SEQ ID NO: 3604232 - DNA, 15 bp, Homo sapiens
aaatgaggtctgttt

SEQ ID NO: 3604233 - DNA, 16 bp, Homo sapiens
aaatgaggtctgttta

SEQ ID NO: 3604234 - DNA, 21 bp, Homo sapiens
aaatgaggtctgtttaaagtg

SEQ ID NO: 3604235 - DNA, 13 bp, Homo sapiens
aaatgagtcattt

SEQ ID NO: 3604236 - DNA, 16 bp, Homo sapiens
aaatgagtcatttgtt

SEQ ID NO: 3604237 - DNA, 18 bp, Homo sapiens
aaatgagtcatttgttta

SEQ ID NO: 3604238 - DNA, 16 bp, Homo sapiens
aaatgcattgaaagaa

SEQ ID NO: 3604239 - DNA, 18 bp, Homo sapiens
aaatgcattgaaagaatt

SEQ ID NO: 3604240 - DNA, 14 bp, Homo sapiens
aaatgccccagtgt

SEQ ID NO: 3604241 - DNA, 21 bp, Homo sapiens
aaatgcctccaaagtattgta

SEQ ID NO: 3604242 - DNA, 15 bp, Homo sapiens
aaatgccttaaaatg

SEQ ID NO: 3604243 - DNA, 13 bp, Homo sapiens
aaatgctctctca

SEQ ID NO: 3604244 - DNA, 17 bp, Homo sapiens
aaatgcttttatattct

SEQ ID NO: 3604245 - DNA, 15 bp, Homo sapiens
aaatggacatggtgg

SEQ ID NO: 3604246 - DNA, 23 bp, Homo sapiens
aaatggccagtgagatcaatgtg

SEQ ID NO: 3604247 - DNA, 13 bp, Homo sapiens
aaatggccatttg

SEQ ID NO: 3604248 - DNA, 17 bp, Homo sapiens
aaatggctatgaacaga

SEQ ID NO: 3604249 - DNA, 15 bp, Homo sapiens
aaatggtgaatgaca

SEQ ID NO: 3604250 - DNA, 16 bp, Homo sapiens
aaatggttaaatttta

SEQ ID NO: 3604251 - DNA, 14 bp, Homo sapiens
aaatggttgatgga

SEQ ID NO: 3604252 - DNA, 19 bp, Homo sapiens
aaatggttgatggaaaata

SEQ ID NO: 3604253 - DNA, 21 bp, Homo sapiens
aaatggttgatggaaaataaa

SEQ ID NO: 3604254 - DNA, 23 bp, Homo sapiens
aaatggttgatggaaaataaaca

SEQ ID NO: 3604255 - DNA, 19 bp, Homo sapiens
aaatgtaaaaatgaaggaa

SEQ ID NO: 3604256 - DNA, 13 bp, Homo sapiens
agcccccagggcc

SEQ ID NO: 3604257 - DNA, 20 bp, Homo sapiens
agcccccagggcctccaggg

SEQ ID NO: 3604258 - DNA, 21 bp, Homo sapiens
agcccccagggcctccagggc

SEQ ID NO: 3604259 - DNA, 20 bp, Homo sapiens
agcccccgggccgctggctg

SEQ ID NO: 3604260 - DNA, 14 bp, Homo sapiens
agccccggcccccc

SEQ ID NO: 3604261 - DNA, 14 bp, Homo sapiens
agcccctactgtgg

SEQ ID NO: 3604262 - DNA, 12 bp, Homo sapiens
agcccctcccca

SEQ ID NO: 3604263 - DNA, 16 bp, Homo sapiens
agcccctccccagcca

SEQ ID NO: 3604264 - DNA, 21 bp, Homo sapiens
agcccctccccagccagccct

SEQ ID NO: 3604265 - DNA, 21 bp, Homo sapiens
agcccctgtctagagagggag

SEQ ID NO: 3604266 - DNA, 14 bp, Homo sapiens
agcccggggccagc

SEQ ID NO: 3604267 - DNA, 23 bp, Homo sapiens
agcccgtgtccaggagccccgcc

SEQ ID NO: 3604268 - DNA, 16 bp, Homo sapiens
agccctatttcttgat

SEQ ID NO: 3604269 - DNA, 17 bp, Homo sapiens
agccctcaccacagcct

SEQ ID NO: 3604270 - DNA, 22 bp, Homo sapiens
agccctcaccacagccttctaa

SEQ ID NO: 3604271 - DNA, 22 bp, Homo sapiens
agccctccctgcccctcccttc

SEQ ID NO: 3604272 - DNA, 23 bp, Homo sapiens
agccctccctgcccctcccttca

SEQ ID NO: 3604273 - DNA, 15 bp, Homo sapiens
agccctcctgagggc

SEQ ID NO: 3604274 - DNA, 16 bp, Homo sapiens
agccctcctgagggcc

SEQ ID NO: 3604275 - DNA, 20 bp, Homo sapiens
agccctcctgagggccggtt

SEQ ID NO: 3604276 - DNA, 14 bp, Homo sapiens
agccctgcctgaga

SEQ ID NO: 3604277 - DNA, 15 bp, Homo sapiens
agccctgggaaccac

SEQ ID NO: 3604278 - DNA, 23 bp, Homo sapiens
agccctgggggattcctgagctg

SEQ ID NO: 3604279 - DNA, 18 bp, Homo sapiens
agccctggttagctgaca

SEQ ID NO: 3604280 - DNA, 19 bp, Homo sapiens
agccctggttagctgacag

SEQ ID NO: 3604281 - DNA, 17 bp, Homo sapiens
agccctgttgacacagg

SEQ ID NO: 3604282 - DNA, 18 bp, Homo sapiens
agccctgttgacacaggt

SEQ ID NO: 3604283 - DNA, 19 bp, Homo sapiens
agcccttccatgtcgcctc

SEQ ID NO: 3604284 - DNA, 20 bp, Homo sapiens
agcccttctatacccaccca

SEQ ID NO: 3604285 - DNA, 23 bp, Homo sapiens
agcccttctatacccacccagaa

SEQ ID NO: 3604286 - DNA, 14 bp, Homo sapiens
agccgaagcccagg

SEQ ID NO: 3604287 - DNA, 17 bp, Homo sapiens
agccgcagacctggagc

SEQ ID NO: 3604288 - DNA, 18 bp, Homo sapiens
agccgcagacctggagct

SEQ ID NO: 3604289 - DNA, 13 bp, Homo sapiens
agccgccagctgg

SEQ ID NO: 3604290 - DNA, 16 bp, Homo sapiens
agccgcgcggccgctt

SEQ ID NO: 3604291 - DNA, 23 bp, Homo sapiens
agccggggtgtaacttcctgctg

SEQ ID NO: 3604292 - DNA, 18 bp, Homo sapiens
agccgtattttacatgaa

SEQ ID NO: 3604293 - DNA, 15 bp, Homo sapiens
agccgtgccttcagc

SEQ ID NO: 3604294 - DNA, 16 bp, Homo sapiens
agccgtgccttcagct

SEQ ID NO: 3604295 - DNA, 21 bp, Homo sapiens
agccgtggcttcccgctcagc

SEQ ID NO: 3604296 - DNA, 15 bp, Homo sapiens
agcctaaagggcagg

SEQ ID NO: 3604297 - DNA, 22 bp, Homo sapiens
agcctaaagggcagggcccacg

SEQ ID NO: 3604298 - DNA, 18 bp, Homo sapiens
agcctaagaagaaggcca

SEQ ID NO: 3604299 - DNA, 18 bp, Homo sapiens
agcctaccgctggccctg

SEQ ID NO: 3604300 - DNA, 20 bp, Homo sapiens
agcctaccgctggccctgcc

SEQ ID NO: 3604301 - DNA, 21 bp, Homo sapiens
agcctaccgctggccctgccg

SEQ ID NO: 3604302 - DNA, 15 bp, Homo sapiens
agcctagatgtttta

SEQ ID NO: 3604303 - DNA, 19 bp, Homo sapiens
agcctagcggagcccagcc

SEQ ID NO: 3604304 - DNA, 23 bp, Homo sapiens
agcctagcggagcccagcctggg

SEQ ID NO: 3604305 - DNA, 21 bp, Homo sapiens
agcctagctcctgccacatgg

SEQ ID NO: 3604306 - DNA, 16 bp, Homo sapiens
agcctcaaaacgggtc

SEQ ID NO: 3604307 - DNA, 12 bp, Homo sapiens
agcctcatctct

SEQ ID NO: 3604308 - DNA, 23 bp, Homo sapiens
agcctccagtccaaagccggctt

SEQ ID NO: 3604309 - DNA, 18 bp, Homo sapiens
agcctccatgctgcctcc

SEQ ID NO: 3604310 - DNA, 16 bp, Homo sapiens
agcctcccctcccctg

SEQ ID NO: 3604311 - DNA, 13 bp, Homo sapiens
agcctccctgaag

SEQ ID NO: 3604312 - DNA, 14 bp, Homo sapiens
agcctccctgaagc

SEQ ID NO: 3604313 - DNA, 15 bp, Homo sapiens
agcctccctgaagcc

SEQ ID NO: 3604314 - DNA, 15 bp, Homo sapiens
agcctccctgtctcc

SEQ ID NO: 3604315 - DNA, 18 bp, Homo sapiens
agcctccctgtctccagc

SEQ ID NO: 3604316 - DNA, 13 bp, Homo sapiens
agcctccggaagc

SEQ ID NO: 3604317 - DNA, 11 bp, Homo sapiens
agcctcctgag

SEQ ID NO: 3604318 - DNA, 19 bp, Homo sapiens
agcctcctgagtagctgga

SEQ ID NO: 3604319 - DNA, 16 bp, Homo sapiens
agcctcctgccccctg

SEQ ID NO: 3604320 - DNA, 14 bp, Homo sapiens
agcctcctgggtag

SEQ ID NO: 3604321 - DNA, 14 bp, Homo sapiens
agcctcctgtacct

SEQ ID NO: 3604322 - DNA, 18 bp, Homo sapiens
agcctcctgtacctcagt

SEQ ID NO: 3604323 - DNA, 14 bp, Homo sapiens
agcctctccgactc

SEQ ID NO: 3604324 - DNA, 17 bp, Homo sapiens
agcctctccgactctgc

SEQ ID NO: 3604325 - DNA, 20 bp, Homo sapiens
agcctctccgactctgcacc

SEQ ID NO: 3604326 - DNA, 22 bp, Homo sapiens
agcctctctccttggccacaga

SEQ ID NO: 3604327 - DNA, 23 bp, Homo sapiens
agcctctctccttggccacagac

SEQ ID NO: 3604328 - DNA, 14 bp, Homo sapiens
agcctctctggctg

SEQ ID NO: 3604329 - DNA, 16 bp, Homo sapiens
agcctctctggctggt

SEQ ID NO: 3604330 - DNA, 18 bp, Homo sapiens
agcctctctggctggtct

SEQ ID NO: 3604331 - DNA, 13 bp, Homo sapiens
agcctctggactg

SEQ ID NO: 3604332 - DNA, 18 bp, Homo sapiens
agcctctggactggaaag

SEQ ID NO: 3604333 - DNA, 12 bp, Homo sapiens
agcctctggctt

SEQ ID NO: 3604334 - DNA, 22 bp, Homo sapiens
agcctgaaggggcgtctgttcc

SEQ ID NO: 3604335 - DNA, 20 bp, Homo sapiens
agcctgaccaacatggagaa

SEQ ID NO: 3604336 - DNA, 13 bp, Homo sapiens
agcctgactagaa

SEQ ID NO: 3604337 - DNA, 14 bp, Homo sapiens
agcctgactagaac

SEQ ID NO: 3604338 - DNA, 20 bp, Homo sapiens
agcctgactagaactcctgt

SEQ ID NO: 3604339 - DNA, 19 bp, Homo sapiens
agcctgagtcacctgcaga

SEQ ID NO: 3604340 - DNA, 20 bp, Homo sapiens
agcctgcaggacctcgtgcc

SEQ ID NO: 3604341 - DNA, 21 bp, Homo sapiens
agcctgcgccaccgcccagag

SEQ ID NO: 3604342 - DNA, 14 bp, Homo sapiens
agcctgcttcccac

SEQ ID NO: 3604343 - DNA, 15 bp, Homo sapiens
agcctgcttcccaca

SEQ ID NO: 3604344 - DNA, 16 bp, Homo sapiens
agcctgcttcccacaa

SEQ ID NO: 3604345 - DNA, 18 bp, Homo sapiens
agcctgcttcccacaact

SEQ ID NO: 3604346 - DNA, 18 bp, Homo sapiens
agcctggcaacagagcga

SEQ ID NO: 3604347 - DNA, 22 bp, Homo sapiens
agcctggccagacacaggccct

SEQ ID NO: 3604348 - DNA, 13 bp, Homo sapiens
agcctggccaggc

SEQ ID NO: 3604349 - DNA, 15 bp, Homo sapiens
agcctggccaggcag

SEQ ID NO: 3604350 - DNA, 20 bp, Homo sapiens
agcctggccaggcagggaga

SEQ ID NO: 3604351 - DNA, 18 bp, Homo sapiens
agcctgggagcccagagg

SEQ ID NO: 3604352 - DNA, 17 bp, Homo sapiens
agcctgggcgacaaaaa

SEQ ID NO: 3604353 - DNA, 19 bp, Homo sapiens
agcctgggctcactgtgct

SEQ ID NO: 3604354 - DNA, 17 bp, Homo sapiens
agcctggggctgaggct

SEQ ID NO: 3604355 - DNA, 23 bp, Homo sapiens
agcctggggtggggtcatgccct

SEQ ID NO: 3604356 - DNA, 16 bp, Homo sapiens
agcctggttcagacac

SEQ ID NO: 3604357 - DNA, 11 bp, Homo sapiens
agcctgtcctg

SEQ ID NO: 3604358 - DNA, 14 bp, Homo sapiens
agcctgtcctgggc

SEQ ID NO: 3604359 - DNA, 12 bp, Homo sapiens
agcctgtgcctc

SEQ ID NO: 3604360 - DNA, 10 bp, Homo sapiens
agcctgtgcg

SEQ ID NO: 3604361 - DNA, 18 bp, Homo sapiens
agcctgtgcgtcccagct

SEQ ID NO: 3604362 - DNA, 20 bp, Homo sapiens
agccttaaggccctcattct

SEQ ID NO: 3604363 - DNA, 20 bp, Homo sapiens
agccttacttcaaagtgcct

SEQ ID NO: 3604364 - DNA, 21 bp, Homo sapiens
agccttacttcaaagtgcctg

SEQ ID NO: 3604365 - DNA, 14 bp, Homo sapiens
agccttagagctct

SEQ ID NO: 3604366 - DNA, 19 bp, Homo sapiens
agccttcatcagaactctt

SEQ ID NO: 3604367 - DNA, 18 bp, Homo sapiens
agccttccaacatttctt

SEQ ID NO: 3604368 - DNA, 20 bp, Homo sapiens
agccttccccagctccagca

SEQ ID NO: 3604369 - DNA, 13 bp, Homo sapiens
agccttcccctcc

SEQ ID NO: 3604370 - DNA, 13 bp, Homo sapiens
agccttgccagag

SEQ ID NO: 3604371 - DNA, 19 bp, Homo sapiens
agccttgccagagatccaa

SEQ ID NO: 3604372 - DNA, 22 bp, Homo sapiens
agccttgcctaaatttaatgct

SEQ ID NO: 3604373 - DNA, 15 bp, Homo sapiens
agccttgggatagca

SEQ ID NO: 3604374 - DNA, 19 bp, Homo sapiens
agccttgtacagtctgctc

SEQ ID NO: 3604375 - DNA, 16 bp, Homo sapiens
agccttgtcagtgtgt

SEQ ID NO: 3604376 - DNA, 15 bp, Homo sapiens
agcctttcttttgga

SEQ ID NO: 3604377 - DNA, 15 bp, Homo sapiens
agccttttgctctct

SEQ ID NO: 3604378 - DNA, 15 bp, Homo sapiens
agcctttttacctgg

SEQ ID NO: 3604379 - DNA, 15 bp, Homo sapiens
agcgagcaagccggc

SEQ ID NO: 3604380 - DNA, 17 bp, Homo sapiens
agcgagtaaagtctggg

SEQ ID NO: 3604381 - DNA, 21 bp, Homo sapiens
agcgagtaaagtctgggccag

SEQ ID NO: 3604382 - DNA, 22 bp, Homo sapiens
agcgagtaaagtctgggccagg

SEQ ID NO: 3604383 - DNA, 12 bp, Homo sapiens
agcgcaggcagc

SEQ ID NO: 3604384 - DNA, 16 bp, Homo sapiens
agcgcagggctggcac

SEQ ID NO: 3604385 - DNA, 13 bp, Homo sapiens
agcgccctgcagg

SEQ ID NO: 3604386 - DNA, 15 bp, Homo sapiens
agcgccctgcagggc

SEQ ID NO: 3604387 - DNA, 17 bp, Homo sapiens
agcgcctttcccaactc

SEQ ID NO: 3604388 - DNA, 23 bp, Homo sapiens
agcgcggacccttctgggtccag

SEQ ID NO: 3604389 - DNA, 19 bp, Homo sapiens
agcgcttcagttcagcttt

SEQ ID NO: 3604390 - DNA, 17 bp, Homo sapiens
agcggagcccagcctgg

SEQ ID NO: 3604391 - DNA, 20 bp, Homo sapiens
agcgggaatggcagctgcca

SEQ ID NO: 3604392 - DNA, 15 bp, Homo sapiens
agcgggacaaagcct

SEQ ID NO: 3604393 - DNA, 22 bp, Homo sapiens
agcagggatgccctggaggtgg

SEQ ID NO: 3604394 - DNA, 19 bp, Homo sapiens
agcagggcatggctgggaa

SEQ ID NO: 3604395 - DNA, 23 bp, Homo sapiens
agcaggggaattccctccccctc

SEQ ID NO: 3604396 - DNA, 18 bp, Homo sapiens
agcaggggggctgtgcca

SEQ ID NO: 3604397 - DNA, 16 bp, Homo sapiens
agcagggtccacagct

SEQ ID NO: 3604398 - DNA, 17 bp, Homo sapiens
agcaggtacatttctga

SEQ ID NO: 3604399 - DNA, 18 bp, Homo sapiens
agcaggtacatttctgat

SEQ ID NO: 3604400 - DNA, 16 bp, Homo sapiens
agcaggttccccaagg

SEQ ID NO: 3604401 - DNA, 18 bp, Homo sapiens
agcaggttccccaagggc

SEQ ID NO: 3604402 - DNA, 23 bp, Homo sapiens
agcaggttccccaagggccctgg

SEQ ID NO: 3604403 - DNA, 20 bp, Homo sapiens
agcagtcgcccaagcagaca

SEQ ID NO: 3604404 - DNA, 15 bp, Homo sapiens
agcagtctaaatttt

SEQ ID NO: 3604405 - DNA, 20 bp, Homo sapiens
agcagtctaaattttctaaa

SEQ ID NO: 3604406 - DNA, 21 bp, Homo sapiens
agcagtctaaattttctaaat

SEQ ID NO: 3604407 - DNA, 17 bp, Homo sapiens
agcagtctccttcagca

SEQ ID NO: 3604408 - DNA, 18 bp, Homo sapiens
agcagtctgataaactga

SEQ ID NO: 3604409 - DNA, 19 bp, Homo sapiens
agcagttaatttatatatt

SEQ ID NO: 3604410 - DNA, 18 bp, Homo sapiens
agcagttgttatattcat

SEQ ID NO: 3604411 - DNA, 15 bp, Homo sapiens
agcagtttccagaga

SEQ ID NO: 3604412 - DNA, 12 bp, Homo sapiens
agcagtttcctc

SEQ ID NO: 3604413 - DNA, 23 bp, Homo sapiens
agcatatgggtgggattttgcaa

SEQ ID NO: 3604414 - DNA, 20 bp, Homo sapiens
agcatatttgccaataaagc

SEQ ID NO: 3604415 - DNA, 21 bp, Homo sapiens
agcatatttgccaataaagct

SEQ ID NO: 3604416 - DNA, 20 bp, Homo sapiens
agcatcaggctaagaccctg

SEQ ID NO: 3604417 - DNA, 16 bp, Homo sapiens
agcatccaccccaccc

SEQ ID NO: 3604418 - DNA, 17 bp, Homo sapiens
agcatccagtgtgagat

SEQ ID NO: 3604419 - DNA, 15 bp, Homo sapiens
agcatccctcaccca

SEQ ID NO: 3604420 - DNA, 12 bp, Homo sapiens
agcatccctgga

SEQ ID NO: 3604421 - DNA, 15 bp, Homo sapiens
agcatccttggcagt

SEQ ID NO: 3604422 - DNA, 19 bp, Homo sapiens
agcatcgcactctggcagc

SEQ ID NO: 3604423 - DNA, 18 bp, Homo sapiens
agcatcgggagcacccag

SEQ ID NO: 3604424 - DNA, 19 bp, Homo sapiens
agcatcgggagcacccaga

SEQ ID NO: 3604425 - DNA, 15 bp, Homo sapiens
agcatctcaggaggg

SEQ ID NO: 3604426 - DNA, 12 bp, Homo sapiens
agcatctcccag

SEQ ID NO: 3604427 - DNA, 14 bp, Homo sapiens
agcatctcccagca

SEQ ID NO: 3604428 - DNA, 19 bp, Homo sapiens
agcatgaataaaacactca

SEQ ID NO: 3604429 - DNA, 16 bp, Homo sapiens
agcatgactttcctta

SEQ ID NO: 3604430 - DNA, 23 bp, Homo sapiens
agcatgactttccttaggaggcc

SEQ ID NO: 3604431 - DNA, 20 bp, Homo sapiens
agcatgagagggatgaggca

SEQ ID NO: 3604432 - DNA, 17 bp, Homo sapiens
agcatgatattgttctc

SEQ ID NO: 3604433 - DNA, 18 bp, Homo sapiens
agcatgatattgttctcc

SEQ ID NO: 3604434 - DNA, 15 bp, Homo sapiens
agcatgcaccacggg

SEQ ID NO: 3604435 - DNA, 15 bp, Homo sapiens
agcatgcttgggctg

SEQ ID NO: 3604436 - DNA, 16 bp, Homo sapiens
agcatgcttgggctga

SEQ ID NO: 3604437 - DNA, 22 bp, Homo sapiens
agcatggaaaaatggttgatgg

SEQ ID NO: 3604438 - DNA, 19 bp, Homo sapiens
agcatgtagactgtgccag

SEQ ID NO: 3604439 - DNA, 14 bp, Homo sapiens
agcatgttcctcct

SEQ ID NO: 3604440 - DNA, 19 bp, Homo sapiens
agcatgttgggttgttaca

SEQ ID NO: 3604441 - DNA, 14 bp, Homo sapiens
agcattccttttga

SEQ ID NO: 3604442 - DNA, 18 bp, Homo sapiens
agcattctcactcctacc

SEQ ID NO: 3604443 - DNA, 16 bp, Homo sapiens
agcattgaaataataa

SEQ ID NO: 3604444 - DNA, 17 bp, Homo sapiens
agcattgaaataataat

SEQ ID NO: 3604445 - DNA, 19 bp, Homo sapiens
agcattgaaataataatat

SEQ ID NO: 3604446 - DNA, 12 bp, Homo sapiens
agcattgcagcc

SEQ ID NO: 3604447 - DNA, 17 bp, Homo sapiens
agcattgtaaaagcatt

SEQ ID NO: 3604448 - DNA, 22 bp, Homo sapiens
agcattgtctatttttctcttc

SEQ ID NO: 3604449 - DNA, 18 bp, Homo sapiens
agcatttactatgcacaa

SEQ ID NO: 3604450 - DNA, 17 bp, Homo sapiens
agcatttcacttattta

SEQ ID NO: 3604451 - DNA, 18 bp, Homo sapiens
agcatttcatgaaaaagc

SEQ ID NO: 3604452 - DNA, 12 bp, Homo sapiens
agcatttgtata

SEQ ID NO: 3604453 - DNA, 18 bp, Homo sapiens
agcattttagaaactaca

SEQ ID NO: 3604454 - DNA, 13 bp, Homo sapiens
agcattttgtaat

SEQ ID NO: 3604455 - DNA, 17 bp, Homo sapiens
agccaaactcaggccca

SEQ ID NO: 3604456 - DNA, 16 bp, Homo sapiens
agccaaagaaacaagc

SEQ ID NO: 3604457 - DNA, 17 bp, Homo sapiens
agccaaagaaacaagct

SEQ ID NO: 3604458 - DNA, 21 bp, Homo sapiens
agccaaatgaccgagccctgg

SEQ ID NO: 3604459 - DNA, 23 bp, Homo sapiens
agccaaatgaccgagccctggag

SEQ ID NO: 3604460 - DNA, 18 bp, Homo sapiens
agccaactgtttccctgc

SEQ ID NO: 3604461 - DNA, 22 bp, Homo sapiens
agccaactgtttccctgctgaa

SEQ ID NO: 3604462 - DNA, 23 bp, Homo sapiens
agccaactgtttccctgctgaat

SEQ ID NO: 3604463 - DNA, 19 bp, Homo sapiens
agccaagagcgcaccattg

SEQ ID NO: 3604464 - DNA, 15 bp, Homo sapiens
agccacagacccctg

SEQ ID NO: 3604465 - DNA, 20 bp, Homo sapiens
agccacagacccctgggagc

SEQ ID NO: 3604466 - DNA, 22 bp, Homo sapiens
agccacagacccctgggagctt

SEQ ID NO: 3604467 - DNA, 14 bp, Homo sapiens
agccacagcagagc

SEQ ID NO: 3604468 - DNA, 15 bp, Homo sapiens
agccacatcttgctc

SEQ ID NO: 3604469 - DNA, 22 bp, Homo sapiens
agccaccatgcttgcctgaagc

SEQ ID NO: 3604470 - DNA, 20 bp, Homo sapiens
agccaccgaagccgcctgtg

SEQ ID NO: 3604471 - DNA, 18 bp, Homo sapiens
agccacctgggaacacag

SEQ ID NO: 3604472 - DNA, 19 bp, Homo sapiens
agccacctgggaacacagt

SEQ ID NO: 3604473 - DNA, 11 bp, Homo sapiens
agccactcccc

SEQ ID NO: 3604474 - DNA, 13 bp, Homo sapiens
agccactccccag

SEQ ID NO: 3604475 - DNA, 23 bp, Homo sapiens
agccactccccagccagcctggc

SEQ ID NO: 3604476 - DNA, 18 bp, Homo sapiens
agccactgtgcttggcca

SEQ ID NO: 3604477 - DNA, 16 bp, Homo sapiens
agccacttccccctct

SEQ ID NO: 3604478 - DNA, 17 bp, Homo sapiens
agccacttccccctctt

SEQ ID NO: 3604479 - DNA, 20 bp, Homo sapiens
agccagaacgtggctctgct

SEQ ID NO: 3604480 - DNA, 13 bp, Homo sapiens
agccagaggtctg

SEQ ID NO: 3604481 - DNA, 17 bp, Homo sapiens
agccagcctcagaaggc

SEQ ID NO: 3604482 - DNA, 22 bp, Homo sapiens
agccagcctcagaaggccccag

SEQ ID NO: 3604483 - DNA, 11 bp, Homo sapiens
agccagcctgg

SEQ ID NO: 3604484 - DNA, 21 bp, Homo sapiens
agccagcctggctctgccccc

SEQ ID NO: 3604485 - DNA, 22 bp, Homo sapiens
agccagcgggaatggcagctgc

SEQ ID NO: 3604486 - DNA, 19 bp, Homo sapiens
agccaggaatttcccagga

SEQ ID NO: 3604487 - DNA, 22 bp, Homo sapiens
agccaggaatttcccaggaccc

SEQ ID NO: 3604488 - DNA, 23 bp, Homo sapiens
agccaggaatttcccaggaccct

SEQ ID NO: 3604489 - DNA, 13 bp, Homo sapiens
agccaggactccc

SEQ ID NO: 3604490 - DNA, 15 bp, Homo sapiens
agccaggactcccag

SEQ ID NO: 3604491 - DNA, 17 bp, Homo sapiens
agccaggactcccagaa

SEQ ID NO: 3604492 - DNA, 19 bp, Homo sapiens
agccaggactcccagaacc

SEQ ID NO: 3604493 - DNA, 23 bp, Homo sapiens
agccaggactcccagaacctcta

SEQ ID NO: 3604494 - DNA, 18 bp, Homo sapiens
agccaggatgcccagatg

SEQ ID NO: 3604495 - DNA, 19 bp, Homo sapiens
agccaggatgcccagatga

SEQ ID NO: 3604496 - DNA, 17 bp, Homo sapiens
agccagggcccctggat

SEQ ID NO: 3604497 - DNA, 21 bp, Homo sapiens
agccaggtacaggagaggcag

SEQ ID NO: 3604498 - DNA, 16 bp, Homo sapiens
agccaggtctgactcc

SEQ ID NO: 3604499 - DNA, 23 bp, Homo sapiens
agccaggtctgactccaaagctg

SEQ ID NO: 3604500 - DNA, 18 bp, Homo sapiens
agccaggttccacagagg

SEQ ID NO: 3604501 - DNA, 16 bp, Homo sapiens
agccatacataaaaga

SEQ ID NO: 3604502 - DNA, 23 bp, Homo sapiens
agccatacataaaagaaataaac

SEQ ID NO: 3604503 - DNA, 21 bp, Homo sapiens
agccatagtttgggtattttt

SEQ ID NO: 3604504 - DNA, 14 bp, Homo sapiens
agccatgtctgcat

SEQ ID NO: 3604505 - DNA, 15 bp, Homo sapiens
agccatgtctgcatt

SEQ ID NO: 3604506 - DNA, 21 bp, Homo sapiens
agcccaaacctgggaaggcca

SEQ ID NO: 3604507 - DNA, 21 bp, Homo sapiens
agcccaagggatctggtccta

SEQ ID NO: 3604508 - DNA, 21 bp, Homo sapiens
agcccaagttcatgcagctgt

SEQ ID NO: 3604509 - DNA, 10 bp, Homo sapiens
agcccagaga

SEQ ID NO: 3604510 - DNA, 11 bp, Homo sapiens
agcccagagac

SEQ ID NO: 3604511 - DNA, 15 bp, Homo sapiens
agcccagagccacct

SEQ ID NO: 3604512 - DNA, 14 bp, Homo sapiens
agcccagcacccct

SEQ ID NO: 3604513 - DNA, 15 bp, Homo sapiens
agcccagcacccctt

SEQ ID NO: 3604514 - DNA, 15 bp, Homo sapiens
agcccagccaggcca

SEQ ID NO: 3604515 - DNA, 14 bp, Homo sapiens
agcccagcctggga

SEQ ID NO: 3604516 - DNA, 17 bp, Homo sapiens
agcccagcctgggagcc

SEQ ID NO: 3604517 - DNA, 18 bp, Homo sapiens
agcccaggatatatttta

SEQ ID NO: 3604518 - DNA, 16 bp, Homo sapiens
agcccagtgaagcctc

SEQ ID NO: 3604519 - DNA, 17 bp, Homo sapiens
agcccagtgaagcctct

SEQ ID NO: 3604520 - DNA, 18 bp, Homo sapiens
agcccagtgaagcctctg

SEQ ID NO: 3604521 - DNA, 22 bp, Homo sapiens
agcccatttgggcagagaggct

SEQ ID NO: 3604522 - DNA, 22 bp, Homo sapiens
agccccaactccaggggcacct

SEQ ID NO: 3604523 - DNA, 14 bp, Homo sapiens
agccccaccccagg

SEQ ID NO: 3604524 - DNA, 12 bp, Homo sapiens
agccccagcttg

SEQ ID NO: 3604525 - DNA, 14 bp, Homo sapiens
agccccagcttggc

SEQ ID NO: 3604526 - DNA, 14 bp, Homo sapiens
agcccccagccctg

SEQ ID NO: 3604527 - DNA, 12 bp, Homo sapiens
agcccccagcta

SEQ ID NO: 3604528 - DNA, 22 bp, Homo sapiens
agcccccagctaagaacctgga

SEQ ID NO: 3604529 - DNA, 11 bp, Homo sapiens
agcgtttttta

SEQ ID NO: 3604530 - DNA, 18 bp, Homo sapiens
agcgttttttaaatgtat

SEQ ID NO: 3604531 - DNA, 23 bp, Homo sapiens
agctaaataaatgtaatagccaa

SEQ ID NO: 3604532 - DNA, 14 bp, Homo sapiens
agctaagaacctgg

SEQ ID NO: 3604533 - DNA, 16 bp, Homo sapiens
agctaagaacctggaa

SEQ ID NO: 3604534 - DNA, 18 bp, Homo sapiens
agctaataacatgtgaaa

SEQ ID NO: 3604535 - DNA, 22 bp, Homo sapiens
agctacacctttctcctttgta

SEQ ID NO: 3604536 - DNA, 17 bp, Homo sapiens
agctacatgttctttgt

SEQ ID NO: 3604537 - DNA, 17 bp, Homo sapiens
agctacccctcaaactg

SEQ ID NO: 3604538 - DNA, 21 bp, Homo sapiens
agctacccctcaaactgcaca

SEQ ID NO: 3604539 - DNA, 22 bp, Homo sapiens
agctacctgctcagccctgcac

SEQ ID NO: 3604540 - DNA, 21 bp, Homo sapiens
agctactcagtggggctggca

SEQ ID NO: 3604541 - DNA, 12 bp, Homo sapiens
agctaggaatga

SEQ ID NO: 3604542 - DNA, 17 bp, Homo sapiens
agctaggagcaggcttg

SEQ ID NO: 3604543 - DNA, 18 bp, Homo sapiens
agctaggccccagaggcc

SEQ ID NO: 3604544 - DNA, 20 bp, Homo sapiens
agctaggccccagaggccct

SEQ ID NO: 3604545 - DNA, 21 bp, Homo sapiens
agctaggccccagaggccctg

SEQ ID NO: 3604546 - DNA, 23 bp, Homo sapiens
agctaggccccagaggccctgga

SEQ ID NO: 3604547 - DNA, 19 bp, Homo sapiens
agctagtaatatattctga

SEQ ID NO: 3604548 - DNA, 14 bp, Homo sapiens
agctatttttatac

SEQ ID NO: 3604549 - DNA, 18 bp, Homo sapiens
agctcagccccaactctt

SEQ ID NO: 3604550 - DNA, 12 bp, Homo sapiens
agctcagccctg

SEQ ID NO: 3604551 - DNA, 14 bp, Homo sapiens
agctcagccctggc

SEQ ID NO: 3604552 - DNA, 21 bp, Homo sapiens
agctcagccctggcctggctg

SEQ ID NO: 3604553 - DNA, 23 bp, Homo sapiens
agctcattcccaacgtgcaaagc

SEQ ID NO: 3604554 - DNA, 16 bp, Homo sapiens
agctccaacctgcaaa

SEQ ID NO: 3604555 - DNA, 21 bp, Homo sapiens
agctccagcaggaaggacccc

SEQ ID NO: 3604556 - DNA, 18 bp, Homo sapiens
agctccatacacacgctg

SEQ ID NO: 3604557 - DNA, 15 bp, Homo sapiens
agctccatctccact

SEQ ID NO: 3604558 - DNA, 21 bp, Homo sapiens
agctccatctccactccagat

SEQ ID NO: 3604559 - DNA, 16 bp, Homo sapiens
agctcccaccccactc

SEQ ID NO: 3604560 - DNA, 15 bp, Homo sapiens
agctccctcctcagg

SEQ ID NO: 3604561 - DNA, 17 bp, Homo sapiens
agctccctgcctgtttc

SEQ ID NO: 3604562 - DNA, 17 bp, Homo sapiens
agctccgatgcccgccc

SEQ ID NO: 3604563 - DNA, 18 bp, Homo sapiens
agctccgggatcagcaac

SEQ ID NO: 3604564 - DNA, 16 bp, Homo sapiens
agctccgtgtttctct

SEQ ID NO: 3604565 - DNA, 19 bp, Homo sapiens
agctcctataaagggccca

SEQ ID NO: 3604566 - DNA, 12 bp, Homo sapiens
agctcctcagcg

SEQ ID NO: 3604567 - DNA, 18 bp, Homo sapiens
agctcctcagcggctcca

SEQ ID NO: 3604568 - DNA, 13 bp, Homo sapiens
agctcctcctccc

SEQ ID NO: 3604569 - DNA, 21 bp, Homo sapiens
agctcctcctccctgcatctg

SEQ ID NO: 3604570 - DNA, 23 bp, Homo sapiens
agctcctctccccagcccagaga

SEQ ID NO: 3604571 - DNA, 16 bp, Homo sapiens
agctcctgaccttggg

SEQ ID NO: 3604572 - DNA, 13 bp, Homo sapiens
agctcctgccaca

SEQ ID NO: 3604573 - DNA, 17 bp, Homo sapiens
agctctaaaatctgctt

SEQ ID NO: 3604574 - DNA, 17 bp, Homo sapiens
agctctagcctctggac

SEQ ID NO: 3604575 - DNA, 19 bp, Homo sapiens
agctctagcctctggactg

SEQ ID NO: 3604576 - DNA, 14 bp, Homo sapiens
agctctcacagaca

SEQ ID NO: 3604577 - DNA, 20 bp, Homo sapiens
agctctccgagctctggtgc

SEQ ID NO: 3604578 - DNA, 21 bp, Homo sapiens
agctctccgagctctggtgct

SEQ ID NO: 3604579 - DNA, 14 bp, Homo sapiens
agctctcctgactt

SEQ ID NO: 3604580 - DNA, 18 bp, Homo sapiens
agctctctgactgctttg

SEQ ID NO: 3604581 - DNA, 11 bp, Homo sapiens
agctctgaaaa

SEQ ID NO: 3604582 - DNA, 14 bp, Homo sapiens
agctctgacatccc

SEQ ID NO: 3604583 - DNA, 16 bp, Homo sapiens
agctctgacatccctt

SEQ ID NO: 3604584 - DNA, 17 bp, Homo sapiens
agctctgacatcccttc

SEQ ID NO: 3604585 - DNA, 19 bp, Homo sapiens
agctctgacatcccttcct

SEQ ID NO: 3604586 - DNA, 12 bp, Homo sapiens
agctctgctgct

SEQ ID NO: 3604587 - DNA, 18 bp, Homo sapiens
agctctggacagccccac

SEQ ID NO: 3604588 - DNA, 18 bp, Homo sapiens
agctctggggacagcttc

SEQ ID NO: 3604589 - DNA, 19 bp, Homo sapiens
agctctggggacagcttcc

SEQ ID NO: 3604590 - DNA, 23 bp, Homo sapiens
agctctggggacagcttcctcac

SEQ ID NO: 3604591 - DNA, 13 bp, Homo sapiens
agctctggtgctt

SEQ ID NO: 3604592 - DNA, 19 bp, Homo sapiens
agctctgtcctcttggcca

SEQ ID NO: 3604593 - DNA, 22 bp, Homo sapiens
agctctgttccatgcaactgga

SEQ ID NO: 3604594 - DNA, 14 bp, Homo sapiens
agctcttcattcca

SEQ ID NO: 3604595 - DNA, 16 bp, Homo sapiens
agctcttcattccatt

SEQ ID NO: 3604596 - DNA, 12 bp, Homo sapiens
agctcttccctt

SEQ ID NO: 3604597 - DNA, 16 bp, Homo sapiens
agctcttggctccact

SEQ ID NO: 3604598 - DNA, 20 bp, Homo sapiens
agctcttgtgttcagaagaa

SEQ ID NO: 3604599 - DNA, 21 bp, Homo sapiens
agctcttgtgttcagaagaat

SEQ ID NO: 3604600 - DNA, 19 bp, Homo sapiens
agctgaaattcaccaagaa

SEQ ID NO: 3604601 - DNA, 19 bp, Homo sapiens
agctgaaggcagtggcagg

SEQ ID NO: 3604602 - DNA, 14 bp, Homo sapiens
agctgagaccttgc

SEQ ID NO: 3604603 - DNA, 17 bp, Homo sapiens
agctgagagaccctggc

SEQ ID NO: 3604604 - DNA, 21 bp, Homo sapiens
agctgagcacttagcaggcac

SEQ ID NO: 3604605 - DNA, 15 bp, Homo sapiens
agctgagcatggaga

SEQ ID NO: 3604606 - DNA, 16 bp, Homo sapiens
agctgagcatggagac

SEQ ID NO: 3604607 - DNA, 18 bp, Homo sapiens
agctgagctggaaggggc

SEQ ID NO: 3604608 - DNA, 19 bp, Homo sapiens
agctgagctggaaggggcc

SEQ ID NO: 3604609 - DNA, 20 bp, Homo sapiens
agctgagctggaaggggcca

SEQ ID NO: 3604610 - DNA, 13 bp, Homo sapiens
agctgcacccctt

SEQ ID NO: 3604611 - DNA, 17 bp, Homo sapiens
agctgcactgatgctgc

SEQ ID NO: 3604612 - DNA, 22 bp, Homo sapiens
agctgcactgatgctgcccctc

SEQ ID NO: 3604613 - DNA, 22 bp, Homo sapiens
agctgcagccttcatcagaact

SEQ ID NO: 3604614 - DNA, 10 bp, Homo sapiens
agctgcccta

SEQ ID NO: 3604615 - DNA, 20 bp, Homo sapiens
agctgcctcccctctccttc

SEQ ID NO: 3604616 - DNA, 23 bp, Homo sapiens
agctgcctcccctctccttcctg

SEQ ID NO: 3604617 - DNA, 18 bp, Homo sapiens
agctgcctcctgcgccct

SEQ ID NO: 3604618 - DNA, 15 bp, Homo sapiens
agctgcctggatgag

SEQ ID NO: 3604619 - DNA, 17 bp, Homo sapiens
agctgcctggatgagaa

SEQ ID NO: 3604620 - DNA, 14 bp, Homo sapiens
agctgcctgggccc

SEQ ID NO: 3604621 - DNA, 17 bp, Homo sapiens
agctgcctgggcccgga

SEQ ID NO: 3604622 - DNA, 21 bp, Homo sapiens
agctgctatagcctggggtgg

SEQ ID NO: 3604623 - DNA, 17 bp, Homo sapiens
agctgctcctagaggga

SEQ ID NO: 3604624 - DNA, 14 bp, Homo sapiens
agctgctgaaacaa

SEQ ID NO: 3604625 - DNA, 15 bp, Homo sapiens
agctgctgaaacaac

SEQ ID NO: 3604626 - DNA, 19 bp, Homo sapiens
agctgctgggtggcagggg

SEQ ID NO: 3604627 - DNA, 23 bp, Homo sapiens
agctgctttgagctacaggacaa

SEQ ID NO: 3604628 - DNA, 17 bp, Homo sapiens
agctggaaagttgggcc

SEQ ID NO: 3604629 - DNA, 21 bp, Homo sapiens
agctggaaagttgggcccctg

SEQ ID NO: 3604630 - DNA, 20 bp, Homo sapiens
agctggaaggggccacgtgg

SEQ ID NO: 3604631 - DNA, 19 bp, Homo sapiens
agctggacatactgctgga

SEQ ID NO: 3604632 - DNA, 22 bp, Homo sapiens
agctggacatactgctggagtc

SEQ ID NO: 3604633 - DNA, 17 bp, Homo sapiens
agctggagaaatatggt

SEQ ID NO: 3604634 - DNA, 15 bp, Homo sapiens
agctggcaaccagcc

SEQ ID NO: 3604635 - DNA, 17 bp, Homo sapiens
agctggcccccagccct

SEQ ID NO: 3604636 - DNA, 22 bp, Homo sapiens
agctggggatccctccccccca

SEQ ID NO: 3604637 - DNA, 22 bp, Homo sapiens
agctggggggatgttctgcctc

SEQ ID NO: 3604638 - DNA, 20 bp, Homo sapiens
agctgggggtgggccaggct

SEQ ID NO: 3604639 - DNA, 22 bp, Homo sapiens
agctggtggtgcagccttcccc

SEQ ID NO: 3604640 - DNA, 16 bp, Homo sapiens
agctgtaaaaatgtta

SEQ ID NO: 3604641 - DNA, 24 bp, Homo sapiens
agctgtaagggcagtgcccatgtg

SEQ ID NO: 3604642 - DNA, 21 bp, Homo sapiens
agctgtataattaattgtcat

SEQ ID NO: 3604643 - DNA, 23 bp, Homo sapiens
agctgtataattaattgtcatta

SEQ ID NO: 3604644 - DNA, 16 bp, Homo sapiens
agctgtcaaggctcag

SEQ ID NO: 3604645 - DNA, 12 bp, Homo sapiens
agctgtccctgc

SEQ ID NO: 3604646 - DNA, 14 bp, Homo sapiens
agctgtccctgcag

SEQ ID NO: 3604647 - DNA, 14 bp, Homo sapiens
agctgtcctggagg

SEQ ID NO: 3604648 - DNA, 16 bp, Homo sapiens
agctgtgcaggcatgg

SEQ ID NO: 3604649 - DNA, 16 bp, Homo sapiens
agctgtgccttccctt

SEQ ID NO: 3604650 - DNA, 22 bp, Homo sapiens
agctgtgctccacactcagaaa

SEQ ID NO: 3604651 - DNA, 18 bp, Homo sapiens
agctgtggcagagttaca

SEQ ID NO: 3604652 - DNA, 18 bp, Homo sapiens
agctgtgttaactgttca

SEQ ID NO: 3604653 - DNA, 13 bp, Homo sapiens
agctgtgttgaaa

SEQ ID NO: 3604654 - DNA, 19 bp, Homo sapiens
agctgtgttgaaacagaaa

SEQ ID NO: 3604655 - DNA, 15 bp, Homo sapiens
agctgttatgctgtt

SEQ ID NO: 3604656 - DNA, 16 bp, Homo sapiens
agctgttatgctgttt

SEQ ID NO: 3604657 - DNA, 17 bp, Homo sapiens
agctgttatgctgtttc

SEQ ID NO: 3604658 - DNA, 19 bp, Homo sapiens
agctgttatgctgtttcct

SEQ ID NO: 3604659 - DNA, 20 bp, Homo sapiens
agctgttatttcttccctgc

SEQ ID NO: 3604660 - DNA, 19 bp, Homo sapiens
agctgttcacagccagact

SEQ ID NO: 3604661 - DNA, 20 bp, Homo sapiens
agctgttccattacaccaca

SEQ ID NO: 3604662 - DNA, 17 bp, Homo sapiens
agctgtttttgacagcc

SEQ ID NO: 3604663 - DNA, 13 bp, Homo sapiens
agcttaaaacact

SEQ ID NO: 3604664 - DNA, 19 bp, Homo sapiens
agcttaatcttaatgtctg

SEQ ID NO: 3604665 - DNA, 14 bp, Homo sapiens
agcttacaggagcc

SEQ ID NO: 3604666 - DNA, 19 bp, Homo sapiens
agcttacaggagccagcct

SEQ ID NO: 3604667 - DNA, 21 bp, Homo sapiens
agcttacaggagccagcctgc

SEQ ID NO: 3604668 - DNA, 22 bp, Homo sapiens
agcttacctgggcacaaacaga

SEQ ID NO: 3604669 - DNA, 21 bp, Homo sapiens
agcttcaccccaatcccagct

SEQ ID NO: 3604670 - DNA, 14 bp, Homo sapiens
agcttcagccaggt

SEQ ID NO: 3604671 - DNA, 12 bp, Homo sapiens
agcttccatgat

SEQ ID NO: 3604672 - DNA, 15 bp, Homo sapiens
agcttccatgatgca

SEQ ID NO: 3604673 - DNA, 23 bp, Homo sapiens
agcttccatgatgcacagtatct

SEQ ID NO: 3604674 - DNA, 11 bp, Homo sapiens
agcttcccaac

SEQ ID NO: 3604675 - DNA, 14 bp, Homo sapiens
agcttccgctttga

SEQ ID NO: 3604676 - DNA, 19 bp, Homo sapiens
agcttccgctttgaaagaa

SEQ ID NO: 3604677 - DNA, 23 bp, Homo sapiens
agcttccgctttgaaagaagcaa

SEQ ID NO: 3604678 - DNA, 13 bp, Homo sapiens
agcttcctcacac

SEQ ID NO: 3604679 - DNA, 14 bp, Homo sapiens
agcttcctcacacc

SEQ ID NO: 3604680 - DNA, 24 bp, Homo sapiens
agcttcctcacacccctgtcccac

SEQ ID NO: 3604681 - DNA, 22 bp, Homo sapiens
agcttccttaagtatatcatgt

SEQ ID NO: 3604682 - DNA, 15 bp, Homo sapiens
agcttccttggcttt

SEQ ID NO: 3604683 - DNA, 17 bp, Homo sapiens
agcttctaaatggtgct

SEQ ID NO: 3604684 - DNA, 19 bp, Homo sapiens
agcttctactcctgcctca

SEQ ID NO: 3604685 - DNA, 17 bp, Homo sapiens
agcttctcccagtgtga

SEQ ID NO: 3604686 - DNA, 12 bp, Homo sapiens
agcttctctgca

SEQ ID NO: 3604687 - DNA, 19 bp, Homo sapiens
agcttgctgggctttggga

SEQ ID NO: 3604688 - DNA, 21 bp, Homo sapiens
agcttgcttgctttctttttt

SEQ ID NO: 3604689 - DNA, 21 bp, Homo sapiens
agcttggctcacaaggcccag

SEQ ID NO: 3604690 - DNA, 17 bp, Homo sapiens
agcttgggcagatctcc

SEQ ID NO: 3604691 - DNA, 23 bp, Homo sapiens
agcttgggcagatctcccacatg

SEQ ID NO: 3604692 - DNA, 18 bp, Homo sapiens
agcttggttctgtgaaca

SEQ ID NO: 3604693 - DNA, 13 bp, Homo sapiens
agcttgtgaagat

SEQ ID NO: 3604694 - DNA, 14 bp, Homo sapiens
agcttgtgaagatt

SEQ ID NO: 3604695 - DNA, 15 bp, Homo sapiens
agcttgttgaaaacc

SEQ ID NO: 3604696 - DNA, 23 bp, Homo sapiens
agcttgttgaaaacccagactgt

SEQ ID NO: 3604697 - DNA, 15 bp, Homo sapiens
agctttaaaagaaaa

SEQ ID NO: 3604698 - DNA, 14 bp, Homo sapiens
agctttctgagcaa

SEQ ID NO: 3604699 - DNA, 22 bp, Homo sapiens
agctttctgagcaagaggattt

SEQ ID NO: 3604700 - DNA, 23 bp, Homo sapiens
agctttctgagcaagaggatttt

SEQ ID NO: 3604701 - DNA, 21 bp, Homo sapiens
agctttgctctttggtagaaa

SEQ ID NO: 3604702 - DNA, 23 bp, Homo sapiens
agctttgctctttggtagaaaag

SEQ ID NO: 3604703 - DNA, 17 bp, Homo sapiens
agctttgtagaaattaa

SEQ ID NO: 3604704 - DNA, 16 bp, Homo sapiens
agctttgtctccaaag

SEQ ID NO: 3604705 - DNA, 20 bp, Homo sapiens
agctttgtctccaaagaaga

SEQ ID NO: 3604706 - DNA, 12 bp, Homo sapiens
agcttttaaaaa

SEQ ID NO: 3604707 - DNA, 13 bp, Homo sapiens
agcttttcccttc

SEQ ID NO: 3604708 - DNA, 16 bp, Homo sapiens
agcttttcccttcttt

SEQ ID NO: 3604709 - DNA, 19 bp, Homo sapiens
agcttttgaaatccagaag

SEQ ID NO: 3604710 - DNA, 15 bp, Homo sapiens
agctttttaaaattt

SEQ ID NO: 3604711 - DNA, 16 bp, Homo sapiens
agcttttttattttaa

SEQ ID NO: 3604712 - DNA, 22 bp, Homo sapiens
aggaaaaaaatcgtccagggag

SEQ ID NO: 3604713 - DNA, 17 bp, Homo sapiens
aggaaaagaaacctggg

SEQ ID NO: 3604714 - DNA, 22 bp, Homo sapiens
aggaaaaggcccctgcaatgtg

SEQ ID NO: 3604715 - DNA, 14 bp, Homo sapiens
aggaaaatgtctgt

SEQ ID NO: 3604716 - DNA, 20 bp, Homo sapiens
aggaaaatgtctgtaataat

SEQ ID NO: 3604717 - DNA, 20 bp, Homo sapiens
aggaaagaagggggccctgc

SEQ ID NO: 3604718 - DNA, 21 bp, Homo sapiens
aggaaagaagggggccctgct

SEQ ID NO: 3604719 - DNA, 13 bp, Homo sapiens
aggaaagccacat

SEQ ID NO: 3604720 - DNA, 15 bp, Homo sapiens
aggaaagtgtgaaga

SEQ ID NO: 3604721 - DNA, 22 bp, Homo sapiens
aggaaatcaaatatgcaaagca

SEQ ID NO: 3604722 - DNA, 11 bp, Homo sapiens
aggaaatctgt

SEQ ID NO: 3604723 - DNA, 17 bp, Homo sapiens
aggaacagtcctgttca

SEQ ID NO: 3604724 - DNA, 15 bp, Homo sapiens
aggaaccacaccaca

SEQ ID NO: 3604725 - DNA, 16 bp, Homo sapiens
aggaaccctcaggcca

SEQ ID NO: 3604726 - DNA, 22 bp, Homo sapiens
aggaaccctcaggccaccctcc

SEQ ID NO: 3604727 - DNA, 14 bp, Homo sapiens
aggaaccctggagg

SEQ ID NO: 3604728 - DNA, 15 bp, Homo sapiens
aggaaccctggaggt

SEQ ID NO: 3604729 - DNA, 16 bp, Homo sapiens
aggaactagaaagaag

SEQ ID NO: 3604730 - DNA, 22 bp, Homo sapiens
aggaactgctgggcttggcagc

SEQ ID NO: 3604731 - DNA, 22 bp, Homo sapiens
aggaagctacgggcacaactgg

SEQ ID NO: 3604732 - DNA, 17 bp, Homo sapiens
aggaagctgtgttgaaa

SEQ ID NO: 3604733 - DNA, 14 bp, Homo sapiens
aggaaggccaaaat

SEQ ID NO: 3604734 - DNA, 19 bp, Homo sapiens
aggaaggccaaaatcaaga

SEQ ID NO: 3604735 - DNA, 18 bp, Homo sapiens
aggaagtggctgtccctg

SEQ ID NO: 3604736 - DNA, 22 bp, Homo sapiens
aggaagttgacttatagtacat

SEQ ID NO: 3604737 - DNA, 19 bp, Homo sapiens
aggaataaattgctccttg

SEQ ID NO: 3604738 - DNA, 19 bp, Homo sapiens
aggaataaggcccagagcg

SEQ ID NO: 3604739 - DNA, 23 bp, Homo sapiens
aggaatgaaatcctgcttcagtg

SEQ ID NO: 3604740 - DNA, 13 bp, Homo sapiens
aggaatggccctc

SEQ ID NO: 3604741 - DNA, 16 bp, Homo sapiens
aggaattacgtgctct

SEQ ID NO: 3604742 - DNA, 15 bp, Homo sapiens
aggaattcagtgcct

SEQ ID NO: 3604743 - DNA, 16 bp, Homo sapiens
aggaattcagtgcctt

SEQ ID NO: 3604744 - DNA, 18 bp, Homo sapiens
aggaatttcccaggaccc

SEQ ID NO: 3604745 - DNA, 15 bp, Homo sapiens
aggaatttcttaact

SEQ ID NO: 3604746 - DNA, 19 bp, Homo sapiens
aggaatttcttaacttctt

SEQ ID NO: 3604747 - DNA, 23 bp, Homo sapiens
aggaatttcttaacttcttgctt

SEQ ID NO: 3604748 - DNA, 16 bp, Homo sapiens
aggaattttctttgtg

SEQ ID NO: 3604749 - DNA, 20 bp, Homo sapiens
aggacaggaccctcaggaat

SEQ ID NO: 3604750 - DNA, 12 bp, Homo sapiens
aggacagtattt

SEQ ID NO: 3604751 - DNA, 19 bp, Homo sapiens
aggacagtatttgtgggga

SEQ ID NO: 3604752 - DNA, 20 bp, Homo sapiens
aggacagttgatggagcccc

SEQ ID NO: 3604753 - DNA, 20 bp, Homo sapiens
aggacataatggggtcctgg

SEQ ID NO: 3604754 - DNA, 13 bp, Homo sapiens
aggacatcagcaa

SEQ ID NO: 3604755 - DNA, 15 bp, Homo sapiens
aggacatcagcaaac

SEQ ID NO: 3604756 - DNA, 22 bp, Homo sapiens
aggacatttgtgggcaagcaga

SEQ ID NO: 3604757 - DNA, 13 bp, Homo sapiens
aggaccagctcag

SEQ ID NO: 3604758 - DNA, 16 bp, Homo sapiens
aggacccatccctgcc

SEQ ID NO: 3604759 - DNA, 19 bp, Homo sapiens
aggacccatccctgcctgg

SEQ ID NO: 3604760 - DNA, 15 bp, Homo sapiens
aggaccccacatcct

SEQ ID NO: 3604761 - DNA, 17 bp, Homo sapiens
aggaccccacatccttc

SEQ ID NO: 3604762 - DNA, 18 bp, Homo sapiens
aggacccggaggggcctg

SEQ ID NO: 3604763 - DNA, 22 bp, Homo sapiens
aggacccggaggggcctggcag

SEQ ID NO: 3604764 - DNA, 13 bp, Homo sapiens
aggaccctcagga

SEQ ID NO: 3604765 - DNA, 14 bp, Homo sapiens
aggaccctcgagag

SEQ ID NO: 3604766 - DNA, 17 bp, Homo sapiens
aggaccctcgagagcct

SEQ ID NO: 3604767 - DNA, 15 bp, Homo sapiens
aggaccctgaagggg

SEQ ID NO: 3604768 - DNA, 13 bp, Homo sapiens
aggaccctgtcct

SEQ ID NO: 3604769 - DNA, 16 bp, Homo sapiens
aggaccctgtcctgca

SEQ ID NO: 3604770 - DNA, 17 bp, Homo sapiens
aggaccctgtcctgcag

SEQ ID NO: 3604771 - DNA, 20 bp, Homo sapiens
aggactatatttgggcctgc

SEQ ID NO: 3604772 - DNA, 12 bp, Homo sapiens
aggactcccaga

SEQ ID NO: 3604773 - DNA, 14 bp, Homo sapiens
aggactcccagaac

SEQ ID NO: 3604774 - DNA, 19 bp, Homo sapiens
aggactcctggcagggcca

SEQ ID NO: 3604775 - DNA, 16 bp, Homo sapiens
aggactctctccagga

SEQ ID NO: 3604776 - DNA, 21 bp, Homo sapiens
aggactctctccaggagggct

SEQ ID NO: 3604777 - DNA, 22 bp, Homo sapiens
aggactctctccaggagggctc

SEQ ID NO: 3604778 - DNA, 14 bp, Homo sapiens
aggactctgcctcc

SEQ ID NO: 3604779 - DNA, 18 bp, Homo sapiens
aggactctgcctcctctt

SEQ ID NO: 3604780 - DNA, 19 bp, Homo sapiens
aggactctgcctcctcttc

SEQ ID NO: 3604781 - DNA, 22 bp, Homo sapiens
aggactggttctgaggccagaa

SEQ ID NO: 3604782 - DNA, 19 bp, Homo sapiens
aggactgtttcaaacatgc

SEQ ID NO: 3604783 - DNA, 21 bp, Homo sapiens
aggacttcctgtccagctcca

SEQ ID NO: 3604784 - DNA, 22 bp, Homo sapiens
aggacttcctgtccagctccaa

SEQ ID NO: 3604785 - DNA, 19 bp, Homo sapiens
aggagaaagcaaaatacat

SEQ ID NO: 3604786 - DNA, 15 bp, Homo sapiens
aggagaacttgctgc

SEQ ID NO: 3604787 - DNA, 16 bp, Homo sapiens
aggagaacttgctgcc

SEQ ID NO: 3604788 - DNA, 17 bp, Homo sapiens
aggagaacttgctgcct

SEQ ID NO: 3604789 - DNA, 14 bp, Homo sapiens
aggagaagccagga

SEQ ID NO: 3604790 - DNA, 14 bp, Homo sapiens
aggagaaggggctt

SEQ ID NO: 3604791 - DNA, 22 bp, Homo sapiens
aggagaatcgcttgaacctggg

SEQ ID NO: 3604792 - DNA, 14 bp, Homo sapiens
aggagaatggcatg

SEQ ID NO: 3604793 - DNA, 17 bp, Homo sapiens
aggagaatggcatggca

SEQ ID NO: 3604794 - DNA, 21 bp, Homo sapiens
aggagaatggcatggcaggag

SEQ ID NO: 3604795 - DNA, 23 bp, Homo sapiens
aggagaatggcatggcaggagtc

SEQ ID NO: 3604796 - DNA, 13 bp, Homo sapiens
aggagacaaaaga

SEQ ID NO: 3604797 - DNA, 16 bp, Homo sapiens
aggagacaaaagagca

SEQ ID NO: 3604798 - DNA, 18 bp, Homo sapiens
aggagacagttcaagaaa

SEQ ID NO: 3604799 - DNA, 15 bp, Homo sapiens
aggagacctccagct

SEQ ID NO: 3604800 - DNA, 22 bp, Homo sapiens
aggagagactgagcagccgcca

SEQ ID NO: 3604801 - DNA, 16 bp, Homo sapiens
aggagagagaccccgc

SEQ ID NO: 3604802 - DNA, 14 bp, Homo sapiens
aggagagagccagg

SEQ ID NO: 3604803 - DNA, 13 bp, Homo sapiens
aggagagaggagg

SEQ ID NO: 3604804 - DNA, 18 bp, Homo sapiens
aggagagaggaggaaaag

SEQ ID NO: 3604805 - DNA, 16 bp, Homo sapiens
aggagagcccttcatt

SEQ ID NO: 3604806 - DNA, 16 bp, Homo sapiens
aggagaggcagcatgc

SEQ ID NO: 3604807 - DNA, 22 bp, Homo sapiens
aggagatccagggcaaggccat

SEQ ID NO: 3604808 - DNA, 17 bp, Homo sapiens
aggagatgaccagggat

SEQ ID NO: 3604809 - DNA, 19 bp, Homo sapiens
aggagatgaccagggatgc

SEQ ID NO: 3604810 - DNA, 15 bp, Homo sapiens
aggagatgctgtgcc

SEQ ID NO: 3604811 - DNA, 17 bp, Homo sapiens
aggagcaatgaagatcc

SEQ ID NO: 3604812 - DNA, 18 bp, Homo sapiens
aggagcaggcttgtggca

SEQ ID NO: 3604813 - DNA, 17 bp, Homo sapiens
aggagcatccttggcag

SEQ ID NO: 3604814 - DNA, 14 bp, Homo sapiens
aggagccccgccac

SEQ ID NO: 3604815 - DNA, 23 bp, Homo sapiens
aggagcccttctatacccaccca

SEQ ID NO: 3604816 - DNA, 22 bp, Homo sapiens
aggagcctagcggagcccagcc

SEQ ID NO: 3604817 - DNA, 14 bp, Homo sapiens
aggagcctctggct

SEQ ID NO: 3604818 - DNA, 15 bp, Homo sapiens
aggagcctctggctt

SEQ ID NO: 3604819 - DNA, 11 bp, Homo sapiens
aggagcctggc

SEQ ID NO: 3604820 - DNA, 17 bp, Homo sapiens
aggagcctggccaggca

SEQ ID NO: 3604821 - DNA, 11 bp, Homo sapiens
aggagctgcta

SEQ ID NO: 3604822 - DNA, 20 bp, Homo sapiens
aggagctgctatagcctggg

SEQ ID NO: 3604823 - DNA, 14 bp, Homo sapiens
aggaggcaggacct

SEQ ID NO: 3604824 - DNA, 17 bp, Homo sapiens
aggaggccaaccagccc

SEQ ID NO: 3604825 - DNA, 21 bp, Homo sapiens
aggaggggcagcgcatgtgtg

SEQ ID NO: 3604826 - DNA, 15 bp, Homo sapiens
aggagggttggagtg

SEQ ID NO: 3604827 - DNA, 14 bp, Homo sapiens
aggagtctctgcca

SEQ ID NO: 3604828 - DNA, 18 bp, Homo sapiens
aggagtgggctctgagca

SEQ ID NO: 3604829 - DNA, 15 bp, Homo sapiens
aggagtgtcctgccc

SEQ ID NO: 3604830 - DNA, 23 bp, Homo sapiens
aggagttcagggtcatagcatgc

SEQ ID NO: 3604831 - DNA, 21 bp, Homo sapiens
aggagtttgagaccagcttag

SEQ ID NO: 3604832 - DNA, 19 bp, Homo sapiens
aggataacttgctttcttc

SEQ ID NO: 3604833 - DNA, 14 bp, Homo sapiens
aggatacaggtgac

SEQ ID NO: 3604834 - DNA, 18 bp, Homo sapiens
aggatacaggtgacagtg

SEQ ID NO: 3604835 - DNA, 15 bp, Homo sapiens
aggatagatgctggc

SEQ ID NO: 3604836 - DNA, 18 bp, Homo sapiens
aggatagatgctggccca

SEQ ID NO: 3604837 - DNA, 13 bp, Homo sapiens
aggatatgattaa

SEQ ID NO: 3604838 - DNA, 19 bp, Homo sapiens
aggatatgattaatattat

SEQ ID NO: 3604839 - DNA, 19 bp, Homo sapiens
aggatattcagatgtatgt

SEQ ID NO: 3604840 - DNA, 17 bp, Homo sapiens
aggatcagttaactatt

SEQ ID NO: 3604841 - DNA, 17 bp, Homo sapiens
aggatccagggcagcag

SEQ ID NO: 3604842 - DNA, 22 bp, Homo sapiens
aggatccagtgacatgattctg

SEQ ID NO: 3604843 - DNA, 22 bp, Homo sapiens
aggatccgtgctgtctcctttg

SEQ ID NO: 3604844 - DNA, 17 bp, Homo sapiens
aggatctgtgattggct

SEQ ID NO: 3604845 - DNA, 16 bp, Homo sapiens
aggatctttgtggcca

SEQ ID NO: 3604846 - DNA, 20 bp, Homo sapiens
aggatctttgtggccaagga

SEQ ID NO: 3604847 - DNA, 18 bp, Homo sapiens
aggatcttttgaacccag

SEQ ID NO: 3604848 - DNA, 23 bp, Homo sapiens
aggatgatgtctttttattaaaa

SEQ ID NO: 3604849 - DNA, 23 bp, Homo sapiens
aggatgcagcgccgtgtcctctc

SEQ ID NO: 3604850 - DNA, 17 bp, Homo sapiens
aggatgctaacatctaa

SEQ ID NO: 3604851 - DNA, 15 bp, Homo sapiens
aggatgggaatcagg

SEQ ID NO: 3604852 - DNA, 13 bp, Homo sapiens
aggatgtctgggc

SEQ ID NO: 3604853 - DNA, 17 bp, Homo sapiens
aggattaactaaagaag

SEQ ID NO: 3604854 - DNA, 14 bp, Homo sapiens
aggattacagaaac

SEQ ID NO: 3604855 - DNA, 16 bp, Homo sapiens
aggattacagaaactg

SEQ ID NO: 3604856 - DNA, 15 bp, Homo sapiens
aggattctctgcagc

SEQ ID NO: 3604857 - DNA, 19 bp, Homo sapiens
aggattgaacttctttgaa

SEQ ID NO: 3604858 - DNA, 13 bp, Homo sapiens
aggattttaccaa

SEQ ID NO: 3604859 - DNA, 17 bp, Homo sapiens
aggattttaccaaagca

SEQ ID NO: 3604860 - DNA, 18 bp, Homo sapiens
aggattttaccaaagcat

SEQ ID NO: 3604861 - DNA, 19 bp, Homo sapiens
aggattttaccaaagcatc

SEQ ID NO: 3604862 - DNA, 19 bp, Homo sapiens
aggcaaaatccttgcttat

SEQ ID NO: 3604863 - DNA, 17 bp, Homo sapiens
aggcaaagaaaatgaaa

SEQ ID NO: 3604864 - DNA, 13 bp, Homo sapiens
aggcaaaggcctg

SEQ ID NO: 3604865 - DNA, 13 bp, Homo sapiens
aggcaacaggatt

SEQ ID NO: 3604866 - DNA, 12 bp, Homo sapiens
aggcaagccctg

SEQ ID NO: 3604867 - DNA, 17 bp, Homo sapiens
aggcaaggccctgccct

SEQ ID NO: 3604868 - DNA, 21 bp, Homo sapiens
aggcacagtgggagctgagct

SEQ ID NO: 3604869 - DNA, 23 bp, Homo sapiens
aggcacagtgggagctgagctgg

SEQ ID NO: 3604870 - DNA, 13 bp, Homo sapiens
aggcaccacagcc

SEQ ID NO: 3604871 - DNA, 14 bp, Homo sapiens
aggcaccacagcct

SEQ ID NO: 3604872 - DNA, 20 bp, Homo sapiens
aggcaccgccacgtcccagc

SEQ ID NO: 3604873 - DNA, 22 bp, Homo sapiens
aggcactgctgcccagcctcca

SEQ ID NO: 3604874 - DNA, 18 bp, Homo sapiens
aggcagcatgcttgggct

SEQ ID NO: 3604875 - DNA, 19 bp, Homo sapiens
aggcagcatgcttgggctg

SEQ ID NO: 3604876 - DNA, 17 bp, Homo sapiens
aggcagcgcagggctgg

SEQ ID NO: 3604877 - DNA, 20 bp, Homo sapiens
aggcagcttctactcctgcc

SEQ ID NO: 3604878 - DNA, 21 bp, Homo sapiens
aggcaggaccttcgggctgtg

SEQ ID NO: 3604879 - DNA, 18 bp, Homo sapiens
aggcaggacttctcacca

SEQ ID NO: 3604880 - DNA, 20 bp, Homo sapiens
aggcaggcggctcctcctca

SEQ ID NO: 3604881 - DNA, 16 bp, Homo sapiens
aggcagggagagagta

SEQ ID NO: 3604882 - DNA, 14 bp, Homo sapiens
aggcaggtgctttt

SEQ ID NO: 3604883 - DNA, 20 bp, Homo sapiens
aggcaggtgcttttggcaga

SEQ ID NO: 3604884 - DNA, 17 bp, Homo sapiens
aggcagtggcaggggag

SEQ ID NO: 3604885 - DNA, 18 bp, Homo sapiens
aggcagtggcaggggagc

SEQ ID NO: 3604886 - DNA, 17 bp, Homo sapiens
aggcatcaaaaaaacaa

SEQ ID NO: 3604887 - DNA, 23 bp, Homo sapiens
aggcatggtcccttaaggcacag

SEQ ID NO: 3604888 - DNA, 17 bp, Homo sapiens
aggcatgtgtcccttcc

SEQ ID NO: 3604889 - DNA, 14 bp, Homo sapiens
aggcattctcccag

SEQ ID NO: 3604890 - DNA, 15 bp, Homo sapiens
aggcattctcccagc

SEQ ID NO: 3604891 - DNA, 20 bp, Homo sapiens
aggcattctcccagctctag

SEQ ID NO: 3604892 - DNA, 13 bp, Homo sapiens
aggccaaccagcc

SEQ ID NO: 3604893 - DNA, 15 bp, Homo sapiens
aggccaaccagcccg

SEQ ID NO: 3604894 - DNA, 19 bp, Homo sapiens
aggccaaccagcccgacag

SEQ ID NO: 3604895 - DNA, 22 bp, Homo sapiens
aggccacagtggggctgcaggc

SEQ ID NO: 3604896 - DNA, 17 bp, Homo sapiens
aggccacattgctggct

SEQ ID NO: 3604897 - DNA, 12 bp, Homo sapiens
aggccagaaagg

SEQ ID NO: 3604898 - DNA, 12 bp, Homo sapiens
aggccagagaaa

SEQ ID NO: 3604899 - DNA, 14 bp, Homo sapiens
aggccagcaacatt

SEQ ID NO: 3604900 - DNA, 15 bp, Homo sapiens
aggccagcccagcca

SEQ ID NO: 3604901 - DNA, 22 bp, Homo sapiens
aggccagccttgtacagtctgc

SEQ ID NO: 3604902 - DNA, 23 bp, Homo sapiens
aggccagtcagacgccaggcacc

SEQ ID NO: 3604903 - DNA, 17 bp, Homo sapiens
aggccatctcaggagat

SEQ ID NO: 3604904 - DNA, 19 bp, Homo sapiens
aggccatctcaggagatgg

SEQ ID NO: 3604905 - DNA, 16 bp, Homo sapiens
aggccatctggagagc

SEQ ID NO: 3604906 - DNA, 21 bp, Homo sapiens
aggccatctggagagcccaga

SEQ ID NO: 3604907 - DNA, 13 bp, Homo sapiens
aggcccagagagg

SEQ ID NO: 3604908 - DNA, 16 bp, Homo sapiens
aggcccagagagggaa

SEQ ID NO: 3604909 - DNA, 16 bp, Homo sapiens
aggcccagagcgagga

SEQ ID NO: 3604910 - DNA, 18 bp, Homo sapiens
aggcccatgggaggctgg

SEQ ID NO: 3604911 - DNA, 23 bp, Homo sapiens
aggcccatgtatataagtactga

SEQ ID NO: 3604912 - DNA, 19 bp, Homo sapiens
aggccccaccggccaggcc

SEQ ID NO: 3604913 - DNA, 18 bp, Homo sapiens
aggccccagaggccctgg

SEQ ID NO: 3604914 - DNA, 19 bp, Homo sapiens
aggccccagaggccctgga

SEQ ID NO: 3604915 - DNA, 20 bp, Homo sapiens
aggccccagaggccctggag

SEQ ID NO: 3604916 - DNA, 12 bp, Homo sapiens
aggccccagcct

SEQ ID NO: 3604917 - DNA, 14 bp, Homo sapiens
aggccccagcctcc

SEQ ID NO: 3604918 - DNA, 20 bp, Homo sapiens
aggcccctaggtgcccaggg

SEQ ID NO: 3604919 - DNA, 12 bp, Homo sapiens
aggcccctgcaa

SEQ ID NO: 3604920 - DNA, 22 bp, Homo sapiens
aggcccgcttgctgggtacctg

SEQ ID NO: 3604921 - DNA, 13 bp, Homo sapiens
aggccctccctgt

SEQ ID NO: 3604922 - DNA, 15 bp, Homo sapiens
aggccctccctgtct

SEQ ID NO: 3604923 - DNA, 20 bp, Homo sapiens
aggccctccctgttccccag

SEQ ID NO: 3604924 - DNA, 22 bp, Homo sapiens
aggccctccctgttccccagag

SEQ ID NO: 3604925 - DNA, 23 bp, Homo sapiens
aggccctccctgttccccagaga

SEQ ID NO: 3604926 - DNA, 13 bp, Homo sapiens
aggccctctggag

SEQ ID NO: 3604927 - DNA, 22 bp, Homo sapiens
aggccctctggagtggccacta

SEQ ID NO: 3604928 - DNA, 17 bp, Homo sapiens
aggccctgtgagcacaa

SEQ ID NO: 3604929 - DNA, 16 bp, Homo sapiens
aggcccttattttcaa

SEQ ID NO: 3604930 - DNA, 20 bp, Homo sapiens
aggcccttattttcaagaaa

SEQ ID NO: 3604931 - DNA, 16 bp, Homo sapiens
aggccggcagcgggcg

SEQ ID NO: 3604932 - DNA, 22 bp, Homo sapiens
aggcctaattctatgcctgtct

SEQ ID NO: 3604933 - DNA, 17 bp, Homo sapiens
aggcctaggtgcagctc

SEQ ID NO: 3604934 - DNA, 18 bp, Homo sapiens
aggcctaggtgcagctcc

SEQ ID NO: 3604935 - DNA, 14 bp, Homo sapiens
aggcctcagccaga

SEQ ID NO: 3604936 - DNA, 18 bp, Homo sapiens
aggcctccaacgcccctg

SEQ ID NO: 3604937 - DNA, 19 bp, Homo sapiens
aggcctccaacgcccctgt

SEQ ID NO: 3604938 - DNA, 24 bp, Homo sapiens
aggcctccaacgcccctgtggcca

SEQ ID NO: 3604939 - DNA, 18 bp, Homo sapiens
aggcctccatcttctcat

SEQ ID NO: 3604940 - DNA, 15 bp, Homo sapiens
aggcctccgttgtct

SEQ ID NO: 3604941 - DNA, 19 bp, Homo sapiens
aggcctctgggacccacag

SEQ ID NO: 3604942 - DNA, 21 bp, Homo sapiens
aggcctctgggacccacagaa

SEQ ID NO: 3604943 - DNA, 16 bp, Homo sapiens
aggcctgactctcagc

SEQ ID NO: 3604944 - DNA, 14 bp, Homo sapiens
aggcctgccccctg

SEQ ID NO: 3604945 - DNA, 18 bp, Homo sapiens
aggcctgccccctgggct

SEQ ID NO: 3604946 - DNA, 11 bp, Homo sapiens
aggcctgccct

SEQ ID NO: 3604947 - DNA, 22 bp, Homo sapiens
aggcctgctgccagtgcagcca

SEQ ID NO: 3604948 - DNA, 20 bp, Homo sapiens
aggcctgcttgactttccag

SEQ ID NO: 3604949 - DNA, 23 bp, Homo sapiens
aggcctgcttgactttccagaat

SEQ ID NO: 3604950 - DNA, 20 bp, Homo sapiens
aggcctgggctggttggaga

SEQ ID NO: 3604951 - DNA, 21 bp, Homo sapiens
aggcctgggtgatctgctgct

SEQ ID NO: 3604952 - DNA, 19 bp, Homo sapiens
aggccttatctccaagacc

SEQ ID NO: 3604953 - DNA, 16 bp, Homo sapiens
aggccttatctgaaag

SEQ ID NO: 3604954 - DNA, 22 bp, Homo sapiens
aggccttatctgaaaggccagc

SEQ ID NO: 3604955 - DNA, 13 bp, Homo sapiens
aggccttgccagt

SEQ ID NO: 3604956 - DNA, 13 bp, Homo sapiens
aggcctttcctct

SEQ ID NO: 3604957 - DNA, 16 bp, Homo sapiens
aggcctttcctctgca

SEQ ID NO: 3604958 - DNA, 19 bp, Homo sapiens
aggcctttcctctgcacgc

SEQ ID NO: 3604959 - DNA, 14 bp, Homo sapiens
aggcgcctggtgtg

SEQ ID NO: 3604960 - DNA, 20 bp, Homo sapiens
aggcggctcctcctcaccca

SEQ ID NO: 3604961 - DNA, 16 bp, Homo sapiens
aggctaaactggtgca

SEQ ID NO: 3604962 - DNA, 17 bp, Homo sapiens
aggctaaactggtgcat

SEQ ID NO: 3604963 - DNA, 16 bp, Homo sapiens
aggctaagaccctgtg

SEQ ID NO: 3604964 - DNA, 20 bp, Homo sapiens
aggctaattttttatccttt

SEQ ID NO: 3604965 - DNA, 20 bp, Homo sapiens
aggctacaacaaaaatcacc

SEQ ID NO: 3604966 - DNA, 14 bp, Homo sapiens
aggctactgtaatg

SEQ ID NO: 3604967 - DNA, 20 bp, Homo sapiens
aggctactgtaatgctgcct

SEQ ID NO: 3604968 - DNA, 14 bp, Homo sapiens
aggctagctgtgct

SEQ ID NO: 3604969 - DNA, 16 bp, Homo sapiens
aggctattattttcac

SEQ ID NO: 3604970 - DNA, 19 bp, Homo sapiens
aggctcaggcacatacacc

SEQ ID NO: 3604971 - DNA, 18 bp, Homo sapiens
aggctcagtggtgggaga

SEQ ID NO: 3604972 - DNA, 20 bp, Homo sapiens
aggctcagtggtgggagaga

SEQ ID NO: 3604973 - DNA, 22 bp, Homo sapiens
aggctccgggcaccaggggcca

SEQ ID NO: 3604974 - DNA, 18 bp, Homo sapiens
aggctcctacctgtctgc

SEQ ID NO: 3604975 - DNA, 21 bp, Homo sapiens
aggctcctacctgtctgctgc

SEQ ID NO: 3604976 - DNA, 19 bp, Homo sapiens
aggctcctctcaggctggg

SEQ ID NO: 3604977 - DNA, 22 bp, Homo sapiens
aggctcttaagcagcatggaaa

SEQ ID NO: 3604978 - DNA, 22 bp, Homo sapiens
aggctgaaatatccacccagca

SEQ ID NO: 3604979 - DNA, 18 bp, Homo sapiens
aggctgacatgctcacac

SEQ ID NO: 3604980 - DNA, 22 bp, Homo sapiens
aggctgcaaagcaaaacagact

SEQ ID NO: 3604981 - DNA, 17 bp, Homo sapiens
aggctgcctcctgccct

SEQ ID NO: 3604982 - DNA, 14 bp, Homo sapiens
aggctggaaatggt

SEQ ID NO: 3604983 - DNA, 15 bp, Homo sapiens
aggctggaagtactt

SEQ ID NO: 3604984 - DNA, 17 bp, Homo sapiens
aggctggagttggggca

SEQ ID NO: 3604985 - DNA, 18 bp, Homo sapiens
aggctgggcgtagtggct

SEQ ID NO: 3604986 - DNA, 18 bp, Homo sapiens
aggctggggatggtagga

SEQ ID NO: 3604987 - DNA, 17 bp, Homo sapiens
aggctggtaagagaagt

SEQ ID NO: 3604988 - DNA, 22 bp, Homo sapiens
aggctggtctcgaactcctgac

SEQ ID NO: 3604989 - DNA, 22 bp, Homo sapiens
aggctggtcttgaactgggctc

SEQ ID NO: 3604990 - DNA, 24 bp, Homo sapiens
aggctggtgttctgtctgggctca

SEQ ID NO: 3604991 - DNA, 12 bp, Homo sapiens
aggctgtaacta

SEQ ID NO: 3604992 - DNA, 18 bp, Homo sapiens
aggctgtacatagtcctt

SEQ ID NO: 3604993 - DNA, 16 bp, Homo sapiens
aggcttctcacggcga

SEQ ID NO: 3604994 - DNA, 18 bp, Homo sapiens
agggaaaaaagagtttaa

SEQ ID NO: 3604995 - DNA, 14 bp, Homo sapiens
agggaaactgccag

SEQ ID NO: 3604996 - DNA, 16 bp, Homo sapiens
agggaaactgccagca

SEQ ID NO: 3604997 - DNA, 19 bp, Homo sapiens
agggaaactgccagcaacg

SEQ ID NO: 3604998 - DNA, 16 bp, Homo sapiens
agggaaagcctctggc

SEQ ID NO: 3604999 - DNA, 19 bp, Homo sapiens
agggaaccccagggggcaa

SEQ ID NO: 3605000 - DNA, 14 bp, Homo sapiens
agggaagaactatt

SEQ ID NO: 3605001 - DNA, 20 bp, Homo sapiens
agggaagatgacctgcccca

SEQ ID NO: 3605002 - DNA, 13 bp, Homo sapiens
agggaagatggag

SEQ ID NO: 3605003 - DNA, 19 bp, Homo sapiens
agggaagcactgcctccct

SEQ ID NO: 3605004 - DNA, 13 bp, Homo sapiens
agggaagccatgt

SEQ ID NO: 3605005 - DNA, 14 bp, Homo sapiens
agggaaggacagga

SEQ ID NO: 3605006 - DNA, 22 bp, Homo sapiens
agggaaggacaggaccctcagg

SEQ ID NO: 3605007 - DNA, 17 bp, Homo sapiens
agggaagtaacagacac

SEQ ID NO: 3605008 - DNA, 14 bp, Homo sapiens
agggaatgcagcag

SEQ ID NO: 3605009 - DNA, 21 bp, Homo sapiens
agggacagaggccccagcctc

SEQ ID NO: 3605010 - DNA, 16 bp, Homo sapiens
agggacaggaccccag

SEQ ID NO: 3605011 - DNA, 20 bp, Homo sapiens
agggacaggaccccagctct

SEQ ID NO: 3605012 - DNA, 13 bp, Homo sapiens
agggacaggctga

SEQ ID NO: 3605013 - DNA, 19 bp, Homo sapiens
agggacaggctgaagagag

SEQ ID NO: 3605014 - DNA, 16 bp, Homo sapiens
agggaccactgggtga

SEQ ID NO: 3605015 - DNA, 18 bp, Homo sapiens
agggaccactgggtgaga

SEQ ID NO: 3605016 - DNA, 19 bp, Homo sapiens
agggaccatctgctgcagt

SEQ ID NO: 3605017 - DNA, 22 bp, Homo sapiens
agggaccggcggaccccagcca

SEQ ID NO: 3605018 - DNA, 18 bp, Homo sapiens
agggaccggtgctgcagg

SEQ ID NO: 3605019 - DNA, 17 bp, Homo sapiens
agggaccgtccagggga

SEQ ID NO: 3605020 - DNA, 15 bp, Homo sapiens
agggacctctcccag

SEQ ID NO: 3605021 - DNA, 18 bp, Homo sapiens
agggactacctctgtgcc

SEQ ID NO: 3605022 - DNA, 20 bp, Homo sapiens
agggagacaccagtggtgcg

SEQ ID NO: 3605023 - DNA, 22 bp, Homo sapiens
agggagactgaccatcatgccc

SEQ ID NO: 3605024 - DNA, 13 bp, Homo sapiens
agggagagagtag

SEQ ID NO: 3605025 - DNA, 15 bp, Homo sapiens
agggagcattttcct

SEQ ID NO: 3605026 - DNA, 12 bp, Homo sapiens
agggagccaagg

SEQ ID NO: 3605027 - DNA, 16 bp, Homo sapiens
agggagggcagctggc

SEQ ID NO: 3605028 - DNA, 17 bp, Homo sapiens
agggagggcagctggcc

SEQ ID NO: 3605029 - DNA, 15 bp, Homo sapiens
agggagggctgaccc

SEQ ID NO: 3605030 - DNA, 17 bp, Homo sapiens
agggagggctgacccag

SEQ ID NO: 3605031 - DNA, 19 bp, Homo sapiens
agggaggggcctaggcctc

SEQ ID NO: 3605032 - DNA, 21 bp, Homo sapiens
agggatatctactgtggtctg

SEQ ID NO: 3605033 - DNA, 15 bp, Homo sapiens
agggatatggcagga

SEQ ID NO: 3605034 - DNA, 22 bp, Homo sapiens
agggatatggcaggactcctgg

SEQ ID NO: 3605035 - DNA, 13 bp, Homo sapiens
agggatgaccttc

SEQ ID NO: 3605036 - DNA, 17 bp, Homo sapiens
agggatgaccttcccag

SEQ ID NO: 3605037 - DNA, 14 bp, Homo sapiens
agggatgatgaggg

SEQ ID NO: 3605038 - DNA, 18 bp, Homo sapiens
agggatgatggcagagcc

SEQ ID NO: 3605039 - DNA, 19 bp, Homo sapiens
agggatgatggcagagcca

SEQ ID NO: 3605040 - DNA, 20 bp, Homo sapiens
agggatgccctggaggtggc

SEQ ID NO: 3605041 - DNA, 21 bp, Homo sapiens
agggatgcggatcctgctggg

SEQ ID NO: 3605042 - DNA, 17 bp, Homo sapiens
agggatgctgggctggg

SEQ ID NO: 3605043 - DNA, 23 bp, Homo sapiens
agggatggacttgtgattggctg

SEQ ID NO: 3605044 - DNA, 15 bp, Homo sapiens
agggatggagaaaga

SEQ ID NO: 3605045 - DNA, 16 bp, Homo sapiens
agggatggagaaagaa

SEQ ID NO: 3605046 - DNA, 18 bp, Homo sapiens
agggatggagaaagaagt

SEQ ID NO: 3605047 - DNA, 15 bp, Homo sapiens
agggattagggagag

SEQ ID NO: 3605048 - DNA, 19 bp, Homo sapiens
agggattgaggggccctgg

SEQ ID NO: 3605049 - DNA, 14 bp, Homo sapiens
agggattgctgagg

SEQ ID NO: 3605050 - DNA, 17 bp, Homo sapiens
agggattgtagataaca

SEQ ID NO: 3605051 - DNA, 12 bp, Homo sapiens
agggcagcaggc

SEQ ID NO: 3605052 - DNA, 14 bp, Homo sapiens
agggcagggcccac

SEQ ID NO: 3605053 - DNA, 17 bp, Homo sapiens
agggcagggcccacgtg

SEQ ID NO: 3605054 - DNA, 23 bp, Homo sapiens
agggcagggcccacgtgtatagt

SEQ ID NO: 3605055 - DNA, 21 bp, Homo sapiens
agggcagtccttactccccca

SEQ ID NO: 3605056 - DNA, 22 bp, Homo sapiens
agggcagtgcccatgtgtacat

SEQ ID NO: 3605057 - DNA, 20 bp, Homo sapiens
agggcagtggcttctttcca

SEQ ID NO: 3605058 - DNA, 17 bp, Homo sapiens
agggcatggccaggtgg

SEQ ID NO: 3605059 - DNA, 21 bp, Homo sapiens
agggccaagagatctgtgtgg

SEQ ID NO: 3605060 - DNA, 20 bp, Homo sapiens
agggccaccggtgggcagtg

SEQ ID NO: 3605061 - DNA, 17 bp, Homo sapiens
agggccacctccacacc

SEQ ID NO: 3605062 - DNA, 18 bp, Homo sapiens
agggccacctgcaggacc

SEQ ID NO: 3605063 - DNA, 15 bp, Homo sapiens
agggccagagccagg

SEQ ID NO: 3605064 - DNA, 22 bp, Homo sapiens
agggccaggtgcagaccttggg

SEQ ID NO: 3605065 - DNA, 22 bp, Homo sapiens
agggccatctgactgccaagcc

SEQ ID NO: 3605066 - DNA, 15 bp, Homo sapiens
agggcccacacctgg

SEQ ID NO: 3605067 - DNA, 17 bp, Homo sapiens
agggcccagagcccagc

SEQ ID NO: 3605068 - DNA, 19 bp, Homo sapiens
agggcccagagcccagctc

SEQ ID NO: 3605069 - DNA, 20 bp, Homo sapiens
agggcccagagcccagctcc

SEQ ID NO: 3605070 - DNA, 15 bp, Homo sapiens
agggcccagcccaga

SEQ ID NO: 3605071 - DNA, 17 bp, Homo sapiens
agggcccagcccagagc

SEQ ID NO: 3605072 - DNA, 22 bp, Homo sapiens
agggcccagcccagagccacct

SEQ ID NO: 3605073 - DNA, 21 bp, Homo sapiens
actcactgggaagctcccacc

SEQ ID NO: 3605074 - DNA, 18 bp, Homo sapiens
actcagaaaattccctgg

SEQ ID NO: 3605075 - DNA, 14 bp, Homo sapiens
actcagatccaggg

SEQ ID NO: 3605076 - DNA, 17 bp, Homo sapiens
actcagatccagggaca

SEQ ID NO: 3605077 - DNA, 21 bp, Homo sapiens
actcagatttaagccttacaa

SEQ ID NO: 3605078 - DNA, 14 bp, Homo sapiens
actcagcagagtga

SEQ ID NO: 3605079 - DNA, 12 bp, Homo sapiens
actcaggccaca

SEQ ID NO: 3605080 - DNA, 14 bp, Homo sapiens
actcaggccacagt

SEQ ID NO: 3605081 - DNA, 23 bp, Homo sapiens
actcaggcctccatcttctcatg

SEQ ID NO: 3605082 - DNA, 21 bp, Homo sapiens
actcaggcctgtgtgactcca

SEQ ID NO: 3605083 - DNA, 20 bp, Homo sapiens
actcagggaggctaaatcag

SEQ ID NO: 3605084 - DNA, 14 bp, Homo sapiens
actcaggggacccc

SEQ ID NO: 3605085 - DNA, 17 bp, Homo sapiens
actcagtctctcttctc

SEQ ID NO: 3605086 - DNA, 19 bp, Homo sapiens
actcagtctctcttctctc

SEQ ID NO: 3605087 - DNA, 16 bp, Homo sapiens
actcagtggggctggc

SEQ ID NO: 3605088 - DNA, 17 bp, Homo sapiens
actcagtggggctggca

SEQ ID NO: 3605089 - DNA, 11 bp, Homo sapiens
actcatattgc

SEQ ID NO: 3605090 - DNA, 21 bp, Homo sapiens
actcatcttggccctcctcag

SEQ ID NO: 3605091 - DNA, 16 bp, Homo sapiens
actccaaacctgtctt

SEQ ID NO: 3605092 - DNA, 14 bp, Homo sapiens
actccaaagaaatg

SEQ ID NO: 3605093 - DNA, 21 bp, Homo sapiens
actccaagagggaatggtcaa

SEQ ID NO: 3605094 - DNA, 16 bp, Homo sapiens
actccaagtgccccac

SEQ ID NO: 3605095 - DNA, 14 bp, Homo sapiens
actccaccgaccaa

SEQ ID NO: 3605096 - DNA, 21 bp, Homo sapiens
actccaccgaccaactgccct

SEQ ID NO: 3605097 - DNA, 20 bp, Homo sapiens
actccactactctcttcctc

SEQ ID NO: 3605098 - DNA, 21 bp, Homo sapiens
actccactactctcttcctcc

SEQ ID NO: 3605099 - DNA, 13 bp, Homo sapiens
actccactgtttt

SEQ ID NO: 3605100 - DNA, 14 bp, Homo sapiens
actccagactctgg

SEQ ID NO: 3605101 - DNA, 23 bp, Homo sapiens
actccagcctgggcgacaaaaac

SEQ ID NO: 3605102 - DNA, 11 bp, Homo sapiens
actccagctga

SEQ ID NO: 3605103 - DNA, 13 bp, Homo sapiens
actccaggcagga

SEQ ID NO: 3605104 - DNA, 19 bp, Homo sapiens
actccagggtgacaaggcc

SEQ ID NO: 3605105 - DNA, 21 bp, Homo sapiens
actccagggtgacaaggcctg

SEQ ID NO: 3605106 - DNA, 22 bp, Homo sapiens
actccagggtgacaaggcctgc

SEQ ID NO: 3605107 - DNA, 14 bp, Homo sapiens
actccaggttcctg

SEQ ID NO: 3605108 - DNA, 18 bp, Homo sapiens
actccatactccactcca

SEQ ID NO: 3605109 - DNA, 15 bp, Homo sapiens
actccatttctttct

SEQ ID NO: 3605110 - DNA, 20 bp, Homo sapiens
actcccaacttcttcctgtg

SEQ ID NO: 3605111 - DNA, 20 bp, Homo sapiens
actcccacagcagccccagg

SEQ ID NO: 3605112 - DNA, 20 bp, Homo sapiens
actcccagcatcgcactctg

SEQ ID NO: 3605113 - DNA, 23 bp, Homo sapiens
actcccaggatgacgtgctccgt

SEQ ID NO: 3605114 - DNA, 14 bp, Homo sapiens
actccccaacccct

SEQ ID NO: 3605115 - DNA, 14 bp, Homo sapiens
actccccagagctg

SEQ ID NO: 3605116 - DNA, 18 bp, Homo sapiens
actccccagagctgtgcc

SEQ ID NO: 3605117 - DNA, 19 bp, Homo sapiens
actccccagagctgtgcca

SEQ ID NO: 3605118 - DNA, 13 bp, Homo sapiens
actccccagccca

SEQ ID NO: 3605119 - DNA, 12 bp, Homo sapiens
actccccaggga

SEQ ID NO: 3605120 - DNA, 14 bp, Homo sapiens
actccccagggagc

SEQ ID NO: 3605121 - DNA, 19 bp, Homo sapiens
actcccccgtttctccttt

SEQ ID NO: 3605122 - DNA, 23 bp, Homo sapiens
actccctacactgatgcaaggat

SEQ ID NO: 3605123 - DNA, 23 bp, Homo sapiens
actccgtccatccgactgcccct

SEQ ID NO: 3605124 - DNA, 20 bp, Homo sapiens
actccgtgcttaaccaaaga

SEQ ID NO: 3605125 - DNA, 14 bp, Homo sapiens
actcctacctggta

SEQ ID NO: 3605126 - DNA, 17 bp, Homo sapiens
actcctcagcacccctc

SEQ ID NO: 3605127 - DNA, 18 bp, Homo sapiens
actcctgacctcaagtga

SEQ ID NO: 3605128 - DNA, 13 bp, Homo sapiens
actcctgctggta

SEQ ID NO: 3605129 - DNA, 16 bp, Homo sapiens
actcctggcagggcca

SEQ ID NO: 3605130 - DNA, 10 bp, Homo sapiens
actcctggct

SEQ ID NO: 3605131 - DNA, 18 bp, Homo sapiens
actcctgtcccttttccc

SEQ ID NO: 3605132 - DNA, 15 bp, Homo sapiens
actcctttatctgta

SEQ ID NO: 3605133 - DNA, 16 bp, Homo sapiens
actcctttatctgtaa

SEQ ID NO: 3605134 - DNA, 18 bp, Homo sapiens
actcggtgtccccaccat

SEQ ID NO: 3605135 - DNA, 23 bp, Homo sapiens
actcgtgtgtttctattttttga

SEQ ID NO: 3605136 - DNA, 14 bp, Homo sapiens
actctaactctgag

SEQ ID NO: 3605137 - DNA, 15 bp, Homo sapiens
actctaactctgaga

SEQ ID NO: 3605138 - DNA, 16 bp, Homo sapiens
actctacctgcacact

SEQ ID NO: 3605139 - DNA, 20 bp, Homo sapiens
actctacttagcatgtccct

SEQ ID NO: 3605140 - DNA, 21 bp, Homo sapiens
actctacttagcatgtcccta

SEQ ID NO: 3605141 - DNA, 23 bp, Homo sapiens
actctagcctggcaacagagcga

SEQ ID NO: 3605142 - DNA, 18 bp, Homo sapiens
actctattgatacaatat

SEQ ID NO: 3605143 - DNA, 22 bp, Homo sapiens
actctcaccatgatgtgaagag

SEQ ID NO: 3605144 - DNA, 18 bp, Homo sapiens
actctcagaaataaatca

SEQ ID NO: 3605145 - DNA, 12 bp, Homo sapiens
actctcagagtg

SEQ ID NO: 3605146 - DNA, 13 bp, Homo sapiens
actctccatatcc

SEQ ID NO: 3605147 - DNA, 19 bp, Homo sapiens
actctcccattatatttat

SEQ ID NO: 3605148 - DNA, 13 bp, Homo sapiens
actctcctgcctc

SEQ ID NO: 3605149 - DNA, 12 bp, Homo sapiens
actctctccagg

SEQ ID NO: 3605150 - DNA, 15 bp, Homo sapiens
actctcttatgcatt

SEQ ID NO: 3605151 - DNA, 22 bp, Homo sapiens
actctgctgtctaacctgtgac

SEQ ID NO: 3605152 - DNA, 23 bp, Homo sapiens
actctgctgtctaacctgtgacc

SEQ ID NO: 3605153 - DNA, 19 bp, Homo sapiens
actctgggcaaagcccctc

SEQ ID NO: 3605154 - DNA, 22 bp, Homo sapiens
actctgggcaaagcccctcaca

SEQ ID NO: 3605155 - DNA, 16 bp, Homo sapiens
actctgggctccagag

SEQ ID NO: 3605156 - DNA, 15 bp, Homo sapiens
actctgtcttgtgtt

SEQ ID NO: 3605157 - DNA, 23 bp, Homo sapiens
actcttcagtgactcctgctggt

SEQ ID NO: 3605158 - DNA, 20 bp, Homo sapiens
actctttaataaattgctta

SEQ ID NO: 3605159 - DNA, 20 bp, Homo sapiens
actctttatcaagcaacatt

SEQ ID NO: 3605160 - DNA, 17 bp, Homo sapiens
actctttctaatgctga

SEQ ID NO: 3605161 - DNA, 13 bp, Homo sapiens
actcttttgatgg

SEQ ID NO: 3605162 - DNA, 15 bp, Homo sapiens
actgaaaatttaaca

SEQ ID NO: 3605163 - DNA, 14 bp, Homo sapiens
actgaaatccttga

SEQ ID NO: 3605164 - DNA, 23 bp, Homo sapiens
actgaaatttgttatacttcaaa

SEQ ID NO: 3605165 - DNA, 13 bp, Homo sapiens
actgaaccaaatt

SEQ ID NO: 3605166 - DNA, 14 bp, Homo sapiens
actgaaccaaattg

SEQ ID NO: 3605167 - DNA, 17 bp, Homo sapiens
actgaagctttttattt

SEQ ID NO: 3605168 - DNA, 13 bp, Homo sapiens
actgaaggaaaag

SEQ ID NO: 3605169 - DNA, 19 bp, Homo sapiens
actgaaggaaaagcaagaa

SEQ ID NO: 3605170 - DNA, 18 bp, Homo sapiens
actgaagtttttgaaata

SEQ ID NO: 3605171 - DNA, 19 bp, Homo sapiens
actgaagtttttgaaatac

SEQ ID NO: 3605172 - DNA, 23 bp, Homo sapiens
actgaagtttttgaaataccttt

SEQ ID NO: 3605173 - DNA, 17 bp, Homo sapiens
actgaatgctgttaata

SEQ ID NO: 3605174 - DNA, 16 bp, Homo sapiens
actgaattttttttaa

SEQ ID NO: 3605175 - DNA, 20 bp, Homo sapiens
actgaattttttttaaaaat

SEQ ID NO: 3605176 - DNA, 20 bp, Homo sapiens
actgacagggagcagccccc

SEQ ID NO: 3605177 - DNA, 15 bp, Homo sapiens
actgacattgctcca

SEQ ID NO: 3605178 - DNA, 14 bp, Homo sapiens
actgaccagaacta

SEQ ID NO: 3605179 - DNA, 20 bp, Homo sapiens
actgaccagcctccatgctg

SEQ ID NO: 3605180 - DNA, 22 bp, Homo sapiens
actgaccctcaggcacaccttg

SEQ ID NO: 3605181 - DNA, 21 bp, Homo sapiens
actgacctgagcggcaccctg

SEQ ID NO: 3605182 - DNA, 18 bp, Homo sapiens
actgactatcataaaatc

SEQ ID NO: 3605183 - DNA, 16 bp, Homo sapiens
actgactggaggaggc

SEQ ID NO: 3605184 - DNA, 20 bp, Homo sapiens
actgactggaggaggcctgt

SEQ ID NO: 3605185 - DNA, 14 bp, Homo sapiens
actgagagaaagat

SEQ ID NO: 3605186 - DNA, 12 bp, Homo sapiens
actgagcagccg

SEQ ID NO: 3605187 - DNA, 16 bp, Homo sapiens
actgagcagccgccag

SEQ ID NO: 3605188 - DNA, 12 bp, Homo sapiens
actgagcaggga

SEQ ID NO: 3605189 - DNA, 20 bp, Homo sapiens
actgaggagatgaccaggga

SEQ ID NO: 3605190 - DNA, 22 bp, Homo sapiens
actgaggagatgaccagggatg

SEQ ID NO: 3605191 - DNA, 23 bp, Homo sapiens
actgaggagatgaccagggatgc

SEQ ID NO: 3605192 - DNA, 22 bp, Homo sapiens
actgaggatttctttttggttt

SEQ ID NO: 3605193 - DNA, 12 bp, Homo sapiens
actgaggcccag

SEQ ID NO: 3605194 - DNA, 21 bp, Homo sapiens
actgaggttcatggattttcc

SEQ ID NO: 3605195 - DNA, 18 bp, Homo sapiens
actgaggtttacatacgt

SEQ ID NO: 3605196 - DNA, 20 bp, Homo sapiens
actgagtagctctcctgact

SEQ ID NO: 3605197 - DNA, 22 bp, Homo sapiens
actgagtatgtgtaacaggata

SEQ ID NO: 3605198 - DNA, 12 bp, Homo sapiens
actgatagacac

SEQ ID NO: 3605199 - DNA, 15 bp, Homo sapiens
actgatgattttcct

SEQ ID NO: 3605200 - DNA, 22 bp, Homo sapiens
actgatgccaaggggctgagtg

SEQ ID NO: 3605201 - DNA, 17 bp, Homo sapiens
actgattaaaaatacct

SEQ ID NO: 3605202 - DNA, 14 bp, Homo sapiens
actgattttgtaaa

SEQ ID NO: 3605203 - DNA, 18 bp, Homo sapiens
actgcaaaaaaagcctcc

SEQ ID NO: 3605204 - DNA, 16 bp, Homo sapiens
actgcaaacacacctt

SEQ ID NO: 3605205 - DNA, 16 bp, Homo sapiens
actgcaacttctgcct

SEQ ID NO: 3605206 - DNA, 14 bp, Homo sapiens
actgcaagggattg

SEQ ID NO: 3605207 - DNA, 22 bp, Homo sapiens
actgcacagtgcatctcagccc

SEQ ID NO: 3605208 - DNA, 13 bp, Homo sapiens
actgcagcctctc

SEQ ID NO: 3605209 - DNA, 19 bp, Homo sapiens
actgcagcctctctggctg

SEQ ID NO: 3605210 - DNA, 14 bp, Homo sapiens
actgcagtctttat

SEQ ID NO: 3605211 - DNA, 22 bp, Homo sapiens
actgcataccaacctgggcaat

SEQ ID NO: 3605212 - DNA, 16 bp, Homo sapiens
actgcattcctgtgcc

SEQ ID NO: 3605213 - DNA, 20 bp, Homo sapiens
actgcattctctcccatcct

SEQ ID NO: 3605214 - DNA, 18 bp, Homo sapiens
actgccaagccagattct

SEQ ID NO: 3605215 - DNA, 22 bp, Homo sapiens
actgccaagccagattctcttg

SEQ ID NO: 3605216 - DNA, 15 bp, Homo sapiens
actgccaggctgcct

SEQ ID NO: 3605217 - DNA, 18 bp, Homo sapiens
actgccaggctgcctcct

SEQ ID NO: 3605218 - DNA, 13 bp, Homo sapiens
actgccaggctgt

SEQ ID NO: 3605219 - DNA, 17 bp, Homo sapiens
actgccaggctgtttca

SEQ ID NO: 3605220 - DNA, 19 bp, Homo sapiens
actgccagtccccctgccc

SEQ ID NO: 3605221 - DNA, 22 bp, Homo sapiens
actgccatggaattccctcctg

SEQ ID NO: 3605222 - DNA, 16 bp, Homo sapiens
actgcccattgtaact

SEQ ID NO: 3605223 - DNA, 20 bp, Homo sapiens
actgcccccagaaagcctcc

SEQ ID NO: 3605224 - DNA, 21 bp, Homo sapiens
actgccctaagcccccagggc

SEQ ID NO: 3605225 - DNA, 14 bp, Homo sapiens
actgcccttgctgc

SEQ ID NO: 3605226 - DNA, 15 bp, Homo sapiens
actgcccttgctgcc

SEQ ID NO: 3605227 - DNA, 17 bp, Homo sapiens
actgcccttgctgcccg

SEQ ID NO: 3605228 - DNA, 23 bp, Homo sapiens
actgcgcccttaactgcatccag

SEQ ID NO: 3605229 - DNA, 21 bp, Homo sapiens
actgctatttttcatcctaaa

SEQ ID NO: 3605230 - DNA, 15 bp, Homo sapiens
actgctctcctccac

SEQ ID NO: 3605231 - DNA, 12 bp, Homo sapiens
actgctgagctg

SEQ ID NO: 3605232 - DNA, 16 bp, Homo sapiens
actgctgcccagcctc

SEQ ID NO: 3605233 - DNA, 14 bp, Homo sapiens
actgctgctgctgc

SEQ ID NO: 3605234 - DNA, 20 bp, Homo sapiens
actgctggagtccagtgctt

SEQ ID NO: 3605235 - DNA, 13 bp, Homo sapiens
actgctggctgcc

SEQ ID NO: 3605236 - DNA, 15 bp, Homo sapiens
actgctggctgcctt

SEQ ID NO: 3605237 - DNA, 18 bp, Homo sapiens
actgcttcctttcttgat

SEQ ID NO: 3605238 - DNA, 21 bp, Homo sapiens
actggaggaggcctgtcccaa

SEQ ID NO: 3605239 - DNA, 15 bp, Homo sapiens
actggagttccttat

SEQ ID NO: 3605240 - DNA, 16 bp, Homo sapiens
actggatatttcaatc

SEQ ID NO: 3605241 - DNA, 22 bp, Homo sapiens
actggcacagttttctgagaaa

SEQ ID NO: 3605242 - DNA, 21 bp, Homo sapiens
actggcaggggagacaggagc

SEQ ID NO: 3605243 - DNA, 23 bp, Homo sapiens
actggccagtggctggatctgtg

SEQ ID NO: 3605244 - DNA, 18 bp, Homo sapiens
actggcctttttcattta

SEQ ID NO: 3605245 - DNA, 17 bp, Homo sapiens
actgggacagctggctg

SEQ ID NO: 3605246 - DNA, 16 bp, Homo sapiens
actgggcactggggcc

SEQ ID NO: 3605247 - DNA, 17 bp, Homo sapiens
actgggcactggggcct

SEQ ID NO: 3605248 - DNA, 15 bp, Homo sapiens
actgggcatttcaat

SEQ ID NO: 3605249 - DNA, 23 bp, Homo sapiens
actgggccataatgttgcttctc

SEQ ID NO: 3605250 - DNA, 20 bp, Homo sapiens
actgggctcaagtgatcctc

SEQ ID NO: 3605251 - DNA, 21 bp, Homo sapiens
actgggctgcccacctggctg

SEQ ID NO: 3605252 - DNA, 16 bp, Homo sapiens
actggggcctcagcct

SEQ ID NO: 3605253 - DNA, 15 bp, Homo sapiens
actgggggcagacat

SEQ ID NO: 3605254 - DNA, 21 bp, Homo sapiens
actggggttgcgtctgaggcc

SEQ ID NO: 3605255 - DNA, 15 bp, Homo sapiens
actgggtctgcgatg

SEQ ID NO: 3605256 - DNA, 12 bp, Homo sapiens
actgggttaaat

SEQ ID NO: 3605257 - DNA, 14 bp, Homo sapiens
actgggttaaatat

SEQ ID NO: 3605258 - DNA, 16 bp, Homo sapiens
actgggttcccatgct

SEQ ID NO: 3605259 - DNA, 20 bp, Homo sapiens
actggtacttagagtttctg

SEQ ID NO: 3605260 - DNA, 17 bp, Homo sapiens
actggtatgaataattg

SEQ ID NO: 3605261 - DNA, 15 bp, Homo sapiens
actggtatttatatt

SEQ ID NO: 3605262 - DNA, 12 bp, Homo sapiens
actggtccagct

SEQ ID NO: 3605263 - DNA, 16 bp, Homo sapiens
actggtccagctctga

SEQ ID NO: 3605264 - DNA, 18 bp, Homo sapiens
actggtccagctctgaca

SEQ ID NO: 3605265 - DNA, 21 bp, Homo sapiens
actggtccagctctgacatcc

SEQ ID NO: 3605266 - DNA, 18 bp, Homo sapiens
actggtttataataaact

SEQ ID NO: 3605267 - DNA, 13 bp, Homo sapiens
actggtttgcagt

SEQ ID NO: 3605268 - DNA, 22 bp, Homo sapiens
actgtaacttccaaataaataa

SEQ ID NO: 3605269 - DNA, 17 bp, Homo sapiens
actgtaagctttgttct

SEQ ID NO: 3605270 - DNA, 22 bp, Homo sapiens
actgtaatacgtagctctctta

SEQ ID NO: 3605271 - DNA, 14 bp, Homo sapiens
actgtactcctccc

SEQ ID NO: 3605272 - DNA, 18 bp, Homo sapiens
actgtagaatgatttcat

SEQ ID NO: 3605273 - DNA, 20 bp, Homo sapiens
actgtagaatgatttcatgc

SEQ ID NO: 3605274 - DNA, 14 bp, Homo sapiens
actgtagctctaaa

SEQ ID NO: 3605275 - DNA, 14 bp, Homo sapiens
actgtagtaattgt

SEQ ID NO: 3605276 - DNA, 20 bp, Homo sapiens
actgtatagctcttttccta

SEQ ID NO: 3605277 - DNA, 13 bp, Homo sapiens
actgtatccattc

SEQ ID NO: 3605278 - DNA, 19 bp, Homo sapiens
actgtatggaaacactgat

SEQ ID NO: 3605279 - DNA, 21 bp, Homo sapiens
actgtatggaaacactgattt

SEQ ID NO: 3605280 - DNA, 23 bp, Homo sapiens
actgtattgggaagttactgtta

SEQ ID NO: 3605281 - DNA, 18 bp, Homo sapiens
actgtattttctttcact

SEQ ID NO: 3605282 - DNA, 22 bp, Homo sapiens
actgtcagctcccctcggagaa

SEQ ID NO: 3605283 - DNA, 18 bp, Homo sapiens
actgtcagttctctggga

SEQ ID NO: 3605284 - DNA, 23 bp, Homo sapiens
actgtcagttctctgggaagtgg

SEQ ID NO: 3605285 - DNA, 21 bp, Homo sapiens
actgtctctccagtgaaatga

SEQ ID NO: 3605286 - DNA, 13 bp, Homo sapiens
actgtgaacttga

SEQ ID NO: 3605287 - DNA, 22 bp, Homo sapiens
actgtgaacttgactgggtgag

SEQ ID NO: 3605288 - DNA, 21 bp, Homo sapiens
actgtgaattcattctggagg

SEQ ID NO: 3605289 - DNA, 14 bp, Homo sapiens
actgtgccagaggc

SEQ ID NO: 3605290 - DNA, 17 bp, Homo sapiens
actgtgcttaatttaaa

SEQ ID NO: 3605291 - DNA, 23 bp, Homo sapiens
actgtgcttaatttaaatagcat

SEQ ID NO: 3605292 - DNA, 17 bp, Homo sapiens
actgtggcctgcaggag

SEQ ID NO: 3605293 - DNA, 18 bp, Homo sapiens
actgtggcctgcaggagg

SEQ ID NO: 3605294 - DNA, 19 bp, Homo sapiens
actgtgggcaaagtcctcc

SEQ ID NO: 3605295 - DNA, 22 bp, Homo sapiens
actgtgtttaactgctgcaggg

SEQ ID NO: 3605296 - DNA, 23 bp, Homo sapiens
actgttaactatgacagatatat

SEQ ID NO: 3605297 - DNA, 22 bp, Homo sapiens
actgttgggacagccattttcc

SEQ ID NO: 3605298 - DNA, 14 bp, Homo sapiens
actgttttatagaa

SEQ ID NO: 3605299 - DNA, 19 bp, Homo sapiens
actgtttttctctaatgct

SEQ ID NO: 3605300 - DNA, 21 bp, Homo sapiens
acttaaaaaatcagaacaaaa

SEQ ID NO: 3605301 - DNA, 17 bp, Homo sapiens
acttaaaagtattcata

SEQ ID NO: 3605302 - DNA, 17 bp, Homo sapiens
acttaaaatacatgaat

SEQ ID NO: 3605303 - DNA, 22 bp, Homo sapiens
acttaaaatattcctgcatttg

SEQ ID NO: 3605304 - DNA, 13 bp, Homo sapiens
acttaagaattga

SEQ ID NO: 3605305 - DNA, 17 bp, Homo sapiens
acttaagggagaaaaaa

SEQ ID NO: 3605306 - DNA, 15 bp, Homo sapiens
acttaatagcaacag

SEQ ID NO: 3605307 - DNA, 15 bp, Homo sapiens
acttaatgtatgtta

SEQ ID NO: 3605308 - DNA, 19 bp, Homo sapiens
acttaattgccagcaaata

SEQ ID NO: 3605309 - DNA, 12 bp, Homo sapiens
acttacaagaaa

SEQ ID NO: 3605310 - DNA, 15 bp, Homo sapiens
acttacacttataaa

SEQ ID NO: 3605311 - DNA, 13 bp, Homo sapiens
acttacagatctg

SEQ ID NO: 3605312 - DNA, 19 bp, Homo sapiens
acttacatatatttttaaa

SEQ ID NO: 3605313 - DNA, 12 bp, Homo sapiens
acttagaaactg

SEQ ID NO: 3605314 - DNA, 19 bp, Homo sapiens
acttagaggcaacaggatt

SEQ ID NO: 3605315 - DNA, 22 bp, Homo sapiens
acttagaggcaacaggattgat

SEQ ID NO: 3605316 - DNA, 17 bp, Homo sapiens
acttagagtttctgttt

SEQ ID NO: 3605317 - DNA, 14 bp, Homo sapiens
acttagcaggcacc

SEQ ID NO: 3605318 - DNA, 21 bp, Homo sapiens
acttaggagaagtcttctatt

SEQ ID NO: 3605319 - DNA, 20 bp, Homo sapiens
acttatggcatgactcttca

SEQ ID NO: 3605320 - DNA, 15 bp, Homo sapiens
acttatgtagaaact

SEQ ID NO: 3605321 - DNA, 23 bp, Homo sapiens
acttatgtagaaactgaggccca

SEQ ID NO: 3605322 - DNA, 22 bp, Homo sapiens
acttattattaataatgaagta

SEQ ID NO: 3605323 - DNA, 13 bp, Homo sapiens
acttattgaatat

SEQ ID NO: 3605324 - DNA, 21 bp, Homo sapiens
acttattttcagtgcatcatt

SEQ ID NO: 3605325 - DNA, 14 bp, Homo sapiens
acttatttttgaca

SEQ ID NO: 3605326 - DNA, 19 bp, Homo sapiens
acttatttttgacagtgtt

SEQ ID NO: 3605327 - DNA, 19 bp, Homo sapiens
acttcaaagctgaatattt

SEQ ID NO: 3605328 - DNA, 20 bp, Homo sapiens
acttcaaagtgcctgggctc

SEQ ID NO: 3605329 - DNA, 16 bp, Homo sapiens
acttcacgcccttggc

SEQ ID NO: 3605330 - DNA, 13 bp, Homo sapiens
acttcagctctgt

SEQ ID NO: 3605331 - DNA, 14 bp, Homo sapiens
acttcagctctgtt

SEQ ID NO: 3605332 - DNA, 14 bp, Homo sapiens
acttcaggctcttc

SEQ ID NO: 3605333 - DNA, 17 bp, Homo sapiens
acttcaggctcttctcc

SEQ ID NO: 3605334 - DNA, 21 bp, Homo sapiens
acttcaggtcaggtggctgtg

SEQ ID NO: 3605335 - DNA, 18 bp, Homo sapiens
acttcatatatgaggact

SEQ ID NO: 3605336 - DNA, 19 bp, Homo sapiens
acttcatgacaagcatttt

SEQ ID NO: 3605337 - DNA, 13 bp, Homo sapiens
acttccagtggct

SEQ ID NO: 3605338 - DNA, 19 bp, Homo sapiens
acttcctctggctccccaa

SEQ ID NO: 3605339 - DNA, 11 bp, Homo sapiens
acttcctgagg

SEQ ID NO: 3605340 - DNA, 12 bp, Homo sapiens
acttcctgctgc

SEQ ID NO: 3605341 - DNA, 22 bp, Homo sapiens
acttcctgctgcaccctgcgcc

SEQ ID NO: 3605342 - DNA, 15 bp, Homo sapiens
acttcctgtgacttc

SEQ ID NO: 3605343 - DNA, 20 bp, Homo sapiens
acttcctgtgcctttcctat

SEQ ID NO: 3605344 - DNA, 21 bp, Homo sapiens
acttcctgtgcctttcctatc

SEQ ID NO: 3605345 - DNA, 13 bp, Homo sapiens
acttcctgtggat

SEQ ID NO: 3605346 - DNA, 20 bp, Homo sapiens
acttcctgtggatgcaaata

SEQ ID NO: 3605347 - DNA, 17 bp, Homo sapiens
acttctaagactttact

SEQ ID NO: 3605348 - DNA, 13 bp, Homo sapiens
acttctaagtaaa

SEQ ID NO: 3605349 - DNA, 13 bp, Homo sapiens
acttctaggattt

SEQ ID NO: 3605350 - DNA, 20 bp, Homo sapiens
acttctaggatttattgtta

SEQ ID NO: 3605351 - DNA, 16 bp, Homo sapiens
acttctcaaagagaat

SEQ ID NO: 3605352 - DNA, 17 bp, Homo sapiens
acttctcttgaaaagtt

SEQ ID NO: 3605353 - DNA, 14 bp, Homo sapiens
acttctctttctta

SEQ ID NO: 3605354 - DNA, 23 bp, Homo sapiens
acttctctttcttattttgtaat

SEQ ID NO: 3605355 - DNA, 18 bp, Homo sapiens
acttcttagggattaaat

SEQ ID NO: 3605356 - DNA, 17 bp, Homo sapiens
acttcttatacatttga

SEQ ID NO: 3605357 - DNA, 13 bp, Homo sapiens
acttcttgaaggt

SEQ ID NO: 3605358 - DNA, 20 bp, Homo sapiens
acttcttgcttctttctaga

SEQ ID NO: 3605359 - DNA, 20 bp, Homo sapiens
acttcttttgctcttagctg

SEQ ID NO: 3605360 - DNA, 16 bp, Homo sapiens
acttgaaagttttcca

SEQ ID NO: 3605361 - DNA, 21 bp, Homo sapiens
acttgaaagttttccagtatt

SEQ ID NO: 3605362 - DNA, 23 bp, Homo sapiens
acttgaagaaacagagtggcctc

SEQ ID NO: 3605363 - DNA, 19 bp, Homo sapiens
acttgaagggccagagcca

SEQ ID NO: 3605364 - DNA, 20 bp, Homo sapiens
acttgaagggccagagccag

SEQ ID NO: 3605365 - DNA, 20 bp, Homo sapiens
acttgagaaccagtctcctc

SEQ ID NO: 3605366 - DNA, 21 bp, Homo sapiens
acttgagaaccagtctcctca

SEQ ID NO: 3605367 - DNA, 22 bp, Homo sapiens
acttgagaaccagtctcctcac

SEQ ID NO: 3605368 - DNA, 20 bp, Homo sapiens
acttgagattcaagacaaga

SEQ ID NO: 3605369 - DNA, 23 bp, Homo sapiens
acttgatgtacataactcctgtc

SEQ ID NO: 3605370 - DNA, 23 bp, Homo sapiens
acttgcacactctcccattatat

SEQ ID NO: 3605371 - DNA, 14 bp, Homo sapiens
acttgcctatctga

SEQ ID NO: 3605372 - DNA, 11 bp, Homo sapiens
acttgctgcct

SEQ ID NO: 3605373 - DNA, 16 bp, Homo sapiens
acttggaggacctggc

SEQ ID NO: 3605374 - DNA, 21 bp, Homo sapiens
acttggcccccttcaggagcc

SEQ ID NO: 3605375 - DNA, 22 bp, Homo sapiens
acttggcccccttcaggagcct

SEQ ID NO: 3605376 - DNA, 23 bp, Homo sapiens
acttggcccccttcaggagcctg

SEQ ID NO: 3605377 - DNA, 23 bp, Homo sapiens
acttggggagttaagacctggca

SEQ ID NO: 3605378 - DNA, 22 bp, Homo sapiens
acttgtaatatttttatataca

SEQ ID NO: 3605379 - DNA, 19 bp, Homo sapiens
acttgtatattctatttta

SEQ ID NO: 3605380 - DNA, 14 bp, Homo sapiens
acttgtatatttta

SEQ ID NO: 3605381 - DNA, 14 bp, Homo sapiens
acttgtatgaaaga

SEQ ID NO: 3605382 - DNA, 15 bp, Homo sapiens
acttgtgattggctg

SEQ ID NO: 3605383 - DNA, 12 bp, Homo sapiens
acttgtggcctt

SEQ ID NO: 3605384 - DNA, 16 bp, Homo sapiens
acttgtgtctctgtgc

SEQ ID NO: 3605385 - DNA, 21 bp, Homo sapiens
acttgtgtctctgtgctttta

SEQ ID NO: 3605386 - DNA, 22 bp, Homo sapiens
acttgtgtctctgtgcttttaa

SEQ ID NO: 3605387 - DNA, 22 bp, Homo sapiens
acttgtttgaatatttgtttta

SEQ ID NO: 3605388 - DNA, 22 bp, Homo sapiens
actttaaaactgctcatttcat

SEQ ID NO: 3605389 - DNA, 13 bp, Homo sapiens
actttaaattata

SEQ ID NO: 3605390 - DNA, 14 bp, Homo sapiens
actttaaattatat

SEQ ID NO: 3605391 - DNA, 15 bp, Homo sapiens
actttaaattatatg

SEQ ID NO: 3605392 - DNA, 18 bp, Homo sapiens
actttataactaacatgt

SEQ ID NO: 3605393 - DNA, 23 bp, Homo sapiens
actttattaccttctttctaata

SEQ ID NO: 3605394 - DNA, 16 bp, Homo sapiens
actttatttatttcta

SEQ ID NO: 3605395 - DNA, 22 bp, Homo sapiens
actttcagcagtctaaattttc

SEQ ID NO: 3605396 - DNA, 22 bp, Homo sapiens
actttcatattttaaacagagg

SEQ ID NO: 3605397 - DNA, 15 bp, Homo sapiens
actttcatctacctt

SEQ ID NO: 3605398 - DNA, 12 bp, Homo sapiens
actttccagaat

SEQ ID NO: 3605399 - DNA, 15 bp, Homo sapiens
actttctatgtgaca

SEQ ID NO: 3605400 - DNA, 13 bp, Homo sapiens
actttctggcaaa

SEQ ID NO: 3605401 - DNA, 18 bp, Homo sapiens
actttcttctgaatattt

SEQ ID NO: 3605402 - DNA, 16 bp, Homo sapiens
actttgaagtgcagct

SEQ ID NO: 3605403 - DNA, 20 bp, Homo sapiens
actttgaagtgcagctcatg

SEQ ID NO: 3605404 - DNA, 22 bp, Homo sapiens
actttgaagtgcagctcatgtt

SEQ ID NO: 3605405 - DNA, 20 bp, Homo sapiens
actttgagcatttttaaggg

SEQ ID NO: 3605406 - DNA, 18 bp, Homo sapiens
actttgatactaccaggg

SEQ ID NO: 3605407 - DNA, 20 bp, Homo sapiens
actttgatactaccagggtc

SEQ ID NO: 3605408 - DNA, 22 bp, Homo sapiens
actttgccaaggctctcccctc

SEQ ID NO: 3605409 - DNA, 10 bp, Homo sapiens
actttgtgct

SEQ ID NO: 3605410 - DNA, 20 bp, Homo sapiens
actttgtgtattaaatggtt

SEQ ID NO: 3605411 - DNA, 11 bp, Homo sapiens
acttttccttt

SEQ ID NO: 3605412 - DNA, 22 bp, Homo sapiens
acttttgtgaattaggctgtaa

SEQ ID NO: 3605413 - DNA, 16 bp, Homo sapiens
actttttgaggcaaaa

SEQ ID NO: 3605414 - DNA, 19 bp, Homo sapiens
actttttgaggcaaaagaa

SEQ ID NO: 3605415 - DNA, 23 bp, Homo sapiens
agaaaaaaaaagcaaatcagaaa

SEQ ID NO: 3605416 - DNA, 15 bp, Homo sapiens
agaaaacatgcctct

SEQ ID NO: 3605417 - DNA, 23 bp, Homo sapiens
agaaaacattttttttttaaatc

SEQ ID NO: 3605418 - DNA, 21 bp, Homo sapiens
agaaaacccacggtttttctt

SEQ ID NO: 3605419 - DNA, 22 bp, Homo sapiens
agaaaacccacggtttttcttt

SEQ ID NO: 3605420 - DNA, 16 bp, Homo sapiens
agaaaagattcttctt

SEQ ID NO: 3605421 - DNA, 19 bp, Homo sapiens
agaaaagctgccatttccc

SEQ ID NO: 3605422 - DNA, 14 bp, Homo sapiens
agaaaagtgcctga

SEQ ID NO: 3605423 - DNA, 14 bp, Homo sapiens
agaaaatatttttg

SEQ ID NO: 3605424 - DNA, 19 bp, Homo sapiens
agaaaatgacttatttctg

SEQ ID NO: 3605425 - DNA, 20 bp, Homo sapiens
agaaaatgacttatttctgc

SEQ ID NO: 3605426 - DNA, 15 bp, Homo sapiens
agaaaattccctggg

SEQ ID NO: 3605427 - DNA, 18 bp, Homo sapiens
agaaaattccctggggtc

SEQ ID NO: 3605428 - DNA, 20 bp, Homo sapiens
agaaaatttttgtagtagcg

SEQ ID NO: 3605429 - DNA, 16 bp, Homo sapiens
agaaacaccagtgtta

SEQ ID NO: 3605430 - DNA, 16 bp, Homo sapiens
agaaacactgcaaatt

SEQ ID NO: 3605431 - DNA, 16 bp, Homo sapiens
agaaaccacagtcttc

SEQ ID NO: 3605432 - DNA, 19 bp, Homo sapiens
agaaaccacagtcttccca

SEQ ID NO: 3605433 - DNA, 12 bp, Homo sapiens
agaaacccagag

SEQ ID NO: 3605434 - DNA, 15 bp, Homo sapiens
agaaacccagagatg

SEQ ID NO: 3605435 - DNA, 19 bp, Homo sapiens
agaaacccagagatgcctg

SEQ ID NO: 3605436 - DNA, 19 bp, Homo sapiens
agaaacctgccaaggagca

SEQ ID NO: 3605437 - DNA, 15 bp, Homo sapiens
agaaaccttgctctc

SEQ ID NO: 3605438 - DNA, 23 bp, Homo sapiens
agaaaccttttatttttatttct

SEQ ID NO: 3605439 - DNA, 16 bp, Homo sapiens
agaaactgaggaattt

SEQ ID NO: 3605440 - DNA, 18 bp, Homo sapiens
agaaactgatgccaaggg

SEQ ID NO: 3605441 - DNA, 23 bp, Homo sapiens
agaaacttaaggttacctttgtt

SEQ ID NO: 3605442 - DNA, 23 bp, Homo sapiens
agaaagaaaccaagtgcgctttg

SEQ ID NO: 3605443 - DNA, 15 bp, Homo sapiens
agaaagaagtggaga

SEQ ID NO: 3605444 - DNA, 18 bp, Homo sapiens
agaaagagagaagccagc

SEQ ID NO: 3605445 - DNA, 15 bp, Homo sapiens
agaaagagctacctg

SEQ ID NO: 3605446 - DNA, 14 bp, Homo sapiens
agaaagagctgcct

SEQ ID NO: 3605447 - DNA, 19 bp, Homo sapiens
agaaagcatccctcaccca

SEQ ID NO: 3605448 - DNA, 20 bp, Homo sapiens
agaaagcctgggtgacattt

SEQ ID NO: 3605449 - DNA, 21 bp, Homo sapiens
agaaagcctgggtgacatttg

SEQ ID NO: 3605450 - DNA, 19 bp, Homo sapiens
agaaagctggcaacatgaa

SEQ ID NO: 3605451 - DNA, 17 bp, Homo sapiens
agaaaggggctcttctg

SEQ ID NO: 3605452 - DNA, 14 bp, Homo sapiens
agaaagtaatttaa

SEQ ID NO: 3605453 - DNA, 18 bp, Homo sapiens
agaaagtaatttaatttg

SEQ ID NO: 3605454 - DNA, 19 bp, Homo sapiens
agaaagtgggaggtcagga

SEQ ID NO: 3605455 - DNA, 22 bp, Homo sapiens
agaaagtgggaggtcaggaaac

SEQ ID NO: 3605456 - DNA, 13 bp, Homo sapiens
agaaagtgtattt

SEQ ID NO: 3605457 - DNA, 13 bp, Homo sapiens
agaaataaaccaa

SEQ ID NO: 3605458 - DNA, 14 bp, Homo sapiens
agaaataaaccaaa

SEQ ID NO: 3605459 - DNA, 23 bp, Homo sapiens
agaaataaaccaaaggaaaatgt

SEQ ID NO: 3605460 - DNA, 16 bp, Homo sapiens
agaaataaatcacaga

SEQ ID NO: 3605461 - DNA, 12 bp, Homo sapiens
agaaataaatga

SEQ ID NO: 3605462 - DNA, 14 bp, Homo sapiens
agaaataaatgaaa

SEQ ID NO: 3605463 - DNA, 12 bp, Homo sapiens
agaaatacaaaa

SEQ ID NO: 3605464 - DNA, 18 bp, Homo sapiens
agaaatgaactttcagca

SEQ ID NO: 3605465 - DNA, 16 bp, Homo sapiens
agaaatgccccagtgt

SEQ ID NO: 3605466 - DNA, 19 bp, Homo sapiens
agaaatggctatgaacaga

SEQ ID NO: 3605467 - DNA, 19 bp, Homo sapiens
agaaattaacaataaagaa

SEQ ID NO: 3605468 - DNA, 20 bp, Homo sapiens
agaaattgcatttcctgaca

SEQ ID NO: 3605469 - DNA, 12 bp, Homo sapiens
agaacaaaactt

SEQ ID NO: 3605470 - DNA, 18 bp, Homo sapiens
agaacaaacaaaacttaa

SEQ ID NO: 3605471 - DNA, 17 bp, Homo sapiens
agaacaatattgacttt

SEQ ID NO: 3605472 - DNA, 21 bp, Homo sapiens
agaacaatattgactttgtct

SEQ ID NO: 3605473 - DNA, 18 bp, Homo sapiens
agaacagatgctgagcca

SEQ ID NO: 3605474 - DNA, 22 bp, Homo sapiens
agaacagtgggcgttgggagcc

SEQ ID NO: 3605475 - DNA, 20 bp, Homo sapiens
agaacagtggttgcctgggg

SEQ ID NO: 3605476 - DNA, 18 bp, Homo sapiens
agaacatcccgcttctga

SEQ ID NO: 3605477 - DNA, 16 bp, Homo sapiens
agaacattcagctctg

SEQ ID NO: 3605478 - DNA, 19 bp, Homo sapiens
agaacattcagctctggag

SEQ ID NO: 3605479 - DNA, 22 bp, Homo sapiens
agaacattcagctctggagaac

SEQ ID NO: 3605480 - DNA, 18 bp, Homo sapiens
agaaccactccttcatgt

SEQ ID NO: 3605481 - DNA, 20 bp, Homo sapiens
agaaccagtccccccaccct

SEQ ID NO: 3605482 - DNA, 15 bp, Homo sapiens
agaaccatgcaggaa

SEQ ID NO: 3605483 - DNA, 22 bp, Homo sapiens
agaacccacataaaagccccag

SEQ ID NO: 3605484 - DNA, 22 bp, Homo sapiens
agaacctacagactccatctct

SEQ ID NO: 3605485 - DNA, 21 bp, Homo sapiens
agaacctcagattcttcattg

SEQ ID NO: 3605486 - DNA, 17 bp, Homo sapiens
agaacctctaagtgctg

SEQ ID NO: 3605487 - DNA, 19 bp, Homo sapiens
agaacctctaagtgctgct

SEQ ID NO: 3605488 - DNA, 21 bp, Homo sapiens
agaacctggaacttggggagt

SEQ ID NO: 3605489 - DNA, 22 bp, Homo sapiens
agaacctgtcttattaagactg

SEQ ID NO: 3605490 - DNA, 13 bp, Homo sapiens
agaaccttctttg

SEQ ID NO: 3605491 - DNA, 17 bp, Homo sapiens
agaacgtggctctgctg

SEQ ID NO: 3605492 - DNA, 17 bp, Homo sapiens
agaactaaaatgttcta

SEQ ID NO: 3605493 - DNA, 15 bp, Homo sapiens
agaactagcatatag

SEQ ID NO: 3605494 - DNA, 21 bp, Homo sapiens
agaactattgtgctcagagac

SEQ ID NO: 3605495 - DNA, 19 bp, Homo sapiens
agaactcaaatggggccag

SEQ ID NO: 3605496 - DNA, 21 bp, Homo sapiens
agaactcctgtcttctttctc

SEQ ID NO: 3605497 - DNA, 19 bp, Homo sapiens
agaactcggtgtccccacc

SEQ ID NO: 3605498 - DNA, 14 bp, Homo sapiens
agaactcttcctcc

SEQ ID NO: 3605499 - DNA, 20 bp, Homo sapiens
agaactcttcctcctcccaa

SEQ ID NO: 3605500 - DNA, 21 bp, Homo sapiens
agaactcttcctcctcccaag

SEQ ID NO: 3605501 - DNA, 12 bp, Homo sapiens
agaactgccctt

SEQ ID NO: 3605502 - DNA, 21 bp, Homo sapiens
agaactggattttcagacctg

SEQ ID NO: 3605503 - DNA, 20 bp, Homo sapiens
agaacttgctgctgccttca

SEQ ID NO: 3605504 - DNA, 14 bp, Homo sapiens
agaactttttcctc

SEQ ID NO: 3605505 - DNA, 18 bp, Homo sapiens
agaagaaaagattcttct

SEQ ID NO: 3605506 - DNA, 12 bp, Homo sapiens
agaagaaaggac

SEQ ID NO: 3605507 - DNA, 14 bp, Homo sapiens
agaagaagtgtgtc

SEQ ID NO: 3605508 - DNA, 19 bp, Homo sapiens
agaagaatcttcctggcac

SEQ ID NO: 3605509 - DNA, 13 bp, Homo sapiens
agaagagaagtga

SEQ ID NO: 3605510 - DNA, 19 bp, Homo sapiens
agaagaggagaaaaagaag

SEQ ID NO: 3605511 - DNA, 20 bp, Homo sapiens
agaagagggcccagcccaga

SEQ ID NO: 3605512 - DNA, 13 bp, Homo sapiens
agaagatagcagg

SEQ ID NO: 3605513 - DNA, 14 bp, Homo sapiens
agaagatgaaattt

SEQ ID NO: 3605514 - DNA, 17 bp, Homo sapiens
agaagatgaaatttgat

SEQ ID NO: 3605515 - DNA, 20 bp, Homo sapiens
agaagatgccagcttctctc

SEQ ID NO: 3605516 - DNA, 21 bp, Homo sapiens
agaagatgcttagctgtagtt

SEQ ID NO: 3605517 - DNA, 13 bp, Homo sapiens
agaagattctatg

SEQ ID NO: 3605518 - DNA, 16 bp, Homo sapiens
agaagattctatgtta

SEQ ID NO: 3605519 - DNA, 11 bp, Homo sapiens
agaagccagcc

SEQ ID NO: 3605520 - DNA, 12 bp, Homo sapiens
agaagccagcca

SEQ ID NO: 3605521 - DNA, 19 bp, Homo sapiens
agaagccagccacagaccc

SEQ ID NO: 3605522 - DNA, 12 bp, Homo sapiens
agaagccaggaa

SEQ ID NO: 3605523 - DNA, 22 bp, Homo sapiens
agaagccaggaatttcccagga

SEQ ID NO: 3605524 - DNA, 14 bp, Homo sapiens
agaagctcctctcc

SEQ ID NO: 3605525 - DNA, 18 bp, Homo sapiens
agaagctcctctccccag

SEQ ID NO: 3605526 - DNA, 20 bp, Homo sapiens
agaagctcctctccccagcc

SEQ ID NO: 3605527 - DNA, 13 bp, Homo sapiens
agaaggaaagaag

SEQ ID NO: 3605528 - DNA, 14 bp, Homo sapiens
agaaggacttgttt

SEQ ID NO: 3605529 - DNA, 13 bp, Homo sapiens
agaaggcaaggct

SEQ ID NO: 3605530 - DNA, 16 bp, Homo sapiens
agaaggccagagaggg

SEQ ID NO: 3605531 - DNA, 17 bp, Homo sapiens
agaaggccccagagaga

SEQ ID NO: 3605532 - DNA, 20 bp, Homo sapiens
agaagggggccctgctacct

SEQ ID NO: 3605533 - DNA, 16 bp, Homo sapiens
agaaggttgctctaga

SEQ ID NO: 3605534 - DNA, 20 bp, Homo sapiens
agaaggttgctctagattga

SEQ ID NO: 3605535 - DNA, 19 bp, Homo sapiens
agaagtaggggtggcccga

SEQ ID NO: 3605536 - DNA, 16 bp, Homo sapiens
agaagtcatcttgcta

SEQ ID NO: 3605537 - DNA, 14 bp, Homo sapiens
agaagtcccttcaa

SEQ ID NO: 3605538 - DNA, 16 bp, Homo sapiens
agaagtcttctattta

SEQ ID NO: 3605539 - DNA, 17 bp, Homo sapiens
agaagtcttctatttat

SEQ ID NO: 3605540 - DNA, 21 bp, Homo sapiens
agaagtcttctatttatttat

SEQ ID NO: 3605541 - DNA, 21 bp, Homo sapiens
agaagtgctcttggctgaccc

SEQ ID NO: 3605542 - DNA, 23 bp, Homo sapiens
agaagttttaacttccagtggct

SEQ ID NO: 3605543 - DNA, 20 bp, Homo sapiens
agaataaaaacttttgagga

SEQ ID NO: 3605544 - DNA, 13 bp, Homo sapiens
agaataaacattt

SEQ ID NO: 3605545 - DNA, 14 bp, Homo sapiens
agaataaacatttg

SEQ ID NO: 3605546 - DNA, 16 bp, Homo sapiens
agaataaacatttgtt

SEQ ID NO: 3605547 - DNA, 13 bp, Homo sapiens
agaataaaggcag

SEQ ID NO: 3605548 - DNA, 18 bp, Homo sapiens
agaatagatcagtatttc

SEQ ID NO: 3605549 - DNA, 20 bp, Homo sapiens
agaatatgcatcttaaaatg

SEQ ID NO: 3605550 - DNA, 18 bp, Homo sapiens
agaatctatatttaacaa

SEQ ID NO: 3605551 - DNA, 20 bp, Homo sapiens
agaatcttttcaatgggttt

SEQ ID NO: 3605552 - DNA, 16 bp, Homo sapiens
agaatgcattcaaaat

SEQ ID NO: 3605553 - DNA, 19 bp, Homo sapiens
agaatggcatggcaggagt

SEQ ID NO: 3605554 - DNA, 14 bp, Homo sapiens
agaatggcctggag

SEQ ID NO: 3605555 - DNA, 19 bp, Homo sapiens
agaatggcctggagcaggc

SEQ ID NO: 3605556 - DNA, 20 bp, Homo sapiens
agaatggcctggagcaggcc

SEQ ID NO: 3605557 - DNA, 13 bp, Homo sapiens
agaatgtcagtat

SEQ ID NO: 3605558 - DNA, 16 bp, Homo sapiens
agaatgtcagtatgtg

SEQ ID NO: 3605559 - DNA, 21 bp, Homo sapiens
agaatgtgtgtgtgtggcagg

SEQ ID NO: 3605560 - DNA, 17 bp, Homo sapiens
agaatgttagtaaagga

SEQ ID NO: 3605561 - DNA, 20 bp, Homo sapiens
agaatgttgaaaagtaattg

SEQ ID NO: 3605562 - DNA, 14 bp, Homo sapiens
agaattatctcaag

SEQ ID NO: 3605563 - DNA, 15 bp, Homo sapiens
agaattatctcaagt

SEQ ID NO: 3605564 - DNA, 18 bp, Homo sapiens
agaattatctcaagtaaa

SEQ ID NO: 3605565 - DNA, 17 bp, Homo sapiens
agaattgaattggaaag

SEQ ID NO: 3605566 - DNA, 23 bp, Homo sapiens
agaattgaattggaaagacttct

SEQ ID NO: 3605567 - DNA, 20 bp, Homo sapiens
agaatttctaccatttcaga

SEQ ID NO: 3605568 - DNA, 21 bp, Homo sapiens
agaatttctaccatttcagag

SEQ ID NO: 3605569 - DNA, 15 bp, Homo sapiens
agacaaaagagcagt

SEQ ID NO: 3605570 - DNA, 14 bp, Homo sapiens
agacaaaatgaaag

SEQ ID NO: 3605571 - DNA, 22 bp, Homo sapiens
agacaaatattcctttgcatat

SEQ ID NO: 3605572 - DNA, 14 bp, Homo sapiens
agacaagagctgtt

SEQ ID NO: 3605573 - DNA, 15 bp, Homo sapiens
agacaagagctgtta

SEQ ID NO: 3605574 - DNA, 23 bp, Homo sapiens
agacaagagctgttatgctgttt

SEQ ID NO: 3605575 - DNA, 13 bp, Homo sapiens
agacaagcagccc

SEQ ID NO: 3605576 - DNA, 14 bp, Homo sapiens
agacaagcagccct

SEQ ID NO: 3605577 - DNA, 18 bp, Homo sapiens
agacaagcagcccttgct

SEQ ID NO: 3605578 - DNA, 13 bp, Homo sapiens
agacaaggtgcta

SEQ ID NO: 3605579 - DNA, 23 bp, Homo sapiens
agacaagtgatgctaaaacctga

SEQ ID NO: 3605580 - DNA, 14 bp, Homo sapiens
agacacacatacat

SEQ ID NO: 3605581 - DNA, 22 bp, Homo sapiens
agacacagctcttccagggcag

SEQ ID NO: 3605582 - DNA, 19 bp, Homo sapiens
agacaccaagctcaccctt

SEQ ID NO: 3605583 - DNA, 12 bp, Homo sapiens
agacacccagga

SEQ ID NO: 3605584 - DNA, 17 bp, Homo sapiens
agacaccctctgggggt

SEQ ID NO: 3605585 - DNA, 20 bp, Homo sapiens
agacactgccacacagggtc

SEQ ID NO: 3605586 - DNA, 13 bp, Homo sapiens
agacagaaaagtg

SEQ ID NO: 3605587 - DNA, 16 bp, Homo sapiens
agacagaccacttgcc

SEQ ID NO: 3605588 - DNA, 17 bp, Homo sapiens
agacagaccacttgcca

SEQ ID NO: 3605589 - DNA, 14 bp, Homo sapiens
agacagactagaag

SEQ ID NO: 3605590 - DNA, 18 bp, Homo sapiens
agacagaggcagagattg

SEQ ID NO: 3605591 - DNA, 11 bp, Homo sapiens
agacagagtct

SEQ ID NO: 3605592 - DNA, 14 bp, Homo sapiens
agacagatcactcc

SEQ ID NO: 3605593 - DNA, 16 bp, Homo sapiens
agacagatcactcctg

SEQ ID NO: 3605594 - DNA, 17 bp, Homo sapiens
agacagatcactcctgg

SEQ ID NO: 3605595 - DNA, 14 bp, Homo sapiens
agacagctggcgga

SEQ ID NO: 3605596 - DNA, 16 bp, Homo sapiens
agacagctggcggagg

SEQ ID NO: 3605597 - DNA, 17 bp, Homo sapiens
agacagctggcggaggc

SEQ ID NO: 3605598 - DNA, 22 bp, Homo sapiens
agacagctggcggaggctgctc

SEQ ID NO: 3605599 - DNA, 21 bp, Homo sapiens
agacagcttacaggagccagc

SEQ ID NO: 3605600 - DNA, 12 bp, Homo sapiens
agacagcttctc

SEQ ID NO: 3605601 - DNA, 18 bp, Homo sapiens
agacagcttctctgcagt

SEQ ID NO: 3605602 - DNA, 22 bp, Homo sapiens
agacagcttctctgcagtaaaa

SEQ ID NO: 3605603 - DNA, 15 bp, Homo sapiens
agacaggagcctagc

SEQ ID NO: 3605604 - DNA, 19 bp, Homo sapiens
agacaggcagggagggctt

SEQ ID NO: 3605605 - DNA, 14 bp, Homo sapiens
agacaggccctccc

SEQ ID NO: 3605606 - DNA, 19 bp, Homo sapiens
agacaggccctccctgtct

SEQ ID NO: 3605607 - DNA, 19 bp, Homo sapiens
agacagggtttcaccatgt

SEQ ID NO: 3605608 - DNA, 23 bp, Homo sapiens
agacaggtgcctaacctgggacc

SEQ ID NO: 3605609 - DNA, 16 bp, Homo sapiens
agacataaaacagaat

SEQ ID NO: 3605610 - DNA, 14 bp, Homo sapiens
agacataaacaaag

SEQ ID NO: 3605611 - DNA, 17 bp, Homo sapiens
agacataaacaaagaca

SEQ ID NO: 3605612 - DNA, 18 bp, Homo sapiens
agacataaacaaagacat

SEQ ID NO: 3605613 - DNA, 17 bp, Homo sapiens
agacatacttgaagggc

SEQ ID NO: 3605614 - DNA, 19 bp, Homo sapiens
agacatacttgaagggcca

SEQ ID NO: 3605615 - DNA, 23 bp, Homo sapiens
agacatgccacaaggacttcctg

SEQ ID NO: 3605616 - DNA, 17 bp, Homo sapiens
agacatggaggggatga

SEQ ID NO: 3605617 - DNA, 12 bp, Homo sapiens
agacattagaga

SEQ ID NO: 3605618 - DNA, 15 bp, Homo sapiens
agacattagagaaaa

SEQ ID NO: 3605619 - DNA, 19 bp, Homo sapiens
agacattagagaaaacctt

SEQ ID NO: 3605620 - DNA, 21 bp, Homo sapiens
agacattagagaaaaccttaa

SEQ ID NO: 3605621 - DNA, 16 bp, Homo sapiens
agacattgacagcaat

SEQ ID NO: 3605622 - DNA, 19 bp, Homo sapiens
agacattttaaaaaatggt

SEQ ID NO: 3605623 - DNA, 20 bp, Homo sapiens
agacattttaaaaaatggtc

SEQ ID NO: 3605624 - DNA, 22 bp, Homo sapiens
agacattttaaaaaatggtcac

SEQ ID NO: 3605625 - DNA, 23 bp, Homo sapiens
agacattttccgcccactcctgg

SEQ ID NO: 3605626 - DNA, 15 bp, Homo sapiens
agaccaaagcaaaga

SEQ ID NO: 3605627 - DNA, 16 bp, Homo sapiens
agaccaattgaagcat

SEQ ID NO: 3605628 - DNA, 13 bp, Homo sapiens
agaccataagaga

SEQ ID NO: 3605629 - DNA, 14 bp, Homo sapiens
agaccataagagaa

SEQ ID NO: 3605630 - DNA, 21 bp, Homo sapiens
agaccataagagaaacctgcc

SEQ ID NO: 3605631 - DNA, 13 bp, Homo sapiens
agacccaaaacag

SEQ ID NO: 3605632 - DNA, 15 bp, Homo sapiens
agacccaaaacagct

SEQ ID NO: 3605633 - DNA, 17 bp, Homo sapiens
agacccaaaacagcttt

SEQ ID NO: 3605634 - DNA, 17 bp, Homo sapiens
agaccccacgctgacca

SEQ ID NO: 3605635 - DNA, 15 bp, Homo sapiens
agacccccaggcaga

SEQ ID NO: 3605636 - DNA, 17 bp, Homo sapiens
agaccccgcacccggct

SEQ ID NO: 3605637 - DNA, 18 bp, Homo sapiens
agaccccgcacccggctc

SEQ ID NO: 3605638 - DNA, 13 bp, Homo sapiens
agacccctgggag

SEQ ID NO: 3605639 - DNA, 24 bp, Homo sapiens
agaccctgtgtcctccaccatgca

SEQ ID NO: 3605640 - DNA, 14 bp, Homo sapiens
agaccctttcagaa

SEQ ID NO: 3605641 - DNA, 19 bp, Homo sapiens
agaccgtacaaactcagat

SEQ ID NO: 3605642 - DNA, 16 bp, Homo sapiens
agacctcatcagcctt

SEQ ID NO: 3605643 - DNA, 20 bp, Homo sapiens
agacctcatctgtggagctg

SEQ ID NO: 3605644 - DNA, 19 bp, Homo sapiens
agacctgacacctttcata

SEQ ID NO: 3605645 - DNA, 15 bp, Homo sapiens
agacctgatcctgga

SEQ ID NO: 3605646 - DNA, 19 bp, Homo sapiens
agacctgatcctggaggcc

SEQ ID NO: 3605647 - DNA, 22 bp, Homo sapiens
agacctgatcctggaggcccag

SEQ ID NO: 3605648 - DNA, 12 bp, Homo sapiens
agacctggagct

SEQ ID NO: 3605649 - DNA, 15 bp, Homo sapiens
agacctggagcttca

SEQ ID NO: 3605650 - DNA, 11 bp, Homo sapiens
agacctggcag

SEQ ID NO: 3605651 - DNA, 17 bp, Homo sapiens
agacctggcagctctgg

SEQ ID NO: 3605652 - DNA, 16 bp, Homo sapiens
agacgatttggggggg

SEQ ID NO: 3605653 - DNA, 20 bp, Homo sapiens
agacgcggcggggactcgga

SEQ ID NO: 3605654 - DNA, 16 bp, Homo sapiens
agacggtctgtgtgct

SEQ ID NO: 3605655 - DNA, 19 bp, Homo sapiens
agacgtgatgggctaggcc

SEQ ID NO: 3605656 - DNA, 21 bp, Homo sapiens
agacgtgatgggctaggcctc

SEQ ID NO: 3605657 - DNA, 14 bp, Homo sapiens
agactaaaaataca

SEQ ID NO: 3605658 - DNA, 16 bp, Homo sapiens
agactactggccccgc

SEQ ID NO: 3605659 - DNA, 12 bp, Homo sapiens
agactagatgta

SEQ ID NO: 3605660 - DNA, 12 bp, Homo sapiens
agactattcaaa

SEQ ID NO: 3605661 - DNA, 18 bp, Homo sapiens
agactattcaaacagtct

SEQ ID NO: 3605662 - DNA, 21 bp, Homo sapiens
agactcaagagaatttatgtg

SEQ ID NO: 3605663 - DNA, 12 bp, Homo sapiens
agactcagcaga

SEQ ID NO: 3605664 - DNA, 12 bp, Homo sapiens
agactccaaaga

SEQ ID NO: 3605665 - DNA, 14 bp, Homo sapiens
agactccaaagaaa

SEQ ID NO: 3605666 - DNA, 16 bp, Homo sapiens
agactccaaagaaatg

SEQ ID NO: 3605667 - DNA, 22 bp, Homo sapiens
agactccaaagaaatgtaaggg

SEQ ID NO: 3605668 - DNA, 13 bp, Homo sapiens
agactccatctct

SEQ ID NO: 3605669 - DNA, 16 bp, Homo sapiens
agactccatctcttct

SEQ ID NO: 3605670 - DNA, 19 bp, Homo sapiens
agactcccattcctgaaga

SEQ ID NO: 3605671 - DNA, 24 bp, Homo sapiens
agactcgagaaccaaccagggaag

SEQ ID NO: 3605672 - DNA, 12 bp, Homo sapiens
agactctggagg

SEQ ID NO: 3605673 - DNA, 22 bp, Homo sapiens
agactctttaataaattgctta

SEQ ID NO: 3605674 - DNA, 13 bp, Homo sapiens
agactgagcagcc

SEQ ID NO: 3605675 - DNA, 21 bp, Homo sapiens
agactggcacagttttctgag

SEQ ID NO: 3605676 - DNA, 15 bp, Homo sapiens
agactggcccagtgc

SEQ ID NO: 3605677 - DNA, 14 bp, Homo sapiens
agactgtctcaaga

SEQ ID NO: 3605678 - DNA, 22 bp, Homo sapiens
agactgtgaacttgactgggtg

SEQ ID NO: 3605679 - DNA, 16 bp, Homo sapiens
agactgtgccagaggc

SEQ ID NO: 3605680 - DNA, 19 bp, Homo sapiens
agactgtgccagaggccag

SEQ ID NO: 3605681 - DNA, 15 bp, Homo sapiens
agacttagaacctga

SEQ ID NO: 3605682 - DNA, 14 bp, Homo sapiens
agacttatcaacat

SEQ ID NO: 3605683 - DNA, 20 bp, Homo sapiens
agacttctcaaagagaattg

SEQ ID NO: 3605684 - DNA, 15 bp, Homo sapiens
agacttctctttctt

SEQ ID NO: 3605685 - DNA, 14 bp, Homo sapiens
agacttgaaagttt

SEQ ID NO: 3605686 - DNA, 20 bp, Homo sapiens
agacttgaaagttttccagt

SEQ ID NO: 3605687 - DNA, 21 bp, Homo sapiens
agacttgtatattctatttta

SEQ ID NO: 3605688 - DNA, 20 bp, Homo sapiens
agactttggacagtggcctc

SEQ ID NO: 3605689 - DNA, 14 bp, Homo sapiens
agagaaaaccttaa

SEQ ID NO: 3605690 - DNA, 13 bp, Homo sapiens
agagaaaattcag

SEQ ID NO: 3605691 - DNA, 13 bp, Homo sapiens
agagaaagagaga

SEQ ID NO: 3605692 - DNA, 18 bp, Homo sapiens
agagaaaggggagcccac

SEQ ID NO: 3605693 - DNA, 14 bp, Homo sapiens
agagaaatgcccca

SEQ ID NO: 3605694 - DNA, 14 bp, Homo sapiens
agagaacctcagat

SEQ ID NO: 3605695 - DNA, 16 bp, Homo sapiens
agagaagagggcccag

SEQ ID NO: 3605696 - DNA, 20 bp, Homo sapiens
agagaagagggcccagccca

SEQ ID NO: 3605697 - DNA, 18 bp, Homo sapiens
agagaagatgcctgttaa

SEQ ID NO: 3605698 - DNA, 12 bp, Homo sapiens
agagaagccagc

SEQ ID NO: 3605699 - DNA, 19 bp, Homo sapiens
agagaagccagccacagac

SEQ ID NO: 3605700 - DNA, 18 bp, Homo sapiens
agagaaggagcagaaaga

SEQ ID NO: 3605701 - DNA, 23 bp, Homo sapiens
agagaagtttgtagccaggtact

SEQ ID NO: 3605702 - DNA, 14 bp, Homo sapiens
agagaattatctca

SEQ ID NO: 3605703 - DNA, 16 bp, Homo sapiens
agagaattatctcaag

SEQ ID NO: 3605704 - DNA, 18 bp, Homo sapiens
agagaattatctcaagta

SEQ ID NO: 3605705 - DNA, 17 bp, Homo sapiens
agagaattgtatgtaac

SEQ ID NO: 3605706 - DNA, 14 bp, Homo sapiens
agagacaaatcttt

SEQ ID NO: 3605707 - DNA, 19 bp, Homo sapiens
agagacacatacagagtgg

SEQ ID NO: 3605708 - DNA, 22 bp, Homo sapiens
agagacactgttgataaaaact

SEQ ID NO: 3605709 - DNA, 18 bp, Homo sapiens
agagaccataagagaaac

SEQ ID NO: 3605710 - DNA, 19 bp, Homo sapiens
agagaccataagagaaacc

SEQ ID NO: 3605711 - DNA, 15 bp, Homo sapiens
agagaccccgcaccc

SEQ ID NO: 3605712 - DNA, 13 bp, Homo sapiens
agagacctcatca

SEQ ID NO: 3605713 - DNA, 17 bp, Homo sapiens
agagactgagcagccgc

SEQ ID NO: 3605714 - DNA, 17 bp, Homo sapiens
agagagaccccgcaccc

SEQ ID NO: 3605715 - DNA, 19 bp, Homo sapiens
agagagaccccgcacccgg

SEQ ID NO: 3605716 - DNA, 14 bp, Homo sapiens
agagagcagggcta

SEQ ID NO: 3605717 - DNA, 16 bp, Homo sapiens
agagagccaggatgcc

SEQ ID NO: 3605718 - DNA, 14 bp, Homo sapiens
agagaggccttttg

SEQ ID NO: 3605719 - DNA, 18 bp, Homo sapiens
agagagtggagagagcag

SEQ ID NO: 3605720 - DNA, 16 bp, Homo sapiens
agagagtggctcctcc

SEQ ID NO: 3605721 - DNA, 15 bp, Homo sapiens
agagataaaaatcat

SEQ ID NO: 3605722 - DNA, 13 bp, Homo sapiens
agagataattgct

SEQ ID NO: 3605723 - DNA, 18 bp, Homo sapiens
agagataggaaactgaag

SEQ ID NO: 3605724 - DNA, 18 bp, Homo sapiens
agagatattgatattgaa

SEQ ID NO: 3605725 - DNA, 19 bp, Homo sapiens
agagatccctgcagaaccc

SEQ ID NO: 3605726 - DNA, 20 bp, Homo sapiens
agagatccctgcagaaccca

SEQ ID NO: 3605727 - DNA, 16 bp, Homo sapiens
agagatcgagaccatc

SEQ ID NO: 3605728 - DNA, 12 bp, Homo sapiens
agagatctgtgt

SEQ ID NO: 3605729 - DNA, 22 bp, Homo sapiens
agagatctgtgtggctcctggg

SEQ ID NO: 3605730 - DNA, 18 bp, Homo sapiens
agagcaaagggaaatcaa

SEQ ID NO: 3605731 - DNA, 21 bp, Homo sapiens
agagcagggctaaataaagag

SEQ ID NO: 3605732 - DNA, 17 bp, Homo sapiens
agagcagtggtaagaat

SEQ ID NO: 3605733 - DNA, 19 bp, Homo sapiens
agagcagtggtaagaatag

SEQ ID NO: 3605734 - DNA, 14 bp, Homo sapiens
agagcataatttaa

SEQ ID NO: 3605735 - DNA, 18 bp, Homo sapiens
agagcataatttaaaaat

SEQ ID NO: 3605736 - DNA, 21 bp, Homo sapiens
agagcatatttgccaataaag

SEQ ID NO: 3605737 - DNA, 23 bp, Homo sapiens
agagcatcctgataccattctat

SEQ ID NO: 3605738 - DNA, 13 bp, Homo sapiens
agagccatacata

SEQ ID NO: 3605739 - DNA, 21 bp, Homo sapiens
agagccatacataaaagaaat

SEQ ID NO: 3605740 - DNA, 22 bp, Homo sapiens
agagcccagagtccccccactc

SEQ ID NO: 3605741 - DNA, 14 bp, Homo sapiens
agagcccagctcca

SEQ ID NO: 3605742 - DNA, 22 bp, Homo sapiens
agagcccccagccctgggaacc

SEQ ID NO: 3605743 - DNA, 13 bp, Homo sapiens
agagcccctactg

SEQ ID NO: 3605744 - DNA, 23 bp, Homo sapiens
agagcccctactgtgggcaaagt

SEQ ID NO: 3605745 - DNA, 17 bp, Homo sapiens
agagcccgggagctgct

SEQ ID NO: 3605746 - DNA, 23 bp, Homo sapiens
agagccgggaggaaaaggcccct

SEQ ID NO: 3605747 - DNA, 22 bp, Homo sapiens
agagcctcctgggaacacatct

SEQ ID NO: 3605748 - DNA, 18 bp, Homo sapiens
agagcctgggggtggggg

SEQ ID NO: 3605749 - DNA, 21 bp, Homo sapiens
agagcgaggaaaggattttac

SEQ ID NO: 3605750 - DNA, 15 bp, Homo sapiens
agagcggctggagaa

SEQ ID NO: 3605751 - DNA, 16 bp, Homo sapiens
agagctaaaaaggccc

SEQ ID NO: 3605752 - DNA, 18 bp, Homo sapiens
agagctaaaaaggccctt

SEQ ID NO: 3605753 - DNA, 22 bp, Homo sapiens
agagctaaaaaggcccttagag

SEQ ID NO: 3605754 - DNA, 14 bp, Homo sapiens
agagctaggaaccc

SEQ ID NO: 3605755 - DNA, 14 bp, Homo sapiens
agagctccgatgcc

SEQ ID NO: 3605756 - DNA, 18 bp, Homo sapiens
agagctcttgtgttcaga

SEQ ID NO: 3605757 - DNA, 23 bp, Homo sapiens
agagctcttgtgttcagaagaat

SEQ ID NO: 3605758 - DNA, 18 bp, Homo sapiens
agagctgagaccttgctt

SEQ ID NO: 3605759 - DNA, 12 bp, Homo sapiens
agagctgcctgg

SEQ ID NO: 3605760 - DNA, 13 bp, Homo sapiens
agagctgcctgga

SEQ ID NO: 3605761 - DNA, 20 bp, Homo sapiens
agagctggtggtgcagcctt

SEQ ID NO: 3605762 - DNA, 23 bp, Homo sapiens
agagctggtggtgcagccttccc

SEQ ID NO: 3605763 - DNA, 14 bp, Homo sapiens
agagctgttatgct

SEQ ID NO: 3605764 - DNA, 22 bp, Homo sapiens
agagctgttatgctgtttccta

SEQ ID NO: 3605765 - DNA, 22 bp, Homo sapiens
agagctgtttggatacagctgc

SEQ ID NO: 3605766 - DNA, 23 bp, Homo sapiens
agagctgtttggatacagctgct

SEQ ID NO: 3605767 - DNA, 17 bp, Homo sapiens
agagcttgtaataaata

SEQ ID NO: 3605768 - DNA, 15 bp, Homo sapiens
agagctttctgcctt

SEQ ID NO: 3605769 - DNA, 21 bp, Homo sapiens
agaggaataaggcccagagcg

SEQ ID NO: 3605770 - DNA, 13 bp, Homo sapiens
agaggaatttata

SEQ ID NO: 3605771 - DNA, 16 bp, Homo sapiens
agaggacaagggaaat

SEQ ID NO: 3605772 - DNA, 14 bp, Homo sapiens
agaggaccaatgct

SEQ ID NO: 3605773 - DNA, 20 bp, Homo sapiens
agaggaccaatgcttgcatg

SEQ ID NO: 3605774 - DNA, 19 bp, Homo sapiens
agaggactcacttgcccac

SEQ ID NO: 3605775 - DNA, 21 bp, Homo sapiens
agaggactggttctgaggcca

SEQ ID NO: 3605776 - DNA, 22 bp, Homo sapiens
agaggagaaaaagaagaaaaga

SEQ ID NO: 3605777 - DNA, 18 bp, Homo sapiens
agaggagataaggtggct

SEQ ID NO: 3605778 - DNA, 19 bp, Homo sapiens
agaggagataaggtggctt

SEQ ID NO: 3605779 - DNA, 21 bp, Homo sapiens
agaggagataaggtggcttct

SEQ ID NO: 3605780 - DNA, 20 bp, Homo sapiens
agaggagcgcaggcagcgca

SEQ ID NO: 3605781 - DNA, 13 bp, Homo sapiens
agaggaggaaaag

SEQ ID NO: 3605782 - DNA, 20 bp, Homo sapiens
agaggaggaaaagtcttcct

SEQ ID NO: 3605783 - DNA, 21 bp, Homo sapiens
agaggaggaaaagtcttccta

SEQ ID NO: 3605784 - DNA, 12 bp, Homo sapiens
agaggaggggcc

SEQ ID NO: 3605785 - DNA, 22 bp, Homo sapiens
agaggaggggccgctgccaccc

SEQ ID NO: 3605786 - DNA, 16 bp, Homo sapiens
agaggagggggcaggc

SEQ ID NO: 3605787 - DNA, 20 bp, Homo sapiens
agaggagggggcaggctgag

SEQ ID NO: 3605788 - DNA, 15 bp, Homo sapiens
agaggcaacaggatt

SEQ ID NO: 3605789 - DNA, 12 bp, Homo sapiens
agaggcagcatg

SEQ ID NO: 3605790 - DNA, 16 bp, Homo sapiens
agaggcagggacctaa

SEQ ID NO: 3605791 - DNA, 23 bp, Homo sapiens
agaggccaggcaggagcccttct

SEQ ID NO: 3605792 - DNA, 12 bp, Homo sapiens
agaggccccagc

SEQ ID NO: 3605793 - DNA, 15 bp, Homo sapiens
agaggccccagcctc

SEQ ID NO: 3605794 - DNA, 21 bp, Homo sapiens
agaggccctctggagtggcca

SEQ ID NO: 3605795 - DNA, 12 bp, Homo sapiens
agaggccctgga

SEQ ID NO: 3605796 - DNA, 14 bp, Homo sapiens
agaggccctggagg

SEQ ID NO: 3605797 - DNA, 15 bp, Homo sapiens
agaggccctggaggt

SEQ ID NO: 3605798 - DNA, 12 bp, Homo sapiens
agaggccttccc

SEQ ID NO: 3605799 - DNA, 19 bp, Homo sapiens
agaggccttttggaatgtg

SEQ ID NO: 3605800 - DNA, 19 bp, Homo sapiens
agagggacctctcccaggg

SEQ ID NO: 3605801 - DNA, 17 bp, Homo sapiens
agagggaggcaagccct

SEQ ID NO: 3605802 - DNA, 15 bp, Homo sapiens
agagggcgagggatg

SEQ ID NO: 3605803 - DNA, 15 bp, Homo sapiens
agaggggaggtcact

SEQ ID NO: 3605804 - DNA, 21 bp, Homo sapiens
agaggggcgttctcccaaaga

SEQ ID NO: 3605805 - DNA, 19 bp, Homo sapiens
agagggggagtagccaagc

SEQ ID NO: 3605806 - DNA, 18 bp, Homo sapiens
agaggtactagaatgctt

SEQ ID NO: 3605807 - DNA, 16 bp, Homo sapiens
agaggtagcactctca

SEQ ID NO: 3605808 - DNA, 17 bp, Homo sapiens
agaggtagcactctcag

SEQ ID NO: 3605809 - DNA, 17 bp, Homo sapiens
agaggtctgattggctg

SEQ ID NO: 3605810 - DNA, 20 bp, Homo sapiens
agaggtctgattggctgctt

SEQ ID NO: 3605811 - DNA, 17 bp, Homo sapiens
agaggtgaaaatgaaga

SEQ ID NO: 3605812 - DNA, 19 bp, Homo sapiens
agaggtgaaaatgaagaag

SEQ ID NO: 3605813 - DNA, 20 bp, Homo sapiens
agaggtgtgagtaattgagg

SEQ ID NO: 3605814 - DNA, 14 bp, Homo sapiens
agagtcagatcttt

SEQ ID NO: 3605815 - DNA, 17 bp, Homo sapiens
agagtccaatttaagga

SEQ ID NO: 3605816 - DNA, 14 bp, Homo sapiens
agagtccccccact

SEQ ID NO: 3605817 - DNA, 14 bp, Homo sapiens
agagtcctctgaat

SEQ ID NO: 3605818 - DNA, 15 bp, Homo sapiens
agagtctccatttaa

SEQ ID NO: 3605819 - DNA, 20 bp, Homo sapiens
agagtgccaacttctttcat

SEQ ID NO: 3605820 - DNA, 15 bp, Homo sapiens
agagtggagagagca

SEQ ID NO: 3605821 - DNA, 16 bp, Homo sapiens
agagtggagagagcag

SEQ ID NO: 3605822 - DNA, 16 bp, Homo sapiens
agagtggcctccctgc

SEQ ID NO: 3605823 - DNA, 20 bp, Homo sapiens
agagtggcctccctgctgtg

SEQ ID NO: 3605824 - DNA, 12 bp, Homo sapiens
agagtggctcct

SEQ ID NO: 3605825 - DNA, 11 bp, Homo sapiens
agagtgtagct

SEQ ID NO: 3605826 - DNA, 21 bp, Homo sapiens
agagtgtagctgtaagggcag

SEQ ID NO: 3605827 - DNA, 20 bp, Homo sapiens
agagtgtgggggaggcgcac

SEQ ID NO: 3605828 - DNA, 19 bp, Homo sapiens
agagttaagaactatgacg

SEQ ID NO: 3605829 - DNA, 15 bp, Homo sapiens
agagttacagttctg

SEQ ID NO: 3605830 - DNA, 16 bp, Homo sapiens
agagttccggggagaa

SEQ ID NO: 3605831 - DNA, 15 bp, Homo sapiens
agagttctttgctgc

SEQ ID NO: 3605832 - DNA, 17 bp, Homo sapiens
agagtttaaacaaaaaa

SEQ ID NO: 3605833 - DNA, 21 bp, Homo sapiens
agagtttaaacaaaaaaccca

SEQ ID NO: 3605834 - DNA, 14 bp, Homo sapiens
agagtttctgtttg

SEQ ID NO: 3605835 - DNA, 18 bp, Homo sapiens
agagtttctgtttgattc

SEQ ID NO: 3605836 - DNA, 22 bp, Homo sapiens
agagtttctgtttgattctttt

SEQ ID NO: 3605837 - DNA, 14 bp, Homo sapiens
agataacactgact

SEQ ID NO: 3605838 - DNA, 13 bp, Homo sapiens
agataaggtggct

SEQ ID NO: 3605839 - DNA, 15 bp, Homo sapiens
agataaggtggcttc

SEQ ID NO: 3605840 - DNA, 17 bp, Homo sapiens
agataaggtggcttctc

SEQ ID NO: 3605841 - DNA, 22 bp, Homo sapiens
agataataatgggtttctttca

SEQ ID NO: 3605842 - DNA, 18 bp, Homo sapiens
agataatagggttttcag

SEQ ID NO: 3605843 - DNA, 16 bp, Homo sapiens
agataatctagaacac

SEQ ID NO: 3605844 - DNA, 13 bp, Homo sapiens
agatacaaaatgt

SEQ ID NO: 3605845 - DNA, 14 bp, Homo sapiens
agatactttgaagt

SEQ ID NO: 3605846 - DNA, 16 bp, Homo sapiens
agatagacctgacaat

SEQ ID NO: 3605847 - DNA, 14 bp, Homo sapiens
agatagatgacttt

SEQ ID NO: 3605848 - DNA, 20 bp, Homo sapiens
agatagctattaagatactt

SEQ ID NO: 3605849 - DNA, 14 bp, Homo sapiens
agataggaaactga

SEQ ID NO: 3605850 - DNA, 16 bp, Homo sapiens
agataggaaactgaag

SEQ ID NO: 3605851 - DNA, 12 bp, Homo sapiens
agatataagtaa

SEQ ID NO: 3605852 - DNA, 21 bp, Homo sapiens
agatatatttaagccttataa

SEQ ID NO: 3605853 - DNA, 23 bp, Homo sapiens
agatatggagtgagtcacctgct

SEQ ID NO: 3605854 - DNA, 13 bp, Homo sapiens
agatattaaattc

SEQ ID NO: 3605855 - DNA, 20 bp, Homo sapiens
agatattctctagtcatttg

SEQ ID NO: 3605856 - DNA, 23 bp, Homo sapiens
agatattctctagtcatttgtta

SEQ ID NO: 3605857 - DNA, 15 bp, Homo sapiens
agatcaccagaataa

SEQ ID NO: 3605858 - DNA, 12 bp, Homo sapiens
agatcactcctg

SEQ ID NO: 3605859 - DNA, 13 bp, Homo sapiens
agatcactcctgg

SEQ ID NO: 3605860 - DNA, 17 bp, Homo sapiens
agatcactcctggaggc

SEQ ID NO: 3605861 - DNA, 15 bp, Homo sapiens
agatcagaacatgaa

SEQ ID NO: 3605862 - DNA, 21 bp, Homo sapiens
agatcagaacattcagctctg

SEQ ID NO: 3605863 - DNA, 17 bp, Homo sapiens
agatcaggagtgacaga

SEQ ID NO: 3605864 - DNA, 18 bp, Homo sapiens
agatccaaaagaagcccc

SEQ ID NO: 3605865 - DNA, 21 bp, Homo sapiens
agatccaaaagaagcccccag

SEQ ID NO: 3605866 - DNA, 14 bp, Homo sapiens
agatccagcctggg

SEQ ID NO: 3605867 - DNA, 12 bp, Homo sapiens
agatccaggact

SEQ ID NO: 3605868 - DNA, 22 bp, Homo sapiens
agatccagggacagaggcccca

SEQ ID NO: 3605869 - DNA, 13 bp, Homo sapiens
agatcgagaccat

SEQ ID NO: 3605870 - DNA, 23 bp, Homo sapiens
agatctaacgtgttccagtgtct

SEQ ID NO: 3605871 - DNA, 22 bp, Homo sapiens
agatctattgtttgttgcacta

SEQ ID NO: 3605872 - DNA, 21 bp, Homo sapiens
agatctcccacatgccagggg

SEQ ID NO: 3605873 - DNA, 14 bp, Homo sapiens
agatctggaacctc

SEQ ID NO: 3605874 - DNA, 15 bp, Homo sapiens
agatctggaacctca

SEQ ID NO: 3605875 - DNA, 14 bp, Homo sapiens
agatgaaaaagaat

SEQ ID NO: 3605876 - DNA, 16 bp, Homo sapiens
agatgaaaaagaataa

SEQ ID NO: 3605877 - DNA, 19 bp, Homo sapiens
agatgaactgactgaagga

SEQ ID NO: 3605878 - DNA, 22 bp, Homo sapiens
agatgaactgactgaaggaaaa

SEQ ID NO: 3605879 - DNA, 22 bp, Homo sapiens
agatgaagtttgtagttgtttt

SEQ ID NO: 3605880 - DNA, 17 bp, Homo sapiens
agatgacaacctccatt

SEQ ID NO: 3605881 - DNA, 23 bp, Homo sapiens
agatgacagaggtttgaaggaga

SEQ ID NO: 3605882 - DNA, 13 bp, Homo sapiens
agatgacctgccc

SEQ ID NO: 3605883 - DNA, 15 bp, Homo sapiens
agatgactttgcaga

SEQ ID NO: 3605884 - DNA, 17 bp, Homo sapiens
agatgactttgcagatg

SEQ ID NO: 3605885 - DNA, 20 bp, Homo sapiens
agatgactttgcagatggaa

SEQ ID NO: 3605886 - DNA, 19 bp, Homo sapiens
agatgcacgtggggcccac

SEQ ID NO: 3605887 - DNA, 15 bp, Homo sapiens
agatgcagtcctcag

SEQ ID NO: 3605888 - DNA, 17 bp, Homo sapiens
agatgcagtcctcagga

SEQ ID NO: 3605889 - DNA, 17 bp, Homo sapiens
agatgcatatagacaca

SEQ ID NO: 3605890 - DNA, 20 bp, Homo sapiens
agatgcatatagacacacat

SEQ ID NO: 3605891 - DNA, 21 bp, Homo sapiens
agatgcatatagacacacata

SEQ ID NO: 3605892 - DNA, 21 bp, Homo sapiens
agatgccagcttctctctcca

SEQ ID NO: 3605893 - DNA, 21 bp, Homo sapiens
agatgccccctccaggagaga

SEQ ID NO: 3605894 - DNA, 23 bp, Homo sapiens
agatgccccctccaggagagagc

SEQ ID NO: 3605895 - DNA, 21 bp, Homo sapiens
agatgcctgatttcattcctc

SEQ ID NO: 3605896 - DNA, 16 bp, Homo sapiens
agatgcctgttaattt

SEQ ID NO: 3605897 - DNA, 20 bp, Homo sapiens
agatgcgttcagcagactgg

SEQ ID NO: 3605898 - DNA, 20 bp, Homo sapiens
agatgctgactgtactcctc

SEQ ID NO: 3605899 - DNA, 23 bp, Homo sapiens
agatgctgactgtactcctccca

SEQ ID NO: 3605900 - DNA, 13 bp, Homo sapiens
agatgctgaggcc

SEQ ID NO: 3605901 - DNA, 19 bp, Homo sapiens
agatgctggcccagggccc

SEQ ID NO: 3605902 - DNA, 22 bp, Homo sapiens
agatgctggcccagggcccaga

SEQ ID NO: 3605903 - DNA, 18 bp, Homo sapiens
agatgctgttgtgaagct

SEQ ID NO: 3605904 - DNA, 17 bp, Homo sapiens
agatgctttttgatcta

SEQ ID NO: 3605905 - DNA, 22 bp, Homo sapiens
agatggaaagaggtgaaaatga

SEQ ID NO: 3605906 - DNA, 13 bp, Homo sapiens
agatggaagcttg

SEQ ID NO: 3605907 - DNA, 20 bp, Homo sapiens
agatggagacaccctctggg

SEQ ID NO: 3605908 - DNA, 14 bp, Homo sapiens
agatggccatgctc

SEQ ID NO: 3605909 - DNA, 20 bp, Homo sapiens
agatggctgtgcctctgcct

SEQ ID NO: 3605910 - DNA, 20 bp, Homo sapiens
agatggtggccacagactga

SEQ ID NO: 3605911 - DNA, 17 bp, Homo sapiens
agatgtaaaaggtatta

SEQ ID NO: 3605912 - DNA, 17 bp, Homo sapiens
agatgtaattttgtgta

SEQ ID NO: 3605913 - DNA, 18 bp, Homo sapiens
agatgtacatttaataat

SEQ ID NO: 3605914 - DNA, 23 bp, Homo sapiens
agatgtaccaattgtcaaattac

SEQ ID NO: 3605915 - DNA, 14 bp, Homo sapiens
agatgtagtatttt

SEQ ID NO: 3605916 - DNA, 22 bp, Homo sapiens
agatgtgaacacatcagcttgc

SEQ ID NO: 3605917 - DNA, 16 bp, Homo sapiens
agatgtgcaaaatcac

SEQ ID NO: 3605918 - DNA, 19 bp, Homo sapiens
agattagttctttttgcca

SEQ ID NO: 3605919 - DNA, 13 bp, Homo sapiens
agattcagagaaa

SEQ ID NO: 3605920 - DNA, 18 bp, Homo sapiens
agattcaggccagcccag

SEQ ID NO: 3605921 - DNA, 20 bp, Homo sapiens
agattcaggccagcccagcc

SEQ ID NO: 3605922 - DNA, 16 bp, Homo sapiens
agattcatatttactt

SEQ ID NO: 3605923 - DNA, 18 bp, Homo sapiens
agattccagagagtggct

SEQ ID NO: 3605924 - DNA, 19 bp, Homo sapiens
agattccagagagtggctc

SEQ ID NO: 3605925 - DNA, 22 bp, Homo sapiens
agattccagagagtggctcctc

SEQ ID NO: 3605926 - DNA, 16 bp, Homo sapiens
agattcccagagcaaa

SEQ ID NO: 3605927 - DNA, 15 bp, Homo sapiens
agattccccatcaac

SEQ ID NO: 3605928 - DNA, 18 bp, Homo sapiens
agattctatgttaatatt

SEQ ID NO: 3605929 - DNA, 14 bp, Homo sapiens
agattctctatgta

SEQ ID NO: 3605930 - DNA, 10 bp, Homo sapiens
agattcttct

SEQ ID NO: 3605931 - DNA, 11 bp, Homo sapiens
agattcttctt

SEQ ID NO: 3605932 - DNA, 21 bp, Homo sapiens
agattcttcttaaaagtttct

SEQ ID NO: 3605933 - DNA, 18 bp, Homo sapiens
agattggggacactcata

SEQ ID NO: 3605934 - DNA, 17 bp, Homo sapiens
agatttaagccttacaa

SEQ ID NO: 3605935 - DNA, 22 bp, Homo sapiens
agatttaagtgaatacattaac

SEQ ID NO: 3605936 - DNA, 12 bp, Homo sapiens
agatttagtgta

SEQ ID NO: 3605937 - DNA, 22 bp, Homo sapiens
agatttctcagaagtctttcag

SEQ ID NO: 3605938 - DNA, 14 bp, Homo sapiens
agatttctgaggaa

SEQ ID NO: 3605939 - DNA, 21 bp, Homo sapiens
agattttgaaatttttattaa

SEQ ID NO: 3605940 - DNA, 13 bp, Homo sapiens
agatttttttcct

SEQ ID NO: 3605941 - DNA, 14 bp, Homo sapiens
agcaaaacagactg

SEQ ID NO: 3605942 - DNA, 14 bp, Homo sapiens
agcaaactccaggt

SEQ ID NO: 3605943 - DNA, 14 bp, Homo sapiens
agcaaactctgctg

SEQ ID NO: 3605944 - DNA, 21 bp, Homo sapiens
agcaaagattaaatgtgtcat

SEQ ID NO: 3605945 - DNA, 23 bp, Homo sapiens
agcaaagattaaatgtgtcattg

SEQ ID NO: 3605946 - DNA, 16 bp, Homo sapiens
agcaaaggtgcactcc

SEQ ID NO: 3605947 - DNA, 20 bp, Homo sapiens
agcaaaggtgcactccagac

SEQ ID NO: 3605948 - DNA, 21 bp, Homo sapiens
agcaaaggtgcactccagact

SEQ ID NO: 3605949 - DNA, 19 bp, Homo sapiens
agcaaataaacttacagat

SEQ ID NO: 3605950 - DNA, 15 bp, Homo sapiens
agcaaatggcctcat

SEQ ID NO: 3605951 - DNA, 16 bp, Homo sapiens
agcaaatgtggctcct

SEQ ID NO: 3605952 - DNA, 11 bp, Homo sapiens
agcaacacaga

SEQ ID NO: 3605953 - DNA, 20 bp, Homo sapiens
agcaacattttacccacaca

SEQ ID NO: 3605954 - DNA, 16 bp, Homo sapiens
agcaaccctacagtat

SEQ ID NO: 3605955 - DNA, 17 bp, Homo sapiens
agcaaccctacagtata

SEQ ID NO: 3605956 - DNA, 21 bp, Homo sapiens
agcaaccctacagtatataag

SEQ ID NO: 3605957 - DNA, 21 bp, Homo sapiens
agcaacccttcctgctgctgc

SEQ ID NO: 3605958 - DNA, 20 bp, Homo sapiens
agcaaccgcctcaaaatgtg

SEQ ID NO: 3605959 - DNA, 21 bp, Homo sapiens
agcaaccgcctcaaaatgtgt

SEQ ID NO: 3605960 - DNA, 23 bp, Homo sapiens
agcaacgcaggcccccaggtgcc

SEQ ID NO: 3605961 - DNA, 16 bp, Homo sapiens
agcaacgcccctccaa

SEQ ID NO: 3605962 - DNA, 12 bp, Homo sapiens
agcaagaaacag

SEQ ID NO: 3605963 - DNA, 16 bp, Homo sapiens
agcaagcaacacagag

SEQ ID NO: 3605964 - DNA, 15 bp, Homo sapiens
agcaagcgggagccc

SEQ ID NO: 3605965 - DNA, 14 bp, Homo sapiens
agcaaggcacagcc

SEQ ID NO: 3605966 - DNA, 15 bp, Homo sapiens
agcaagtccttaggc

SEQ ID NO: 3605967 - DNA, 16 bp, Homo sapiens
agcaataaatgctttt

SEQ ID NO: 3605968 - DNA, 12 bp, Homo sapiens
agcaataatttc

SEQ ID NO: 3605969 - DNA, 20 bp, Homo sapiens
agcaatactgtttccatttt

SEQ ID NO: 3605970 - DNA, 23 bp, Homo sapiens
agcaataggtagctggggagccc

SEQ ID NO: 3605971 - DNA, 22 bp, Homo sapiens
agcaatcctcctacctcagcct

SEQ ID NO: 3605972 - DNA, 22 bp, Homo sapiens
agcaatgccccaaactttctca

SEQ ID NO: 3605973 - DNA, 23 bp, Homo sapiens
agcaatgccccaaactttctcat

SEQ ID NO: 3605974 - DNA, 23 bp, Homo sapiens
agcaattagtctgaaactggctt

SEQ ID NO: 3605975 - DNA, 19 bp, Homo sapiens
agcaatttaactagacaca

SEQ ID NO: 3605976 - DNA, 13 bp, Homo sapiens
agcaatttactga

SEQ ID NO: 3605977 - DNA, 18 bp, Homo sapiens
agcacaaagaagaaagct

SEQ ID NO: 3605978 - DNA, 19 bp, Homo sapiens
agcacaactttaagaggac

SEQ ID NO: 3605979 - DNA, 16 bp, Homo sapiens
agcacaagactggccc

SEQ ID NO: 3605980 - DNA, 16 bp, Homo sapiens
agcacaagtacttttg

SEQ ID NO: 3605981 - DNA, 21 bp, Homo sapiens
agcacacctgaatcagctgga

SEQ ID NO: 3605982 - DNA, 20 bp, Homo sapiens
agcacactcatcccctcact

SEQ ID NO: 3605983 - DNA, 21 bp, Homo sapiens
agcacagcagcccctgcacaa

SEQ ID NO: 3605984 - DNA, 20 bp, Homo sapiens
agcacagtaggtcccggcca

SEQ ID NO: 3605985 - DNA, 15 bp, Homo sapiens
agcaccaacctccag

SEQ ID NO: 3605986 - DNA, 16 bp, Homo sapiens
agcaccaacctccaga

SEQ ID NO: 3605987 - DNA, 18 bp, Homo sapiens
agcaccaacctccagact

SEQ ID NO: 3605988 - DNA, 22 bp, Homo sapiens
agcacccagagcaccccctgct

SEQ ID NO: 3605989 - DNA, 20 bp, Homo sapiens
agcaccccctgctccaccag

SEQ ID NO: 3605990 - DNA, 22 bp, Homo sapiens
agcaccccctgctccaccagca

SEQ ID NO: 3605991 - DNA, 21 bp, Homo sapiens
agcactccccagagctgtgcc

SEQ ID NO: 3605992 - DNA, 22 bp, Homo sapiens
agcactccccagagctgtgcca

SEQ ID NO: 3605993 - DNA, 20 bp, Homo sapiens
agcactgaaagtatgtttta

SEQ ID NO: 3605994 - DNA, 22 bp, Homo sapiens
agcactgaaccacattcaggga

SEQ ID NO: 3605995 - DNA, 17 bp, Homo sapiens
agcactgacttctaagt

SEQ ID NO: 3605996 - DNA, 16 bp, Homo sapiens
agcactttgggaggcc

SEQ ID NO: 3605997 - DNA, 22 bp, Homo sapiens
agcactttgggaggccgaggtg

SEQ ID NO: 3605998 - DNA, 20 bp, Homo sapiens
agcagaaagaagagaagtga

SEQ ID NO: 3605999 - DNA, 12 bp, Homo sapiens
agcagaggaggg

SEQ ID NO: 3606000 - DNA, 19 bp, Homo sapiens
agcagaggaggggccgctg

SEQ ID NO: 3606001 - DNA, 21 bp, Homo sapiens
agcagaggcgtactacccagc

SEQ ID NO: 3606002 - DNA, 22 bp, Homo sapiens
agcagatgctgttgtgaagcta

SEQ ID NO: 3606003 - DNA, 22 bp, Homo sapiens
agcagcaggaggggggagggaa

SEQ ID NO: 3606004 - DNA, 16 bp, Homo sapiens
agcagcaggcctctgg

SEQ ID NO: 3606005 - DNA, 23 bp, Homo sapiens
agcagcaggcctctgggacccac

SEQ ID NO: 3606006 - DNA, 14 bp, Homo sapiens
agcagcaggctcag

SEQ ID NO: 3606007 - DNA, 14 bp, Homo sapiens
agcagcatggaaaa

SEQ ID NO: 3606008 - DNA, 20 bp, Homo sapiens
agcagcatggaaaaatggtt

SEQ ID NO: 3606009 - DNA, 21 bp, Homo sapiens
agcagcatggaaaaatggttg

SEQ ID NO: 3606010 - DNA, 14 bp, Homo sapiens
agcagcccagggcc

SEQ ID NO: 3606011 - DNA, 21 bp, Homo sapiens
agcagccccccttgccccacc

SEQ ID NO: 3606012 - DNA, 14 bp, Homo sapiens
agcagcgcctttcc

SEQ ID NO: 3606013 - DNA, 20 bp, Homo sapiens
agcagctagaaaacattttt

SEQ ID NO: 3606014 - DNA, 14 bp, Homo sapiens
agcagctgatgctg

SEQ ID NO: 3606015 - DNA, 23 bp, Homo sapiens
agcagctttttattccctgccca

SEQ ID NO: 3606016 - DNA, 21 bp, Homo sapiens
agcaggagagactgagcagcc

SEQ ID NO: 3606017 - DNA, 17 bp, Homo sapiens
agcaggagccccgccac

SEQ ID NO: 3606018 - DNA, 23 bp, Homo sapiens
agcaggcaccgccacgtcccagc

SEQ ID NO: 3606019 - DNA, 14 bp, Homo sapiens
agcaggccagagaa

SEQ ID NO: 3606020 - DNA, 23 bp, Homo sapiens
agcaggcccatgggaggctggag

SEQ ID NO: 3606021 - DNA, 16 bp, Homo sapiens
agcaggcctctgggac

SEQ ID NO: 3606022 - DNA, 22 bp, Homo sapiens
agcaggcctctgggacccacag

SEQ ID NO: 3606023 - DNA, 20 bp, Homo sapiens
agcaggctactgtcagctcc

SEQ ID NO: 3606024 - DNA, 21 bp, Homo sapiens
agcaggcttgtggcagcctga

SEQ ID NO: 3606025 - DNA, 19 bp, Homo sapiens
aactgccctaagcccccag

SEQ ID NO: 3606026 - DNA, 21 bp, Homo sapiens
aactggaaaggatctgtgatt

SEQ ID NO: 3606027 - DNA, 13 bp, Homo sapiens
aactggaagcttt

SEQ ID NO: 3606028 - DNA, 14 bp, Homo sapiens
aactgggttaaata

SEQ ID NO: 3606029 - DNA, 16 bp, Homo sapiens
aactggtgcatgacaa

SEQ ID NO: 3606030 - DNA, 21 bp, Homo sapiens
aactggttaaacattaatatt

SEQ ID NO: 3606031 - DNA, 15 bp, Homo sapiens
aactgtagtaattgt

SEQ ID NO: 3606032 - DNA, 22 bp, Homo sapiens
aactgtagtaattgttacaatt

SEQ ID NO: 3606033 - DNA, 22 bp, Homo sapiens
aactgtattttctttcacttta

SEQ ID NO: 3606034 - DNA, 14 bp, Homo sapiens
aactgtcctgtcct

SEQ ID NO: 3606035 - DNA, 19 bp, Homo sapiens
aactgtgatttttatcaca

SEQ ID NO: 3606036 - DNA, 23 bp, Homo sapiens
aactgtgttttagtgtaaaattg

SEQ ID NO: 3606037 - DNA, 20 bp, Homo sapiens
aactgttaactatgacagat

SEQ ID NO: 3606038 - DNA, 13 bp, Homo sapiens
aactgtttagatg

SEQ ID NO: 3606039 - DNA, 14 bp, Homo sapiens
aacttaaacaaaaa

SEQ ID NO: 3606040 - DNA, 15 bp, Homo sapiens
aacttaaacaaaaaa

SEQ ID NO: 3606041 - DNA, 17 bp, Homo sapiens
aacttaatttaatattt

SEQ ID NO: 3606042 - DNA, 19 bp, Homo sapiens
aacttcaaagctgaatatt

SEQ ID NO: 3606043 - DNA, 11 bp, Homo sapiens
aacttcagcaa

SEQ ID NO: 3606044 - DNA, 20 bp, Homo sapiens
aacttcatatatgaggactt

SEQ ID NO: 3606045 - DNA, 12 bp, Homo sapiens
aacttcattctc

SEQ ID NO: 3606046 - DNA, 11 bp, Homo sapiens
aacttcctgct

SEQ ID NO: 3606047 - DNA, 21 bp, Homo sapiens
aacttcctgctgcaccctgcg

SEQ ID NO: 3606048 - DNA, 23 bp, Homo sapiens
aacttccttggactcattttaaa

SEQ ID NO: 3606049 - DNA, 18 bp, Homo sapiens
aacttctcttgaaaagtt

SEQ ID NO: 3606050 - DNA, 19 bp, Homo sapiens
aacttctcttgctttctat

SEQ ID NO: 3606051 - DNA, 18 bp, Homo sapiens
aacttcttgcttctttct

SEQ ID NO: 3606052 - DNA, 20 bp, Homo sapiens
aacttcttgcttctttctag

SEQ ID NO: 3606053 - DNA, 22 bp, Homo sapiens
aacttcttgcttctttctagaa

SEQ ID NO: 3606054 - DNA, 21 bp, Homo sapiens
aacttgactgggtgagaccca

SEQ ID NO: 3606055 - DNA, 16 bp, Homo sapiens
aacttgagattcaaga

SEQ ID NO: 3606056 - DNA, 18 bp, Homo sapiens
aacttgagattcaagaca

SEQ ID NO: 3606057 - DNA, 23 bp, Homo sapiens
aacttgagattcaagacaagagc

SEQ ID NO: 3606058 - DNA, 22 bp, Homo sapiens
aacttgcacttgttatattata

SEQ ID NO: 3606059 - DNA, 14 bp, Homo sapiens
aacttgctgcctcg

SEQ ID NO: 3606060 - DNA, 14 bp, Homo sapiens
aacttgctgctgcc

SEQ ID NO: 3606061 - DNA, 15 bp, Homo sapiens
aacttgctgctgcct

SEQ ID NO: 3606062 - DNA, 16 bp, Homo sapiens
aacttgctgctgcctt

SEQ ID NO: 3606063 - DNA, 16 bp, Homo sapiens
aacttggccagtttgt

SEQ ID NO: 3606064 - DNA, 23 bp, Homo sapiens
aacttggggagttaagacctggc

SEQ ID NO: 3606065 - DNA, 21 bp, Homo sapiens
aactttaagaactaaaatgtt

SEQ ID NO: 3606066 - DNA, 15 bp, Homo sapiens
aactttactttcagc

SEQ ID NO: 3606067 - DNA, 17 bp, Homo sapiens
aactttcgttgttatta

SEQ ID NO: 3606068 - DNA, 16 bp, Homo sapiens
aactttctcataagca

SEQ ID NO: 3606069 - DNA, 14 bp, Homo sapiens
aacttttaatttaa

SEQ ID NO: 3606070 - DNA, 13 bp, Homo sapiens
aacttttgtgaat

SEQ ID NO: 3606071 - DNA, 19 bp, Homo sapiens
aagaaaaataataaagtca

SEQ ID NO: 3606072 - DNA, 14 bp, Homo sapiens
aagaaaacccaccc

SEQ ID NO: 3606073 - DNA, 16 bp, Homo sapiens
aagaaaagattcttct

SEQ ID NO: 3606074 - DNA, 12 bp, Homo sapiens
aagaaaatgtct

SEQ ID NO: 3606075 - DNA, 15 bp, Homo sapiens
aagaaacaagctgtg

SEQ ID NO: 3606076 - DNA, 16 bp, Homo sapiens
aagaaacaagctgtgc

SEQ ID NO: 3606077 - DNA, 15 bp, Homo sapiens
aagaaacaccagtgt

SEQ ID NO: 3606078 - DNA, 19 bp, Homo sapiens
aagaaaccttgctctcctc

SEQ ID NO: 3606079 - DNA, 19 bp, Homo sapiens
aagaaactgaggaattttc

SEQ ID NO: 3606080 - DNA, 20 bp, Homo sapiens
aagaaactgaggaattttct

SEQ ID NO: 3606081 - DNA, 20 bp, Homo sapiens
aagaaactggtccatgtaaa

SEQ ID NO: 3606082 - DNA, 19 bp, Homo sapiens
aagaaacttttttattttt

SEQ ID NO: 3606083 - DNA, 12 bp, Homo sapiens
aagaaagaaata

SEQ ID NO: 3606084 - DNA, 13 bp, Homo sapiens
aagaaagtggtct

SEQ ID NO: 3606085 - DNA, 23 bp, Homo sapiens
aagaaataaatgaaacttggcca

SEQ ID NO: 3606086 - DNA, 14 bp, Homo sapiens
aagaacatgatttt

SEQ ID NO: 3606087 - DNA, 17 bp, Homo sapiens
aagaaccagtcccccca

SEQ ID NO: 3606088 - DNA, 14 bp, Homo sapiens
aagaaccatgcagg

SEQ ID NO: 3606089 - DNA, 14 bp, Homo sapiens
aagaacctggaact

SEQ ID NO: 3606090 - DNA, 13 bp, Homo sapiens
aagaacttgctgc

SEQ ID NO: 3606091 - DNA, 17 bp, Homo sapiens
aagaacttgctgctgcc

SEQ ID NO: 3606092 - DNA, 19 bp, Homo sapiens
aagaacttgctgctgcctt

SEQ ID NO: 3606093 - DNA, 14 bp, Homo sapiens
aagaagaaggccag

SEQ ID NO: 3606094 - DNA, 14 bp, Homo sapiens
aagaagaggagaaa

SEQ ID NO: 3606095 - DNA, 18 bp, Homo sapiens
aagaagaggagaaaaaga

SEQ ID NO: 3606096 - DNA, 13 bp, Homo sapiens
aagaaggaagctg

SEQ ID NO: 3606097 - DNA, 17 bp, Homo sapiens
aagaaggaagctgtgtt

SEQ ID NO: 3606098 - DNA, 15 bp, Homo sapiens
aagaaggccagagag

SEQ ID NO: 3606099 - DNA, 17 bp, Homo sapiens
aagaagggggccctgct

SEQ ID NO: 3606100 - DNA, 14 bp, Homo sapiens
aagaagtggagaca

SEQ ID NO: 3606101 - DNA, 15 bp, Homo sapiens
aagaagtggagacag

SEQ ID NO: 3606102 - DNA, 19 bp, Homo sapiens
aagaagtgtgtcaccctta

SEQ ID NO: 3606103 - DNA, 17 bp, Homo sapiens
aagaatagcattgtaaa

SEQ ID NO: 3606104 - DNA, 13 bp, Homo sapiens
aagaatagttcta

SEQ ID NO: 3606105 - DNA, 19 bp, Homo sapiens
aagaatagttctaaaattg

SEQ ID NO: 3606106 - DNA, 13 bp, Homo sapiens
aagaatcttcctg

SEQ ID NO: 3606107 - DNA, 15 bp, Homo sapiens
aagaatgcattcaaa

SEQ ID NO: 3606108 - DNA, 20 bp, Homo sapiens
aagaatgttagagtaatgaa

SEQ ID NO: 3606109 - DNA, 17 bp, Homo sapiens
aagacaaaggttttcct

SEQ ID NO: 3606110 - DNA, 20 bp, Homo sapiens
aagacaaatattcctttgca

SEQ ID NO: 3606111 - DNA, 22 bp, Homo sapiens
aagacacgtggcctcgtgaggg

SEQ ID NO: 3606112 - DNA, 17 bp, Homo sapiens
aagacactcaaatatga

SEQ ID NO: 3606113 - DNA, 13 bp, Homo sapiens
aagacagaaaagt

SEQ ID NO: 3606114 - DNA, 15 bp, Homo sapiens
aagacagaggcagag

SEQ ID NO: 3606115 - DNA, 21 bp, Homo sapiens
aagacagcagacaaaatgaaa

SEQ ID NO: 3606116 - DNA, 18 bp, Homo sapiens
aagacaggagacaaaaga

SEQ ID NO: 3606117 - DNA, 14 bp, Homo sapiens
aagacagtggcccc

SEQ ID NO: 3606118 - DNA, 14 bp, Homo sapiens
aagacataaaacag

SEQ ID NO: 3606119 - DNA, 15 bp, Homo sapiens
aagacataaaacaga

SEQ ID NO: 3606120 - DNA, 19 bp, Homo sapiens
aagacataaacaaagacat

SEQ ID NO: 3606121 - DNA, 21 bp, Homo sapiens
aagacattagagaaaacctta

SEQ ID NO: 3606122 - DNA, 17 bp, Homo sapiens
aagacattgacagcaat

SEQ ID NO: 3606123 - DNA, 12 bp, Homo sapiens
aagaccagtcca

SEQ ID NO: 3606124 - DNA, 15 bp, Homo sapiens
aagacccaaaacagc

SEQ ID NO: 3606125 - DNA, 21 bp, Homo sapiens
aagacccaaaacagctttgtc

SEQ ID NO: 3606126 - DNA, 13 bp, Homo sapiens
aagaccctgaatc

SEQ ID NO: 3606127 - DNA, 14 bp, Homo sapiens
aagaccctttcaga

SEQ ID NO: 3606128 - DNA, 16 bp, Homo sapiens
aagacctcatctgtgg

SEQ ID NO: 3606129 - DNA, 19 bp, Homo sapiens
aagacctcatctgtggagc

SEQ ID NO: 3606130 - DNA, 12 bp, Homo sapiens
aagacctgaaag

SEQ ID NO: 3606131 - DNA, 13 bp, Homo sapiens
aagacgaggggca

SEQ ID NO: 3606132 - DNA, 14 bp, Homo sapiens
aagacgaggggcag

SEQ ID NO: 3606133 - DNA, 19 bp, Homo sapiens
aagacgaggggcagggaag

SEQ ID NO: 3606134 - DNA, 19 bp, Homo sapiens
aagacgtggctctgggtga

SEQ ID NO: 3606135 - DNA, 17 bp, Homo sapiens
aagactccaaagaaatg

SEQ ID NO: 3606136 - DNA, 22 bp, Homo sapiens
aagactctggaggtcatctggc

SEQ ID NO: 3606137 - DNA, 15 bp, Homo sapiens
aagactgaagatggc

SEQ ID NO: 3606138 - DNA, 19 bp, Homo sapiens
aagactgaagatggctttt

SEQ ID NO: 3606139 - DNA, 18 bp, Homo sapiens
aagactggcccagtgcca

SEQ ID NO: 3606140 - DNA, 15 bp, Homo sapiens
aagacttcctctggc

SEQ ID NO: 3606141 - DNA, 15 bp, Homo sapiens
aagagaaacctgcca

SEQ ID NO: 3606142 - DNA, 22 bp, Homo sapiens
aagagaaacctgccaaggagca

SEQ ID NO: 3606143 - DNA, 21 bp, Homo sapiens
aagagaaatatatttgtcact

SEQ ID NO: 3606144 - DNA, 21 bp, Homo sapiens
aagagaagagggcccagccca

SEQ ID NO: 3606145 - DNA, 22 bp, Homo sapiens
aagagaagagggcccagcccag

SEQ ID NO: 3606146 - DNA, 17 bp, Homo sapiens
aagagaagtgagtggtg

SEQ ID NO: 3606147 - DNA, 19 bp, Homo sapiens
aagagacaaacacctccca

SEQ ID NO: 3606148 - DNA, 21 bp, Homo sapiens
aagagacaaacacctcccagg

SEQ ID NO: 3606149 - DNA, 17 bp, Homo sapiens
aagagacaatttctgca

SEQ ID NO: 3606150 - DNA, 14 bp, Homo sapiens
aagagagaagccag

SEQ ID NO: 3606151 - DNA, 15 bp, Homo sapiens
aagagagaagccagc

SEQ ID NO: 3606152 - DNA, 18 bp, Homo sapiens
aagagagaagccagccac

SEQ ID NO: 3606153 - DNA, 12 bp, Homo sapiens
aagagaggactg

SEQ ID NO: 3606154 - DNA, 15 bp, Homo sapiens
aagagagggacaggc

SEQ ID NO: 3606155 - DNA, 12 bp, Homo sapiens
aagagcatcctg

SEQ ID NO: 3606156 - DNA, 18 bp, Homo sapiens
aagagcatgaaattttta

SEQ ID NO: 3606157 - DNA, 12 bp, Homo sapiens
aagagctgcctg

SEQ ID NO: 3606158 - DNA, 15 bp, Homo sapiens
aagagctgcctggat

SEQ ID NO: 3606159 - DNA, 16 bp, Homo sapiens
aagagctgcctggatg

SEQ ID NO: 3606160 - DNA, 17 bp, Homo sapiens
aagagctgcctggatga

SEQ ID NO: 3606161 - DNA, 19 bp, Homo sapiens
aagagctgttatgctgttt

SEQ ID NO: 3606162 - DNA, 22 bp, Homo sapiens
aagagctgttatgctgtttcct

SEQ ID NO: 3606163 - DNA, 20 bp, Homo sapiens
aaatgtaaactgtttcttta

SEQ ID NO: 3606164 - DNA, 22 bp, Homo sapiens
aaatgtaagggaaactgccagc

SEQ ID NO: 3606165 - DNA, 19 bp, Homo sapiens
aaatgtacatttccaaatg

SEQ ID NO: 3606166 - DNA, 21 bp, Homo sapiens
aaatgtacatttccaaatgaa

SEQ ID NO: 3606167 - DNA, 15 bp, Homo sapiens
aaatgtagttttgta

SEQ ID NO: 3606168 - DNA, 17 bp, Homo sapiens
aaatgtatcatagaaat

SEQ ID NO: 3606169 - DNA, 14 bp, Homo sapiens
aaatgtatgtgtgt

SEQ ID NO: 3606170 - DNA, 13 bp, Homo sapiens
aaatgtattcaag

SEQ ID NO: 3606171 - DNA, 14 bp, Homo sapiens
aaatgtcacttttt

SEQ ID NO: 3606172 - DNA, 18 bp, Homo sapiens
aaatgtccacttaaaata

SEQ ID NO: 3606173 - DNA, 20 bp, Homo sapiens
aaatgtccacttaaaataca

SEQ ID NO: 3606174 - DNA, 13 bp, Homo sapiens
aaatgtctgcact

SEQ ID NO: 3606175 - DNA, 18 bp, Homo sapiens
aaatgtctgtaataatag

SEQ ID NO: 3606176 - DNA, 18 bp, Homo sapiens
aaatgtctttcatgtaaa

SEQ ID NO: 3606177 - DNA, 23 bp, Homo sapiens
aaatgtgtacaatgtacacactg

SEQ ID NO: 3606178 - DNA, 15 bp, Homo sapiens
aaatgtgtttccttt

SEQ ID NO: 3606179 - DNA, 16 bp, Homo sapiens
aaatgttagtatttta

SEQ ID NO: 3606180 - DNA, 21 bp, Homo sapiens
aaatgttcagaaggttgctct

SEQ ID NO: 3606181 - DNA, 21 bp, Homo sapiens
aaatgtttatattgtttttat

SEQ ID NO: 3606182 - DNA, 20 bp, Homo sapiens
aaattaatgcagatttctct

SEQ ID NO: 3606183 - DNA, 14 bp, Homo sapiens
aaattacatgtttt

SEQ ID NO: 3606184 - DNA, 18 bp, Homo sapiens
aaattaggatttcatgat

SEQ ID NO: 3606185 - DNA, 20 bp, Homo sapiens
aaattataactattacagtg

SEQ ID NO: 3606186 - DNA, 21 bp, Homo sapiens
aaattataactattacagtgt

SEQ ID NO: 3606187 - DNA, 20 bp, Homo sapiens
aaattatacaatgatatcca

SEQ ID NO: 3606188 - DNA, 14 bp, Homo sapiens
aaattatatgatat

SEQ ID NO: 3606189 - DNA, 12 bp, Homo sapiens
aaattattactt

SEQ ID NO: 3606190 - DNA, 17 bp, Homo sapiens
aaattattactttaaat

SEQ ID NO: 3606191 - DNA, 24 bp, Homo sapiens
aaattattactttaaattatatga

SEQ ID NO: 3606192 - DNA, 17 bp, Homo sapiens
aaattatttgattattt

SEQ ID NO: 3606193 - DNA, 13 bp, Homo sapiens
aaattcaccttcc

SEQ ID NO: 3606194 - DNA, 16 bp, Homo sapiens
aaattcaggtctgtat

SEQ ID NO: 3606195 - DNA, 18 bp, Homo sapiens
aaattcaggtctgtatgt

SEQ ID NO: 3606196 - DNA, 19 bp, Homo sapiens
aaattcattttttaaattc

SEQ ID NO: 3606197 - DNA, 14 bp, Homo sapiens
aaattccactgaaa

SEQ ID NO: 3606198 - DNA, 15 bp, Homo sapiens
aaattctactaagtt

SEQ ID NO: 3606199 - DNA, 23 bp, Homo sapiens
aaattctactaagttattttatg

SEQ ID NO: 3606200 - DNA, 14 bp, Homo sapiens
aaattgatctgttt

SEQ ID NO: 3606201 - DNA, 19 bp, Homo sapiens
aaattgatctgttttggat

SEQ ID NO: 3606202 - DNA, 12 bp, Homo sapiens
aaattgcagttt

SEQ ID NO: 3606203 - DNA, 21 bp, Homo sapiens
aaattgcagtttacagtattt

SEQ ID NO: 3606204 - DNA, 13 bp, Homo sapiens
aaattgctccttg

SEQ ID NO: 3606205 - DNA, 21 bp, Homo sapiens
aaattgcttctaaaacaataa

SEQ ID NO: 3606206 - DNA, 12 bp, Homo sapiens
aaattgtgatgt

SEQ ID NO: 3606207 - DNA, 16 bp, Homo sapiens
aaatttactttacaca

SEQ ID NO: 3606208 - DNA, 18 bp, Homo sapiens
aaatttcataattctgaa

SEQ ID NO: 3606209 - DNA, 20 bp, Homo sapiens
aaatttcataattctgaaac

SEQ ID NO: 3606210 - DNA, 12 bp, Homo sapiens
aaatttcttttg

SEQ ID NO: 3606211 - DNA, 17 bp, Homo sapiens
aaatttgataaactgaa

SEQ ID NO: 3606212 - DNA, 19 bp, Homo sapiens
aaatttgttatacttcaaa

SEQ ID NO: 3606213 - DNA, 14 bp, Homo sapiens
aaattttacatgac

SEQ ID NO: 3606214 - DNA, 16 bp, Homo sapiens
aaattttctaaataac

SEQ ID NO: 3606215 - DNA, 23 bp, Homo sapiens
aaattttgattaaccttttcaaa

SEQ ID NO: 3606216 - DNA, 17 bp, Homo sapiens
aaatttttaggcaaaga

SEQ ID NO: 3606217 - DNA, 20 bp, Homo sapiens
aaatttttgtagtagcgttt

SEQ ID NO: 3606218 - DNA, 20 bp, Homo sapiens
aaattttttacgtagctatt

SEQ ID NO: 3606219 - DNA, 15 bp, Homo sapiens
aaattttttgaaaca

SEQ ID NO: 3606220 - DNA, 15 bp, Homo sapiens
aaattttttttacat

SEQ ID NO: 3606221 - DNA, 14 bp, Homo sapiens
aacaaaaaacccac

SEQ ID NO: 3606222 - DNA, 19 bp, Homo sapiens
aacaaaaacactaaaaata

SEQ ID NO: 3606223 - DNA, 15 bp, Homo sapiens
aacaaaaatcaccat

SEQ ID NO: 3606224 - DNA, 11 bp, Homo sapiens
aacaaaacaaa

SEQ ID NO: 3606225 - DNA, 14 bp, Homo sapiens
aacaaaacaaaaca

SEQ ID NO: 3606226 - DNA, 12 bp, Homo sapiens
aacaaaacttct

SEQ ID NO: 3606227 - DNA, 15 bp, Homo sapiens
aacaaaatgaaacaa

SEQ ID NO: 3606228 - DNA, 20 bp, Homo sapiens
aacaaagacattgacagcaa

SEQ ID NO: 3606229 - DNA, 19 bp, Homo sapiens
aacaaagcaattctttcaa

SEQ ID NO: 3606230 - DNA, 17 bp, Homo sapiens
aacaaagcagctttaaa

SEQ ID NO: 3606231 - DNA, 17 bp, Homo sapiens
aacaaagggaaaaaaga

SEQ ID NO: 3606232 - DNA, 17 bp, Homo sapiens
aacaaattgatctgttt

SEQ ID NO: 3606233 - DNA, 15 bp, Homo sapiens
aacaacgtgagagaa

SEQ ID NO: 3606234 - DNA, 15 bp, Homo sapiens
aacaagaaagtggtc

SEQ ID NO: 3606235 - DNA, 22 bp, Homo sapiens
aacaagccaaagagcctcccac

SEQ ID NO: 3606236 - DNA, 19 bp, Homo sapiens
aacaagttttggcagccat

SEQ ID NO: 3606237 - DNA, 13 bp, Homo sapiens
aacaataagaaca

SEQ ID NO: 3606238 - DNA, 18 bp, Homo sapiens
aacaatctttcatgtctt

SEQ ID NO: 3606239 - DNA, 17 bp, Homo sapiens
aacaattcctgtaacct

SEQ ID NO: 3606240 - DNA, 12 bp, Homo sapiens
aacaatttttga

SEQ ID NO: 3606241 - DNA, 17 bp, Homo sapiens
aacaattttttttaatt

SEQ ID NO: 3606242 - DNA, 13 bp, Homo sapiens
aacacaataccta

SEQ ID NO: 3606243 - DNA, 14 bp, Homo sapiens
aacacaccttggag

SEQ ID NO: 3606244 - DNA, 22 bp, Homo sapiens
aacacaggcaaaatccttgctt

SEQ ID NO: 3606245 - DNA, 17 bp, Homo sapiens
aacacagttctgggcaa

SEQ ID NO: 3606246 - DNA, 23 bp, Homo sapiens
aacacatttccattcatggatat

SEQ ID NO: 3606247 - DNA, 13 bp, Homo sapiens
aacaccagtgtta

SEQ ID NO: 3606248 - DNA, 18 bp, Homo sapiens
aacaccagtgttagctta

SEQ ID NO: 3606249 - DNA, 14 bp, Homo sapiens
aacactaaaaataa

SEQ ID NO: 3606250 - DNA, 18 bp, Homo sapiens
aacactaactatgcatgg

SEQ ID NO: 3606251 - DNA, 14 bp, Homo sapiens
aacactgagaaaga

SEQ ID NO: 3606252 - DNA, 17 bp, Homo sapiens
aacactgttttatagaa

SEQ ID NO: 3606253 - DNA, 18 bp, Homo sapiens
aacacttaatagcaacag

SEQ ID NO: 3606254 - DNA, 11 bp, Homo sapiens
aacacttccat

SEQ ID NO: 3606255 - DNA, 15 bp, Homo sapiens
aacacttgagggcct

SEQ ID NO: 3606256 - DNA, 19 bp, Homo sapiens
aacactttgagcattttta

SEQ ID NO: 3606257 - DNA, 15 bp, Homo sapiens
aacagaacttttcct

SEQ ID NO: 3606258 - DNA, 21 bp, Homo sapiens
aacagacaggaatttagaaaa

SEQ ID NO: 3606259 - DNA, 15 bp, Homo sapiens
aacagagaggggcag

SEQ ID NO: 3606260 - DNA, 20 bp, Homo sapiens
aacagagtccaatttaagga

SEQ ID NO: 3606261 - DNA, 13 bp, Homo sapiens
aacagatctggaa

SEQ ID NO: 3606262 - DNA, 21 bp, Homo sapiens
aacagatctggaacctcagcc

SEQ ID NO: 3606263 - DNA, 22 bp, Homo sapiens
aacagatctggaacctcagcct

SEQ ID NO: 3606264 - DNA, 23 bp, Homo sapiens
aacagattcaggccagcccagcc

SEQ ID NO: 3606265 - DNA, 13 bp, Homo sapiens
aacagatttggaa

SEQ ID NO: 3606266 - DNA, 20 bp, Homo sapiens
aacagcagtctccttcagca

SEQ ID NO: 3606267 - DNA, 19 bp, Homo sapiens
aacagcatgaataaaacac

SEQ ID NO: 3606268 - DNA, 17 bp, Homo sapiens
aacagccctcctctgca

SEQ ID NO: 3606269 - DNA, 14 bp, Homo sapiens
aacagctcagccag

SEQ ID NO: 3606270 - DNA, 12 bp, Homo sapiens
aacagctcccag

SEQ ID NO: 3606271 - DNA, 14 bp, Homo sapiens
aacagctttgtctc

SEQ ID NO: 3606272 - DNA, 16 bp, Homo sapiens
aacagctttgtctcca

SEQ ID NO: 3606273 - DNA, 20 bp, Homo sapiens
aacagctttgtctccaaaga

SEQ ID NO: 3606274 - DNA, 23 bp, Homo sapiens
aacagctttgtctccaaagaaga

SEQ ID NO: 3606275 - DNA, 17 bp, Homo sapiens
aacaggaaagagctagg

SEQ ID NO: 3606276 - DNA, 13 bp, Homo sapiens
aacaggtattttg

SEQ ID NO: 3606277 - DNA, 21 bp, Homo sapiens
aacagtgagcctgaattttgt

SEQ ID NO: 3606278 - DNA, 22 bp, Homo sapiens
aacagtgtaaatcccagactga

SEQ ID NO: 3606279 - DNA, 23 bp, Homo sapiens
aacagtttcttgcttggaagcca

SEQ ID NO: 3606280 - DNA, 15 bp, Homo sapiens
aacagttttgagtaa

SEQ ID NO: 3606281 - DNA, 20 bp, Homo sapiens
aacataaaaaggacatcagc

SEQ ID NO: 3606282 - DNA, 14 bp, Homo sapiens
aacataaaatacaa

SEQ ID NO: 3606283 - DNA, 20 bp, Homo sapiens
aacataataaatcacacatt

SEQ ID NO: 3606284 - DNA, 12 bp, Homo sapiens
aacataatgaaa

SEQ ID NO: 3606285 - DNA, 16 bp, Homo sapiens
aacatatactatttag

SEQ ID NO: 3606286 - DNA, 14 bp, Homo sapiens
aacatattatttca

SEQ ID NO: 3606287 - DNA, 16 bp, Homo sapiens
aacatattatttcatt

SEQ ID NO: 3606288 - DNA, 14 bp, Homo sapiens
aacatattcaagga

SEQ ID NO: 3606289 - DNA, 24 bp, Homo sapiens
aacatccaagtggcctccgtcact

SEQ ID NO: 3606290 - DNA, 18 bp, Homo sapiens
aacatcgcaatagttttt

SEQ ID NO: 3606291 - DNA, 15 bp, Homo sapiens
aacatcgcacagttt

SEQ ID NO: 3606292 - DNA, 14 bp, Homo sapiens
aacatgaaatatat

SEQ ID NO: 3606293 - DNA, 14 bp, Homo sapiens
aacatgaaatgccc

SEQ ID NO: 3606294 - DNA, 14 bp, Homo sapiens
aacatgaagaatgc

SEQ ID NO: 3606295 - DNA, 22 bp, Homo sapiens
aacatgattttacaagtataac

SEQ ID NO: 3606296 - DNA, 21 bp, Homo sapiens
aacatgggctcttcactagtg

SEQ ID NO: 3606297 - DNA, 20 bp, Homo sapiens
aacatgtgttttcatcattt

SEQ ID NO: 3606298 - DNA, 14 bp, Homo sapiens
aacatgtttctgtt

SEQ ID NO: 3606299 - DNA, 12 bp, Homo sapiens
aacattataatt

SEQ ID NO: 3606300 - DNA, 14 bp, Homo sapiens
aacattcagctctg

SEQ ID NO: 3606301 - DNA, 17 bp, Homo sapiens
aacattcagctctggag

SEQ ID NO: 3606302 - DNA, 20 bp, Homo sapiens
aacattcctccagcctcccc

SEQ ID NO: 3606303 - DNA, 19 bp, Homo sapiens
aacattcgtgagctgggga

SEQ ID NO: 3606304 - DNA, 16 bp, Homo sapiens
aacattgtagcctcaa

SEQ ID NO: 3606305 - DNA, 13 bp, Homo sapiens
aacatttctcatg

SEQ ID NO: 3606306 - DNA, 23 bp, Homo sapiens
aacatttgggacctggataatta

SEQ ID NO: 3606307 - DNA, 15 bp, Homo sapiens
aacattttacccaca

SEQ ID NO: 3606308 - DNA, 16 bp, Homo sapiens
aacattttgtcatata

SEQ ID NO: 3606309 - DNA, 14 bp, Homo sapiens
aaccaaaaagaaaa

SEQ ID NO: 3606310 - DNA, 16 bp, Homo sapiens
aaccaagccgtggctt

SEQ ID NO: 3606311 - DNA, 16 bp, Homo sapiens
aaccaaggaatttaaa

SEQ ID NO: 3606312 - DNA, 13 bp, Homo sapiens
aaccacaccacat

SEQ ID NO: 3606313 - DNA, 14 bp, Homo sapiens
aaccacattgaaga

SEQ ID NO: 3606314 - DNA, 23 bp, Homo sapiens
aaccacctggttgaatataatag

SEQ ID NO: 3606315 - DNA, 21 bp, Homo sapiens
aaccactcccaccacaggcat

SEQ ID NO: 3606316 - DNA, 22 bp, Homo sapiens
aaccagaaaagcaatactgttt

SEQ ID NO: 3606317 - DNA, 20 bp, Homo sapiens
aaccagccgtattttacatg

SEQ ID NO: 3606318 - DNA, 14 bp, Homo sapiens
aaccaggctttcta

SEQ ID NO: 3606319 - DNA, 14 bp, Homo sapiens
aaccagtctcctca

SEQ ID NO: 3606320 - DNA, 18 bp, Homo sapiens
aaccataacaacttcata

SEQ ID NO: 3606321 - DNA, 13 bp, Homo sapiens
aaccatactgaaa

SEQ ID NO: 3606322 - DNA, 21 bp, Homo sapiens
aaccatccacttacatatatt

SEQ ID NO: 3606323 - DNA, 18 bp, Homo sapiens
aaccatgcaggaaggaaa

SEQ ID NO: 3606324 - DNA, 19 bp, Homo sapiens
aaccatttgaaacccctgt

SEQ ID NO: 3606325 - DNA, 14 bp, Homo sapiens
aacccacctctcct

SEQ ID NO: 3606326 - DNA, 21 bp, Homo sapiens
aacccactcatgactgcatga

SEQ ID NO: 3606327 - DNA, 15 bp, Homo sapiens
aacccagagatgcct

SEQ ID NO: 3606328 - DNA, 11 bp, Homo sapiens
aacccagtctt

SEQ ID NO: 3606329 - DNA, 15 bp, Homo sapiens
aaccccctgcagccc

SEQ ID NO: 3606330 - DNA, 20 bp, Homo sapiens
aaccccctgcagcccaggcc

SEQ ID NO: 3606331 - DNA, 22 bp, Homo sapiens
aacccctgacctaccccagcca

SEQ ID NO: 3606332 - DNA, 15 bp, Homo sapiens
aacccgtctggccca

SEQ ID NO: 3606333 - DNA, 18 bp, Homo sapiens
aaccctccaaaggaactc

SEQ ID NO: 3606334 - DNA, 23 bp, Homo sapiens
aaccctccaaaggaactctagag

SEQ ID NO: 3606335 - DNA, 18 bp, Homo sapiens
aaccctgtcacccacaga

SEQ ID NO: 3606336 - DNA, 13 bp, Homo sapiens
aacccttctctgt

SEQ ID NO: 3606337 - DNA, 15 bp, Homo sapiens
aacccttctctgttg

SEQ ID NO: 3606338 - DNA, 17 bp, Homo sapiens
aacctacattccaccct

SEQ ID NO: 3606339 - DNA, 15 bp, Homo sapiens
aacctagcacacctg

SEQ ID NO: 3606340 - DNA, 14 bp, Homo sapiens
aacctcagcctggc

SEQ ID NO: 3606341 - DNA, 18 bp, Homo sapiens
aacctccagcctccctgt

SEQ ID NO: 3606342 - DNA, 22 bp, Homo sapiens
aacctccattctattttagaat

SEQ ID NO: 3606343 - DNA, 13 bp, Homo sapiens
aacctcctgggtt

SEQ ID NO: 3606344 - DNA, 23 bp, Homo sapiens
aacctctaagtgctgctgtggag

SEQ ID NO: 3606345 - DNA, 14 bp, Homo sapiens
aacctctcctgacc

SEQ ID NO: 3606346 - DNA, 21 bp, Homo sapiens
aacctctcctgacccctgcct

SEQ ID NO: 3606347 - DNA, 20 bp, Homo sapiens
aacctctgtggtcacccatg

SEQ ID NO: 3606348 - DNA, 20 bp, Homo sapiens
aacctgactcaattatttgc

SEQ ID NO: 3606349 - DNA, 11 bp, Homo sapiens
aacctgctctc

SEQ ID NO: 3606350 - DNA, 16 bp, Homo sapiens
aacctggatccagcac

SEQ ID NO: 3606351 - DNA, 17 bp, Homo sapiens
aacctggatccagcact

SEQ ID NO: 3606352 - DNA, 23 bp, Homo sapiens
aacctggtcacaggactctgcct

SEQ ID NO: 3606353 - DNA, 21 bp, Homo sapiens
aacctgtcttattaagactgg

SEQ ID NO: 3606354 - DNA, 15 bp, Homo sapiens
aaccttgctctcctc

SEQ ID NO: 3606355 - DNA, 21 bp, Homo sapiens
aaccttgctctcctcatctcc

SEQ ID NO: 3606356 - DNA, 13 bp, Homo sapiens
aaccttttcaaat

SEQ ID NO: 3606357 - DNA, 16 bp, Homo sapiens
aacgaaatatcaaagt

SEQ ID NO: 3606358 - DNA, 12 bp, Homo sapiens
aacgcaccccac

SEQ ID NO: 3606359 - DNA, 20 bp, Homo sapiens
aacgccacaaaaatagagaa

SEQ ID NO: 3606360 - DNA, 11 bp, Homo sapiens
aacgcccctcc

SEQ ID NO: 3606361 - DNA, 15 bp, Homo sapiens
aacgcccctccaaac

SEQ ID NO: 3606362 - DNA, 22 bp, Homo sapiens
aacgcccctccaaacctccagc

SEQ ID NO: 3606363 - DNA, 23 bp, Homo sapiens
aacgcccctccaaacctccagcc

SEQ ID NO: 3606364 - DNA, 12 bp, Homo sapiens
aacgcccctgtg

SEQ ID NO: 3606365 - DNA, 13 bp, Homo sapiens
aacgcccctgtgg

SEQ ID NO: 3606366 - DNA, 18 bp, Homo sapiens
aacgcccctgtggccaac

SEQ ID NO: 3606367 - DNA, 16 bp, Homo sapiens
aacgcgtctgcctggg

SEQ ID NO: 3606368 - DNA, 17 bp, Homo sapiens
aacgcgtctgcctgggc

SEQ ID NO: 3606369 - DNA, 19 bp, Homo sapiens
aacggattattttttcaga

SEQ ID NO: 3606370 - DNA, 20 bp, Homo sapiens
aacggtgctaaaaatgaaaa

SEQ ID NO: 3606371 - DNA, 15 bp, Homo sapiens
aacggttcctggtga

SEQ ID NO: 3606372 - DNA, 21 bp, Homo sapiens
aacggttcctggtgactcctg

SEQ ID NO: 3606373 - DNA, 23 bp, Homo sapiens
aacggtttttttctttggctgca

SEQ ID NO: 3606374 - DNA, 13 bp, Homo sapiens
aacgtagcctggg

SEQ ID NO: 3606375 - DNA, 15 bp, Homo sapiens
aacgtgcaaagccaa

SEQ ID NO: 3606376 - DNA, 18 bp, Homo sapiens
aacgtgcaaagccaaggc

SEQ ID NO: 3606377 - DNA, 22 bp, Homo sapiens
aacgtggattgtatttaagaca

SEQ ID NO: 3606378 - DNA, 15 bp, Homo sapiens
aacgtggctctgctg

SEQ ID NO: 3606379 - DNA, 16 bp, Homo sapiens
aacgtggctctgctgg

SEQ ID NO: 3606380 - DNA, 17 bp, Homo sapiens
aacgtggctctgctggc

SEQ ID NO: 3606381 - DNA, 15 bp, Homo sapiens
aacgttttaataatt

SEQ ID NO: 3606382 - DNA, 21 bp, Homo sapiens
aactaaaaatatatctgttgg

SEQ ID NO: 3606383 - DNA, 17 bp, Homo sapiens
aactaaaataattttgt

SEQ ID NO: 3606384 - DNA, 19 bp, Homo sapiens
aactaaataacacagatat

SEQ ID NO: 3606385 - DNA, 15 bp, Homo sapiens
aactaacatgtcctg

SEQ ID NO: 3606386 - DNA, 19 bp, Homo sapiens
aactaaggactccaatgtc

SEQ ID NO: 3606387 - DNA, 15 bp, Homo sapiens
aactaaggatttttc

SEQ ID NO: 3606388 - DNA, 13 bp, Homo sapiens
aactacatgttct

SEQ ID NO: 3606389 - DNA, 17 bp, Homo sapiens
aactacatttctactat

SEQ ID NO: 3606390 - DNA, 22 bp, Homo sapiens
aactacctatccttacatttca

SEQ ID NO: 3606391 - DNA, 14 bp, Homo sapiens
aactactctttgat

SEQ ID NO: 3606392 - DNA, 16 bp, Homo sapiens
aactactctttgattt

SEQ ID NO: 3606393 - DNA, 18 bp, Homo sapiens
aactacttttctaaaatc

SEQ ID NO: 3606394 - DNA, 21 bp, Homo sapiens
aactacttttctaaaatctaa

SEQ ID NO: 3606395 - DNA, 16 bp, Homo sapiens
aactagaaagaaggac

SEQ ID NO: 3606396 - DNA, 13 bp, Homo sapiens
aactaggctctta

SEQ ID NO: 3606397 - DNA, 11 bp, Homo sapiens
aactatcttgg

SEQ ID NO: 3606398 - DNA, 22 bp, Homo sapiens
aactatgcatggtgccccagga

SEQ ID NO: 3606399 - DNA, 22 bp, Homo sapiens
aactattgtgctcagagacact

SEQ ID NO: 3606400 - DNA, 15 bp, Homo sapiens
aactatttaaagaaa

SEQ ID NO: 3606401 - DNA, 18 bp, Homo sapiens
aactcaaagacttcctct

SEQ ID NO: 3606402 - DNA, 18 bp, Homo sapiens
aactcaaatggggccaga

SEQ ID NO: 3606403 - DNA, 21 bp, Homo sapiens
aactcaaatggggccagatcc

SEQ ID NO: 3606404 - DNA, 22 bp, Homo sapiens
aactcactcagtttatgctgtg

SEQ ID NO: 3606405 - DNA, 15 bp, Homo sapiens
aactcaggcaaagaa

SEQ ID NO: 3606406 - DNA, 10 bp, Homo sapiens
aactccaggc

SEQ ID NO: 3606407 - DNA, 19 bp, Homo sapiens
aactccaggcatgtgtctg

SEQ ID NO: 3606408 - DNA, 19 bp, Homo sapiens
aactccatactccactcca

SEQ ID NO: 3606409 - DNA, 15 bp, Homo sapiens
aactccatgatattt

SEQ ID NO: 3606410 - DNA, 13 bp, Homo sapiens
aactcctggcctt

SEQ ID NO: 3606411 - DNA, 22 bp, Homo sapiens
aactcctgtcccttttccctta

SEQ ID NO: 3606412 - DNA, 16 bp, Homo sapiens
aactcggtgtccccac

SEQ ID NO: 3606413 - DNA, 12 bp, Homo sapiens
aactctctgaac

SEQ ID NO: 3606414 - DNA, 19 bp, Homo sapiens
aactctgttgcaagtgcaa

SEQ ID NO: 3606415 - DNA, 16 bp, Homo sapiens
aactcttctttgctgc

SEQ ID NO: 3606416 - DNA, 22 bp, Homo sapiens
aactcttggttcgatacctgga

SEQ ID NO: 3606417 - DNA, 13 bp, Homo sapiens
aactgaaagtgaa

SEQ ID NO: 3606418 - DNA, 10 bp, Homo sapiens
aactgaaatc

SEQ ID NO: 3606419 - DNA, 11 bp, Homo sapiens
aactgaaccaa

SEQ ID NO: 3606420 - DNA, 20 bp, Homo sapiens
aactgaatagcaagtggcat

SEQ ID NO: 3606421 - DNA, 21 bp, Homo sapiens
aactgacaattttacctattc

SEQ ID NO: 3606422 - DNA, 19 bp, Homo sapiens
aactgaccagcctccatgc

SEQ ID NO: 3606423 - DNA, 22 bp, Homo sapiens
aactgaccctcaggcacacctt

SEQ ID NO: 3606424 - DNA, 19 bp, Homo sapiens
aactgactgaaggaaaagc

SEQ ID NO: 3606425 - DNA, 14 bp, Homo sapiens
aactgagagaaaga

SEQ ID NO: 3606426 - DNA, 20 bp, Homo sapiens
aactgagatgtgaacacatc

SEQ ID NO: 3606427 - DNA, 12 bp, Homo sapiens
aactgaggaatt

SEQ ID NO: 3606428 - DNA, 22 bp, Homo sapiens
aactgaggagatgaccagggat

SEQ ID NO: 3606429 - DNA, 22 bp, Homo sapiens
aactgagtatgtgtaacaggat

SEQ ID NO: 3606430 - DNA, 18 bp, Homo sapiens
aactgcaaaaaaagcctc

SEQ ID NO: 3606431 - DNA, 20 bp, Homo sapiens
aactgcaaaaaaagcctcca

SEQ ID NO: 3606432 - DNA, 19 bp, Homo sapiens
aactgcactgtcaagatga

SEQ ID NO: 3606433 - DNA, 21 bp, Homo sapiens
aactgcagcctctctggctgg

SEQ ID NO: 3606434 - DNA, 22 bp, Homo sapiens
aactgcattgactttcagtaaa

SEQ ID NO: 3606435 - DNA, 17 bp, Homo sapiens
aactgccaggctgcctc

SEQ ID NO: 3606436 - DNA, 24 bp, Homo sapiens
aactgccaggctgcctcctgccct

SEQ ID NO: 3606437 - DNA, 18 bp, Homo sapiens
aagagctgttcacagcca

SEQ ID NO: 3606438 - DNA, 14 bp, Homo sapiens
aagagggcccagcc

SEQ ID NO: 3606439 - DNA, 16 bp, Homo sapiens
aagagggcccagccca

SEQ ID NO: 3606440 - DNA, 23 bp, Homo sapiens
aagagggcccagcccagagccac

SEQ ID NO: 3606441 - DNA, 17 bp, Homo sapiens
aagaggtctgattggct

SEQ ID NO: 3606442 - DNA, 18 bp, Homo sapiens
aagaggtctgattggctg

SEQ ID NO: 3606443 - DNA, 14 bp, Homo sapiens
aagagtcagacatt

SEQ ID NO: 3606444 - DNA, 15 bp, Homo sapiens
aagagtttaaacaaa

SEQ ID NO: 3606445 - DNA, 11 bp, Homo sapiens
aagataaatgc

SEQ ID NO: 3606446 - DNA, 19 bp, Homo sapiens
aagataaggtctgaataat

SEQ ID NO: 3606447 - DNA, 18 bp, Homo sapiens
aagatacaaaagcttttt

SEQ ID NO: 3606448 - DNA, 14 bp, Homo sapiens
aagatagcagggca

SEQ ID NO: 3606449 - DNA, 14 bp, Homo sapiens
aagatattatttgt

SEQ ID NO: 3606450 - DNA, 18 bp, Homo sapiens
aagatctgtcctcagcct

SEQ ID NO: 3606451 - DNA, 20 bp, Homo sapiens
aagatctgtcctcagccttg

SEQ ID NO: 3606452 - DNA, 14 bp, Homo sapiens
aagatgaaaaagaa

SEQ ID NO: 3606453 - DNA, 15 bp, Homo sapiens
aagatgaaaaagaat

SEQ ID NO: 3606454 - DNA, 20 bp, Homo sapiens
aagatgaaatttgataaact

SEQ ID NO: 3606455 - DNA, 16 bp, Homo sapiens
aagatgaatgtcagtt

SEQ ID NO: 3606456 - DNA, 16 bp, Homo sapiens
aagatgacctgcccca

SEQ ID NO: 3606457 - DNA, 22 bp, Homo sapiens
aagatgccagcttctctctcca

SEQ ID NO: 3606458 - DNA, 18 bp, Homo sapiens
aagatgcctgttaattta

SEQ ID NO: 3606459 - DNA, 21 bp, Homo sapiens
aagatggctgtgcctctgcct

SEQ ID NO: 3606460 - DNA, 17 bp, Homo sapiens
aagatgtacctggtgga

SEQ ID NO: 3606461 - DNA, 18 bp, Homo sapiens
aagatgtgcaaaatcact

SEQ ID NO: 3606462 - DNA, 15 bp, Homo sapiens
aagatgttctcctga

SEQ ID NO: 3606463 - DNA, 14 bp, Homo sapiens
aagatgtttacatt

SEQ ID NO: 3606464 - DNA, 18 bp, Homo sapiens
aagattaaatgtgtcatt

SEQ ID NO: 3606465 - DNA, 20 bp, Homo sapiens
aagattacaaatcagaagtc

SEQ ID NO: 3606466 - DNA, 13 bp, Homo sapiens
aagattatatgaa

SEQ ID NO: 3606467 - DNA, 20 bp, Homo sapiens
aagattcatatttacttctt

SEQ ID NO: 3606468 - DNA, 11 bp, Homo sapiens
aagattctatg

SEQ ID NO: 3606469 - DNA, 22 bp, Homo sapiens
aagattctatgttaatatttta

SEQ ID NO: 3606470 - DNA, 12 bp, Homo sapiens
aagatttaatat

SEQ ID NO: 3606471 - DNA, 13 bp, Homo sapiens
aagatttttttcc

SEQ ID NO: 3606472 - DNA, 17 bp, Homo sapiens
aagcaaacatcaaataa

SEQ ID NO: 3606473 - DNA, 13 bp, Homo sapiens
aagcaaagaaaat

SEQ ID NO: 3606474 - DNA, 15 bp, Homo sapiens
aagcaaatcagaaaa

SEQ ID NO: 3606475 - DNA, 12 bp, Homo sapiens
aagcaaattttg

SEQ ID NO: 3606476 - DNA, 20 bp, Homo sapiens
aagcaaattttgtattattg

SEQ ID NO: 3606477 - DNA, 15 bp, Homo sapiens
aagcaaccaaaaaga

SEQ ID NO: 3606478 - DNA, 19 bp, Homo sapiens
aagcaaccacactgcttgg

SEQ ID NO: 3606479 - DNA, 19 bp, Homo sapiens
aagcaaccatatagaaagc

SEQ ID NO: 3606480 - DNA, 17 bp, Homo sapiens
aagcaactgtgaattca

SEQ ID NO: 3606481 - DNA, 14 bp, Homo sapiens
aagcaagaaacagt

SEQ ID NO: 3606482 - DNA, 14 bp, Homo sapiens
aagcaatcctccta

SEQ ID NO: 3606483 - DNA, 17 bp, Homo sapiens
aagcaatcctcctacct

SEQ ID NO: 3606484 - DNA, 13 bp, Homo sapiens
aagcaatggttga

SEQ ID NO: 3606485 - DNA, 15 bp, Homo sapiens
aagcacaagactggc

SEQ ID NO: 3606486 - DNA, 13 bp, Homo sapiens
aagcacagccctt

SEQ ID NO: 3606487 - DNA, 14 bp, Homo sapiens
aagcaccaacctcc

SEQ ID NO: 3606488 - DNA, 18 bp, Homo sapiens
aagcaccaacctccagac

SEQ ID NO: 3606489 - DNA, 19 bp, Homo sapiens
aagcaccaacctccagact

SEQ ID NO: 3606490 - DNA, 16 bp, Homo sapiens
aagcactgacttctaa

SEQ ID NO: 3606491 - DNA, 13 bp, Homo sapiens
aagcagaaccttc

SEQ ID NO: 3606492 - DNA, 16 bp, Homo sapiens
aagcagacattttaaa

SEQ ID NO: 3606493 - DNA, 14 bp, Homo sapiens
aagcagagcctcct

SEQ ID NO: 3606494 - DNA, 15 bp, Homo sapiens
aagcagaggaggggc

SEQ ID NO: 3606495 - DNA, 14 bp, Homo sapiens
aagcagcaactatt

SEQ ID NO: 3606496 - DNA, 14 bp, Homo sapiens
aagcagcccttgct

SEQ ID NO: 3606497 - DNA, 13 bp, Homo sapiens
aagcagctctccc

SEQ ID NO: 3606498 - DNA, 14 bp, Homo sapiens
aagcagttcattct

SEQ ID NO: 3606499 - DNA, 17 bp, Homo sapiens
aagcagttcctgtccca

SEQ ID NO: 3606500 - DNA, 19 bp, Homo sapiens
aagcatctggctctaattc

SEQ ID NO: 3606501 - DNA, 19 bp, Homo sapiens
aagcattgtaaatgtgctt

SEQ ID NO: 3606502 - DNA, 11 bp, Homo sapiens
aagcatttcat

SEQ ID NO: 3606503 - DNA, 23 bp, Homo sapiens
aagcatttcatgaaaaagctgct

SEQ ID NO: 3606504 - DNA, 20 bp, Homo sapiens
aagcatttggtttttcacat

SEQ ID NO: 3606505 - DNA, 13 bp, Homo sapiens
aagcattttgtaa

SEQ ID NO: 3606506 - DNA, 17 bp, Homo sapiens
aagcattttgtaataat

SEQ ID NO: 3606507 - DNA, 17 bp, Homo sapiens
aagccaaagaaacaagc

SEQ ID NO: 3606508 - DNA, 18 bp, Homo sapiens
aagccaaagaaacaagct

SEQ ID NO: 3606509 - DNA, 16 bp, Homo sapiens
aagccacagcagagca

SEQ ID NO: 3606510 - DNA, 15 bp, Homo sapiens
aagccacatcttgct

SEQ ID NO: 3606511 - DNA, 17 bp, Homo sapiens
aagccacatcttgctct

SEQ ID NO: 3606512 - DNA, 18 bp, Homo sapiens
aagccacatcttgctctg

SEQ ID NO: 3606513 - DNA, 20 bp, Homo sapiens
aagccacatcttgctctgca

SEQ ID NO: 3606514 - DNA, 20 bp, Homo sapiens
aagccagccacagacccctg

SEQ ID NO: 3606515 - DNA, 21 bp, Homo sapiens
aagccaggaatttcccaggac

SEQ ID NO: 3606516 - DNA, 22 bp, Homo sapiens
aagccaggctcaggagaagcca

SEQ ID NO: 3606517 - DNA, 17 bp, Homo sapiens
aagccagtgtctaggca

SEQ ID NO: 3606518 - DNA, 16 bp, Homo sapiens
aagccatgtataaatg

SEQ ID NO: 3606519 - DNA, 20 bp, Homo sapiens
aagccatgtataaatgtgat

SEQ ID NO: 3606520 - DNA, 17 bp, Homo sapiens
aagccatttttacatct

SEQ ID NO: 3606521 - DNA, 15 bp, Homo sapiens
aagcccccagggcct

SEQ ID NO: 3606522 - DNA, 19 bp, Homo sapiens
aagccctgaatttcttctt

SEQ ID NO: 3606523 - DNA, 22 bp, Homo sapiens
aagccctgaatttcttcttttc

SEQ ID NO: 3606524 - DNA, 23 bp, Homo sapiens
aagcccttccatgtcgcctctgc

SEQ ID NO: 3606525 - DNA, 18 bp, Homo sapiens
aagccgcagacctggagc

SEQ ID NO: 3606526 - DNA, 21 bp, Homo sapiens
aagccggggtgtaacttcctg

SEQ ID NO: 3606527 - DNA, 18 bp, Homo sapiens
aagcctagatgttttata

SEQ ID NO: 3606528 - DNA, 18 bp, Homo sapiens
aagcctcaaaacaaaggc

SEQ ID NO: 3606529 - DNA, 16 bp, Homo sapiens
aagcctcatgccaacc

SEQ ID NO: 3606530 - DNA, 15 bp, Homo sapiens
aagcctctaaacaga

SEQ ID NO: 3606531 - DNA, 15 bp, Homo sapiens
aagcgggcagccccg

SEQ ID NO: 3606532 - DNA, 17 bp, Homo sapiens
aagctaaggtttagata

SEQ ID NO: 3606533 - DNA, 14 bp, Homo sapiens
aagctaggaatgaa

SEQ ID NO: 3606534 - DNA, 22 bp, Homo sapiens
aagctaggccccagaggccctg

SEQ ID NO: 3606535 - DNA, 13 bp, Homo sapiens
aagctcctcctcc

SEQ ID NO: 3606536 - DNA, 15 bp, Homo sapiens
aagctcctcctccct

SEQ ID NO: 3606537 - DNA, 17 bp, Homo sapiens
aagctcctcctccctgc

SEQ ID NO: 3606538 - DNA, 22 bp, Homo sapiens
aagctctccgagctctggtgct

SEQ ID NO: 3606539 - DNA, 18 bp, Homo sapiens
aagctgagagaccctggc

SEQ ID NO: 3606540 - DNA, 19 bp, Homo sapiens
aagctgagagaccctggcc

SEQ ID NO: 3606541 - DNA, 20 bp, Homo sapiens
aagctgagagaccctggcct

SEQ ID NO: 3606542 - DNA, 21 bp, Homo sapiens
aagctgagagaccctggcctc

SEQ ID NO: 3606543 - DNA, 23 bp, Homo sapiens
aagctgcctcccctctccttcct

SEQ ID NO: 3606544 - DNA, 15 bp, Homo sapiens
aagctgctgcagctc

SEQ ID NO: 3606545 - DNA, 22 bp, Homo sapiens
aagctgctgcagctccctcctc

SEQ ID NO: 3606546 - DNA, 19 bp, Homo sapiens
aagctgctgtgtcctctag

SEQ ID NO: 3606547 - DNA, 11 bp, Homo sapiens
aagctgtcaca

SEQ ID NO: 3606548 - DNA, 13 bp, Homo sapiens
aagctgtgcaggc

SEQ ID NO: 3606549 - DNA, 20 bp, Homo sapiens
aagctgtgttgaaacagaaa

SEQ ID NO: 3606550 - DNA, 16 bp, Homo sapiens
aagctgttatttcttc

SEQ ID NO: 3606551 - DNA, 17 bp, Homo sapiens
aagctgttatttcttcc

SEQ ID NO: 3606552 - DNA, 21 bp, Homo sapiens
aagctgttatttcttccctgc

SEQ ID NO: 3606553 - DNA, 18 bp, Homo sapiens
aagcttattaaaactcat

SEQ ID NO: 3606554 - DNA, 18 bp, Homo sapiens
aagcttcaaactgcatga

SEQ ID NO: 3606555 - DNA, 18 bp, Homo sapiens
aagcttccatgatgcaca

SEQ ID NO: 3606556 - DNA, 16 bp, Homo sapiens
aagctttattaccagt

SEQ ID NO: 3606557 - DNA, 21 bp, Homo sapiens
aagctttattaccagtggcgt

SEQ ID NO: 3606558 - DNA, 21 bp, Homo sapiens
aagctttgccgcttttgtgcc

SEQ ID NO: 3606559 - DNA, 20 bp, Homo sapiens
aagctttggtttatggtttt

SEQ ID NO: 3606560 - DNA, 13 bp, Homo sapiens
aagcttttggaag

SEQ ID NO: 3606561 - DNA, 22 bp, Homo sapiens
aaggaaaactatgtattaattt

SEQ ID NO: 3606562 - DNA, 16 bp, Homo sapiens
aaggaaaagcaagaaa

SEQ ID NO: 3606563 - DNA, 20 bp, Homo sapiens
aaggaaagaagggggccctg

SEQ ID NO: 3606564 - DNA, 13 bp, Homo sapiens
aaggaacaaaaat

SEQ ID NO: 3606565 - DNA, 14 bp, Homo sapiens
aaggaagctgtgtt

SEQ ID NO: 3606566 - DNA, 21 bp, Homo sapiens
aaggaagctgtgttgaaacag

SEQ ID NO: 3606567 - DNA, 13 bp, Homo sapiens
aaggacaggaccc

SEQ ID NO: 3606568 - DNA, 18 bp, Homo sapiens
aaggacaggaccctcagg

SEQ ID NO: 3606569 - DNA, 17 bp, Homo sapiens
aaggacatcagcaaaca

SEQ ID NO: 3606570 - DNA, 21 bp, Homo sapiens
aaggacccggaggggcctggc

SEQ ID NO: 3606571 - DNA, 15 bp, Homo sapiens
aaggactccaatgtc

SEQ ID NO: 3606572 - DNA, 20 bp, Homo sapiens
aaggacttcctgtccagctc

SEQ ID NO: 3606573 - DNA, 22 bp, Homo sapiens
aaggacttcctgtccagctcca

SEQ ID NO: 3606574 - DNA, 15 bp, Homo sapiens
aaggacttgtttccc

SEQ ID NO: 3606575 - DNA, 13 bp, Homo sapiens
aaggagcaagaaa

SEQ ID NO: 3606576 - DNA, 18 bp, Homo sapiens
aaggagcatccttggcag

SEQ ID NO: 3606577 - DNA, 12 bp, Homo sapiens
aaggagctgcta

SEQ ID NO: 3606578 - DNA, 14 bp, Homo sapiens
aaggagctgctata

SEQ ID NO: 3606579 - DNA, 20 bp, Homo sapiens
aaggaggtgggccacaccca

SEQ ID NO: 3606580 - DNA, 13 bp, Homo sapiens
aaggataaagaag

SEQ ID NO: 3606581 - DNA, 15 bp, Homo sapiens
aaggatagatgctgg

SEQ ID NO: 3606582 - DNA, 17 bp, Homo sapiens
aaggatagtgtgaagat

SEQ ID NO: 3606583 - DNA, 18 bp, Homo sapiens
aaggatctgtgattggct

SEQ ID NO: 3606584 - DNA, 12 bp, Homo sapiens
aaggattacaga

SEQ ID NO: 3606585 - DNA, 14 bp, Homo sapiens
aaggattacagaaa

SEQ ID NO: 3606586 - DNA, 17 bp, Homo sapiens
aaggattacagaaactg

SEQ ID NO: 3606587 - DNA, 20 bp, Homo sapiens
aaggattacagaaactgatg

SEQ ID NO: 3606588 - DNA, 23 bp, Homo sapiens
aaggattacagaaactgatgcca

SEQ ID NO: 3606589 - DNA, 13 bp, Homo sapiens
aaggattttacca

SEQ ID NO: 3606590 - DNA, 18 bp, Homo sapiens
aaggcaaggccctgccct

SEQ ID NO: 3606591 - DNA, 16 bp, Homo sapiens
aaggcacagtgggagc

SEQ ID NO: 3606592 - DNA, 17 bp, Homo sapiens
aaggcagcgaccccagg

SEQ ID NO: 3606593 - DNA, 12 bp, Homo sapiens
aaggcaggtgct

SEQ ID NO: 3606594 - DNA, 18 bp, Homo sapiens
aaggcagtggcaggggag

SEQ ID NO: 3606595 - DNA, 15 bp, Homo sapiens
aaggcattctcccag

SEQ ID NO: 3606596 - DNA, 18 bp, Homo sapiens
aaggcattctcccagctc

SEQ ID NO: 3606597 - DNA, 16 bp, Homo sapiens
aaggccaaaatcaaga

SEQ ID NO: 3606598 - DNA, 15 bp, Homo sapiens
aaggccagagaggga

SEQ ID NO: 3606599 - DNA, 24 bp, Homo sapiens
aaggccagccttgtacagtctgct

SEQ ID NO: 3606600 - DNA, 20 bp, Homo sapiens
aaggccaggacgggccacac

SEQ ID NO: 3606601 - DNA, 15 bp, Homo sapiens
aaggcccactgtaat

SEQ ID NO: 3606602 - DNA, 17 bp, Homo sapiens
aaggccccagagagacc

SEQ ID NO: 3606603 - DNA, 16 bp, Homo sapiens
aaggcccttagaggga

SEQ ID NO: 3606604 - DNA, 18 bp, Homo sapiens
aaggcccttagagggaat

SEQ ID NO: 3606605 - DNA, 21 bp, Homo sapiens
aaggctaattttttatccttt

SEQ ID NO: 3606606 - DNA, 20 bp, Homo sapiens
aaggctacaacaaaaatcac

SEQ ID NO: 3606607 - DNA, 23 bp, Homo sapiens
aaggctatggggatagatgtgtg

SEQ ID NO: 3606608 - DNA, 17 bp, Homo sapiens
aaggctctcccctctcg

SEQ ID NO: 3606609 - DNA, 23 bp, Homo sapiens
aaggctctcccctctcgccccat

SEQ ID NO: 3606610 - DNA, 23 bp, Homo sapiens
aaggctctgagcaaatgtggctc

SEQ ID NO: 3606611 - DNA, 22 bp, Homo sapiens
aaggctgacagactcactggga

SEQ ID NO: 3606612 - DNA, 20 bp, Homo sapiens
aaggctgaggcaggagaatc

SEQ ID NO: 3606613 - DNA, 20 bp, Homo sapiens
aaggctgataatatgacaaa

SEQ ID NO: 3606614 - DNA, 22 bp, Homo sapiens
aaggctggtgaggtcctggtgc

SEQ ID NO: 3606615 - DNA, 19 bp, Homo sapiens
aaggctgtacatagtcctt

SEQ ID NO: 3606616 - DNA, 16 bp, Homo sapiens
aaggctttaaagctga

SEQ ID NO: 3606617 - DNA, 17 bp, Homo sapiens
aagggaaactgccagca

SEQ ID NO: 3606618 - DNA, 17 bp, Homo sapiens
aagggaaagcctctggc

SEQ ID NO: 3606619 - DNA, 17 bp, Homo sapiens
aagggaaagcgggcagc

SEQ ID NO: 3606620 - DNA, 20 bp, Homo sapiens
aagggaaagcgggcagcccc

SEQ ID NO: 3606621 - DNA, 18 bp, Homo sapiens
aagggactacctctgtgc

SEQ ID NO: 3606622 - DNA, 20 bp, Homo sapiens
aagggactacctctgtgcct

SEQ ID NO: 3606623 - DNA, 14 bp, Homo sapiens
aagggagccaaggg

SEQ ID NO: 3606624 - DNA, 19 bp, Homo sapiens
aagggagccaagggatgga

SEQ ID NO: 3606625 - DNA, 16 bp, Homo sapiens
aagggatggacatctt

SEQ ID NO: 3606626 - DNA, 17 bp, Homo sapiens
aagggatggacatcttg

SEQ ID NO: 3606627 - DNA, 22 bp, Homo sapiens
aagggatggacttgtgattggc

SEQ ID NO: 3606628 - DNA, 14 bp, Homo sapiens
aagggatggcaaga

SEQ ID NO: 3606629 - DNA, 16 bp, Homo sapiens
aagggcagggcccacg

SEQ ID NO: 3606630 - DNA, 13 bp, Homo sapiens
aagggcagtgccc

SEQ ID NO: 3606631 - DNA, 15 bp, Homo sapiens
aagggcataaagtaa

SEQ ID NO: 3606632 - DNA, 18 bp, Homo sapiens
aagggcccacacctggtg

SEQ ID NO: 3606633 - DNA, 19 bp, Homo sapiens
aagggcccacacctggtgg

SEQ ID NO: 3606634 - DNA, 12 bp, Homo sapiens
aagggccctggc

SEQ ID NO: 3606635 - DNA, 20 bp, Homo sapiens
aagggctttggttccttctc

SEQ ID NO: 3606636 - DNA, 22 bp, Homo sapiens
aagggctttggttccttctctg

SEQ ID NO: 3606637 - DNA, 21 bp, Homo sapiens
aaggggaggcacactttctgg

SEQ ID NO: 3606638 - DNA, 23 bp, Homo sapiens
aaggggaggcacactttctggca

SEQ ID NO: 3606639 - DNA, 12 bp, Homo sapiens
aagggggccctg

SEQ ID NO: 3606640 - DNA, 14 bp, Homo sapiens
aagggggccctgct

SEQ ID NO: 3606641 - DNA, 15 bp, Homo sapiens
aagggggccctgcta

SEQ ID NO: 3606642 - DNA, 22 bp, Homo sapiens
aagggggccgccaccctcccct

SEQ ID NO: 3606643 - DNA, 15 bp, Homo sapiens
aagggggctgctgct

SEQ ID NO: 3606644 - DNA, 15 bp, Homo sapiens
aagggggtagggaaa

SEQ ID NO: 3606645 - DNA, 12 bp, Homo sapiens
aaggggttttct

SEQ ID NO: 3606646 - DNA, 13 bp, Homo sapiens
aaggggttttctt

SEQ ID NO: 3606647 - DNA, 21 bp, Homo sapiens
aagggttaatcatatttgaaa

SEQ ID NO: 3606648 - DNA, 20 bp, Homo sapiens
aagggtttcgactggtccag

SEQ ID NO: 3606649 - DNA, 18 bp, Homo sapiens
aaggtactttcatatttt

SEQ ID NO: 3606650 - DNA, 22 bp, Homo sapiens
aaggtattaaattgatgttgct

SEQ ID NO: 3606651 - DNA, 19 bp, Homo sapiens
aaggtctaatcagtgatta

SEQ ID NO: 3606652 - DNA, 13 bp, Homo sapiens
aaggtctttggtt

SEQ ID NO: 3606653 - DNA, 13 bp, Homo sapiens
aaggtgcactcca

SEQ ID NO: 3606654 - DNA, 18 bp, Homo sapiens
aaggtgcactccagactc

SEQ ID NO: 3606655 - DNA, 22 bp, Homo sapiens
aaggtgcactccagactctggg

SEQ ID NO: 3606656 - DNA, 21 bp, Homo sapiens
aaggtgccaccaccctgcccc

SEQ ID NO: 3606657 - DNA, 19 bp, Homo sapiens
aaggttgagtatgtgaaga

SEQ ID NO: 3606658 - DNA, 21 bp, Homo sapiens
aaggtttaggctggtggccca

SEQ ID NO: 3606659 - DNA, 14 bp, Homo sapiens
aagtaaaaccacag

SEQ ID NO: 3606660 - DNA, 17 bp, Homo sapiens
aagtaaaaccacagcag

SEQ ID NO: 3606661 - DNA, 15 bp, Homo sapiens
aagtaaaagaaaagc

SEQ ID NO: 3606662 - DNA, 18 bp, Homo sapiens
aagtaaatacatgcatat

SEQ ID NO: 3606663 - DNA, 19 bp, Homo sapiens
aagtaacttttaaaatttg

SEQ ID NO: 3606664 - DNA, 22 bp, Homo sapiens
aagtaagtgaactaccatgctt

SEQ ID NO: 3606665 - DNA, 21 bp, Homo sapiens
aagtaagtttatccaaatctt

SEQ ID NO: 3606666 - DNA, 21 bp, Homo sapiens
aagtaatccacctgcctcggc

SEQ ID NO: 3606667 - DNA, 13 bp, Homo sapiens
aagtacatattta

SEQ ID NO: 3606668 - DNA, 21 bp, Homo sapiens
aagtacatatttattttcttt

SEQ ID NO: 3606669 - DNA, 18 bp, Homo sapiens
aagtactacacattttta

SEQ ID NO: 3606670 - DNA, 17 bp, Homo sapiens
aagtacttccctcaggc

SEQ ID NO: 3606671 - DNA, 22 bp, Homo sapiens
aagtacttggcccccttcagga

SEQ ID NO: 3606672 - DNA, 18 bp, Homo sapiens
aagtatcctgcttctgat

SEQ ID NO: 3606673 - DNA, 14 bp, Homo sapiens
aagtattaagcagt

SEQ ID NO: 3606674 - DNA, 21 bp, Homo sapiens
aagtattcatacaccttgcta

SEQ ID NO: 3606675 - DNA, 15 bp, Homo sapiens
aagtatttaaatgtt

SEQ ID NO: 3606676 - DNA, 15 bp, Homo sapiens
aagtattttcctgtt

SEQ ID NO: 3606677 - DNA, 16 bp, Homo sapiens
aagtcaaaaggaacaa

SEQ ID NO: 3606678 - DNA, 16 bp, Homo sapiens
aagtcacccctttctg

SEQ ID NO: 3606679 - DNA, 23 bp, Homo sapiens
aagtcacccctttctgtcccact

SEQ ID NO: 3606680 - DNA, 17 bp, Homo sapiens
aagtcactcccaagccc

SEQ ID NO: 3606681 - DNA, 14 bp, Homo sapiens
aagtcactgcacag

SEQ ID NO: 3606682 - DNA, 22 bp, Homo sapiens
aagtcactgcacagtgcatctc

SEQ ID NO: 3606683 - DNA, 21 bp, Homo sapiens
aagtcactggccagtggctgg

SEQ ID NO: 3606684 - DNA, 23 bp, Homo sapiens
aagtcagatggaaaattcatttt

SEQ ID NO: 3606685 - DNA, 17 bp, Homo sapiens
aagtcaggctagctgtg

SEQ ID NO: 3606686 - DNA, 18 bp, Homo sapiens
aagtcaggctagctgtgc

SEQ ID NO: 3606687 - DNA, 23 bp, Homo sapiens
aagtcagtccaggatgctaacat

SEQ ID NO: 3606688 - DNA, 23 bp, Homo sapiens
aagtcatcttgctaccagtattt

SEQ ID NO: 3606689 - DNA, 16 bp, Homo sapiens
aagtcattggcaaagt

SEQ ID NO: 3606690 - DNA, 24 bp, Homo sapiens
aagtcattgtttcccatcactgta

SEQ ID NO: 3606691 - DNA, 21 bp, Homo sapiens
aagtccagctgggaagccctt

SEQ ID NO: 3606692 - DNA, 20 bp, Homo sapiens
aagtcctaacttcctgtgcc

SEQ ID NO: 3606693 - DNA, 20 bp, Homo sapiens
aagtccttcagtgagcccct

SEQ ID NO: 3606694 - DNA, 12 bp, Homo sapiens
aagtctgggcca

SEQ ID NO: 3606695 - DNA, 20 bp, Homo sapiens
aagtctgttgattaaagatg

SEQ ID NO: 3606696 - DNA, 20 bp, Homo sapiens
aagtcttggttttatcttaa

SEQ ID NO: 3606697 - DNA, 19 bp, Homo sapiens
aagtgaaataacaaaatgg

SEQ ID NO: 3606698 - DNA, 15 bp, Homo sapiens
aagtgaatattttaa

SEQ ID NO: 3606699 - DNA, 14 bp, Homo sapiens
aagtgactctcctg

SEQ ID NO: 3606700 - DNA, 20 bp, Homo sapiens
aagtgagtggtgtgactctt

SEQ ID NO: 3606701 - DNA, 15 bp, Homo sapiens
aagtgatttttggtc

SEQ ID NO: 3606702 - DNA, 12 bp, Homo sapiens
aagtgcagtcag

SEQ ID NO: 3606703 - DNA, 16 bp, Homo sapiens
aagtgccccaccactc

SEQ ID NO: 3606704 - DNA, 15 bp, Homo sapiens
aagtgcctgggctca

SEQ ID NO: 3606705 - DNA, 20 bp, Homo sapiens
aagtgcctgggctcagcctg

SEQ ID NO: 3606706 - DNA, 21 bp, Homo sapiens
aagtgctcttggctgacccct

SEQ ID NO: 3606707 - DNA, 23 bp, Homo sapiens
aagtgctgctgtggagtgaggtg

SEQ ID NO: 3606708 - DNA, 20 bp, Homo sapiens
aagtgctgtttattaatctt

SEQ ID NO: 3606709 - DNA, 21 bp, Homo sapiens
aagtgctgtttattaatctta

SEQ ID NO: 3606710 - DNA, 22 bp, Homo sapiens
aagtgctgtttattaatcttag

SEQ ID NO: 3606711 - DNA, 12 bp, Homo sapiens
aagtggctgcct

SEQ ID NO: 3606712 - DNA, 19 bp, Homo sapiens
aagtgggaggtcaggaaac

SEQ ID NO: 3606713 - DNA, 19 bp, Homo sapiens
aagtgggtgggtagattta

SEQ ID NO: 3606714 - DNA, 19 bp, Homo sapiens
aagtggtaattgggaactg

SEQ ID NO: 3606715 - DNA, 23 bp, Homo sapiens
aagtggtctgtggatcagcattt

SEQ ID NO: 3606716 - DNA, 18 bp, Homo sapiens
aagtggtggtaaccctgg

SEQ ID NO: 3606717 - DNA, 12 bp, Homo sapiens
aagtgtgaagac

SEQ ID NO: 3606718 - DNA, 18 bp, Homo sapiens
aagtgtgggtctgtgtgt

SEQ ID NO: 3606719 - DNA, 15 bp, Homo sapiens
aagtgtttatgttgt

SEQ ID NO: 3606720 - DNA, 13 bp, Homo sapiens
aagttaaaattgt

SEQ ID NO: 3606721 - DNA, 12 bp, Homo sapiens
aagttaaataaa

SEQ ID NO: 3606722 - DNA, 19 bp, Homo sapiens
aagttagttccactgagac

SEQ ID NO: 3606723 - DNA, 14 bp, Homo sapiens
aagttagtttcagt

SEQ ID NO: 3606724 - DNA, 14 bp, Homo sapiens
aagttatctttgaa

SEQ ID NO: 3606725 - DNA, 15 bp, Homo sapiens
aagttatctttgaat

SEQ ID NO: 3606726 - DNA, 18 bp, Homo sapiens
aagttatttatgctataa

SEQ ID NO: 3606727 - DNA, 13 bp, Homo sapiens
aagttattttatg

SEQ ID NO: 3606728 - DNA, 11 bp, Homo sapiens
aagttcaaact

SEQ ID NO: 3606729 - DNA, 13 bp, Homo sapiens
aagttcatcttgc

SEQ ID NO: 3606730 - DNA, 16 bp, Homo sapiens
aagttcatcttgcagc

SEQ ID NO: 3606731 - DNA, 23 bp, Homo sapiens
aagttcatgttggccatggtgaa

SEQ ID NO: 3606732 - DNA, 14 bp, Homo sapiens
aagttccaagtcca

SEQ ID NO: 3606733 - DNA, 14 bp, Homo sapiens
aagttccctacttc

SEQ ID NO: 3606734 - DNA, 17 bp, Homo sapiens
aagttccctacttcctg

SEQ ID NO: 3606735 - DNA, 18 bp, Homo sapiens
aagttctaggcatacttt

SEQ ID NO: 3606736 - DNA, 22 bp, Homo sapiens
aagttctattttactgtcttga

SEQ ID NO: 3606737 - DNA, 12 bp, Homo sapiens
aagttgaccttt

SEQ ID NO: 3606738 - DNA, 20 bp, Homo sapiens
aagttgacctttatttatta

SEQ ID NO: 3606739 - DNA, 16 bp, Homo sapiens
aagttgacttatagta

SEQ ID NO: 3606740 - DNA, 20 bp, Homo sapiens
aagttgacttatagtacatg

SEQ ID NO: 3606741 - DNA, 18 bp, Homo sapiens
aagttgaggattgttgaa

SEQ ID NO: 3606742 - DNA, 21 bp, Homo sapiens
aagtttattgtttgatgtttt

SEQ ID NO: 3606743 - DNA, 23 bp, Homo sapiens
aagtttctaatgttattttcctt

SEQ ID NO: 3606744 - DNA, 11 bp, Homo sapiens
aagtttgctgt

SEQ ID NO: 3606745 - DNA, 19 bp, Homo sapiens
aagtttgtagttgttttaa

SEQ ID NO: 3606746 - DNA, 16 bp, Homo sapiens
aagttttaacttccag

SEQ ID NO: 3606747 - DNA, 18 bp, Homo sapiens
aagttttaacttccagtg

SEQ ID NO: 3606748 - DNA, 21 bp, Homo sapiens
aagttttaacttccagtggct

SEQ ID NO: 3606749 - DNA, 18 bp, Homo sapiens
aagttttattataaattc

SEQ ID NO: 3606750 - DNA, 14 bp, Homo sapiens
aagttttggcagcc

SEQ ID NO: 3606751 - DNA, 17 bp, Homo sapiens
aagtttttgaaatacct

SEQ ID NO: 3606752 - DNA, 18 bp, Homo sapiens
aagtttttgaaatacctt

SEQ ID NO: 3606753 - DNA, 15 bp, Homo sapiens
aataaaaagcctctt

SEQ ID NO: 3606754 - DNA, 22 bp, Homo sapiens
aataaaagtggtaattgggaac

SEQ ID NO: 3606755 - DNA, 15 bp, Homo sapiens
aataaaatatatctt

SEQ ID NO: 3606756 - DNA, 20 bp, Homo sapiens
aataaaatatatcttataaa

SEQ ID NO: 3606757 - DNA, 13 bp, Homo sapiens
aataaacaaataa

SEQ ID NO: 3606758 - DNA, 21 bp, Homo sapiens
aataaacactgttttatagaa

SEQ ID NO: 3606759 - DNA, 13 bp, Homo sapiens
aataaaccaaata

SEQ ID NO: 3606760 - DNA, 11 bp, Homo sapiens
aataaactctc

SEQ ID NO: 3606761 - DNA, 23 bp, Homo sapiens
aataaactggtatgaataattgc

SEQ ID NO: 3606762 - DNA, 14 bp, Homo sapiens
aataaacttacaga

SEQ ID NO: 3606763 - DNA, 12 bp, Homo sapiens
aataaagaaaaa

SEQ ID NO: 3606764 - DNA, 11 bp, Homo sapiens
aataaagacag

SEQ ID NO: 3606765 - DNA, 12 bp, Homo sapiens
aataaagacagg

SEQ ID NO: 3606766 - DNA, 15 bp, Homo sapiens
aataaagagaaatat

SEQ ID NO: 3606767 - DNA, 11 bp, Homo sapiens
aataaagagga

SEQ ID NO: 3606768 - DNA, 18 bp, Homo sapiens
aataaagatacaaaatgt

SEQ ID NO: 3606769 - DNA, 12 bp, Homo sapiens
aataaagcagtt

SEQ ID NO: 3606770 - DNA, 16 bp, Homo sapiens
aataaagcttttggaa

SEQ ID NO: 3606771 - DNA, 18 bp, Homo sapiens
aataaaggcagttttcta

SEQ ID NO: 3606772 - DNA, 14 bp, Homo sapiens
aataaataaagctt

SEQ ID NO: 3606773 - DNA, 16 bp, Homo sapiens
aataaataattttcat

SEQ ID NO: 3606774 - DNA, 12 bp, Homo sapiens
aataaatactgc

SEQ ID NO: 3606775 - DNA, 21 bp, Homo sapiens
aataaatcattcttactaaaa

SEQ ID NO: 3606776 - DNA, 20 bp, Homo sapiens
aataaatcttagtgttcaaa

SEQ ID NO: 3606777 - DNA, 14 bp, Homo sapiens
aataaatctttcaa

SEQ ID NO: 3606778 - DNA, 15 bp, Homo sapiens
aataaatctttcaaa

SEQ ID NO: 3606779 - DNA, 22 bp, Homo sapiens
aataaatgaaacttggccagtt

SEQ ID NO: 3606780 - DNA, 23 bp, Homo sapiens
aataaatggcccggacatgtctt

SEQ ID NO: 3606781 - DNA, 13 bp, Homo sapiens
aataaatgtcact

SEQ ID NO: 3606782 - DNA, 14 bp, Homo sapiens
aataaatgtcttgc

SEQ ID NO: 3606783 - DNA, 14 bp, Homo sapiens
aataaattatttgt

SEQ ID NO: 3606784 - DNA, 12 bp, Homo sapiens
aataaattctaa

SEQ ID NO: 3606785 - DNA, 13 bp, Homo sapiens
aataaatttctgg

SEQ ID NO: 3606786 - DNA, 21 bp, Homo sapiens
aataaatttctgggatattta

SEQ ID NO: 3606787 - DNA, 22 bp, Homo sapiens
aataaatttctgggatatttaa

SEQ ID NO: 3606788 - DNA, 14 bp, Homo sapiens
aataacaaaatgga

SEQ ID NO: 3606789 - DNA, 22 bp, Homo sapiens
aataactagcttcttataatga

SEQ ID NO: 3606790 - DNA, 15 bp, Homo sapiens
aataactgaaccaaa

SEQ ID NO: 3606791 - DNA, 16 bp, Homo sapiens
aataactgaaccaaat

SEQ ID NO: 3606792 - DNA, 13 bp, Homo sapiens
aataacttgcatc

SEQ ID NO: 3606793 - DNA, 17 bp, Homo sapiens
aataagtgccaggatgg

SEQ ID NO: 3606794 - DNA, 13 bp, Homo sapiens
aataagtttcata

SEQ ID NO: 3606795 - DNA, 15 bp, Homo sapiens
aataataaaaagcaa

SEQ ID NO: 3606796 - DNA, 14 bp, Homo sapiens
aataatccaccccc

SEQ ID NO: 3606797 - DNA, 15 bp, Homo sapiens
aataatccatgaaag

SEQ ID NO: 3606798 - DNA, 12 bp, Homo sapiens
aataatgaagta

SEQ ID NO: 3606799 - DNA, 12 bp, Homo sapiens
aataatgctgca

SEQ ID NO: 3606800 - DNA, 18 bp, Homo sapiens
aataatgggtttctttca

SEQ ID NO: 3606801 - DNA, 19 bp, Homo sapiens
aataatgttaacatggaca

SEQ ID NO: 3606802 - DNA, 13 bp, Homo sapiens
aataatttccttc

SEQ ID NO: 3606803 - DNA, 14 bp, Homo sapiens
aataatttccttca

SEQ ID NO: 3606804 - DNA, 23 bp, Homo sapiens
aatacactcatggggaagcttcc

SEQ ID NO: 3606805 - DNA, 15 bp, Homo sapiens
aatacagactggatg

SEQ ID NO: 3606806 - DNA, 21 bp, Homo sapiens
aatacagcctatagtaaatgt

SEQ ID NO: 3606807 - DNA, 15 bp, Homo sapiens
aatacatgcatataa

SEQ ID NO: 3606808 - DNA, 14 bp, Homo sapiens
aatacatttaaaac

SEQ ID NO: 3606809 - DNA, 17 bp, Homo sapiens
aatacatttaaaacatt

SEQ ID NO: 3606810 - DNA, 20 bp, Homo sapiens
aatacatttaaaacattaaa

SEQ ID NO: 3606811 - DNA, 18 bp, Homo sapiens
aatacctctaataaacac

SEQ ID NO: 3606812 - DNA, 22 bp, Homo sapiens
aataccttctatgtattagtgt

SEQ ID NO: 3606813 - DNA, 14 bp, Homo sapiens
aatacctttgtagt

SEQ ID NO: 3606814 - DNA, 20 bp, Homo sapiens
aatacgtgatctctgttaca

SEQ ID NO: 3606815 - DNA, 19 bp, Homo sapiens
aatacgtgtcaaaaaagaa

SEQ ID NO: 3606816 - DNA, 21 bp, Homo sapiens
aatactaagaccctaattctt

SEQ ID NO: 3606817 - DNA, 15 bp, Homo sapiens
aatacttattttcag

SEQ ID NO: 3606818 - DNA, 14 bp, Homo sapiens
aatacttccagaag

SEQ ID NO: 3606819 - DNA, 16 bp, Homo sapiens
aatagaataaaggcag

SEQ ID NO: 3606820 - DNA, 16 bp, Homo sapiens
aatagacagcatgaga

SEQ ID NO: 3606821 - DNA, 16 bp, Homo sapiens
aatagacttaaatctc

SEQ ID NO: 3606822 - DNA, 16 bp, Homo sapiens
aatagatgctgactgt

SEQ ID NO: 3606823 - DNA, 21 bp, Homo sapiens
aatagcaagtggcataaagca

SEQ ID NO: 3606824 - DNA, 23 bp, Homo sapiens
aatagcagaaaaaccaacatcta

SEQ ID NO: 3606825 - DNA, 14 bp, Homo sapiens
aatagcattatctt

SEQ ID NO: 3606826 - DNA, 15 bp, Homo sapiens
aatagcattatctta

SEQ ID NO: 3606827 - DNA, 23 bp, Homo sapiens
aatagccactgcataccaacctg

SEQ ID NO: 3606828 - DNA, 14 bp, Homo sapiens
aataggcattttaa

SEQ ID NO: 3606829 - DNA, 16 bp, Homo sapiens
aataggcattttaagt

SEQ ID NO: 3606830 - DNA, 14 bp, Homo sapiens
aataggcctattta

SEQ ID NO: 3606831 - DNA, 15 bp, Homo sapiens
aataggtcatatgtt

SEQ ID NO: 3606832 - DNA, 17 bp, Homo sapiens
aataggtctttctctca

SEQ ID NO: 3606833 - DNA, 19 bp, Homo sapiens
aataggtctttctctcagt

SEQ ID NO: 3606834 - DNA, 11 bp, Homo sapiens
aatagtacatg

SEQ ID NO: 3606835 - DNA, 22 bp, Homo sapiens
aatagtagatgtggcctttgaa

SEQ ID NO: 3606836 - DNA, 18 bp, Homo sapiens
aatagtatcctccaggtt

SEQ ID NO: 3606837 - DNA, 17 bp, Homo sapiens
aatagtatgaaaatgga

SEQ ID NO: 3606838 - DNA, 22 bp, Homo sapiens
aatagtttttcactttgtgtat

SEQ ID NO: 3606839 - DNA, 23 bp, Homo sapiens
aatagtttttcactttgtgtatt

SEQ ID NO: 3606840 - DNA, 14 bp, Homo sapiens
aatataataatgat

SEQ ID NO: 3606841 - DNA, 21 bp, Homo sapiens
aatatagatcagttataagta

SEQ ID NO: 3606842 - DNA, 23 bp, Homo sapiens
aatatagatgtaatttttcaaaa

SEQ ID NO: 3606843 - DNA, 18 bp, Homo sapiens
aatatatctgttggagaa

SEQ ID NO: 3606844 - DNA, 23 bp, Homo sapiens
aatatatctgttggagaaagaaa

SEQ ID NO: 3606845 - DNA, 21 bp, Homo sapiens
aatatatcttataaagtggaa

SEQ ID NO: 3606846 - DNA, 14 bp, Homo sapiens
aatatatttgtcac

SEQ ID NO: 3606847 - DNA, 15 bp, Homo sapiens
aatatattttctctt

SEQ ID NO: 3606848 - DNA, 24 bp, Homo sapiens
aatatcaaagagaagatgcctgtt

SEQ ID NO: 3606849 - DNA, 21 bp, Homo sapiens
aatatcaaagtcattaaagac

SEQ ID NO: 3606850 - DNA, 19 bp, Homo sapiens
aatatcaccaaaaacctat

SEQ ID NO: 3606851 - DNA, 23 bp, Homo sapiens
aatatcaccaaaaacctattcca

SEQ ID NO: 3606852 - DNA, 21 bp, Homo sapiens
aatatcccagaaaaagtaact

SEQ ID NO: 3606853 - DNA, 23 bp, Homo sapiens
aatatcccttggacattttatgt

SEQ ID NO: 3606854 - DNA, 12 bp, Homo sapiens
aatatcctttgc

SEQ ID NO: 3606855 - DNA, 17 bp, Homo sapiens
aatatgagtacaaatgc

SEQ ID NO: 3606856 - DNA, 21 bp, Homo sapiens
aatatgagtacaaatgcctta

SEQ ID NO: 3606857 - DNA, 15 bp, Homo sapiens
aatatgcaaagcact

SEQ ID NO: 3606858 - DNA, 24 bp, Homo sapiens
aatatgcaaagcactgacttctaa

SEQ ID NO: 3606859 - DNA, 14 bp, Homo sapiens
aatatgcaagcagc

SEQ ID NO: 3606860 - DNA, 15 bp, Homo sapiens
aatatgtataacttt

SEQ ID NO: 3606861 - DNA, 14 bp, Homo sapiens
aatatgtgtttact

SEQ ID NO: 3606862 - DNA, 17 bp, Homo sapiens
aatatgttaaagtttaa

SEQ ID NO: 3606863 - DNA, 23 bp, Homo sapiens
aatatgtttggaatattccacta

SEQ ID NO: 3606864 - DNA, 16 bp, Homo sapiens
aatattagttggcttt

SEQ ID NO: 3606865 - DNA, 14 bp, Homo sapiens
aatattatacttct

SEQ ID NO: 3606866 - DNA, 17 bp, Homo sapiens
aatattattactttatg

SEQ ID NO: 3606867 - DNA, 20 bp, Homo sapiens
aatattcctttgcatattat

SEQ ID NO: 3606868 - DNA, 20 bp, Homo sapiens
aatattgtgcatgctagtgt

SEQ ID NO: 3606869 - DNA, 21 bp, Homo sapiens
aatattgtgcatgctagtgtt

SEQ ID NO: 3606870 - DNA, 11 bp, Homo sapiens
aatatttcatt

SEQ ID NO: 3606871 - DNA, 12 bp, Homo sapiens
aatatttgtaca

SEQ ID NO: 3606872 - DNA, 14 bp, Homo sapiens
aatatttgtacata

SEQ ID NO: 3606873 - DNA, 17 bp, Homo sapiens
aatattttatctttcct

SEQ ID NO: 3606874 - DNA, 14 bp, Homo sapiens
aatattttgctaac

SEQ ID NO: 3606875 - DNA, 16 bp, Homo sapiens
aatattttgctaactg

SEQ ID NO: 3606876 - DNA, 16 bp, Homo sapiens
aatatttttatataca

SEQ ID NO: 3606877 - DNA, 19 bp, Homo sapiens
aatatttttgtattttaca

SEQ ID NO: 3606878 - DNA, 20 bp, Homo sapiens
aatatttttgtattttacat

SEQ ID NO: 3606879 - DNA, 20 bp, Homo sapiens
aatcaaaactttcgttgtta

SEQ ID NO: 3606880 - DNA, 13 bp, Homo sapiens
aatcaaatgtaaa

SEQ ID NO: 3606881 - DNA, 14 bp, Homo sapiens
aatcaaatgtaaag

SEQ ID NO: 3606882 - DNA, 21 bp, Homo sapiens
aatcacagatgcatatagaca

SEQ ID NO: 3606883 - DNA, 16 bp, Homo sapiens
aatcagaacaaaactt

SEQ ID NO: 3606884 - DNA, 20 bp, Homo sapiens
aatcagaagtcatcttgcta

SEQ ID NO: 3606885 - DNA, 24 bp, Homo sapiens
aatcagaagtcatcttgctaccag

SEQ ID NO: 3606886 - DNA, 19 bp, Homo sapiens
aatcagtgtttgattgccc

SEQ ID NO: 3606887 - DNA, 14 bp, Homo sapiens
aatcatacaaactc

SEQ ID NO: 3606888 - DNA, 16 bp, Homo sapiens
aatcatatagaccaat

SEQ ID NO: 3606889 - DNA, 22 bp, Homo sapiens
aatcatgttgttgtgtgtatat

SEQ ID NO: 3606890 - DNA, 18 bp, Homo sapiens
aatcattcttactaaaaa

SEQ ID NO: 3606891 - DNA, 11 bp, Homo sapiens
aatcattttaa

SEQ ID NO: 3606892 - DNA, 15 bp, Homo sapiens
aatcattttaaattc

SEQ ID NO: 3606893 - DNA, 20 bp, Homo sapiens
aatcatttttaattcacgtg

SEQ ID NO: 3606894 - DNA, 17 bp, Homo sapiens
aatccaaaacttctctt

SEQ ID NO: 3606895 - DNA, 19 bp, Homo sapiens
aatccacctgcctcggcct

SEQ ID NO: 3606896 - DNA, 13 bp, Homo sapiens
aatccagaaggaa

SEQ ID NO: 3606897 - DNA, 17 bp, Homo sapiens
aatccaggcagatccag

SEQ ID NO: 3606898 - DNA, 20 bp, Homo sapiens
aatccaggcagatccaggac

SEQ ID NO: 3606899 - DNA, 22 bp, Homo sapiens
aatccaggcagatccaggacta

SEQ ID NO: 3606900 - DNA, 16 bp, Homo sapiens
aatccagtggtgggta

SEQ ID NO: 3606901 - DNA, 17 bp, Homo sapiens
aatccatttcaggactc

SEQ ID NO: 3606902 - DNA, 20 bp, Homo sapiens
aatcccaatctttctatata

SEQ ID NO: 3606903 - DNA, 16 bp, Homo sapiens
aatcccaccttcccac

SEQ ID NO: 3606904 - DNA, 17 bp, Homo sapiens
aatcctagactgctcct

SEQ ID NO: 3606905 - DNA, 23 bp, Homo sapiens
aatcctcttgagagaaacgtgaa

SEQ ID NO: 3606906 - DNA, 18 bp, Homo sapiens
aatccttgcttatgacat

SEQ ID NO: 3606907 - DNA, 14 bp, Homo sapiens
aatccttttcctta

SEQ ID NO: 3606908 - DNA, 19 bp, Homo sapiens
aatctaaaagctctgttcc

SEQ ID NO: 3606909 - DNA, 12 bp, Homo sapiens
aatctaaaattt

SEQ ID NO: 3606910 - DNA, 17 bp, Homo sapiens
aatctaagtgatataaa

SEQ ID NO: 3606911 - DNA, 23 bp, Homo sapiens
aatctatttcacttattttggct

SEQ ID NO: 3606912 - DNA, 19 bp, Homo sapiens
aatctattttctcattgct

SEQ ID NO: 3606913 - DNA, 15 bp, Homo sapiens
aatctcacatataca

SEQ ID NO: 3606914 - DNA, 23 bp, Homo sapiens
aatctcacatatacaagtagctt

SEQ ID NO: 3606915 - DNA, 12 bp, Homo sapiens
aatctgacatat

SEQ ID NO: 3606916 - DNA, 14 bp, Homo sapiens
aatctgacccagtg

SEQ ID NO: 3606917 - DNA, 13 bp, Homo sapiens
aatctgagcaggt

SEQ ID NO: 3606918 - DNA, 16 bp, Homo sapiens
aatctgatgtataatg

SEQ ID NO: 3606919 - DNA, 18 bp, Homo sapiens
aatctgatgtataatgta

SEQ ID NO: 3606920 - DNA, 16 bp, Homo sapiens
aatctggactcctctg

SEQ ID NO: 3606921 - DNA, 17 bp, Homo sapiens
aatctggactcctctgt

SEQ ID NO: 3606922 - DNA, 20 bp, Homo sapiens
aatctggactcctctgtcca

SEQ ID NO: 3606923 - DNA, 17 bp, Homo sapiens
aatctggattcatattt

SEQ ID NO: 3606924 - DNA, 21 bp, Homo sapiens
aatctgtaacaggtattttgt

SEQ ID NO: 3606925 - DNA, 16 bp, Homo sapiens
aatctgtgctgtttca

SEQ ID NO: 3606926 - DNA, 12 bp, Homo sapiens
aatctgttatcc

SEQ ID NO: 3606927 - DNA, 14 bp, Homo sapiens
aatctgttatccca

SEQ ID NO: 3606928 - DNA, 22 bp, Homo sapiens
aatcttaatgtctggtgtttgt

SEQ ID NO: 3606929 - DNA, 18 bp, Homo sapiens
aatcttagtgtatgatta

SEQ ID NO: 3606930 - DNA, 12 bp, Homo sapiens
aatcttcctggc

SEQ ID NO: 3606931 - DNA, 13 bp, Homo sapiens
aatcttgaaaatg

SEQ ID NO: 3606932 - DNA, 15 bp, Homo sapiens
aatcttgaatttctg

SEQ ID NO: 3606933 - DNA, 16 bp, Homo sapiens
aatctttaagaatagt

SEQ ID NO: 3606934 - DNA, 17 bp, Homo sapiens
aatctttagcctgggca

SEQ ID NO: 3606935 - DNA, 13 bp, Homo sapiens
aatctttcatgtc

SEQ ID NO: 3606936 - DNA, 16 bp, Homo sapiens
aatgaaaataactgaa

SEQ ID NO: 3606937 - DNA, 17 bp, Homo sapiens
aatgaaacattttgtca

SEQ ID NO: 3606938 - DNA, 15 bp, Homo sapiens
aatgaaacttaagaa

SEQ ID NO: 3606939 - DNA, 16 bp, Homo sapiens
aatgaaacttaagaat

SEQ ID NO: 3606940 - DNA, 15 bp, Homo sapiens
aatgaaatttaatta

SEQ ID NO: 3606941 - DNA, 13 bp, Homo sapiens
aatgaagaaggaa

SEQ ID NO: 3606942 - DNA, 14 bp, Homo sapiens
aatgaagaaggaag

SEQ ID NO: 3606943 - DNA, 22 bp, Homo sapiens
aatgaagccatatgaacagctg

SEQ ID NO: 3606944 - DNA, 12 bp, Homo sapiens
aatgacaaaaga

SEQ ID NO: 3606945 - DNA, 15 bp, Homo sapiens
aatgacaacacttaa

SEQ ID NO: 3606946 - DNA, 22 bp, Homo sapiens
aatgacataaaaagaagccttc

SEQ ID NO: 3606947 - DNA, 16 bp, Homo sapiens
aatgaccgagccctgg

SEQ ID NO: 3606948 - DNA, 17 bp, Homo sapiens
aatgaccgagccctgga

SEQ ID NO: 3606949 - DNA, 20 bp, Homo sapiens
aatgaccgagccctggagag

SEQ ID NO: 3606950 - DNA, 15 bp, Homo sapiens
aatgacctcaaggaa

SEQ ID NO: 3606951 - DNA, 14 bp, Homo sapiens
aatgacggtgttaa

SEQ ID NO: 3606952 - DNA, 15 bp, Homo sapiens
aatgactcaaagtct

SEQ ID NO: 3606953 - DNA, 20 bp, Homo sapiens
aatgactcaggacatccccc

SEQ ID NO: 3606954 - DNA, 17 bp, Homo sapiens
aatgactccactgtttt

SEQ ID NO: 3606955 - DNA, 23 bp, Homo sapiens
aatgacttatttctgctctggaa

SEQ ID NO: 3606956 - DNA, 14 bp, Homo sapiens
aatgagacatccag

SEQ ID NO: 3606957 - DNA, 15 bp, Homo sapiens
aatgagacatccagc

SEQ ID NO: 3606958 - DNA, 12 bp, Homo sapiens
aatgagagcata

SEQ ID NO: 3606959 - DNA, 23 bp, Homo sapiens
aatgagcacccattccaaagctt

SEQ ID NO: 3606960 - DNA, 15 bp, Homo sapiens
aatgagcctttgtgc

SEQ ID NO: 3606961 - DNA, 14 bp, Homo sapiens
aatgaggatccagg

SEQ ID NO: 3606962 - DNA, 22 bp, Homo sapiens
aatgaggatccagggcagcagg

SEQ ID NO: 3606963 - DNA, 16 bp, Homo sapiens
aatgaggtctgtttaa

SEQ ID NO: 3606964 - DNA, 21 bp, Homo sapiens
aatgagtcatttgtttaaaca

SEQ ID NO: 3606965 - DNA, 22 bp, Homo sapiens
aatgagtcatttgtttaaacaa

SEQ ID NO: 3606966 - DNA, 16 bp, Homo sapiens
aatgagtgcacctgcc

SEQ ID NO: 3606967 - DNA, 19 bp, Homo sapiens
aatgatatgcttgtaacta

SEQ ID NO: 3606968 - DNA, 19 bp, Homo sapiens
aatgatattgttatataca

SEQ ID NO: 3606969 - DNA, 17 bp, Homo sapiens
aatgatggcaattttgt

SEQ ID NO: 3606970 - DNA, 18 bp, Homo sapiens
aatgatggcaattttgta

SEQ ID NO: 3606971 - DNA, 17 bp, Homo sapiens
aatgcaaccatttgaaa

SEQ ID NO: 3606972 - DNA, 18 bp, Homo sapiens
aatgcagatttctcttta

SEQ ID NO: 3606973 - DNA, 15 bp, Homo sapiens
aatgcagcaggaagg

SEQ ID NO: 3606974 - DNA, 23 bp, Homo sapiens
aatgcattataggatcatttgtt

SEQ ID NO: 3606975 - DNA, 19 bp, Homo sapiens
aatgcattcaaaatataac

SEQ ID NO: 3606976 - DNA, 14 bp, Homo sapiens
aatgcattgaaaga

SEQ ID NO: 3606977 - DNA, 15 bp, Homo sapiens
aatgccccaaacttt

SEQ ID NO: 3606978 - DNA, 16 bp, Homo sapiens
aatgccccaaactttc

SEQ ID NO: 3606979 - DNA, 19 bp, Homo sapiens
aatgccctcctaaatgtca

SEQ ID NO: 3606980 - DNA, 16 bp, Homo sapiens
aatgccgctgtctctg

SEQ ID NO: 3606981 - DNA, 17 bp, Homo sapiens
aatgccgctgtctctga

SEQ ID NO: 3606982 - DNA, 19 bp, Homo sapiens
aatgcctcgctcccttcaa

SEQ ID NO: 3606983 - DNA, 23 bp, Homo sapiens
aatgctattttttcccttctctt

SEQ ID NO: 3606984 - DNA, 22 bp, Homo sapiens
aatgctgcaagttatgaaatat

SEQ ID NO: 3606985 - DNA, 19 bp, Homo sapiens
aatgctgcctcaggaccca

SEQ ID NO: 3606986 - DNA, 23 bp, Homo sapiens
aatgctgccttttctttaacttt

SEQ ID NO: 3606987 - DNA, 18 bp, Homo sapiens
aatgctggtgaaatgctg

SEQ ID NO: 3606988 - DNA, 19 bp, Homo sapiens
aatgctgtctttcttgctc

SEQ ID NO: 3606989 - DNA, 22 bp, Homo sapiens
aatgctgttaatatttctaaaa

SEQ ID NO: 3606990 - DNA, 21 bp, Homo sapiens
aatgcttccactaccaaaaga

SEQ ID NO: 3606991 - DNA, 22 bp, Homo sapiens
aatgcttccactaccaaaagac

SEQ ID NO: 3606992 - DNA, 16 bp, Homo sapiens
aatgcttgcatggaga

SEQ ID NO: 3606993 - DNA, 20 bp, Homo sapiens
aatgcttgcatggagaatgg

SEQ ID NO: 3606994 - DNA, 15 bp, Homo sapiens
aatgctttctgtatg

SEQ ID NO: 3606995 - DNA, 17 bp, Homo sapiens
aatgcttttatattcta

SEQ ID NO: 3606996 - DNA, 20 bp, Homo sapiens
aatggaggatctctaaagag

SEQ ID NO: 3606997 - DNA, 16 bp, Homo sapiens
aatggatcaatacaca

SEQ ID NO: 3606998 - DNA, 16 bp, Homo sapiens
aatggatttcctagtg

SEQ ID NO: 3606999 - DNA, 14 bp, Homo sapiens
aatggcagtcctgg

SEQ ID NO: 3607000 - DNA, 17 bp, Homo sapiens
aatggcagtcctggagg

SEQ ID NO: 3607001 - DNA, 13 bp, Homo sapiens
aatggcatggcag

SEQ ID NO: 3607002 - DNA, 16 bp, Homo sapiens
aatggcatggcaggag

SEQ ID NO: 3607003 - DNA, 14 bp, Homo sapiens
aatggcctggagca

SEQ ID NO: 3607004 - DNA, 16 bp, Homo sapiens
aatggctatgaacaga

SEQ ID NO: 3607005 - DNA, 20 bp, Homo sapiens
aatggctatttttgaagcaa

SEQ ID NO: 3607006 - DNA, 22 bp, Homo sapiens
aatgggcatttctaaaatgtta

SEQ ID NO: 3607007 - DNA, 17 bp, Homo sapiens
aatggggccagatccag

SEQ ID NO: 3607008 - DNA, 22 bp, Homo sapiens
aatgggggcaggaaagccacat

SEQ ID NO: 3607009 - DNA, 23 bp, Homo sapiens
aatgggggcaggaaagccacatc

SEQ ID NO: 3607010 - DNA, 18 bp, Homo sapiens
aatggtactcccaaactg

SEQ ID NO: 3607011 - DNA, 22 bp, Homo sapiens
aatggtcacgtttggtgcttct

SEQ ID NO: 3607012 - DNA, 22 bp, Homo sapiens
aatggtctttctaatgtgtgaa

SEQ ID NO: 3607013 - DNA, 22 bp, Homo sapiens
aatgtaacttttgtaagacaaa

SEQ ID NO: 3607014 - DNA, 22 bp, Homo sapiens
aatgtaatgtttttatttcaat

SEQ ID NO: 3607015 - DNA, 18 bp, Homo sapiens
aatgtacttgtttgaata

SEQ ID NO: 3607016 - DNA, 14 bp, Homo sapiens
aatgtatattttta

SEQ ID NO: 3607017 - DNA, 16 bp, Homo sapiens
aatgtatcaaactgta

SEQ ID NO: 3607018 - DNA, 18 bp, Homo sapiens
aatgtatcatagaaatgt

SEQ ID NO: 3607019 - DNA, 12 bp, Homo sapiens
aatgtatgtgtg

SEQ ID NO: 3607020 - DNA, 18 bp, Homo sapiens
aatgtatgtgtgtctatt

SEQ ID NO: 3607021 - DNA, 19 bp, Homo sapiens
aatgtatgtgtgtctattt

SEQ ID NO: 3607022 - DNA, 17 bp, Homo sapiens
aatgtatgttaccaaaa

SEQ ID NO: 3607023 - DNA, 13 bp, Homo sapiens
aatgtattcaagc

SEQ ID NO: 3607024 - DNA, 19 bp, Homo sapiens
aatgtatttgaaaattaca

SEQ ID NO: 3607025 - DNA, 13 bp, Homo sapiens
aatgtattttaca

SEQ ID NO: 3607026 - DNA, 19 bp, Homo sapiens
aatgtcagttgttatttat

SEQ ID NO: 3607027 - DNA, 20 bp, Homo sapiens
aatgtcagttgttatttatt

SEQ ID NO: 3607028 - DNA, 22 bp, Homo sapiens
aatgtcagttgttatttattga

SEQ ID NO: 3607029 - DNA, 18 bp, Homo sapiens
aatgtctgcactgaggat

SEQ ID NO: 3607030 - DNA, 21 bp, Homo sapiens
aatgtctggtgtttgtcatgg

SEQ ID NO: 3607031 - DNA, 17 bp, Homo sapiens
aatgtctgtaataatag

SEQ ID NO: 3607032 - DNA, 19 bp, Homo sapiens
aatgtctgtaataatagac

SEQ ID NO: 3607033 - DNA, 16 bp, Homo sapiens
aatgtgaaatgctttt

SEQ ID NO: 3607034 - DNA, 21 bp, Homo sapiens
aatgtgagaagccagccagag

SEQ ID NO: 3607035 - DNA, 17 bp, Homo sapiens
aatgtgcactttatcct

SEQ ID NO: 3607036 - DNA, 12 bp, Homo sapiens
aatgtgctctgt

SEQ ID NO: 3607037 - DNA, 21 bp, Homo sapiens
aatgtggaaggaaaatatttc

SEQ ID NO: 3607038 - DNA, 21 bp, Homo sapiens
aatgtggtgacacctccccct

SEQ ID NO: 3607039 - DNA, 19 bp, Homo sapiens
aatgtgtgtgtgtggcagg

SEQ ID NO: 3607040 - DNA, 14 bp, Homo sapiens
aatgtgtttccttt

SEQ ID NO: 3607041 - DNA, 21 bp, Homo sapiens
aatgttaaaacataaacacat

SEQ ID NO: 3607042 - DNA, 22 bp, Homo sapiens
aatgttaataaagcccgcgtct

SEQ ID NO: 3607043 - DNA, 18 bp, Homo sapiens
aatgttagtattttaatc

SEQ ID NO: 3607044 - DNA, 19 bp, Homo sapiens
aatgttatgactatgtaaa

SEQ ID NO: 3607045 - DNA, 20 bp, Homo sapiens
aatgttccagtttgaagacc

SEQ ID NO: 3607046 - DNA, 21 bp, Homo sapiens
aatgttcttatgcaaaatgga

SEQ ID NO: 3607047 - DNA, 12 bp, Homo sapiens
aatgttctttct

SEQ ID NO: 3607048 - DNA, 20 bp, Homo sapiens
aatgttggagcagcaggcct

SEQ ID NO: 3607049 - DNA, 14 bp, Homo sapiens
aatgtttttatttc

SEQ ID NO: 3607050 - DNA, 21 bp, Homo sapiens
aatgtttttcatccattccta

SEQ ID NO: 3607051 - DNA, 11 bp, Homo sapiens
aattaaaaaat

SEQ ID NO: 3607052 - DNA, 23 bp, Homo sapiens
aattaaaaactgtgatttttatc

SEQ ID NO: 3607053 - DNA, 13 bp, Homo sapiens
aattaaacggatt

SEQ ID NO: 3607054 - DNA, 22 bp, Homo sapiens
aattaaacggattattttttca

SEQ ID NO: 3607055 - DNA, 21 bp, Homo sapiens
aattaatatccctacatgtat

SEQ ID NO: 3607056 - DNA, 18 bp, Homo sapiens
aattaatgcagatttctc

SEQ ID NO: 3607057 - DNA, 15 bp, Homo sapiens
aattaattgtcatta

SEQ ID NO: 3607058 - DNA, 23 bp, Homo sapiens
aattacaaaacctatttttcctt

SEQ ID NO: 3607059 - DNA, 12 bp, Homo sapiens
aattacaaacaa

SEQ ID NO: 3607060 - DNA, 21 bp, Homo sapiens
aattacaaacaataagaacaa

SEQ ID NO: 3607061 - DNA, 17 bp, Homo sapiens
aattacattttatatgt

SEQ ID NO: 3607062 - DNA, 19 bp, Homo sapiens
aattacattttatatgtga

SEQ ID NO: 3607063 - DNA, 21 bp, Homo sapiens
aattactggaattcttctgca

SEQ ID NO: 3607064 - DNA, 16 bp, Homo sapiens
aattagacactttgga

SEQ ID NO: 3607065 - DNA, 17 bp, Homo sapiens
aattagacactttggaa

SEQ ID NO: 3607066 - DNA, 17 bp, Homo sapiens
aattaggctgtaactac

SEQ ID NO: 3607067 - DNA, 18 bp, Homo sapiens
aattaggctgtaactact

SEQ ID NO: 3607068 - DNA, 22 bp, Homo sapiens
aattaggctgtaactactttat

SEQ ID NO: 3607069 - DNA, 23 bp, Homo sapiens
aattaggctgtaactactttata

SEQ ID NO: 3607070 - DNA, 23 bp, Homo sapiens
aattagggtgggctctaaatcca

SEQ ID NO: 3607071 - DNA, 15 bp, Homo sapiens
aattataactattac

SEQ ID NO: 3607072 - DNA, 17 bp, Homo sapiens
aattataactattacag

SEQ ID NO: 3607073 - DNA, 22 bp, Homo sapiens
aattatatcagagtatgtcagt

SEQ ID NO: 3607074 - DNA, 17 bp, Homo sapiens
aattatctcaagtaaaa

SEQ ID NO: 3607075 - DNA, 20 bp, Homo sapiens
aattatctcaagtaaaacaa

SEQ ID NO: 3607076 - DNA, 18 bp, Homo sapiens
aattatgttggtgtgaat

SEQ ID NO: 3607077 - DNA, 13 bp, Homo sapiens
aattattacttta

SEQ ID NO: 3607078 - DNA, 15 bp, Homo sapiens
aattattactttaaa

SEQ ID NO: 3607079 - DNA, 15 bp, Homo sapiens
aattattggcaaagt

SEQ ID NO: 3607080 - DNA, 16 bp, Homo sapiens
aattatttaattgtcc

SEQ ID NO: 3607081 - DNA, 14 bp, Homo sapiens
aattatttgcatat

SEQ ID NO: 3607082 - DNA, 12 bp, Homo sapiens
aattcaacttaa

SEQ ID NO: 3607083 - DNA, 21 bp, Homo sapiens
aattcaacttaactatcatct

SEQ ID NO: 3607084 - DNA, 16 bp, Homo sapiens
aattcaaggaatttct

SEQ ID NO: 3607085 - DNA, 18 bp, Homo sapiens
aattcaccacagacttta

SEQ ID NO: 3607086 - DNA, 15 bp, Homo sapiens
aattcaccagtgttc

SEQ ID NO: 3607087 - DNA, 16 bp, Homo sapiens
aattcaggtctgtatg

SEQ ID NO: 3607088 - DNA, 17 bp, Homo sapiens
aattcaggtctgtatgt

SEQ ID NO: 3607089 - DNA, 24 bp, Homo sapiens
aattcatggttcaagtattaagca

SEQ ID NO: 3607090 - DNA, 13 bp, Homo sapiens
aattcatttcact

SEQ ID NO: 3607091 - DNA, 15 bp, Homo sapiens
aattcatttcactgt

SEQ ID NO: 3607092 - DNA, 14 bp, Homo sapiens
aattccaaaatcca

SEQ ID NO: 3607093 - DNA, 16 bp, Homo sapiens
aattccactgaaaatt

SEQ ID NO: 3607094 - DNA, 21 bp, Homo sapiens
aattccactgaaaatttaaca

SEQ ID NO: 3607095 - DNA, 20 bp, Homo sapiens
aattcccgttttgtcacttt

SEQ ID NO: 3607096 - DNA, 18 bp, Homo sapiens
aattcctctttgctttgc

SEQ ID NO: 3607097 - DNA, 23 bp, Homo sapiens
aattcgtacataataagtttcat

SEQ ID NO: 3607098 - DNA, 21 bp, Homo sapiens
aattctaacccaagacatgac

SEQ ID NO: 3607099 - DNA, 19 bp, Homo sapiens
aattctactaagttatttt

SEQ ID NO: 3607100 - DNA, 14 bp, Homo sapiens
aattctactttgag

SEQ ID NO: 3607101 - DNA, 23 bp, Homo sapiens
aattctagtgtccataaataaag

SEQ ID NO: 3607102 - DNA, 15 bp, Homo sapiens
aattctcccctccct

SEQ ID NO: 3607103 - DNA, 16 bp, Homo sapiens
aattctcccctccctc

SEQ ID NO: 3607104 - DNA, 16 bp, Homo sapiens
aattctggacagacag

SEQ ID NO: 3607105 - DNA, 17 bp, Homo sapiens
aattctgtgatattttc

SEQ ID NO: 3607106 - DNA, 21 bp, Homo sapiens
aattcttcagcgtaaaatggt

SEQ ID NO: 3607107 - DNA, 13 bp, Homo sapiens
aattcttcctttg

SEQ ID NO: 3607108 - DNA, 17 bp, Homo sapiens
aattgaaaaactcttta

SEQ ID NO: 3607109 - DNA, 12 bp, Homo sapiens
aattgaagcatg

SEQ ID NO: 3607110 - DNA, 13 bp, Homo sapiens
aattgaagcatga

SEQ ID NO: 3607111 - DNA, 19 bp, Homo sapiens
aattgagaaaaatatatac

SEQ ID NO: 3607112 - DNA, 13 bp, Homo sapiens
aattgagcttaca

SEQ ID NO: 3607113 - DNA, 13 bp, Homo sapiens
aattgatctgttt

SEQ ID NO: 3607114 - DNA, 17 bp, Homo sapiens
aattgcactgaagtttt

SEQ ID NO: 3607115 - DNA, 20 bp, Homo sapiens
aattgcactgaagtttttga

SEQ ID NO: 3607116 - DNA, 22 bp, Homo sapiens
aattgcactgaagtttttgaaa

SEQ ID NO: 3607117 - DNA, 16 bp, Homo sapiens
aattgcagtttacagt

SEQ ID NO: 3607118 - DNA, 19 bp, Homo sapiens
aattgcagtttacagtatt

SEQ ID NO: 3607119 - DNA, 20 bp, Homo sapiens
aattgcagtttacagtattt

SEQ ID NO: 3607120 - DNA, 19 bp, Homo sapiens
aattgcttctaaaacaata

SEQ ID NO: 3607121 - DNA, 10 bp, Homo sapiens
aattgctttg

SEQ ID NO: 3607122 - DNA, 11 bp, Homo sapiens
aattgctttga

SEQ ID NO: 3607123 - DNA, 13 bp, Homo sapiens
aattggaaagact

SEQ ID NO: 3607124 - DNA, 17 bp, Homo sapiens
aattgggaactgaaatc

SEQ ID NO: 3607125 - DNA, 21 bp, Homo sapiens
aattgggagcttgggaatgga

SEQ ID NO: 3607126 - DNA, 20 bp, Homo sapiens
aattgtaattccaaaatcca

SEQ ID NO: 3607127 - DNA, 13 bp, Homo sapiens
aattgtacaataa

SEQ ID NO: 3607128 - DNA, 18 bp, Homo sapiens
aattgtcagcaatttaac

SEQ ID NO: 3607129 - DNA, 20 bp, Homo sapiens
aattgtcattatttttgtta

SEQ ID NO: 3607130 - DNA, 23 bp, Homo sapiens
aattgtgtatttaaaaaaaagaa

SEQ ID NO: 3607131 - DNA, 16 bp, Homo sapiens
aattgttaaccttgta

SEQ ID NO: 3607132 - DNA, 13 bp, Homo sapiens
aattgttacaatt

SEQ ID NO: 3607133 - DNA, 16 bp, Homo sapiens
aattgttacaattttc

SEQ ID NO: 3607134 - DNA, 23 bp, Homo sapiens
aattgttgctaatcttcttatgc

SEQ ID NO: 3607135 - DNA, 21 bp, Homo sapiens
aatttaaatagcattatctta

SEQ ID NO: 3607136 - DNA, 11 bp, Homo sapiens
aatttaaatgt

SEQ ID NO: 3607137 - DNA, 15 bp, Homo sapiens
aatttaatatttact

SEQ ID NO: 3607138 - DNA, 19 bp, Homo sapiens
aatttaatccttctttgta

SEQ ID NO: 3607139 - DNA, 22 bp, Homo sapiens
aatttaatttgtaaaacttctg

SEQ ID NO: 3607140 - DNA, 13 bp, Homo sapiens
aatttaatttttc

SEQ ID NO: 3607141 - DNA, 21 bp, Homo sapiens
aatttacctaagattacaaat

SEQ ID NO: 3607142 - DNA, 21 bp, Homo sapiens
aatttactgatgagagaatgt

SEQ ID NO: 3607143 - DNA, 17 bp, Homo sapiens
aatttagaaatataatt

SEQ ID NO: 3607144 - DNA, 19 bp, Homo sapiens
aatttagacaaagccttaa

SEQ ID NO: 3607145 - DNA, 15 bp, Homo sapiens
aatttataaaggtct

SEQ ID NO: 3607146 - DNA, 15 bp, Homo sapiens
aatttataatgtatt

SEQ ID NO: 3607147 - DNA, 17 bp, Homo sapiens
aatttataatgtatttg

SEQ ID NO: 3607148 - DNA, 20 bp, Homo sapiens
aatttataatgtatttgaaa

SEQ ID NO: 3607149 - DNA, 23 bp, Homo sapiens
aatttatcctgaaatttcagatt

SEQ ID NO: 3607150 - DNA, 15 bp, Homo sapiens
aatttatgtgaaatg

SEQ ID NO: 3607151 - DNA, 18 bp, Homo sapiens
aatttattaattgctttg

SEQ ID NO: 3607152 - DNA, 23 bp, Homo sapiens
aatttatttcaataaatctttca

SEQ ID NO: 3607153 - DNA, 23 bp, Homo sapiens
aatttcagactcccattcctgaa

SEQ ID NO: 3607154 - DNA, 14 bp, Homo sapiens
aatttcaggattaa

SEQ ID NO: 3607155 - DNA, 17 bp, Homo sapiens
aatttcataattctgaa

SEQ ID NO: 3607156 - DNA, 22 bp, Homo sapiens
aatttcatacctatcatcttaa

SEQ ID NO: 3607157 - DNA, 12 bp, Homo sapiens
aatttcccagga

SEQ ID NO: 3607158 - DNA, 22 bp, Homo sapiens
aatttcccaggaccctgaaggg

SEQ ID NO: 3607159 - DNA, 17 bp, Homo sapiens
aatttccttcaggcagc

SEQ ID NO: 3607160 - DNA, 21 bp, Homo sapiens
aatttcgggagccttgtcagt

SEQ ID NO: 3607161 - DNA, 18 bp, Homo sapiens
aatttctaccatttcaga

SEQ ID NO: 3607162 - DNA, 19 bp, Homo sapiens
aatttctcccagtcattta

SEQ ID NO: 3607163 - DNA, 21 bp, Homo sapiens
aatttctgccaataaattcta

SEQ ID NO: 3607164 - DNA, 22 bp, Homo sapiens
aatttctgccaataaattctaa

SEQ ID NO: 3607165 - DNA, 19 bp, Homo sapiens
aatttctgggatatttaac

SEQ ID NO: 3607166 - DNA, 12 bp, Homo sapiens
aatttcttaact

SEQ ID NO: 3607167 - DNA, 16 bp, Homo sapiens
aatttcttaacttctt

SEQ ID NO: 3607168 - DNA, 13 bp, Homo sapiens
aatttgaggacaa

SEQ ID NO: 3607169 - DNA, 16 bp, Homo sapiens
aatttggctttcacat

SEQ ID NO: 3607170 - DNA, 15 bp, Homo sapiens
aatttgtaaaacttc

SEQ ID NO: 3607171 - DNA, 17 bp, Homo sapiens
aatttgtaaaacttctg

SEQ ID NO: 3607172 - DNA, 23 bp, Homo sapiens
aattttacaagggcataaagtaa

SEQ ID NO: 3607173 - DNA, 16 bp, Homo sapiens
aattttacatgacaga

SEQ ID NO: 3607174 - DNA, 18 bp, Homo sapiens
aattttacctattctgaa

SEQ ID NO: 3607175 - DNA, 18 bp, Homo sapiens
aattttcacttttggcaa

SEQ ID NO: 3607176 - DNA, 14 bp, Homo sapiens
aattttcagttcta

SEQ ID NO: 3607177 - DNA, 22 bp, Homo sapiens
aattttctggaatacatgaaat

SEQ ID NO: 3607178 - DNA, 14 bp, Homo sapiens
aattttgaagtgct

SEQ ID NO: 3607179 - DNA, 20 bp, Homo sapiens
aattttgattaaccttttca

SEQ ID NO: 3607180 - DNA, 21 bp, Homo sapiens
aattttgattaaccttttcaa

SEQ ID NO: 3607181 - DNA, 17 bp, Homo sapiens
aattttgctaactgggt

SEQ ID NO: 3607182 - DNA, 19 bp, Homo sapiens
aattttgctaactgggtta

SEQ ID NO: 3607183 - DNA, 21 bp, Homo sapiens
aattttgctaactgggttaaa

SEQ ID NO: 3607184 - DNA, 23 bp, Homo sapiens
aattttgtgaaacagacttgtat

SEQ ID NO: 3607185 - DNA, 15 bp, Homo sapiens
aattttgtgtaagaa

SEQ ID NO: 3607186 - DNA, 17 bp, Homo sapiens
aatttttattaaattat

SEQ ID NO: 3607187 - DNA, 18 bp, Homo sapiens
aatttttcaaaatcgttt

SEQ ID NO: 3607188 - DNA, 20 bp, Homo sapiens
aatttttccaactactaata

SEQ ID NO: 3607189 - DNA, 10 bp, Homo sapiens
aatttttcct

SEQ ID NO: 3607190 - DNA, 13 bp, Homo sapiens
aattttttgaaac

SEQ ID NO: 3607191 - DNA, 17 bp, Homo sapiens
aattttttttaaaaatc

SEQ ID NO: 3607192 - DNA, 22 bp, Homo sapiens
acaaaaaaaattttagctcttc

SEQ ID NO: 3607193 - DNA, 20 bp, Homo sapiens
acaaaaaacccacaattgaa

SEQ ID NO: 3607194 - DNA, 13 bp, Homo sapiens
acaaaaacacagc

SEQ ID NO: 3607195 - DNA, 15 bp, Homo sapiens
acaaaaacacagcaa

SEQ ID NO: 3607196 - DNA, 14 bp, Homo sapiens
acaaaaatagagaa

SEQ ID NO: 3607197 - DNA, 14 bp, Homo sapiens
acaaaacaaaacaa

SEQ ID NO: 3607198 - DNA, 23 bp, Homo sapiens
acaaaaccacctggttgaatata

SEQ ID NO: 3607199 - DNA, 19 bp, Homo sapiens
acaaaacctatttttcctt

SEQ ID NO: 3607200 - DNA, 20 bp, Homo sapiens
acaaaacctatttttccttt

SEQ ID NO: 3607201 - DNA, 21 bp, Homo sapiens
acaaaacttaaaagtattcat

SEQ ID NO: 3607202 - DNA, 11 bp, Homo sapiens
acaaaacttct

SEQ ID NO: 3607203 - DNA, 14 bp, Homo sapiens
acaaaacttgcatc

SEQ ID NO: 3607204 - DNA, 17 bp, Homo sapiens
acaaaagaaaaaagcaa

SEQ ID NO: 3607205 - DNA, 11 bp, Homo sapiens
acaaaatgaaa

SEQ ID NO: 3607206 - DNA, 10 bp, Homo sapiens
acaaaatgga

SEQ ID NO: 3607207 - DNA, 13 bp, Homo sapiens
acaaacaaaactt

SEQ ID NO: 3607208 - DNA, 18 bp, Homo sapiens
acaaacaaacaatgcata

SEQ ID NO: 3607209 - DNA, 14 bp, Homo sapiens
acaaacaataagaa

SEQ ID NO: 3607210 - DNA, 14 bp, Homo sapiens
acaaaccatgcaaa

SEQ ID NO: 3607211 - DNA, 17 bp, Homo sapiens
acaaactcagatccttg

SEQ ID NO: 3607212 - DNA, 16 bp, Homo sapiens
acaaactccaggctgg

SEQ ID NO: 3607213 - DNA, 16 bp, Homo sapiens
acaaactctcaccatg

SEQ ID NO: 3607214 - DNA, 19 bp, Homo sapiens
acaaagacattgacagcaa

SEQ ID NO: 3607215 - DNA, 20 bp, Homo sapiens
acaaagacattgacagcaat

SEQ ID NO: 3607216 - DNA, 17 bp, Homo sapiens
acaaagagacaaagctt

SEQ ID NO: 3607217 - DNA, 15 bp, Homo sapiens
acaaagcaattcttt

SEQ ID NO: 3607218 - DNA, 11 bp, Homo sapiens
acaaagcccaa

SEQ ID NO: 3607219 - DNA, 17 bp, Homo sapiens
acaaagccttaagcaaa

SEQ ID NO: 3607220 - DNA, 19 bp, Homo sapiens
acaaagccttaagcaaatt

SEQ ID NO: 3607221 - DNA, 23 bp, Homo sapiens
acaaagccttaagcaaattttgt

SEQ ID NO: 3607222 - DNA, 16 bp, Homo sapiens
acaaagggaaaaaaga

SEQ ID NO: 3607223 - DNA, 17 bp, Homo sapiens
acaaagggaaagcctct

SEQ ID NO: 3607224 - DNA, 24 bp, Homo sapiens
acaaaggttgagatgtaaaaggta

SEQ ID NO: 3607225 - DNA, 21 bp, Homo sapiens
acaaaggttttcctcttctat

SEQ ID NO: 3607226 - DNA, 18 bp, Homo sapiens
acaaagttaaaattgtta

SEQ ID NO: 3607227 - DNA, 16 bp, Homo sapiens
acaaataacaatgtgc

SEQ ID NO: 3607228 - DNA, 17 bp, Homo sapiens
acaaataagaaatgaaa

SEQ ID NO: 3607229 - DNA, 13 bp, Homo sapiens
acaaataatttag

SEQ ID NO: 3607230 - DNA, 22 bp, Homo sapiens
acaaatatttattttctttctg

SEQ ID NO: 3607231 - DNA, 23 bp, Homo sapiens
acaaatatttattttctttctgt

SEQ ID NO: 3607232 - DNA, 14 bp, Homo sapiens
acaaatcagaagtc

SEQ ID NO: 3607233 - DNA, 15 bp, Homo sapiens
acaaatcagaagtca

SEQ ID NO: 3607234 - DNA, 20 bp, Homo sapiens
acaaatcagaagtcatcttg

SEQ ID NO: 3607235 - DNA, 23 bp, Homo sapiens
acaaatcagaagtcatcttgcta

SEQ ID NO: 3607236 - DNA, 21 bp, Homo sapiens
acaaatgaaatttaattacaa

SEQ ID NO: 3607237 - DNA, 14 bp, Homo sapiens
acaaatttataaag

SEQ ID NO: 3607238 - DNA, 23 bp, Homo sapiens
acaaatttttctgctttaaaaat

SEQ ID NO: 3607239 - DNA, 21 bp, Homo sapiens
acaacaaatatgttctctgaa

SEQ ID NO: 3607240 - DNA, 15 bp, Homo sapiens
acaacaacctggtca

SEQ ID NO: 3607241 - DNA, 16 bp, Homo sapiens
acaacacttaatagca

SEQ ID NO: 3607242 - DNA, 15 bp, Homo sapiens
acaacagcagtctcc

SEQ ID NO: 3607243 - DNA, 16 bp, Homo sapiens
acaacagcagtctcct

SEQ ID NO: 3607244 - DNA, 19 bp, Homo sapiens
acaacatgtttaataaata

SEQ ID NO: 3607245 - DNA, 14 bp, Homo sapiens
acaaccattccaga

SEQ ID NO: 3607246 - DNA, 19 bp, Homo sapiens
acaacccttctctgttggt

SEQ ID NO: 3607247 - DNA, 16 bp, Homo sapiens
acaacgtgagagaaag

SEQ ID NO: 3607248 - DNA, 15 bp, Homo sapiens
acaactgcaaagaaa

SEQ ID NO: 3607249 - DNA, 22 bp, Homo sapiens
acaagaatactacttatgaaat

SEQ ID NO: 3607250 - DNA, 13 bp, Homo sapiens
acaagactggccc

SEQ ID NO: 3607251 - DNA, 14 bp, Homo sapiens
acaagactggccca

SEQ ID NO: 3607252 - DNA, 18 bp, Homo sapiens
acaagactggcccagtgc

SEQ ID NO: 3607253 - DNA, 17 bp, Homo sapiens
acaagagctgttatgct

SEQ ID NO: 3607254 - DNA, 13 bp, Homo sapiens
acaagcagccctt

SEQ ID NO: 3607255 - DNA, 14 bp, Homo sapiens
acaagcctcctgta

SEQ ID NO: 3607256 - DNA, 21 bp, Homo sapiens
acaagcctcctgtacctcagt

SEQ ID NO: 3607257 - DNA, 13 bp, Homo sapiens
acaagctgtccct

SEQ ID NO: 3607258 - DNA, 13 bp, Homo sapiens
acaagctgtgcag

SEQ ID NO: 3607259 - DNA, 19 bp, Homo sapiens
acaagcttcagtaagttat

SEQ ID NO: 3607260 - DNA, 16 bp, Homo sapiens
acaaggatagatgctg

SEQ ID NO: 3607261 - DNA, 14 bp, Homo sapiens
acaaggcctgcttg

SEQ ID NO: 3607262 - DNA, 12 bp, Homo sapiens
acaaggtgctaa

SEQ ID NO: 3607263 - DNA, 23 bp, Homo sapiens
acaagtcataggttaatatttaa

SEQ ID NO: 3607264 - DNA, 23 bp, Homo sapiens
acaagtgatgctaaaacctgaaa

SEQ ID NO: 3607265 - DNA, 20 bp, Homo sapiens
acaagttccaacatgcaata

SEQ ID NO: 3607266 - DNA, 19 bp, Homo sapiens
acaagttctatttcttgaa

SEQ ID NO: 3607267 - DNA, 19 bp, Homo sapiens
acaagttttggcagccatg

SEQ ID NO: 3607268 - DNA, 23 bp, Homo sapiens
acaataaagatcgcccccacctc

SEQ ID NO: 3607269 - DNA, 21 bp, Homo sapiens
acaataaattttttttggtca

SEQ ID NO: 3607270 - DNA, 12 bp, Homo sapiens
acaataagaaca

SEQ ID NO: 3607271 - DNA, 17 bp, Homo sapiens
acaataagaacaagttt

SEQ ID NO: 3607272 - DNA, 20 bp, Homo sapiens
acaatacctacaataaactg

SEQ ID NO: 3607273 - DNA, 18 bp, Homo sapiens
acaataggtctttctctc

SEQ ID NO: 3607274 - DNA, 15 bp, Homo sapiens
acaatctttcatgtc

SEQ ID NO: 3607275 - DNA, 22 bp, Homo sapiens
acaatggatattgcctgtgttt

SEQ ID NO: 3607276 - DNA, 20 bp, Homo sapiens
acaatgttggagcagcaggc

SEQ ID NO: 3607277 - DNA, 18 bp, Homo sapiens
acaattatgtgcaaaggt

SEQ ID NO: 3607278 - DNA, 16 bp, Homo sapiens
acaattcagtaacaaa

SEQ ID NO: 3607279 - DNA, 15 bp, Homo sapiens
acaattgaacttcca

SEQ ID NO: 3607280 - DNA, 21 bp, Homo sapiens
acaattgaacttccaggaaag

SEQ ID NO: 3607281 - DNA, 22 bp, Homo sapiens
acaattgaggtaagttttttga

SEQ ID NO: 3607282 - DNA, 19 bp, Homo sapiens
acaattttacctattctga

SEQ ID NO: 3607283 - DNA, 20 bp, Homo sapiens
acaattttacctattctgaa

SEQ ID NO: 3607284 - DNA, 21 bp, Homo sapiens
acaattttacctattctgaaa

SEQ ID NO: 3607285 - DNA, 19 bp, Homo sapiens
acacaaaaaaaattttagc

SEQ ID NO: 3607286 - DNA, 17 bp, Homo sapiens
acacaacagcagtctcc

SEQ ID NO: 3607287 - DNA, 14 bp, Homo sapiens
acacaataagcaaa

SEQ ID NO: 3607288 - DNA, 12 bp, Homo sapiens
acacaataccta

SEQ ID NO: 3607289 - DNA, 15 bp, Homo sapiens
acacacaccccccca

SEQ ID NO: 3607290 - DNA, 14 bp, Homo sapiens
acacacatacataa

SEQ ID NO: 3607291 - DNA, 14 bp, Homo sapiens
acacaccaggcgct

SEQ ID NO: 3607292 - DNA, 15 bp, Homo sapiens
acacacccccccaca

SEQ ID NO: 3607293 - DNA, 20 bp, Homo sapiens
acacactcaaatcaagaaac

SEQ ID NO: 3607294 - DNA, 22 bp, Homo sapiens
acacactggaaattgaaataaa

SEQ ID NO: 3607295 - DNA, 12 bp, Homo sapiens
acacactgtgcc

SEQ ID NO: 3607296 - DNA, 14 bp, Homo sapiens
acacagaaaccaat

SEQ ID NO: 3607297 - DNA, 21 bp, Homo sapiens
acacagacactaacgaaatat

SEQ ID NO: 3607298 - DNA, 15 bp, Homo sapiens
acacagacatatata

SEQ ID NO: 3607299 - DNA, 15 bp, Homo sapiens
acacagctcttcatt

SEQ ID NO: 3607300 - DNA, 17 bp, Homo sapiens
acacagctgagcactta

SEQ ID NO: 3607301 - DNA, 12 bp, Homo sapiens
acacagctgccc

SEQ ID NO: 3607302 - DNA, 19 bp, Homo sapiens
acacagctgccctagctga

SEQ ID NO: 3607303 - DNA, 22 bp, Homo sapiens
acacagctgccctagctgaccc

SEQ ID NO: 3607304 - DNA, 12 bp, Homo sapiens
acacagctgggc

SEQ ID NO: 3607305 - DNA, 15 bp, Homo sapiens
acacagctgggctgt

SEQ ID NO: 3607306 - DNA, 20 bp, Homo sapiens
acacaggtctcattgcttct

SEQ ID NO: 3607307 - DNA, 19 bp, Homo sapiens
acacagtaccatttaatgg

SEQ ID NO: 3607308 - DNA, 19 bp, Homo sapiens
acacagtagctccaacact

SEQ ID NO: 3607309 - DNA, 19 bp, Homo sapiens
acacagttctgggcaaaga

SEQ ID NO: 3607310 - DNA, 14 bp, Homo sapiens
acacatacataatg

SEQ ID NO: 3607311 - DNA, 22 bp, Homo sapiens
acacatctggctgcacaggctg

SEQ ID NO: 3607312 - DNA, 23 bp, Homo sapiens
acacatctggctgcacaggctga

SEQ ID NO: 3607313 - DNA, 14 bp, Homo sapiens
acacattacaaagt

SEQ ID NO: 3607314 - DNA, 23 bp, Homo sapiens
acacattacaaagttaaaattgt

SEQ ID NO: 3607315 - DNA, 21 bp, Homo sapiens
acacatttgggatgttccttt

SEQ ID NO: 3607316 - DNA, 15 bp, Homo sapiens
acacatttttaaatt

SEQ ID NO: 3607317 - DNA, 17 bp, Homo sapiens
acaccacagcattgtgt

SEQ ID NO: 3607318 - DNA, 16 bp, Homo sapiens
acaccagcattccttt

SEQ ID NO: 3607319 - DNA, 10 bp, Homo sapiens
acaccagtgt

SEQ ID NO: 3607320 - DNA, 18 bp, Homo sapiens
acacccaccccctctgga

SEQ ID NO: 3607321 - DNA, 15 bp, Homo sapiens
acacccaggaaggga

SEQ ID NO: 3607322 - DNA, 17 bp, Homo sapiens
acacccagttctgaata

SEQ ID NO: 3607323 - DNA, 16 bp, Homo sapiens
acacccatgccagaga

SEQ ID NO: 3607324 - DNA, 18 bp, Homo sapiens
acacccatgccagagagg

SEQ ID NO: 3607325 - DNA, 18 bp, Homo sapiens
acacccgtgtgcacactc

SEQ ID NO: 3607326 - DNA, 20 bp, Homo sapiens
acaccctctgggggtcctct

SEQ ID NO: 3607327 - DNA, 13 bp, Homo sapiens
acaccctggatgc

SEQ ID NO: 3607328 - DNA, 11 bp, Homo sapiens
acaccctggcc

SEQ ID NO: 3607329 - DNA, 12 bp, Homo sapiens
acaccctggcct

SEQ ID NO: 3607330 - DNA, 16 bp, Homo sapiens
acaccgggcctggaga

SEQ ID NO: 3607331 - DNA, 21 bp, Homo sapiens
acaccgtttagaaaaaacaat

SEQ ID NO: 3607332 - DNA, 12 bp, Homo sapiens
acacctcccagg

SEQ ID NO: 3607333 - DNA, 22 bp, Homo sapiens
acacctccccctttcacactgg

SEQ ID NO: 3607334 - DNA, 14 bp, Homo sapiens
acacctcctcccac

SEQ ID NO: 3607335 - DNA, 15 bp, Homo sapiens
acacctcctcccgaa

SEQ ID NO: 3607336 - DNA, 17 bp, Homo sapiens
acacctgaatcagctgg

SEQ ID NO: 3607337 - DNA, 19 bp, Homo sapiens
acacctggccttaaagagg

SEQ ID NO: 3607338 - DNA, 14 bp, Homo sapiens
acacctttctcctt

SEQ ID NO: 3607339 - DNA, 17 bp, Homo sapiens
acacctttctcctttgt

SEQ ID NO: 3607340 - DNA, 23 bp, Homo sapiens
acacgatgttgtcaaggatggtt

SEQ ID NO: 3607341 - DNA, 17 bp, Homo sapiens
acacgctgctctgcccc

SEQ ID NO: 3607342 - DNA, 14 bp, Homo sapiens
acactaaactccat

SEQ ID NO: 3607343 - DNA, 17 bp, Homo sapiens
acactaacgaaatatca

SEQ ID NO: 3607344 - DNA, 21 bp, Homo sapiens
acactaacgaaatatcaaagt

SEQ ID NO: 3607345 - DNA, 13 bp, Homo sapiens
acactcagaaaat

SEQ ID NO: 3607346 - DNA, 20 bp, Homo sapiens
acactcatggggaagcttcc

SEQ ID NO: 3607347 - DNA, 19 bp, Homo sapiens
acactcttcagtgactcct

SEQ ID NO: 3607348 - DNA, 14 bp, Homo sapiens
acactgatgcaagg

SEQ ID NO: 3607349 - DNA, 20 bp, Homo sapiens
acactgctctaacagccctc

SEQ ID NO: 3607350 - DNA, 19 bp, Homo sapiens
acactgcttggcccttcaa

SEQ ID NO: 3607351 - DNA, 24 bp, Homo sapiens
acactggcgtctggactgttctgt

SEQ ID NO: 3607352 - DNA, 15 bp, Homo sapiens
acactggctttacat

SEQ ID NO: 3607353 - DNA, 17 bp, Homo sapiens
acactgtaagctttgtt

SEQ ID NO: 3607354 - DNA, 19 bp, Homo sapiens
acactgttgataaaaactc

SEQ ID NO: 3607355 - DNA, 15 bp, Homo sapiens
acactgttttataga

SEQ ID NO: 3607356 - DNA, 16 bp, Homo sapiens
acactgttttatagaa

SEQ ID NO: 3607357 - DNA, 13 bp, Homo sapiens
acacttaatagca

SEQ ID NO: 3607358 - DNA, 15 bp, Homo sapiens
acacttataaaataa

SEQ ID NO: 3607359 - DNA, 20 bp, Homo sapiens
acacttctcttaagtggtct

SEQ ID NO: 3607360 - DNA, 19 bp, Homo sapiens
acacttgtgattataaaat

SEQ ID NO: 3607361 - DNA, 13 bp, Homo sapiens
acacttgttttct

SEQ ID NO: 3607362 - DNA, 17 bp, Homo sapiens
acacttgttttctttgt

SEQ ID NO: 3607363 - DNA, 15 bp, Homo sapiens
acactttctggcaaa

SEQ ID NO: 3607364 - DNA, 17 bp, Homo sapiens
acactttgcactgatat

SEQ ID NO: 3607365 - DNA, 14 bp, Homo sapiens
acagaaaagtgcct

SEQ ID NO: 3607366 - DNA, 18 bp, Homo sapiens
acagaaaagtgcctgagc

SEQ ID NO: 3607367 - DNA, 16 bp, Homo sapiens
acagaaaccttttatt

SEQ ID NO: 3607368 - DNA, 18 bp, Homo sapiens
acagaaaccttttatttt

SEQ ID NO: 3607369 - DNA, 13 bp, Homo sapiens
acagaaactgatg

SEQ ID NO: 3607370 - DNA, 16 bp, Homo sapiens
acagaaactgatgcca

SEQ ID NO: 3607371 - DNA, 16 bp, Homo sapiens
acagaaaggttttctt

SEQ ID NO: 3607372 - DNA, 16 bp, Homo sapiens
acagaacatgctgtta

SEQ ID NO: 3607373 - DNA, 22 bp, Homo sapiens
acagaactcggtgtccccacca

SEQ ID NO: 3607374 - DNA, 13 bp, Homo sapiens
acagaacttgtgg

SEQ ID NO: 3607375 - DNA, 18 bp, Homo sapiens
acagacaagcagcccttg

SEQ ID NO: 3607376 - DNA, 22 bp, Homo sapiens
acagacactaacgaaatatcaa

SEQ ID NO: 3607377 - DNA, 14 bp, Homo sapiens
acagacatatatat

SEQ ID NO: 3607378 - DNA, 20 bp, Homo sapiens
acagaccatattacctggat

SEQ ID NO: 3607379 - DNA, 15 bp, Homo sapiens
acagactccatctct

SEQ ID NO: 3607380 - DNA, 24 bp, Homo sapiens
acagactccatctcttctgcaagc

SEQ ID NO: 3607381 - DNA, 20 bp, Homo sapiens
acagactggatgtaccacca

SEQ ID NO: 3607382 - DNA, 16 bp, Homo sapiens
acagactttagctttc

SEQ ID NO: 3607383 - DNA, 19 bp, Homo sapiens
acagactttagctttctga

SEQ ID NO: 3607384 - DNA, 20 bp, Homo sapiens
acagactttagctttctgag

SEQ ID NO: 3607385 - DNA, 20 bp, Homo sapiens
acagagaagtttgtagccag

SEQ ID NO: 3607386 - DNA, 22 bp, Homo sapiens
acagagaagtttgtagccaggt

SEQ ID NO: 3607387 - DNA, 14 bp, Homo sapiens
acagagaggggcag

SEQ ID NO: 3607388 - DNA, 16 bp, Homo sapiens
acagaggacacagaga

SEQ ID NO: 3607389 - DNA, 23 bp, Homo sapiens
acagaggacagtatttgtgggga

SEQ ID NO: 3607390 - DNA, 15 bp, Homo sapiens
acagaggccccagcc

SEQ ID NO: 3607391 - DNA, 22 bp, Homo sapiens
acagaggccccagcctccctga

SEQ ID NO: 3607392 - DNA, 14 bp, Homo sapiens
acagagggaagcca

SEQ ID NO: 3607393 - DNA, 17 bp, Homo sapiens
acagagggaagccatgt

SEQ ID NO: 3607394 - DNA, 22 bp, Homo sapiens
acagaggtttgaaggagaatgg

SEQ ID NO: 3607395 - DNA, 21 bp, Homo sapiens
acagagtcttcactaaccttt

SEQ ID NO: 3607396 - DNA, 15 bp, Homo sapiens
acagagtgggccccg

SEQ ID NO: 3607397 - DNA, 15 bp, Homo sapiens
acagataataatggg

SEQ ID NO: 3607398 - DNA, 21 bp, Homo sapiens
acagataataatgggtttctt

SEQ ID NO: 3607399 - DNA, 21 bp, Homo sapiens
acagatattgttataaataaa

SEQ ID NO: 3607400 - DNA, 15 bp, Homo sapiens
acagatcactcctgg

SEQ ID NO: 3607401 - DNA, 18 bp, Homo sapiens
acagatcactcctggagg

SEQ ID NO: 3607402 - DNA, 14 bp, Homo sapiens
acagatcagaacat

SEQ ID NO: 3607403 - DNA, 17 bp, Homo sapiens
acagatcagaacatgaa

SEQ ID NO: 3607404 - DNA, 22 bp, Homo sapiens
acagatctgcaccaccatgccc

SEQ ID NO: 3607405 - DNA, 22 bp, Homo sapiens
acagatctggaacctcagcctg

SEQ ID NO: 3607406 - DNA, 16 bp, Homo sapiens
acagatgctgagccat

SEQ ID NO: 3607407 - DNA, 20 bp, Homo sapiens
acagattcaggccagcccag

SEQ ID NO: 3607408 - DNA, 13 bp, Homo sapiens
acagattctttat

SEQ ID NO: 3607409 - DNA, 20 bp, Homo sapiens
acagatttattcctttgtta

SEQ ID NO: 3607410 - DNA, 15 bp, Homo sapiens
acagatttggaaaga

SEQ ID NO: 3607411 - DNA, 15 bp, Homo sapiens
acagcaattcatggt

SEQ ID NO: 3607412 - DNA, 23 bp, Homo sapiens
acagcaattcatggttcaagtat

SEQ ID NO: 3607413 - DNA, 15 bp, Homo sapiens
acagcaattcctcag

SEQ ID NO: 3607414 - DNA, 17 bp, Homo sapiens
acagcacctccccgctg

SEQ ID NO: 3607415 - DNA, 17 bp, Homo sapiens
acagcagcccctgcaca

SEQ ID NO: 3607416 - DNA, 22 bp, Homo sapiens
acagcagctgcaggggcctctg

SEQ ID NO: 3607417 - DNA, 18 bp, Homo sapiens
acagcagtctccttcagc

SEQ ID NO: 3607418 - DNA, 20 bp, Homo sapiens
acagcagtctccttcagcac

SEQ ID NO: 3607419 - DNA, 21 bp, Homo sapiens
acagcagtctccttcagcacg

SEQ ID NO: 3607420 - DNA, 14 bp, Homo sapiens
acagcagtttccag

SEQ ID NO: 3607421 - DNA, 15 bp, Homo sapiens
acagcagtttccaga

SEQ ID NO: 3607422 - DNA, 22 bp, Homo sapiens
acagcatcgggagcacccagag

SEQ ID NO: 3607423 - DNA, 23 bp, Homo sapiens
acagcatgaataaaacactcatc

SEQ ID NO: 3607424 - DNA, 12 bp, Homo sapiens
acagccaagctg

SEQ ID NO: 3607425 - DNA, 17 bp, Homo sapiens
acagccaagctggcaca

SEQ ID NO: 3607426 - DNA, 12 bp, Homo sapiens
acagccacaccg

SEQ ID NO: 3607427 - DNA, 15 bp, Homo sapiens
acagccattttccaa

SEQ ID NO: 3607428 - DNA, 15 bp, Homo sapiens
acagccccaccctgg

SEQ ID NO: 3607429 - DNA, 21 bp, Homo sapiens
acagccctgcctgagaagccc

SEQ ID NO: 3607430 - DNA, 12 bp, Homo sapiens
acagccctggca

SEQ ID NO: 3607431 - DNA, 20 bp, Homo sapiens
acagccctggcaaatgcctg

SEQ ID NO: 3607432 - DNA, 11 bp, Homo sapiens
acagcctggca

SEQ ID NO: 3607433 - DNA, 12 bp, Homo sapiens
acagcctggcac

SEQ ID NO: 3607434 - DNA, 13 bp, Homo sapiens
acagccttcccca

SEQ ID NO: 3607435 - DNA, 20 bp, Homo sapiens
acagccttctaaattcccaa

SEQ ID NO: 3607436 - DNA, 16 bp, Homo sapiens
acagcctttgcccaaa

SEQ ID NO: 3607437 - DNA, 22 bp, Homo sapiens
acagcgggtacttatttctcag

SEQ ID NO: 3607438 - DNA, 22 bp, Homo sapiens
acagcggtcagatagcatcaga

SEQ ID NO: 3607439 - DNA, 22 bp, Homo sapiens
acagctaatcagcattctcact

SEQ ID NO: 3607440 - DNA, 14 bp, Homo sapiens
acagctacaaccct

SEQ ID NO: 3607441 - DNA, 24 bp, Homo sapiens
acagctacaaccctaccctggcag

SEQ ID NO: 3607442 - DNA, 19 bp, Homo sapiens
acagctcctccatgcctga

SEQ ID NO: 3607443 - DNA, 13 bp, Homo sapiens
acagctctagaca

SEQ ID NO: 3607444 - DNA, 12 bp, Homo sapiens
acagctcttcat

SEQ ID NO: 3607445 - DNA, 13 bp, Homo sapiens
acagctcttcatt

SEQ ID NO: 3607446 - DNA, 18 bp, Homo sapiens
acagctcttccagggcag

SEQ ID NO: 3607447 - DNA, 19 bp, Homo sapiens
acagctcttccagggcagc

SEQ ID NO: 3607448 - DNA, 21 bp, Homo sapiens
acagctgataaatttaatcct

SEQ ID NO: 3607449 - DNA, 12 bp, Homo sapiens
acagctgcccta

SEQ ID NO: 3607450 - DNA, 17 bp, Homo sapiens
acagctgccctagctga

SEQ ID NO: 3607451 - DNA, 12 bp, Homo sapiens
acagctgcctgc

SEQ ID NO: 3607452 - DNA, 21 bp, Homo sapiens
acagctgctcctagagggagg

SEQ ID NO: 3607453 - DNA, 23 bp, Homo sapiens
acagctgctcctagagggagggg

SEQ ID NO: 3607454 - DNA, 14 bp, Homo sapiens
acagctgctttgag

SEQ ID NO: 3607455 - DNA, 22 bp, Homo sapiens
acagctggctgggccttcacca

SEQ ID NO: 3607456 - DNA, 22 bp, Homo sapiens
acagcttacaggagccagcctg

SEQ ID NO: 3607457 - DNA, 14 bp, Homo sapiens
acagcttcctcaca

SEQ ID NO: 3607458 - DNA, 23 bp, Homo sapiens
acagcttcctcacacccctgtcc

SEQ ID NO: 3607459 - DNA, 12 bp, Homo sapiens
acagcttctctg

SEQ ID NO: 3607460 - DNA, 13 bp, Homo sapiens
acagcttctctgc

SEQ ID NO: 3607461 - DNA, 14 bp, Homo sapiens
acagcttctctgca

SEQ ID NO: 3607462 - DNA, 17 bp, Homo sapiens
acagcttctctgcagta

SEQ ID NO: 3607463 - DNA, 11 bp, Homo sapiens
acagctttgct

SEQ ID NO: 3607464 - DNA, 16 bp, Homo sapiens
acagctttgtctccaa

SEQ ID NO: 3607465 - DNA, 23 bp, Homo sapiens
acagctttgtctccaaagaagat

SEQ ID NO: 3607466 - DNA, 14 bp, Homo sapiens
acaggaaaaacaaa

SEQ ID NO: 3607467 - DNA, 21 bp, Homo sapiens
acaggaaaataaaatatttaa

SEQ ID NO: 3607468 - DNA, 12 bp, Homo sapiens
acaggaaagagc

SEQ ID NO: 3607469 - DNA, 21 bp, Homo sapiens
acaggaaagagctaggaaccc

SEQ ID NO: 3607470 - DNA, 13 bp, Homo sapiens
acaggaaaggagc

SEQ ID NO: 3607471 - DNA, 13 bp, Homo sapiens
acaggaccccagc

SEQ ID NO: 3607472 - DNA, 17 bp, Homo sapiens
acaggaccccagctctg

SEQ ID NO: 3607473 - DNA, 13 bp, Homo sapiens
acaggaccctcag

SEQ ID NO: 3607474 - DNA, 15 bp, Homo sapiens
acaggaccctcagga

SEQ ID NO: 3607475 - DNA, 16 bp, Homo sapiens
acaggaccctcaggaa

SEQ ID NO: 3607476 - DNA, 22 bp, Homo sapiens
acaggagaggcagcatgcttgg

SEQ ID NO: 3607477 - DNA, 18 bp, Homo sapiens
acaggagatgctgtgccc

SEQ ID NO: 3607478 - DNA, 12 bp, Homo sapiens
acaggagccagc

SEQ ID NO: 3607479 - DNA, 13 bp, Homo sapiens
acaggagggccag

SEQ ID NO: 3607480 - DNA, 14 bp, Homo sapiens
acaggagggccagc

SEQ ID NO: 3607481 - DNA, 14 bp, Homo sapiens
acaggattattgga

SEQ ID NO: 3607482 - DNA, 17 bp, Homo sapiens
acaggccctccctgtct

SEQ ID NO: 3607483 - DNA, 17 bp, Homo sapiens
acaggcgcctaaagtca

SEQ ID NO: 3607484 - DNA, 18 bp, Homo sapiens
acaggcgcctaaagtcat

SEQ ID NO: 3607485 - DNA, 22 bp, Homo sapiens
acaggcgtgagccactgttccc

SEQ ID NO: 3607486 - DNA, 17 bp, Homo sapiens
acaggctcgtcagccac

SEQ ID NO: 3607487 - DNA, 20 bp, Homo sapiens
acaggctcgtcagccacctg

SEQ ID NO: 3607488 - DNA, 23 bp, Homo sapiens
acaggctgaaatatccacccagc

SEQ ID NO: 3607489 - DNA, 12 bp, Homo sapiens
acaggctgaaga

SEQ ID NO: 3607490 - DNA, 22 bp, Homo sapiens
acagggaatggccacaaacctg

SEQ ID NO: 3607491 - DNA, 19 bp, Homo sapiens
acagggatctgtttgaaca

SEQ ID NO: 3607492 - DNA, 22 bp, Homo sapiens
acagggcagtccttactccccc

SEQ ID NO: 3607493 - DNA, 21 bp, Homo sapiens
acagggctgataagctaacac

SEQ ID NO: 3607494 - DNA, 14 bp, Homo sapiens
acagggtcttgcta

SEQ ID NO: 3607495 - DNA, 17 bp, Homo sapiens
acaggtattttgtttct

SEQ ID NO: 3607496 - DNA, 18 bp, Homo sapiens
acaggtattttgtttctt

SEQ ID NO: 3607497 - DNA, 21 bp, Homo sapiens
acagtacctgattgtattttt

SEQ ID NO: 3607498 - DNA, 13 bp, Homo sapiens
acagtaggtcccg

SEQ ID NO: 3607499 - DNA, 19 bp, Homo sapiens
acagtaggtcccggccagc

SEQ ID NO: 3607500 - DNA, 20 bp, Homo sapiens
acagtaggtcccggccagct

SEQ ID NO: 3607501 - DNA, 21 bp, Homo sapiens
acagtaggtcccggccagctc

SEQ ID NO: 3607502 - DNA, 15 bp, Homo sapiens
acagtatataagctt

SEQ ID NO: 3607503 - DNA, 16 bp, Homo sapiens
acagtatctgctgttc

SEQ ID NO: 3607504 - DNA, 19 bp, Homo sapiens
acagtattaacactaaatt

SEQ ID NO: 3607505 - DNA, 19 bp, Homo sapiens
acagtatttctacattaca

SEQ ID NO: 3607506 - DNA, 16 bp, Homo sapiens
acagtccacaggggcc

SEQ ID NO: 3607507 - DNA, 18 bp, Homo sapiens
acagtccacaggggccac

SEQ ID NO: 3607508 - DNA, 22 bp, Homo sapiens
acagtccgcagttgtagcagaa

SEQ ID NO: 3607509 - DNA, 13 bp, Homo sapiens
acagtctcaggaa

SEQ ID NO: 3607510 - DNA, 14 bp, Homo sapiens
acagtctcaggaaa

SEQ ID NO: 3607511 - DNA, 16 bp, Homo sapiens
acagtctcaggaaatc

SEQ ID NO: 3607512 - DNA, 16 bp, Homo sapiens
acagtctgctcctctt

SEQ ID NO: 3607513 - DNA, 14 bp, Homo sapiens
acagtgagcctgaa

SEQ ID NO: 3607514 - DNA, 19 bp, Homo sapiens
acagtgccatccccacctt

SEQ ID NO: 3607515 - DNA, 17 bp, Homo sapiens
acagtgctcttttctcc

SEQ ID NO: 3607516 - DNA, 21 bp, Homo sapiens
acagtgctcttttctcctcac

SEQ ID NO: 3607517 - DNA, 19 bp, Homo sapiens
acagtgggcgttgggagcc

SEQ ID NO: 3607518 - DNA, 17 bp, Homo sapiens
acagtggggctgcaggc

SEQ ID NO: 3607519 - DNA, 17 bp, Homo sapiens
acagtggtggcaacatt

SEQ ID NO: 3607520 - DNA, 21 bp, Homo sapiens
acagtggtggcaacattcatt

SEQ ID NO: 3607521 - DNA, 21 bp, Homo sapiens
acagtgttggagaacaacaaa

SEQ ID NO: 3607522 - DNA, 12 bp, Homo sapiens
acagttctgtgg

SEQ ID NO: 3607523 - DNA, 18 bp, Homo sapiens
acagttctttgggccaga

SEQ ID NO: 3607524 - DNA, 21 bp, Homo sapiens
acagttctttgggccagacat

SEQ ID NO: 3607525 - DNA, 16 bp, Homo sapiens
acagttgatggagccc

SEQ ID NO: 3607526 - DNA, 16 bp, Homo sapiens
acagttggtaactttt

SEQ ID NO: 3607527 - DNA, 24 bp, Homo sapiens
acagttggtaacttttgtgaatta

SEQ ID NO: 3607528 - DNA, 23 bp, Homo sapiens
acagtttcttgcttggaagccag

SEQ ID NO: 3607529 - DNA, 15 bp, Homo sapiens
acagttttctgagaa

SEQ ID NO: 3607530 - DNA, 17 bp, Homo sapiens
acagttttctgagaaag

SEQ ID NO: 3607531 - DNA, 21 bp, Homo sapiens
acataaaaaggacatcagcaa

SEQ ID NO: 3607532 - DNA, 13 bp, Homo sapiens
acataaaacagaa

SEQ ID NO: 3607533 - DNA, 13 bp, Homo sapiens
acataaacaaaga

SEQ ID NO: 3607534 - DNA, 16 bp, Homo sapiens
acataaacaaagacat

SEQ ID NO: 3607535 - DNA, 17 bp, Homo sapiens
acataaacaaagacatt

SEQ ID NO: 3607536 - DNA, 13 bp, Homo sapiens
acataaacacatt

SEQ ID NO: 3607537 - DNA, 16 bp, Homo sapiens
acataacggaaagttt

SEQ ID NO: 3607538 - DNA, 18 bp, Homo sapiens
acataagtaacttttaaa

SEQ ID NO: 3607539 - DNA, 13 bp, Homo sapiens
acataatgaaaat

SEQ ID NO: 3607540 - DNA, 13 bp, Homo sapiens
acatacaccagca

SEQ ID NO: 3607541 - DNA, 15 bp, Homo sapiens
acatacagagtgggc

SEQ ID NO: 3607542 - DNA, 14 bp, Homo sapiens
acatactatgaaat

SEQ ID NO: 3607543 - DNA, 13 bp, Homo sapiens
acatactgctgga

SEQ ID NO: 3607544 - DNA, 20 bp, Homo sapiens
acatacttgaagggccagag

SEQ ID NO: 3607545 - DNA, 21 bp, Homo sapiens
acatagcttacaagccagctg

SEQ ID NO: 3607546 - DNA, 16 bp, Homo sapiens
acatagtgatggttcc

SEQ ID NO: 3607547 - DNA, 16 bp, Homo sapiens
acatatgtaaacataa

SEQ ID NO: 3607548 - DNA, 14 bp, Homo sapiens
acatattatttcat

SEQ ID NO: 3607549 - DNA, 18 bp, Homo sapiens
acatcaacatcttggtca

SEQ ID NO: 3607550 - DNA, 16 bp, Homo sapiens
acatcagccccacagg

SEQ ID NO: 3607551 - DNA, 20 bp, Homo sapiens
acatcagtctccaacatgtt

SEQ ID NO: 3607552 - DNA, 18 bp, Homo sapiens
acatccctcagtttctta

SEQ ID NO: 3607553 - DNA, 21 bp, Homo sapiens
acatcccttcctggaaacagc

SEQ ID NO: 3607554 - DNA, 12 bp, Homo sapiens
acatccttctca

SEQ ID NO: 3607555 - DNA, 15 bp, Homo sapiens
acatccttctcactg

SEQ ID NO: 3607556 - DNA, 17 bp, Homo sapiens
acatccttctcactgcc

SEQ ID NO: 3607557 - DNA, 22 bp, Homo sapiens
acatcgcaatagttttttactt

SEQ ID NO: 3607558 - DNA, 16 bp, Homo sapiens
acatcgcacagtttac

SEQ ID NO: 3607559 - DNA, 17 bp, Homo sapiens
acatctacaaaacatta

SEQ ID NO: 3607560 - DNA, 22 bp, Homo sapiens
acatctggctggaaagcagagc

SEQ ID NO: 3607561 - DNA, 17 bp, Homo sapiens
acatgaaatatattttc

SEQ ID NO: 3607562 - DNA, 13 bp, Homo sapiens
acatgaaatgccc

SEQ ID NO: 3607563 - DNA, 14 bp, Homo sapiens
acatgaagcagaac

SEQ ID NO: 3607564 - DNA, 21 bp, Homo sapiens
acatgaatgggcatttctaaa

SEQ ID NO: 3607565 - DNA, 21 bp, Homo sapiens
acatgatccccgtctctgccc

SEQ ID NO: 3607566 - DNA, 15 bp, Homo sapiens
acatgatcttcttta

SEQ ID NO: 3607567 - DNA, 22 bp, Homo sapiens
acatgatgttatgtaccatatg

SEQ ID NO: 3607568 - DNA, 15 bp, Homo sapiens
acatgcagaaattga

SEQ ID NO: 3607569 - DNA, 20 bp, Homo sapiens
acatgcataaaaattaaatg

SEQ ID NO: 3607570 - DNA, 16 bp, Homo sapiens
acatgcatataatgaa

SEQ ID NO: 3607571 - DNA, 23 bp, Homo sapiens
acatgcatataatgaataaatca

SEQ ID NO: 3607572 - DNA, 13 bp, Homo sapiens
acatgctcacaca

SEQ ID NO: 3607573 - DNA, 15 bp, Homo sapiens
acatgctcacacatt

SEQ ID NO: 3607574 - DNA, 14 bp, Homo sapiens
acatggaacagtgt

SEQ ID NO: 3607575 - DNA, 19 bp, Homo sapiens
acatggagccccctctgcc

SEQ ID NO: 3607576 - DNA, 17 bp, Homo sapiens
acatggccatcttcttt

SEQ ID NO: 3607577 - DNA, 19 bp, Homo sapiens
acatggtgtggggggctgg

SEQ ID NO: 3607578 - DNA, 18 bp, Homo sapiens
acatgtattgcacattgt

SEQ ID NO: 3607579 - DNA, 21 bp, Homo sapiens
acatgtattgcacattgtaaa

SEQ ID NO: 3607580 - DNA, 23 bp, Homo sapiens
acatgtcctgcctattatctgtc

SEQ ID NO: 3607581 - DNA, 17 bp, Homo sapiens
acatgtgaaaagaatag

SEQ ID NO: 3607582 - DNA, 21 bp, Homo sapiens
acatgtgacatttatatattg

SEQ ID NO: 3607583 - DNA, 13 bp, Homo sapiens
acatgttctttgt

SEQ ID NO: 3607584 - DNA, 15 bp, Homo sapiens
acatgttctttgtac

SEQ ID NO: 3607585 - DNA, 16 bp, Homo sapiens
acatgtttaactttaa

SEQ ID NO: 3607586 - DNA, 17 bp, Homo sapiens
acatgttttttcatttg

SEQ ID NO: 3607587 - DNA, 18 bp, Homo sapiens
acattaaaataaaccaaa

SEQ ID NO: 3607588 - DNA, 13 bp, Homo sapiens
acattaaattgat

SEQ ID NO: 3607589 - DNA, 22 bp, Homo sapiens
acattacaaagttaaaattgtt

SEQ ID NO: 3607590 - DNA, 16 bp, Homo sapiens
acattacttatttaac

SEQ ID NO: 3607591 - DNA, 15 bp, Homo sapiens
acattagagaaaacc

SEQ ID NO: 3607592 - DNA, 18 bp, Homo sapiens
acattcagactaaaaata

SEQ ID NO: 3607593 - DNA, 18 bp, Homo sapiens
acattcagctctggagaa

SEQ ID NO: 3607594 - DNA, 21 bp, Homo sapiens
acattcagctctggagaacag

SEQ ID NO: 3607595 - DNA, 21 bp, Homo sapiens
acattcccctcccacctctcc

SEQ ID NO: 3607596 - DNA, 13 bp, Homo sapiens
acattcctccagc

SEQ ID NO: 3607597 - DNA, 16 bp, Homo sapiens
acattcgtgagctggg

SEQ ID NO: 3607598 - DNA, 18 bp, Homo sapiens
acattcgtgagctgggga

SEQ ID NO: 3607599 - DNA, 12 bp, Homo sapiens
acattctcacat

SEQ ID NO: 3607600 - DNA, 13 bp, Homo sapiens
acattctcacata

SEQ ID NO: 3607601 - DNA, 18 bp, Homo sapiens
acattgaatggatcaata

SEQ ID NO: 3607602 - DNA, 12 bp, Homo sapiens
acattgacagca

SEQ ID NO: 3607603 - DNA, 14 bp, Homo sapiens
acattgacagcaat

SEQ ID NO: 3607604 - DNA, 17 bp, Homo sapiens
acattgacagcaattca

SEQ ID NO: 3607605 - DNA, 21 bp, Homo sapiens
acattgctccaagatgttctc

SEQ ID NO: 3607606 - DNA, 14 bp, Homo sapiens
acattgctggctgc

SEQ ID NO: 3607607 - DNA, 22 bp, Homo sapiens
acattggcacctaatccaggca

SEQ ID NO: 3607608 - DNA, 20 bp, Homo sapiens
acattgttctttccggccaa

SEQ ID NO: 3607609 - DNA, 12 bp, Homo sapiens
acatttatttgg

SEQ ID NO: 3607610 - DNA, 16 bp, Homo sapiens
acatttccaaatgaac

SEQ ID NO: 3607611 - DNA, 19 bp, Homo sapiens
acatttgggagacatgtga

SEQ ID NO: 3607612 - DNA, 14 bp, Homo sapiens
acattttacattaa

SEQ ID NO: 3607613 - DNA, 22 bp, Homo sapiens
acattttagaatgtcaataaat

SEQ ID NO: 3607614 - DNA, 18 bp, Homo sapiens
acattttagctctattga

SEQ ID NO: 3607615 - DNA, 14 bp, Homo sapiens
acattttatgtctt

SEQ ID NO: 3607616 - DNA, 14 bp, Homo sapiens
acatttttaaattg

SEQ ID NO: 3607617 - DNA, 18 bp, Homo sapiens
acattttttttttaaatc

SEQ ID NO: 3607618 - DNA, 19 bp, Homo sapiens
accaaaaactgaaagtgaa

SEQ ID NO: 3607619 - DNA, 23 bp, Homo sapiens
accaaaagacattagagaaaacc

SEQ ID NO: 3607620 - DNA, 13 bp, Homo sapiens
accaaagacatca

SEQ ID NO: 3607621 - DNA, 13 bp, Homo sapiens
accaaatagtgat

SEQ ID NO: 3607622 - DNA, 20 bp, Homo sapiens
accaaatagtgattgtaaca

SEQ ID NO: 3607623 - DNA, 15 bp, Homo sapiens
accaaattgcactga

SEQ ID NO: 3607624 - DNA, 19 bp, Homo sapiens
accaaattgcactgaagtt

SEQ ID NO: 3607625 - DNA, 18 bp, Homo sapiens
accaacaagaaccactcc

SEQ ID NO: 3607626 - DNA, 17 bp, Homo sapiens
accaagccgtggcttcc

SEQ ID NO: 3607627 - DNA, 22 bp, Homo sapiens
accaatagttgccaatctaaaa

SEQ ID NO: 3607628 - DNA, 15 bp, Homo sapiens
accaatcaaatatat

SEQ ID NO: 3607629 - DNA, 16 bp, Homo sapiens
accaatgaaattttga

SEQ ID NO: 3607630 - DNA, 21 bp, Homo sapiens
accaatgccaaaaaaagacag

SEQ ID NO: 3607631 - DNA, 14 bp, Homo sapiens
accaattgaagcat

SEQ ID NO: 3607632 - DNA, 15 bp, Homo sapiens
accaattgaagcatg

SEQ ID NO: 3607633 - DNA, 18 bp, Homo sapiens
accaattgtcaaattacc

SEQ ID NO: 3607634 - DNA, 23 bp, Homo sapiens
accacacaacatccaagtggcct

SEQ ID NO: 3607635 - DNA, 11 bp, Homo sapiens
accacagcagt

SEQ ID NO: 3607636 - DNA, 12 bp, Homo sapiens
accacagcatcg

SEQ ID NO: 3607637 - DNA, 21 bp, Homo sapiens
accacagccttctaaattccc

SEQ ID NO: 3607638 - DNA, 17 bp, Homo sapiens
accacccggtccccact

SEQ ID NO: 3607639 - DNA, 21 bp, Homo sapiens
accaccctgccccccctaaga

SEQ ID NO: 3607640 - DNA, 15 bp, Homo sapiens
accacgaatgaggta

SEQ ID NO: 3607641 - DNA, 13 bp, Homo sapiens
accacgaggaaaa

SEQ ID NO: 3607642 - DNA, 19 bp, Homo sapiens
accacgggcccgggttggg

SEQ ID NO: 3607643 - DNA, 21 bp, Homo sapiens
accactatctccgttccatct

SEQ ID NO: 3607644 - DNA, 22 bp, Homo sapiens
accactatctccgttccatctg

SEQ ID NO: 3607645 - DNA, 18 bp, Homo sapiens
accactccccaacccctc

SEQ ID NO: 3607646 - DNA, 21 bp, Homo sapiens
accactccccaacccctctcc

SEQ ID NO: 3607647 - DNA, 23 bp, Homo sapiens
accactccccaacccctctccag

SEQ ID NO: 3607648 - DNA, 15 bp, Homo sapiens
accacttcagggctt

SEQ ID NO: 3607649 - DNA, 14 bp, Homo sapiens
accacttcctgagg

SEQ ID NO: 3607650 - DNA, 17 bp, Homo sapiens
accagaaagcttcatcc

SEQ ID NO: 3607651 - DNA, 13 bp, Homo sapiens
accagaagaacta

SEQ ID NO: 3607652 - DNA, 16 bp, Homo sapiens
accagacacccaggac

SEQ ID NO: 3607653 - DNA, 14 bp, Homo sapiens
accagacggggctg

SEQ ID NO: 3607654 - DNA, 21 bp, Homo sapiens
accagacggggctggagtgtg

SEQ ID NO: 3607655 - DNA, 21 bp, Homo sapiens
accagactacttgggagcacc

SEQ ID NO: 3607656 - DNA, 23 bp, Homo sapiens
accagactacttgggagcaccgc

SEQ ID NO: 3607657 - DNA, 14 bp, Homo sapiens
accagcaatttaga

SEQ ID NO: 3607658 - DNA, 17 bp, Homo sapiens
accagcattccttttga

SEQ ID NO: 3607659 - DNA, 14 bp, Homo sapiens
accagccagcctca

SEQ ID NO: 3607660 - DNA, 16 bp, Homo sapiens
accagccagcctcaga

SEQ ID NO: 3607661 - DNA, 14 bp, Homo sapiens
accagcctccatgc

SEQ ID NO: 3607662 - DNA, 19 bp, Homo sapiens
accagcctccatgctgcct

SEQ ID NO: 3607663 - DNA, 20 bp, Homo sapiens
accagcctccatgctgcctc

SEQ ID NO: 3607664 - DNA, 11 bp, Homo sapiens
accagcctggc

SEQ ID NO: 3607665 - DNA, 15 bp, Homo sapiens
accagcctggccaac

SEQ ID NO: 3607666 - DNA, 16 bp, Homo sapiens
accagctcaggacaga

SEQ ID NO: 3607667 - DNA, 19 bp, Homo sapiens
accaggaagaaggacttgt

SEQ ID NO: 3607668 - DNA, 14 bp, Homo sapiens
accaggatttattt

SEQ ID NO: 3607669 - DNA, 16 bp, Homo sapiens
accagggaagctgtcc

SEQ ID NO: 3607670 - DNA, 13 bp, Homo sapiens
accagggatgctg

SEQ ID NO: 3607671 - DNA, 14 bp, Homo sapiens
accagggatgctgg

SEQ ID NO: 3607672 - DNA, 17 bp, Homo sapiens
accaggggaggagcctg

SEQ ID NO: 3607673 - DNA, 12 bp, Homo sapiens
accaggggccaa

SEQ ID NO: 3607674 - DNA, 22 bp, Homo sapiens
accaggggccaacctcaggctc

SEQ ID NO: 3607675 - DNA, 15 bp, Homo sapiens
accagggtctctcag

SEQ ID NO: 3607676 - DNA, 20 bp, Homo sapiens
accagtaggggcttataata

SEQ ID NO: 3607677 - DNA, 19 bp, Homo sapiens
accagtatttagaagccaa

SEQ ID NO: 3607678 - DNA, 15 bp, Homo sapiens
accagtccccccacc

SEQ ID NO: 3607679 - DNA, 17 bp, Homo sapiens
accagtctcctcactct

SEQ ID NO: 3607680 - DNA, 20 bp, Homo sapiens
accagtctcctcactctgtc

SEQ ID NO: 3607681 - DNA, 14 bp, Homo sapiens
accagtctcctccc

SEQ ID NO: 3607682 - DNA, 16 bp, Homo sapiens
accagtgacgctgctg

SEQ ID NO: 3607683 - DNA, 15 bp, Homo sapiens
accagtgttcctgaa

SEQ ID NO: 3607684 - DNA, 13 bp, Homo sapiens
accataagagaaa

SEQ ID NO: 3607685 - DNA, 22 bp, Homo sapiens
accataagagaaacctgccaag

SEQ ID NO: 3607686 - DNA, 23 bp, Homo sapiens
accatatactgttcttcatttta

SEQ ID NO: 3607687 - DNA, 17 bp, Homo sapiens
accatattacctggatt

SEQ ID NO: 3607688 - DNA, 20 bp, Homo sapiens
accatattttattgtatttt

SEQ ID NO: 3607689 - DNA, 21 bp, Homo sapiens
accatattttattgtattttg

SEQ ID NO: 3607690 - DNA, 12 bp, Homo sapiens
accatcatccta

SEQ ID NO: 3607691 - DNA, 13 bp, Homo sapiens
accatcatgccct

SEQ ID NO: 3607692 - DNA, 12 bp, Homo sapiens
accatctgctgc

SEQ ID NO: 3607693 - DNA, 19 bp, Homo sapiens
accatctgctgcagttacc

SEQ ID NO: 3607694 - DNA, 15 bp, Homo sapiens
accatctgctgtctt

SEQ ID NO: 3607695 - DNA, 13 bp, Homo sapiens
accatctgtttga

SEQ ID NO: 3607696 - DNA, 16 bp, Homo sapiens
accatgcaaatgctat

SEQ ID NO: 3607697 - DNA, 21 bp, Homo sapiens
accatgcaggaaggaaaacta

SEQ ID NO: 3607698 - DNA, 17 bp, Homo sapiens
accatgcgtcaggggcc

SEQ ID NO: 3607699 - DNA, 14 bp, Homo sapiens
accatgctgctggg

SEQ ID NO: 3607700 - DNA, 16 bp, Homo sapiens
accatgctgctgggga

SEQ ID NO: 3607701 - DNA, 19 bp, Homo sapiens
accatgctgctggggaaga

SEQ ID NO: 3607702 - DNA, 19 bp, Homo sapiens
accattcctgcctttaagc

SEQ ID NO: 3607703 - DNA, 17 bp, Homo sapiens
accattctattctccag

SEQ ID NO: 3607704 - DNA, 18 bp, Homo sapiens
accattctattctccaga

SEQ ID NO: 3607705 - DNA, 16 bp, Homo sapiens
accattgagtccctgc

SEQ ID NO: 3607706 - DNA, 17 bp, Homo sapiens
accattgagtccctgct

SEQ ID NO: 3607707 - DNA, 21 bp, Homo sapiens
accattgcactctagcctggc

SEQ ID NO: 3607708 - DNA, 14 bp, Homo sapiens
accatttcagagag

SEQ ID NO: 3607709 - DNA, 13 bp, Homo sapiens
acccaaaccccca

SEQ ID NO: 3607710 - DNA, 14 bp, Homo sapiens
acccaaacccccaa

SEQ ID NO: 3607711 - DNA, 16 bp, Homo sapiens
acccaaaccccctgca

SEQ ID NO: 3607712 - DNA, 18 bp, Homo sapiens
acccaaagaggtatttat

SEQ ID NO: 3607713 - DNA, 14 bp, Homo sapiens
acccaaaggtggca

SEQ ID NO: 3607714 - DNA, 17 bp, Homo sapiens
acccaagatgtggcctt

SEQ ID NO: 3607715 - DNA, 15 bp, Homo sapiens
acccaaggtgaggtg

SEQ ID NO: 3607716 - DNA, 23 bp, Homo sapiens
acccaaggtgaggtgaactccag

SEQ ID NO: 3607717 - DNA, 21 bp, Homo sapiens
acccacaaactccaggctgga

SEQ ID NO: 3607718 - DNA, 16 bp, Homo sapiens
acccacacagctgccc

SEQ ID NO: 3607719 - DNA, 12 bp, Homo sapiens
acccaccacaca

SEQ ID NO: 3607720 - DNA, 17 bp, Homo sapiens
acccaccacccccttta

SEQ ID NO: 3607721 - DNA, 13 bp, Homo sapiens
acccacctccctg

SEQ ID NO: 3607722 - DNA, 16 bp, Homo sapiens
acccacctccctgcct

SEQ ID NO: 3607723 - DNA, 15 bp, Homo sapiens
acccagactcagaca

SEQ ID NO: 3607724 - DNA, 12 bp, Homo sapiens
acccagactgtc

SEQ ID NO: 3607725 - DNA, 15 bp, Homo sapiens
acccagactgtctcc

SEQ ID NO: 3607726 - DNA, 14 bp, Homo sapiens
acccagagatgcct

SEQ ID NO: 3607727 - DNA, 14 bp, Homo sapiens
acccagcatctccc

SEQ ID NO: 3607728 - DNA, 16 bp, Homo sapiens
acccagcatctcccag

SEQ ID NO: 3607729 - DNA, 13 bp, Homo sapiens
acccagctgcacc

SEQ ID NO: 3607730 - DNA, 13 bp, Homo sapiens
acccagtcccaca

SEQ ID NO: 3607731 - DNA, 14 bp, Homo sapiens
acccagtgggaaga

SEQ ID NO: 3607732 - DNA, 17 bp, Homo sapiens
acccatccccgcagtgt

SEQ ID NO: 3607733 - DNA, 19 bp, Homo sapiens
acccatcctaggaaccagc

SEQ ID NO: 3607734 - DNA, 20 bp, Homo sapiens
acccatctttaatttatatc

SEQ ID NO: 3607735 - DNA, 22 bp, Homo sapiens
acccatgaaagaaaacttttat

SEQ ID NO: 3607736 - DNA, 21 bp, Homo sapiens
acccattctgttttcccccag

SEQ ID NO: 3607737 - DNA, 21 bp, Homo sapiens
acccattttttaaaaaagcaa

SEQ ID NO: 3607738 - DNA, 15 bp, Homo sapiens
accccaagcttccca

SEQ ID NO: 3607739 - DNA, 21 bp, Homo sapiens
accccaagggggctgctgctc

SEQ ID NO: 3607740 - DNA, 20 bp, Homo sapiens
accccacagaaccttcaacc

SEQ ID NO: 3607741 - DNA, 18 bp, Homo sapiens
accccactcaggggaccc

SEQ ID NO: 3607742 - DNA, 14 bp, Homo sapiens
accccagccaggct

SEQ ID NO: 3607743 - DNA, 16 bp, Homo sapiens
accccagccaggctcc

SEQ ID NO: 3607744 - DNA, 11 bp, Homo sapiens
accccagctct

SEQ ID NO: 3607745 - DNA, 23 bp, Homo sapiens
accccaggacctcttctggagat

SEQ ID NO: 3607746 - DNA, 15 bp, Homo sapiens
accccatcatccctt

SEQ ID NO: 3607747 - DNA, 14 bp, Homo sapiens
accccatggccggc

SEQ ID NO: 3607748 - DNA, 22 bp, Homo sapiens
acccccacaagctgtccctgca

SEQ ID NO: 3607749 - DNA, 14 bp, Homo sapiens
accccccaagctgt

SEQ ID NO: 3607750 - DNA, 20 bp, Homo sapiens
accccccactcagtgcctcc

SEQ ID NO: 3607751 - DNA, 23 bp, Homo sapiens
accccctccaccccccactcagt

SEQ ID NO: 3607752 - DNA, 13 bp, Homo sapiens
accccctctggag

SEQ ID NO: 3607753 - DNA, 22 bp, Homo sapiens
accccctctggagaaggcctgg

SEQ ID NO: 3607754 - DNA, 17 bp, Homo sapiens
accccctgcagcccagg

SEQ ID NO: 3607755 - DNA, 18 bp, Homo sapiens
accccctgcagcccaggc

SEQ ID NO: 3607756 - DNA, 19 bp, Homo sapiens
accccctgctccaccagca

SEQ ID NO: 3607757 - DNA, 16 bp, Homo sapiens
acccccttccctggga

SEQ ID NO: 3607758 - DNA, 17 bp, Homo sapiens
acccccttccctgggag

SEQ ID NO: 3607759 - DNA, 16 bp, Homo sapiens
accccgagaaccctga

SEQ ID NO: 3607760 - DNA, 22 bp, Homo sapiens
accccgagaagtgctcttggct

SEQ ID NO: 3607761 - DNA, 22 bp, Homo sapiens
acccctaaagagatactttgat

SEQ ID NO: 3607762 - DNA, 15 bp, Homo sapiens
acccctagccctggt

SEQ ID NO: 3607763 - DNA, 14 bp, Homo sapiens
acccctcactcccc

SEQ ID NO: 3607764 - DNA, 18 bp, Homo sapiens
acccctcactccccaggg

SEQ ID NO: 3607765 - DNA, 13 bp, Homo sapiens
acccctctccagg

SEQ ID NO: 3607766 - DNA, 18 bp, Homo sapiens
acccctctccaggcctgt

SEQ ID NO: 3607767 - DNA, 20 bp, Homo sapiens
acccctctccaggcctgtca

SEQ ID NO: 3607768 - DNA, 13 bp, Homo sapiens
acccctctcttag

SEQ ID NO: 3607769 - DNA, 12 bp, Homo sapiens
acccctctggtg

SEQ ID NO: 3607770 - DNA, 19 bp, Homo sapiens
acccctgacctaccccagc

SEQ ID NO: 3607771 - DNA, 17 bp, Homo sapiens
acccctgagccagcagg

SEQ ID NO: 3607772 - DNA, 18 bp, Homo sapiens
acccctgagccagcaggg

SEQ ID NO: 3607773 - DNA, 19 bp, Homo sapiens
acccctggcttttcactgc

SEQ ID NO: 3607774 - DNA, 15 bp, Homo sapiens
accccttcctgggca

SEQ ID NO: 3607775 - DNA, 23 bp, Homo sapiens
accccttcctgggcacacgctgc

SEQ ID NO: 3607776 - DNA, 18 bp, Homo sapiens
accccttggaggagagag

SEQ ID NO: 3607777 - DNA, 17 bp, Homo sapiens
acccctttctgtcccac

SEQ ID NO: 3607778 - DNA, 23 bp, Homo sapiens
acccgcggcccgcgcagctgcct

SEQ ID NO: 3607779 - DNA, 21 bp, Homo sapiens
acccgggcaagggtcctcttt

SEQ ID NO: 3607780 - DNA, 13 bp, Homo sapiens
acccgggggagcc

SEQ ID NO: 3607781 - DNA, 14 bp, Homo sapiens
acccgtcctctcgg

SEQ ID NO: 3607782 - DNA, 15 bp, Homo sapiens
acccgtcctctcggc

SEQ ID NO: 3607783 - DNA, 16 bp, Homo sapiens
accctacagtatataa

SEQ ID NO: 3607784 - DNA, 17 bp, Homo sapiens
accctacctgtgcctga

SEQ ID NO: 3607785 - DNA, 17 bp, Homo sapiens
accctagccagagaata

SEQ ID NO: 3607786 - DNA, 11 bp, Homo sapiens
accctcagagc

SEQ ID NO: 3607787 - DNA, 21 bp, Homo sapiens
accctcaggcacaccttgcag

SEQ ID NO: 3607788 - DNA, 22 bp, Homo sapiens
accctcaggcacaccttgcaga

SEQ ID NO: 3607789 - DNA, 13 bp, Homo sapiens
accctcaggccac

SEQ ID NO: 3607790 - DNA, 18 bp, Homo sapiens
accctcatacacagaaac

SEQ ID NO: 3607791 - DNA, 12 bp, Homo sapiens
accctcctctgc

SEQ ID NO: 3607792 - DNA, 19 bp, Homo sapiens
accctcgggccccatcctc

SEQ ID NO: 3607793 - DNA, 11 bp, Homo sapiens
accctctgggg

SEQ ID NO: 3607794 - DNA, 13 bp, Homo sapiens
accctctgggggt

SEQ ID NO: 3607795 - DNA, 19 bp, Homo sapiens
accctctgggggtcctctc

SEQ ID NO: 3607796 - DNA, 23 bp, Homo sapiens
accctctgggggtcctctctgag

SEQ ID NO: 3607797 - DNA, 18 bp, Homo sapiens
accctgaaggggccatga

SEQ ID NO: 3607798 - DNA, 17 bp, Homo sapiens
accctgacctccgcccc

SEQ ID NO: 3607799 - DNA, 16 bp, Homo sapiens
accctgagcagggtcc

SEQ ID NO: 3607800 - DNA, 21 bp, Homo sapiens
accctgagcagggtccacagc

SEQ ID NO: 3607801 - DNA, 22 bp, Homo sapiens
accctgagcagggtccacagct

SEQ ID NO: 3607802 - DNA, 18 bp, Homo sapiens
accctgaggtcactgcta

SEQ ID NO: 3607803 - DNA, 19 bp, Homo sapiens
accctgaggtcactgctag

SEQ ID NO: 3607804 - DNA, 14 bp, Homo sapiens
accctgcgcctcca

SEQ ID NO: 3607805 - DNA, 21 bp, Homo sapiens
accctgctttggcggcccggc

SEQ ID NO: 3607806 - DNA, 11 bp, Homo sapiens
accctggcctc

SEQ ID NO: 3607807 - DNA, 19 bp, Homo sapiens
accctgggctacagaaacc

SEQ ID NO: 3607808 - DNA, 21 bp, Homo sapiens
accctgggtcaggaaattact

SEQ ID NO: 3607809 - DNA, 19 bp, Homo sapiens
accctggtggttgctgttt

SEQ ID NO: 3607810 - DNA, 15 bp, Homo sapiens
accctgtcacccaca

SEQ ID NO: 3607811 - DNA, 21 bp, Homo sapiens
accctgtcctgcagtcccaca

SEQ ID NO: 3607812 - DNA, 18 bp, Homo sapiens
accctgtgtcctccacca

SEQ ID NO: 3607813 - DNA, 22 bp, Homo sapiens
acccttgattcattctgaaccc

SEQ ID NO: 3607814 - DNA, 19 bp, Homo sapiens
acccttgctttcctgggcc

SEQ ID NO: 3607815 - DNA, 20 bp, Homo sapiens
acccttgctttcctgggcct

SEQ ID NO: 3607816 - DNA, 21 bp, Homo sapiens
accctttcagaatcttttcaa

SEQ ID NO: 3607817 - DNA, 16 bp, Homo sapiens
acccttttcccccttc

SEQ ID NO: 3607818 - DNA, 18 bp, Homo sapiens
acccttttcccccttccc

SEQ ID NO: 3607819 - DNA, 16 bp, Homo sapiens
accgaccaactgccct

SEQ ID NO: 3607820 - DNA, 12 bp, Homo sapiens
accgagccctgg

SEQ ID NO: 3607821 - DNA, 15 bp, Homo sapiens
accgagccctggaga

SEQ ID NO: 3607822 - DNA, 18 bp, Homo sapiens
accgagtctcttctccac

SEQ ID NO: 3607823 - DNA, 23 bp, Homo sapiens
accgcagaagcctccccagctca

SEQ ID NO: 3607824 - DNA, 20 bp, Homo sapiens
accgccacgtcccagcatcc

SEQ ID NO: 3607825 - DNA, 13 bp, Homo sapiens
accgcctcttccc

SEQ ID NO: 3607826 - DNA, 14 bp, Homo sapiens
accgcctcttcccg

SEQ ID NO: 3607827 - DNA, 22 bp, Homo sapiens
accggaaggaggccaaccagcc

SEQ ID NO: 3607828 - DNA, 22 bp, Homo sapiens
accggccaggccgcgcccagca

SEQ ID NO: 3607829 - DNA, 17 bp, Homo sapiens
accgtcacactcttcag

SEQ ID NO: 3607830 - DNA, 14 bp, Homo sapiens
accgtccaggcccc

SEQ ID NO: 3607831 - DNA, 22 bp, Homo sapiens
accgtccaggggagatggggag

SEQ ID NO: 3607832 - DNA, 15 bp, Homo sapiens
accgtggatttgtac

SEQ ID NO: 3607833 - DNA, 19 bp, Homo sapiens
acctaagtccttccacctg

SEQ ID NO: 3607834 - DNA, 15 bp, Homo sapiens
acctaatccaggcag

SEQ ID NO: 3607835 - DNA, 20 bp, Homo sapiens
acctaatccaggcagatcca

SEQ ID NO: 3607836 - DNA, 14 bp, Homo sapiens
acctacaataaact

SEQ ID NO: 3607837 - DNA, 18 bp, Homo sapiens
acctacaataaactggta

SEQ ID NO: 3607838 - DNA, 16 bp, Homo sapiens
acctacagactccatc

SEQ ID NO: 3607839 - DNA, 17 bp, Homo sapiens
acctacagactccatct

SEQ ID NO: 3607840 - DNA, 22 bp, Homo sapiens
acctacagactccatctcttct

SEQ ID NO: 3607841 - DNA, 13 bp, Homo sapiens
acctaccccagcc

SEQ ID NO: 3607842 - DNA, 16 bp, Homo sapiens
acctaccccagccagg

SEQ ID NO: 3607843 - DNA, 12 bp, Homo sapiens
acctagattttt

SEQ ID NO: 3607844 - DNA, 20 bp, Homo sapiens
acctattctgaaaaagacat

SEQ ID NO: 3607845 - DNA, 13 bp, Homo sapiens
acctatttttcct

SEQ ID NO: 3607846 - DNA, 15 bp, Homo sapiens
acctatttttccttt

SEQ ID NO: 3607847 - DNA, 16 bp, Homo sapiens
acctcaaactatctgg

SEQ ID NO: 3607848 - DNA, 20 bp, Homo sapiens
acctcaagccccatttcctc

SEQ ID NO: 3607849 - DNA, 23 bp, Homo sapiens
acctcaagtgatctgtccacctc

SEQ ID NO: 3607850 - DNA, 15 bp, Homo sapiens
acctcacctctttgt

SEQ ID NO: 3607851 - DNA, 22 bp, Homo sapiens
acctcactggcctgccatgcca

SEQ ID NO: 3607852 - DNA, 19 bp, Homo sapiens
acctcagattcttcattga

SEQ ID NO: 3607853 - DNA, 11 bp, Homo sapiens
acctcagcctg

SEQ ID NO: 3607854 - DNA, 16 bp, Homo sapiens
acctcagcctggccag

SEQ ID NO: 3607855 - DNA, 19 bp, Homo sapiens
acctcagcctggccagaca

SEQ ID NO: 3607856 - DNA, 19 bp, Homo sapiens
acctcagtggatcttcaga

SEQ ID NO: 3607857 - DNA, 22 bp, Homo sapiens
acctcagttgaaaatgcaactc

SEQ ID NO: 3607858 - DNA, 18 bp, Homo sapiens
acctcatctgtggagctg

SEQ ID NO: 3607859 - DNA, 22 bp, Homo sapiens
acctcatctgtggagctgccac

SEQ ID NO: 3607860 - DNA, 23 bp, Homo sapiens
acctcattctggttccctgctgc

SEQ ID NO: 3607861 - DNA, 12 bp, Homo sapiens
acctccaagcat

SEQ ID NO: 3607862 - DNA, 20 bp, Homo sapiens
acctccacacccaccccctc

SEQ ID NO: 3607863 - DNA, 18 bp, Homo sapiens
acctccagactcagcaga

SEQ ID NO: 3607864 - DNA, 21 bp, Homo sapiens
acctccagcctccctgtctcc

SEQ ID NO: 3607865 - DNA, 22 bp, Homo sapiens
acctccgcccctgcccccgctc

SEQ ID NO: 3607866 - DNA, 23 bp, Homo sapiens
acctccgcccctgcccccgctcc

SEQ ID NO: 3607867 - DNA, 14 bp, Homo sapiens
acctcctaaataaa

SEQ ID NO: 3607868 - DNA, 16 bp, Homo sapiens
acctcctcccactgcc

SEQ ID NO: 3607869 - DNA, 19 bp, Homo sapiens
acctcctcccactgcccac

SEQ ID NO: 3607870 - DNA, 23 bp, Homo sapiens
acctcctcccgaaaaatgtgtgg

SEQ ID NO: 3607871 - DNA, 22 bp, Homo sapiens
acctcggagggatggagaaaga

SEQ ID NO: 3607872 - DNA, 19 bp, Homo sapiens
acctcgtcaagagcatgca

SEQ ID NO: 3607873 - DNA, 19 bp, Homo sapiens
acctcgtgccaccccgagg

SEQ ID NO: 3607874 - DNA, 14 bp, Homo sapiens
acctctcctcatgt

SEQ ID NO: 3607875 - DNA, 17 bp, Homo sapiens
acctctgtggtcaccca

SEQ ID NO: 3607876 - DNA, 21 bp, Homo sapiens
acctctgtggtcacccatgca

SEQ ID NO: 3607877 - DNA, 22 bp, Homo sapiens
acctctgtggtcacccatgcat

SEQ ID NO: 3607878 - DNA, 11 bp, Homo sapiens
acctcttctgg

SEQ ID NO: 3607879 - DNA, 16 bp, Homo sapiens
acctgaaaggaaggtt

SEQ ID NO: 3607880 - DNA, 23 bp, Homo sapiens
acctgaaggggttttcttgataa

SEQ ID NO: 3607881 - DNA, 11 bp, Homo sapiens
acctgacaatt

SEQ ID NO: 3607882 - DNA, 19 bp, Homo sapiens
acctgagagcatctcagga

SEQ ID NO: 3607883 - DNA, 22 bp, Homo sapiens
acctgagagcatctcaggaggg

SEQ ID NO: 3607884 - DNA, 22 bp, Homo sapiens
acctgatcctggaggcccagtt

SEQ ID NO: 3607885 - DNA, 15 bp, Homo sapiens
acctgattgtatttt

SEQ ID NO: 3607886 - DNA, 23 bp, Homo sapiens
acctgattgtattttttttttaa

SEQ ID NO: 3607887 - DNA, 21 bp, Homo sapiens
acctgatttccatttgcaaca

SEQ ID NO: 3607888 - DNA, 15 bp, Homo sapiens
acctgcaaagatctg

SEQ ID NO: 3607889 - DNA, 18 bp, Homo sapiens
acctgccaaggagcatcc

SEQ ID NO: 3607890 - DNA, 23 bp, Homo sapiens
acctgccaaggagcatccttggc

SEQ ID NO: 3607891 - DNA, 22 bp, Homo sapiens
acctgccacccccttccctggg

SEQ ID NO: 3607892 - DNA, 13 bp, Homo sapiens
acctgcccaacct

SEQ ID NO: 3607893 - DNA, 21 bp, Homo sapiens
acctgcccaacctgctctcct

SEQ ID NO: 3607894 - DNA, 16 bp, Homo sapiens
acctgcccctgcctga

SEQ ID NO: 3607895 - DNA, 14 bp, Homo sapiens
acctgcctccacca

SEQ ID NO: 3607896 - DNA, 16 bp, Homo sapiens
acctgcctccaccagc

SEQ ID NO: 3607897 - DNA, 12 bp, Homo sapiens
acctgctccaga

SEQ ID NO: 3607898 - DNA, 22 bp, Homo sapiens
acctgctccagaagatgccagc

SEQ ID NO: 3607899 - DNA, 12 bp, Homo sapiens
acctgctctcct

SEQ ID NO: 3607900 - DNA, 19 bp, Homo sapiens
acctgcttttcaatgtgtt

SEQ ID NO: 3607901 - DNA, 19 bp, Homo sapiens
acctggagcttcagccagg

SEQ ID NO: 3607902 - DNA, 16 bp, Homo sapiens
acctggcaaaggaccc

SEQ ID NO: 3607903 - DNA, 17 bp, Homo sapiens
acctggcagctctggac

SEQ ID NO: 3607904 - DNA, 16 bp, Homo sapiens
acctggcctagaaagg

SEQ ID NO: 3607905 - DNA, 17 bp, Homo sapiens
acctggccttaaagagg

SEQ ID NO: 3607906 - DNA, 23 bp, Homo sapiens
acctggcggtgtataccaggcag

SEQ ID NO: 3607907 - DNA, 15 bp, Homo sapiens
acctggcgtgctcag

SEQ ID NO: 3607908 - DNA, 19 bp, Homo sapiens
acctgggcatttggtgaga

SEQ ID NO: 3607909 - DNA, 23 bp, Homo sapiens
acctggtcacaggactctgcctc

SEQ ID NO: 3607910 - DNA, 14 bp, Homo sapiens
acctggtccccact

SEQ ID NO: 3607911 - DNA, 22 bp, Homo sapiens
acctggtccccactgctgagct

SEQ ID NO: 3607912 - DNA, 13 bp, Homo sapiens
acctggttgagtg

SEQ ID NO: 3607913 - DNA, 15 bp, Homo sapiens
acctgtaatgacagg

SEQ ID NO: 3607914 - DNA, 20 bp, Homo sapiens
acctgtaatgacaggcctgt

SEQ ID NO: 3607915 - DNA, 17 bp, Homo sapiens
acctgtatgtctccagt

SEQ ID NO: 3607916 - DNA, 15 bp, Homo sapiens
acctgtcctgtcttt

SEQ ID NO: 3607917 - DNA, 20 bp, Homo sapiens
acctgtcttattaagactgg

SEQ ID NO: 3607918 - DNA, 18 bp, Homo sapiens
acctgtgactcttagccc

SEQ ID NO: 3607919 - DNA, 20 bp, Homo sapiens
acctgtggaacataaaaagg

SEQ ID NO: 3607920 - DNA, 15 bp, Homo sapiens
acctgtggtcatgtg

SEQ ID NO: 3607921 - DNA, 20 bp, Homo sapiens
acctgtgtttttttctaaaa

SEQ ID NO: 3607922 - DNA, 18 bp, Homo sapiens
acctgttcatttgaagaa

SEQ ID NO: 3607923 - DNA, 13 bp, Homo sapiens
acctgttcctccc

SEQ ID NO: 3607924 - DNA, 16 bp, Homo sapiens
acctgttcttgggcct

SEQ ID NO: 3607925 - DNA, 21 bp, Homo sapiens
acctgttcttgggcctcaggc

SEQ ID NO: 3607926 - DNA, 13 bp, Homo sapiens
acctgtttaaata

SEQ ID NO: 3607927 - DNA, 23 bp, Homo sapiens
accttaaaagtaataaagagaaa

SEQ ID NO: 3607928 - DNA, 20 bp, Homo sapiens
accttacaacgccgagtgca

SEQ ID NO: 3607929 - DNA, 22 bp, Homo sapiens
accttatagttactgtgtaatt

SEQ ID NO: 3607930 - DNA, 23 bp, Homo sapiens
accttatcactgcattattctct

SEQ ID NO: 3607931 - DNA, 16 bp, Homo sapiens
accttcgggctgtgcc

SEQ ID NO: 3607932 - DNA, 17 bp, Homo sapiens
accttctagttgccccc

SEQ ID NO: 3607933 - DNA, 14 bp, Homo sapiens
accttctatgtatt

SEQ ID NO: 3607934 - DNA, 13 bp, Homo sapiens
accttctgtggct

SEQ ID NO: 3607935 - DNA, 12 bp, Homo sapiens
accttctttcta

SEQ ID NO: 3607936 - DNA, 17 bp, Homo sapiens
accttgagttaacagga

SEQ ID NO: 3607937 - DNA, 23 bp, Homo sapiens
accttgcagaaggcaaggccctg

SEQ ID NO: 3607938 - DNA, 19 bp, Homo sapiens
accttgctctcctcatctc

SEQ ID NO: 3607939 - DNA, 14 bp, Homo sapiens
accttggcaccaga

SEQ ID NO: 3607940 - DNA, 14 bp, Homo sapiens
acctttatttatta

SEQ ID NO: 3607941 - DNA, 20 bp, Homo sapiens
acctttatttattaaacttc

SEQ ID NO: 3607942 - DNA, 18 bp, Homo sapiens
acctttcataatctttgc

SEQ ID NO: 3607943 - DNA, 20 bp, Homo sapiens
acctttcataatctttgctt

SEQ ID NO: 3607944 - DNA, 18 bp, Homo sapiens
acctttcatgtgcctgaa

SEQ ID NO: 3607945 - DNA, 15 bp, Homo sapiens
acctttctcctttgt

SEQ ID NO: 3607946 - DNA, 19 bp, Homo sapiens
acctttgagagatataata

SEQ ID NO: 3607947 - DNA, 15 bp, Homo sapiens
accttttcaaattaa

SEQ ID NO: 3607948 - DNA, 14 bp, Homo sapiens
accttttctctttt

SEQ ID NO: 3607949 - DNA, 22 bp, Homo sapiens
acgaaactccatctcaaaacaa

SEQ ID NO: 3607950 - DNA, 16 bp, Homo sapiens
acgaagctcattccca

SEQ ID NO: 3607951 - DNA, 16 bp, Homo sapiens
acgagcagcccagggc

SEQ ID NO: 3607952 - DNA, 19 bp, Homo sapiens
acgagcaggctactgtcag

SEQ ID NO: 3607953 - DNA, 20 bp, Homo sapiens
acgaggggcagggaaggaca

SEQ ID NO: 3607954 - DNA, 16 bp, Homo sapiens
acgatcaggaggaagt

SEQ ID NO: 3607955 - DNA, 17 bp, Homo sapiens
acgcaccattttgtcag

SEQ ID NO: 3607956 - DNA, 12 bp, Homo sapiens
acgccccaggac

SEQ ID NO: 3607957 - DNA, 23 bp, Homo sapiens
acgcccccccccacccctggggg

SEQ ID NO: 3607958 - DNA, 19 bp, Homo sapiens
acgcccctccaaacctcca

SEQ ID NO: 3607959 - DNA, 13 bp, Homo sapiens
acgcccctgtggc

SEQ ID NO: 3607960 - DNA, 14 bp, Homo sapiens
acgcccctgtggcc

SEQ ID NO: 3607961 - DNA, 16 bp, Homo sapiens
acgcccctgtggccaa

SEQ ID NO: 3607962 - DNA, 17 bp, Homo sapiens
acgcccctgtggccaac

SEQ ID NO: 3607963 - DNA, 19 bp, Homo sapiens
acgccctggtaaggctggt

SEQ ID NO: 3607964 - DNA, 19 bp, Homo sapiens
acgcctgaggcaattagac

SEQ ID NO: 3607965 - DNA, 13 bp, Homo sapiens
acgcgtctgcctg

SEQ ID NO: 3607966 - DNA, 14 bp, Homo sapiens
acgctcaatgccca

SEQ ID NO: 3607967 - DNA, 14 bp, Homo sapiens
acgctgctctgccc

SEQ ID NO: 3607968 - DNA, 14 bp, Homo sapiens
acggatctgctggg

SEQ ID NO: 3607969 - DNA, 22 bp, Homo sapiens
acggatggtgcatgggctcgcc

SEQ ID NO: 3607970 - DNA, 17 bp, Homo sapiens
acggattattttttcag

SEQ ID NO: 3607971 - DNA, 20 bp, Homo sapiens
acggattattttttcagacc

SEQ ID NO: 3607972 - DNA, 21 bp, Homo sapiens
acggattattttttcagaccg

SEQ ID NO: 3607973 - DNA, 18 bp, Homo sapiens
acggcaacgtagcctggg

SEQ ID NO: 3607974 - DNA, 17 bp, Homo sapiens
acggccagggagaagct

SEQ ID NO: 3607975 - DNA, 18 bp, Homo sapiens
acggccagggagaagctc

SEQ ID NO: 3607976 - DNA, 21 bp, Homo sapiens
acggcgtggtgtgtccctgga

SEQ ID NO: 3607977 - DNA, 15 bp, Homo sapiens
acgggaccagctcac

SEQ ID NO: 3607978 - DNA, 16 bp, Homo sapiens
acgggatgacctccag

SEQ ID NO: 3607979 - DNA, 16 bp, Homo sapiens
acgggcccgggttggg

SEQ ID NO: 3607980 - DNA, 20 bp, Homo sapiens
acgggcccgggttgggtcac

SEQ ID NO: 3607981 - DNA, 21 bp, Homo sapiens
acgggcccgggttgggtcacc

SEQ ID NO: 3607982 - DNA, 22 bp, Homo sapiens
acgggctcatgcacccctgagc

SEQ ID NO: 3607983 - DNA, 23 bp, Homo sapiens
acggtgttaattttgctaactgg

SEQ ID NO: 3607984 - DNA, 12 bp, Homo sapiens
acggttcctggt

SEQ ID NO: 3607985 - DNA, 19 bp, Homo sapiens
acggttcctggtgactcct

SEQ ID NO: 3607986 - DNA, 21 bp, Homo sapiens
acggtttttttctttggctgc

SEQ ID NO: 3607987 - DNA, 12 bp, Homo sapiens
acgtagcctggg

SEQ ID NO: 3607988 - DNA, 20 bp, Homo sapiens
acgtcccagcatccctggag

SEQ ID NO: 3607989 - DNA, 21 bp, Homo sapiens
acgtcccagcatccctggagc

SEQ ID NO: 3607990 - DNA, 13 bp, Homo sapiens
acgtccttgggcg

SEQ ID NO: 3607991 - DNA, 18 bp, Homo sapiens
acgtctccccttctctgc

SEQ ID NO: 3607992 - DNA, 23 bp, Homo sapiens
acgtctccccttctctgcctcac

SEQ ID NO: 3607993 - DNA, 16 bp, Homo sapiens
acgtgaagaaataaat

SEQ ID NO: 3607994 - DNA, 18 bp, Homo sapiens
acgtgaagaaataaatga

SEQ ID NO: 3607995 - DNA, 13 bp, Homo sapiens
acgtgacaggctc

SEQ ID NO: 3607996 - DNA, 18 bp, Homo sapiens
acgtgagagaaagagaga

SEQ ID NO: 3607997 - DNA, 20 bp, Homo sapiens
acgtgagagaaagagagaag

SEQ ID NO: 3607998 - DNA, 21 bp, Homo sapiens
acgtgagagaaagagagaagc

SEQ ID NO: 3607999 - DNA, 23 bp, Homo sapiens
acgtgagagaaagagagaagcca

SEQ ID NO: 3608000 - DNA, 22 bp, Homo sapiens
acgtgatctctgttacaaaaga

SEQ ID NO: 3608001 - DNA, 19 bp, Homo sapiens
acgtgctccgtagctctgc

SEQ ID NO: 3608002 - DNA, 21 bp, Homo sapiens
acgtgctccgtagctctgctg

SEQ ID NO: 3608003 - DNA, 24 bp, Homo sapiens
acgtgctccgtagctctgctgctg

SEQ ID NO: 3608004 - DNA, 13 bp, Homo sapiens
acgtgtaatgaca

SEQ ID NO: 3608005 - DNA, 17 bp, Homo sapiens
acgtttctcaaatctgc

SEQ ID NO: 3608006 - DNA, 22 bp, Homo sapiens
acgtttctcaaatctgcttcat

SEQ ID NO: 3608007 - DNA, 21 bp, Homo sapiens
actaaaaagtataaaatagta

SEQ ID NO: 3608008 - DNA, 12 bp, Homo sapiens
actaaaaatgca

SEQ ID NO: 3608009 - DNA, 20 bp, Homo sapiens
actaaagaagaggagaaaaa

SEQ ID NO: 3608010 - DNA, 20 bp, Homo sapiens
actaaagcttcagactcaag

SEQ ID NO: 3608011 - DNA, 21 bp, Homo sapiens
actaaagtgcttgaggctacc

SEQ ID NO: 3608012 - DNA, 19 bp, Homo sapiens
actaaatgatctctgaaag

SEQ ID NO: 3608013 - DNA, 23 bp, Homo sapiens
actaaattgcagtttacagtatt

SEQ ID NO: 3608014 - DNA, 17 bp, Homo sapiens
actaacatgtcctgcct

SEQ ID NO: 3608015 - DNA, 14 bp, Homo sapiens
actaaccaaatctc

SEQ ID NO: 3608016 - DNA, 18 bp, Homo sapiens
actaacccagtctttctt

SEQ ID NO: 3608017 - DNA, 16 bp, Homo sapiens
actaactatgcaataa

SEQ ID NO: 3608018 - DNA, 12 bp, Homo sapiens
actaagcagagg

SEQ ID NO: 3608019 - DNA, 18 bp, Homo sapiens
actaagtagaataaagaa

SEQ ID NO: 3608020 - DNA, 16 bp, Homo sapiens
actaagttattttatg

SEQ ID NO: 3608021 - DNA, 17 bp, Homo sapiens
actaagttattttatga

SEQ ID NO: 3608022 - DNA, 15 bp, Homo sapiens
actaatatttctgta

SEQ ID NO: 3608023 - DNA, 17 bp, Homo sapiens
actaatatttctgtaat

SEQ ID NO: 3608024 - DNA, 15 bp, Homo sapiens
actaatgtaaaatga

SEQ ID NO: 3608025 - DNA, 19 bp, Homo sapiens
actaatgtctcttctaaca

SEQ ID NO: 3608026 - DNA, 18 bp, Homo sapiens
actacacatttttaaatt

SEQ ID NO: 3608027 - DNA, 11 bp, Homo sapiens
actacatctgg

SEQ ID NO: 3608028 - DNA, 19 bp, Homo sapiens
actaccaaaagacattaga

SEQ ID NO: 3608029 - DNA, 15 bp, Homo sapiens
actaccagggtctct

SEQ ID NO: 3608030 - DNA, 19 bp, Homo sapiens
actaccagggtctctcagg

SEQ ID NO: 3608031 - DNA, 13 bp, Homo sapiens
actacccagctct

SEQ ID NO: 3608032 - DNA, 17 bp, Homo sapiens
actacctatccttacat

SEQ ID NO: 3608033 - DNA, 15 bp, Homo sapiens
actacctctgtgcct

SEQ ID NO: 3608034 - DNA, 14 bp, Homo sapiens
actacctggctgcg

SEQ ID NO: 3608035 - DNA, 17 bp, Homo sapiens
actactagtgtgactcc

SEQ ID NO: 3608036 - DNA, 20 bp, Homo sapiens
actactagtgtgactcctta

SEQ ID NO: 3608037 - DNA, 14 bp, Homo sapiens
actactctcttcct

SEQ ID NO: 3608038 - DNA, 15 bp, Homo sapiens
actactgacagggag

SEQ ID NO: 3608039 - DNA, 17 bp, Homo sapiens
actactgcagtctttat

SEQ ID NO: 3608040 - DNA, 12 bp, Homo sapiens
actactttataa

SEQ ID NO: 3608041 - DNA, 16 bp, Homo sapiens
actagagacaaatctt

SEQ ID NO: 3608042 - DNA, 21 bp, Homo sapiens
actagagggacctctcccagg

SEQ ID NO: 3608043 - DNA, 12 bp, Homo sapiens
actagatgtagt

SEQ ID NO: 3608044 - DNA, 13 bp, Homo sapiens
actagatgtagta

SEQ ID NO: 3608045 - DNA, 22 bp, Homo sapiens
actaggctcttatgtgtgcctt

SEQ ID NO: 3608046 - DNA, 17 bp, Homo sapiens
actagtagaagaagctt

SEQ ID NO: 3608047 - DNA, 19 bp, Homo sapiens
actagtgaccccttccctg

SEQ ID NO: 3608048 - DNA, 11 bp, Homo sapiens
actagtggaaa

SEQ ID NO: 3608049 - DNA, 19 bp, Homo sapiens
actagtggaaagtcaggct

SEQ ID NO: 3608050 - DNA, 18 bp, Homo sapiens
actataggcttcttcctt

SEQ ID NO: 3608051 - DNA, 17 bp, Homo sapiens
actatcatcttattcag

SEQ ID NO: 3608052 - DNA, 16 bp, Homo sapiens
actatcttggtgaatt

SEQ ID NO: 3608053 - DNA, 19 bp, Homo sapiens
actatgcacaacagagtaa

SEQ ID NO: 3608054 - DNA, 20 bp, Homo sapiens
actatgcatggtgccccagg

SEQ ID NO: 3608055 - DNA, 19 bp, Homo sapiens
actatgcgtggctggaacc

SEQ ID NO: 3608056 - DNA, 23 bp, Homo sapiens
actatgcgtggctggaaccacat

SEQ ID NO: 3608057 - DNA, 13 bp, Homo sapiens
actattacagtgt

SEQ ID NO: 3608058 - DNA, 14 bp, Homo sapiens
actattacagtgtt

SEQ ID NO: 3608059 - DNA, 15 bp, Homo sapiens
actattacagtgttg

SEQ ID NO: 3608060 - DNA, 13 bp, Homo sapiens
actattcaaacag

SEQ ID NO: 3608061 - DNA, 21 bp, Homo sapiens
actattcaaacagtctcagga

SEQ ID NO: 3608062 - DNA, 13 bp, Homo sapiens
actattggcccta

SEQ ID NO: 3608063 - DNA, 23 bp, Homo sapiens
actattgtgctcagagacactgt

SEQ ID NO: 3608064 - DNA, 12 bp, Homo sapiens
actatttcacat

SEQ ID NO: 3608065 - DNA, 14 bp, Homo sapiens
actattttcttttt

SEQ ID NO: 3608066 - DNA, 17 bp, Homo sapiens
actcaaaatatttgtac

SEQ ID NO: 3608067 - DNA, 19 bp, Homo sapiens
actcaaaatatttgtacat

SEQ ID NO: 3608068 - DNA, 14 bp, Homo sapiens
actcaaagacttcc

SEQ ID NO: 3608069 - DNA, 23 bp, Homo sapiens
actcaaatatgagtacaaatgcc

SEQ ID NO: 3608070 - DNA, 21 bp, Homo sapiens
actcaaatgctcagaccagct

SEQ ID NO: 3608071 - DNA, 17 bp, Homo sapiens
actcaaatggggccaga

SEQ ID NO: 3608072 - DNA, 22 bp, Homo sapiens
actcaacaaaacccatgcattt

SEQ ID NO: 3608073 - DNA, 17 bp, Homo sapiens
actcaagtacccattct

SEQ ID NO: 3608074 - DNA, 16 bp, Homo sapiens
actcaccctgggagcc

SEQ ID NO: 3608075 - DNA, 12 bp, Homo sapiens
tggatggtttgt

SEQ ID NO: 3608076 - DNA, 18 bp, Homo sapiens
tggatgttgctatagtga

SEQ ID NO: 3608077 - DNA, 23 bp, Homo sapiens
tggattataagttctattttact

SEQ ID NO: 3608078 - DNA, 18 bp, Homo sapiens
tggattcacccccctctg

SEQ ID NO: 3608079 - DNA, 20 bp, Homo sapiens
tggattcacccccctctgct

SEQ ID NO: 3608080 - DNA, 17 bp, Homo sapiens
tggattcatatttaatt

SEQ ID NO: 3608081 - DNA, 18 bp, Homo sapiens
tggattgcgcctaatgtg

SEQ ID NO: 3608082 - DNA, 19 bp, Homo sapiens
tggattgcgcctaatgtgt

SEQ ID NO: 3608083 - DNA, 13 bp, Homo sapiens
tggattgtattta

SEQ ID NO: 3608084 - DNA, 18 bp, Homo sapiens
tggattgtatttaagaca

SEQ ID NO: 3608085 - DNA, 20 bp, Homo sapiens
tggattgtgcctaatgtgtt

SEQ ID NO: 3608086 - DNA, 17 bp, Homo sapiens
tggatttgagctgtggc

SEQ ID NO: 3608087 - DNA, 14 bp, Homo sapiens
tggatttgtacttg

SEQ ID NO: 3608088 - DNA, 22 bp, Homo sapiens
tggattttccaggactgtttca

SEQ ID NO: 3608089 - DNA, 14 bp, Homo sapiens
tggcaacagagcga

SEQ ID NO: 3608090 - DNA, 16 bp, Homo sapiens
tggcaacattcattgc

SEQ ID NO: 3608091 - DNA, 15 bp, Homo sapiens
tggcaaccagccagc

SEQ ID NO: 3608092 - DNA, 16 bp, Homo sapiens
tggcaataaataaagc

SEQ ID NO: 3608093 - DNA, 17 bp, Homo sapiens
tggcacaaaagacagct

SEQ ID NO: 3608094 - DNA, 22 bp, Homo sapiens
tggcacaaaagacagctggcgg

SEQ ID NO: 3608095 - DNA, 18 bp, Homo sapiens
tggcacagaccaggcctt

SEQ ID NO: 3608096 - DNA, 16 bp, Homo sapiens
tggcacagggcagtgg

SEQ ID NO: 3608097 - DNA, 18 bp, Homo sapiens
tggcacagttttctgaga

SEQ ID NO: 3608098 - DNA, 20 bp, Homo sapiens
tggcacagttttctgagaaa

SEQ ID NO: 3608099 - DNA, 22 bp, Homo sapiens
tggcacagttttctgagaaaga

SEQ ID NO: 3608100 - DNA, 15 bp, Homo sapiens
tggcacatgccacct

SEQ ID NO: 3608101 - DNA, 17 bp, Homo sapiens
tggcaccagacacccag

SEQ ID NO: 3608102 - DNA, 20 bp, Homo sapiens
tggcaccagacacccaggac

SEQ ID NO: 3608103 - DNA, 14 bp, Homo sapiens
tggcaccatcagcc

SEQ ID NO: 3608104 - DNA, 17 bp, Homo sapiens
tggcaccatcagcctgt

SEQ ID NO: 3608105 - DNA, 18 bp, Homo sapiens
tggcacccccacaagctg

SEQ ID NO: 3608106 - DNA, 14 bp, Homo sapiens
tggcacccccatgc

SEQ ID NO: 3608107 - DNA, 15 bp, Homo sapiens
tggcacccccatgct

SEQ ID NO: 3608108 - DNA, 16 bp, Homo sapiens
tggcacccccatgctg

SEQ ID NO: 3608109 - DNA, 20 bp, Homo sapiens
tggcacctaatccaggcaga

SEQ ID NO: 3608110 - DNA, 13 bp, Homo sapiens
tggcactgactga

SEQ ID NO: 3608111 - DNA, 21 bp, Homo sapiens
tggcagagaccataagagaaa

SEQ ID NO: 3608112 - DNA, 12 bp, Homo sapiens
tggcagagccag

SEQ ID NO: 3608113 - DNA, 14 bp, Homo sapiens
tggcagagccaggc

SEQ ID NO: 3608114 - DNA, 17 bp, Homo sapiens
tggcagagttacagttc

SEQ ID NO: 3608115 - DNA, 20 bp, Homo sapiens
tggcagagttacagttctgt

SEQ ID NO: 3608116 - DNA, 12 bp, Homo sapiens
tggcagcagccc

SEQ ID NO: 3608117 - DNA, 19 bp, Homo sapiens
tggcagccgtgccttcagc

SEQ ID NO: 3608118 - DNA, 23 bp, Homo sapiens
tggcagccgtgccttcagctcta

SEQ ID NO: 3608119 - DNA, 11 bp, Homo sapiens
tggcagctgct

SEQ ID NO: 3608120 - DNA, 15 bp, Homo sapiens
tggcagctgctgtgg

SEQ ID NO: 3608121 - DNA, 19 bp, Homo sapiens
tggcagcttgctgggcttt

SEQ ID NO: 3608122 - DNA, 15 bp, Homo sapiens
tggcaggactcctgg

SEQ ID NO: 3608123 - DNA, 17 bp, Homo sapiens
tggcaggactcctggca

SEQ ID NO: 3608124 - DNA, 17 bp, Homo sapiens
tggcaggagtgggctct

SEQ ID NO: 3608125 - DNA, 19 bp, Homo sapiens
tggcagggacctgagagca

SEQ ID NO: 3608126 - DNA, 14 bp, Homo sapiens
tggcagggccacct

SEQ ID NO: 3608127 - DNA, 13 bp, Homo sapiens
tggcaggggagca

SEQ ID NO: 3608128 - DNA, 22 bp, Homo sapiens
tggcagggggccccgccagggc

SEQ ID NO: 3608129 - DNA, 22 bp, Homo sapiens
tggcaggtgtgggatctgggga

SEQ ID NO: 3608130 - DNA, 13 bp, Homo sapiens
tggcagtcctgga

SEQ ID NO: 3608131 - DNA, 14 bp, Homo sapiens
tggcagtcctggag

SEQ ID NO: 3608132 - DNA, 15 bp, Homo sapiens
tggcagtcctggagg

SEQ ID NO: 3608133 - DNA, 16 bp, Homo sapiens
tggcagtgactcccca

SEQ ID NO: 3608134 - DNA, 19 bp, Homo sapiens
tggcagtgggaatgttctt

SEQ ID NO: 3608135 - DNA, 23 bp, Homo sapiens
tggcagtgggaatgttctttctg

SEQ ID NO: 3608136 - DNA, 14 bp, Homo sapiens
tggcatagctctgg

SEQ ID NO: 3608137 - DNA, 20 bp, Homo sapiens
tggcatctgaatgaaaataa

SEQ ID NO: 3608138 - DNA, 21 bp, Homo sapiens
tggcatctgaatgaaaataac

SEQ ID NO: 3608139 - DNA, 15 bp, Homo sapiens
tggcatggcaggagt

SEQ ID NO: 3608140 - DNA, 21 bp, Homo sapiens
tggcattgctgcatatttgac

SEQ ID NO: 3608141 - DNA, 21 bp, Homo sapiens
tggccaactgcaaaaaaagcc

SEQ ID NO: 3608142 - DNA, 23 bp, Homo sapiens
tggccaactgcaaaaaaagcctc

SEQ ID NO: 3608143 - DNA, 15 bp, Homo sapiens
tggccaaggagctgc

SEQ ID NO: 3608144 - DNA, 16 bp, Homo sapiens
tggccaaggagctgct

SEQ ID NO: 3608145 - DNA, 19 bp, Homo sapiens
tggccaaggagctgctata

SEQ ID NO: 3608146 - DNA, 18 bp, Homo sapiens
tggccacaaacctgcccg

SEQ ID NO: 3608147 - DNA, 14 bp, Homo sapiens
tggccacatcagcc

SEQ ID NO: 3608148 - DNA, 12 bp, Homo sapiens
tggccactaagc

SEQ ID NO: 3608149 - DNA, 22 bp, Homo sapiens
tggccactccagacccctggct

SEQ ID NO: 3608150 - DNA, 13 bp, Homo sapiens
tggccagacacag

SEQ ID NO: 3608151 - DNA, 18 bp, Homo sapiens
tggccagacacaggccct

SEQ ID NO: 3608152 - DNA, 16 bp, Homo sapiens
tggccaggtggccact

SEQ ID NO: 3608153 - DNA, 19 bp, Homo sapiens
tggccagtgagatcaatgt

SEQ ID NO: 3608154 - DNA, 20 bp, Homo sapiens
tggccagtgagatcaatgtg

SEQ ID NO: 3608155 - DNA, 16 bp, Homo sapiens
tggccagtggctggat

SEQ ID NO: 3608156 - DNA, 23 bp, Homo sapiens
tggccagtggctggatctgtgag

SEQ ID NO: 3608157 - DNA, 17 bp, Homo sapiens
tggccatccttctgtgt

SEQ ID NO: 3608158 - DNA, 13 bp, Homo sapiens
tggccatcttctt

SEQ ID NO: 3608159 - DNA, 15 bp, Homo sapiens
tggccatcttctttc

SEQ ID NO: 3608160 - DNA, 17 bp, Homo sapiens
tggccatcttctttctt

SEQ ID NO: 3608161 - DNA, 23 bp, Homo sapiens
tggccatcttctttcttccaccc

SEQ ID NO: 3608162 - DNA, 22 bp, Homo sapiens
tggccatttccaagaggctgta

SEQ ID NO: 3608163 - DNA, 17 bp, Homo sapiens
tggcccagggcccagag

SEQ ID NO: 3608164 - DNA, 21 bp, Homo sapiens
tggcccagggcccagagccca

SEQ ID NO: 3608165 - DNA, 13 bp, Homo sapiens
tggccccctgtcc

SEQ ID NO: 3608166 - DNA, 15 bp, Homo sapiens
tggcccccttcagga

SEQ ID NO: 3608167 - DNA, 18 bp, Homo sapiens
tggcccccttcaggagcc

SEQ ID NO: 3608168 - DNA, 19 bp, Homo sapiens
tggcccccttcaggagcct

SEQ ID NO: 3608169 - DNA, 20 bp, Homo sapiens
tggcccctgaacaagaattg

SEQ ID NO: 3608170 - DNA, 14 bp, Homo sapiens
tggcccgacagcct

SEQ ID NO: 3608171 - DNA, 15 bp, Homo sapiens
tggcccgacagcctg

SEQ ID NO: 3608172 - DNA, 15 bp, Homo sapiens
tggccctcctcagct

SEQ ID NO: 3608173 - DNA, 21 bp, Homo sapiens
tggccctcctcagctccctgc

SEQ ID NO: 3608174 - DNA, 13 bp, Homo sapiens
tggccctgccgtt

SEQ ID NO: 3608175 - DNA, 20 bp, Homo sapiens
tggccctgggggtctgggcg

SEQ ID NO: 3608176 - DNA, 23 bp, Homo sapiens
tggcccttaagccaaactcaggc

SEQ ID NO: 3608177 - DNA, 13 bp, Homo sapiens
tggccgactcagg

SEQ ID NO: 3608178 - DNA, 17 bp, Homo sapiens
tggccgactcagggacc

SEQ ID NO: 3608179 - DNA, 22 bp, Homo sapiens
tggccggagcaaactctgctgt

SEQ ID NO: 3608180 - DNA, 13 bp, Homo sapiens
tggccgggcaggg

SEQ ID NO: 3608181 - DNA, 14 bp, Homo sapiens
tggcctagaaaggg

SEQ ID NO: 3608182 - DNA, 18 bp, Homo sapiens
tggcctcccacagactca

SEQ ID NO: 3608183 - DNA, 23 bp, Homo sapiens
tggcctccccatgggcacagtgg

SEQ ID NO: 3608184 - DNA, 21 bp, Homo sapiens
tggcctcttgagttcctctgc

SEQ ID NO: 3608185 - DNA, 22 bp, Homo sapiens
tggcctcttgagttcctctgca

SEQ ID NO: 3608186 - DNA, 13 bp, Homo sapiens
tggcctgcaggag

SEQ ID NO: 3608187 - DNA, 15 bp, Homo sapiens
tggcctggagcaggc

SEQ ID NO: 3608188 - DNA, 23 bp, Homo sapiens
tggcctggggtgcatctcctccc

SEQ ID NO: 3608189 - DNA, 16 bp, Homo sapiens
tggccttaaagaggga

SEQ ID NO: 3608190 - DNA, 22 bp, Homo sapiens
tggcctttttcatttatctata

SEQ ID NO: 3608191 - DNA, 22 bp, Homo sapiens
tggcgcccctgcctgtgcccgc

SEQ ID NO: 3608192 - DNA, 22 bp, Homo sapiens
tggcggcccggccggagggcag

SEQ ID NO: 3608193 - DNA, 22 bp, Homo sapiens
tggcggctgcacaacagccctg

SEQ ID NO: 3608194 - DNA, 16 bp, Homo sapiens
tggcggtggctgcccc

SEQ ID NO: 3608195 - DNA, 15 bp, Homo sapiens
tggcgtgctcagacc

SEQ ID NO: 3608196 - DNA, 13 bp, Homo sapiens
tggcgtggcctcc

SEQ ID NO: 3608197 - DNA, 14 bp, Homo sapiens
tggcgtggcctccc

SEQ ID NO: 3608198 - DNA, 17 bp, Homo sapiens
tggctaacttacaaaga

SEQ ID NO: 3608199 - DNA, 19 bp, Homo sapiens
tggctaatgtactgcatat

SEQ ID NO: 3608200 - DNA, 15 bp, Homo sapiens
tggctataggtgcta

SEQ ID NO: 3608201 - DNA, 12 bp, Homo sapiens
tggctcacaagg

SEQ ID NO: 3608202 - DNA, 17 bp, Homo sapiens
tggctcacaaggcccag

SEQ ID NO: 3608203 - DNA, 17 bp, Homo sapiens
tggctcccacaggccct

SEQ ID NO: 3608204 - DNA, 20 bp, Homo sapiens
tggctcccacaggcccttcc

SEQ ID NO: 3608205 - DNA, 20 bp, Homo sapiens
tggctcccggagggccctga

SEQ ID NO: 3608206 - DNA, 16 bp, Homo sapiens
tggctcctcccggtgc

SEQ ID NO: 3608207 - DNA, 12 bp, Homo sapiens
tggctcctctca

SEQ ID NO: 3608208 - DNA, 17 bp, Homo sapiens
tggctgacccctctggt

SEQ ID NO: 3608209 - DNA, 13 bp, Homo sapiens
tggctgagccctg

SEQ ID NO: 3608210 - DNA, 15 bp, Homo sapiens
tggctgcacaggctg

SEQ ID NO: 3608211 - DNA, 13 bp, Homo sapiens
tggctgcaggtgt

SEQ ID NO: 3608212 - DNA, 17 bp, Homo sapiens
tggctgggactgggaac

SEQ ID NO: 3608213 - DNA, 18 bp, Homo sapiens
tggctggggtggagtggg

SEQ ID NO: 3608214 - DNA, 21 bp, Homo sapiens
tggctggtagcagcaggctca

SEQ ID NO: 3608215 - DNA, 17 bp, Homo sapiens
tggctggtgggaaggcc

SEQ ID NO: 3608216 - DNA, 14 bp, Homo sapiens
tggctggtttctga

SEQ ID NO: 3608217 - DNA, 13 bp, Homo sapiens
tggcttcaaaaag

SEQ ID NO: 3608218 - DNA, 15 bp, Homo sapiens
tggcttcaaaaagcc

SEQ ID NO: 3608219 - DNA, 18 bp, Homo sapiens
tggcttcaaaaagccaca

SEQ ID NO: 3608220 - DNA, 15 bp, Homo sapiens
tggcttcccgctcag

SEQ ID NO: 3608221 - DNA, 18 bp, Homo sapiens
tggcttcccgctcagccc

SEQ ID NO: 3608222 - DNA, 21 bp, Homo sapiens
tggcttcccgctcagccctcc

SEQ ID NO: 3608223 - DNA, 17 bp, Homo sapiens
tggcttccctaaactgc

SEQ ID NO: 3608224 - DNA, 19 bp, Homo sapiens
tggcttccctaaactgcag

SEQ ID NO: 3608225 - DNA, 19 bp, Homo sapiens
tggcttgtctcacgcagcc

SEQ ID NO: 3608226 - DNA, 19 bp, Homo sapiens
tggctttatgcaaatacaa

SEQ ID NO: 3608227 - DNA, 15 bp, Homo sapiens
tggctttcagcctct

SEQ ID NO: 3608228 - DNA, 22 bp, Homo sapiens
tggctttcataaatcatgttgt

SEQ ID NO: 3608229 - DNA, 13 bp, Homo sapiens
tggctttgcccac

SEQ ID NO: 3608230 - DNA, 11 bp, Homo sapiens
tggctttgcct

SEQ ID NO: 3608231 - DNA, 13 bp, Homo sapiens
tggctttgcctct

SEQ ID NO: 3608232 - DNA, 18 bp, Homo sapiens
tggcttttcactgctggc

SEQ ID NO: 3608233 - DNA, 21 bp, Homo sapiens
tggcttttcactgctggctgc

SEQ ID NO: 3608234 - DNA, 13 bp, Homo sapiens
tgggaaaggggag

SEQ ID NO: 3608235 - DNA, 18 bp, Homo sapiens
tgggaaccactcccacca

SEQ ID NO: 3608236 - DNA, 20 bp, Homo sapiens
tgggaacccaagtccaagca

SEQ ID NO: 3608237 - DNA, 23 bp, Homo sapiens
tgggaagagaagagggcccagcc

SEQ ID NO: 3608238 - DNA, 16 bp, Homo sapiens
tgggaaggccggcagc

SEQ ID NO: 3608239 - DNA, 19 bp, Homo sapiens
tgggaagggagagttcttt

SEQ ID NO: 3608240 - DNA, 13 bp, Homo sapiens
tgggaagtttgct

SEQ ID NO: 3608241 - DNA, 15 bp, Homo sapiens
tgggaagtttgctgt

SEQ ID NO: 3608242 - DNA, 17 bp, Homo sapiens
tgggaagtttgctgtgc

SEQ ID NO: 3608243 - DNA, 18 bp, Homo sapiens
tgggaagtttgctgtgct

SEQ ID NO: 3608244 - DNA, 13 bp, Homo sapiens
tgggacagctggc

SEQ ID NO: 3608245 - DNA, 16 bp, Homo sapiens
tgggacagctggctgg

SEQ ID NO: 3608246 - DNA, 16 bp, Homo sapiens
tgggacagggcatggc

SEQ ID NO: 3608247 - DNA, 12 bp, Homo sapiens
tgggacccacag

SEQ ID NO: 3608248 - DNA, 13 bp, Homo sapiens
tgggacccacaga

SEQ ID NO: 3608249 - DNA, 17 bp, Homo sapiens
tgggacccacagaactt

SEQ ID NO: 3608250 - DNA, 19 bp, Homo sapiens
tgggaccccagagaaaacc

SEQ ID NO: 3608251 - DNA, 22 bp, Homo sapiens
tgggactagaggctcagtggtg

SEQ ID NO: 3608252 - DNA, 19 bp, Homo sapiens
tgggagaatgtcagtatgt

SEQ ID NO: 3608253 - DNA, 18 bp, Homo sapiens
tgggagagctggtggtgc

SEQ ID NO: 3608254 - DNA, 14 bp, Homo sapiens
tgggagatttggaa

SEQ ID NO: 3608255 - DNA, 21 bp, Homo sapiens
tgggagccaggactcccagaa

SEQ ID NO: 3608256 - DNA, 23 bp, Homo sapiens
tgggagccaggactcccagaacc

SEQ ID NO: 3608257 - DNA, 13 bp, Homo sapiens
tgggagcccagaa

SEQ ID NO: 3608258 - DNA, 13 bp, Homo sapiens
tgggagccgggca

SEQ ID NO: 3608259 - DNA, 21 bp, Homo sapiens
tgggagcctagctcctgccac

SEQ ID NO: 3608260 - DNA, 21 bp, Homo sapiens
tgggagcctggttcagacaca

SEQ ID NO: 3608261 - DNA, 15 bp, Homo sapiens
tgggagctgagctgg

SEQ ID NO: 3608262 - DNA, 13 bp, Homo sapiens
tgggaggagggag

SEQ ID NO: 3608263 - DNA, 14 bp, Homo sapiens
tgggaggagggagg

SEQ ID NO: 3608264 - DNA, 22 bp, Homo sapiens
tgggagtgaggatgtctgggcc

SEQ ID NO: 3608265 - DNA, 21 bp, Homo sapiens
tgggatagtgttctgctcctg

SEQ ID NO: 3608266 - DNA, 15 bp, Homo sapiens
tgggatatggctgcc

SEQ ID NO: 3608267 - DNA, 14 bp, Homo sapiens
tgggatattcttta

SEQ ID NO: 3608268 - DNA, 14 bp, Homo sapiens
tgggatatttaact

SEQ ID NO: 3608269 - DNA, 18 bp, Homo sapiens
tgggatccaggcccctcc

SEQ ID NO: 3608270 - DNA, 13 bp, Homo sapiens
tgggatctgggga

SEQ ID NO: 3608271 - DNA, 14 bp, Homo sapiens
tgggatctggggag

SEQ ID NO: 3608272 - DNA, 16 bp, Homo sapiens
tgggatctggggagag

SEQ ID NO: 3608273 - DNA, 19 bp, Homo sapiens
tgggatggtcggatctcac

SEQ ID NO: 3608274 - DNA, 20 bp, Homo sapiens
tgggatggtcggatctcaca

SEQ ID NO: 3608275 - DNA, 13 bp, Homo sapiens
tgggattttgcaa

SEQ ID NO: 3608276 - DNA, 15 bp, Homo sapiens
tgggattttgcaaaa

SEQ ID NO: 3608277 - DNA, 20 bp, Homo sapiens
tgggcaacgagtgaaactcc

SEQ ID NO: 3608278 - DNA, 15 bp, Homo sapiens
tgggcacaaacagaa

SEQ ID NO: 3608279 - DNA, 15 bp, Homo sapiens
tgggcacacgctgct

SEQ ID NO: 3608280 - DNA, 21 bp, Homo sapiens
tgggcacacgctgctctgccc

SEQ ID NO: 3608281 - DNA, 14 bp, Homo sapiens
tgggcactggtggg

SEQ ID NO: 3608282 - DNA, 17 bp, Homo sapiens
tgggcactggtgggcca

SEQ ID NO: 3608283 - DNA, 17 bp, Homo sapiens
tgggcagcaatttaaat

SEQ ID NO: 3608284 - DNA, 18 bp, Homo sapiens
tgggcagccatcttgaat

SEQ ID NO: 3608285 - DNA, 12 bp, Homo sapiens
tgggcaggaagg

SEQ ID NO: 3608286 - DNA, 18 bp, Homo sapiens
tgggcatgggtccagggc

SEQ ID NO: 3608287 - DNA, 16 bp, Homo sapiens
tgggcattagcaaggc

SEQ ID NO: 3608288 - DNA, 18 bp, Homo sapiens
tgggcattagcaaggcag

SEQ ID NO: 3608289 - DNA, 22 bp, Homo sapiens
tgggcatttctaaaatgttaaa

SEQ ID NO: 3608290 - DNA, 15 bp, Homo sapiens
tgggccactggggac

SEQ ID NO: 3608291 - DNA, 23 bp, Homo sapiens
tgggccactggggactttattta

SEQ ID NO: 3608292 - DNA, 13 bp, Homo sapiens
tgggccagacatg

SEQ ID NO: 3608293 - DNA, 18 bp, Homo sapiens
tgggccagacatgccaca

SEQ ID NO: 3608294 - DNA, 19 bp, Homo sapiens
tgggccagacatgccacaa

SEQ ID NO: 3608295 - DNA, 23 bp, Homo sapiens
tgggccataatgttgcttctcag

SEQ ID NO: 3608296 - DNA, 17 bp, Homo sapiens
tgggcccctgaggagct

SEQ ID NO: 3608297 - DNA, 19 bp, Homo sapiens
tgggccctctttccctgcg

SEQ ID NO: 3608298 - DNA, 14 bp, Homo sapiens
tgggccggctgagt

SEQ ID NO: 3608299 - DNA, 21 bp, Homo sapiens
tgggccggctgagtggcagca

SEQ ID NO: 3608300 - DNA, 11 bp, Homo sapiens
tgggcctcagg

SEQ ID NO: 3608301 - DNA, 20 bp, Homo sapiens
tgggcctgagggtccacctg

SEQ ID NO: 3608302 - DNA, 21 bp, Homo sapiens
tgggcctgagggtccacctgg

SEQ ID NO: 3608303 - DNA, 13 bp, Homo sapiens
tgggcctgcagaa

SEQ ID NO: 3608304 - DNA, 15 bp, Homo sapiens
tgggcctgctccaga

SEQ ID NO: 3608305 - DNA, 18 bp, Homo sapiens
tgggcctgctccagacct

SEQ ID NO: 3608306 - DNA, 14 bp, Homo sapiens
tgggcgcagtggct

SEQ ID NO: 3608307 - DNA, 17 bp, Homo sapiens
tgggcgcagtggctcac

SEQ ID NO: 3608308 - DNA, 14 bp, Homo sapiens
tgggcgtccagctc

SEQ ID NO: 3608309 - DNA, 21 bp, Homo sapiens
tgggcgtccagctcagccctg

SEQ ID NO: 3608310 - DNA, 17 bp, Homo sapiens
tgggcgttgggagccta

SEQ ID NO: 3608311 - DNA, 18 bp, Homo sapiens
tgggctgacccagcatct

SEQ ID NO: 3608312 - DNA, 20 bp, Homo sapiens
tgggctgcccacctggctgc

SEQ ID NO: 3608313 - DNA, 14 bp, Homo sapiens
tgggctgggccctc

SEQ ID NO: 3608314 - DNA, 19 bp, Homo sapiens
tgggcttcaacagccaagc

SEQ ID NO: 3608315 - DNA, 21 bp, Homo sapiens
tgggcttcaacagccaagctg

SEQ ID NO: 3608316 - DNA, 20 bp, Homo sapiens
tgggctttaacatccttatt

SEQ ID NO: 3608317 - DNA, 16 bp, Homo sapiens
tgggctttgggaagtt

SEQ ID NO: 3608318 - DNA, 15 bp, Homo sapiens
tggggaacggaggag

SEQ ID NO: 3608319 - DNA, 16 bp, Homo sapiens
tggggaacggaggagg

SEQ ID NO: 3608320 - DNA, 19 bp, Homo sapiens
tggggaacggaggaggaca

SEQ ID NO: 3608321 - DNA, 14 bp, Homo sapiens
tggggaagacagtg

SEQ ID NO: 3608322 - DNA, 14 bp, Homo sapiens
tggggacagcttcc

SEQ ID NO: 3608323 - DNA, 22 bp, Homo sapiens
tggggacagcttcctcacaccc

SEQ ID NO: 3608324 - DNA, 18 bp, Homo sapiens
tggggagagcggctggag

SEQ ID NO: 3608325 - DNA, 14 bp, Homo sapiens
tggggagggatttg

SEQ ID NO: 3608326 - DNA, 16 bp, Homo sapiens
tggggaggttgtgggg

SEQ ID NO: 3608327 - DNA, 15 bp, Homo sapiens
tggggatgaggtcac

SEQ ID NO: 3608328 - DNA, 15 bp, Homo sapiens
tggggattgcccctg

SEQ ID NO: 3608329 - DNA, 16 bp, Homo sapiens
tggggcagaggagaac

SEQ ID NO: 3608330 - DNA, 19 bp, Homo sapiens
tggggccactttcagagcc

SEQ ID NO: 3608331 - DNA, 13 bp, Homo sapiens
tggggccagatcc

SEQ ID NO: 3608332 - DNA, 18 bp, Homo sapiens
tggggccagatccagcct

SEQ ID NO: 3608333 - DNA, 21 bp, Homo sapiens
tggggccagatccagcctggg

SEQ ID NO: 3608334 - DNA, 22 bp, Homo sapiens
tggggccataaacggttcctgg

SEQ ID NO: 3608335 - DNA, 20 bp, Homo sapiens
tggggccatgcctcctcagg

SEQ ID NO: 3608336 - DNA, 19 bp, Homo sapiens
tggggccgccacggcctgg

SEQ ID NO: 3608337 - DNA, 13 bp, Homo sapiens
tggggcctcagcc

SEQ ID NO: 3608338 - DNA, 17 bp, Homo sapiens
tggggcctcaggctccg

SEQ ID NO: 3608339 - DNA, 15 bp, Homo sapiens
tggggctcagagtgg

SEQ ID NO: 3608340 - DNA, 15 bp, Homo sapiens
tggggctgagccctc

SEQ ID NO: 3608341 - DNA, 14 bp, Homo sapiens
tggggctttcccta

SEQ ID NO: 3608342 - DNA, 18 bp, Homo sapiens
tgggggaggccaccccaa

SEQ ID NO: 3608343 - DNA, 12 bp, Homo sapiens
tgggggagtgga

SEQ ID NO: 3608344 - DNA, 14 bp, Homo sapiens
tgggggatttcaaa

SEQ ID NO: 3608345 - DNA, 21 bp, Homo sapiens
tgggggcaggaaagccacatc

SEQ ID NO: 3608346 - DNA, 13 bp, Homo sapiens
tgggggtcctctc

SEQ ID NO: 3608347 - DNA, 14 bp, Homo sapiens
tgggggtctgtgtg

SEQ ID NO: 3608348 - DNA, 18 bp, Homo sapiens
tgggggtctgtgtgttta

SEQ ID NO: 3608349 - DNA, 21 bp, Homo sapiens
tgggggtgccgctctaaattg

SEQ ID NO: 3608350 - DNA, 19 bp, Homo sapiens
tgggggtgccgctgtctct

SEQ ID NO: 3608351 - DNA, 19 bp, Homo sapiens
tgggggtggggggactgcc

SEQ ID NO: 3608352 - DNA, 15 bp, Homo sapiens
tgggggttctttctt

SEQ ID NO: 3608353 - DNA, 21 bp, Homo sapiens
tggggtaggttgggagaatgt

SEQ ID NO: 3608354 - DNA, 12 bp, Homo sapiens
tggggtattttt

SEQ ID NO: 3608355 - DNA, 19 bp, Homo sapiens
tggggtccctccaccccac

SEQ ID NO: 3608356 - DNA, 19 bp, Homo sapiens
tggggtcctggccatccca

SEQ ID NO: 3608357 - DNA, 19 bp, Homo sapiens
tggggtctcctcaggacca

SEQ ID NO: 3608358 - DNA, 12 bp, Homo sapiens
tggggtgaatac

SEQ ID NO: 3608359 - DNA, 12 bp, Homo sapiens
tggggtgcatct

SEQ ID NO: 3608360 - DNA, 23 bp, Homo sapiens
tggggtttgtgtttgattggctt

SEQ ID NO: 3608361 - DNA, 19 bp, Homo sapiens
tgggtacctggtccccact

SEQ ID NO: 3608362 - DNA, 21 bp, Homo sapiens
tgggtatttttataacaatat

SEQ ID NO: 3608363 - DNA, 14 bp, Homo sapiens
tgggtccagggcct

SEQ ID NO: 3608364 - DNA, 21 bp, Homo sapiens
tgggtccagggcctgacaccc

SEQ ID NO: 3608365 - DNA, 22 bp, Homo sapiens
tgggtccagggcctgacacccc

SEQ ID NO: 3608366 - DNA, 19 bp, Homo sapiens
tgggtctgagtcatggccg

SEQ ID NO: 3608367 - DNA, 17 bp, Homo sapiens
tgggtctgattttctca

SEQ ID NO: 3608368 - DNA, 23 bp, Homo sapiens
tgggtctgggatatggctgccca

SEQ ID NO: 3608369 - DNA, 19 bp, Homo sapiens
tgggtctggggacaggccc

SEQ ID NO: 3608370 - DNA, 12 bp, Homo sapiens
tgggtgacattt

SEQ ID NO: 3608371 - DNA, 15 bp, Homo sapiens
tgggtgagagaggaa

SEQ ID NO: 3608372 - DNA, 17 bp, Homo sapiens
tgggtgtttttcatgtt

SEQ ID NO: 3608373 - DNA, 14 bp, Homo sapiens
tgggttctgcctgc

SEQ ID NO: 3608374 - DNA, 21 bp, Homo sapiens
tgggttctgcctgccagctgc

SEQ ID NO: 3608375 - DNA, 15 bp, Homo sapiens
tgggtttgggagcca

SEQ ID NO: 3608376 - DNA, 15 bp, Homo sapiens
tggtaaaacattact

SEQ ID NO: 3608377 - DNA, 18 bp, Homo sapiens
tggtaaaacattacttat

SEQ ID NO: 3608378 - DNA, 16 bp, Homo sapiens
tggtaaagcacatggt

SEQ ID NO: 3608379 - DNA, 22 bp, Homo sapiens
tggtaacttgagattcaagaca

SEQ ID NO: 3608380 - DNA, 14 bp, Homo sapiens
tggtaattgggaac

SEQ ID NO: 3608381 - DNA, 16 bp, Homo sapiens
tggtacaaggtggaga

SEQ ID NO: 3608382 - DNA, 13 bp, Homo sapiens
tggtacctgccct

SEQ ID NO: 3608383 - DNA, 14 bp, Homo sapiens
tggtacctgccctc

SEQ ID NO: 3608384 - DNA, 17 bp, Homo sapiens
tggtactcattaaaaaa

SEQ ID NO: 3608385 - DNA, 18 bp, Homo sapiens
tggtactcccaaactgac

SEQ ID NO: 3608386 - DNA, 15 bp, Homo sapiens
tggtactctgtgaaa

SEQ ID NO: 3608387 - DNA, 15 bp, Homo sapiens
tggtagatgctgagg

SEQ ID NO: 3608388 - DNA, 15 bp, Homo sapiens
tggtagcagcaggct

SEQ ID NO: 3608389 - DNA, 19 bp, Homo sapiens
tggtaggaccctcgagagc

SEQ ID NO: 3608390 - DNA, 22 bp, Homo sapiens
tggtaggaccctcgagagcctt

SEQ ID NO: 3608391 - DNA, 14 bp, Homo sapiens
tggtagttaacaca

SEQ ID NO: 3608392 - DNA, 15 bp, Homo sapiens
tggtagttttacagt

SEQ ID NO: 3608393 - DNA, 17 bp, Homo sapiens
tggtattctggtaggga

SEQ ID NO: 3608394 - DNA, 18 bp, Homo sapiens
tggtattggaatagcagc

SEQ ID NO: 3608395 - DNA, 16 bp, Homo sapiens
tggtattttcagagaa

SEQ ID NO: 3608396 - DNA, 21 bp, Homo sapiens
tggtcaaacaaactctctgaa

SEQ ID NO: 3608397 - DNA, 19 bp, Homo sapiens
tggtcaacatttctcatgt

SEQ ID NO: 3608398 - DNA, 20 bp, Homo sapiens
tggtcaacatttctcatgtt

SEQ ID NO: 3608399 - DNA, 19 bp, Homo sapiens
tggtcacgtttggtgcttc

SEQ ID NO: 3608400 - DNA, 15 bp, Homo sapiens
tggtcagatttgaac

SEQ ID NO: 3608401 - DNA, 15 bp, Homo sapiens
tggtccagctctgac

SEQ ID NO: 3608402 - DNA, 21 bp, Homo sapiens
tggtccagctctgacatccct

SEQ ID NO: 3608403 - DNA, 23 bp, Homo sapiens
tggtccatgtaaatactttccat

SEQ ID NO: 3608404 - DNA, 16 bp, Homo sapiens
tggtcccttaaggcac

SEQ ID NO: 3608405 - DNA, 12 bp, Homo sapiens
tggtcctaccca

SEQ ID NO: 3608406 - DNA, 19 bp, Homo sapiens
tggtccttctttcctctta

SEQ ID NO: 3608407 - DNA, 13 bp, Homo sapiens
tggtcggagaggg

SEQ ID NO: 3608408 - DNA, 22 bp, Homo sapiens
tggtcggatctcacaggctgag

SEQ ID NO: 3608409 - DNA, 22 bp, Homo sapiens
tggtctccccaattctcccctc

SEQ ID NO: 3608410 - DNA, 17 bp, Homo sapiens
tggtctcctcagcctcc

SEQ ID NO: 3608411 - DNA, 17 bp, Homo sapiens
tggtctcgaactcctga

SEQ ID NO: 3608412 - DNA, 18 bp, Homo sapiens
tggtctctgccccagcct

SEQ ID NO: 3608413 - DNA, 16 bp, Homo sapiens
tggtctgccttctgct

SEQ ID NO: 3608414 - DNA, 18 bp, Homo sapiens
tggtctggttcctgtgtg

SEQ ID NO: 3608415 - DNA, 22 bp, Homo sapiens
tggtcttatagtgtttggacag

SEQ ID NO: 3608416 - DNA, 23 bp, Homo sapiens
tggtcttatagtgtttggacagc

SEQ ID NO: 3608417 - DNA, 16 bp, Homo sapiens
tggtcttgtggaattg

SEQ ID NO: 3608418 - DNA, 18 bp, Homo sapiens
tggtgaaagggtttgata

SEQ ID NO: 3608419 - DNA, 20 bp, Homo sapiens
tggtgaaattataactatta

SEQ ID NO: 3608420 - DNA, 22 bp, Homo sapiens
tggtgaaattataactattaca

SEQ ID NO: 3608421 - DNA, 21 bp, Homo sapiens
tggtgaactgagctgggcagg

SEQ ID NO: 3608422 - DNA, 16 bp, Homo sapiens
tggtgacaaaattcat

SEQ ID NO: 3608423 - DNA, 20 bp, Homo sapiens
tggtgacaaaattcatttgc

SEQ ID NO: 3608424 - DNA, 18 bp, Homo sapiens
tggtgacacctccccctt

SEQ ID NO: 3608425 - DNA, 17 bp, Homo sapiens
tggtgagagtcaaagct

SEQ ID NO: 3608426 - DNA, 13 bp, Homo sapiens
tggtgagcaagca

SEQ ID NO: 3608427 - DNA, 20 bp, Homo sapiens
tggtgcacgcaggcacagca

SEQ ID NO: 3608428 - DNA, 15 bp, Homo sapiens
tggtgcagccttccc

SEQ ID NO: 3608429 - DNA, 18 bp, Homo sapiens
tggtgcagccttcccctc

SEQ ID NO: 3608430 - DNA, 19 bp, Homo sapiens
tggtgcagccttcccctcc

SEQ ID NO: 3608431 - DNA, 13 bp, Homo sapiens
tggtgccccagga

SEQ ID NO: 3608432 - DNA, 17 bp, Homo sapiens
tggtgccccaggaccag

SEQ ID NO: 3608433 - DNA, 19 bp, Homo sapiens
tggtgccccaggaccagct

SEQ ID NO: 3608434 - DNA, 22 bp, Homo sapiens
tggtgcgtttataattggctta

SEQ ID NO: 3608435 - DNA, 18 bp, Homo sapiens
tggtgctgccacacttca

SEQ ID NO: 3608436 - DNA, 17 bp, Homo sapiens
tggtggcagctgggcag

SEQ ID NO: 3608437 - DNA, 14 bp, Homo sapiens
tggtggctcatgcc

SEQ ID NO: 3608438 - DNA, 17 bp, Homo sapiens
tggtggctcatgcctgt

SEQ ID NO: 3608439 - DNA, 21 bp, Homo sapiens
tggtggctcccggagggccct

SEQ ID NO: 3608440 - DNA, 20 bp, Homo sapiens
tggtgggccaacaaagaaca

SEQ ID NO: 3608441 - DNA, 23 bp, Homo sapiens
tggtgggccaacaaagaacacta

SEQ ID NO: 3608442 - DNA, 17 bp, Homo sapiens
tggtggggtggcacctg

SEQ ID NO: 3608443 - DNA, 12 bp, Homo sapiens
tggtgggtaatt

SEQ ID NO: 3608444 - DNA, 20 bp, Homo sapiens
tggtgggtaattgtacaata

SEQ ID NO: 3608445 - DNA, 22 bp, Homo sapiens
tggtgggtaattgtacaataaa

SEQ ID NO: 3608446 - DNA, 12 bp, Homo sapiens
tggtggtgcagc

SEQ ID NO: 3608447 - DNA, 16 bp, Homo sapiens
tggtgtgaatttgcca

SEQ ID NO: 3608448 - DNA, 16 bp, Homo sapiens
tggtgtgtccctggac

SEQ ID NO: 3608449 - DNA, 17 bp, Homo sapiens
tggtgtgtccctggaca

SEQ ID NO: 3608450 - DNA, 19 bp, Homo sapiens
tggtgtgtccctggacaca

SEQ ID NO: 3608451 - DNA, 14 bp, Homo sapiens
tggtgttgactgga

SEQ ID NO: 3608452 - DNA, 14 bp, Homo sapiens
tggtgttgcagccg

SEQ ID NO: 3608453 - DNA, 15 bp, Homo sapiens
tggtgtttgtcatgg

SEQ ID NO: 3608454 - DNA, 13 bp, Homo sapiens
tggttagaaaaca

SEQ ID NO: 3608455 - DNA, 13 bp, Homo sapiens
tggttagaaatgc

SEQ ID NO: 3608456 - DNA, 15 bp, Homo sapiens
tggttattggttttt

SEQ ID NO: 3608457 - DNA, 15 bp, Homo sapiens
tggttcaagtattaa

SEQ ID NO: 3608458 - DNA, 23 bp, Homo sapiens
tggttcaagtattaagcagttca

SEQ ID NO: 3608459 - DNA, 18 bp, Homo sapiens
tggttcacctgtgactcc

SEQ ID NO: 3608460 - DNA, 22 bp, Homo sapiens
tggttcagacacagctcttcca

SEQ ID NO: 3608461 - DNA, 15 bp, Homo sapiens
tggttccatgttgac

SEQ ID NO: 3608462 - DNA, 11 bp, Homo sapiens
tggttcccctg

SEQ ID NO: 3608463 - DNA, 14 bp, Homo sapiens
tggttccctgctgc

SEQ ID NO: 3608464 - DNA, 22 bp, Homo sapiens
tggttcctgtgtgaccctgggc

SEQ ID NO: 3608465 - DNA, 13 bp, Homo sapiens
tggttccttctct

SEQ ID NO: 3608466 - DNA, 18 bp, Homo sapiens
tggttcgatacctggagc

SEQ ID NO: 3608467 - DNA, 20 bp, Homo sapiens
tggttctgaggccagaaagg

SEQ ID NO: 3608468 - DNA, 21 bp, Homo sapiens
tggttctgtgctaatcaaaac

SEQ ID NO: 3608469 - DNA, 12 bp, Homo sapiens
tggttgatggaa

SEQ ID NO: 3608470 - DNA, 15 bp, Homo sapiens
tggttgatggaaaat

SEQ ID NO: 3608471 - DNA, 19 bp, Homo sapiens
tggtttaaagaaagtgtat

SEQ ID NO: 3608472 - DNA, 17 bp, Homo sapiens
tggtttaattcagcaga

SEQ ID NO: 3608473 - DNA, 18 bp, Homo sapiens
tggtttattctttgcaaa

SEQ ID NO: 3608474 - DNA, 12 bp, Homo sapiens
tggtttcatgtt

SEQ ID NO: 3608475 - DNA, 15 bp, Homo sapiens
tggtttcatgttagt

SEQ ID NO: 3608476 - DNA, 19 bp, Homo sapiens
tggtttgccttttatgtaa

SEQ ID NO: 3608477 - DNA, 17 bp, Homo sapiens
tggtttgggggagaaga

SEQ ID NO: 3608478 - DNA, 15 bp, Homo sapiens
tggtttgttccctgt

SEQ ID NO: 3608479 - DNA, 12 bp, Homo sapiens
tgtaaaaatgtt

SEQ ID NO: 3608480 - DNA, 17 bp, Homo sapiens
tgtaaaacttctgctcg

SEQ ID NO: 3608481 - DNA, 19 bp, Homo sapiens
tgtaaaagcattttgtaat

SEQ ID NO: 3608482 - DNA, 20 bp, Homo sapiens
tgtaaaattgttaaccttgt

SEQ ID NO: 3608483 - DNA, 15 bp, Homo sapiens
tgtaaactcaaaata

SEQ ID NO: 3608484 - DNA, 23 bp, Homo sapiens
tgtaaactcaaaatatttgtaca

SEQ ID NO: 3608485 - DNA, 19 bp, Homo sapiens
tgtaaactgtttctttaaa

SEQ ID NO: 3608486 - DNA, 13 bp, Homo sapiens
tgtaaagaaatgt

SEQ ID NO: 3608487 - DNA, 19 bp, Homo sapiens
tgtaaagatgaatgtcagt

SEQ ID NO: 3608488 - DNA, 22 bp, Homo sapiens
tgtaaaggacctcctaaataaa

SEQ ID NO: 3608489 - DNA, 20 bp, Homo sapiens
tgtaaatgaaacttaagaat

SEQ ID NO: 3608490 - DNA, 16 bp, Homo sapiens
tgtaaatttatgtgat

SEQ ID NO: 3608491 - DNA, 23 bp, Homo sapiens
tgtaaattttttacgtagctatt

SEQ ID NO: 3608492 - DNA, 19 bp, Homo sapiens
tgtaacaaattgatctgtt

SEQ ID NO: 3608493 - DNA, 20 bp, Homo sapiens
tgtaacaggatacaggtgac

SEQ ID NO: 3608494 - DNA, 21 bp, Homo sapiens
tgtaacaggatacaggtgaca

SEQ ID NO: 3608495 - DNA, 14 bp, Homo sapiens
tgtaactaaaataa

SEQ ID NO: 3608496 - DNA, 16 bp, Homo sapiens
tgtaactactttataa

SEQ ID NO: 3608497 - DNA, 15 bp, Homo sapiens
tgtaacttccaaata

SEQ ID NO: 3608498 - DNA, 19 bp, Homo sapiens
tgtaacttccaaataaata

SEQ ID NO: 3608499 - DNA, 12 bp, Homo sapiens
tgtaacttcctg

SEQ ID NO: 3608500 - DNA, 14 bp, Homo sapiens
tgtaacttcctgct

SEQ ID NO: 3608501 - DNA, 14 bp, Homo sapiens
tgtaacttcctgtg

SEQ ID NO: 3608502 - DNA, 15 bp, Homo sapiens
tgtaacttcctgtgg

SEQ ID NO: 3608503 - DNA, 15 bp, Homo sapiens
tgtaacttttgtaag

SEQ ID NO: 3608504 - DNA, 20 bp, Homo sapiens
tgtaacttttgtaagacaaa

SEQ ID NO: 3608505 - DNA, 21 bp, Homo sapiens
tgtaagacaaaggttttcctc

SEQ ID NO: 3608506 - DNA, 19 bp, Homo sapiens
tgtaagatcgttctctgcc

SEQ ID NO: 3608507 - DNA, 19 bp, Homo sapiens
tgtaagggaaactgccagc

SEQ ID NO: 3608508 - DNA, 16 bp, Homo sapiens
tgtaagggcagtgccc

SEQ ID NO: 3608509 - DNA, 13 bp, Homo sapiens
tgtaataaactct

SEQ ID NO: 3608510 - DNA, 15 bp, Homo sapiens
tgtaataaactctct

SEQ ID NO: 3608511 - DNA, 21 bp, Homo sapiens
tgtaataagacttagattgtg

SEQ ID NO: 3608512 - DNA, 20 bp, Homo sapiens
tgtaatcccagttactcggg

SEQ ID NO: 3608513 - DNA, 12 bp, Homo sapiens
tgtaatgctgca

SEQ ID NO: 3608514 - DNA, 18 bp, Homo sapiens
tgtaatgctgcacttcct

SEQ ID NO: 3608515 - DNA, 20 bp, Homo sapiens
tgtaatgctgcacttcctgt

SEQ ID NO: 3608516 - DNA, 23 bp, Homo sapiens
tgtaatgtatcaaatacatttaa

SEQ ID NO: 3608517 - DNA, 21 bp, Homo sapiens
tgtaatgtttttatttcaatt

SEQ ID NO: 3608518 - DNA, 21 bp, Homo sapiens
tgtaatttctgccaataaatt

SEQ ID NO: 3608519 - DNA, 15 bp, Homo sapiens
tgtaattttgtgtaa

SEQ ID NO: 3608520 - DNA, 15 bp, Homo sapiens
tgtacaaaagcaatg

SEQ ID NO: 3608521 - DNA, 13 bp, Homo sapiens
tgtacaaaataaa

SEQ ID NO: 3608522 - DNA, 22 bp, Homo sapiens
tgtacaaaataaacaaataaca

SEQ ID NO: 3608523 - DNA, 12 bp, Homo sapiens
tgtacaataaat

SEQ ID NO: 3608524 - DNA, 14 bp, Homo sapiens
tgtacaataaattt

SEQ ID NO: 3608525 - DNA, 15 bp, Homo sapiens
tgtacagtctgctcc

SEQ ID NO: 3608526 - DNA, 19 bp, Homo sapiens
tgtacagtctgctcctctt

SEQ ID NO: 3608527 - DNA, 19 bp, Homo sapiens
tgtacataactcctgtccc

SEQ ID NO: 3608528 - DNA, 18 bp, Homo sapiens
tgtacatagttatttatt

SEQ ID NO: 3608529 - DNA, 15 bp, Homo sapiens
tgtacatatgtgctg

SEQ ID NO: 3608530 - DNA, 21 bp, Homo sapiens
tgtacattctgcctagagtgt

SEQ ID NO: 3608531 - DNA, 17 bp, Homo sapiens
tgtacatttaataatat

SEQ ID NO: 3608532 - DNA, 18 bp, Homo sapiens
tgtaccacttcctgaggc

SEQ ID NO: 3608533 - DNA, 20 bp, Homo sapiens
tgtaccacttcctgaggcct

SEQ ID NO: 3608534 - DNA, 21 bp, Homo sapiens
tgtaccacttcctgaggcctc

SEQ ID NO: 3608535 - DNA, 19 bp, Homo sapiens
tgtacccatctttaattta

SEQ ID NO: 3608536 - DNA, 16 bp, Homo sapiens
tgtactaacccagtct

SEQ ID NO: 3608537 - DNA, 21 bp, Homo sapiens
tgtactaacccagtctttctt

SEQ ID NO: 3608538 - DNA, 21 bp, Homo sapiens
tgtactatagcggcatataga

SEQ ID NO: 3608539 - DNA, 15 bp, Homo sapiens
tgtacttttcctttg

SEQ ID NO: 3608540 - DNA, 20 bp, Homo sapiens
tgtacttttcctttgctagt

SEQ ID NO: 3608541 - DNA, 18 bp, Homo sapiens
tgtagaaactgaggccca

SEQ ID NO: 3608542 - DNA, 17 bp, Homo sapiens
tgtagaatgatttcatg

SEQ ID NO: 3608543 - DNA, 15 bp, Homo sapiens
tgtagactgtgccag

SEQ ID NO: 3608544 - DNA, 22 bp, Homo sapiens
tgtagatttagtgtaataagac

SEQ ID NO: 3608545 - DNA, 17 bp, Homo sapiens
tgtagcctacagacatg

SEQ ID NO: 3608546 - DNA, 23 bp, Homo sapiens
tgtagcctcaatcgagtgagaca

SEQ ID NO: 3608547 - DNA, 18 bp, Homo sapiens
tgtagctgtaagggcagt

SEQ ID NO: 3608548 - DNA, 22 bp, Homo sapiens
tgtagctgtaagggcagtgccc

SEQ ID NO: 3608549 - DNA, 19 bp, Homo sapiens
tgtagctgtcgtacattga

SEQ ID NO: 3608550 - DNA, 17 bp, Homo sapiens
tgtagggttataataat

SEQ ID NO: 3608551 - DNA, 21 bp, Homo sapiens
tgtaggtgttatgtattccta

SEQ ID NO: 3608552 - DNA, 14 bp, Homo sapiens
tgtagtaattgtta

SEQ ID NO: 3608553 - DNA, 22 bp, Homo sapiens
tgtagtagcgttttttaaatgt

SEQ ID NO: 3608554 - DNA, 15 bp, Homo sapiens
tgtagtatggtatat

SEQ ID NO: 3608555 - DNA, 19 bp, Homo sapiens
tgtagtattttttgtataa

SEQ ID NO: 3608556 - DNA, 20 bp, Homo sapiens
tgtagtattttttgtataat

SEQ ID NO: 3608557 - DNA, 14 bp, Homo sapiens
tgtagttactcaag

SEQ ID NO: 3608558 - DNA, 16 bp, Homo sapiens
tgtagttactcaagca

SEQ ID NO: 3608559 - DNA, 14 bp, Homo sapiens
tgtagttttgtata

SEQ ID NO: 3608560 - DNA, 14 bp, Homo sapiens
tgtataaatgtgat

SEQ ID NO: 3608561 - DNA, 18 bp, Homo sapiens
tgtataactttaacttct

SEQ ID NO: 3608562 - DNA, 18 bp, Homo sapiens
tgtataattggatttcct

SEQ ID NO: 3608563 - DNA, 19 bp, Homo sapiens
tgtataattggatttccta

SEQ ID NO: 3608564 - DNA, 21 bp, Homo sapiens
tgtataattggatttcctaat

SEQ ID NO: 3608565 - DNA, 21 bp, Homo sapiens
tgtataccagcctactgtact

SEQ ID NO: 3608566 - DNA, 12 bp, Homo sapiens
tgtatagaccaa

SEQ ID NO: 3608567 - DNA, 16 bp, Homo sapiens
tgtatagaccaaagca

SEQ ID NO: 3608568 - DNA, 12 bp, Homo sapiens
tgtatatgtatt

SEQ ID NO: 3608569 - DNA, 22 bp, Homo sapiens
tgtatattttaagaaataacag

SEQ ID NO: 3608570 - DNA, 18 bp, Homo sapiens
tgtatatttttaaagaat

SEQ ID NO: 3608571 - DNA, 14 bp, Homo sapiens
tgtatcaaatacat

SEQ ID NO: 3608572 - DNA, 14 bp, Homo sapiens
tgtatcagtgtcct

SEQ ID NO: 3608573 - DNA, 20 bp, Homo sapiens
tgtatcagtgtcctttccag

SEQ ID NO: 3608574 - DNA, 15 bp, Homo sapiens
tgtatcttaaatttg

SEQ ID NO: 3608575 - DNA, 15 bp, Homo sapiens
tgtatgagtgtatgt

SEQ ID NO: 3608576 - DNA, 12 bp, Homo sapiens
tgtatgattact

SEQ ID NO: 3608577 - DNA, 13 bp, Homo sapiens
tgtatgattactg

SEQ ID NO: 3608578 - DNA, 21 bp, Homo sapiens
tgtatgcagtactaaaattaa

SEQ ID NO: 3608579 - DNA, 13 bp, Homo sapiens
tgtatggaaacac

SEQ ID NO: 3608580 - DNA, 16 bp, Homo sapiens
tgtatggaaacactga

SEQ ID NO: 3608581 - DNA, 20 bp, Homo sapiens
tgtatggaaacactgatttt

SEQ ID NO: 3608582 - DNA, 15 bp, Homo sapiens
tgtatgtcttaaaac

SEQ ID NO: 3608583 - DNA, 23 bp, Homo sapiens
tgtatgtgagctgtaaaaatgtt

SEQ ID NO: 3608584 - DNA, 21 bp, Homo sapiens
tgtatgtgggggtctgtgtgt

SEQ ID NO: 3608585 - DNA, 19 bp, Homo sapiens
tgtattatctcctttgaag

SEQ ID NO: 3608586 - DNA, 14 bp, Homo sapiens
tgtattctgtaaaa

SEQ ID NO: 3608587 - DNA, 23 bp, Homo sapiens
tgtattgagatttacccagactg

SEQ ID NO: 3608588 - DNA, 19 bp, Homo sapiens
tgtattgatttttaagaaa

SEQ ID NO: 3608589 - DNA, 21 bp, Homo sapiens
tgtattgtatattacaatgat

SEQ ID NO: 3608590 - DNA, 19 bp, Homo sapiens
tgtatttaagacataaaca

SEQ ID NO: 3608591 - DNA, 15 bp, Homo sapiens
tgtatttctatacag

SEQ ID NO: 3608592 - DNA, 13 bp, Homo sapiens
tgtatttctccat

SEQ ID NO: 3608593 - DNA, 12 bp, Homo sapiens
tgtatttggaaa

SEQ ID NO: 3608594 - DNA, 13 bp, Homo sapiens
tgtattttacata

SEQ ID NO: 3608595 - DNA, 13 bp, Homo sapiens
tgtattttccaag

SEQ ID NO: 3608596 - DNA, 15 bp, Homo sapiens
tgtattttctttcac

SEQ ID NO: 3608597 - DNA, 17 bp, Homo sapiens
tgtattttctttcactt

SEQ ID NO: 3608598 - DNA, 14 bp, Homo sapiens
tgtattttgatgag

SEQ ID NO: 3608599 - DNA, 18 bp, Homo sapiens
tgtattttgtcacttttt

SEQ ID NO: 3608600 - DNA, 19 bp, Homo sapiens
tgtcaaaactactgacagg

SEQ ID NO: 3608601 - DNA, 14 bp, Homo sapiens
tgtcaaagatgccc

SEQ ID NO: 3608602 - DNA, 20 bp, Homo sapiens
tgtcaaccccaagttagttc

SEQ ID NO: 3608603 - DNA, 21 bp, Homo sapiens
tgtcacaggttttcagagaat

SEQ ID NO: 3608604 - DNA, 18 bp, Homo sapiens
tgtcaccagttaaaagca

SEQ ID NO: 3608605 - DNA, 22 bp, Homo sapiens
tgtcacccttaggccagcacca

SEQ ID NO: 3608606 - DNA, 20 bp, Homo sapiens
tgtcacctcaatatttacta

SEQ ID NO: 3608607 - DNA, 20 bp, Homo sapiens
tgtcactagaatggataaaa

SEQ ID NO: 3608608 - DNA, 21 bp, Homo sapiens
tgtcactggtagaccaaaata

SEQ ID NO: 3608609 - DNA, 17 bp, Homo sapiens
tgtcactttttgaggca

SEQ ID NO: 3608610 - DNA, 19 bp, Homo sapiens
tgtcactttttgaggcaaa

SEQ ID NO: 3608611 - DNA, 20 bp, Homo sapiens
tgtcagctcccctcggagaa

SEQ ID NO: 3608612 - DNA, 15 bp, Homo sapiens
tgtcagggccaggtg

SEQ ID NO: 3608613 - DNA, 21 bp, Homo sapiens
tgtcagggtccaggagagcct

SEQ ID NO: 3608614 - DNA, 24 bp, Homo sapiens
tgtcagggtccaggagagcctggg

SEQ ID NO: 3608615 - DNA, 15 bp, Homo sapiens
tgtcaggtgggagat

SEQ ID NO: 3608616 - DNA, 15 bp, Homo sapiens
tgtcagtgtgtcagt

SEQ ID NO: 3608617 - DNA, 15 bp, Homo sapiens
tgtcatagaaattac

SEQ ID NO: 3608618 - DNA, 13 bp, Homo sapiens
tgtcatcactcta

SEQ ID NO: 3608619 - DNA, 23 bp, Homo sapiens
tgtcatcctcaaagaaagtgtat

SEQ ID NO: 3608620 - DNA, 13 bp, Homo sapiens
tgtcatggtgaaa

SEQ ID NO: 3608621 - DNA, 13 bp, Homo sapiens
tgtcatgttatgc

SEQ ID NO: 3608622 - DNA, 16 bp, Homo sapiens
tgtcatgttatgcagt

SEQ ID NO: 3608623 - DNA, 15 bp, Homo sapiens
tgtcattcagaaaaa

SEQ ID NO: 3608624 - DNA, 16 bp, Homo sapiens
tgtcattcagttctag

SEQ ID NO: 3608625 - DNA, 14 bp, Homo sapiens
tgtcattggaagcc

SEQ ID NO: 3608626 - DNA, 23 bp, Homo sapiens
tgtcatttctatattcctccagc

SEQ ID NO: 3608627 - DNA, 13 bp, Homo sapiens
tgtcatttcttca

SEQ ID NO: 3608628 - DNA, 22 bp, Homo sapiens
tgtcatttcttcacttcaagct

SEQ ID NO: 3608629 - DNA, 15 bp, Homo sapiens
tgtcattttttttct

SEQ ID NO: 3608630 - DNA, 16 bp, Homo sapiens
tgtccaaaactgcctc

SEQ ID NO: 3608631 - DNA, 17 bp, Homo sapiens
tgtccacttaaaataca

SEQ ID NO: 3608632 - DNA, 21 bp, Homo sapiens
tgtccagagataaaaatcata

SEQ ID NO: 3608633 - DNA, 20 bp, Homo sapiens
tgtccaggagccccgccagg

SEQ ID NO: 3608634 - DNA, 22 bp, Homo sapiens
tgtcccactacatctgggactg

SEQ ID NO: 3608635 - DNA, 16 bp, Homo sapiens
tgtcccaggtcctcac

SEQ ID NO: 3608636 - DNA, 16 bp, Homo sapiens
tgtcccctgacagggc

SEQ ID NO: 3608637 - DNA, 18 bp, Homo sapiens
tgtcccctgacagggcca

SEQ ID NO: 3608638 - DNA, 20 bp, Homo sapiens
tgtccctaccgagtctcttc

SEQ ID NO: 3608639 - DNA, 18 bp, Homo sapiens
tgtccctggacacagctc

SEQ ID NO: 3608640 - DNA, 20 bp, Homo sapiens
tgtccctggacacagctctt

SEQ ID NO: 3608641 - DNA, 21 bp, Homo sapiens
tgtccctggacacagctcttc

SEQ ID NO: 3608642 - DNA, 16 bp, Homo sapiens
tgtcccttgcctctgc

SEQ ID NO: 3608643 - DNA, 13 bp, Homo sapiens
tgtcccttttccc

SEQ ID NO: 3608644 - DNA, 14 bp, Homo sapiens
tgtccgtgcccctt

SEQ ID NO: 3608645 - DNA, 18 bp, Homo sapiens
tgtcctatgtatatcttc

SEQ ID NO: 3608646 - DNA, 16 bp, Homo sapiens
tgtcctcagccttgcc

SEQ ID NO: 3608647 - DNA, 21 bp, Homo sapiens
tgtcctccgccttaccaggag

SEQ ID NO: 3608648 - DNA, 16 bp, Homo sapiens
tgtcctctgcctgggc

SEQ ID NO: 3608649 - DNA, 17 bp, Homo sapiens
tgtcctcttctgctctt

SEQ ID NO: 3608650 - DNA, 20 bp, Homo sapiens
tgtcctcttctgctcttttc

SEQ ID NO: 3608651 - DNA, 12 bp, Homo sapiens
tgtcctgatttc

SEQ ID NO: 3608652 - DNA, 22 bp, Homo sapiens
tgtcctgccacccagccccagc

SEQ ID NO: 3608653 - DNA, 17 bp, Homo sapiens
tgtcctgcctattatct

SEQ ID NO: 3608654 - DNA, 24 bp, Homo sapiens
tgtcctgcctattatctgtcagct

SEQ ID NO: 3608655 - DNA, 19 bp, Homo sapiens
tgtcctgcctgtctgaagc

SEQ ID NO: 3608656 - DNA, 23 bp, Homo sapiens
tgtcctgggcatgggtccagggc

SEQ ID NO: 3608657 - DNA, 15 bp, Homo sapiens
tgtcctgggcctgca

SEQ ID NO: 3608658 - DNA, 17 bp, Homo sapiens
tgtcctgggcctgcaga

SEQ ID NO: 3608659 - DNA, 17 bp, Homo sapiens
tgtcctgggcctgcccc

SEQ ID NO: 3608660 - DNA, 21 bp, Homo sapiens
tgtcctgggcctgcccctgtg

SEQ ID NO: 3608661 - DNA, 13 bp, Homo sapiens
tgtcctgggctgg

SEQ ID NO: 3608662 - DNA, 13 bp, Homo sapiens
tgtcctgtcctgc

SEQ ID NO: 3608663 - DNA, 13 bp, Homo sapiens
tgtcctgtctttg

SEQ ID NO: 3608664 - DNA, 14 bp, Homo sapiens
tgtcctgtctttga

SEQ ID NO: 3608665 - DNA, 17 bp, Homo sapiens
tgtccttaacccacctc

SEQ ID NO: 3608666 - DNA, 20 bp, Homo sapiens
tgtccttaacccacctctcc

SEQ ID NO: 3608667 - DNA, 23 bp, Homo sapiens
tgtccttaacccacctctcctgc

SEQ ID NO: 3608668 - DNA, 12 bp, Homo sapiens
tgtccttccctg

SEQ ID NO: 3608669 - DNA, 16 bp, Homo sapiens
tgtccttccctgttct

SEQ ID NO: 3608670 - DNA, 13 bp, Homo sapiens
tgtcgcctctgca

SEQ ID NO: 3608671 - DNA, 18 bp, Homo sapiens
tgtcgggggcccaagtgg

SEQ ID NO: 3608672 - DNA, 22 bp, Homo sapiens
tgtcgtcttgaacgagcagccc

SEQ ID NO: 3608673 - DNA, 24 bp, Homo sapiens
tgtcgtcttgaacgagcagcccag

SEQ ID NO: 3608674 - DNA, 17 bp, Homo sapiens
tgtcgttaaaaacagat

SEQ ID NO: 3608675 - DNA, 18 bp, Homo sapiens
tgtctaattaaaacactt

SEQ ID NO: 3608676 - DNA, 20 bp, Homo sapiens
tgtctaggcactgagcaggg

SEQ ID NO: 3608677 - DNA, 17 bp, Homo sapiens
tgtctattttgtaactg

SEQ ID NO: 3608678 - DNA, 16 bp, Homo sapiens
tgtctcaacgcctccc

SEQ ID NO: 3608679 - DNA, 17 bp, Homo sapiens
tgtctcaagagggcact

SEQ ID NO: 3608680 - DNA, 19 bp, Homo sapiens
tgtctcaagagggcactgg

SEQ ID NO: 3608681 - DNA, 21 bp, Homo sapiens
tgtctcaagagggcactggtg

SEQ ID NO: 3608682 - DNA, 16 bp, Homo sapiens
tgtctcacctggactt

SEQ ID NO: 3608683 - DNA, 15 bp, Homo sapiens
tgtctcagcctctgc

SEQ ID NO: 3608684 - DNA, 16 bp, Homo sapiens
tgtctccaaagaagat

SEQ ID NO: 3608685 - DNA, 20 bp, Homo sapiens
tgtctccagctgcctgggcc

SEQ ID NO: 3608686 - DNA, 19 bp, Homo sapiens
tgtctccagggcccccacc

SEQ ID NO: 3608687 - DNA, 13 bp, Homo sapiens
tgtctctttcatg

SEQ ID NO: 3608688 - DNA, 13 bp, Homo sapiens
tgtctgagacagg

SEQ ID NO: 3608689 - DNA, 13 bp, Homo sapiens
tgtctgcagctgt

SEQ ID NO: 3608690 - DNA, 13 bp, Homo sapiens
tgtctgcatttcg

SEQ ID NO: 3608691 - DNA, 21 bp, Homo sapiens
tgtctgcatttcggtggctag

SEQ ID NO: 3608692 - DNA, 15 bp, Homo sapiens
tgtctgctgccagca

SEQ ID NO: 3608693 - DNA, 17 bp, Homo sapiens
tgtctgtcctgatttct

SEQ ID NO: 3608694 - DNA, 13 bp, Homo sapiens
tgtctgtctgagg

SEQ ID NO: 3608695 - DNA, 21 bp, Homo sapiens
tgtcttaaaaaatgtgaaatg

SEQ ID NO: 3608696 - DNA, 14 bp, Homo sapiens
tgtcttaattaaaa

SEQ ID NO: 3608697 - DNA, 18 bp, Homo sapiens
tgtcttaattttctttca

SEQ ID NO: 3608698 - DNA, 16 bp, Homo sapiens
tgtcttctttctccat

SEQ ID NO: 3608699 - DNA, 17 bp, Homo sapiens
tgtcttgctaacaggat

SEQ ID NO: 3608700 - DNA, 16 bp, Homo sapiens
tgtctttctttgtcat

SEQ ID NO: 3608701 - DNA, 18 bp, Homo sapiens
tgtctttctttgtcattc

SEQ ID NO: 3608702 - DNA, 19 bp, Homo sapiens
tgtcttttctttgccatct

SEQ ID NO: 3608703 - DNA, 21 bp, Homo sapiens
tgtctttttattaaaatattt

SEQ ID NO: 3608704 - DNA, 17 bp, Homo sapiens
tgtgaaagaagagaaaa

SEQ ID NO: 3608705 - DNA, 23 bp, Homo sapiens
tgtgaacaagcttcagtaagtta

SEQ ID NO: 3608706 - DNA, 15 bp, Homo sapiens
tgtgaacctacctgc

SEQ ID NO: 3608707 - DNA, 16 bp, Homo sapiens
tgtgaacctacctgcc

SEQ ID NO: 3608708 - DNA, 19 bp, Homo sapiens
tgtgaacctacctgccttg

SEQ ID NO: 3608709 - DNA, 22 bp, Homo sapiens
tgtgaacctacctgccttggag

SEQ ID NO: 3608710 - DNA, 20 bp, Homo sapiens
tgtgaagacccaaaacagct

SEQ ID NO: 3608711 - DNA, 21 bp, Homo sapiens
tgtgaagacccaaaacagctt

SEQ ID NO: 3608712 - DNA, 14 bp, Homo sapiens
tgtgaaggaccctt

SEQ ID NO: 3608713 - DNA, 20 bp, Homo sapiens
tgtgaccagaaagcttcatc

SEQ ID NO: 3608714 - DNA, 19 bp, Homo sapiens
tgtgaccagtctgaccctt

SEQ ID NO: 3608715 - DNA, 19 bp, Homo sapiens
tgtgactaactatgcaata

SEQ ID NO: 3608716 - DNA, 21 bp, Homo sapiens
tgtgactcttactccttaggt

SEQ ID NO: 3608717 - DNA, 19 bp, Homo sapiens
tgtgacttcagctctgttt

SEQ ID NO: 3608718 - DNA, 13 bp, Homo sapiens
tgtgagaagccag

SEQ ID NO: 3608719 - DNA, 21 bp, Homo sapiens
tgtgagaagccagccagaggc

SEQ ID NO: 3608720 - DNA, 19 bp, Homo sapiens
tgtgagaatggcctggagc

SEQ ID NO: 3608721 - DNA, 20 bp, Homo sapiens
tgtgagaatggcctggagca

SEQ ID NO: 3608722 - DNA, 17 bp, Homo sapiens
tgtgagcacaaagaaga

SEQ ID NO: 3608723 - DNA, 20 bp, Homo sapiens
tgtgagcatggggccaggaa

SEQ ID NO: 3608724 - DNA, 14 bp, Homo sapiens
tgtgagcgagcaag

SEQ ID NO: 3608725 - DNA, 15 bp, Homo sapiens
tgtgagcgagcaagc

SEQ ID NO: 3608726 - DNA, 18 bp, Homo sapiens
tgtgagctgtaaaaatgt

SEQ ID NO: 3608727 - DNA, 18 bp, Homo sapiens
tgtgaggggctctctcat

SEQ ID NO: 3608728 - DNA, 21 bp, Homo sapiens
tgtgagtcattatgtagctgt

SEQ ID NO: 3608729 - DNA, 15 bp, Homo sapiens
tgtgagtctgggata

SEQ ID NO: 3608730 - DNA, 19 bp, Homo sapiens
tgtgagtttaccttgtata

SEQ ID NO: 3608731 - DNA, 23 bp, Homo sapiens
tgtgattgacagctttgctgctg

SEQ ID NO: 3608732 - DNA, 12 bp, Homo sapiens
tgtgattggctg

SEQ ID NO: 3608733 - DNA, 14 bp, Homo sapiens
tgtgattggctgca

SEQ ID NO: 3608734 - DNA, 20 bp, Homo sapiens
tgtgattggctgcaggaaga

SEQ ID NO: 3608735 - DNA, 12 bp, Homo sapiens
tgtgatttccat

SEQ ID NO: 3608736 - DNA, 13 bp, Homo sapiens
tgtgatttccatt

SEQ ID NO: 3608737 - DNA, 17 bp, Homo sapiens
tgtgatttccatttctg

SEQ ID NO: 3608738 - DNA, 16 bp, Homo sapiens
tgtgatttttatcaca

SEQ ID NO: 3608739 - DNA, 21 bp, Homo sapiens
tgtgcacactcatacacatgt

SEQ ID NO: 3608740 - DNA, 23 bp, Homo sapiens
tgtgcactaaggggcccggccag

SEQ ID NO: 3608741 - DNA, 17 bp, Homo sapiens
tgtgcacttatttatga

SEQ ID NO: 3608742 - DNA, 14 bp, Homo sapiens
tgtgcagacccagt

SEQ ID NO: 3608743 - DNA, 16 bp, Homo sapiens
tgtgcagtatctgtga

SEQ ID NO: 3608744 - DNA, 16 bp, Homo sapiens
tgtgcattattttcca

SEQ ID NO: 3608745 - DNA, 13 bp, Homo sapiens
tgtgcattctttt

SEQ ID NO: 3608746 - DNA, 16 bp, Homo sapiens
tgtgccagaggccaga

SEQ ID NO: 3608747 - DNA, 23 bp, Homo sapiens
tgtgcccctaaagagcatcctga

SEQ ID NO: 3608748 - DNA, 19 bp, Homo sapiens
tgtgccctagatgcacgtg

SEQ ID NO: 3608749 - DNA, 14 bp, Homo sapiens
tgtgcctaatgtgt

SEQ ID NO: 3608750 - DNA, 17 bp, Homo sapiens
tgtgcctaatgtgtttg

SEQ ID NO: 3608751 - DNA, 14 bp, Homo sapiens
tgtgcctcctcacc

SEQ ID NO: 3608752 - DNA, 15 bp, Homo sapiens
tgtgcctcctcaccc

SEQ ID NO: 3608753 - DNA, 16 bp, Homo sapiens
tgtgcctcctcacccc

SEQ ID NO: 3608754 - DNA, 15 bp, Homo sapiens
tgtgcctgaccctac

SEQ ID NO: 3608755 - DNA, 17 bp, Homo sapiens
tgtgccttccctttcta

SEQ ID NO: 3608756 - DNA, 17 bp, Homo sapiens
tgtgccttggtgtgctg

SEQ ID NO: 3608757 - DNA, 17 bp, Homo sapiens
tgtgcctttcctatcac

SEQ ID NO: 3608758 - DNA, 20 bp, Homo sapiens
tgtgcctttctttgcctctg

SEQ ID NO: 3608759 - DNA, 11 bp, Homo sapiens
tctttaacttt

SEQ ID NO: 3608760 - DNA, 16 bp, Homo sapiens
tctttaataaattgct

SEQ ID NO: 3608761 - DNA, 17 bp, Homo sapiens
tctttagcagtttcctc

SEQ ID NO: 3608762 - DNA, 20 bp, Homo sapiens
tctttagcagtttcctcagt

SEQ ID NO: 3608763 - DNA, 23 bp, Homo sapiens
tctttagcagtttcctcagtgat

SEQ ID NO: 3608764 - DNA, 16 bp, Homo sapiens
tctttagcttacctgg

SEQ ID NO: 3608765 - DNA, 20 bp, Homo sapiens
tctttagcttacctgggcac

SEQ ID NO: 3608766 - DNA, 20 bp, Homo sapiens
tctttataattctactttga

SEQ ID NO: 3608767 - DNA, 23 bp, Homo sapiens
tctttatcaagcaacattcttgt

SEQ ID NO: 3608768 - DNA, 19 bp, Homo sapiens
tctttcacccatcctagga

SEQ ID NO: 3608769 - DNA, 14 bp, Homo sapiens
tctttcacctttct

SEQ ID NO: 3608770 - DNA, 21 bp, Homo sapiens
tctttcagcaagataaacatt

SEQ ID NO: 3608771 - DNA, 14 bp, Homo sapiens
tctttcatgtcttg

SEQ ID NO: 3608772 - DNA, 21 bp, Homo sapiens
tctttcatttgctttggaagt

SEQ ID NO: 3608773 - DNA, 14 bp, Homo sapiens
tctttccctgcgag

SEQ ID NO: 3608774 - DNA, 13 bp, Homo sapiens
tctttccggccaa

SEQ ID NO: 3608775 - DNA, 15 bp, Homo sapiens
tctttccggccaagg

SEQ ID NO: 3608776 - DNA, 15 bp, Homo sapiens
tctttcctcacattt

SEQ ID NO: 3608777 - DNA, 15 bp, Homo sapiens
tctttcctccccctg

SEQ ID NO: 3608778 - DNA, 15 bp, Homo sapiens
tctttctaatacaag

SEQ ID NO: 3608779 - DNA, 21 bp, Homo sapiens
tctttctccttgaatatcttt

SEQ ID NO: 3608780 - DNA, 13 bp, Homo sapiens
tctttctctgagg

SEQ ID NO: 3608781 - DNA, 20 bp, Homo sapiens
tctttctgtcttgttaatgc

SEQ ID NO: 3608782 - DNA, 23 bp, Homo sapiens
tctttcttattttgtaataaact

SEQ ID NO: 3608783 - DNA, 16 bp, Homo sapiens
tctttcttccattcct

SEQ ID NO: 3608784 - DNA, 14 bp, Homo sapiens
tctttcttcctctg

SEQ ID NO: 3608785 - DNA, 19 bp, Homo sapiens
tctttcttgctccctgact

SEQ ID NO: 3608786 - DNA, 22 bp, Homo sapiens
tctttcttgggatagtgttctg

SEQ ID NO: 3608787 - DNA, 22 bp, Homo sapiens
tctttctttccaaaacatttct

SEQ ID NO: 3608788 - DNA, 18 bp, Homo sapiens
tctttctttgtcattcag

SEQ ID NO: 3608789 - DNA, 13 bp, Homo sapiens
tctttgaaagctt

SEQ ID NO: 3608790 - DNA, 21 bp, Homo sapiens
tctttgaataaatgtcacttt

SEQ ID NO: 3608791 - DNA, 22 bp, Homo sapiens
tctttgacatttttgccaaaat

SEQ ID NO: 3608792 - DNA, 20 bp, Homo sapiens
tctttgatcgcctctttgac

SEQ ID NO: 3608793 - DNA, 21 bp, Homo sapiens
tctttgatcgcctctttgaca

SEQ ID NO: 3608794 - DNA, 22 bp, Homo sapiens
tctttgatcgcctctttgacat

SEQ ID NO: 3608795 - DNA, 13 bp, Homo sapiens
tctttgccatctc

SEQ ID NO: 3608796 - DNA, 17 bp, Homo sapiens
tctttgccatctctgct

SEQ ID NO: 3608797 - DNA, 20 bp, Homo sapiens
tctttgcctctgcagtctca

SEQ ID NO: 3608798 - DNA, 15 bp, Homo sapiens
tctttgctgcccctg

SEQ ID NO: 3608799 - DNA, 18 bp, Homo sapiens
tctttgctgcccctgtct

SEQ ID NO: 3608800 - DNA, 11 bp, Homo sapiens
tctttggctgc

SEQ ID NO: 3608801 - DNA, 14 bp, Homo sapiens
tctttggctgcagg

SEQ ID NO: 3608802 - DNA, 20 bp, Homo sapiens
tctttgggccagacatgcca

SEQ ID NO: 3608803 - DNA, 21 bp, Homo sapiens
tctttgtatataggcttctca

SEQ ID NO: 3608804 - DNA, 11 bp, Homo sapiens
tctttgtcaaa

SEQ ID NO: 3608805 - DNA, 17 bp, Homo sapiens
tctttgtcattcagttc

SEQ ID NO: 3608806 - DNA, 14 bp, Homo sapiens
tctttgtgcctttg

SEQ ID NO: 3608807 - DNA, 23 bp, Homo sapiens
tctttgtggccaaggagctgcta

SEQ ID NO: 3608808 - DNA, 13 bp, Homo sapiens
tctttgtgtagct

SEQ ID NO: 3608809 - DNA, 13 bp, Homo sapiens
tcttttaaactgg

SEQ ID NO: 3608810 - DNA, 12 bp, Homo sapiens
tcttttaaattg

SEQ ID NO: 3608811 - DNA, 12 bp, Homo sapiens
tcttttagagag

SEQ ID NO: 3608812 - DNA, 14 bp, Homo sapiens
tcttttatctgttt

SEQ ID NO: 3608813 - DNA, 15 bp, Homo sapiens
tcttttcaatgggtt

SEQ ID NO: 3608814 - DNA, 21 bp, Homo sapiens
tcttttcatatctcttgccct

SEQ ID NO: 3608815 - DNA, 13 bp, Homo sapiens
tcttttcctggtg

SEQ ID NO: 3608816 - DNA, 18 bp, Homo sapiens
tcttttctttgccatctc

SEQ ID NO: 3608817 - DNA, 20 bp, Homo sapiens
tcttttctttgccatctctg

SEQ ID NO: 3608818 - DNA, 14 bp, Homo sapiens
tcttttgaattgtt

SEQ ID NO: 3608819 - DNA, 23 bp, Homo sapiens
tcttttgcaggagtttgtggtaa

SEQ ID NO: 3608820 - DNA, 20 bp, Homo sapiens
tctttttaaaaattgttatt

SEQ ID NO: 3608821 - DNA, 14 bp, Homo sapiens
tctttttctagggt

SEQ ID NO: 3608822 - DNA, 23 bp, Homo sapiens
tctttttcttaccagtctcctcc

SEQ ID NO: 3608823 - DNA, 14 bp, Homo sapiens
tctttttgaaatgt

SEQ ID NO: 3608824 - DNA, 22 bp, Homo sapiens
tctttttgccagttttccctgg

SEQ ID NO: 3608825 - DNA, 15 bp, Homo sapiens
tctttttgtgtgtgt

SEQ ID NO: 3608826 - DNA, 14 bp, Homo sapiens
tctttttttgtgat

SEQ ID NO: 3608827 - DNA, 12 bp, Homo sapiens
tgaaaaacatga

SEQ ID NO: 3608828 - DNA, 13 bp, Homo sapiens
tgaaaaagacata

SEQ ID NO: 3608829 - DNA, 20 bp, Homo sapiens
tgaaaaagacataaaacaga

SEQ ID NO: 3608830 - DNA, 22 bp, Homo sapiens
tgaaaaagctgcttcttattaa

SEQ ID NO: 3608831 - DNA, 12 bp, Homo sapiens
tgaaaagaaaga

SEQ ID NO: 3608832 - DNA, 19 bp, Homo sapiens
tgaaaagactccaaagaaa

SEQ ID NO: 3608833 - DNA, 22 bp, Homo sapiens
tgaaaagactccaaagaaatgt

SEQ ID NO: 3608834 - DNA, 12 bp, Homo sapiens
tgaaaagatgta

SEQ ID NO: 3608835 - DNA, 16 bp, Homo sapiens
tgaaaagatgtacctg

SEQ ID NO: 3608836 - DNA, 16 bp, Homo sapiens
tgaaaagcagacattt

SEQ ID NO: 3608837 - DNA, 18 bp, Homo sapiens
tgaaaagttatttatgct

SEQ ID NO: 3608838 - DNA, 23 bp, Homo sapiens
tgaaaagttcagggaccgtccag

SEQ ID NO: 3608839 - DNA, 13 bp, Homo sapiens
tgaaaataactga

SEQ ID NO: 3608840 - DNA, 20 bp, Homo sapiens
tgaaaataactgaaccaaat

SEQ ID NO: 3608841 - DNA, 23 bp, Homo sapiens
tgaaaatattgttttacaatagt

SEQ ID NO: 3608842 - DNA, 11 bp, Homo sapiens
tgaaaatggaa

SEQ ID NO: 3608843 - DNA, 14 bp, Homo sapiens
tgaaaattacatgt

SEQ ID NO: 3608844 - DNA, 13 bp, Homo sapiens
tgaaacagaaaca

SEQ ID NO: 3608845 - DNA, 16 bp, Homo sapiens
tgaaacagaaacaaaa

SEQ ID NO: 3608846 - DNA, 13 bp, Homo sapiens
tgaaacagacttg

SEQ ID NO: 3608847 - DNA, 23 bp, Homo sapiens
tgaaacagattcaggccagccca

SEQ ID NO: 3608848 - DNA, 18 bp, Homo sapiens
tgaaactccagatgccac

SEQ ID NO: 3608849 - DNA, 19 bp, Homo sapiens
tgaaactccagatgccaca

SEQ ID NO: 3608850 - DNA, 22 bp, Homo sapiens
tgaaactgagatgtgaacacat

SEQ ID NO: 3608851 - DNA, 19 bp, Homo sapiens
tgaaactggtttataataa

SEQ ID NO: 3608852 - DNA, 15 bp, Homo sapiens
tgaaagaaaactttt

SEQ ID NO: 3608853 - DNA, 18 bp, Homo sapiens
tgaaagaaaacttttatg

SEQ ID NO: 3608854 - DNA, 15 bp, Homo sapiens
tgaaagaatgtaaag

SEQ ID NO: 3608855 - DNA, 16 bp, Homo sapiens
tgaaagaatgtaaagc

SEQ ID NO: 3608856 - DNA, 18 bp, Homo sapiens
tgaaagaggcagcttgaa

SEQ ID NO: 3608857 - DNA, 21 bp, Homo sapiens
tgaaagatggctgtgcctctg

SEQ ID NO: 3608858 - DNA, 22 bp, Homo sapiens
tgaaagatggctgtgcctctgc

SEQ ID NO: 3608859 - DNA, 14 bp, Homo sapiens
tgaaagcataacat

SEQ ID NO: 3608860 - DNA, 18 bp, Homo sapiens
tgaaagtccagaaactgt

SEQ ID NO: 3608861 - DNA, 21 bp, Homo sapiens
tgaaagttttccagtattgaa

SEQ ID NO: 3608862 - DNA, 21 bp, Homo sapiens
tgaaataccaacctgaagaca

SEQ ID NO: 3608863 - DNA, 21 bp, Homo sapiens
tgaaatacctttgtagttact

SEQ ID NO: 3608864 - DNA, 14 bp, Homo sapiens
tgaaatccaggaat

SEQ ID NO: 3608865 - DNA, 20 bp, Homo sapiens
tgaaatccctgcctcaggcc

SEQ ID NO: 3608866 - DNA, 15 bp, Homo sapiens
tgaaatcttcccagt

SEQ ID NO: 3608867 - DNA, 16 bp, Homo sapiens
tgaaatgaaatcttcc

SEQ ID NO: 3608868 - DNA, 19 bp, Homo sapiens
tgaaatgatttcacagtgt

SEQ ID NO: 3608869 - DNA, 23 bp, Homo sapiens
tgaaatgccactgggacagctgg

SEQ ID NO: 3608870 - DNA, 22 bp, Homo sapiens
tgaaatgcttttatattctaat

SEQ ID NO: 3608871 - DNA, 16 bp, Homo sapiens
tgaaatgtgtttcctt

SEQ ID NO: 3608872 - DNA, 23 bp, Homo sapiens
tgaaattataactattacagtgt

SEQ ID NO: 3608873 - DNA, 19 bp, Homo sapiens
tgaaattgactgatgattt

SEQ ID NO: 3608874 - DNA, 16 bp, Homo sapiens
tgaaatttaattacaa

SEQ ID NO: 3608875 - DNA, 13 bp, Homo sapiens
tgaaatttacaaa

SEQ ID NO: 3608876 - DNA, 15 bp, Homo sapiens
tgaaatttgataaac

SEQ ID NO: 3608877 - DNA, 22 bp, Homo sapiens
tgaaatttgataaactgaattt

SEQ ID NO: 3608878 - DNA, 20 bp, Homo sapiens
tgaaatttttattaaattat

SEQ ID NO: 3608879 - DNA, 12 bp, Homo sapiens
tgaacaagaatt

SEQ ID NO: 3608880 - DNA, 17 bp, Homo sapiens
tgaacaagcttcagtaa

SEQ ID NO: 3608881 - DNA, 14 bp, Homo sapiens
tgaacacatcagct

SEQ ID NO: 3608882 - DNA, 23 bp, Homo sapiens
tgaacagaaactacatttctact

SEQ ID NO: 3608883 - DNA, 19 bp, Homo sapiens
tgaacaggggctggtatta

SEQ ID NO: 3608884 - DNA, 14 bp, Homo sapiens
tgaaccaaattgca

SEQ ID NO: 3608885 - DNA, 18 bp, Homo sapiens
tgaaccaaattgcactga

SEQ ID NO: 3608886 - DNA, 17 bp, Homo sapiens
tgaacctcattctggtt

SEQ ID NO: 3608887 - DNA, 20 bp, Homo sapiens
tgaacgtggattgtatttaa

SEQ ID NO: 3608888 - DNA, 23 bp, Homo sapiens
tgaacgtggcccgcatgtgcatt

SEQ ID NO: 3608889 - DNA, 23 bp, Homo sapiens
tgaacgttttaataatttttgct

SEQ ID NO: 3608890 - DNA, 19 bp, Homo sapiens
tgaactcaccctgggagcc

SEQ ID NO: 3608891 - DNA, 23 bp, Homo sapiens
tgaactccaccgaccaactgccc

SEQ ID NO: 3608892 - DNA, 11 bp, Homo sapiens
tgaactccagg

SEQ ID NO: 3608893 - DNA, 12 bp, Homo sapiens
tgaactccaggc

SEQ ID NO: 3608894 - DNA, 19 bp, Homo sapiens
tgaactctggtgctcctgc

SEQ ID NO: 3608895 - DNA, 13 bp, Homo sapiens
tgaactttctccc

SEQ ID NO: 3608896 - DNA, 14 bp, Homo sapiens
tgaagaaataaatg

SEQ ID NO: 3608897 - DNA, 15 bp, Homo sapiens
tgaagaaataaatga

SEQ ID NO: 3608898 - DNA, 17 bp, Homo sapiens
tgaagaaataaatgaaa

SEQ ID NO: 3608899 - DNA, 17 bp, Homo sapiens
tgaagaactagcatata

SEQ ID NO: 3608900 - DNA, 12 bp, Homo sapiens
tgaagaaggaag

SEQ ID NO: 3608901 - DNA, 17 bp, Homo sapiens
tgaagaatgcattcaaa

SEQ ID NO: 3608902 - DNA, 14 bp, Homo sapiens
tgaagacagaggca

SEQ ID NO: 3608903 - DNA, 19 bp, Homo sapiens
tgaagaccaatcaaatata

SEQ ID NO: 3608904 - DNA, 20 bp, Homo sapiens
tgaagaccaatcaaatatat

SEQ ID NO: 3608905 - DNA, 21 bp, Homo sapiens
tgaagaccattttctggttct

SEQ ID NO: 3608906 - DNA, 17 bp, Homo sapiens
tgaagacccaaaacagc

SEQ ID NO: 3608907 - DNA, 19 bp, Homo sapiens
tgaagacccaaaacagctt

SEQ ID NO: 3608908 - DNA, 20 bp, Homo sapiens
tgaagagagggacaggcact

SEQ ID NO: 3608909 - DNA, 18 bp, Homo sapiens
tgaagaggtctgattggc

SEQ ID NO: 3608910 - DNA, 22 bp, Homo sapiens
tgaagaggtctgattggctgct

SEQ ID NO: 3608911 - DNA, 17 bp, Homo sapiens
tgaagagtcctctgaat

SEQ ID NO: 3608912 - DNA, 14 bp, Homo sapiens
tgaagatagaagaa

SEQ ID NO: 3608913 - DNA, 15 bp, Homo sapiens
tgaagatcagaacat

SEQ ID NO: 3608914 - DNA, 21 bp, Homo sapiens
tgaagatcagaacattcagct

SEQ ID NO: 3608915 - DNA, 13 bp, Homo sapiens
tgaagcaaagaag

SEQ ID NO: 3608916 - DNA, 21 bp, Homo sapiens
tgaagcaattagtctgaaact

SEQ ID NO: 3608917 - DNA, 23 bp, Homo sapiens
tgaagcaattagtctgaaactgg

SEQ ID NO: 3608918 - DNA, 15 bp, Homo sapiens
tgaagcagaaccttc

SEQ ID NO: 3608919 - DNA, 17 bp, Homo sapiens
tgaagcagaaccttctt

SEQ ID NO: 3608920 - DNA, 19 bp, Homo sapiens
tgaagcagaaccttctttg

SEQ ID NO: 3608921 - DNA, 23 bp, Homo sapiens
tgaagcatgaacgtggattgtat

SEQ ID NO: 3608922 - DNA, 18 bp, Homo sapiens
tgaagcattatggtctaa

SEQ ID NO: 3608923 - DNA, 14 bp, Homo sapiens
tgaagccaccctgg

SEQ ID NO: 3608924 - DNA, 19 bp, Homo sapiens
tgaagcctctctccttggc

SEQ ID NO: 3608925 - DNA, 12 bp, Homo sapiens
tgaagctgctgt

SEQ ID NO: 3608926 - DNA, 14 bp, Homo sapiens
tgaagctttttatt

SEQ ID NO: 3608927 - DNA, 21 bp, Homo sapiens
tgaaggaaaagcaagaaacag

SEQ ID NO: 3608928 - DNA, 22 bp, Homo sapiens
tgaaggaaaagcaagaaacagt

SEQ ID NO: 3608929 - DNA, 16 bp, Homo sapiens
tgaaggagagcccttc

SEQ ID NO: 3608930 - DNA, 20 bp, Homo sapiens
tgaaggagagcccttcattt

SEQ ID NO: 3608931 - DNA, 19 bp, Homo sapiens
tgaaggcagtggcagggga

SEQ ID NO: 3608932 - DNA, 14 bp, Homo sapiens
tgaagggccagagc

SEQ ID NO: 3608933 - DNA, 19 bp, Homo sapiens
tgaagggccagagccaggg

SEQ ID NO: 3608934 - DNA, 19 bp, Homo sapiens
tgaaggtctcctaaaactg

SEQ ID NO: 3608935 - DNA, 21 bp, Homo sapiens
tgaaggtctcctaaaactggg

SEQ ID NO: 3608936 - DNA, 23 bp, Homo sapiens
tgaaggtctcctaaaactgggat

SEQ ID NO: 3608937 - DNA, 15 bp, Homo sapiens
tgaaggtgctgacgg

SEQ ID NO: 3608938 - DNA, 20 bp, Homo sapiens
tgaaggtgctgacggccagg

SEQ ID NO: 3608939 - DNA, 15 bp, Homo sapiens
tgaagtagaagttac

SEQ ID NO: 3608940 - DNA, 22 bp, Homo sapiens
tgaagtcacccctttctgtccc

SEQ ID NO: 3608941 - DNA, 14 bp, Homo sapiens
tgaagtcactgcac

SEQ ID NO: 3608942 - DNA, 20 bp, Homo sapiens
tgaagtgacctcactggcct

SEQ ID NO: 3608943 - DNA, 13 bp, Homo sapiens
tgaagtgccttaa

SEQ ID NO: 3608944 - DNA, 12 bp, Homo sapiens
tgaagttcatct

SEQ ID NO: 3608945 - DNA, 18 bp, Homo sapiens
tgaagtttaaattctagt

SEQ ID NO: 3608946 - DNA, 18 bp, Homo sapiens
tgaagtttaattgtctca

SEQ ID NO: 3608947 - DNA, 17 bp, Homo sapiens
tgaagtttttgaaatac

SEQ ID NO: 3608948 - DNA, 11 bp, Homo sapiens
tgaataaaaca

SEQ ID NO: 3608949 - DNA, 16 bp, Homo sapiens
tgaataaatgtcactt

SEQ ID NO: 3608950 - DNA, 19 bp, Homo sapiens
tgaataaatgtcacttttt

SEQ ID NO: 3608951 - DNA, 13 bp, Homo sapiens
tgaataaatgtct

SEQ ID NO: 3608952 - DNA, 14 bp, Homo sapiens
tgaataaatgtctt

SEQ ID NO: 3608953 - DNA, 15 bp, Homo sapiens
tgaataaatgtcttg

SEQ ID NO: 3608954 - DNA, 13 bp, Homo sapiens
tgaataattgcat

SEQ ID NO: 3608955 - DNA, 23 bp, Homo sapiens
tgaatacattaacggtgctaaaa

SEQ ID NO: 3608956 - DNA, 14 bp, Homo sapiens
tgaatacatttgta

SEQ ID NO: 3608957 - DNA, 15 bp, Homo sapiens
tgaatacatttgtat

SEQ ID NO: 3608958 - DNA, 19 bp, Homo sapiens
tgaatacatttgtatttat

SEQ ID NO: 3608959 - DNA, 13 bp, Homo sapiens
tgaatacttattt

SEQ ID NO: 3608960 - DNA, 16 bp, Homo sapiens
tgaatattcctttatt

SEQ ID NO: 3608961 - DNA, 16 bp, Homo sapiens
tgaatattgccattat

SEQ ID NO: 3608962 - DNA, 17 bp, Homo sapiens
tgaatatttttgtattt

SEQ ID NO: 3608963 - DNA, 19 bp, Homo sapiens
tgaatattttttatttcta

SEQ ID NO: 3608964 - DNA, 24 bp, Homo sapiens
tgaatattttttatttctaagtat

SEQ ID NO: 3608965 - DNA, 13 bp, Homo sapiens
tgaatcagaacag

SEQ ID NO: 3608966 - DNA, 13 bp, Homo sapiens
tgaatcagctgga

SEQ ID NO: 3608967 - DNA, 14 bp, Homo sapiens
tgaatcagctggac

SEQ ID NO: 3608968 - DNA, 15 bp, Homo sapiens
tgaatcagctggaca

SEQ ID NO: 3608969 - DNA, 16 bp, Homo sapiens
tgaatgaaaataactg

SEQ ID NO: 3608970 - DNA, 17 bp, Homo sapiens
tgaatgaaaataactga

SEQ ID NO: 3608971 - DNA, 16 bp, Homo sapiens
tgaatgaaccttctgg

SEQ ID NO: 3608972 - DNA, 19 bp, Homo sapiens
tgaatggaggacttttctg

SEQ ID NO: 3608973 - DNA, 12 bp, Homo sapiens
tgaatggttttt

SEQ ID NO: 3608974 - DNA, 16 bp, Homo sapiens
tgaatgtgagtcatta

SEQ ID NO: 3608975 - DNA, 18 bp, Homo sapiens
tgaatgtggctgaagttg

SEQ ID NO: 3608976 - DNA, 22 bp, Homo sapiens
tgaattaatatccctacatgta

SEQ ID NO: 3608977 - DNA, 23 bp, Homo sapiens
tgaattaatatccctacatgtat

SEQ ID NO: 3608978 - DNA, 21 bp, Homo sapiens
tgaattagggtgggctctaaa

SEQ ID NO: 3608979 - DNA, 22 bp, Homo sapiens
tgaattgtgtcccccataaaag

SEQ ID NO: 3608980 - DNA, 17 bp, Homo sapiens
tgaatttgccagaggac

SEQ ID NO: 3608981 - DNA, 19 bp, Homo sapiens
tgaatttgccagaggacca

SEQ ID NO: 3608982 - DNA, 21 bp, Homo sapiens
tgaatttgccagaggaccaat

SEQ ID NO: 3608983 - DNA, 14 bp, Homo sapiens
tgaattttgttgct

SEQ ID NO: 3608984 - DNA, 16 bp, Homo sapiens
tgaattttgttgctgt

SEQ ID NO: 3608985 - DNA, 19 bp, Homo sapiens
tgaatttttttttcctagc

SEQ ID NO: 3608986 - DNA, 19 bp, Homo sapiens
tgacaaaactaaccttgaa

SEQ ID NO: 3608987 - DNA, 18 bp, Homo sapiens
tgacaaaagatacaaaag

SEQ ID NO: 3608988 - DNA, 19 bp, Homo sapiens
tgacaacacttaatagcaa

SEQ ID NO: 3608989 - DNA, 21 bp, Homo sapiens
tgacaacctgtgtgagagaat

SEQ ID NO: 3608990 - DNA, 16 bp, Homo sapiens
tgacaactgtgaagcc

SEQ ID NO: 3608991 - DNA, 22 bp, Homo sapiens
tgacaactgtgaagccaccctg

SEQ ID NO: 3608992 - DNA, 16 bp, Homo sapiens
tgacacaggtctttcc

SEQ ID NO: 3608993 - DNA, 22 bp, Homo sapiens
tgacacagtcttggctcactgc

SEQ ID NO: 3608994 - DNA, 20 bp, Homo sapiens
tgacaccacacttgttttct

SEQ ID NO: 3608995 - DNA, 23 bp, Homo sapiens
tgacaccccctccccgcccctgt

SEQ ID NO: 3608996 - DNA, 19 bp, Homo sapiens
tgacaccttagagaagcta

SEQ ID NO: 3608997 - DNA, 18 bp, Homo sapiens
tgacagaggtttgaagga

SEQ ID NO: 3608998 - DNA, 22 bp, Homo sapiens
tgacagaggtttgaaggagaat

SEQ ID NO: 3608999 - DNA, 19 bp, Homo sapiens
tgacagatatatttaagcc

SEQ ID NO: 3609000 - DNA, 20 bp, Homo sapiens
tgacagatatatttaagcct

SEQ ID NO: 3609001 - DNA, 22 bp, Homo sapiens
tgacagatatatttaagcctta

SEQ ID NO: 3609002 - DNA, 18 bp, Homo sapiens
tgacagcaattcatggtt

SEQ ID NO: 3609003 - DNA, 20 bp, Homo sapiens
tgacagcaattcatggttca

SEQ ID NO: 3609004 - DNA, 17 bp, Homo sapiens
tgacagccttccccagc

SEQ ID NO: 3609005 - DNA, 13 bp, Homo sapiens
tgacagccttctt

SEQ ID NO: 3609006 - DNA, 14 bp, Homo sapiens
tgacagctccggga

SEQ ID NO: 3609007 - DNA, 13 bp, Homo sapiens
tgacagctgctcc

SEQ ID NO: 3609008 - DNA, 18 bp, Homo sapiens
tgacagctgctcctagag

SEQ ID NO: 3609009 - DNA, 21 bp, Homo sapiens
tgacagctgctcctagaggga

SEQ ID NO: 3609010 - DNA, 15 bp, Homo sapiens
tgacagctttgctgc

SEQ ID NO: 3609011 - DNA, 14 bp, Homo sapiens
tgacagtccacagg

SEQ ID NO: 3609012 - DNA, 18 bp, Homo sapiens
tgacagtccacaggggcc

SEQ ID NO: 3609013 - DNA, 12 bp, Homo sapiens
tgacatattatg

SEQ ID NO: 3609014 - DNA, 15 bp, Homo sapiens
tgacatattatgcct

SEQ ID NO: 3609015 - DNA, 17 bp, Homo sapiens
tgacatattatgcctga

SEQ ID NO: 3609016 - DNA, 16 bp, Homo sapiens
tgacatcccttcctgg

SEQ ID NO: 3609017 - DNA, 19 bp, Homo sapiens
tgacatcccttcctggaaa

SEQ ID NO: 3609018 - DNA, 20 bp, Homo sapiens
tgacatcccttcctggaaac

SEQ ID NO: 3609019 - DNA, 17 bp, Homo sapiens
tgacatgaaaagttatt

SEQ ID NO: 3609020 - DNA, 13 bp, Homo sapiens
tgacatgcagtta

SEQ ID NO: 3609021 - DNA, 14 bp, Homo sapiens
tgacatgcagttat

SEQ ID NO: 3609022 - DNA, 22 bp, Homo sapiens
tgacatgctcacacattacaac

SEQ ID NO: 3609023 - DNA, 15 bp, Homo sapiens
tgacatgggccttta

SEQ ID NO: 3609024 - DNA, 14 bp, Homo sapiens
tgacattcttagct

SEQ ID NO: 3609025 - DNA, 19 bp, Homo sapiens
tgacatttaggattttgtg

SEQ ID NO: 3609026 - DNA, 19 bp, Homo sapiens
tgacatttatatattgaat

SEQ ID NO: 3609027 - DNA, 12 bp, Homo sapiens
tgacattttaca

SEQ ID NO: 3609028 - DNA, 16 bp, Homo sapiens
tgacattttacattaa

SEQ ID NO: 3609029 - DNA, 17 bp, Homo sapiens
tgacattttagaatgtc

SEQ ID NO: 3609030 - DNA, 20 bp, Homo sapiens
tgacattttagaatgtcaat

SEQ ID NO: 3609031 - DNA, 18 bp, Homo sapiens
tgaccaacagaaaccttt

SEQ ID NO: 3609032 - DNA, 15 bp, Homo sapiens
tgaccactctgtctt

SEQ ID NO: 3609033 - DNA, 16 bp, Homo sapiens
tgaccactctgtcttg

SEQ ID NO: 3609034 - DNA, 16 bp, Homo sapiens
tgaccagaactttttc

SEQ ID NO: 3609035 - DNA, 22 bp, Homo sapiens
tgaccagcctccatgctgcctc

SEQ ID NO: 3609036 - DNA, 20 bp, Homo sapiens
tgaccagggatgctgggctg

SEQ ID NO: 3609037 - DNA, 22 bp, Homo sapiens
tgaccagggatgctgggctggg

SEQ ID NO: 3609038 - DNA, 21 bp, Homo sapiens
tgaccatcatgccctctctcg

SEQ ID NO: 3609039 - DNA, 17 bp, Homo sapiens
tgacccagtgcccccac

SEQ ID NO: 3609040 - DNA, 20 bp, Homo sapiens
tgaccccaagggggctgctg

SEQ ID NO: 3609041 - DNA, 20 bp, Homo sapiens
tgaccccaggagggaggcag

SEQ ID NO: 3609042 - DNA, 22 bp, Homo sapiens
tgaccccaggagggaggcaggg

SEQ ID NO: 3609043 - DNA, 20 bp, Homo sapiens
tgacccccatctgagctggg

SEQ ID NO: 3609044 - DNA, 13 bp, Homo sapiens
tgacccctctggt

SEQ ID NO: 3609045 - DNA, 20 bp, Homo sapiens
tgaccctcaggcacaccttg

SEQ ID NO: 3609046 - DNA, 11 bp, Homo sapiens
tgaccctgggc

SEQ ID NO: 3609047 - DNA, 22 bp, Homo sapiens
tgacccttacagcctctgactt

SEQ ID NO: 3609048 - DNA, 16 bp, Homo sapiens
tgaccgagccctggag

SEQ ID NO: 3609049 - DNA, 20 bp, Homo sapiens
tgaccgagccctggagagcc

SEQ ID NO: 3609050 - DNA, 15 bp, Homo sapiens
tgacctaccccagcc

SEQ ID NO: 3609051 - DNA, 20 bp, Homo sapiens
tgacctaccccagccaggct

SEQ ID NO: 3609052 - DNA, 21 bp, Homo sapiens
tgacctaccccagccaggctc

SEQ ID NO: 3609053 - DNA, 21 bp, Homo sapiens
tgacctcaagtgatctgtcca

SEQ ID NO: 3609054 - DNA, 16 bp, Homo sapiens
tgacctcactggcctg

SEQ ID NO: 3609055 - DNA, 21 bp, Homo sapiens
tgacctctgacaactgtgaag

SEQ ID NO: 3609056 - DNA, 13 bp, Homo sapiens
tgacctgccccaa

SEQ ID NO: 3609057 - DNA, 14 bp, Homo sapiens
tgacctgtcctctt

SEQ ID NO: 3609058 - DNA, 12 bp, Homo sapiens
tgaccttcccag

SEQ ID NO: 3609059 - DNA, 14 bp, Homo sapiens
tgaccttcccaggg

SEQ ID NO: 3609060 - DNA, 22 bp, Homo sapiens
tgaccttgagttaacaggacag

SEQ ID NO: 3609061 - DNA, 14 bp, Homo sapiens
tgacctttatttat

SEQ ID NO: 3609062 - DNA, 23 bp, Homo sapiens
tgacctttatttattaaacttca

SEQ ID NO: 3609063 - DNA, 14 bp, Homo sapiens
tgacgctgacaata

SEQ ID NO: 3609064 - DNA, 19 bp, Homo sapiens
tgacggtgttaattttgct

SEQ ID NO: 3609065 - DNA, 23 bp, Homo sapiens
tgacgtgctccgtagctctgctg

SEQ ID NO: 3609066 - DNA, 14 bp, Homo sapiens
tgactaaaatattt

SEQ ID NO: 3609067 - DNA, 17 bp, Homo sapiens
tgactaactatgcaata

SEQ ID NO: 3609068 - DNA, 16 bp, Homo sapiens
tgactcaattatttgc

SEQ ID NO: 3609069 - DNA, 18 bp, Homo sapiens
tgactcaattatttgcat

SEQ ID NO: 3609070 - DNA, 20 bp, Homo sapiens
tgactcaattatttgcatat

SEQ ID NO: 3609071 - DNA, 19 bp, Homo sapiens
tgactccagggtgacaagg

SEQ ID NO: 3609072 - DNA, 18 bp, Homo sapiens
tgactccccagcccagca

SEQ ID NO: 3609073 - DNA, 20 bp, Homo sapiens
tgactccccagcccagcacc

SEQ ID NO: 3609074 - DNA, 21 bp, Homo sapiens
tgactccccagcccagcaccc

SEQ ID NO: 3609075 - DNA, 15 bp, Homo sapiens
tgactcctgctggta

SEQ ID NO: 3609076 - DNA, 21 bp, Homo sapiens
tgactcctgctggtacctgcc

SEQ ID NO: 3609077 - DNA, 19 bp, Homo sapiens
tgactccttatctctttcc

SEQ ID NO: 3609078 - DNA, 23 bp, Homo sapiens
tgactccttatctctttccacca

SEQ ID NO: 3609079 - DNA, 14 bp, Homo sapiens
tgactctcctgcct

SEQ ID NO: 3609080 - DNA, 20 bp, Homo sapiens
tgactctcctgcctcagcct

SEQ ID NO: 3609081 - DNA, 17 bp, Homo sapiens
tgactgatgattttcct

SEQ ID NO: 3609082 - DNA, 18 bp, Homo sapiens
tgactgatgattttcctt

SEQ ID NO: 3609083 - DNA, 14 bp, Homo sapiens
tgactgccaagcca

SEQ ID NO: 3609084 - DNA, 14 bp, Homo sapiens
tgactggaggaggc

SEQ ID NO: 3609085 - DNA, 17 bp, Homo sapiens
tgactgggtgagaccca

SEQ ID NO: 3609086 - DNA, 21 bp, Homo sapiens
tgactgtggtagccagcatcg

SEQ ID NO: 3609087 - DNA, 14 bp, Homo sapiens
tgacttatttctgc

SEQ ID NO: 3609088 - DNA, 18 bp, Homo sapiens
tgacttcgcagccccggg

SEQ ID NO: 3609089 - DNA, 15 bp, Homo sapiens
tgacttctaagtaaa

SEQ ID NO: 3609090 - DNA, 18 bp, Homo sapiens
tgacttgaaaagaaagaa

SEQ ID NO: 3609091 - DNA, 13 bp, Homo sapiens
tgactttccagaa

SEQ ID NO: 3609092 - DNA, 12 bp, Homo sapiens
tgactttcctta

SEQ ID NO: 3609093 - DNA, 14 bp, Homo sapiens
tgactttggttttt

SEQ ID NO: 3609094 - DNA, 19 bp, Homo sapiens
tgagaaacagctcagccag

SEQ ID NO: 3609095 - DNA, 20 bp, Homo sapiens
tgagaaacagctcagccagt

SEQ ID NO: 3609096 - DNA, 23 bp, Homo sapiens
tgagaaacagctcagccagtggg

SEQ ID NO: 3609097 - DNA, 16 bp, Homo sapiens
tgagaaactgctgcag

SEQ ID NO: 3609098 - DNA, 16 bp, Homo sapiens
tgagaaagactattca

SEQ ID NO: 3609099 - DNA, 17 bp, Homo sapiens
tgagaaagactattcaa

SEQ ID NO: 3609100 - DNA, 18 bp, Homo sapiens
tgagaaagactattcaaa

SEQ ID NO: 3609101 - DNA, 21 bp, Homo sapiens
tgagaaagggattgctgaggc

SEQ ID NO: 3609102 - DNA, 20 bp, Homo sapiens
tgagaatgctagcaggctgt

SEQ ID NO: 3609103 - DNA, 21 bp, Homo sapiens
tgagaatggcctggagcaggc

SEQ ID NO: 3609104 - DNA, 20 bp, Homo sapiens
tgagactcctcagcacccct

SEQ ID NO: 3609105 - DNA, 17 bp, Homo sapiens
tgagagaaacgtgaaac

SEQ ID NO: 3609106 - DNA, 16 bp, Homo sapiens
tgagagaaagagagaa

SEQ ID NO: 3609107 - DNA, 14 bp, Homo sapiens
tgagagacacgctg

SEQ ID NO: 3609108 - DNA, 15 bp, Homo sapiens
tgagagcataattta

SEQ ID NO: 3609109 - DNA, 16 bp, Homo sapiens
tgagagctttctgcct

SEQ ID NO: 3609110 - DNA, 19 bp, Homo sapiens
tgagaggctgtctgttgta

SEQ ID NO: 3609111 - DNA, 22 bp, Homo sapiens
tgagagttccggggagaaaccc

SEQ ID NO: 3609112 - DNA, 15 bp, Homo sapiens
tgagatattaaattc

SEQ ID NO: 3609113 - DNA, 13 bp, Homo sapiens
tgagatgtgaaca

SEQ ID NO: 3609114 - DNA, 16 bp, Homo sapiens
tgagattcaagacaag

SEQ ID NO: 3609115 - DNA, 18 bp, Homo sapiens
tgagcaaatgtggctcct

SEQ ID NO: 3609116 - DNA, 15 bp, Homo sapiens
tgagcaagcccagga

SEQ ID NO: 3609117 - DNA, 21 bp, Homo sapiens
tgagcacaaagaagaaagctg

SEQ ID NO: 3609118 - DNA, 22 bp, Homo sapiens
tgagcacaactttaagaggaca

SEQ ID NO: 3609119 - DNA, 21 bp, Homo sapiens
tgagcagcatccaccccaccc

SEQ ID NO: 3609120 - DNA, 20 bp, Homo sapiens
tgagcaggattttaatcttt

SEQ ID NO: 3609121 - DNA, 14 bp, Homo sapiens
tgagcagggatctg

SEQ ID NO: 3609122 - DNA, 19 bp, Homo sapiens
tgagcagggtccacagctg

SEQ ID NO: 3609123 - DNA, 19 bp, Homo sapiens
tgagcaggtacatttctga

SEQ ID NO: 3609124 - DNA, 22 bp, Homo sapiens
tgagcaggtacatttctgattc

SEQ ID NO: 3609125 - DNA, 19 bp, Homo sapiens
tgagcagtcgcctgcctgc

SEQ ID NO: 3609126 - DNA, 22 bp, Homo sapiens
tgagcagtcgcctgcctgcagc

SEQ ID NO: 3609127 - DNA, 19 bp, Homo sapiens
tgagcagtgttgcgttttt

SEQ ID NO: 3609128 - DNA, 16 bp, Homo sapiens
tgagccaaatttcttt

SEQ ID NO: 3609129 - DNA, 19 bp, Homo sapiens
tgagccactgtgcttggcc

SEQ ID NO: 3609130 - DNA, 16 bp, Homo sapiens
tgagcccatttctggg

SEQ ID NO: 3609131 - DNA, 17 bp, Homo sapiens
tgagcccatttctgggg

SEQ ID NO: 3609132 - DNA, 23 bp, Homo sapiens
tgagcccatttctggggggagaa

SEQ ID NO: 3609133 - DNA, 17 bp, Homo sapiens
tgagcccctccccagcc

SEQ ID NO: 3609134 - DNA, 19 bp, Homo sapiens
tgagcccctccccagccag

SEQ ID NO: 3609135 - DNA, 17 bp, Homo sapiens
tgagcccctgtctagag

SEQ ID NO: 3609136 - DNA, 22 bp, Homo sapiens
tgagcccctgtctagagaggga

SEQ ID NO: 3609137 - DNA, 19 bp, Homo sapiens
tgagccctcctgagggccg

SEQ ID NO: 3609138 - DNA, 11 bp, Homo sapiens
tgagcctggtc

SEQ ID NO: 3609139 - DNA, 14 bp, Homo sapiens
tgagcggcaccctg

SEQ ID NO: 3609140 - DNA, 12 bp, Homo sapiens
tgagctcttccc

SEQ ID NO: 3609141 - DNA, 15 bp, Homo sapiens
tgagctcttccctta

SEQ ID NO: 3609142 - DNA, 17 bp, Homo sapiens
tgagctggaaggggcca

SEQ ID NO: 3609143 - DNA, 17 bp, Homo sapiens
tgagctggcaaccagcc

SEQ ID NO: 3609144 - DNA, 19 bp, Homo sapiens
tgagctggcaaccagccag

SEQ ID NO: 3609145 - DNA, 20 bp, Homo sapiens
tgagctggcaaccagccagc

SEQ ID NO: 3609146 - DNA, 16 bp, Homo sapiens
tgagctggcccttggg

SEQ ID NO: 3609147 - DNA, 20 bp, Homo sapiens
tgagctggggactcagggac

SEQ ID NO: 3609148 - DNA, 21 bp, Homo sapiens
tgagctggggactcagggacc

SEQ ID NO: 3609149 - DNA, 23 bp, Homo sapiens
tgagcttttaaataaaattgaaa

SEQ ID NO: 3609150 - DNA, 13 bp, Homo sapiens
tgaggaattttct

SEQ ID NO: 3609151 - DNA, 18 bp, Homo sapiens
tgaggaattttctttgtg

SEQ ID NO: 3609152 - DNA, 16 bp, Homo sapiens
tgaggagatgaccagg

SEQ ID NO: 3609153 - DNA, 19 bp, Homo sapiens
tgaggagcagcaggagggg

SEQ ID NO: 3609154 - DNA, 22 bp, Homo sapiens
tgaggagcagcaggagggggga

SEQ ID NO: 3609155 - DNA, 13 bp, Homo sapiens
tgaggagctgggg

SEQ ID NO: 3609156 - DNA, 20 bp, Homo sapiens
tgaggagctggggatccctc

SEQ ID NO: 3609157 - DNA, 15 bp, Homo sapiens
tgaggatccagggca

SEQ ID NO: 3609158 - DNA, 16 bp, Homo sapiens
tgaggatccagggcag

SEQ ID NO: 3609159 - DNA, 18 bp, Homo sapiens
tgaggatccagggcagca

SEQ ID NO: 3609160 - DNA, 22 bp, Homo sapiens
tgaggatttctttttggtttgc

SEQ ID NO: 3609161 - DNA, 17 bp, Homo sapiens
tgaggcaccgtccaggc

SEQ ID NO: 3609162 - DNA, 19 bp, Homo sapiens
tgaggcaccgtccaggccc

SEQ ID NO: 3609163 - DNA, 15 bp, Homo sapiens
tgaggcactggcgag

SEQ ID NO: 3609164 - DNA, 14 bp, Homo sapiens
tgaggccatctcag

SEQ ID NO: 3609165 - DNA, 15 bp, Homo sapiens
tgaggccatctcagg

SEQ ID NO: 3609166 - DNA, 19 bp, Homo sapiens
tgaggcccagagagggaag

SEQ ID NO: 3609167 - DNA, 19 bp, Homo sapiens
tgaggcctgccccctgggc

SEQ ID NO: 3609168 - DNA, 17 bp, Homo sapiens
tgaggcttctccttctc

SEQ ID NO: 3609169 - DNA, 23 bp, Homo sapiens
tgagggccggttctaaggctcag

SEQ ID NO: 3609170 - DNA, 20 bp, Homo sapiens
tgagggctaattctgggaag

SEQ ID NO: 3609171 - DNA, 14 bp, Homo sapiens
tgaggggcaggtct

SEQ ID NO: 3609172 - DNA, 13 bp, Homo sapiens
tgaggggctttct

SEQ ID NO: 3609173 - DNA, 15 bp, Homo sapiens
tgaggggctttctct

SEQ ID NO: 3609174 - DNA, 16 bp, Homo sapiens
tgaggggctttctctt

SEQ ID NO: 3609175 - DNA, 14 bp, Homo sapiens
tgagggggtaaagc

SEQ ID NO: 3609176 - DNA, 18 bp, Homo sapiens
tgagggggtgggggtgct

SEQ ID NO: 3609177 - DNA, 11 bp, Homo sapiens
tgaggggtctc

SEQ ID NO: 3609178 - DNA, 15 bp, Homo sapiens
tgaggggtctcggat

SEQ ID NO: 3609179 - DNA, 14 bp, Homo sapiens
tgagggtaagtatt

SEQ ID NO: 3609180 - DNA, 15 bp, Homo sapiens
tgagggtcctgcagc

SEQ ID NO: 3609181 - DNA, 18 bp, Homo sapiens
tgagggtcctgcagcctg

SEQ ID NO: 3609182 - DNA, 19 bp, Homo sapiens
tgagggtcctgcagcctgc

SEQ ID NO: 3609183 - DNA, 22 bp, Homo sapiens
tgagggtcctgcagcctgcagg

SEQ ID NO: 3609184 - DNA, 16 bp, Homo sapiens
tgagggtcgtgggaaa

SEQ ID NO: 3609185 - DNA, 21 bp, Homo sapiens
tgaggtcaccaggggaggagc

SEQ ID NO: 3609186 - DNA, 15 bp, Homo sapiens
tgaggtcactgctag

SEQ ID NO: 3609187 - DNA, 14 bp, Homo sapiens
tgaggtcagtgttt

SEQ ID NO: 3609188 - DNA, 19 bp, Homo sapiens
tgaggtctagagagaacca

SEQ ID NO: 3609189 - DNA, 21 bp, Homo sapiens
tgaggtctcattcatccttat

SEQ ID NO: 3609190 - DNA, 17 bp, Homo sapiens
tgaggtgaactccaggc

SEQ ID NO: 3609191 - DNA, 16 bp, Homo sapiens
tgaggtttttaaatat

SEQ ID NO: 3609192 - DNA, 16 bp, Homo sapiens
tgagtaattgaggaaa

SEQ ID NO: 3609193 - DNA, 13 bp, Homo sapiens
tgagtcaaaacaa

SEQ ID NO: 3609194 - DNA, 14 bp, Homo sapiens
tgagtcaaaacaaa

SEQ ID NO: 3609195 - DNA, 13 bp, Homo sapiens
tgagtcaaatcca

SEQ ID NO: 3609196 - DNA, 18 bp, Homo sapiens
tgagtcaaatccagtggt

SEQ ID NO: 3609197 - DNA, 20 bp, Homo sapiens
tgagtcaccctacctgtgcc

SEQ ID NO: 3609198 - DNA, 17 bp, Homo sapiens
tgagtcacctgctccag

SEQ ID NO: 3609199 - DNA, 23 bp, Homo sapiens
tgagtcatttgtttaaacaatct

SEQ ID NO: 3609200 - DNA, 18 bp, Homo sapiens
tgagtgagaagataaaaa

SEQ ID NO: 3609201 - DNA, 15 bp, Homo sapiens
tgagtgcacctgcct

SEQ ID NO: 3609202 - DNA, 22 bp, Homo sapiens
tgagtgcacctgcctccaccag

SEQ ID NO: 3609203 - DNA, 12 bp, Homo sapiens
tgagtggaaata

SEQ ID NO: 3609204 - DNA, 21 bp, Homo sapiens
tgagtgtgtggtctctgcccc

SEQ ID NO: 3609205 - DNA, 16 bp, Homo sapiens
tgagttaacaggacag

SEQ ID NO: 3609206 - DNA, 17 bp, Homo sapiens
tgagttaacaggacagt

SEQ ID NO: 3609207 - DNA, 18 bp, Homo sapiens
tgagttacattaaaataa

SEQ ID NO: 3609208 - DNA, 18 bp, Homo sapiens
tgagttcataaatttatg

SEQ ID NO: 3609209 - DNA, 16 bp, Homo sapiens
tgagttcctctgcagt

SEQ ID NO: 3609210 - DNA, 18 bp, Homo sapiens
tgagttgaagatctttga

SEQ ID NO: 3609211 - DNA, 21 bp, Homo sapiens
tgagttggaacaacatgttct

SEQ ID NO: 3609212 - DNA, 16 bp, Homo sapiens
tgagtttaccttgtat

SEQ ID NO: 3609213 - DNA, 13 bp, Homo sapiens
tgataaactgaat

SEQ ID NO: 3609214 - DNA, 14 bp, Homo sapiens
tgataaactgacga

SEQ ID NO: 3609215 - DNA, 12 bp, Homo sapiens
tgataaaggaaa

SEQ ID NO: 3609216 - DNA, 17 bp, Homo sapiens
tgataacaatgttttaa

SEQ ID NO: 3609217 - DNA, 16 bp, Homo sapiens
tgataacatggaaatg

SEQ ID NO: 3609218 - DNA, 15 bp, Homo sapiens
tgataattctcagta

SEQ ID NO: 3609219 - DNA, 13 bp, Homo sapiens
tgataattttcct

SEQ ID NO: 3609220 - DNA, 17 bp, Homo sapiens
tgataattttcctttaa

SEQ ID NO: 3609221 - DNA, 13 bp, Homo sapiens
tgatactaccagg

SEQ ID NO: 3609222 - DNA, 17 bp, Homo sapiens
tgatactaccagggtct

SEQ ID NO: 3609223 - DNA, 13 bp, Homo sapiens
tgatactgtctct

SEQ ID NO: 3609224 - DNA, 17 bp, Homo sapiens
tgatagacaattgaggt

SEQ ID NO: 3609225 - DNA, 19 bp, Homo sapiens
tgatagacacatatgaggg

SEQ ID NO: 3609226 - DNA, 17 bp, Homo sapiens
tgatagtgatgtatttt

SEQ ID NO: 3609227 - DNA, 10 bp, Homo sapiens
tgatatgcat

SEQ ID NO: 3609228 - DNA, 11 bp, Homo sapiens
tgatatgcatg

SEQ ID NO: 3609229 - DNA, 17 bp, Homo sapiens
tgatattgttatataca

SEQ ID NO: 3609230 - DNA, 17 bp, Homo sapiens
tgatatttaagcagctt

SEQ ID NO: 3609231 - DNA, 22 bp, Homo sapiens
tgatatttaagcagcttgaatg

SEQ ID NO: 3609232 - DNA, 12 bp, Homo sapiens
tgatatttgcat

SEQ ID NO: 3609233 - DNA, 14 bp, Homo sapiens
tgatatttgcattg

SEQ ID NO: 3609234 - DNA, 16 bp, Homo sapiens
tgatatttgcattgag

SEQ ID NO: 3609235 - DNA, 21 bp, Homo sapiens
tgatatttgcattgaggaaat

SEQ ID NO: 3609236 - DNA, 22 bp, Homo sapiens
tgatattttcaacgcagccctg

SEQ ID NO: 3609237 - DNA, 19 bp, Homo sapiens
tgatcaccgactgaaaata

SEQ ID NO: 3609238 - DNA, 22 bp, Homo sapiens
tgatcccaccccctcctccccc

SEQ ID NO: 3609239 - DNA, 21 bp, Homo sapiens
tgatccccgtctctgccctgg

SEQ ID NO: 3609240 - DNA, 17 bp, Homo sapiens
tgatcccttgagatatg

SEQ ID NO: 3609241 - DNA, 14 bp, Homo sapiens
tgatcctcacgcct

SEQ ID NO: 3609242 - DNA, 15 bp, Homo sapiens
tgatcctgccaatct

SEQ ID NO: 3609243 - DNA, 15 bp, Homo sapiens
tgatcctggaggccc

SEQ ID NO: 3609244 - DNA, 20 bp, Homo sapiens
tgatcgcctctttgacattt

SEQ ID NO: 3609245 - DNA, 16 bp, Homo sapiens
tgatctctcttgtcct

SEQ ID NO: 3609246 - DNA, 22 bp, Homo sapiens
tgatctcttctggtgttgactg

SEQ ID NO: 3609247 - DNA, 18 bp, Homo sapiens
tgatctggaacccagact

SEQ ID NO: 3609248 - DNA, 18 bp, Homo sapiens
tgatcttaatatatttga

SEQ ID NO: 3609249 - DNA, 20 bp, Homo sapiens
tgatcttctttataattcta

SEQ ID NO: 3609250 - DNA, 10 bp, Homo sapiens
tgatcttgtg

SEQ ID NO: 3609251 - DNA, 20 bp, Homo sapiens
tgatcttgtgctatgaaaca

SEQ ID NO: 3609252 - DNA, 17 bp, Homo sapiens
tgatctttaaaatacac

SEQ ID NO: 3609253 - DNA, 20 bp, Homo sapiens
tgatgaaaactaaggatttt

SEQ ID NO: 3609254 - DNA, 18 bp, Homo sapiens
tgatgacatatcacatgt

SEQ ID NO: 3609255 - DNA, 15 bp, Homo sapiens
tgatgacattccctg

SEQ ID NO: 3609256 - DNA, 18 bp, Homo sapiens
tgatgacattccctgcta

SEQ ID NO: 3609257 - DNA, 17 bp, Homo sapiens
tgatgagagaatgtgga

SEQ ID NO: 3609258 - DNA, 14 bp, Homo sapiens
tgatgatctttaaa

SEQ ID NO: 3609259 - DNA, 17 bp, Homo sapiens
tgatgatctttaaaata

SEQ ID NO: 3609260 - DNA, 16 bp, Homo sapiens
tgatgatgatgaaaac

SEQ ID NO: 3609261 - DNA, 16 bp, Homo sapiens
tgatgatgatgatgat

SEQ ID NO: 3609262 - DNA, 14 bp, Homo sapiens
tgatgattttcctt

SEQ ID NO: 3609263 - DNA, 18 bp, Homo sapiens
tgatgattttcctttttc

SEQ ID NO: 3609264 - DNA, 13 bp, Homo sapiens
tgatgcaaggatt

SEQ ID NO: 3609265 - DNA, 16 bp, Homo sapiens
tgatgcaaggattaca

SEQ ID NO: 3609266 - DNA, 23 bp, Homo sapiens
tgatgcaaggattacagaaactg

SEQ ID NO: 3609267 - DNA, 15 bp, Homo sapiens
tgatgcacagtatct

SEQ ID NO: 3609268 - DNA, 16 bp, Homo sapiens
tgatgcacagtatctg

SEQ ID NO: 3609269 - DNA, 22 bp, Homo sapiens
tgatgcacagtatctgctgttc

SEQ ID NO: 3609270 - DNA, 15 bp, Homo sapiens
tgatgctgcccctca

SEQ ID NO: 3609271 - DNA, 14 bp, Homo sapiens
tgatggaaaataaa

SEQ ID NO: 3609272 - DNA, 17 bp, Homo sapiens
tgatggagccccagggt

SEQ ID NO: 3609273 - DNA, 14 bp, Homo sapiens
tgatggatggcaga

SEQ ID NO: 3609274 - DNA, 16 bp, Homo sapiens
tgatggcaacagatct

SEQ ID NO: 3609275 - DNA, 14 bp, Homo sapiens
tgatggcagagcca

SEQ ID NO: 3609276 - DNA, 14 bp, Homo sapiens
tgatgggaaagcat

SEQ ID NO: 3609277 - DNA, 19 bp, Homo sapiens
tgatgggaaagcattgtaa

SEQ ID NO: 3609278 - DNA, 15 bp, Homo sapiens
tgatgggtcagttgt

SEQ ID NO: 3609279 - DNA, 13 bp, Homo sapiens
tgatgtataatgt

SEQ ID NO: 3609280 - DNA, 20 bp, Homo sapiens
tgatgtataatgtaatgttt

SEQ ID NO: 3609281 - DNA, 13 bp, Homo sapiens
tgatgtccttgga

SEQ ID NO: 3609282 - DNA, 20 bp, Homo sapiens
tgatgtgaagagtttcacaa

SEQ ID NO: 3609283 - DNA, 17 bp, Homo sapiens
tgattaaccttttcaaa

SEQ ID NO: 3609284 - DNA, 17 bp, Homo sapiens
tgattagttgacagtat

SEQ ID NO: 3609285 - DNA, 20 bp, Homo sapiens
tgattattaacgatgtccaa

SEQ ID NO: 3609286 - DNA, 14 bp, Homo sapiens
tgattcaaatgttt

SEQ ID NO: 3609287 - DNA, 14 bp, Homo sapiens
tgattcatatttaa

SEQ ID NO: 3609288 - DNA, 15 bp, Homo sapiens
tgattcatatttaat

SEQ ID NO: 3609289 - DNA, 15 bp, Homo sapiens
tgattccatcaaaga

SEQ ID NO: 3609290 - DNA, 18 bp, Homo sapiens
tgattcgtagatttaata

SEQ ID NO: 3609291 - DNA, 15 bp, Homo sapiens
tgattctcagggctg

SEQ ID NO: 3609292 - DNA, 13 bp, Homo sapiens
tgattctcctgcc

SEQ ID NO: 3609293 - DNA, 16 bp, Homo sapiens
tgattctgattgctat

SEQ ID NO: 3609294 - DNA, 15 bp, Homo sapiens
tgattggctgcagga

SEQ ID NO: 3609295 - DNA, 12 bp, Homo sapiens
tgattggctgct

SEQ ID NO: 3609296 - DNA, 10 bp, Homo sapiens
tgattggctt

SEQ ID NO: 3609297 - DNA, 14 bp, Homo sapiens
tgatttaatatgga

SEQ ID NO: 3609298 - DNA, 15 bp, Homo sapiens
tgatttaatatggat

SEQ ID NO: 3609299 - DNA, 22 bp, Homo sapiens
tgatttaggtagccttgtgttc

SEQ ID NO: 3609300 - DNA, 18 bp, Homo sapiens
tgatttgtactgaaaaat

SEQ ID NO: 3609301 - DNA, 16 bp, Homo sapiens
tgatttttaagaaagt

SEQ ID NO: 3609302 - DNA, 22 bp, Homo sapiens
tgatttttaagaaagtaattta

SEQ ID NO: 3609303 - DNA, 10 bp, Homo sapiens
tgatttttgt

SEQ ID NO: 3609304 - DNA, 18 bp, Homo sapiens
tgcaaaaaaagcctccaa

SEQ ID NO: 3609305 - DNA, 23 bp, Homo sapiens
tgcaaagatctgtcctcagcctt

SEQ ID NO: 3609306 - DNA, 20 bp, Homo sapiens
tgcaaagcactgacttctaa

SEQ ID NO: 3609307 - DNA, 17 bp, Homo sapiens
tgcaaatacaatcagcc

SEQ ID NO: 3609308 - DNA, 15 bp, Homo sapiens
tgcaaattttaactg

SEQ ID NO: 3609309 - DNA, 21 bp, Homo sapiens
tgcaacattttaaggcaatgg

SEQ ID NO: 3609310 - DNA, 20 bp, Homo sapiens
tgcaactctaactctgagag

SEQ ID NO: 3609311 - DNA, 14 bp, Homo sapiens
tgcaacttctgcct

SEQ ID NO: 3609312 - DNA, 16 bp, Homo sapiens
tgcaagaccacggagg

SEQ ID NO: 3609313 - DNA, 15 bp, Homo sapiens
tgcaagcacagccct

SEQ ID NO: 3609314 - DNA, 16 bp, Homo sapiens
tgcaagcacagccctt

SEQ ID NO: 3609315 - DNA, 21 bp, Homo sapiens
tgcaaggattacagaaactga

SEQ ID NO: 3609316 - DNA, 22 bp, Homo sapiens
tgcaagtggagctgtctgtctc

SEQ ID NO: 3609317 - DNA, 17 bp, Homo sapiens
tgcaagttatgaaatat

SEQ ID NO: 3609318 - DNA, 21 bp, Homo sapiens
tgcaataaatctgacccagtg

SEQ ID NO: 3609319 - DNA, 24 bp, Homo sapiens
tgcaatcacagctcactgcagcct

SEQ ID NO: 3609320 - DNA, 18 bp, Homo sapiens
tgcaatctaatctgaact

SEQ ID NO: 3609321 - DNA, 15 bp, Homo sapiens
tgcacaacagagtaa

SEQ ID NO: 3609322 - DNA, 12 bp, Homo sapiens
tgcacaacagcc

SEQ ID NO: 3609323 - DNA, 22 bp, Homo sapiens
tgcacaacagccctgcctgaga

SEQ ID NO: 3609324 - DNA, 17 bp, Homo sapiens
tgcacaccattttgtaa

SEQ ID NO: 3609325 - DNA, 18 bp, Homo sapiens
tgcacaccattttgtaaa

SEQ ID NO: 3609326 - DNA, 21 bp, Homo sapiens
tgcacactctcccattatatt

SEQ ID NO: 3609327 - DNA, 14 bp, Homo sapiens
tgcacactgtccta

SEQ ID NO: 3609328 - DNA, 20 bp, Homo sapiens
tgcacagtatctgctgttct

SEQ ID NO: 3609329 - DNA, 16 bp, Homo sapiens
tgcacagtgcatctca

SEQ ID NO: 3609330 - DNA, 12 bp, Homo sapiens
tgcacatccctg

SEQ ID NO: 3609331 - DNA, 19 bp, Homo sapiens
tgcacatgctgtctggccc

SEQ ID NO: 3609332 - DNA, 23 bp, Homo sapiens
tgcacatgctgtctggccctggg

SEQ ID NO: 3609333 - DNA, 13 bp, Homo sapiens
tgcacatttggaa

SEQ ID NO: 3609334 - DNA, 16 bp, Homo sapiens
tgcacatttggaattg

SEQ ID NO: 3609335 - DNA, 19 bp, Homo sapiens
tgcaccatgctgctgggga

SEQ ID NO: 3609336 - DNA, 13 bp, Homo sapiens
tgcacccagaaca

SEQ ID NO: 3609337 - DNA, 22 bp, Homo sapiens
tgcacccctgagccagcagggc

SEQ ID NO: 3609338 - DNA, 16 bp, Homo sapiens
tgcaccccttcctggg

SEQ ID NO: 3609339 - DNA, 17 bp, Homo sapiens
tgcaccccttcctgggc

SEQ ID NO: 3609340 - DNA, 19 bp, Homo sapiens
tgcaccccttcctgggcac

SEQ ID NO: 3609341 - DNA, 17 bp, Homo sapiens
tgcaccctgcgcctcca

SEQ ID NO: 3609342 - DNA, 18 bp, Homo sapiens
tgcacctatctcagccat

SEQ ID NO: 3609343 - DNA, 20 bp, Homo sapiens
tgcacctatctcagccatag

SEQ ID NO: 3609344 - DNA, 18 bp, Homo sapiens
tgcacctcctaccctccc

SEQ ID NO: 3609345 - DNA, 20 bp, Homo sapiens
tgcacctcctaccctcccac

SEQ ID NO: 3609346 - DNA, 18 bp, Homo sapiens
tgcacctgcctccaccag

SEQ ID NO: 3609347 - DNA, 19 bp, Homo sapiens
tgcacctgcctccaccagc

SEQ ID NO: 3609348 - DNA, 20 bp, Homo sapiens
tgcacctgcctccaccagca

SEQ ID NO: 3609349 - DNA, 17 bp, Homo sapiens
tgcaccttccagcccgg

SEQ ID NO: 3609350 - DNA, 15 bp, Homo sapiens
tgcacgctcaatgcc

SEQ ID NO: 3609351 - DNA, 18 bp, Homo sapiens
tgcacgctcaatgcccag

SEQ ID NO: 3609352 - DNA, 24 bp, Homo sapiens
tgcacgctcaatgcccagtaaaat

SEQ ID NO: 3609353 - DNA, 22 bp, Homo sapiens
tgcacgctgggcaatgagaatc

SEQ ID NO: 3609354 - DNA, 21 bp, Homo sapiens
tgcactaaaatgaggatccag

SEQ ID NO: 3609355 - DNA, 23 bp, Homo sapiens
tgcactaaggggcccggccagcc

SEQ ID NO: 3609356 - DNA, 21 bp, Homo sapiens
tgcactcacccctagccctgg

SEQ ID NO: 3609357 - DNA, 12 bp, Homo sapiens
tgcactcagatt

SEQ ID NO: 3609358 - DNA, 14 bp, Homo sapiens
tgcactccagactc

SEQ ID NO: 3609359 - DNA, 19 bp, Homo sapiens
tgcactccagactctgggg

SEQ ID NO: 3609360 - DNA, 20 bp, Homo sapiens
tgcactgaacaggttctctt

SEQ ID NO: 3609361 - DNA, 15 bp, Homo sapiens
tgcactgaagttttt

SEQ ID NO: 3609362 - DNA, 17 bp, Homo sapiens
tgcactgatgctgcccc

SEQ ID NO: 3609363 - DNA, 17 bp, Homo sapiens
tgcactgcctgcatgag

SEQ ID NO: 3609364 - DNA, 20 bp, Homo sapiens
tgcactgcctgcatgagctg

SEQ ID NO: 3609365 - DNA, 19 bp, Homo sapiens
tgcactggggcgtttccta

SEQ ID NO: 3609366 - DNA, 22 bp, Homo sapiens
tgcacttacacttataaaataa

SEQ ID NO: 3609367 - DNA, 22 bp, Homo sapiens
tgcacttatttatgaacctgcc

SEQ ID NO: 3609368 - DNA, 18 bp, Homo sapiens
tgcacttgttatattata

SEQ ID NO: 3609369 - DNA, 14 bp, Homo sapiens
tgcagaagctgtgg

SEQ ID NO: 3609370 - DNA, 14 bp, Homo sapiens
tgcagaaggaaaga

SEQ ID NO: 3609371 - DNA, 15 bp, Homo sapiens
tgcagaaggaaagaa

SEQ ID NO: 3609372 - DNA, 21 bp, Homo sapiens
tgcagaaggcaaggccctgcc

SEQ ID NO: 3609373 - DNA, 21 bp, Homo sapiens
tgcagagcaggaaacatgact

SEQ ID NO: 3609374 - DNA, 22 bp, Homo sapiens
tgcagatactttgaagtgcagc

SEQ ID NO: 3609375 - DNA, 22 bp, Homo sapiens
tgcagatattctctagtcattt

SEQ ID NO: 3609376 - DNA, 14 bp, Homo sapiens
tgcagatttgatat

SEQ ID NO: 3609377 - DNA, 23 bp, Homo sapiens
tgcagcacagctgagaggctgtc

SEQ ID NO: 3609378 - DNA, 10 bp, Homo sapiens
tgcagcaggc

SEQ ID NO: 3609379 - DNA, 17 bp, Homo sapiens
tgcagcagggatgccct

SEQ ID NO: 3609380 - DNA, 21 bp, Homo sapiens
tgcagcatttactatgcacaa

SEQ ID NO: 3609381 - DNA, 22 bp, Homo sapiens
tgcagcatttactatgcacaac

SEQ ID NO: 3609382 - DNA, 14 bp, Homo sapiens
tgcagcatttcact

SEQ ID NO: 3609383 - DNA, 15 bp, Homo sapiens
tgcagcatttcactt

SEQ ID NO: 3609384 - DNA, 14 bp, Homo sapiens
tgcagcccaggcca

SEQ ID NO: 3609385 - DNA, 16 bp, Homo sapiens
tgcagcccaggccagt

SEQ ID NO: 3609386 - DNA, 19 bp, Homo sapiens
tgcagcccattcccaaggg

SEQ ID NO: 3609387 - DNA, 17 bp, Homo sapiens
tgcagccccagggcctg

SEQ ID NO: 3609388 - DNA, 18 bp, Homo sapiens
tgcagcccgtgtccagga

SEQ ID NO: 3609389 - DNA, 20 bp, Homo sapiens
tgcagcccgtgtccaggagc

SEQ ID NO: 3609390 - DNA, 15 bp, Homo sapiens
tgcagccgcagagaa

SEQ ID NO: 3609391 - DNA, 13 bp, Homo sapiens
tgcagcctaagaa

SEQ ID NO: 3609392 - DNA, 17 bp, Homo sapiens
tgcagcctaagaagaag

SEQ ID NO: 3609393 - DNA, 16 bp, Homo sapiens
tgcagcctctctggct

SEQ ID NO: 3609394 - DNA, 18 bp, Homo sapiens
tgcagcctctctggctgg

SEQ ID NO: 3609395 - DNA, 21 bp, Homo sapiens
tgcagcctctctggctggtct

SEQ ID NO: 3609396 - DNA, 17 bp, Homo sapiens
tgcagcctgcaggacct

SEQ ID NO: 3609397 - DNA, 18 bp, Homo sapiens
tgcagcctgcaggacctc

SEQ ID NO: 3609398 - DNA, 20 bp, Homo sapiens
tgcagcctgtcctgggctgg

SEQ ID NO: 3609399 - DNA, 20 bp, Homo sapiens
tgcagccttcatcagaactc

SEQ ID NO: 3609400 - DNA, 12 bp, Homo sapiens
tgcagccttccc

SEQ ID NO: 3609401 - DNA, 14 bp, Homo sapiens
tgcagcggctcctg

SEQ ID NO: 3609402 - DNA, 17 bp, Homo sapiens
tgcagctcaagggctgg

SEQ ID NO: 3609403 - DNA, 19 bp, Homo sapiens
tgcagctcaagggctggca

SEQ ID NO: 3609404 - DNA, 13 bp, Homo sapiens
tgcagctcctcag

SEQ ID NO: 3609405 - DNA, 20 bp, Homo sapiens
tgcagctgtggcagagttac

SEQ ID NO: 3609406 - DNA, 13 bp, Homo sapiens
tgcaggaaggaaa

SEQ ID NO: 3609407 - DNA, 16 bp, Homo sapiens
tgcaggaaggaaaact

SEQ ID NO: 3609408 - DNA, 20 bp, Homo sapiens
tgcaggaccctgtcctgcag

SEQ ID NO: 3609409 - DNA, 17 bp, Homo sapiens
tgcaggagtttgtggta

SEQ ID NO: 3609410 - DNA, 15 bp, Homo sapiens
tgcaggccaggccag

SEQ ID NO: 3609411 - DNA, 21 bp, Homo sapiens
tgcaggcctaggtgcagctcc

SEQ ID NO: 3609412 - DNA, 16 bp, Homo sapiens
tgcagggacagagcat

SEQ ID NO: 3609413 - DNA, 14 bp, Homo sapiens
tgcaggggcctctg

SEQ ID NO: 3609414 - DNA, 15 bp, Homo sapiens
tgcaggggcctctgt

SEQ ID NO: 3609415 - DNA, 19 bp, Homo sapiens
tgcaggggcctctgttcct

SEQ ID NO: 3609416 - DNA, 15 bp, Homo sapiens
tgcagtaaaacacat

SEQ ID NO: 3609417 - DNA, 13 bp, Homo sapiens
tgcagtaaatatt

SEQ ID NO: 3609418 - DNA, 20 bp, Homo sapiens
tgcagtactaaaattaatgc

SEQ ID NO: 3609419 - DNA, 16 bp, Homo sapiens
tgcagtatctgtgaac

SEQ ID NO: 3609420 - DNA, 21 bp, Homo sapiens
tgcagtctggctgagccctgc

SEQ ID NO: 3609421 - DNA, 15 bp, Homo sapiens
tgcagtgtgtgaaaa

SEQ ID NO: 3609422 - DNA, 19 bp, Homo sapiens
tgcagtgtttccctctgtg

SEQ ID NO: 3609423 - DNA, 21 bp, Homo sapiens
tgcagtgtttccctctgtgtt

SEQ ID NO: 3609424 - DNA, 16 bp, Homo sapiens
tgcagttcagaatggc

SEQ ID NO: 3609425 - DNA, 12 bp, Homo sapiens
tgcagtttcttt

SEQ ID NO: 3609426 - DNA, 12 bp, Homo sapiens
tgcagttttcct

SEQ ID NO: 3609427 - DNA, 15 bp, Homo sapiens
tgcagttttgacatt

SEQ ID NO: 3609428 - DNA, 19 bp, Homo sapiens
tgcataaaaattaaatgga

SEQ ID NO: 3609429 - DNA, 14 bp, Homo sapiens
tgcataagtgaaaa

SEQ ID NO: 3609430 - DNA, 18 bp, Homo sapiens
tgcataagtgaaaatctt

SEQ ID NO: 3609431 - DNA, 14 bp, Homo sapiens
tgcataagttaact

SEQ ID NO: 3609432 - DNA, 13 bp, Homo sapiens
tgcatatagacac

SEQ ID NO: 3609433 - DNA, 17 bp, Homo sapiens
tgcatatagacacacat

SEQ ID NO: 3609434 - DNA, 21 bp, Homo sapiens
tgcatatagacacacatacat

SEQ ID NO: 3609435 - DNA, 13 bp, Homo sapiens
tgcatattataaa

SEQ ID NO: 3609436 - DNA, 19 bp, Homo sapiens
tgcatatttgcaaagtgta

SEQ ID NO: 3609437 - DNA, 16 bp, Homo sapiens
tgcatattttgagaaa

SEQ ID NO: 3609438 - DNA, 13 bp, Homo sapiens
tgcatcagctgct

SEQ ID NO: 3609439 - DNA, 19 bp, Homo sapiens
tgcatcagctgctgaaaca

SEQ ID NO: 3609440 - DNA, 15 bp, Homo sapiens
tgcatctcagcccac

SEQ ID NO: 3609441 - DNA, 15 bp, Homo sapiens
tgcatctgaccagca

SEQ ID NO: 3609442 - DNA, 17 bp, Homo sapiens
tgcatctgaccagcagc

SEQ ID NO: 3609443 - DNA, 22 bp, Homo sapiens
tgcatgagctggcaaccagcca

SEQ ID NO: 3609444 - DNA, 20 bp, Homo sapiens
tgcatgctagtgttgtattt

SEQ ID NO: 3609445 - DNA, 16 bp, Homo sapiens
tgcatggagaatggga

SEQ ID NO: 3609446 - DNA, 17 bp, Homo sapiens
tgcatggcactgactga

SEQ ID NO: 3609447 - DNA, 21 bp, Homo sapiens
tgcatggtgccccaggaccag

SEQ ID NO: 3609448 - DNA, 22 bp, Homo sapiens
tgcatggtgccccaggaccagc

SEQ ID NO: 3609449 - DNA, 15 bp, Homo sapiens
tgcatgtagcatata

SEQ ID NO: 3609450 - DNA, 16 bp, Homo sapiens
tgcatgtagcatataa

SEQ ID NO: 3609451 - DNA, 20 bp, Homo sapiens
tgcatgtagcatataaatgt

SEQ ID NO: 3609452 - DNA, 16 bp, Homo sapiens
tgcatgtgctgtgtga

SEQ ID NO: 3609453 - DNA, 15 bp, Homo sapiens
tgcattagtatcaca

SEQ ID NO: 3609454 - DNA, 15 bp, Homo sapiens
tgcattattctcttt

SEQ ID NO: 3609455 - DNA, 17 bp, Homo sapiens
tgcattattttccagat

SEQ ID NO: 3609456 - DNA, 14 bp, Homo sapiens
tgcattgactttca

SEQ ID NO: 3609457 - DNA, 22 bp, Homo sapiens
tgcattgccgctgtataaagca

SEQ ID NO: 3609458 - DNA, 16 bp, Homo sapiens
tgcatttatatgtacc

SEQ ID NO: 3609459 - DNA, 13 bp, Homo sapiens
tgcatttcctgac

SEQ ID NO: 3609460 - DNA, 21 bp, Homo sapiens
tgcatttgtttgctgaaattt

SEQ ID NO: 3609461 - DNA, 16 bp, Homo sapiens
tgccaaaacccagctg

SEQ ID NO: 3609462 - DNA, 17 bp, Homo sapiens
tgccaaaacccagctgc

SEQ ID NO: 3609463 - DNA, 19 bp, Homo sapiens
tgccaaaacccagctgcac

SEQ ID NO: 3609464 - DNA, 20 bp, Homo sapiens
tgccaaaacccagctgcacc

SEQ ID NO: 3609465 - DNA, 12 bp, Homo sapiens
tgccaaatgctc

SEQ ID NO: 3609466 - DNA, 13 bp, Homo sapiens
tgccaacccctct

SEQ ID NO: 3609467 - DNA, 15 bp, Homo sapiens
tgccaaccctgggct

SEQ ID NO: 3609468 - DNA, 23 bp, Homo sapiens
tgccaacctgttcttagagtgta

SEQ ID NO: 3609469 - DNA, 12 bp, Homo sapiens
tgccaagagcta

SEQ ID NO: 3609470 - DNA, 22 bp, Homo sapiens
tgccaagagctactcccacagc

SEQ ID NO: 3609471 - DNA, 12 bp, Homo sapiens
tgccaagccaga

SEQ ID NO: 3609472 - DNA, 13 bp, Homo sapiens
tgccaagccagat

SEQ ID NO: 3609473 - DNA, 14 bp, Homo sapiens
tgccaaggctctcc

SEQ ID NO: 3609474 - DNA, 13 bp, Homo sapiens
tgccaataaattc

SEQ ID NO: 3609475 - DNA, 17 bp, Homo sapiens
tgccaataaattctaaa

SEQ ID NO: 3609476 - DNA, 15 bp, Homo sapiens
tgccacaaggacttc

SEQ ID NO: 3609477 - DNA, 19 bp, Homo sapiens
tgccacaaggacttcctgt

SEQ ID NO: 3609478 - DNA, 15 bp, Homo sapiens
tgccacacctggcct

SEQ ID NO: 3609479 - DNA, 12 bp, Homo sapiens
tgccacacttca

SEQ ID NO: 3609480 - DNA, 15 bp, Homo sapiens
tgccacatggagccc

SEQ ID NO: 3609481 - DNA, 15 bp, Homo sapiens
tgccacattaaattg

SEQ ID NO: 3609482 - DNA, 22 bp, Homo sapiens
tgccacattaaattgataacat

SEQ ID NO: 3609483 - DNA, 17 bp, Homo sapiens
tgccacccacctccctg

SEQ ID NO: 3609484 - DNA, 19 bp, Homo sapiens
tgccacccacctccctgcc

SEQ ID NO: 3609485 - DNA, 21 bp, Homo sapiens
tgccacccacctccctgcctc

SEQ ID NO: 3609486 - DNA, 15 bp, Homo sapiens
tgccacccccttccc

SEQ ID NO: 3609487 - DNA, 20 bp, Homo sapiens
tgccacccccttccctggga

SEQ ID NO: 3609488 - DNA, 22 bp, Homo sapiens
tgccacccccttccctgggagg

SEQ ID NO: 3609489 - DNA, 13 bp, Homo sapiens
tgccacctggcaa

SEQ ID NO: 3609490 - DNA, 11 bp, Homo sapiens
tgccactggga

SEQ ID NO: 3609491 - DNA, 19 bp, Homo sapiens
tgccactgggacagctggc

SEQ ID NO: 3609492 - DNA, 17 bp, Homo sapiens
tgccacttaatgtatgt

SEQ ID NO: 3609493 - DNA, 23 bp, Homo sapiens
tgccacttaatgtatgttaccaa

SEQ ID NO: 3609494 - DNA, 14 bp, Homo sapiens
tgccagagatccaa

SEQ ID NO: 3609495 - DNA, 15 bp, Homo sapiens
tgccagcaagtcctt

SEQ ID NO: 3609496 - DNA, 22 bp, Homo sapiens
tgccagcaggggggctgtgcca

SEQ ID NO: 3609497 - DNA, 17 bp, Homo sapiens
tgccagccactgtgata

SEQ ID NO: 3609498 - DNA, 15 bp, Homo sapiens
tgccagcccatttgg

SEQ ID NO: 3609499 - DNA, 16 bp, Homo sapiens
tgccagcttctctctc

SEQ ID NO: 3609500 - DNA, 21 bp, Homo sapiens
tgccagcttctctctccaggg

SEQ ID NO: 3609501 - DNA, 20 bp, Homo sapiens
tgccaggctgcctcctgccc

SEQ ID NO: 3609502 - DNA, 16 bp, Homo sapiens
tgccaggctgtttcag

SEQ ID NO: 3609503 - DNA, 13 bp, Homo sapiens
tgccagggcttcc

SEQ ID NO: 3609504 - DNA, 14 bp, Homo sapiens
tgccaggggctctg

SEQ ID NO: 3609505 - DNA, 20 bp, Homo sapiens
tgccaggtccttgccctttg

SEQ ID NO: 3609506 - DNA, 20 bp, Homo sapiens
tgccagtccccctgccccag

SEQ ID NO: 3609507 - DNA, 16 bp, Homo sapiens
tgccagtgcagccact

SEQ ID NO: 3609508 - DNA, 16 bp, Homo sapiens
tgccagttttccgaag

SEQ ID NO: 3609509 - DNA, 16 bp, Homo sapiens
tgccatcatgtttaca

SEQ ID NO: 3609510 - DNA, 15 bp, Homo sapiens
tgccatctctgctcc

SEQ ID NO: 3609511 - DNA, 20 bp, Homo sapiens
tgccatggaattccctcctg

SEQ ID NO: 3609512 - DNA, 12 bp, Homo sapiens
tgccatttgctg

SEQ ID NO: 3609513 - DNA, 13 bp, Homo sapiens
tgcccaaaccctt

SEQ ID NO: 3609514 - DNA, 22 bp, Homo sapiens
tgcccaacctgctctcctcttg

SEQ ID NO: 3609515 - DNA, 18 bp, Homo sapiens
tgcccacccctcactccc

SEQ ID NO: 3609516 - DNA, 23 bp, Homo sapiens
tgcccacccctcactccccaggg

SEQ ID NO: 3609517 - DNA, 15 bp, Homo sapiens
tgcccacctggctgc

SEQ ID NO: 3609518 - DNA, 20 bp, Homo sapiens
tgcccaggctggtcttgaac

SEQ ID NO: 3609519 - DNA, 16 bp, Homo sapiens
tgcccaggggagccct

SEQ ID NO: 3609520 - DNA, 21 bp, Homo sapiens
tgcccagtaaaatttcaggat

SEQ ID NO: 3609521 - DNA, 16 bp, Homo sapiens
tgcccagtcgacccca

SEQ ID NO: 3609522 - DNA, 15 bp, Homo sapiens
tgccccaccactccc

SEQ ID NO: 3609523 - DNA, 21 bp, Homo sapiens
tgccccacctcccccttcccc

SEQ ID NO: 3609524 - DNA, 21 bp, Homo sapiens
tgccccagtcggccccatctc

SEQ ID NO: 3609525 - DNA, 24 bp, Homo sapiens
tgccccagtcggccccatctctca

SEQ ID NO: 3609526 - DNA, 19 bp, Homo sapiens
tgccccatcctccagcagg

SEQ ID NO: 3609527 - DNA, 20 bp, Homo sapiens
tgccccatcctccagcaggg

SEQ ID NO: 3609528 - DNA, 16 bp, Homo sapiens
tgccccattcctaaga

SEQ ID NO: 3609529 - DNA, 19 bp, Homo sapiens
tgccccccctaagagacac

SEQ ID NO: 3609530 - DNA, 14 bp, Homo sapiens
tgccccctctcact

SEQ ID NO: 3609531 - DNA, 15 bp, Homo sapiens
tgccccctctcactt

SEQ ID NO: 3609532 - DNA, 18 bp, Homo sapiens
tgccccctgggctggggc

SEQ ID NO: 3609533 - DNA, 20 bp, Homo sapiens
tgccccgagcccaggcagct

SEQ ID NO: 3609534 - DNA, 13 bp, Homo sapiens
tgcccctcccttc

SEQ ID NO: 3609535 - DNA, 19 bp, Homo sapiens
tgcccctggccttgggatc

SEQ ID NO: 3609536 - DNA, 12 bp, Homo sapiens
tgcccctggctt

SEQ ID NO: 3609537 - DNA, 14 bp, Homo sapiens
tgcccctggctttg

SEQ ID NO: 3609538 - DNA, 22 bp, Homo sapiens
tgccccttaaacacaggctgtc

SEQ ID NO: 3609539 - DNA, 18 bp, Homo sapiens
tgcccgcatgtgtgcctg

SEQ ID NO: 3609540 - DNA, 15 bp, Homo sapiens
tgcccgcccggggag

SEQ ID NO: 3609541 - DNA, 20 bp, Homo sapiens
tgcccgcgccaggccctcag

SEQ ID NO: 3609542 - DNA, 22 bp, Homo sapiens
tgcccgcgggagacagcttctc

SEQ ID NO: 3609543 - DNA, 16 bp, Homo sapiens
tgcccgctcccacagc

SEQ ID NO: 3609544 - DNA, 14 bp, Homo sapiens
tgccctaagccccc

SEQ ID NO: 3609545 - DNA, 15 bp, Homo sapiens
tgccctaagccccca

SEQ ID NO: 3609546 - DNA, 16 bp, Homo sapiens
tgccctaagcccccag

SEQ ID NO: 3609547 - DNA, 15 bp, Homo sapiens
tgccctagctgaccc

SEQ ID NO: 3609548 - DNA, 16 bp, Homo sapiens
tgccctagctgacccc

SEQ ID NO: 3609549 - DNA, 15 bp, Homo sapiens
tgccctcaagtaaaa

SEQ ID NO: 3609550 - DNA, 16 bp, Homo sapiens
tgccctcctctcccat

SEQ ID NO: 3609551 - DNA, 24 bp, Homo sapiens
tgccctctatttattagccaactg

SEQ ID NO: 3609552 - DNA, 16 bp, Homo sapiens
tgccctggaggtggct

SEQ ID NO: 3609553 - DNA, 12 bp, Homo sapiens
tgccctggtgct

SEQ ID NO: 3609554 - DNA, 14 bp, Homo sapiens
tgccctggtgctgc

SEQ ID NO: 3609555 - DNA, 20 bp, Homo sapiens
tgccctggtgctgccacact

SEQ ID NO: 3609556 - DNA, 16 bp, Homo sapiens
tgcccttcctactcct

SEQ ID NO: 3609557 - DNA, 13 bp, Homo sapiens
tgcccttgctgcc

SEQ ID NO: 3609558 - DNA, 20 bp, Homo sapiens
tgccgaccacgccccaggac

SEQ ID NO: 3609559 - DNA, 16 bp, Homo sapiens
tgccgcgtcgccctcc

SEQ ID NO: 3609560 - DNA, 14 bp, Homo sapiens
tgccgctctctctg

SEQ ID NO: 3609561 - DNA, 16 bp, Homo sapiens
tgccgctctctctgag

SEQ ID NO: 3609562 - DNA, 16 bp, Homo sapiens
tgccgctgtataaagc

SEQ ID NO: 3609563 - DNA, 15 bp, Homo sapiens
tgccgctttctctga

SEQ ID NO: 3609564 - DNA, 18 bp, Homo sapiens
tgccgcttttgtgcctct

SEQ ID NO: 3609565 - DNA, 18 bp, Homo sapiens
tgccggtcgggcagccag

SEQ ID NO: 3609566 - DNA, 20 bp, Homo sapiens
tgccgtcacccactctgcac

SEQ ID NO: 3609567 - DNA, 15 bp, Homo sapiens
tgccgtggcttgggg

SEQ ID NO: 3609568 - DNA, 20 bp, Homo sapiens
tgcctaaatttaatgctgcc

SEQ ID NO: 3609569 - DNA, 14 bp, Homo sapiens
tgcctaacctggga

SEQ ID NO: 3609570 - DNA, 23 bp, Homo sapiens
tgcctaggagatgttgggaacag

SEQ ID NO: 3609571 - DNA, 18 bp, Homo sapiens
tgcctatgatactgtctc

SEQ ID NO: 3609572 - DNA, 19 bp, Homo sapiens
tgcctatgatactgtctct

SEQ ID NO: 3609573 - DNA, 20 bp, Homo sapiens
tgcctatgatactgtctctc

SEQ ID NO: 3609574 - DNA, 18 bp, Homo sapiens
tgcctatttcccccttca

SEQ ID NO: 3609575 - DNA, 17 bp, Homo sapiens
tgcctcagcctcctgag

SEQ ID NO: 3609576 - DNA, 12 bp, Homo sapiens
tgcctcaggacc

SEQ ID NO: 3609577 - DNA, 17 bp, Homo sapiens
tgcctcaggacccatcc

SEQ ID NO: 3609578 - DNA, 21 bp, Homo sapiens
tgcctcaggaggcaggacctt

SEQ ID NO: 3609579 - DNA, 22 bp, Homo sapiens
tgcctcaggccaagggaccagg

SEQ ID NO: 3609580 - DNA, 21 bp, Homo sapiens
tgcctccacatgctgcctggc

SEQ ID NO: 3609581 - DNA, 13 bp, Homo sapiens
tgcctccaccagc

SEQ ID NO: 3609582 - DNA, 15 bp, Homo sapiens
tgcctccaccagcaa

SEQ ID NO: 3609583 - DNA, 17 bp, Homo sapiens
tgcctccaccagcaagg

SEQ ID NO: 3609584 - DNA, 19 bp, Homo sapiens
tgcctccaggaaccacacc

SEQ ID NO: 3609585 - DNA, 22 bp, Homo sapiens
tgcctccgcgtgatcaaagcca

SEQ ID NO: 3609586 - DNA, 12 bp, Homo sapiens
tgcctcctcacc

SEQ ID NO: 3609587 - DNA, 17 bp, Homo sapiens
tgcctcctgcgccctgt

SEQ ID NO: 3609588 - DNA, 12 bp, Homo sapiens
tgcctcggacag

SEQ ID NO: 3609589 - DNA, 17 bp, Homo sapiens
tgcctctcacaggcgcc

SEQ ID NO: 3609590 - DNA, 15 bp, Homo sapiens
tgcctctccctgggt

SEQ ID NO: 3609591 - DNA, 19 bp, Homo sapiens
tgcctctgacagtccacag

SEQ ID NO: 3609592 - DNA, 21 bp, Homo sapiens
tgcctctgcagtctcatttct

SEQ ID NO: 3609593 - DNA, 24 bp, Homo sapiens
tgcctctgcagtctcatttctcat

SEQ ID NO: 3609594 - DNA, 21 bp, Homo sapiens
tgcctctgccaaaggatgtga

SEQ ID NO: 3609595 - DNA, 12 bp, Homo sapiens
tgcctctgcctg

SEQ ID NO: 3609596 - DNA, 14 bp, Homo sapiens
tgcctctgcctgtc

SEQ ID NO: 3609597 - DNA, 18 bp, Homo sapiens
tgcctctgcctgtctccc

SEQ ID NO: 3609598 - DNA, 13 bp, Homo sapiens
tgcctctgggact

SEQ ID NO: 3609599 - DNA, 10 bp, Homo sapiens
tgcctctgtc

SEQ ID NO: 3609600 - DNA, 19 bp, Homo sapiens
tgcctcttctttgtgcctt

SEQ ID NO: 3609601 - DNA, 21 bp, Homo sapiens
tgcctctttttaaagttcaaa

SEQ ID NO: 3609602 - DNA, 20 bp, Homo sapiens
tgcctgacagccttccccag

SEQ ID NO: 3609603 - DNA, 16 bp, Homo sapiens
tgcctgattcatagta

SEQ ID NO: 3609604 - DNA, 11 bp, Homo sapiens
tgcctgctcct

SEQ ID NO: 3609605 - DNA, 21 bp, Homo sapiens
tgcctggaggcaaaggcctgg

SEQ ID NO: 3609606 - DNA, 24 bp, Homo sapiens
tgcctggaggctcctctaggccct

SEQ ID NO: 3609607 - DNA, 21 bp, Homo sapiens
tgcctggcacagaccaggcct

SEQ ID NO: 3609608 - DNA, 19 bp, Homo sapiens
tgcctggccccctgtcctc

SEQ ID NO: 3609609 - DNA, 21 bp, Homo sapiens
tgcctgggccgtggcacagct

SEQ ID NO: 3609610 - DNA, 14 bp, Homo sapiens
tgcctgggctcagc

SEQ ID NO: 3609611 - DNA, 15 bp, Homo sapiens
tgcctgggctctgga

SEQ ID NO: 3609612 - DNA, 18 bp, Homo sapiens
tgcctgggctctggaaga

SEQ ID NO: 3609613 - DNA, 18 bp, Homo sapiens
tgcctgtaacaatgtaat

SEQ ID NO: 3609614 - DNA, 14 bp, Homo sapiens
tgcctgtgcccgca

SEQ ID NO: 3609615 - DNA, 15 bp, Homo sapiens
tgcctgttaatttat

SEQ ID NO: 3609616 - DNA, 17 bp, Homo sapiens
tgccttaaacacacatt

SEQ ID NO: 3609617 - DNA, 20 bp, Homo sapiens
tgccttcacatttggggttt

SEQ ID NO: 3609618 - DNA, 13 bp, Homo sapiens
tgccttcagctct

SEQ ID NO: 3609619 - DNA, 15 bp, Homo sapiens
tgccttcccctgggc

SEQ ID NO: 3609620 - DNA, 18 bp, Homo sapiens
tgccttcggtacccacca

SEQ ID NO: 3609621 - DNA, 22 bp, Homo sapiens
tgccttctttagaccctcgggc

SEQ ID NO: 3609622 - DNA, 15 bp, Homo sapiens
tgccttgatgattta

SEQ ID NO: 3609623 - DNA, 15 bp, Homo sapiens
tgccttgtttaatgt

SEQ ID NO: 3609624 - DNA, 21 bp, Homo sapiens
tgccttgtttaatgttaatta

SEQ ID NO: 3609625 - DNA, 22 bp, Homo sapiens
tgcctttaagccaaagaaacaa

SEQ ID NO: 3609626 - DNA, 19 bp, Homo sapiens
tgcctttatctctgaggct

SEQ ID NO: 3609627 - DNA, 18 bp, Homo sapiens
tgcctttatttgctgtta

SEQ ID NO: 3609628 - DNA, 23 bp, Homo sapiens
tgcctttcctatcacctcgagaa

SEQ ID NO: 3609629 - DNA, 13 bp, Homo sapiens
tgcctttctttgc

SEQ ID NO: 3609630 - DNA, 16 bp, Homo sapiens
tgcctttctttgcctc

SEQ ID NO: 3609631 - DNA, 17 bp, Homo sapiens
tgcctttctttgcctct

SEQ ID NO: 3609632 - DNA, 14 bp, Homo sapiens
tgccttttatgtaa

SEQ ID NO: 3609633 - DNA, 17 bp, Homo sapiens
tgccttttatgtaaatt

SEQ ID NO: 3609634 - DNA, 23 bp, Homo sapiens
tgccttttatgtaaattttttac

SEQ ID NO: 3609635 - DNA, 19 bp, Homo sapiens
tgcgaatctagaggagggg

SEQ ID NO: 3609636 - DNA, 20 bp, Homo sapiens
tgcgcacagagggaagccat

SEQ ID NO: 3609637 - DNA, 17 bp, Homo sapiens
tgcgccaccgcccagag

SEQ ID NO: 3609638 - DNA, 21 bp, Homo sapiens
tgcgcccttaactgcatccag

SEQ ID NO: 3609639 - DNA, 15 bp, Homo sapiens
tgcgcctaatgtgtt

SEQ ID NO: 3609640 - DNA, 16 bp, Homo sapiens
tgcgcctaatgtgttt

SEQ ID NO: 3609641 - DNA, 18 bp, Homo sapiens
tgcgcctcggtatctggc

SEQ ID NO: 3609642 - DNA, 20 bp, Homo sapiens
tgcgcctcggtatctggctt

SEQ ID NO: 3609643 - DNA, 21 bp, Homo sapiens
tgcgcctcggtatctggcttc

SEQ ID NO: 3609644 - DNA, 22 bp, Homo sapiens
tgcgcctcggtatctggcttcc

SEQ ID NO: 3609645 - DNA, 15 bp, Homo sapiens
tgcgctgtgtacaat

SEQ ID NO: 3609646 - DNA, 13 bp, Homo sapiens
tgcggcggtccca

SEQ ID NO: 3609647 - DNA, 13 bp, Homo sapiens
tgcgtcccagctg

SEQ ID NO: 3609648 - DNA, 14 bp, Homo sapiens
tgcgtcccagctga

SEQ ID NO: 3609649 - DNA, 16 bp, Homo sapiens
tgcgtctgaggcctgc

SEQ ID NO: 3609650 - DNA, 12 bp, Homo sapiens
tgcgtttttcct

SEQ ID NO: 3609651 - DNA, 14 bp, Homo sapiens
tgcgtttttccttg

SEQ ID NO: 3609652 - DNA, 18 bp, Homo sapiens
tgcgtttttccttgtagc

SEQ ID NO: 3609653 - DNA, 16 bp, Homo sapiens
tgctaaagcctgtggg

SEQ ID NO: 3609654 - DNA, 13 bp, Homo sapiens
tgctaacatctaa

SEQ ID NO: 3609655 - DNA, 16 bp, Homo sapiens
tgctaacatctaaaaa

SEQ ID NO: 3609656 - DNA, 15 bp, Homo sapiens
tgctaacctaaaaga

SEQ ID NO: 3609657 - DNA, 10 bp, Homo sapiens
tgctaactgg

SEQ ID NO: 3609658 - DNA, 13 bp, Homo sapiens
tgctaactgggtt

SEQ ID NO: 3609659 - DNA, 14 bp, Homo sapiens
tgctaactgggtta

SEQ ID NO: 3609660 - DNA, 15 bp, Homo sapiens
tgctaactgggttaa

SEQ ID NO: 3609661 - DNA, 17 bp, Homo sapiens
tgctaactgggttaaat

SEQ ID NO: 3609662 - DNA, 18 bp, Homo sapiens
tgctaactgggttaaata

SEQ ID NO: 3609663 - DNA, 20 bp, Homo sapiens
tgctaactgggttaaatatt

SEQ ID NO: 3609664 - DNA, 17 bp, Homo sapiens
tgctaactggttaaaca

SEQ ID NO: 3609665 - DNA, 18 bp, Homo sapiens
tgctaactggttaaacat

SEQ ID NO: 3609666 - DNA, 19 bp, Homo sapiens
tgctaagagaaaaaaaaga

SEQ ID NO: 3609667 - DNA, 16 bp, Homo sapiens
tgctaagtaatttaga

SEQ ID NO: 3609668 - DNA, 20 bp, Homo sapiens
tgctaagtcattggcaaagt

SEQ ID NO: 3609669 - DNA, 15 bp, Homo sapiens
tgctaatcaaaactt

SEQ ID NO: 3609670 - DNA, 16 bp, Homo sapiens
tgctaatgacagcctt

SEQ ID NO: 3609671 - DNA, 14 bp, Homo sapiens
tgctaatttagaga

SEQ ID NO: 3609672 - DNA, 18 bp, Homo sapiens
tgctaatttatcctgaaa

SEQ ID NO: 3609673 - DNA, 17 bp, Homo sapiens
tgctacaaaaacacagc

SEQ ID NO: 3609674 - DNA, 19 bp, Homo sapiens
tgctacaaaaacacagcaa

SEQ ID NO: 3609675 - DNA, 13 bp, Homo sapiens
tgctaccaaagca

SEQ ID NO: 3609676 - DNA, 18 bp, Homo sapiens
tgctaccagtatttagaa

SEQ ID NO: 3609677 - DNA, 16 bp, Homo sapiens
tgctactactgcagtc

SEQ ID NO: 3609678 - DNA, 13 bp, Homo sapiens
tgctagaagccta

SEQ ID NO: 3609679 - DNA, 18 bp, Homo sapiens
tgctagtgttgtatttct

SEQ ID NO: 3609680 - DNA, 20 bp, Homo sapiens
tgctataaattttttgaaac

SEQ ID NO: 3609681 - DNA, 14 bp, Homo sapiens
tgctatagcctggg

SEQ ID NO: 3609682 - DNA, 15 bp, Homo sapiens
tgctatcagttttat

SEQ ID NO: 3609683 - DNA, 16 bp, Homo sapiens
tgctatgagctgggga

SEQ ID NO: 3609684 - DNA, 20 bp, Homo sapiens
tgctatgagctggggatgtc

SEQ ID NO: 3609685 - DNA, 21 bp, Homo sapiens
tgctatgatgttagttttcct

SEQ ID NO: 3609686 - DNA, 14 bp, Homo sapiens
tgctatttttcatc

SEQ ID NO: 3609687 - DNA, 23 bp, Homo sapiens
tgctattttttcccttctcttct

SEQ ID NO: 3609688 - DNA, 12 bp, Homo sapiens
tgctcaaaattg

SEQ ID NO: 3609689 - DNA, 16 bp, Homo sapiens
tgctcaaaattgcttc

SEQ ID NO: 3609690 - DNA, 19 bp, Homo sapiens
tgctcaaaattgcttctaa

SEQ ID NO: 3609691 - DNA, 14 bp, Homo sapiens
tgctcaacccccct

SEQ ID NO: 3609692 - DNA, 15 bp, Homo sapiens
tgctcaacccccctc

SEQ ID NO: 3609693 - DNA, 20 bp, Homo sapiens
tgctcaacccccctcccaga

SEQ ID NO: 3609694 - DNA, 22 bp, Homo sapiens
tgctcaacccccctcccagaca

SEQ ID NO: 3609695 - DNA, 23 bp, Homo sapiens
tgctcaacccccctcccagacag

SEQ ID NO: 3609696 - DNA, 14 bp, Homo sapiens
tgctcaatttcagc

SEQ ID NO: 3609697 - DNA, 16 bp, Homo sapiens
tgctcaatttcagcac

SEQ ID NO: 3609698 - DNA, 16 bp, Homo sapiens
tgctcagctgtcaagg

SEQ ID NO: 3609699 - DNA, 15 bp, Homo sapiens
tgctcagcttctcct

SEQ ID NO: 3609700 - DNA, 21 bp, Homo sapiens
tgctcagggaaaagcagctct

SEQ ID NO: 3609701 - DNA, 17 bp, Homo sapiens
tgctccaagatgttctc

SEQ ID NO: 3609702 - DNA, 18 bp, Homo sapiens
tgctccaatgactgagca

SEQ ID NO: 3609703 - DNA, 15 bp, Homo sapiens
tgctccacactcaga

SEQ ID NO: 3609704 - DNA, 16 bp, Homo sapiens
tgctccagaagatgcc

SEQ ID NO: 3609705 - DNA, 18 bp, Homo sapiens
tgctccataccttttctc

SEQ ID NO: 3609706 - DNA, 12 bp, Homo sapiens
tgctcccctaaa

SEQ ID NO: 3609707 - DNA, 21 bp, Homo sapiens
tgctcccctaaagccaggctc

SEQ ID NO: 3609708 - DNA, 22 bp, Homo sapiens
tgctccgcagggcgcccagcgc

SEQ ID NO: 3609709 - DNA, 16 bp, Homo sapiens
tgctccgtagctctgc

SEQ ID NO: 3609710 - DNA, 17 bp, Homo sapiens
tgctccgtagctctgct

SEQ ID NO: 3609711 - DNA, 19 bp, Homo sapiens
tgctccgtagctctgctgc

SEQ ID NO: 3609712 - DNA, 20 bp, Homo sapiens
tgctcctagagggaggggcc

SEQ ID NO: 3609713 - DNA, 21 bp, Homo sapiens
tgctcctcttgttcctgaaat

SEQ ID NO: 3609714 - DNA, 16 bp, Homo sapiens
tgctcctgcttttctg

SEQ ID NO: 3609715 - DNA, 21 bp, Homo sapiens
tgctcctgcttttctgtcctg

SEQ ID NO: 3609716 - DNA, 22 bp, Homo sapiens
tgctccttggcacccccatgct

SEQ ID NO: 3609717 - DNA, 13 bp, Homo sapiens
tgctcggctactg

SEQ ID NO: 3609718 - DNA, 15 bp, Homo sapiens
tgctctaacagccct

SEQ ID NO: 3609719 - DNA, 20 bp, Homo sapiens
tgctctaccaaatagtgatt

SEQ ID NO: 3609720 - DNA, 14 bp, Homo sapiens
tgctctagtgcctt

SEQ ID NO: 3609721 - DNA, 14 bp, Homo sapiens
tgctctataaatag

SEQ ID NO: 3609722 - DNA, 20 bp, Homo sapiens
tgctctataaatagtattcc

SEQ ID NO: 3609723 - DNA, 23 bp, Homo sapiens
tgctctataaatagtattccaat

SEQ ID NO: 3609724 - DNA, 15 bp, Homo sapiens
tgctctatactgtgg

SEQ ID NO: 3609725 - DNA, 20 bp, Homo sapiens
tgctctatactgtggcctgc

SEQ ID NO: 3609726 - DNA, 22 bp, Homo sapiens
tgctctatactgtggcctgcag

SEQ ID NO: 3609727 - DNA, 16 bp, Homo sapiens
tgctctcctcatctcc

SEQ ID NO: 3609728 - DNA, 18 bp, Homo sapiens
tgctctcctcttgccact

SEQ ID NO: 3609729 - DNA, 22 bp, Homo sapiens
tgctctcctcttgccactgcct

SEQ ID NO: 3609730 - DNA, 14 bp, Homo sapiens
tgctctgccccagc

SEQ ID NO: 3609731 - DNA, 12 bp, Homo sapiens
tgctctggcacc

SEQ ID NO: 3609732 - DNA, 15 bp, Homo sapiens
tgctctggtctgacc

SEQ ID NO: 3609733 - DNA, 12 bp, Homo sapiens
tgctctgtaaca

SEQ ID NO: 3609734 - DNA, 11 bp, Homo sapiens
tgctcttccca

SEQ ID NO: 3609735 - DNA, 12 bp, Homo sapiens
tgctcttcccac

SEQ ID NO: 3609736 - DNA, 15 bp, Homo sapiens
tgctcttcccactcc

SEQ ID NO: 3609737 - DNA, 18 bp, Homo sapiens
tgctcttcccactccagc

SEQ ID NO: 3609738 - DNA, 13 bp, Homo sapiens
tgctcttttcctg

SEQ ID NO: 3609739 - DNA, 15 bp, Homo sapiens
tgctcttttcctggt

SEQ ID NO: 3609740 - DNA, 15 bp, Homo sapiens
tgctcttttctcctc

SEQ ID NO: 3609741 - DNA, 13 bp, Homo sapiens
tgctgaaagactc

SEQ ID NO: 3609742 - DNA, 18 bp, Homo sapiens
tgctgaacaggaaagagc

SEQ ID NO: 3609743 - DNA, 23 bp, Homo sapiens
tgctgaatgcctcgctcccttca

SEQ ID NO: 3609744 - DNA, 18 bp, Homo sapiens
tgctgacagctgctccta

SEQ ID NO: 3609745 - DNA, 21 bp, Homo sapiens
tgctgactgtactcctcccag

SEQ ID NO: 3609746 - DNA, 23 bp, Homo sapiens
tgctgagacgccacggagggctg

SEQ ID NO: 3609747 - DNA, 13 bp, Homo sapiens
tgctgaggcccct

SEQ ID NO: 3609748 - DNA, 22 bp, Homo sapiens
tgctgatatcaacagcttccct

SEQ ID NO: 3609749 - DNA, 12 bp, Homo sapiens
tgctgcaaccca

SEQ ID NO: 3609750 - DNA, 14 bp, Homo sapiens
tgctgcaacccaag

SEQ ID NO: 3609751 - DNA, 20 bp, Homo sapiens
tgctgcaccctgcgcctcca

SEQ ID NO: 3609752 - DNA, 23 bp, Homo sapiens
tgctgcaccctgcgcctccagag

SEQ ID NO: 3609753 - DNA, 17 bp, Homo sapiens
tgctgcacttcctgttt

SEQ ID NO: 3609754 - DNA, 12 bp, Homo sapiens
tgctgcagagat

SEQ ID NO: 3609755 - DNA, 13 bp, Homo sapiens
tgctgcatatttg

SEQ ID NO: 3609756 - DNA, 13 bp, Homo sapiens
tgctgcattcctt

SEQ ID NO: 3609757 - DNA, 15 bp, Homo sapiens
tgctgccacacttca

SEQ ID NO: 3609758 - DNA, 14 bp, Homo sapiens
tgctgcccagcctc

SEQ ID NO: 3609759 - DNA, 18 bp, Homo sapiens
tgctgcccctgtctggaa

SEQ ID NO: 3609760 - DNA, 13 bp, Homo sapiens
tgctgccctgcgg

SEQ ID NO: 3609761 - DNA, 13 bp, Homo sapiens
tgctgccggctct

SEQ ID NO: 3609762 - DNA, 23 bp, Homo sapiens
tgctgcctcaggacccatccctg

SEQ ID NO: 3609763 - DNA, 16 bp, Homo sapiens
tgctgctactgctgct

SEQ ID NO: 3609764 - DNA, 23 bp, Homo sapiens
tgctgctcccctaaagccaggct

SEQ ID NO: 3609765 - DNA, 11 bp, Homo sapiens
tgctgctcctc

SEQ ID NO: 3609766 - DNA, 14 bp, Homo sapiens
tgctgctggggaag

SEQ ID NO: 3609767 - DNA, 15 bp, Homo sapiens
tgctgctggggaaga

SEQ ID NO: 3609768 - DNA, 17 bp, Homo sapiens
tgctggaattctaacaa

SEQ ID NO: 3609769 - DNA, 16 bp, Homo sapiens
tgctggagtccagtgc

SEQ ID NO: 3609770 - DNA, 17 bp, Homo sapiens
tgctggcaaatccaggc

SEQ ID NO: 3609771 - DNA, 18 bp, Homo sapiens
tgctggcccagggcccag

SEQ ID NO: 3609772 - DNA, 22 bp, Homo sapiens
tgctggcccagggcccagagcc

SEQ ID NO: 3609773 - DNA, 15 bp, Homo sapiens
tgctgggcagaggga

SEQ ID NO: 3609774 - DNA, 14 bp, Homo sapiens
tgctgggccactgg

SEQ ID NO: 3609775 - DNA, 12 bp, Homo sapiens
tgctgggctggg

SEQ ID NO: 3609776 - DNA, 14 bp, Homo sapiens
tgctgggctgggcc

SEQ ID NO: 3609777 - DNA, 15 bp, Homo sapiens
tgctgggctgggccc

SEQ ID NO: 3609778 - DNA, 16 bp, Homo sapiens
tgctggggaagacagt

SEQ ID NO: 3609779 - DNA, 17 bp, Homo sapiens
tgctggggaagacagtg

SEQ ID NO: 3609780 - DNA, 22 bp, Homo sapiens
tgctgggtacctggtccccact

SEQ ID NO: 3609781 - DNA, 17 bp, Homo sapiens
tgctggtagatgctgag

SEQ ID NO: 3609782 - DNA, 14 bp, Homo sapiens
tgctggtcctgcac

SEQ ID NO: 3609783 - DNA, 16 bp, Homo sapiens
tgctgtagatgacaac

SEQ ID NO: 3609784 - DNA, 23 bp, Homo sapiens
tgctgtatccatccatggggctg

SEQ ID NO: 3609785 - DNA, 16 bp, Homo sapiens
tgctgtatgtgagctg

SEQ ID NO: 3609786 - DNA, 21 bp, Homo sapiens
tgctgtcgttgttgtggaagc

SEQ ID NO: 3609787 - DNA, 18 bp, Homo sapiens
tgctgtctaacctgtgac

SEQ ID NO: 3609788 - DNA, 14 bp, Homo sapiens
tgctgtctggccct

SEQ ID NO: 3609789 - DNA, 16 bp, Homo sapiens
tgctgtctggccctgg

SEQ ID NO: 3609790 - DNA, 13 bp, Homo sapiens
tgctgtctttctt

SEQ ID NO: 3609791 - DNA, 23 bp, Homo sapiens
tgctgtcttttctttgccatctc

SEQ ID NO: 3609792 - DNA, 23 bp, Homo sapiens
tgctgtgccatgctgggccactg

SEQ ID NO: 3609793 - DNA, 12 bp, Homo sapiens
tgctgtgctgct

SEQ ID NO: 3609794 - DNA, 11 bp, Homo sapiens
tgctgtgcttt

SEQ ID NO: 3609795 - DNA, 16 bp, Homo sapiens
tgctgtgctttggaac

SEQ ID NO: 3609796 - DNA, 23 bp, Homo sapiens
tgctgtgctttggaacaatcaca

SEQ ID NO: 3609797 - DNA, 15 bp, Homo sapiens
tgctgtgtgagtgag

SEQ ID NO: 3609798 - DNA, 23 bp, Homo sapiens
tgctgttaactgttaactatgac

SEQ ID NO: 3609799 - DNA, 16 bp, Homo sapiens
tgctgttaatatttct

SEQ ID NO: 3609800 - DNA, 21 bp, Homo sapiens
tgctgttcactggacacttca

SEQ ID NO: 3609801 - DNA, 19 bp, Homo sapiens
tgctgttcttcagtccttt

SEQ ID NO: 3609802 - DNA, 23 bp, Homo sapiens
tgctgttcttcagtcctttgtct

SEQ ID NO: 3609803 - DNA, 22 bp, Homo sapiens
tgctgttgatcggtctcctagg

SEQ ID NO: 3609804 - DNA, 22 bp, Homo sapiens
tgctgttgtgaagctaatgtca

SEQ ID NO: 3609805 - DNA, 17 bp, Homo sapiens
tgctgtttattaatctt

SEQ ID NO: 3609806 - DNA, 11 bp, Homo sapiens
tgctgtttcct

SEQ ID NO: 3609807 - DNA, 12 bp, Homo sapiens
tgctgtttccta

SEQ ID NO: 3609808 - DNA, 13 bp, Homo sapiens
tgctgtttcctag

SEQ ID NO: 3609809 - DNA, 14 bp, Homo sapiens
tgctgtttcctagc

SEQ ID NO: 3609810 - DNA, 14 bp, Homo sapiens
tgctgtttgaaaat

SEQ ID NO: 3609811 - DNA, 16 bp, Homo sapiens
tgctgtttgtagtgaa

SEQ ID NO: 3609812 - DNA, 16 bp, Homo sapiens
tgctgttttcctccct

SEQ ID NO: 3609813 - DNA, 22 bp, Homo sapiens
tgctgttttgccagcccatttg

SEQ ID NO: 3609814 - DNA, 17 bp, Homo sapiens
tgcttagagactatcaa

SEQ ID NO: 3609815 - DNA, 22 bp, Homo sapiens
tgcttaggagacagatcactcc

SEQ ID NO: 3609816 - DNA, 13 bp, Homo sapiens
tgcttatacactt

SEQ ID NO: 3609817 - DNA, 19 bp, Homo sapiens
tgcttcatccaatgtgaag

SEQ ID NO: 3609818 - DNA, 23 bp, Homo sapiens
tgcttccactaccaaaagacatt

SEQ ID NO: 3609819 - DNA, 15 bp, Homo sapiens
tgcttctaaaacaat

SEQ ID NO: 3609820 - DNA, 17 bp, Homo sapiens
tgcttctaaaacaataa

SEQ ID NO: 3609821 - DNA, 20 bp, Homo sapiens
tgcttctaaaacaataaaga

SEQ ID NO: 3609822 - DNA, 14 bp, Homo sapiens
tgcttctacatgat

SEQ ID NO: 3609823 - DNA, 14 bp, Homo sapiens
tgcttgactttcca

SEQ ID NO: 3609824 - DNA, 15 bp, Homo sapiens
tgcttgactttccag

SEQ ID NO: 3609825 - DNA, 19 bp, Homo sapiens
tgcttgactttccagaatg

SEQ ID NO: 3609826 - DNA, 19 bp, Homo sapiens
tgcttgcatggagaatggg

SEQ ID NO: 3609827 - DNA, 18 bp, Homo sapiens
tgcttgcccgctcccaca

SEQ ID NO: 3609828 - DNA, 14 bp, Homo sapiens
tgcttgcctgaagc

SEQ ID NO: 3609829 - DNA, 14 bp, Homo sapiens
tgcttggaagccag

SEQ ID NO: 3609830 - DNA, 12 bp, Homo sapiens
tgcttgggctga

SEQ ID NO: 3609831 - DNA, 13 bp, Homo sapiens
tgcttgggctgac

SEQ ID NO: 3609832 - DNA, 12 bp, Homo sapiens
tgctttaaaaca

SEQ ID NO: 3609833 - DNA, 14 bp, Homo sapiens
tgctttaaaacaaa

SEQ ID NO: 3609834 - DNA, 15 bp, Homo sapiens
tgctttaaaacaaag

SEQ ID NO: 3609835 - DNA, 11 bp, Homo sapiens
tgctttcttac

SEQ ID NO: 3609836 - DNA, 14 bp, Homo sapiens
tgctttcttaccta

SEQ ID NO: 3609837 - DNA, 23 bp, Homo sapiens
tgctttgagactcctcagcaccc

SEQ ID NO: 3609838 - DNA, 20 bp, Homo sapiens
tgctttgcatctttgttact

SEQ ID NO: 3609839 - DNA, 19 bp, Homo sapiens
tgctttggatagtctccta

SEQ ID NO: 3609840 - DNA, 17 bp, Homo sapiens
tgctttggcggcccggc

SEQ ID NO: 3609841 - DNA, 15 bp, Homo sapiens
tgctttgggctgccc

SEQ ID NO: 3609842 - DNA, 21 bp, Homo sapiens
tgctttgggctgccctggtgc

SEQ ID NO: 3609843 - DNA, 21 bp, Homo sapiens
tgctttgtgttcagttttgtg

SEQ ID NO: 3609844 - DNA, 12 bp, Homo sapiens
tgctttgtttac

SEQ ID NO: 3609845 - DNA, 14 bp, Homo sapiens
tgcttttatattct

SEQ ID NO: 3609846 - DNA, 15 bp, Homo sapiens
tgcttttatattcta

SEQ ID NO: 3609847 - DNA, 14 bp, Homo sapiens
tgcttttctgtcct

SEQ ID NO: 3609848 - DNA, 19 bp, Homo sapiens
tgcttttgggggtcagcat

SEQ ID NO: 3609849 - DNA, 23 bp, Homo sapiens
tgctttttaatattgatatgctt

SEQ ID NO: 3609850 - DNA, 15 bp, Homo sapiens
tgctttttcaccaga

SEQ ID NO: 3609851 - DNA, 15 bp, Homo sapiens
tgctttttgtcatgt

SEQ ID NO: 3609852 - DNA, 19 bp, Homo sapiens
tgctttttgtcatgttatg

SEQ ID NO: 3609853 - DNA, 17 bp, Homo sapiens
tgcttttttaaatatta

SEQ ID NO: 3609854 - DNA, 11 bp, Homo sapiens
tggaaaaatgg

SEQ ID NO: 3609855 - DNA, 14 bp, Homo sapiens
tggaaaaatggttg

SEQ ID NO: 3609856 - DNA, 16 bp, Homo sapiens
tggaaaaatggttgat

SEQ ID NO: 3609857 - DNA, 15 bp, Homo sapiens
tggaaaagtttgaaa

SEQ ID NO: 3609858 - DNA, 14 bp, Homo sapiens
tggaaaataaacat

SEQ ID NO: 3609859 - DNA, 16 bp, Homo sapiens
tggaaaataaattatt

SEQ ID NO: 3609860 - DNA, 21 bp, Homo sapiens
tggaaagcacaagactggccc

SEQ ID NO: 3609861 - DNA, 22 bp, Homo sapiens
tggaaagcagagcctcctggga

SEQ ID NO: 3609862 - DNA, 21 bp, Homo sapiens
tggaaaggatctgtgattggc

SEQ ID NO: 3609863 - DNA, 15 bp, Homo sapiens
tggaaagtcaggcta

SEQ ID NO: 3609864 - DNA, 15 bp, Homo sapiens
tggaaataaatgtat

SEQ ID NO: 3609865 - DNA, 23 bp, Homo sapiens
tggaaataaatgtatcatagaaa

SEQ ID NO: 3609866 - DNA, 15 bp, Homo sapiens
tggaaattgaaataa

SEQ ID NO: 3609867 - DNA, 14 bp, Homo sapiens
tggaaatttttacc

SEQ ID NO: 3609868 - DNA, 16 bp, Homo sapiens
tggaacacagaactga

SEQ ID NO: 3609869 - DNA, 15 bp, Homo sapiens
tggaacaccctggat

SEQ ID NO: 3609870 - DNA, 18 bp, Homo sapiens
tggaacaccctggatgct

SEQ ID NO: 3609871 - DNA, 14 bp, Homo sapiens
tggaacaccttggg

SEQ ID NO: 3609872 - DNA, 14 bp, Homo sapiens
tggaacatccttgg

SEQ ID NO: 3609873 - DNA, 17 bp, Homo sapiens
tggaacccagactcaga

SEQ ID NO: 3609874 - DNA, 22 bp, Homo sapiens
tggaacccagactcagacattg

SEQ ID NO: 3609875 - DNA, 18 bp, Homo sapiens
tggaacctcagcctggcc

SEQ ID NO: 3609876 - DNA, 23 bp, Homo sapiens
tggaacctcagcctggccagaca

SEQ ID NO: 3609877 - DNA, 19 bp, Homo sapiens
tggaacgtttcactgcaaa

SEQ ID NO: 3609878 - DNA, 19 bp, Homo sapiens
tggaagaaatggctatgaa

SEQ ID NO: 3609879 - DNA, 22 bp, Homo sapiens
tggaagaaatggctatgaacag

SEQ ID NO: 3609880 - DNA, 23 bp, Homo sapiens
tggaagaaatggctatgaacaga

SEQ ID NO: 3609881 - DNA, 17 bp, Homo sapiens
tggaagaagaaaggact

SEQ ID NO: 3609882 - DNA, 18 bp, Homo sapiens
tggaagaagaaaggactg

SEQ ID NO: 3609883 - DNA, 18 bp, Homo sapiens
tggaagccaggtacagga

SEQ ID NO: 3609884 - DNA, 19 bp, Homo sapiens
tggaagcccaactggggtt

SEQ ID NO: 3609885 - DNA, 20 bp, Homo sapiens
tggaagctctccgagctctg

SEQ ID NO: 3609886 - DNA, 21 bp, Homo sapiens
tggaagctctccgagctctgg

SEQ ID NO: 3609887 - DNA, 16 bp, Homo sapiens
tggaagcttgttgaaa

SEQ ID NO: 3609888 - DNA, 20 bp, Homo sapiens
tggaagctttgtagaaatta

SEQ ID NO: 3609889 - DNA, 19 bp, Homo sapiens
tggaagggtctctctccag

SEQ ID NO: 3609890 - DNA, 13 bp, Homo sapiens
tggaagtacttgg

SEQ ID NO: 3609891 - DNA, 19 bp, Homo sapiens
tggaagtgcagtcagcaga

SEQ ID NO: 3609892 - DNA, 13 bp, Homo sapiens
tggaagtgtgggt

SEQ ID NO: 3609893 - DNA, 20 bp, Homo sapiens
tggaagtgtgggtctgtgtg

SEQ ID NO: 3609894 - DNA, 17 bp, Homo sapiens
tggaatacacatgcagg

SEQ ID NO: 3609895 - DNA, 19 bp, Homo sapiens
tggaatacacatgcaggac

SEQ ID NO: 3609896 - DNA, 20 bp, Homo sapiens
tggaatagtatcctccaggt

SEQ ID NO: 3609897 - DNA, 22 bp, Homo sapiens
tggaatagtatcctccaggttt

SEQ ID NO: 3609898 - DNA, 23 bp, Homo sapiens
tggaatagtatcctccaggtttt

SEQ ID NO: 3609899 - DNA, 18 bp, Homo sapiens
tggaatgaattaaataaa

SEQ ID NO: 3609900 - DNA, 21 bp, Homo sapiens
tggaatgtggcccctgaacaa

SEQ ID NO: 3609901 - DNA, 23 bp, Homo sapiens
tggaatgtggcccctgaacaaga

SEQ ID NO: 3609902 - DNA, 13 bp, Homo sapiens
tggaattataaat

SEQ ID NO: 3609903 - DNA, 16 bp, Homo sapiens
tggaattataaatatt

SEQ ID NO: 3609904 - DNA, 21 bp, Homo sapiens
tggaattatgttggtgtgaat

SEQ ID NO: 3609905 - DNA, 22 bp, Homo sapiens
tggaattccctcctgagtgccc

SEQ ID NO: 3609906 - DNA, 15 bp, Homo sapiens
tggacagctgataaa

SEQ ID NO: 3609907 - DNA, 22 bp, Homo sapiens
tggacagtacctgattgtattt

SEQ ID NO: 3609908 - DNA, 16 bp, Homo sapiens
tggacatctgacccca

SEQ ID NO: 3609909 - DNA, 11 bp, Homo sapiens
tggacatttta

SEQ ID NO: 3609910 - DNA, 18 bp, Homo sapiens
tggacgggatgacctcca

SEQ ID NO: 3609911 - DNA, 16 bp, Homo sapiens
tggacgttaggccagg

SEQ ID NO: 3609912 - DNA, 15 bp, Homo sapiens
tggactattgtgcca

SEQ ID NO: 3609913 - DNA, 16 bp, Homo sapiens
tggactcaggatccag

SEQ ID NO: 3609914 - DNA, 17 bp, Homo sapiens
tggactcaggatccagt

SEQ ID NO: 3609915 - DNA, 13 bp, Homo sapiens
tggactcctctgt

SEQ ID NO: 3609916 - DNA, 14 bp, Homo sapiens
tggactcctctgtc

SEQ ID NO: 3609917 - DNA, 18 bp, Homo sapiens
tggactcctgccaccagc

SEQ ID NO: 3609918 - DNA, 21 bp, Homo sapiens
tggactgtcatagaaattaca

SEQ ID NO: 3609919 - DNA, 16 bp, Homo sapiens
tggacttgtgattggc

SEQ ID NO: 3609920 - DNA, 20 bp, Homo sapiens
tggacttgtgattggctgca

SEQ ID NO: 3609921 - DNA, 23 bp, Homo sapiens
tggacttgtgattggctgcagga

SEQ ID NO: 3609922 - DNA, 13 bp, Homo sapiens
tggagaaagaagt

SEQ ID NO: 3609923 - DNA, 14 bp, Homo sapiens
tggagaaagaagtg

SEQ ID NO: 3609924 - DNA, 20 bp, Homo sapiens
tggagaaagagctgcctgga

SEQ ID NO: 3609925 - DNA, 11 bp, Homo sapiens
tggagaacagt

SEQ ID NO: 3609926 - DNA, 23 bp, Homo sapiens
tggagaacagtggttgcctgggg

SEQ ID NO: 3609927 - DNA, 14 bp, Homo sapiens
tggagaacatgttt

SEQ ID NO: 3609928 - DNA, 23 bp, Homo sapiens
tggagaaccagggctcttctcag

SEQ ID NO: 3609929 - DNA, 17 bp, Homo sapiens
tggagaagaccctcccc

SEQ ID NO: 3609930 - DNA, 14 bp, Homo sapiens
tggagaaggcatat

SEQ ID NO: 3609931 - DNA, 17 bp, Homo sapiens
tggagaaggcctggaag

SEQ ID NO: 3609932 - DNA, 15 bp, Homo sapiens
tggagaaggtctgtg

SEQ ID NO: 3609933 - DNA, 17 bp, Homo sapiens
tggagacaccctctggg

SEQ ID NO: 3609934 - DNA, 20 bp, Homo sapiens
tggagacaccctctgggggt

SEQ ID NO: 3609935 - DNA, 12 bp, Homo sapiens
tggagacagcag

SEQ ID NO: 3609936 - DNA, 14 bp, Homo sapiens
tggagagggcccag

SEQ ID NO: 3609937 - DNA, 21 bp, Homo sapiens
tggagagtacatttgctttaa

SEQ ID NO: 3609938 - DNA, 17 bp, Homo sapiens
tggagagtttcctgaaa

SEQ ID NO: 3609939 - DNA, 14 bp, Homo sapiens
tggagatcaggagt

SEQ ID NO: 3609940 - DNA, 22 bp, Homo sapiens
tggagatggaagcttgttgaaa

SEQ ID NO: 3609941 - DNA, 15 bp, Homo sapiens
tggagatggactcag

SEQ ID NO: 3609942 - DNA, 18 bp, Homo sapiens
tggagatggactcaggat

SEQ ID NO: 3609943 - DNA, 13 bp, Homo sapiens
tggagcagcaggc

SEQ ID NO: 3609944 - DNA, 14 bp, Homo sapiens
tggagcagcaggcc

SEQ ID NO: 3609945 - DNA, 20 bp, Homo sapiens
tggagcagcaggcctctggg

SEQ ID NO: 3609946 - DNA, 19 bp, Homo sapiens
tggagcaggagccccgcca

SEQ ID NO: 3609947 - DNA, 13 bp, Homo sapiens
tggagcaggccca

SEQ ID NO: 3609948 - DNA, 16 bp, Homo sapiens
tggagcaggcccaatg

SEQ ID NO: 3609949 - DNA, 18 bp, Homo sapiens
tggagcaggcccaatgct

SEQ ID NO: 3609950 - DNA, 19 bp, Homo sapiens
tggagcaggcccaatgctg

SEQ ID NO: 3609951 - DNA, 21 bp, Homo sapiens
tggagcaggcccaatgctgct

SEQ ID NO: 3609952 - DNA, 13 bp, Homo sapiens
tggagccccaggg

SEQ ID NO: 3609953 - DNA, 17 bp, Homo sapiens
tggagccccatcggcca

SEQ ID NO: 3609954 - DNA, 18 bp, Homo sapiens
tggagcctacctctgtct

SEQ ID NO: 3609955 - DNA, 17 bp, Homo sapiens
tggagctgtctgtctct

SEQ ID NO: 3609956 - DNA, 17 bp, Homo sapiens
tggagcttcagccaggt

SEQ ID NO: 3609957 - DNA, 20 bp, Homo sapiens
tggagcttcagccaggtctg

SEQ ID NO: 3609958 - DNA, 23 bp, Homo sapiens
tggaggaaaaccaagccgtggct

SEQ ID NO: 3609959 - DNA, 11 bp, Homo sapiens
tggaggagaga

SEQ ID NO: 3609960 - DNA, 13 bp, Homo sapiens
tggaggagagaga

SEQ ID NO: 3609961 - DNA, 15 bp, Homo sapiens
tggaggagagagacc

SEQ ID NO: 3609962 - DNA, 19 bp, Homo sapiens
tggaggaggcctgtcccaa

SEQ ID NO: 3609963 - DNA, 16 bp, Homo sapiens
tggaggcaaaggcctg

SEQ ID NO: 3609964 - DNA, 17 bp, Homo sapiens
tggaggcaaaggcctgg

SEQ ID NO: 3609965 - DNA, 12 bp, Homo sapiens
tggaggcccagt

SEQ ID NO: 3609966 - DNA, 15 bp, Homo sapiens
tggaggctcctctag

SEQ ID NO: 3609967 - DNA, 19 bp, Homo sapiens
tggagggaagacctgaaag

SEQ ID NO: 3609968 - DNA, 22 bp, Homo sapiens
tggagggagggcagctggcccc

SEQ ID NO: 3609969 - DNA, 15 bp, Homo sapiens
tggagggcttggccc

SEQ ID NO: 3609970 - DNA, 20 bp, Homo sapiens
tggagggcttggcccagcgc

SEQ ID NO: 3609971 - DNA, 22 bp, Homo sapiens
tggaggtctccaggggcctgca

SEQ ID NO: 3609972 - DNA, 18 bp, Homo sapiens
tggaggtctggctgagcc

SEQ ID NO: 3609973 - DNA, 14 bp, Homo sapiens
tggagtccagtgct

SEQ ID NO: 3609974 - DNA, 20 bp, Homo sapiens
tggagtgttttagttcttgg

SEQ ID NO: 3609975 - DNA, 14 bp, Homo sapiens
tggagttccttatc

SEQ ID NO: 3609976 - DNA, 17 bp, Homo sapiens
tggagttgatctggaac

SEQ ID NO: 3609977 - DNA, 17 bp, Homo sapiens
tggagttggtggtgctg

SEQ ID NO: 3609978 - DNA, 18 bp, Homo sapiens
tggagttttataaattaa

SEQ ID NO: 3609979 - DNA, 21 bp, Homo sapiens
tggagttttataaattaaaag

SEQ ID NO: 3609980 - DNA, 17 bp, Homo sapiens
tggataaaataatgctg

SEQ ID NO: 3609981 - DNA, 16 bp, Homo sapiens
tggataatctgagcag

SEQ ID NO: 3609982 - DNA, 16 bp, Homo sapiens
tggataatgtgtataa

SEQ ID NO: 3609983 - DNA, 13 bp, Homo sapiens
tggataccattat

SEQ ID NO: 3609984 - DNA, 19 bp, Homo sapiens
tggatatataggctatttt

SEQ ID NO: 3609985 - DNA, 14 bp, Homo sapiens
tggatatttcaatc

SEQ ID NO: 3609986 - DNA, 18 bp, Homo sapiens
tggatatttcaatctttt

SEQ ID NO: 3609987 - DNA, 21 bp, Homo sapiens
tggatccatcttgagccacag

SEQ ID NO: 3609988 - DNA, 15 bp, Homo sapiens
tggatggcagactct

SEQ ID NO: 3609989 - DNA, 22 bp, Homo sapiens
tggatgggggaactcagatcca

SEQ ID NO: 3609990 - DNA, 16 bp, Homo sapiens
tacatgaagcagaacc

SEQ ID NO: 3609991 - DNA, 15 bp, Homo sapiens
tacatgtattgcaca

SEQ ID NO: 3609992 - DNA, 20 bp, Homo sapiens
tacatgtattgcacattgta

SEQ ID NO: 3609993 - DNA, 22 bp, Homo sapiens
tacatgtattgcacattgtaaa

SEQ ID NO: 3609994 - DNA, 15 bp, Homo sapiens
tacatgtttccatca

SEQ ID NO: 3609995 - DNA, 21 bp, Homo sapiens
tacatgtttccatcatttctg

SEQ ID NO: 3609996 - DNA, 22 bp, Homo sapiens
tacatgtttccatcatttctgt

SEQ ID NO: 3609997 - DNA, 17 bp, Homo sapiens
tacatgttttttcattt

SEQ ID NO: 3609998 - DNA, 18 bp, Homo sapiens
tacatgttttttcatttg

SEQ ID NO: 3609999 - DNA, 20 bp, Homo sapiens
tacatgttttttcatttgta

SEQ ID NO: 3610000 - DNA, 22 bp, Homo sapiens
tacatgttttttcatttgtaaa

SEQ ID NO: 3610001 - DNA, 18 bp, Homo sapiens
tacattaaaataaaccaa

SEQ ID NO: 3610002 - DNA, 21 bp, Homo sapiens
tacattaaaataaaccaaata

SEQ ID NO: 3610003 - DNA, 17 bp, Homo sapiens
tacattaacggtgctaa

SEQ ID NO: 3610004 - DNA, 20 bp, Homo sapiens
tacattagcagtttgctttg

SEQ ID NO: 3610005 - DNA, 14 bp, Homo sapiens
tacattccaccctg

SEQ ID NO: 3610006 - DNA, 19 bp, Homo sapiens
tacattctgcctagagtgt

SEQ ID NO: 3610007 - DNA, 16 bp, Homo sapiens
tacatttaaaacatta

SEQ ID NO: 3610008 - DNA, 15 bp, Homo sapiens
taccaaaaataaata

SEQ ID NO: 3610009 - DNA, 13 bp, Homo sapiens
taccaaaagacat

SEQ ID NO: 3610010 - DNA, 20 bp, Homo sapiens
taccaaaagacattagagaa

SEQ ID NO: 3610011 - DNA, 14 bp, Homo sapiens
taccaaatagtgat

SEQ ID NO: 3610012 - DNA, 15 bp, Homo sapiens
taccaaatagtgatt

SEQ ID NO: 3610013 - DNA, 16 bp, Homo sapiens
taccaaatagtgattg

SEQ ID NO: 3610014 - DNA, 12 bp, Homo sapiens
taccaaatctga

SEQ ID NO: 3610015 - DNA, 16 bp, Homo sapiens
taccacagcaactgac

SEQ ID NO: 3610016 - DNA, 23 bp, Homo sapiens
taccacgaggaaaagaacaaaca

SEQ ID NO: 3610017 - DNA, 20 bp, Homo sapiens
taccactagtggaaagtcag

SEQ ID NO: 3610018 - DNA, 16 bp, Homo sapiens
taccagaagaactagt

SEQ ID NO: 3610019 - DNA, 12 bp, Homo sapiens
taccagccagcc

SEQ ID NO: 3610020 - DNA, 20 bp, Homo sapiens
taccagggactatctttgct

SEQ ID NO: 3610021 - DNA, 16 bp, Homo sapiens
taccagggtctctcag

SEQ ID NO: 3610022 - DNA, 20 bp, Homo sapiens
taccagggtctctcagggat

SEQ ID NO: 3610023 - DNA, 18 bp, Homo sapiens
taccagttaatttttcca

SEQ ID NO: 3610024 - DNA, 17 bp, Homo sapiens
taccagttgtatttaat

SEQ ID NO: 3610025 - DNA, 14 bp, Homo sapiens
taccatttatgaag

SEQ ID NO: 3610026 - DNA, 12 bp, Homo sapiens
taccatttcaga

SEQ ID NO: 3610027 - DNA, 20 bp, Homo sapiens
taccattttaacgctgccta

SEQ ID NO: 3610028 - DNA, 16 bp, Homo sapiens
tacccattctgttttc

SEQ ID NO: 3610029 - DNA, 22 bp, Homo sapiens
tacccattctgttttcccccag

SEQ ID NO: 3610030 - DNA, 22 bp, Homo sapiens
tacccattttttaaaaaagcaa

SEQ ID NO: 3610031 - DNA, 21 bp, Homo sapiens
taccccagactagatgtagta

SEQ ID NO: 3610032 - DNA, 12 bp, Homo sapiens
taccccagccag

SEQ ID NO: 3610033 - DNA, 21 bp, Homo sapiens
tacccctcaaactgcacatct

SEQ ID NO: 3610034 - DNA, 17 bp, Homo sapiens
taccctaaccaagttcc

SEQ ID NO: 3610035 - DNA, 14 bp, Homo sapiens
taccctcccaccag

SEQ ID NO: 3610036 - DNA, 12 bp, Homo sapiens
taccctcctctg

SEQ ID NO: 3610037 - DNA, 15 bp, Homo sapiens
taccctcctctgctg

SEQ ID NO: 3610038 - DNA, 19 bp, Homo sapiens
taccctcctctgctgggaa

SEQ ID NO: 3610039 - DNA, 18 bp, Homo sapiens
taccctgaggtcactgct

SEQ ID NO: 3610040 - DNA, 19 bp, Homo sapiens
taccctgaggtcactgcta

SEQ ID NO: 3610041 - DNA, 22 bp, Homo sapiens
tacccttcccgcctccctctca

SEQ ID NO: 3610042 - DNA, 16 bp, Homo sapiens
tacccttttccccctt

SEQ ID NO: 3610043 - DNA, 17 bp, Homo sapiens
tacccttttcccccttc

SEQ ID NO: 3610044 - DNA, 18 bp, Homo sapiens
taccgagtctcttctcca

SEQ ID NO: 3610045 - DNA, 20 bp, Homo sapiens
taccgtaggctttgtattca

SEQ ID NO: 3610046 - DNA, 18 bp, Homo sapiens
taccgtggatttgtactt

SEQ ID NO: 3610047 - DNA, 19 bp, Homo sapiens
tacctacaataaactggta

SEQ ID NO: 3610048 - DNA, 17 bp, Homo sapiens
tacctagctaattattt

SEQ ID NO: 3610049 - DNA, 13 bp, Homo sapiens
tacctattctgaa

SEQ ID NO: 3610050 - DNA, 20 bp, Homo sapiens
tacctattctgaaaaagaca

SEQ ID NO: 3610051 - DNA, 14 bp, Homo sapiens
tacctcaaactatc

SEQ ID NO: 3610052 - DNA, 20 bp, Homo sapiens
tacctcagtggatcttcaga

SEQ ID NO: 3610053 - DNA, 13 bp, Homo sapiens
tacctctgtgcct

SEQ ID NO: 3610054 - DNA, 14 bp, Homo sapiens
tacctgattgtatt

SEQ ID NO: 3610055 - DNA, 17 bp, Homo sapiens
tacctgattgtattttt

SEQ ID NO: 3610056 - DNA, 12 bp, Homo sapiens
tacctgccctct

SEQ ID NO: 3610057 - DNA, 24 bp, Homo sapiens
tacctgccctctatttattagcca

SEQ ID NO: 3610058 - DNA, 14 bp, Homo sapiens
tacctggcctagaa

SEQ ID NO: 3610059 - DNA, 16 bp, Homo sapiens
tacctggtccccactg

SEQ ID NO: 3610060 - DNA, 14 bp, Homo sapiens
tacctgtctgctgc

SEQ ID NO: 3610061 - DNA, 12 bp, Homo sapiens
tacctgtgcctg

SEQ ID NO: 3610062 - DNA, 21 bp, Homo sapiens
tacctgtgtttttttctaaaa

SEQ ID NO: 3610063 - DNA, 14 bp, Homo sapiens
tacctgttcctccc

SEQ ID NO: 3610064 - DNA, 12 bp, Homo sapiens
taccttctttct

SEQ ID NO: 3610065 - DNA, 12 bp, Homo sapiens
tacctttgtagt

SEQ ID NO: 3610066 - DNA, 22 bp, Homo sapiens
tacctttgtagttactcaagca

SEQ ID NO: 3610067 - DNA, 17 bp, Homo sapiens
taccttttctcttttct

SEQ ID NO: 3610068 - DNA, 12 bp, Homo sapiens
taccttttgtag

SEQ ID NO: 3610069 - DNA, 12 bp, Homo sapiens
tacgctctcgtc

SEQ ID NO: 3610070 - DNA, 18 bp, Homo sapiens
tacgtgctctgtgggtct

SEQ ID NO: 3610071 - DNA, 19 bp, Homo sapiens
tactaaaaagtataaaata

SEQ ID NO: 3610072 - DNA, 23 bp, Homo sapiens
tactaatgatacttacaagtttc

SEQ ID NO: 3610073 - DNA, 16 bp, Homo sapiens
tactaatgtaaaatga

SEQ ID NO: 3610074 - DNA, 14 bp, Homo sapiens
tactacccagctct

SEQ ID NO: 3610075 - DNA, 16 bp, Homo sapiens
tactactgcagtcttt

SEQ ID NO: 3610076 - DNA, 18 bp, Homo sapiens
tactactgcagtctttat

SEQ ID NO: 3610077 - DNA, 17 bp, Homo sapiens
tactacttatgaaatgt

SEQ ID NO: 3610078 - DNA, 13 bp, Homo sapiens
tactagaatgctt

SEQ ID NO: 3610079 - DNA, 14 bp, Homo sapiens
tactagaatgctta

SEQ ID NO: 3610080 - DNA, 13 bp, Homo sapiens
tactatagtacca

SEQ ID NO: 3610081 - DNA, 13 bp, Homo sapiens
tactcccaaactg

SEQ ID NO: 3610082 - DNA, 23 bp, Homo sapiens
tactcccacagcagccccaggag

SEQ ID NO: 3610083 - DNA, 13 bp, Homo sapiens
tactcccccacca

SEQ ID NO: 3610084 - DNA, 18 bp, Homo sapiens
tactcccccaccactcag

SEQ ID NO: 3610085 - DNA, 21 bp, Homo sapiens
tactcccccaccactcaggcc

SEQ ID NO: 3610086 - DNA, 15 bp, Homo sapiens
tactccctacactga

SEQ ID NO: 3610087 - DNA, 17 bp, Homo sapiens
tactccctacactgatg

SEQ ID NO: 3610088 - DNA, 13 bp, Homo sapiens
tactcctgcctca

SEQ ID NO: 3610089 - DNA, 22 bp, Homo sapiens
tactcgtgcattaaaatttctt

SEQ ID NO: 3610090 - DNA, 23 bp, Homo sapiens
tactctataaccaaatgaaatat

SEQ ID NO: 3610091 - DNA, 21 bp, Homo sapiens
tactctattgatacaatattg

SEQ ID NO: 3610092 - DNA, 21 bp, Homo sapiens
tactctcttatgcattagtat

SEQ ID NO: 3610093 - DNA, 15 bp, Homo sapiens
tactctcttcctcca

SEQ ID NO: 3610094 - DNA, 18 bp, Homo sapiens
tactctgtgaaagaagag

SEQ ID NO: 3610095 - DNA, 21 bp, Homo sapiens
tactctgtgaaagaagagaaa

SEQ ID NO: 3610096 - DNA, 19 bp, Homo sapiens
tactgaaagagtccattgt

SEQ ID NO: 3610097 - DNA, 21 bp, Homo sapiens
tactgacagggagcagccccc

SEQ ID NO: 3610098 - DNA, 16 bp, Homo sapiens
tactgatgagagaatg

SEQ ID NO: 3610099 - DNA, 16 bp, Homo sapiens
tactgcaaactattta

SEQ ID NO: 3610100 - DNA, 14 bp, Homo sapiens
tactgcaagagcca

SEQ ID NO: 3610101 - DNA, 13 bp, Homo sapiens
tactgcagtcttt

SEQ ID NO: 3610102 - DNA, 13 bp, Homo sapiens
tactgccctttca

SEQ ID NO: 3610103 - DNA, 19 bp, Homo sapiens
tactgccttgtttaatgtt

SEQ ID NO: 3610104 - DNA, 16 bp, Homo sapiens
tactggaattcttctg

SEQ ID NO: 3610105 - DNA, 19 bp, Homo sapiens
tactggaattcttctgcaa

SEQ ID NO: 3610106 - DNA, 22 bp, Homo sapiens
tactggcaaaaggatctttgtg

SEQ ID NO: 3610107 - DNA, 18 bp, Homo sapiens
tactggcctttttcattt

SEQ ID NO: 3610108 - DNA, 14 bp, Homo sapiens
tactgggtctgcga

SEQ ID NO: 3610109 - DNA, 15 bp, Homo sapiens
tactggttacctgga

SEQ ID NO: 3610110 - DNA, 15 bp, Homo sapiens
tactgtaatgctgcc

SEQ ID NO: 3610111 - DNA, 18 bp, Homo sapiens
tactgtaatgctgcctca

SEQ ID NO: 3610112 - DNA, 18 bp, Homo sapiens
tactgtatggaaacactg

SEQ ID NO: 3610113 - DNA, 18 bp, Homo sapiens
tactgtatggttttgttt

SEQ ID NO: 3610114 - DNA, 23 bp, Homo sapiens
tactgtcatcctcaaagaaagtg

SEQ ID NO: 3610115 - DNA, 17 bp, Homo sapiens
tactgtctctccagtga

SEQ ID NO: 3610116 - DNA, 19 bp, Homo sapiens
tactgtctctccagtgaaa

SEQ ID NO: 3610117 - DNA, 16 bp, Homo sapiens
tactgtggcctgcagg

SEQ ID NO: 3610118 - DNA, 17 bp, Homo sapiens
tactgtggcctgcagga

SEQ ID NO: 3610119 - DNA, 18 bp, Homo sapiens
tacttacaagtttctagc

SEQ ID NO: 3610120 - DNA, 17 bp, Homo sapiens
tacttacatatctgact

SEQ ID NO: 3610121 - DNA, 16 bp, Homo sapiens
tacttagagtttctgt

SEQ ID NO: 3610122 - DNA, 14 bp, Homo sapiens
tacttatttaactg

SEQ ID NO: 3610123 - DNA, 15 bp, Homo sapiens
tacttatttctcagc

SEQ ID NO: 3610124 - DNA, 22 bp, Homo sapiens
tacttatttctcagctgtgcct

SEQ ID NO: 3610125 - DNA, 20 bp, Homo sapiens
tacttattttcagtgcatca

SEQ ID NO: 3610126 - DNA, 16 bp, Homo sapiens
tacttcaaagtgcctg

SEQ ID NO: 3610127 - DNA, 14 bp, Homo sapiens
tacttccctcaggc

SEQ ID NO: 3610128 - DNA, 16 bp, Homo sapiens
tacttcttatacattt

SEQ ID NO: 3610129 - DNA, 15 bp, Homo sapiens
tacttgaagggccag

SEQ ID NO: 3610130 - DNA, 16 bp, Homo sapiens
tacttgaagggccaga

SEQ ID NO: 3610131 - DNA, 17 bp, Homo sapiens
tacttgaagggccagag

SEQ ID NO: 3610132 - DNA, 22 bp, Homo sapiens
tacttgaagggccagagccagg

SEQ ID NO: 3610133 - DNA, 17 bp, Homo sapiens
tacttgcctatctgact

SEQ ID NO: 3610134 - DNA, 19 bp, Homo sapiens
tacttgctccttttgctct

SEQ ID NO: 3610135 - DNA, 22 bp, Homo sapiens
tacttggcccccttcaggagcc

SEQ ID NO: 3610136 - DNA, 23 bp, Homo sapiens
tacttggcccccttcaggagcct

SEQ ID NO: 3610137 - DNA, 18 bp, Homo sapiens
tacttgggcttcaacagc

SEQ ID NO: 3610138 - DNA, 19 bp, Homo sapiens
tacttgggcttcaacagcc

SEQ ID NO: 3610139 - DNA, 16 bp, Homo sapiens
tactttaaattatatg

SEQ ID NO: 3610140 - DNA, 17 bp, Homo sapiens
tactttaaattatatga

SEQ ID NO: 3610141 - DNA, 16 bp, Homo sapiens
tactttccatgttttt

SEQ ID NO: 3610142 - DNA, 22 bp, Homo sapiens
tactttgaagtgcagctcatgt

SEQ ID NO: 3610143 - DNA, 13 bp, Homo sapiens
tacttttcaaagc

SEQ ID NO: 3610144 - DNA, 13 bp, Homo sapiens
tacttttcctttg

SEQ ID NO: 3610145 - DNA, 19 bp, Homo sapiens
tacttttctaaaatctaaa

SEQ ID NO: 3610146 - DNA, 13 bp, Homo sapiens
tagaaaaaacaat

SEQ ID NO: 3610147 - DNA, 21 bp, Homo sapiens
tagaaaaggctaggtacacag

SEQ ID NO: 3610148 - DNA, 20 bp, Homo sapiens
tagaaaatgacttatttctg

SEQ ID NO: 3610149 - DNA, 15 bp, Homo sapiens
tagaaactacaaata

SEQ ID NO: 3610150 - DNA, 21 bp, Homo sapiens
tagaaactgaggcccagagag

SEQ ID NO: 3610151 - DNA, 18 bp, Homo sapiens
tagaaagagatacagagg

SEQ ID NO: 3610152 - DNA, 20 bp, Homo sapiens
tagaaagctggcaacatgaa

SEQ ID NO: 3610153 - DNA, 22 bp, Homo sapiens
tagaaagctttgttgaaagaaa

SEQ ID NO: 3610154 - DNA, 16 bp, Homo sapiens
tagaaaggggagaatg

SEQ ID NO: 3610155 - DNA, 12 bp, Homo sapiens
tagaaattaaac

SEQ ID NO: 3610156 - DNA, 21 bp, Homo sapiens
tagaaccagccgtattttaca

SEQ ID NO: 3610157 - DNA, 19 bp, Homo sapiens
tagaagatgcagttcaaaa

SEQ ID NO: 3610158 - DNA, 17 bp, Homo sapiens
tagaagattagaaacta

SEQ ID NO: 3610159 - DNA, 19 bp, Homo sapiens
tagaagattctatgttaat

SEQ ID NO: 3610160 - DNA, 17 bp, Homo sapiens
tagaagccgtgggaaga

SEQ ID NO: 3610161 - DNA, 15 bp, Homo sapiens
tagaataaagaaaaa

SEQ ID NO: 3610162 - DNA, 22 bp, Homo sapiens
tagaataaaggcagttttctaa

SEQ ID NO: 3610163 - DNA, 22 bp, Homo sapiens
tagaataggcagggggccctgc

SEQ ID NO: 3610164 - DNA, 17 bp, Homo sapiens
tagaatgagatctgaat

SEQ ID NO: 3610165 - DNA, 13 bp, Homo sapiens
tagaatgtcaata

SEQ ID NO: 3610166 - DNA, 23 bp, Homo sapiens
tagaatgtcaataaatttgcttt

SEQ ID NO: 3610167 - DNA, 15 bp, Homo sapiens
tagaatgttgaaaag

SEQ ID NO: 3610168 - DNA, 15 bp, Homo sapiens
tagacaattgaggta

SEQ ID NO: 3610169 - DNA, 14 bp, Homo sapiens
tagacacacataca

SEQ ID NO: 3610170 - DNA, 13 bp, Homo sapiens
tagacacagataa

SEQ ID NO: 3610171 - DNA, 17 bp, Homo sapiens
tagaccaaagcaaagaa

SEQ ID NO: 3610172 - DNA, 14 bp, Homo sapiens
tagaccaattgaag

SEQ ID NO: 3610173 - DNA, 16 bp, Homo sapiens
tagaccctcgggcccc

SEQ ID NO: 3610174 - DNA, 14 bp, Homo sapiens
tagacctgacaatt

SEQ ID NO: 3610175 - DNA, 15 bp, Homo sapiens
tagactgctcctggg

SEQ ID NO: 3610176 - DNA, 13 bp, Homo sapiens
tagactgtgccag

SEQ ID NO: 3610177 - DNA, 16 bp, Homo sapiens
tagactgttgggacag

SEQ ID NO: 3610178 - DNA, 13 bp, Homo sapiens
tagagaaaacctt

SEQ ID NO: 3610179 - DNA, 14 bp, Homo sapiens
tagagaaaacctta

SEQ ID NO: 3610180 - DNA, 17 bp, Homo sapiens
tagagaaaaccttaaaa

SEQ ID NO: 3610181 - DNA, 13 bp, Homo sapiens
tagagaaggaccc

SEQ ID NO: 3610182 - DNA, 23 bp, Homo sapiens
tagagatgaagtttgtagttgtt

SEQ ID NO: 3610183 - DNA, 22 bp, Homo sapiens
tagagcatatttgccaataaag

SEQ ID NO: 3610184 - DNA, 17 bp, Homo sapiens
tagagcccctactgtgg

SEQ ID NO: 3610185 - DNA, 15 bp, Homo sapiens
tagagctccagttct

SEQ ID NO: 3610186 - DNA, 18 bp, Homo sapiens
tagagcttgtaataaata

SEQ ID NO: 3610187 - DNA, 15 bp, Homo sapiens
tagaggaacccaaga

SEQ ID NO: 3610188 - DNA, 21 bp, Homo sapiens
tagaggctcagtggtgggaga

SEQ ID NO: 3610189 - DNA, 20 bp, Homo sapiens
tagagggacctctcccaggg

SEQ ID NO: 3610190 - DNA, 21 bp, Homo sapiens
tagagggtgatggaacaagag

SEQ ID NO: 3610191 - DNA, 14 bp, Homo sapiens
tagagtaatgaaat

SEQ ID NO: 3610192 - DNA, 20 bp, Homo sapiens
tagagtgtagcctaaagggc

SEQ ID NO: 3610193 - DNA, 14 bp, Homo sapiens
tagagtgtagctgt

SEQ ID NO: 3610194 - DNA, 20 bp, Homo sapiens
tagagtttctgtttgattct

SEQ ID NO: 3610195 - DNA, 16 bp, Homo sapiens
tagatcagtatttcac

SEQ ID NO: 3610196 - DNA, 22 bp, Homo sapiens
tagatccagcccaaacctggga

SEQ ID NO: 3610197 - DNA, 13 bp, Homo sapiens
tagatgaggctca

SEQ ID NO: 3610198 - DNA, 16 bp, Homo sapiens
tagatgaggctcagag

SEQ ID NO: 3610199 - DNA, 13 bp, Homo sapiens
tagatgatatgtt

SEQ ID NO: 3610200 - DNA, 15 bp, Homo sapiens
tagatgctggcccag

SEQ ID NO: 3610201 - DNA, 18 bp, Homo sapiens
tagatgctggcccagggc

SEQ ID NO: 3610202 - DNA, 22 bp, Homo sapiens
tagatgctggcccagggcccag

SEQ ID NO: 3610203 - DNA, 16 bp, Homo sapiens
tagatgtaattttgtg

SEQ ID NO: 3610204 - DNA, 17 bp, Homo sapiens
tagatgtagtatttttt

SEQ ID NO: 3610205 - DNA, 11 bp, Homo sapiens
tagatgtgtgg

SEQ ID NO: 3610206 - DNA, 14 bp, Homo sapiens
tagattcagagaaa

SEQ ID NO: 3610207 - DNA, 11 bp, Homo sapiens
tagcaaagatt

SEQ ID NO: 3610208 - DNA, 17 bp, Homo sapiens
tagcaaggcagagcctt

SEQ ID NO: 3610209 - DNA, 14 bp, Homo sapiens
tagcactctcagag

SEQ ID NO: 3610210 - DNA, 12 bp, Homo sapiens
tagcagcaggct

SEQ ID NO: 3610211 - DNA, 15 bp, Homo sapiens
tagcagtttcctcag

SEQ ID NO: 3610212 - DNA, 16 bp, Homo sapiens
tagcagtttcctcagt

SEQ ID NO: 3610213 - DNA, 19 bp, Homo sapiens
tagcagtttcctcagtgat

SEQ ID NO: 3610214 - DNA, 15 bp, Homo sapiens
tagcatgaaataaaa

SEQ ID NO: 3610215 - DNA, 20 bp, Homo sapiens
tagcatgggtatttttataa

SEQ ID NO: 3610216 - DNA, 21 bp, Homo sapiens
tagcattatcttatcatttat

SEQ ID NO: 3610217 - DNA, 19 bp, Homo sapiens
tagcattgtaaaagcattt

SEQ ID NO: 3610218 - DNA, 12 bp, Homo sapiens
tagcatttgtat

SEQ ID NO: 3610219 - DNA, 12 bp, Homo sapiens
tagcccaaccta

SEQ ID NO: 3610220 - DNA, 13 bp, Homo sapiens
tagccccataatt

SEQ ID NO: 3610221 - DNA, 20 bp, Homo sapiens
tagcctaaagggcagggccc

SEQ ID NO: 3610222 - DNA, 20 bp, Homo sapiens
tagcctctggactggaaagc

SEQ ID NO: 3610223 - DNA, 14 bp, Homo sapiens
tagcctggctctgc

SEQ ID NO: 3610224 - DNA, 20 bp, Homo sapiens
tagcctgtgcctctgggact

SEQ ID NO: 3610225 - DNA, 16 bp, Homo sapiens
tagcggagcccagcct

SEQ ID NO: 3610226 - DNA, 15 bp, Homo sapiens
tagctaagtacacaa

SEQ ID NO: 3610227 - DNA, 15 bp, Homo sapiens
tagctacatgttctt

SEQ ID NO: 3610228 - DNA, 20 bp, Homo sapiens
tagctacatgttctttgtac

SEQ ID NO: 3610229 - DNA, 17 bp, Homo sapiens
tagctattaagatactt

SEQ ID NO: 3610230 - DNA, 22 bp, Homo sapiens
tagctatttttatacactgtaa

SEQ ID NO: 3610231 - DNA, 11 bp, Homo sapiens
tagctctgctg

SEQ ID NO: 3610232 - DNA, 22 bp, Homo sapiens
tagctctggggtgggcagtttt

SEQ ID NO: 3610233 - DNA, 18 bp, Homo sapiens
tagctgacagtcagctgt

SEQ ID NO: 3610234 - DNA, 21 bp, Homo sapiens
tagctgacagtcagctgtggg

SEQ ID NO: 3610235 - DNA, 22 bp, Homo sapiens
tagctgaccccgagaagtgctc

SEQ ID NO: 3610236 - DNA, 12 bp, Homo sapiens
tagctgcagcct

SEQ ID NO: 3610237 - DNA, 21 bp, Homo sapiens
tagctgtaagggcagtgccca

SEQ ID NO: 3610238 - DNA, 23 bp, Homo sapiens
tagctgtaagggcagtgcccatg

SEQ ID NO: 3610239 - DNA, 21 bp, Homo sapiens
tagctgtctgctcagacagaa

SEQ ID NO: 3610240 - DNA, 15 bp, Homo sapiens
tagcttacctgggca

SEQ ID NO: 3610241 - DNA, 19 bp, Homo sapiens
tagcttacctgggcacaaa

SEQ ID NO: 3610242 - DNA, 22 bp, Homo sapiens
tagcttccctcccctctagttt

SEQ ID NO: 3610243 - DNA, 9 bp, Homo sapiens
taggacaga

SEQ ID NO: 3610244 - DNA, 15 bp, Homo sapiens
taggaccctcgagag

SEQ ID NO: 3610245 - DNA, 15 bp, Homo sapiens
taggactctggacaa

SEQ ID NO: 3610246 - DNA, 23 bp, Homo sapiens
taggagacagatcactcctggag

SEQ ID NO: 3610247 - DNA, 19 bp, Homo sapiens
taggagcaggcttgtggca

SEQ ID NO: 3610248 - DNA, 20 bp, Homo sapiens
taggagccgactctttgata

SEQ ID NO: 3610249 - DNA, 17 bp, Homo sapiens
taggatcctggaggctg

SEQ ID NO: 3610250 - DNA, 13 bp, Homo sapiens
taggattgctggg

SEQ ID NO: 3610251 - DNA, 14 bp, Homo sapiens
taggattgctgggg

SEQ ID NO: 3610252 - DNA, 17 bp, Homo sapiens
taggattttgtgtcttt

SEQ ID NO: 3610253 - DNA, 12 bp, Homo sapiens
taggcagcaagc

SEQ ID NO: 3610254 - DNA, 17 bp, Homo sapiens
taggcagggggccctgc

SEQ ID NO: 3610255 - DNA, 19 bp, Homo sapiens
taggcagggggccctgccc

SEQ ID NO: 3610256 - DNA, 17 bp, Homo sapiens
taggcatacttttcaaa

SEQ ID NO: 3610257 - DNA, 18 bp, Homo sapiens
taggcattttaagtaaaa

SEQ ID NO: 3610258 - DNA, 22 bp, Homo sapiens
taggccaggccttatctgaaag

SEQ ID NO: 3610259 - DNA, 16 bp, Homo sapiens
taggcctcagccagag

SEQ ID NO: 3610260 - DNA, 18 bp, Homo sapiens
taggcctcagccagagaa

SEQ ID NO: 3610261 - DNA, 21 bp, Homo sapiens
taggcctgtcccttgcctctg

SEQ ID NO: 3610262 - DNA, 16 bp, Homo sapiens
taggcctttcctctgc

SEQ ID NO: 3610263 - DNA, 20 bp, Homo sapiens
taggctcttaagcagcatgg

SEQ ID NO: 3610264 - DNA, 21 bp, Homo sapiens
taggctcttatgtgtgccttt

SEQ ID NO: 3610265 - DNA, 15 bp, Homo sapiens
tagggagagaagata

SEQ ID NO: 3610266 - DNA, 18 bp, Homo sapiens
tagggatatggcaggact

SEQ ID NO: 3610267 - DNA, 22 bp, Homo sapiens
tagggatgcggatcctgctggg

SEQ ID NO: 3610268 - DNA, 13 bp, Homo sapiens
tagggtctttctt

SEQ ID NO: 3610269 - DNA, 14 bp, Homo sapiens
taggtagctgggga

SEQ ID NO: 3610270 - DNA, 19 bp, Homo sapiens
taggtcgttttccaaagag

SEQ ID NO: 3610271 - DNA, 19 bp, Homo sapiens
taggtctttctctcagtga

SEQ ID NO: 3610272 - DNA, 13 bp, Homo sapiens
taggtgcccaggg

SEQ ID NO: 3610273 - DNA, 23 bp, Homo sapiens
taggtgctacaaaaacacagcaa

SEQ ID NO: 3610274 - DNA, 14 bp, Homo sapiens
taggtgttatgtat

SEQ ID NO: 3610275 - DNA, 23 bp, Homo sapiens
taggttcttctatagtgatgatg

SEQ ID NO: 3610276 - DNA, 15 bp, Homo sapiens
tagtacctgtgactc

SEQ ID NO: 3610277 - DNA, 17 bp, Homo sapiens
tagtacctgtgactctt

SEQ ID NO: 3610278 - DNA, 17 bp, Homo sapiens
tagtaggaatgtacatg

SEQ ID NO: 3610279 - DNA, 13 bp, Homo sapiens
tagtatcctccag

SEQ ID NO: 3610280 - DNA, 15 bp, Homo sapiens
tagtatcctccaggt

SEQ ID NO: 3610281 - DNA, 19 bp, Homo sapiens
tagtatcctccaggttttt

SEQ ID NO: 3610282 - DNA, 20 bp, Homo sapiens
tagtatcctccaggtttttc

SEQ ID NO: 3610283 - DNA, 21 bp, Homo sapiens
tagtatcctccaggtttttca

SEQ ID NO: 3610284 - DNA, 15 bp, Homo sapiens
tagtatctatatgac

SEQ ID NO: 3610285 - DNA, 19 bp, Homo sapiens
tagtattttttgtataatt

SEQ ID NO: 3610286 - DNA, 18 bp, Homo sapiens
tagtcaccagagacttta

SEQ ID NO: 3610287 - DNA, 19 bp, Homo sapiens
tagtcatttgttaatattt

SEQ ID NO: 3610288 - DNA, 12 bp, Homo sapiens
tagtcctgtact

SEQ ID NO: 3610289 - DNA, 15 bp, Homo sapiens
tagtccttcctggca

SEQ ID NO: 3610290 - DNA, 18 bp, Homo sapiens
tagtccttttatctcctt

SEQ ID NO: 3610291 - DNA, 19 bp, Homo sapiens
tagtctagatggctcctct

SEQ ID NO: 3610292 - DNA, 20 bp, Homo sapiens
tagtctagatggctcctctc

SEQ ID NO: 3610293 - DNA, 15 bp, Homo sapiens
tagtctgaaactggc

SEQ ID NO: 3610294 - DNA, 18 bp, Homo sapiens
tagtctgaaactggcttc

SEQ ID NO: 3610295 - DNA, 13 bp, Homo sapiens
tagtgtaaaattg

SEQ ID NO: 3610296 - DNA, 15 bp, Homo sapiens
tagtgtatgattact

SEQ ID NO: 3610297 - DNA, 20 bp, Homo sapiens
tagtgtccataaataaagtt

SEQ ID NO: 3610298 - DNA, 19 bp, Homo sapiens
tagtgtgaatattccttta

SEQ ID NO: 3610299 - DNA, 18 bp, Homo sapiens
tagtgttctgctcctgct

SEQ ID NO: 3610300 - DNA, 20 bp, Homo sapiens
tagtgttctgctcctgcttt

SEQ ID NO: 3610301 - DNA, 23 bp, Homo sapiens
tagtgttctgctcctgcttttct

SEQ ID NO: 3610302 - DNA, 13 bp, Homo sapiens
tagtgttgtattt

SEQ ID NO: 3610303 - DNA, 14 bp, Homo sapiens
tagtgttgtatttc

SEQ ID NO: 3610304 - DNA, 21 bp, Homo sapiens
tagttaccttatagttactgt

SEQ ID NO: 3610305 - DNA, 17 bp, Homo sapiens
tagttactgtgtaatta

SEQ ID NO: 3610306 - DNA, 19 bp, Homo sapiens
tagttactgtgtaattagt

SEQ ID NO: 3610307 - DNA, 15 bp, Homo sapiens
tagttgacagtatta

SEQ ID NO: 3610308 - DNA, 14 bp, Homo sapiens
tagtttttcacttt

SEQ ID NO: 3610309 - DNA, 23 bp, Homo sapiens
tataaaataaaaagtcacaatga

SEQ ID NO: 3610310 - DNA, 19 bp, Homo sapiens
tataaaatgtattcaagca

SEQ ID NO: 3610311 - DNA, 22 bp, Homo sapiens
tataaacatgcttgcattatat

SEQ ID NO: 3610312 - DNA, 20 bp, Homo sapiens
tataaaccaatcttaaacat

SEQ ID NO: 3610313 - DNA, 22 bp, Homo sapiens
tataaactatatataatgtata

SEQ ID NO: 3610314 - DNA, 21 bp, Homo sapiens
tataaagaaactggtccatgt

SEQ ID NO: 3610315 - DNA, 11 bp, Homo sapiens
tataaagtcag

SEQ ID NO: 3610316 - DNA, 14 bp, Homo sapiens
tataaagtcagtga

SEQ ID NO: 3610317 - DNA, 19 bp, Homo sapiens
tataaagtgcctcggacag

SEQ ID NO: 3610318 - DNA, 14 bp, Homo sapiens
tataaataaaattg

SEQ ID NO: 3610319 - DNA, 16 bp, Homo sapiens
tataaatagtattcca

SEQ ID NO: 3610320 - DNA, 14 bp, Homo sapiens
tataaatgtaaaaa

SEQ ID NO: 3610321 - DNA, 13 bp, Homo sapiens
tataaatgtacat

SEQ ID NO: 3610322 - DNA, 20 bp, Homo sapiens
tataaatgtacatttccaaa

SEQ ID NO: 3610323 - DNA, 18 bp, Homo sapiens
tataaatgtttatattgt

SEQ ID NO: 3610324 - DNA, 18 bp, Homo sapiens
tataaattctactaagtt

SEQ ID NO: 3610325 - DNA, 15 bp, Homo sapiens
tataaatttttacct

SEQ ID NO: 3610326 - DNA, 15 bp, Homo sapiens
tataaattttttgaa

SEQ ID NO: 3610327 - DNA, 17 bp, Homo sapiens
tataacaatataactga

SEQ ID NO: 3610328 - DNA, 20 bp, Homo sapiens
tataacaatataactgagtt

SEQ ID NO: 3610329 - DNA, 20 bp, Homo sapiens
tataacaattcagtaacaaa

SEQ ID NO: 3610330 - DNA, 15 bp, Homo sapiens
tataactattacagt

SEQ ID NO: 3610331 - DNA, 23 bp, Homo sapiens
tataactgagttatattggaatt

SEQ ID NO: 3610332 - DNA, 17 bp, Homo sapiens
tataagacactttgcca

SEQ ID NO: 3610333 - DNA, 12 bp, Homo sapiens
tataagttgacc

SEQ ID NO: 3610334 - DNA, 14 bp, Homo sapiens
tataagttgacctt

SEQ ID NO: 3610335 - DNA, 22 bp, Homo sapiens
tataagttgacctttatttatt

SEQ ID NO: 3610336 - DNA, 12 bp, Homo sapiens
tataataaaaat

SEQ ID NO: 3610337 - DNA, 13 bp, Homo sapiens
tataataaaaata

SEQ ID NO: 3610338 - DNA, 13 bp, Homo sapiens
tataatgaataaa

SEQ ID NO: 3610339 - DNA, 16 bp, Homo sapiens
tataatgtaatgtttt

SEQ ID NO: 3610340 - DNA, 21 bp, Homo sapiens
tataatgtaatgtttttattt

SEQ ID NO: 3610341 - DNA, 16 bp, Homo sapiens
tataatgtatataaac

SEQ ID NO: 3610342 - DNA, 13 bp, Homo sapiens
tataatgtatttg

SEQ ID NO: 3610343 - DNA, 14 bp, Homo sapiens
tataatgtatttga

SEQ ID NO: 3610344 - DNA, 20 bp, Homo sapiens
tataatgtatttgaaaatta

SEQ ID NO: 3610345 - DNA, 21 bp, Homo sapiens
tataatgtatttgaaaattac

SEQ ID NO: 3610346 - DNA, 17 bp, Homo sapiens
tataattctactttgag

SEQ ID NO: 3610347 - DNA, 14 bp, Homo sapiens
tataatttacctaa

SEQ ID NO: 3610348 - DNA, 22 bp, Homo sapiens
tatacacttacactttatgcac

SEQ ID NO: 3610349 - DNA, 16 bp, Homo sapiens
tatacatactatgaaa

SEQ ID NO: 3610350 - DNA, 21 bp, Homo sapiens
tatacatactatgaaatatgt

SEQ ID NO: 3610351 - DNA, 19 bp, Homo sapiens
tataccaggatttattttg

SEQ ID NO: 3610352 - DNA, 14 bp, Homo sapiens
tatacccacccaga

SEQ ID NO: 3610353 - DNA, 15 bp, Homo sapiens
tatacctcaaactat

SEQ ID NO: 3610354 - DNA, 17 bp, Homo sapiens
tatactatagtaccagt

SEQ ID NO: 3610355 - DNA, 20 bp, Homo sapiens
tatactatagtaccagtagg

SEQ ID NO: 3610356 - DNA, 18 bp, Homo sapiens
tatactgctctataaata

SEQ ID NO: 3610357 - DNA, 13 bp, Homo sapiens
tatactgtaggtg

SEQ ID NO: 3610358 - DNA, 18 bp, Homo sapiens
tatactgtaggtgttatg

SEQ ID NO: 3610359 - DNA, 12 bp, Homo sapiens
tatacttcaaaa

SEQ ID NO: 3610360 - DNA, 16 bp, Homo sapiens
tatacttgtaaaacca

SEQ ID NO: 3610361 - DNA, 16 bp, Homo sapiens
tatacttttctcaata

SEQ ID NO: 3610362 - DNA, 20 bp, Homo sapiens
tatagaactggattttcaga

SEQ ID NO: 3610363 - DNA, 17 bp, Homo sapiens
tatagacattctcacat

SEQ ID NO: 3610364 - DNA, 19 bp, Homo sapiens
tatagaccaattgaagcat

SEQ ID NO: 3610365 - DNA, 16 bp, Homo sapiens
tatagcatgaaataaa

SEQ ID NO: 3610366 - DNA, 18 bp, Homo sapiens
tatagctacatgttcttt

SEQ ID NO: 3610367 - DNA, 15 bp, Homo sapiens
tataggatcatttgt

SEQ ID NO: 3610368 - DNA, 15 bp, Homo sapiens
tataggcagttgcat

SEQ ID NO: 3610369 - DNA, 17 bp, Homo sapiens
tataggctattttctaa

SEQ ID NO: 3610370 - DNA, 23 bp, Homo sapiens
tataggtgctacaaaaacacagc

SEQ ID NO: 3610371 - DNA, 18 bp, Homo sapiens
tataggttttaaagacct

SEQ ID NO: 3610372 - DNA, 14 bp, Homo sapiens
tatagtacatgata

SEQ ID NO: 3610373 - DNA, 16 bp, Homo sapiens
tatagtacatgataaa

SEQ ID NO: 3610374 - DNA, 15 bp, Homo sapiens
tatagtatctgtata

SEQ ID NO: 3610375 - DNA, 15 bp, Homo sapiens
tatagttactgtgta

SEQ ID NO: 3610376 - DNA, 16 bp, Homo sapiens
tatagttactgtgtaa

SEQ ID NO: 3610377 - DNA, 16 bp, Homo sapiens
tatagttatatgtaca

SEQ ID NO: 3610378 - DNA, 17 bp, Homo sapiens
tatataaagtatatgtt

SEQ ID NO: 3610379 - DNA, 23 bp, Homo sapiens
tatataagagcatgaaattttta

SEQ ID NO: 3610380 - DNA, 12 bp, Homo sapiens
tatataagcttt

SEQ ID NO: 3610381 - DNA, 14 bp, Homo sapiens
tatataatgtatat

SEQ ID NO: 3610382 - DNA, 14 bp, Homo sapiens
tatatagaatgctg

SEQ ID NO: 3610383 - DNA, 18 bp, Homo sapiens
tatataggctattttcta

SEQ ID NO: 3610384 - DNA, 13 bp, Homo sapiens
tatatataatgta

SEQ ID NO: 3610385 - DNA, 15 bp, Homo sapiens
tatatatatatgcac

SEQ ID NO: 3610386 - DNA, 18 bp, Homo sapiens
tatatatgcacacatata

SEQ ID NO: 3610387 - DNA, 20 bp, Homo sapiens
tatatatgcacacatatata

SEQ ID NO: 3610388 - DNA, 15 bp, Homo sapiens
tatatattataagtt

SEQ ID NO: 3610389 - DNA, 23 bp, Homo sapiens
tatatcaggtgtataaatgtaca

SEQ ID NO: 3610390 - DNA, 16 bp, Homo sapiens
tatatctgttggagaa

SEQ ID NO: 3610391 - DNA, 19 bp, Homo sapiens
tatatgaggacttgtgtct

SEQ ID NO: 3610392 - DNA, 13 bp, Homo sapiens
tatatgatatgca

SEQ ID NO: 3610393 - DNA, 16 bp, Homo sapiens
tatatgatatgcatgt

SEQ ID NO: 3610394 - DNA, 17 bp, Homo sapiens
tatatgcacaaaactac

SEQ ID NO: 3610395 - DNA, 21 bp, Homo sapiens
tatatgcacaaaactactttt

SEQ ID NO: 3610396 - DNA, 16 bp, Homo sapiens
tatatgcctgattcat

SEQ ID NO: 3610397 - DNA, 19 bp, Homo sapiens
tatatgtaccgtaggcttt

SEQ ID NO: 3610398 - DNA, 11 bp, Homo sapiens
tatatgtattt

SEQ ID NO: 3610399 - DNA, 12 bp, Homo sapiens
tatatgtattta

SEQ ID NO: 3610400 - DNA, 14 bp, Homo sapiens
tatatgtatttaag

SEQ ID NO: 3610401 - DNA, 16 bp, Homo sapiens
tatatgtatttaagat

SEQ ID NO: 3610402 - DNA, 13 bp, Homo sapiens
tatattacaatga

SEQ ID NO: 3610403 - DNA, 18 bp, Homo sapiens
tatattataattggaagt

SEQ ID NO: 3610404 - DNA, 20 bp, Homo sapiens
tatattgcccaggctggtct

SEQ ID NO: 3610405 - DNA, 22 bp, Homo sapiens
tatattgtttttatatattata

SEQ ID NO: 3610406 - DNA, 16 bp, Homo sapiens
tatattgtttttgtat

SEQ ID NO: 3610407 - DNA, 23 bp, Homo sapiens
tatatttcaaacattttgtatca

SEQ ID NO: 3610408 - DNA, 21 bp, Homo sapiens
tatatttttaaaaaatgaaat

SEQ ID NO: 3610409 - DNA, 20 bp, Homo sapiens
tatatttttgtctgcagctg

SEQ ID NO: 3610410 - DNA, 14 bp, Homo sapiens
tatcaaactgctgt

SEQ ID NO: 3610411 - DNA, 16 bp, Homo sapiens
tatcaaggaaacgttt

SEQ ID NO: 3610412 - DNA, 22 bp, Homo sapiens
tatcacatgtcagccactgtga

SEQ ID NO: 3610413 - DNA, 14 bp, Homo sapiens
tatcagaaatacaa

SEQ ID NO: 3610414 - DNA, 21 bp, Homo sapiens
tatcagactcggaatctattt

SEQ ID NO: 3610415 - DNA, 21 bp, Homo sapiens
tatcagcaatgccccaaactt

SEQ ID NO: 3610416 - DNA, 14 bp, Homo sapiens
tatcagcacgtgtg

SEQ ID NO: 3610417 - DNA, 17 bp, Homo sapiens
tatcaggtgtataaatg

SEQ ID NO: 3610418 - DNA, 16 bp, Homo sapiens
tatcagtgtcctttcc

SEQ ID NO: 3610419 - DNA, 18 bp, Homo sapiens
tatcagtgtcctttccag

SEQ ID NO: 3610420 - DNA, 22 bp, Homo sapiens
tatcatgaatgtgagtcattat

SEQ ID NO: 3610421 - DNA, 18 bp, Homo sapiens
tatccactttgcacagct

SEQ ID NO: 3610422 - DNA, 19 bp, Homo sapiens
tatccaggttccctcccag

SEQ ID NO: 3610423 - DNA, 21 bp, Homo sapiens
tatccaggttggttttgctgt

SEQ ID NO: 3610424 - DNA, 23 bp, Homo sapiens
tatccatcagagatgactctgtc

SEQ ID NO: 3610425 - DNA, 22 bp, Homo sapiens
tatccctctcttccccttccct

SEQ ID NO: 3610426 - DNA, 19 bp, Homo sapiens
tatcccttggacattttat

SEQ ID NO: 3610427 - DNA, 20 bp, Homo sapiens
tatcctagtcattcttccct

SEQ ID NO: 3610428 - DNA, 12 bp, Homo sapiens
tatcctccaggt

SEQ ID NO: 3610429 - DNA, 20 bp, Homo sapiens
tatcctccaggtttttcaat

SEQ ID NO: 3610430 - DNA, 22 bp, Homo sapiens
tatcctccaggtttttcaatta

SEQ ID NO: 3610431 - DNA, 17 bp, Homo sapiens
tatcctgaaatttcaga

SEQ ID NO: 3610432 - DNA, 15 bp, Homo sapiens
tatccttacatttca

SEQ ID NO: 3610433 - DNA, 22 bp, Homo sapiens
tatctaccccagactagatgta

SEQ ID NO: 3610434 - DNA, 13 bp, Homo sapiens
tatctacttgtgt

SEQ ID NO: 3610435 - DNA, 22 bp, Homo sapiens
tatctacttttactcataagta

SEQ ID NO: 3610436 - DNA, 18 bp, Homo sapiens
tatctagtgacagaggag

SEQ ID NO: 3610437 - DNA, 14 bp, Homo sapiens
tatctataatttac

SEQ ID NO: 3610438 - DNA, 17 bp, Homo sapiens
tatctcaaaactgcact

SEQ ID NO: 3610439 - DNA, 17 bp, Homo sapiens
tatctcaagtaaaacaa

SEQ ID NO: 3610440 - DNA, 15 bp, Homo sapiens
tatctccaagaccag

SEQ ID NO: 3610441 - DNA, 16 bp, Homo sapiens
tatctccttgtggcct

SEQ ID NO: 3610442 - DNA, 21 bp, Homo sapiens
tatctccttgtggcctatgaa

SEQ ID NO: 3610443 - DNA, 14 bp, Homo sapiens
tatctcctttgaag

SEQ ID NO: 3610444 - DNA, 23 bp, Homo sapiens
tatctcctttgaagaaggcaagg

SEQ ID NO: 3610445 - DNA, 13 bp, Homo sapiens
tatctcttgccct

SEQ ID NO: 3610446 - DNA, 12 bp, Homo sapiens
tatctctttcca

SEQ ID NO: 3610447 - DNA, 17 bp, Homo sapiens
tatctgaaaggccagca

SEQ ID NO: 3610448 - DNA, 18 bp, Homo sapiens
tatctgaaaggccagcag

SEQ ID NO: 3610449 - DNA, 16 bp, Homo sapiens
tatctggcttccctgg

SEQ ID NO: 3610450 - DNA, 19 bp, Homo sapiens
tatctggcttccctggaag

SEQ ID NO: 3610451 - DNA, 20 bp, Homo sapiens
tatctgtgcttctaatatta

SEQ ID NO: 3610452 - DNA, 23 bp, Homo sapiens
tatcttataaagtggaagtatgt

SEQ ID NO: 3610453 - DNA, 16 bp, Homo sapiens
tatctttcacctttct

SEQ ID NO: 3610454 - DNA, 15 bp, Homo sapiens
tatctttgaatatgt

SEQ ID NO: 3610455 - DNA, 22 bp, Homo sapiens
tatgaaaatatagacattctca

SEQ ID NO: 3610456 - DNA, 17 bp, Homo sapiens
tatgaaacaatcttcca

SEQ ID NO: 3610457 - DNA, 15 bp, Homo sapiens
tatgaaactggttta

SEQ ID NO: 3610458 - DNA, 19 bp, Homo sapiens
tatgaagacagaggcagag

SEQ ID NO: 3610459 - DNA, 23 bp, Homo sapiens
tatgaagacagaggcagagattg

SEQ ID NO: 3610460 - DNA, 13 bp, Homo sapiens
tatgaatactttg

SEQ ID NO: 3610461 - DNA, 22 bp, Homo sapiens
tatgacagatatatttaagcct

SEQ ID NO: 3610462 - DNA, 16 bp, Homo sapiens
tatgactatgtaaact

SEQ ID NO: 3610463 - DNA, 16 bp, Homo sapiens
tatgagatggccatgc

SEQ ID NO: 3610464 - DNA, 19 bp, Homo sapiens
tatgagatggccatgctca

SEQ ID NO: 3610465 - DNA, 23 bp, Homo sapiens
tatgagctggggatgtctctcat

SEQ ID NO: 3610466 - DNA, 17 bp, Homo sapiens
tatgaggacaaggtata

SEQ ID NO: 3610467 - DNA, 17 bp, Homo sapiens
tatgagtacaaatgcct

SEQ ID NO: 3610468 - DNA, 12 bp, Homo sapiens
tatgatatgcat

SEQ ID NO: 3610469 - DNA, 22 bp, Homo sapiens
tatgatatgcatgtagcatata

SEQ ID NO: 3610470 - DNA, 22 bp, Homo sapiens
tatgatcttgagtataagaaat

SEQ ID NO: 3610471 - DNA, 13 bp, Homo sapiens
tatgatggatggc

SEQ ID NO: 3610472 - DNA, 12 bp, Homo sapiens
tatgattattaa

SEQ ID NO: 3610473 - DNA, 13 bp, Homo sapiens
tatgcaaaatgga

SEQ ID NO: 3610474 - DNA, 14 bp, Homo sapiens
tatgcaaagcactg

SEQ ID NO: 3610475 - DNA, 18 bp, Homo sapiens
tatgcaataatccacccc

SEQ ID NO: 3610476 - DNA, 13 bp, Homo sapiens
tatgcacaacaga

SEQ ID NO: 3610477 - DNA, 14 bp, Homo sapiens
tatgcagtgaacta

SEQ ID NO: 3610478 - DNA, 13 bp, Homo sapiens
tatgcagtgtttc

SEQ ID NO: 3610479 - DNA, 20 bp, Homo sapiens
tatgcatggtgccccaggac

SEQ ID NO: 3610480 - DNA, 23 bp, Homo sapiens
tatgcatggtgccccaggaccag

SEQ ID NO: 3610481 - DNA, 13 bp, Homo sapiens
tatgcatgtagca

SEQ ID NO: 3610482 - DNA, 14 bp, Homo sapiens
tatgcatgtagcat

SEQ ID NO: 3610483 - DNA, 23 bp, Homo sapiens
tatgccaccagcgaactctcaga

SEQ ID NO: 3610484 - DNA, 18 bp, Homo sapiens
tatgcctgattcatagta

SEQ ID NO: 3610485 - DNA, 13 bp, Homo sapiens
tatgctgtttcct

SEQ ID NO: 3610486 - DNA, 15 bp, Homo sapiens
tatgcttatacactt

SEQ ID NO: 3610487 - DNA, 20 bp, Homo sapiens
tatgcttgtaactaaaataa

SEQ ID NO: 3610488 - DNA, 16 bp, Homo sapiens
tatggaaacactgatt

SEQ ID NO: 3610489 - DNA, 23 bp, Homo sapiens
tatggaaacactgattttgtaaa

SEQ ID NO: 3610490 - DNA, 19 bp, Homo sapiens
tatggaagttgttgctata

SEQ ID NO: 3610491 - DNA, 14 bp, Homo sapiens
tatggagaacatgt

SEQ ID NO: 3610492 - DNA, 19 bp, Homo sapiens
tatggaggctttgcataga

SEQ ID NO: 3610493 - DNA, 21 bp, Homo sapiens
tatggagtgagtcacctgctc

SEQ ID NO: 3610494 - DNA, 23 bp, Homo sapiens
tatggagtgagtcacctgctcca

SEQ ID NO: 3610495 - DNA, 19 bp, Homo sapiens
tatggataatctgagcagg

SEQ ID NO: 3610496 - DNA, 15 bp, Homo sapiens
tatggatttgttaca

SEQ ID NO: 3610497 - DNA, 15 bp, Homo sapiens
tatggcaggactcct

SEQ ID NO: 3610498 - DNA, 16 bp, Homo sapiens
tatggccgggcagggt

SEQ ID NO: 3610499 - DNA, 13 bp, Homo sapiens
tatggctgcccag

SEQ ID NO: 3610500 - DNA, 14 bp, Homo sapiens
tatggctgcccagg

SEQ ID NO: 3610501 - DNA, 20 bp, Homo sapiens
tatgggatattcccaagccg

SEQ ID NO: 3610502 - DNA, 17 bp, Homo sapiens
tatggggatagatgtgt

SEQ ID NO: 3610503 - DNA, 17 bp, Homo sapiens
tatgggggatttcaaac

SEQ ID NO: 3610504 - DNA, 20 bp, Homo sapiens
tatgggtgggattttgcaaa

SEQ ID NO: 3610505 - DNA, 22 bp, Homo sapiens
tatggtatgtagccagctgtgc

SEQ ID NO: 3610506 - DNA, 15 bp, Homo sapiens
tatgtaacttcctgt

SEQ ID NO: 3610507 - DNA, 15 bp, Homo sapiens
tatgtagacaatata

SEQ ID NO: 3610508 - DNA, 14 bp, Homo sapiens
tatgtatatcttct

SEQ ID NO: 3610509 - DNA, 15 bp, Homo sapiens
tatgtcactagaatg

SEQ ID NO: 3610510 - DNA, 20 bp, Homo sapiens
tatgtgacatttctcttccc

SEQ ID NO: 3610511 - DNA, 19 bp, Homo sapiens
tatgtgacattttacatta

SEQ ID NO: 3610512 - DNA, 19 bp, Homo sapiens
tatgtgagctgtaaaaatg

SEQ ID NO: 3610513 - DNA, 23 bp, Homo sapiens
tatgtgagctgtaaaaatgttac

SEQ ID NO: 3610514 - DNA, 17 bp, Homo sapiens
tatgtgcctcccattca

SEQ ID NO: 3610515 - DNA, 20 bp, Homo sapiens
tatgtgggggtctgtgtgtt

SEQ ID NO: 3610516 - DNA, 15 bp, Homo sapiens
tatgtgtgtctattt

SEQ ID NO: 3610517 - DNA, 18 bp, Homo sapiens
tatgttatcatcctccct

SEQ ID NO: 3610518 - DNA, 15 bp, Homo sapiens
tatgttctctgaatg

SEQ ID NO: 3610519 - DNA, 16 bp, Homo sapiens
tatgttggtgtgaatt

SEQ ID NO: 3610520 - DNA, 17 bp, Homo sapiens
tattaaaaaagagacat

SEQ ID NO: 3610521 - DNA, 13 bp, Homo sapiens
tattaaaattgtt

SEQ ID NO: 3610522 - DNA, 12 bp, Homo sapiens
tattaaattatg

SEQ ID NO: 3610523 - DNA, 19 bp, Homo sapiens
tattaacatattatttcat

SEQ ID NO: 3610524 - DNA, 17 bp, Homo sapiens
tattaactgtattttct

SEQ ID NO: 3610525 - DNA, 21 bp, Homo sapiens
tattaactgtattttctttca

SEQ ID NO: 3610526 - DNA, 20 bp, Homo sapiens
tattaatcaagagaaacttc

SEQ ID NO: 3610527 - DNA, 20 bp, Homo sapiens
tattaatcatacaaactctc

SEQ ID NO: 3610528 - DNA, 15 bp, Homo sapiens
tattaattaaagaaa

SEQ ID NO: 3610529 - DNA, 14 bp, Homo sapiens
tattaattgctttg

SEQ ID NO: 3610530 - DNA, 13 bp, Homo sapiens
tattaatttgaaa

SEQ ID NO: 3610531 - DNA, 22 bp, Homo sapiens
tattaatttgaaaccaggacat

SEQ ID NO: 3610532 - DNA, 15 bp, Homo sapiens
tattacaatgatcac

SEQ ID NO: 3610533 - DNA, 19 bp, Homo sapiens
tattacagtgttggagaac

SEQ ID NO: 3610534 - DNA, 22 bp, Homo sapiens
tattacataaaggctaactatg

SEQ ID NO: 3610535 - DNA, 14 bp, Homo sapiens
tattactcagttta

SEQ ID NO: 3610536 - DNA, 23 bp, Homo sapiens
tattagccaactgtttccctgct

SEQ ID NO: 3610537 - DNA, 20 bp, Homo sapiens
tattataaaggataaagaag

SEQ ID NO: 3610538 - DNA, 12 bp, Homo sapiens
tattataagttg

SEQ ID NO: 3610539 - DNA, 23 bp, Homo sapiens
tattatattcattctttttgaaa

SEQ ID NO: 3610540 - DNA, 13 bp, Homo sapiens
tattatctgtcag

SEQ ID NO: 3610541 - DNA, 17 bp, Homo sapiens
tattattaatataataa

SEQ ID NO: 3610542 - DNA, 15 bp, Homo sapiens
tattattatctttaa

SEQ ID NO: 3610543 - DNA, 17 bp, Homo sapiens
tattatttcattggtct

SEQ ID NO: 3610544 - DNA, 23 bp, Homo sapiens
tattatttctccatcccctccct

SEQ ID NO: 3610545 - DNA, 14 bp, Homo sapiens
tattatttgtctta

SEQ ID NO: 3610546 - DNA, 19 bp, Homo sapiens
tattcaagcaaacatcaaa

SEQ ID NO: 3610547 - DNA, 15 bp, Homo sapiens
tattcagttcttaca

SEQ ID NO: 3610548 - DNA, 23 bp, Homo sapiens
tattcagttcttacacattccat

SEQ ID NO: 3610549 - DNA, 18 bp, Homo sapiens
tattcattctttttgaaa

SEQ ID NO: 3610550 - DNA, 18 bp, Homo sapiens
tattcattgtggtcatag

SEQ ID NO: 3610551 - DNA, 23 bp, Homo sapiens
tattccaactgggcatttcaatc

SEQ ID NO: 3610552 - DNA, 13 bp, Homo sapiens
tattcctccagct

SEQ ID NO: 3610553 - DNA, 14 bp, Homo sapiens
tattcctccagctg

SEQ ID NO: 3610554 - DNA, 17 bp, Homo sapiens
tattctattttacaact

SEQ ID NO: 3610555 - DNA, 12 bp, Homo sapiens
tattctccagac

SEQ ID NO: 3610556 - DNA, 16 bp, Homo sapiens
tattctgaaaaagaca

SEQ ID NO: 3610557 - DNA, 17 bp, Homo sapiens
tattctgaaaaagacat

SEQ ID NO: 3610558 - DNA, 18 bp, Homo sapiens
tattctgaaaaagacata

SEQ ID NO: 3610559 - DNA, 22 bp, Homo sapiens
tattctgtcagtgttaaagatt

SEQ ID NO: 3610560 - DNA, 22 bp, Homo sapiens
tattctgtgctgttacagtttt

SEQ ID NO: 3610561 - DNA, 15 bp, Homo sapiens
tattgaaaacttcaa

SEQ ID NO: 3610562 - DNA, 14 bp, Homo sapiens
tattgaaatgattt

SEQ ID NO: 3610563 - DNA, 14 bp, Homo sapiens
tattgaaggaattt

SEQ ID NO: 3610564 - DNA, 18 bp, Homo sapiens
tattgaatattttatatt

SEQ ID NO: 3610565 - DNA, 19 bp, Homo sapiens
tattgaattcatttcactg

SEQ ID NO: 3610566 - DNA, 22 bp, Homo sapiens
tattgcatttggattggggtcc

SEQ ID NO: 3610567 - DNA, 13 bp, Homo sapiens
tattgctgctgcc

SEQ ID NO: 3610568 - DNA, 13 bp, Homo sapiens
tattggcaaagtt

SEQ ID NO: 3610569 - DNA, 16 bp, Homo sapiens
tattgtatattacaat

SEQ ID NO: 3610570 - DNA, 19 bp, Homo sapiens
tattgtatattacaatgat

SEQ ID NO: 3610571 - DNA, 13 bp, Homo sapiens
tattgtattttga

SEQ ID NO: 3610572 - DNA, 18 bp, Homo sapiens
tattgtctgttttccttc

SEQ ID NO: 3610573 - DNA, 18 bp, Homo sapiens
tattgtgcatgctagtgt

SEQ ID NO: 3610574 - DNA, 16 bp, Homo sapiens
tattgttagaaaatga

SEQ ID NO: 3610575 - DNA, 15 bp, Homo sapiens
tattgttataaataa

SEQ ID NO: 3610576 - DNA, 18 bp, Homo sapiens
tattgttatattacttgc

SEQ ID NO: 3610577 - DNA, 20 bp, Homo sapiens
tattgtttgttgcactaaaa

SEQ ID NO: 3610578 - DNA, 17 bp, Homo sapiens
tattgttttacaatagt

SEQ ID NO: 3610579 - DNA, 20 bp, Homo sapiens
tattgttttacaatagttct

SEQ ID NO: 3610580 - DNA, 22 bp, Homo sapiens
tattgttttacaatagttctgt

SEQ ID NO: 3610581 - DNA, 17 bp, Homo sapiens
tatttaaaaaaaagaaa

SEQ ID NO: 3610582 - DNA, 24 bp, Homo sapiens
tatttaaactctgttgcaagtgca

SEQ ID NO: 3610583 - DNA, 18 bp, Homo sapiens
tatttaagacataaacaa

SEQ ID NO: 3610584 - DNA, 19 bp, Homo sapiens
tatttaagacataaacaaa

SEQ ID NO: 3610585 - DNA, 22 bp, Homo sapiens
tatttaagacataaacaaagac

SEQ ID NO: 3610586 - DNA, 14 bp, Homo sapiens
tatttaagactaaa

SEQ ID NO: 3610587 - DNA, 18 bp, Homo sapiens
tatttaagatgtacattt

SEQ ID NO: 3610588 - DNA, 15 bp, Homo sapiens
tatttaagcagcttg

SEQ ID NO: 3610589 - DNA, 17 bp, Homo sapiens
tatttaagccttataaa

SEQ ID NO: 3610590 - DNA, 21 bp, Homo sapiens
tatttaagccttataaaccaa

SEQ ID NO: 3610591 - DNA, 16 bp, Homo sapiens
tatttaatttgaagat

SEQ ID NO: 3610592 - DNA, 14 bp, Homo sapiens
tatttactacctta

SEQ ID NO: 3610593 - DNA, 14 bp, Homo sapiens
tatttactatttca

SEQ ID NO: 3610594 - DNA, 13 bp, Homo sapiens
tatttatatttca

SEQ ID NO: 3610595 - DNA, 13 bp, Homo sapiens
tatttatgccttg

SEQ ID NO: 3610596 - DNA, 19 bp, Homo sapiens
tatttatgccttgatgatt

SEQ ID NO: 3610597 - DNA, 20 bp, Homo sapiens
tatttattaaacttcagcaa

SEQ ID NO: 3610598 - DNA, 21 bp, Homo sapiens
tatttattaaacttcagcaac

SEQ ID NO: 3610599 - DNA, 14 bp, Homo sapiens
tatttattaatttg

SEQ ID NO: 3610600 - DNA, 15 bp, Homo sapiens
tatttattaatttga

SEQ ID NO: 3610601 - DNA, 16 bp, Homo sapiens
tatttattaatttgaa

SEQ ID NO: 3610602 - DNA, 12 bp, Homo sapiens
tatttattgaaa

SEQ ID NO: 3610603 - DNA, 22 bp, Homo sapiens
tatttattgaaatgatttcaca

SEQ ID NO: 3610604 - DNA, 14 bp, Homo sapiens
tatttatttaaatt

SEQ ID NO: 3610605 - DNA, 12 bp, Homo sapiens
tatttatttatt

SEQ ID NO: 3610606 - DNA, 14 bp, Homo sapiens
tatttatttattta

SEQ ID NO: 3610607 - DNA, 15 bp, Homo sapiens
tatttatttatttgt

SEQ ID NO: 3610608 - DNA, 12 bp, Homo sapiens
tatttatttcta

SEQ ID NO: 3610609 - DNA, 14 bp, Homo sapiens
tatttatttgaggt

SEQ ID NO: 3610610 - DNA, 20 bp, Homo sapiens
tatttatttgtttgttttag

SEQ ID NO: 3610611 - DNA, 22 bp, Homo sapiens
tatttcaataaatctttcaaaa

SEQ ID NO: 3610612 - DNA, 23 bp, Homo sapiens
tatttcaattgtttatatggata

SEQ ID NO: 3610613 - DNA, 23 bp, Homo sapiens
tatttcacatgagtcaaaacaaa

SEQ ID NO: 3610614 - DNA, 18 bp, Homo sapiens
tatttcagcaaacttgtt

SEQ ID NO: 3610615 - DNA, 14 bp, Homo sapiens
tatttctaagtatt

SEQ ID NO: 3610616 - DNA, 16 bp, Homo sapiens
tatttctaagtattta

SEQ ID NO: 3610617 - DNA, 23 bp, Homo sapiens
tatttctaagtatttaaatgttc

SEQ ID NO: 3610618 - DNA, 20 bp, Homo sapiens
tatttctacattacagccat

SEQ ID NO: 3610619 - DNA, 19 bp, Homo sapiens
tatttctcagctgtgcctt

SEQ ID NO: 3610620 - DNA, 18 bp, Homo sapiens
tatttctccatcccctcc

SEQ ID NO: 3610621 - DNA, 13 bp, Homo sapiens
tatttctgctctg

SEQ ID NO: 3610622 - DNA, 14 bp, Homo sapiens
tatttcttccctgc

SEQ ID NO: 3610623 - DNA, 18 bp, Homo sapiens
tatttcttgctgcttcta

SEQ ID NO: 3610624 - DNA, 21 bp, Homo sapiens
tatttgaaaaccatattttat

SEQ ID NO: 3610625 - DNA, 20 bp, Homo sapiens
tatttgaaaattacatgttt

SEQ ID NO: 3610626 - DNA, 18 bp, Homo sapiens
tatttgaggtcagtgttt

SEQ ID NO: 3610627 - DNA, 14 bp, Homo sapiens
tatttgcagaggct

SEQ ID NO: 3610628 - DNA, 17 bp, Homo sapiens
tatttgcctgtctgttt

SEQ ID NO: 3610629 - DNA, 20 bp, Homo sapiens
tatttgggggaactggacac

SEQ ID NO: 3610630 - DNA, 17 bp, Homo sapiens
tatttgtaaatttatgt

SEQ ID NO: 3610631 - DNA, 21 bp, Homo sapiens
tatttgtcaacagatttaaag

SEQ ID NO: 3610632 - DNA, 13 bp, Homo sapiens
tatttgtcttaaa

SEQ ID NO: 3610633 - DNA, 20 bp, Homo sapiens
tattttaattaaaattggta

SEQ ID NO: 3610634 - DNA, 16 bp, Homo sapiens
tattttacatgggcca

SEQ ID NO: 3610635 - DNA, 14 bp, Homo sapiens
tattttactgtctt

SEQ ID NO: 3610636 - DNA, 13 bp, Homo sapiens
tattttatgtgta

SEQ ID NO: 3610637 - DNA, 17 bp, Homo sapiens
tattttcagtgcatcat

SEQ ID NO: 3610638 - DNA, 16 bp, Homo sapiens
tattttcccctatcat

SEQ ID NO: 3610639 - DNA, 19 bp, Homo sapiens
tattttcccctatcattta

SEQ ID NO: 3610640 - DNA, 20 bp, Homo sapiens
tattttcccctatcatttat

SEQ ID NO: 3610641 - DNA, 21 bp, Homo sapiens
tattttcccctatcatttatt

SEQ ID NO: 3610642 - DNA, 12 bp, Homo sapiens
tattttctttca

SEQ ID NO: 3610643 - DNA, 13 bp, Homo sapiens
tattttctttcac

SEQ ID NO: 3610644 - DNA, 16 bp, Homo sapiens
tattttcttttgaatt

SEQ ID NO: 3610645 - DNA, 17 bp, Homo sapiens
tattttgaaatggaaat

SEQ ID NO: 3610646 - DNA, 12 bp, Homo sapiens
tattttgctaac

SEQ ID NO: 3610647 - DNA, 14 bp, Homo sapiens
tattttgctaactg

SEQ ID NO: 3610648 - DNA, 15 bp, Homo sapiens
tattttgctaactgg

SEQ ID NO: 3610649 - DNA, 19 bp, Homo sapiens
tattttgctaactggttaa

SEQ ID NO: 3610650 - DNA, 21 bp, Homo sapiens
tattttgtaaactcaaaatat

SEQ ID NO: 3610651 - DNA, 16 bp, Homo sapiens
tattttgtaataaact

SEQ ID NO: 3610652 - DNA, 17 bp, Homo sapiens
tattttgtaataaactc

SEQ ID NO: 3610653 - DNA, 21 bp, Homo sapiens
tattttgtaataaactctcta

SEQ ID NO: 3610654 - DNA, 18 bp, Homo sapiens
tatttttaagaaagaaat

SEQ ID NO: 3610655 - DNA, 12 bp, Homo sapiens
tatttttacagc

SEQ ID NO: 3610656 - DNA, 12 bp, Homo sapiens
tatttttataca

SEQ ID NO: 3610657 - DNA, 14 bp, Homo sapiens
tatttttatacact

SEQ ID NO: 3610658 - DNA, 17 bp, Homo sapiens
tatttttatacactgta

SEQ ID NO: 3610659 - DNA, 18 bp, Homo sapiens
tatttttatacactgtaa

SEQ ID NO: 3610660 - DNA, 19 bp, Homo sapiens
tatttttatttctgactct

SEQ ID NO: 3610661 - DNA, 16 bp, Homo sapiens
tatttttcatcctaaa

SEQ ID NO: 3610662 - DNA, 19 bp, Homo sapiens
tatttttccagctccgtgt

SEQ ID NO: 3610663 - DNA, 14 bp, Homo sapiens
tatttttgaaaaat

SEQ ID NO: 3610664 - DNA, 16 bp, Homo sapiens
tatttttgtattttac

SEQ ID NO: 3610665 - DNA, 15 bp, Homo sapiens
tatttttgtctgcag

SEQ ID NO: 3610666 - DNA, 14 bp, Homo sapiens
tatttttgtggaca

SEQ ID NO: 3610667 - DNA, 21 bp, Homo sapiens
tattttttaaaaaatttgcgc

SEQ ID NO: 3610668 - DNA, 16 bp, Homo sapiens
tattttttatgttgta

SEQ ID NO: 3610669 - DNA, 21 bp, Homo sapiens
tattttttatttctaagtatt

SEQ ID NO: 3610670 - DNA, 17 bp, Homo sapiens
tattttttgtataattg

SEQ ID NO: 3610671 - DNA, 12 bp, Homo sapiens
tcaaaaagccac

SEQ ID NO: 3610672 - DNA, 20 bp, Homo sapiens
tcaaaaattatctatagcta

SEQ ID NO: 3610673 - DNA, 12 bp, Homo sapiens
tcaaaacaaaac

SEQ ID NO: 3610674 - DNA, 16 bp, Homo sapiens
tcaaaacgggtcagta

SEQ ID NO: 3610675 - DNA, 16 bp, Homo sapiens
tcaaaactttcgttgt

SEQ ID NO: 3610676 - DNA, 21 bp, Homo sapiens
tcaaaataccatgccatttaa

SEQ ID NO: 3610677 - DNA, 15 bp, Homo sapiens
tcaaaatattactca

SEQ ID NO: 3610678 - DNA, 16 bp, Homo sapiens
tcaaaatatttgtaca

SEQ ID NO: 3610679 - DNA, 18 bp, Homo sapiens
tcaaaatatttgtacata

SEQ ID NO: 3610680 - DNA, 19 bp, Homo sapiens
tcaaaatatttgtacatag

SEQ ID NO: 3610681 - DNA, 12 bp, Homo sapiens
tcaaaattgctt

SEQ ID NO: 3610682 - DNA, 18 bp, Homo sapiens
tcaaaattgcttctaaaa

SEQ ID NO: 3610683 - DNA, 20 bp, Homo sapiens
tcaaacagtctcaggaaatc

SEQ ID NO: 3610684 - DNA, 20 bp, Homo sapiens
tcaaacattcgtgagctggg

SEQ ID NO: 3610685 - DNA, 22 bp, Homo sapiens
tcaaacattcgtgagctgggga

SEQ ID NO: 3610686 - DNA, 21 bp, Homo sapiens
tcaaacattttgtatcaagga

SEQ ID NO: 3610687 - DNA, 21 bp, Homo sapiens
tcaaacccagagggttgctgg

SEQ ID NO: 3610688 - DNA, 23 bp, Homo sapiens
tcaaaccccgaccacctgcccaa

SEQ ID NO: 3610689 - DNA, 17 bp, Homo sapiens
tcaaactatctggccat

SEQ ID NO: 3610690 - DNA, 16 bp, Homo sapiens
tcaaactgcacatcta

SEQ ID NO: 3610691 - DNA, 17 bp, Homo sapiens
tcaaacttaaacaaaaa

SEQ ID NO: 3610692 - DNA, 18 bp, Homo sapiens
tcaaacttaaacaaaaaa

SEQ ID NO: 3610693 - DNA, 14 bp, Homo sapiens
tcaaagagaagatg

SEQ ID NO: 3610694 - DNA, 17 bp, Homo sapiens
tcaaagagaagatgcct

SEQ ID NO: 3610695 - DNA, 19 bp, Homo sapiens
tcaaagagaagatgcctgt

SEQ ID NO: 3610696 - DNA, 15 bp, Homo sapiens
tcaaagccacactct

SEQ ID NO: 3610697 - DNA, 15 bp, Homo sapiens
tcaaagctttttcca

SEQ ID NO: 3610698 - DNA, 16 bp, Homo sapiens
tcaaagctttttccag

SEQ ID NO: 3610699 - DNA, 23 bp, Homo sapiens
tcaaagtaaggctggtaagagaa

SEQ ID NO: 3610700 - DNA, 18 bp, Homo sapiens
tcaaagtcattaaagaca

SEQ ID NO: 3610701 - DNA, 16 bp, Homo sapiens
tcaaagtgcctgggct

SEQ ID NO: 3610702 - DNA, 23 bp, Homo sapiens
tcaaagtgcctgggctcagcctg

SEQ ID NO: 3610703 - DNA, 21 bp, Homo sapiens
tcaaagtgttgctgtggctcc

SEQ ID NO: 3610704 - DNA, 22 bp, Homo sapiens
tcaaagtgttgctgtggctcca

SEQ ID NO: 3610705 - DNA, 14 bp, Homo sapiens
tcaaataaatttct

SEQ ID NO: 3610706 - DNA, 21 bp, Homo sapiens
tcaaatatgagtacaaatgcc

SEQ ID NO: 3610707 - DNA, 18 bp, Homo sapiens
tcaaatatgcaaagcact

SEQ ID NO: 3610708 - DNA, 11 bp, Homo sapiens
tcaaatccagt

SEQ ID NO: 3610709 - DNA, 13 bp, Homo sapiens
tcaaatccagtgg

SEQ ID NO: 3610710 - DNA, 14 bp, Homo sapiens
tcaaatccagtggt

SEQ ID NO: 3610711 - DNA, 18 bp, Homo sapiens
tcaaatccagtggtgggt

SEQ ID NO: 3610712 - DNA, 22 bp, Homo sapiens
tcaaatccagtggtgggtaatt

SEQ ID NO: 3610713 - DNA, 17 bp, Homo sapiens
tcaaatctagaagatgc

SEQ ID NO: 3610714 - DNA, 22 bp, Homo sapiens
tcaaatctgcttcatccaatgt

SEQ ID NO: 3610715 - DNA, 23 bp, Homo sapiens
tcaaatcttggcaatattcctta

SEQ ID NO: 3610716 - DNA, 18 bp, Homo sapiens
tcaaatggggccagatcc

SEQ ID NO: 3610717 - DNA, 15 bp, Homo sapiens
tcaaattctgtctgg

SEQ ID NO: 3610718 - DNA, 20 bp, Homo sapiens
tcaaattgtcagcaatttaa

SEQ ID NO: 3610719 - DNA, 15 bp, Homo sapiens
tcaacagatttaaag

SEQ ID NO: 3610720 - DNA, 16 bp, Homo sapiens
tcaacagatttaaaga

SEQ ID NO: 3610721 - DNA, 21 bp, Homo sapiens
tcaacagccaagctggcacaa

SEQ ID NO: 3610722 - DNA, 16 bp, Homo sapiens
tcaacatttctcatgt

SEQ ID NO: 3610723 - DNA, 13 bp, Homo sapiens
tcaaccagataac

SEQ ID NO: 3610724 - DNA, 12 bp, Homo sapiens
tcaacccccctc

SEQ ID NO: 3610725 - DNA, 17 bp, Homo sapiens
tcaaccggaaggaggcc

SEQ ID NO: 3610726 - DNA, 20 bp, Homo sapiens
tcaactcccaacttcttcct

SEQ ID NO: 3610727 - DNA, 18 bp, Homo sapiens
tcaactccctcctttagt

SEQ ID NO: 3610728 - DNA, 19 bp, Homo sapiens
tcaactgccaaaatgctct

SEQ ID NO: 3610729 - DNA, 16 bp, Homo sapiens
tcaactggttgtatat

SEQ ID NO: 3610730 - DNA, 17 bp, Homo sapiens
tcaagaaactgaggaat

SEQ ID NO: 3610731 - DNA, 20 bp, Homo sapiens
tcaagaaactgaggaatttt

SEQ ID NO: 3610732 - DNA, 19 bp, Homo sapiens
tcaagaatagcattgtaaa

SEQ ID NO: 3610733 - DNA, 16 bp, Homo sapiens
tcaagacaagagctgt

SEQ ID NO: 3610734 - DNA, 18 bp, Homo sapiens
tcaagacaagagctgtta

SEQ ID NO: 3610735 - DNA, 11 bp, Homo sapiens
tcaagagaaac

SEQ ID NO: 3610736 - DNA, 17 bp, Homo sapiens
tcaagagcatgcacatg

SEQ ID NO: 3610737 - DNA, 21 bp, Homo sapiens
tcaagagggcactggtggccc

SEQ ID NO: 3610738 - DNA, 14 bp, Homo sapiens
tcaagcaaacatca

SEQ ID NO: 3610739 - DNA, 13 bp, Homo sapiens
tcaagctcctcct

SEQ ID NO: 3610740 - DNA, 19 bp, Homo sapiens
tcaaggaatttcttaactt

SEQ ID NO: 3610741 - DNA, 21 bp, Homo sapiens
tcaaggaatttcttaacttct

SEQ ID NO: 3610742 - DNA, 13 bp, Homo sapiens
tcaaggataaata

SEQ ID NO: 3610743 - DNA, 14 bp, Homo sapiens
tcaaggataaatat

SEQ ID NO: 3610744 - DNA, 18 bp, Homo sapiens
tcaagggctggcactttt

SEQ ID NO: 3610745 - DNA, 14 bp, Homo sapiens
tcaagtaaaacaaa

SEQ ID NO: 3610746 - DNA, 18 bp, Homo sapiens
tcaagtaaaacaaatgaa

SEQ ID NO: 3610747 - DNA, 21 bp, Homo sapiens
tcaagtaaaagaaaagccgaa

SEQ ID NO: 3610748 - DNA, 19 bp, Homo sapiens
tcaagtacccattctgttt

SEQ ID NO: 3610749 - DNA, 19 bp, Homo sapiens
tcaagtattaagcagttca

SEQ ID NO: 3610750 - DNA, 15 bp, Homo sapiens
tcaagtcactcccaa

SEQ ID NO: 3610751 - DNA, 15 bp, Homo sapiens
tcaagtttgctgcaa

SEQ ID NO: 3610752 - DNA, 15 bp, Homo sapiens
tcaataaatctttca

SEQ ID NO: 3610753 - DNA, 17 bp, Homo sapiens
tcaataaatctttcaaa

SEQ ID NO: 3610754 - DNA, 21 bp, Homo sapiens
tcaatacacacacacagacat

SEQ ID NO: 3610755 - DNA, 23 bp, Homo sapiens
tcaatagcccaggatatatttta

SEQ ID NO: 3610756 - DNA, 15 bp, Homo sapiens
tcaatatatttgtat

SEQ ID NO: 3610757 - DNA, 16 bp, Homo sapiens
tcaatatcctttgcct

SEQ ID NO: 3610758 - DNA, 12 bp, Homo sapiens
tcaatatgcaag

SEQ ID NO: 3610759 - DNA, 20 bp, Homo sapiens
tcaatatgcaagcagctttt

SEQ ID NO: 3610760 - DNA, 19 bp, Homo sapiens
tcaatctctgggggctgag

SEQ ID NO: 3610761 - DNA, 14 bp, Homo sapiens
tcaatgagagcata

SEQ ID NO: 3610762 - DNA, 14 bp, Homo sapiens
tcaatggaagaaat

SEQ ID NO: 3610763 - DNA, 20 bp, Homo sapiens
tcaatgtacttgtttgaata

SEQ ID NO: 3610764 - DNA, 11 bp, Homo sapiens
tcaattaaacg

SEQ ID NO: 3610765 - DNA, 13 bp, Homo sapiens
tcaattaaacgga

SEQ ID NO: 3610766 - DNA, 14 bp, Homo sapiens
tcaattaaacggat

SEQ ID NO: 3610767 - DNA, 18 bp, Homo sapiens
tcaattaaacggattatt

SEQ ID NO: 3610768 - DNA, 20 bp, Homo sapiens
tcaattaaacggattatttt

SEQ ID NO: 3610769 - DNA, 16 bp, Homo sapiens
tcaattgtttatatgg

SEQ ID NO: 3610770 - DNA, 22 bp, Homo sapiens
tcaatttctagtacctgtgact

SEQ ID NO: 3610771 - DNA, 21 bp, Homo sapiens
tcaattttatccctcacctgt

SEQ ID NO: 3610772 - DNA, 20 bp, Homo sapiens
tcaatttttcttatttcatt

SEQ ID NO: 3610773 - DNA, 15 bp, Homo sapiens
tcaattttttttccg

SEQ ID NO: 3610774 - DNA, 21 bp, Homo sapiens
tcacaacagattattacctta

SEQ ID NO: 3610775 - DNA, 14 bp, Homo sapiens
tcacaaggcccagg

SEQ ID NO: 3610776 - DNA, 17 bp, Homo sapiens
tcacaaggcccaggaga

SEQ ID NO: 3610777 - DNA, 18 bp, Homo sapiens
tcacaagttctatttctt

SEQ ID NO: 3610778 - DNA, 18 bp, Homo sapiens
tcacaatgagtttgggca

SEQ ID NO: 3610779 - DNA, 14 bp, Homo sapiens
tcacacagacacta

SEQ ID NO: 3610780 - DNA, 21 bp, Homo sapiens
tcacacagtagctccaacact

SEQ ID NO: 3610781 - DNA, 17 bp, Homo sapiens
tcacacattacaacagt

SEQ ID NO: 3610782 - DNA, 18 bp, Homo sapiens
tcacactaagagggcaga

SEQ ID NO: 3610783 - DNA, 13 bp, Homo sapiens
tcacactgcaagg

SEQ ID NO: 3610784 - DNA, 24 bp, Homo sapiens
tcacactggatccatcttgagcca

SEQ ID NO: 3610785 - DNA, 21 bp, Homo sapiens
tcacactggcgtctggactgt

SEQ ID NO: 3610786 - DNA, 16 bp, Homo sapiens
tcacactggtaaatgt

SEQ ID NO: 3610787 - DNA, 16 bp, Homo sapiens
tcacactgtcttctga

SEQ ID NO: 3610788 - DNA, 15 bp, Homo sapiens
tcacagacatataga

SEQ ID NO: 3610789 - DNA, 17 bp, Homo sapiens
tcacagatgcatataga

SEQ ID NO: 3610790 - DNA, 23 bp, Homo sapiens
tcacagccagactggcacagttt

SEQ ID NO: 3610791 - DNA, 20 bp, Homo sapiens
tcacagcctcaagtcactcc

SEQ ID NO: 3610792 - DNA, 16 bp, Homo sapiens
tcacagctactcagtg

SEQ ID NO: 3610793 - DNA, 18 bp, Homo sapiens
tcacaggactctgcctcc

SEQ ID NO: 3610794 - DNA, 23 bp, Homo sapiens
tcacaggactctgcctcctcttc

SEQ ID NO: 3610795 - DNA, 19 bp, Homo sapiens
tcacaggccccaggaaagg

SEQ ID NO: 3610796 - DNA, 15 bp, Homo sapiens
tcacaggctgagaac

SEQ ID NO: 3610797 - DNA, 17 bp, Homo sapiens
tcacaggttttcagaga

SEQ ID NO: 3610798 - DNA, 19 bp, Homo sapiens
tcacaggttttcagagaat

SEQ ID NO: 3610799 - DNA, 21 bp, Homo sapiens
tcacaggttttcagagaatta

SEQ ID NO: 3610800 - DNA, 20 bp, Homo sapiens
tcacagtgctcttttctcct

SEQ ID NO: 3610801 - DNA, 16 bp, Homo sapiens
tcacagtgtgtggtca

SEQ ID NO: 3610802 - DNA, 17 bp, Homo sapiens
tcacagtgtgtggtcaa

SEQ ID NO: 3610803 - DNA, 19 bp, Homo sapiens
tcacagttctttgggccag

SEQ ID NO: 3610804 - DNA, 20 bp, Homo sapiens
tcacagttctttgggccaga

SEQ ID NO: 3610805 - DNA, 22 bp, Homo sapiens
tcacagttctttgggccagaca

SEQ ID NO: 3610806 - DNA, 14 bp, Homo sapiens
tcacatatctgctt

SEQ ID NO: 3610807 - DNA, 19 bp, Homo sapiens
tcacatgagtcaaaacaaa

SEQ ID NO: 3610808 - DNA, 16 bp, Homo sapiens
tcacatggtttacatc

SEQ ID NO: 3610809 - DNA, 23 bp, Homo sapiens
tcacatgtcagccactgtgatag

SEQ ID NO: 3610810 - DNA, 22 bp, Homo sapiens
tcacatgtttaactttaaggat

SEQ ID NO: 3610811 - DNA, 15 bp, Homo sapiens
tcacattaggctgtt

SEQ ID NO: 3610812 - DNA, 11 bp, Homo sapiens
tcacatttaaa

SEQ ID NO: 3610813 - DNA, 13 bp, Homo sapiens
tcaccacagcctt

SEQ ID NO: 3610814 - DNA, 20 bp, Homo sapiens
tcaccactaccagccagcct

SEQ ID NO: 3610815 - DNA, 15 bp, Homo sapiens
tcaccagacggggct

SEQ ID NO: 3610816 - DNA, 15 bp, Homo sapiens
tcaccagatttgcta

SEQ ID NO: 3610817 - DNA, 17 bp, Homo sapiens
tcaccaggggaggagcc

SEQ ID NO: 3610818 - DNA, 19 bp, Homo sapiens
tcaccaggggaggagcctg

SEQ ID NO: 3610819 - DNA, 13 bp, Homo sapiens
tcaccagtgttcc

SEQ ID NO: 3610820 - DNA, 15 bp, Homo sapiens
tcaccagtgttcctg

SEQ ID NO: 3610821 - DNA, 20 bp, Homo sapiens
tcaccagttaaaagcatttt

SEQ ID NO: 3610822 - DNA, 21 bp, Homo sapiens
tcaccagttaaaagcatttta

SEQ ID NO: 3610823 - DNA, 13 bp, Homo sapiens
tcaccatctttgt

SEQ ID NO: 3610824 - DNA, 19 bp, Homo sapiens
tcaccatctttgtcaaact

SEQ ID NO: 3610825 - DNA, 15 bp, Homo sapiens
tcaccatttcctcct

SEQ ID NO: 3610826 - DNA, 14 bp, Homo sapiens
tcaccgcaggtgct

SEQ ID NO: 3610827 - DNA, 17 bp, Homo sapiens
tcacctaggggaggagg

SEQ ID NO: 3610828 - DNA, 20 bp, Homo sapiens
tcacctccaagcatttcatg

SEQ ID NO: 3610829 - DNA, 22 bp, Homo sapiens
tcacctcggagggatggagaaa

SEQ ID NO: 3610830 - DNA, 17 bp, Homo sapiens
tcacctcttaaagaaaa

SEQ ID NO: 3610831 - DNA, 16 bp, Homo sapiens
tcacctgctccagaag

SEQ ID NO: 3610832 - DNA, 21 bp, Homo sapiens
tcacctgctccagaagatgcc

SEQ ID NO: 3610833 - DNA, 22 bp, Homo sapiens
tcacctgttcatttgaagaaaa

SEQ ID NO: 3610834 - DNA, 16 bp, Homo sapiens
tcacgagatttgccag

SEQ ID NO: 3610835 - DNA, 16 bp, Homo sapiens
tcacgatcacaggcct

SEQ ID NO: 3610836 - DNA, 18 bp, Homo sapiens
tcacgccttggcctccca

SEQ ID NO: 3610837 - DNA, 22 bp, Homo sapiens
tcactaatttggctttcacatt

SEQ ID NO: 3610838 - DNA, 14 bp, Homo sapiens
tcactagaatggat

SEQ ID NO: 3610839 - DNA, 21 bp, Homo sapiens
tcactcaccactaccagccag

SEQ ID NO: 3610840 - DNA, 17 bp, Homo sapiens
tcactccccagggagct

SEQ ID NO: 3610841 - DNA, 20 bp, Homo sapiens
tcactctacttagcatgtcc

SEQ ID NO: 3610842 - DNA, 15 bp, Homo sapiens
tcactctgggcctgg

SEQ ID NO: 3610843 - DNA, 18 bp, Homo sapiens
tcactctgtccctgtcct

SEQ ID NO: 3610844 - DNA, 23 bp, Homo sapiens
tcactctgtccctgtccttccct

SEQ ID NO: 3610845 - DNA, 17 bp, Homo sapiens
tcactgaactccaccga

SEQ ID NO: 3610846 - DNA, 23 bp, Homo sapiens
tcactgcaaacacaccttggaga

SEQ ID NO: 3610847 - DNA, 14 bp, Homo sapiens
tcactgcaacctcc

SEQ ID NO: 3610848 - DNA, 18 bp, Homo sapiens
tcactgcaacctccgcct

SEQ ID NO: 3610849 - DNA, 17 bp, Homo sapiens
tcactgcaacttctgcc

SEQ ID NO: 3610850 - DNA, 15 bp, Homo sapiens
tcactgcacagtgca

SEQ ID NO: 3610851 - DNA, 24 bp, Homo sapiens
tcactgcacagtgcatctcagccc

SEQ ID NO: 3610852 - DNA, 20 bp, Homo sapiens
tcactgcagcctcaacctcc

SEQ ID NO: 3610853 - DNA, 22 bp, Homo sapiens
tcactgcagcctcaacctcctg

SEQ ID NO: 3610854 - DNA, 17 bp, Homo sapiens
tcactgcattattctct

SEQ ID NO: 3610855 - DNA, 18 bp, Homo sapiens
tcactgcattattctctt

SEQ ID NO: 3610856 - DNA, 23 bp, Homo sapiens
tcactgccatggaattccctcct

SEQ ID NO: 3610857 - DNA, 14 bp, Homo sapiens
tcactgctggctgc

SEQ ID NO: 3610858 - DNA, 17 bp, Homo sapiens
tcactgctggctgcctt

SEQ ID NO: 3610859 - DNA, 22 bp, Homo sapiens
tcactgctggctgccttagaac

SEQ ID NO: 3610860 - DNA, 22 bp, Homo sapiens
tcactgctgttatatttcatca

SEQ ID NO: 3610861 - DNA, 23 bp, Homo sapiens
tcactgggaagctcccaccccac

SEQ ID NO: 3610862 - DNA, 18 bp, Homo sapiens
tcactggtagaccaaaat

SEQ ID NO: 3610863 - DNA, 20 bp, Homo sapiens
tcactggtagaccaaaataa

SEQ ID NO: 3610864 - DNA, 18 bp, Homo sapiens
tcacttactattgttgct

SEQ ID NO: 3610865 - DNA, 13 bp, Homo sapiens
tcacttatacctg

SEQ ID NO: 3610866 - DNA, 20 bp, Homo sapiens
tcacttattattaataatga

SEQ ID NO: 3610867 - DNA, 20 bp, Homo sapiens
tcacttatttagattcactt

SEQ ID NO: 3610868 - DNA, 22 bp, Homo sapiens
tcacttgaggccagtgagctgt

SEQ ID NO: 3610869 - DNA, 17 bp, Homo sapiens
tcacttgtacaaaataa

SEQ ID NO: 3610870 - DNA, 18 bp, Homo sapiens
tcactttcctcagttgat

SEQ ID NO: 3610871 - DNA, 13 bp, Homo sapiens
tcactttttctga

SEQ ID NO: 3610872 - DNA, 14 bp, Homo sapiens
tcactttttctgat

SEQ ID NO: 3610873 - DNA, 16 bp, Homo sapiens
tcactttttgaggcaa

SEQ ID NO: 3610874 - DNA, 17 bp, Homo sapiens
tcagaaaattccctggg

SEQ ID NO: 3610875 - DNA, 19 bp, Homo sapiens
tcagaaaattccctggggt

SEQ ID NO: 3610876 - DNA, 17 bp, Homo sapiens
tcagaaataaatcacag

SEQ ID NO: 3610877 - DNA, 21 bp, Homo sapiens
tcagaaataaatcacagatgc

SEQ ID NO: 3610878 - DNA, 16 bp, Homo sapiens
tcagaaatacaaaaaa

SEQ ID NO: 3610879 - DNA, 15 bp, Homo sapiens
tcagaacaaaacttc

SEQ ID NO: 3610880 - DNA, 20 bp, Homo sapiens
tcagaacagatgctgagcca

SEQ ID NO: 3610881 - DNA, 15 bp, Homo sapiens
tcagaacatgaaatg

SEQ ID NO: 3610882 - DNA, 17 bp, Homo sapiens
tcagaacattcagctct

SEQ ID NO: 3610883 - DNA, 22 bp, Homo sapiens
tcagaacattcagctctggaga

SEQ ID NO: 3610884 - DNA, 15 bp, Homo sapiens
tcagaactcttcctc

SEQ ID NO: 3610885 - DNA, 23 bp, Homo sapiens
tcagaagaacatgattttacaag

SEQ ID NO: 3610886 - DNA, 19 bp, Homo sapiens
tcagaaggccccagagaga

SEQ ID NO: 3610887 - DNA, 15 bp, Homo sapiens
tcagaagtctttcag

SEQ ID NO: 3610888 - DNA, 19 bp, Homo sapiens
tcagaagtttctcagctcc

SEQ ID NO: 3610889 - DNA, 21 bp, Homo sapiens
tcagaatggcagtcctggagg

SEQ ID NO: 3610890 - DNA, 18 bp, Homo sapiens
tcagacagaacccctaca

SEQ ID NO: 3610891 - DNA, 17 bp, Homo sapiens
tcagacatttctttgga

SEQ ID NO: 3610892 - DNA, 19 bp, Homo sapiens
tcagacatttctttggaaa

SEQ ID NO: 3610893 - DNA, 22 bp, Homo sapiens
tcagaccccctcagccttggga

SEQ ID NO: 3610894 - DNA, 18 bp, Homo sapiens
tcagactaaaaatacacc

SEQ ID NO: 3610895 - DNA, 15 bp, Homo sapiens
tcagactcaagtacc

SEQ ID NO: 3610896 - DNA, 21 bp, Homo sapiens
tcagactcaagtacccattct

SEQ ID NO: 3610897 - DNA, 22 bp, Homo sapiens
tcagactcccattcctgaagaa

SEQ ID NO: 3610898 - DNA, 16 bp, Homo sapiens
tcagactgatagacac

SEQ ID NO: 3610899 - DNA, 21 bp, Homo sapiens
tcagactgggcactggggcct

SEQ ID NO: 3610900 - DNA, 14 bp, Homo sapiens
tcagagaaaggact

SEQ ID NO: 3610901 - DNA, 17 bp, Homo sapiens
tcagagaaatgtctgtc

SEQ ID NO: 3610902 - DNA, 20 bp, Homo sapiens
tcagagaattatctcaagta

SEQ ID NO: 3610903 - DNA, 13 bp, Homo sapiens
tcagagaatttct

SEQ ID NO: 3610904 - DNA, 23 bp, Homo sapiens
tcagagaatttctaccatttcag

SEQ ID NO: 3610905 - DNA, 16 bp, Homo sapiens
tcagagaggccttttg

SEQ ID NO: 3610906 - DNA, 23 bp, Homo sapiens
tcagagaggtagcactctcagag

SEQ ID NO: 3610907 - DNA, 21 bp, Homo sapiens
tcagagccacccctaaagaga

SEQ ID NO: 3610908 - DNA, 15 bp, Homo sapiens
tcagagccagcctgg

SEQ ID NO: 3610909 - DNA, 18 bp, Homo sapiens
tcagaggcctgctgccag

SEQ ID NO: 3610910 - DNA, 14 bp, Homo sapiens
tcagatccagggac

SEQ ID NO: 3610911 - DNA, 14 bp, Homo sapiens
tcagattcccagag

SEQ ID NO: 3610912 - DNA, 16 bp, Homo sapiens
tcagatttctgaggaa

SEQ ID NO: 3610913 - DNA, 12 bp, Homo sapiens
tcagatttgaac

SEQ ID NO: 3610914 - DNA, 14 bp, Homo sapiens
tcagattttttcct

SEQ ID NO: 3610915 - DNA, 21 bp, Homo sapiens
tcagcaaccctacagtatata

SEQ ID NO: 3610916 - DNA, 18 bp, Homo sapiens
tcagcaatgccccaaact

SEQ ID NO: 3610917 - DNA, 19 bp, Homo sapiens
tcagcaatttaactagaca

SEQ ID NO: 3610918 - DNA, 15 bp, Homo sapiens
tcagcacccctccag

SEQ ID NO: 3610919 - DNA, 20 bp, Homo sapiens
tcagcacttaactatgagcc

SEQ ID NO: 3610920 - DNA, 18 bp, Homo sapiens
tcagcagagtgagggggt

SEQ ID NO: 3610921 - DNA, 14 bp, Homo sapiens
tcagcagctagaaa

SEQ ID NO: 3610922 - DNA, 17 bp, Homo sapiens
tcagcagtctaaatttt

SEQ ID NO: 3610923 - DNA, 12 bp, Homo sapiens
tcagcatccagt

SEQ ID NO: 3610924 - DNA, 16 bp, Homo sapiens
tcagcatccagtgtga

SEQ ID NO: 3610925 - DNA, 19 bp, Homo sapiens
tcagcatccagtgtgagat

SEQ ID NO: 3610926 - DNA, 13 bp, Homo sapiens
tcagccacctggg

SEQ ID NO: 3610927 - DNA, 14 bp, Homo sapiens
tcagccacctggga

SEQ ID NO: 3610928 - DNA, 14 bp, Homo sapiens
tcagccaggtctga

SEQ ID NO: 3610929 - DNA, 17 bp, Homo sapiens
tcagccccacaggactt

SEQ ID NO: 3610930 - DNA, 13 bp, Homo sapiens
tcagccctccctg

SEQ ID NO: 3610931 - DNA, 14 bp, Homo sapiens
tcagccctccctgc

SEQ ID NO: 3610932 - DNA, 17 bp, Homo sapiens
tcagccctccctgcccc

SEQ ID NO: 3610933 - DNA, 19 bp, Homo sapiens
tcagccctggcctggctgg

SEQ ID NO: 3610934 - DNA, 23 bp, Homo sapiens
tcagcctaccgctggccctgccg

SEQ ID NO: 3610935 - DNA, 19 bp, Homo sapiens
tcagcctcctcatctgggg

SEQ ID NO: 3610936 - DNA, 13 bp, Homo sapiens
tcagcctcctgag

SEQ ID NO: 3610937 - DNA, 15 bp, Homo sapiens
tcagcctcctgggta

SEQ ID NO: 3610938 - DNA, 18 bp, Homo sapiens
tcagcctgctttcctgca

SEQ ID NO: 3610939 - DNA, 11 bp, Homo sapiens
tcagcctggaa

SEQ ID NO: 3610940 - DNA, 13 bp, Homo sapiens
tcagcctggaagg

SEQ ID NO: 3610941 - DNA, 12 bp, Homo sapiens
tcagcctggcca

SEQ ID NO: 3610942 - DNA, 17 bp, Homo sapiens
tcagcctggccagacac

SEQ ID NO: 3610943 - DNA, 19 bp, Homo sapiens
tcagcctggccagacacag

SEQ ID NO: 3610944 - DNA, 18 bp, Homo sapiens
tcagcctgttccagaagg

SEQ ID NO: 3610945 - DNA, 14 bp, Homo sapiens
tcagccttgccaga

SEQ ID NO: 3610946 - DNA, 19 bp, Homo sapiens
tcagccttttatgtatttt

SEQ ID NO: 3610947 - DNA, 14 bp, Homo sapiens
tcagcggctccagc

SEQ ID NO: 3610948 - DNA, 18 bp, Homo sapiens
tcagctcccctcggagaa

SEQ ID NO: 3610949 - DNA, 14 bp, Homo sapiens
tcagctctggagaa

SEQ ID NO: 3610950 - DNA, 13 bp, Homo sapiens
tcagctgagcatg

SEQ ID NO: 3610951 - DNA, 18 bp, Homo sapiens
tcagctgagcatggagac

SEQ ID NO: 3610952 - DNA, 21 bp, Homo sapiens
tcagctgcaaggtactctggt

SEQ ID NO: 3610953 - DNA, 16 bp, Homo sapiens
tcagctgctgaaacaa

SEQ ID NO: 3610954 - DNA, 13 bp, Homo sapiens
tcagctggacata

SEQ ID NO: 3610955 - DNA, 20 bp, Homo sapiens
tcagctggacatactgctgg

SEQ ID NO: 3610956 - DNA, 12 bp, Homo sapiens
tcagctgtgggg

SEQ ID NO: 3610957 - DNA, 21 bp, Homo sapiens
tcagcttggtagttaacacat

SEQ ID NO: 3610958 - DNA, 15 bp, Homo sapiens
tcagctttggctctg

SEQ ID NO: 3610959 - DNA, 20 bp, Homo sapiens
tcaggaaatcaaatatgcaa

SEQ ID NO: 3610960 - DNA, 16 bp, Homo sapiens
tcaggaattcagtgcc

SEQ ID NO: 3610961 - DNA, 17 bp, Homo sapiens
tcaggactctctccagg

SEQ ID NO: 3610962 - DNA, 18 bp, Homo sapiens
tcaggactctctccagga

SEQ ID NO: 3610963 - DNA, 19 bp, Homo sapiens
tcaggactctctccaggag

SEQ ID NO: 3610964 - DNA, 13 bp, Homo sapiens
tcaggagcctggc

SEQ ID NO: 3610965 - DNA, 21 bp, Homo sapiens
tcaggagcctggccaggcagg

SEQ ID NO: 3610966 - DNA, 16 bp, Homo sapiens
tcaggaggctgaggca

SEQ ID NO: 3610967 - DNA, 17 bp, Homo sapiens
tcaggatccagtgacat

SEQ ID NO: 3610968 - DNA, 19 bp, Homo sapiens
tcaggattaactaaagaag

SEQ ID NO: 3610969 - DNA, 16 bp, Homo sapiens
tcaggcaaagaaaatg

SEQ ID NO: 3610970 - DNA, 13 bp, Homo sapiens
tcaggccagccca

SEQ ID NO: 3610971 - DNA, 16 bp, Homo sapiens
tcaggccagcccagcc

SEQ ID NO: 3610972 - DNA, 17 bp, Homo sapiens
tcaggctaagaccctgt

SEQ ID NO: 3610973 - DNA, 19 bp, Homo sapiens
tcaggctaagaccctgtgt

SEQ ID NO: 3610974 - DNA, 15 bp, Homo sapiens
tcaggctactagaat

SEQ ID NO: 3610975 - DNA, 20 bp, Homo sapiens
tcaggctactgcttcaatct

SEQ ID NO: 3610976 - DNA, 14 bp, Homo sapiens
tcaggctagctgtg

SEQ ID NO: 3610977 - DNA, 22 bp, Homo sapiens
tcaggctctgcacagacaagca

SEQ ID NO: 3610978 - DNA, 16 bp, Homo sapiens
tcaggctcttctcctt

SEQ ID NO: 3610979 - DNA, 21 bp, Homo sapiens
tcaggctcttctcctttcaca

SEQ ID NO: 3610980 - DNA, 13 bp, Homo sapiens
tcaggctgggccc

SEQ ID NO: 3610981 - DNA, 14 bp, Homo sapiens
tcaggctggtctcg

SEQ ID NO: 3610982 - DNA, 22 bp, Homo sapiens
tcaggctggtctcgaactcctg

SEQ ID NO: 3610983 - DNA, 19 bp, Homo sapiens
tcagggaaaagcagctctc

SEQ ID NO: 3610984 - DNA, 20 bp, Homo sapiens
tcagggaccggtgctgcagg

SEQ ID NO: 3610985 - DNA, 22 bp, Homo sapiens
tcagggaccggtgctgcaggag

SEQ ID NO: 3610986 - DNA, 16 bp, Homo sapiens
tcagggatggagggaa

SEQ ID NO: 3610987 - DNA, 17 bp, Homo sapiens
tcagggatggagggaag

SEQ ID NO: 3610988 - DNA, 18 bp, Homo sapiens
tcagggctggagcctggg

SEQ ID NO: 3610989 - DNA, 20 bp, Homo sapiens
tcagggctggagcctggggt

SEQ ID NO: 3610990 - DNA, 16 bp, Homo sapiens
tcagggcttctagttt

SEQ ID NO: 3610991 - DNA, 22 bp, Homo sapiens
tcaggggaccccactcccctca

SEQ ID NO: 3610992 - DNA, 13 bp, Homo sapiens
tcaggggcctgga

SEQ ID NO: 3610993 - DNA, 14 bp, Homo sapiens
tcaggggcctggag

SEQ ID NO: 3610994 - DNA, 16 bp, Homo sapiens
tcaggggcctggaggt

SEQ ID NO: 3610995 - DNA, 19 bp, Homo sapiens
tcaggggcctggaggtctg

SEQ ID NO: 3610996 - DNA, 22 bp, Homo sapiens
tcagggtccaggagagcctggg

SEQ ID NO: 3610997 - DNA, 17 bp, Homo sapiens
tcaggtcaggtggctgt

SEQ ID NO: 3610998 - DNA, 14 bp, Homo sapiens
tcaggtctgtatgt

SEQ ID NO: 3610999 - DNA, 15 bp, Homo sapiens
tcaggtgtataaatg

SEQ ID NO: 3611000 - DNA, 15 bp, Homo sapiens
tcaggtgtcgaggcc

SEQ ID NO: 3611001 - DNA, 20 bp, Homo sapiens
tcagtaacaaaggtttaaag

SEQ ID NO: 3611002 - DNA, 20 bp, Homo sapiens
tcagtcaatggaagaaatgg

SEQ ID NO: 3611003 - DNA, 18 bp, Homo sapiens
tcagtccccgtgaaggag

SEQ ID NO: 3611004 - DNA, 13 bp, Homo sapiens
tcagtcctttgtc

SEQ ID NO: 3611005 - DNA, 19 bp, Homo sapiens
tcagtcctttgtctttctt

SEQ ID NO: 3611006 - DNA, 22 bp, Homo sapiens
tcagtctttaatctgagaggcc

SEQ ID NO: 3611007 - DNA, 13 bp, Homo sapiens
tcagtgactcctg

SEQ ID NO: 3611008 - DNA, 14 bp, Homo sapiens
tcagtgactcctgc

SEQ ID NO: 3611009 - DNA, 16 bp, Homo sapiens
tcagtgactcctgctg

SEQ ID NO: 3611010 - DNA, 18 bp, Homo sapiens
tcagtgactcctgctggt

SEQ ID NO: 3611011 - DNA, 23 bp, Homo sapiens
tcagtgagcccctccccagccag

SEQ ID NO: 3611012 - DNA, 19 bp, Homo sapiens
tcagtgatggaatatcatg

SEQ ID NO: 3611013 - DNA, 22 bp, Homo sapiens
tcagtgtatggaaataaatgta

SEQ ID NO: 3611014 - DNA, 15 bp, Homo sapiens
tcagtgtcctttcca

SEQ ID NO: 3611015 - DNA, 20 bp, Homo sapiens
tcagttaactattgcattta

SEQ ID NO: 3611016 - DNA, 15 bp, Homo sapiens
tcagttctaggcctt

SEQ ID NO: 3611017 - DNA, 16 bp, Homo sapiens
tcagttctaggccttt

SEQ ID NO: 3611018 - DNA, 20 bp, Homo sapiens
tcagttctaggcctttcctc

SEQ ID NO: 3611019 - DNA, 23 bp, Homo sapiens
tcagttctaggcctttcctctgc

SEQ ID NO: 3611020 - DNA, 21 bp, Homo sapiens
tcagtttcttaaaatgtccta

SEQ ID NO: 3611021 - DNA, 11 bp, Homo sapiens
tcataaattat

SEQ ID NO: 3611022 - DNA, 13 bp, Homo sapiens
tcataaattattt

SEQ ID NO: 3611023 - DNA, 21 bp, Homo sapiens
tcataagcacctaaaacccaa

SEQ ID NO: 3611024 - DNA, 13 bp, Homo sapiens
tcataattctgaa

SEQ ID NO: 3611025 - DNA, 22 bp, Homo sapiens
tcatacatccctcagtttctta

SEQ ID NO: 3611026 - DNA, 18 bp, Homo sapiens
tcatacctatcatcttaa

SEQ ID NO: 3611027 - DNA, 17 bp, Homo sapiens
tcataccttgatggtaa

SEQ ID NO: 3611028 - DNA, 22 bp, Homo sapiens
tcatagaaatgtaacttttgta

SEQ ID NO: 3611029 - DNA, 18 bp, Homo sapiens
tcatagcaagcttttgct

SEQ ID NO: 3611030 - DNA, 22 bp, Homo sapiens
tcatagcattgtctatttttct

SEQ ID NO: 3611031 - DNA, 21 bp, Homo sapiens
tcatagtgatagagtgcagtg

SEQ ID NO: 3611032 - DNA, 12 bp, Homo sapiens
tcatataagaca

SEQ ID NO: 3611033 - DNA, 23 bp, Homo sapiens
tcatataattaaagactcaagag

SEQ ID NO: 3611034 - DNA, 18 bp, Homo sapiens
tcatatagaccaattgaa

SEQ ID NO: 3611035 - DNA, 20 bp, Homo sapiens
tcatatctcttgcccttcct

SEQ ID NO: 3611036 - DNA, 23 bp, Homo sapiens
tcatatgttgtgtttggttcaat

SEQ ID NO: 3611037 - DNA, 23 bp, Homo sapiens
tcatatttacttcttatacattt

SEQ ID NO: 3611038 - DNA, 20 bp, Homo sapiens
tcatattttaaacagaggat

SEQ ID NO: 3611039 - DNA, 15 bp, Homo sapiens
tcatcacagggattt

SEQ ID NO: 3611040 - DNA, 20 bp, Homo sapiens
tcatcatttcagccaaagtc

SEQ ID NO: 3611041 - DNA, 14 bp, Homo sapiens
tcatccagaaaaga

SEQ ID NO: 3611042 - DNA, 17 bp, Homo sapiens
tcatcccctcacttgcc

SEQ ID NO: 3611043 - DNA, 17 bp, Homo sapiens
tcatccttttggataag

SEQ ID NO: 3611044 - DNA, 23 bp, Homo sapiens
tcatcgaagggattgtgtatctg

SEQ ID NO: 3611045 - DNA, 16 bp, Homo sapiens
tcatctaccttttctg

SEQ ID NO: 3611046 - DNA, 18 bp, Homo sapiens
tcatctaccttttctggc

SEQ ID NO: 3611047 - DNA, 20 bp, Homo sapiens
tcatctccctcctccaggtc

SEQ ID NO: 3611048 - DNA, 19 bp, Homo sapiens
tcatctgagaggctctccg

SEQ ID NO: 3611049 - DNA, 20 bp, Homo sapiens
tcatctgctaagtaatttag

SEQ ID NO: 3611050 - DNA, 23 bp, Homo sapiens
tcatctgggaacttgtcacagat

SEQ ID NO: 3611051 - DNA, 20 bp, Homo sapiens
tcatctgggggagtggaata

SEQ ID NO: 3611052 - DNA, 22 bp, Homo sapiens
tcatctgtctcggctctgcatg

SEQ ID NO: 3611053 - DNA, 16 bp, Homo sapiens
tcatcttattcagcac

SEQ ID NO: 3611054 - DNA, 22 bp, Homo sapiens
tcatcttgcagcatttactatg

SEQ ID NO: 3611055 - DNA, 11 bp, Homo sapiens
tcatcttgcta

SEQ ID NO: 3611056 - DNA, 18 bp, Homo sapiens
tcatcttgctaccagtat

SEQ ID NO: 3611057 - DNA, 20 bp, Homo sapiens
tcatcttggaaaggggagga

SEQ ID NO: 3611058 - DNA, 16 bp, Homo sapiens
tcatcttggccctcct

SEQ ID NO: 3611059 - DNA, 19 bp, Homo sapiens
tcatcttggccctcctcag

SEQ ID NO: 3611060 - DNA, 21 bp, Homo sapiens
tcatcttggccctcctcagct

SEQ ID NO: 3611061 - DNA, 20 bp, Homo sapiens
tcatgaatgtgagtcattat

SEQ ID NO: 3611062 - DNA, 17 bp, Homo sapiens
tcatgataattcagcag

SEQ ID NO: 3611063 - DNA, 20 bp, Homo sapiens
tcatgcacccctgagccagc

SEQ ID NO: 3611064 - DNA, 12 bp, Homo sapiens
tcatgcagctgt

SEQ ID NO: 3611065 - DNA, 14 bp, Homo sapiens
tcatgctgctcccc

SEQ ID NO: 3611066 - DNA, 14 bp, Homo sapiens
tcatggtgaaatta

SEQ ID NO: 3611067 - DNA, 23 bp, Homo sapiens
tcatggtgaaattataactatta

SEQ ID NO: 3611068 - DNA, 16 bp, Homo sapiens
tcatgtaaagaaatgt

SEQ ID NO: 3611069 - DNA, 22 bp, Homo sapiens
tcatgtaaagaaatgtcttaat

SEQ ID NO: 3611070 - DNA, 23 bp, Homo sapiens
tcatgtcaaatatttagatgtaa

SEQ ID NO: 3611071 - DNA, 15 bp, Homo sapiens
tcatgttagttacct

SEQ ID NO: 3611072 - DNA, 16 bp, Homo sapiens
tcatgttatgcagtga

SEQ ID NO: 3611073 - DNA, 14 bp, Homo sapiens
tcatgttgaagctt

SEQ ID NO: 3611074 - DNA, 20 bp, Homo sapiens
tcatgttgaagctttaagaa

SEQ ID NO: 3611075 - DNA, 17 bp, Homo sapiens
tcatgtttacagaggac

SEQ ID NO: 3611076 - DNA, 18 bp, Homo sapiens
tcatgttttagcatttgt

SEQ ID NO: 3611077 - DNA, 21 bp, Homo sapiens
tcatgttttagcatttgtata

SEQ ID NO: 3611078 - DNA, 23 bp, Homo sapiens
tcattagttttgaagattctatg

SEQ ID NO: 3611079 - DNA, 13 bp, Homo sapiens
tcattatctcaaa

SEQ ID NO: 3611080 - DNA, 19 bp, Homo sapiens
tcattatggtagaatcatt

SEQ ID NO: 3611081 - DNA, 17 bp, Homo sapiens
tcattatgtagctgtcg

SEQ ID NO: 3611082 - DNA, 13 bp, Homo sapiens
tcattcagaaaaa

SEQ ID NO: 3611083 - DNA, 12 bp, Homo sapiens
tcattcagttct

SEQ ID NO: 3611084 - DNA, 17 bp, Homo sapiens
tcattctaccaagctgt

SEQ ID NO: 3611085 - DNA, 19 bp, Homo sapiens
tcattctgaaccctccaaa

SEQ ID NO: 3611086 - DNA, 23 bp, Homo sapiens
tcattctgaaccctccaaaggaa

SEQ ID NO: 3611087 - DNA, 13 bp, Homo sapiens
tcattctggaggg

SEQ ID NO: 3611088 - DNA, 16 bp, Homo sapiens
tcattctttactgcac

SEQ ID NO: 3611089 - DNA, 19 bp, Homo sapiens
tcattctttactgcactca

SEQ ID NO: 3611090 - DNA, 21 bp, Homo sapiens
tcattctttttgaaatgtcaa

SEQ ID NO: 3611091 - DNA, 19 bp, Homo sapiens
tcattgcacctatctcagc

SEQ ID NO: 3611092 - DNA, 24 bp, Homo sapiens
tcattgcacctatctcagccatag

SEQ ID NO: 3611093 - DNA, 14 bp, Homo sapiens
tcattgcttctgac

SEQ ID NO: 3611094 - DNA, 12 bp, Homo sapiens
tcattggcaaag

SEQ ID NO: 3611095 - DNA, 12 bp, Homo sapiens
tcattgtttaga

SEQ ID NO: 3611096 - DNA, 21 bp, Homo sapiens
tcattgtttagatgaggctca

SEQ ID NO: 3611097 - DNA, 12 bp, Homo sapiens
tcatttatctat

SEQ ID NO: 3611098 - DNA, 21 bp, Homo sapiens
tcatttatctataatttacct

SEQ ID NO: 3611099 - DNA, 21 bp, Homo sapiens
tcatttcactgtagctctaaa

SEQ ID NO: 3611100 - DNA, 14 bp, Homo sapiens
tcatttcagccaaa

SEQ ID NO: 3611101 - DNA, 15 bp, Homo sapiens
tcatttcagccaaag

SEQ ID NO: 3611102 - DNA, 17 bp, Homo sapiens
tcatttcagccaaagtc

SEQ ID NO: 3611103 - DNA, 21 bp, Homo sapiens
tcatttcgggtgaatctgtct

SEQ ID NO: 3611104 - DNA, 20 bp, Homo sapiens
tcatttctgtctttaagaac

SEQ ID NO: 3611105 - DNA, 14 bp, Homo sapiens
tcatttcttcactt

SEQ ID NO: 3611106 - DNA, 15 bp, Homo sapiens
tcatttgctttggaa

SEQ ID NO: 3611107 - DNA, 15 bp, Homo sapiens
tcatttgtaaaaatg

SEQ ID NO: 3611108 - DNA, 17 bp, Homo sapiens
tcatttgttaatatttc

SEQ ID NO: 3611109 - DNA, 17 bp, Homo sapiens
tcatttgtttaaacaat

SEQ ID NO: 3611110 - DNA, 22 bp, Homo sapiens
tcatttttttagaaatgtgaag

SEQ ID NO: 3611111 - DNA, 20 bp, Homo sapiens
tcattttttttctttgaata

SEQ ID NO: 3611112 - DNA, 17 bp, Homo sapiens
tccaaaaagctctgaaa

SEQ ID NO: 3611113 - DNA, 19 bp, Homo sapiens
tccaaaaagctctgaaaac

SEQ ID NO: 3611114 - DNA, 22 bp, Homo sapiens
tccaaaaagctctgaaaacaag

SEQ ID NO: 3611115 - DNA, 20 bp, Homo sapiens
tccaaaacatttctggacag

SEQ ID NO: 3611116 - DNA, 23 bp, Homo sapiens
tccaaaacttctcttgaaaagtt

SEQ ID NO: 3611117 - DNA, 15 bp, Homo sapiens
tccaaaagaagcccc

SEQ ID NO: 3611118 - DNA, 21 bp, Homo sapiens
tccaaaagaagcccccagcta

SEQ ID NO: 3611119 - DNA, 13 bp, Homo sapiens
tccaaacccactc

SEQ ID NO: 3611120 - DNA, 13 bp, Homo sapiens
tccaaacctccag

SEQ ID NO: 3611121 - DNA, 14 bp, Homo sapiens
tccaaacctccagc

SEQ ID NO: 3611122 - DNA, 21 bp, Homo sapiens
tccaaacctccagcctccctg

SEQ ID NO: 3611123 - DNA, 22 bp, Homo sapiens
tccaaacctccagcctccctgt

SEQ ID NO: 3611124 - DNA, 19 bp, Homo sapiens
tccaaacctgtaacctttc

SEQ ID NO: 3611125 - DNA, 12 bp, Homo sapiens
tccaaagaagat

SEQ ID NO: 3611126 - DNA, 20 bp, Homo sapiens
tccaaagctttattaccagt

SEQ ID NO: 3611127 - DNA, 18 bp, Homo sapiens
tccaaatcttgaatttct

SEQ ID NO: 3611128 - DNA, 21 bp, Homo sapiens
tccaacactttgagcattttt

SEQ ID NO: 3611129 - DNA, 22 bp, Homo sapiens
tccaacactttgagcattttta

SEQ ID NO: 3611130 - DNA, 22 bp, Homo sapiens
tccaacccgtctggcccaccag

SEQ ID NO: 3611131 - DNA, 20 bp, Homo sapiens
tccaacgcccctgtggccaa

SEQ ID NO: 3611132 - DNA, 20 bp, Homo sapiens
tccaactactaatagaataa

SEQ ID NO: 3611133 - DNA, 20 bp, Homo sapiens
tccaactgggcatttcaatc

SEQ ID NO: 3611134 - DNA, 23 bp, Homo sapiens
tccaagcatttcatgaaaaagct

SEQ ID NO: 3611135 - DNA, 14 bp, Homo sapiens
tccaagggtttcga

SEQ ID NO: 3611136 - DNA, 22 bp, Homo sapiens
tccaagggtttcgactggtcca

SEQ ID NO: 3611137 - DNA, 13 bp, Homo sapiens
tccaagtgcccca

SEQ ID NO: 3611138 - DNA, 23 bp, Homo sapiens
tccaagtgccccaccactcccca

SEQ ID NO: 3611139 - DNA, 20 bp, Homo sapiens
tccaagtggcctccgtcact

SEQ ID NO: 3611140 - DNA, 22 bp, Homo sapiens
tccaatgcacagttgccacatt

SEQ ID NO: 3611141 - DNA, 23 bp, Homo sapiens
tccaatgtgaagttcatcttgca

SEQ ID NO: 3611142 - DNA, 13 bp, Homo sapiens
tccaatttaagga

SEQ ID NO: 3611143 - DNA, 15 bp, Homo sapiens
tccaattttccttca

SEQ ID NO: 3611144 - DNA, 17 bp, Homo sapiens
tccacaagttaaataaa

SEQ ID NO: 3611145 - DNA, 19 bp, Homo sapiens
tccacaattattggcaaag

SEQ ID NO: 3611146 - DNA, 20 bp, Homo sapiens
tccacaattattggcaaagt

SEQ ID NO: 3611147 - DNA, 12 bp, Homo sapiens
tccacactcaga

SEQ ID NO: 3611148 - DNA, 17 bp, Homo sapiens
tccacactgccggcagg

SEQ ID NO: 3611149 - DNA, 12 bp, Homo sapiens
tccacagagagg

SEQ ID NO: 3611150 - DNA, 17 bp, Homo sapiens
tccacagaggacacaga

SEQ ID NO: 3611151 - DNA, 15 bp, Homo sapiens
tccacagctggaaag

SEQ ID NO: 3611152 - DNA, 23 bp, Homo sapiens
tccacataaccctgtcacccaca

SEQ ID NO: 3611153 - DNA, 19 bp, Homo sapiens
tccacatgctgcctggcac

SEQ ID NO: 3611154 - DNA, 15 bp, Homo sapiens
tccaccagcagcatg

SEQ ID NO: 3611155 - DNA, 16 bp, Homo sapiens
tccaccataccttaga

SEQ ID NO: 3611156 - DNA, 10 bp, Homo sapiens
tccacccaca

SEQ ID NO: 3611157 - DNA, 18 bp, Homo sapiens
tccacccacaaactccag

SEQ ID NO: 3611158 - DNA, 22 bp, Homo sapiens
tccacccacaaactccaggctg

SEQ ID NO: 3611159 - DNA, 23 bp, Homo sapiens
tccacccacaaactccaggctgg

SEQ ID NO: 3611160 - DNA, 21 bp, Homo sapiens
tccacccagcaggcagagtgg

SEQ ID NO: 3611161 - DNA, 15 bp, Homo sapiens
tccacccccaggtgc

SEQ ID NO: 3611162 - DNA, 14 bp, Homo sapiens
tccaccccccactc

SEQ ID NO: 3611163 - DNA, 19 bp, Homo sapiens
tccacccgggggagcccag

SEQ ID NO: 3611164 - DNA, 12 bp, Homo sapiens
tccacctggaga

SEQ ID NO: 3611165 - DNA, 18 bp, Homo sapiens
tccaccttcccatgccct

SEQ ID NO: 3611166 - DNA, 15 bp, Homo sapiens
tccactaccaaaaga

SEQ ID NO: 3611167 - DNA, 20 bp, Homo sapiens
tccactaccaaaagacatta

SEQ ID NO: 3611168 - DNA, 22 bp, Homo sapiens
tccactaccaaaagacattaga

SEQ ID NO: 3611169 - DNA, 20 bp, Homo sapiens
tccactactctcttcctcca

SEQ ID NO: 3611170 - DNA, 22 bp, Homo sapiens
tccactactctcttcctccact

SEQ ID NO: 3611171 - DNA, 15 bp, Homo sapiens
tccactcgtgtgttt

SEQ ID NO: 3611172 - DNA, 16 bp, Homo sapiens
tccactcgtgtgtttc

SEQ ID NO: 3611173 - DNA, 16 bp, Homo sapiens
tccactcttgatctct

SEQ ID NO: 3611174 - DNA, 14 bp, Homo sapiens
tccactgaaaattt

SEQ ID NO: 3611175 - DNA, 22 bp, Homo sapiens
tccactgccttcgatacaccgg

SEQ ID NO: 3611176 - DNA, 14 bp, Homo sapiens
tccactgcctttgg

SEQ ID NO: 3611177 - DNA, 21 bp, Homo sapiens
tccactggacccttgattcat

SEQ ID NO: 3611178 - DNA, 16 bp, Homo sapiens
tccacttaaaatacat

SEQ ID NO: 3611179 - DNA, 23 bp, Homo sapiens
tccacttagaaattgcatttcct

SEQ ID NO: 3611180 - DNA, 18 bp, Homo sapiens
tccagaaaacctctcctg

SEQ ID NO: 3611181 - DNA, 21 bp, Homo sapiens
tccagaaaacctctcctgacc

SEQ ID NO: 3611182 - DNA, 23 bp, Homo sapiens
tccagaaaacctctcctgacccc

SEQ ID NO: 3611183 - DNA, 12 bp, Homo sapiens
tccagaaggaag

SEQ ID NO: 3611184 - DNA, 13 bp, Homo sapiens
tccagacccctgg

SEQ ID NO: 3611185 - DNA, 17 bp, Homo sapiens
tccagacccctggcttt

SEQ ID NO: 3611186 - DNA, 18 bp, Homo sapiens
tccagacccctggctttt

SEQ ID NO: 3611187 - DNA, 13 bp, Homo sapiens
tccagacctggct

SEQ ID NO: 3611188 - DNA, 14 bp, Homo sapiens
tccagactcagcag

SEQ ID NO: 3611189 - DNA, 14 bp, Homo sapiens
tccagactctgggg

SEQ ID NO: 3611190 - DNA, 22 bp, Homo sapiens
tccagagagtggagagagcagg

SEQ ID NO: 3611191 - DNA, 15 bp, Homo sapiens
tccagagagtggctc

SEQ ID NO: 3611192 - DNA, 20 bp, Homo sapiens
tccagagatgagtgtctgga

SEQ ID NO: 3611193 - DNA, 13 bp, Homo sapiens
tccagagctgttt

SEQ ID NO: 3611194 - DNA, 15 bp, Homo sapiens
tccagagctgtttgg

SEQ ID NO: 3611195 - DNA, 20 bp, Homo sapiens
tccagaggctattattttca

SEQ ID NO: 3611196 - DNA, 17 bp, Homo sapiens
tccagaggtcctccgta

SEQ ID NO: 3611197 - DNA, 22 bp, Homo sapiens
tccagattggcacccctttcta

SEQ ID NO: 3611198 - DNA, 22 bp, Homo sapiens
tccagcagatttccagccttct

SEQ ID NO: 3611199 - DNA, 13 bp, Homo sapiens
tccagcaggccca

SEQ ID NO: 3611200 - DNA, 20 bp, Homo sapiens
tccagcagtctgataaactg

SEQ ID NO: 3611201 - DNA, 21 bp, Homo sapiens
tccagccacttccccctcttc

SEQ ID NO: 3611202 - DNA, 16 bp, Homo sapiens
tccagcccaaacctgg

SEQ ID NO: 3611203 - DNA, 17 bp, Homo sapiens
tccagcccaaacctggg

SEQ ID NO: 3611204 - DNA, 14 bp, Homo sapiens
tccagcccggggcc

SEQ ID NO: 3611205 - DNA, 20 bp, Homo sapiens
tccagcctcccctcccctgg

SEQ ID NO: 3611206 - DNA, 19 bp, Homo sapiens
tccagcctccctgtctcca

SEQ ID NO: 3611207 - DNA, 22 bp, Homo sapiens
tccagcctccctgtctccagct

SEQ ID NO: 3611208 - DNA, 23 bp, Homo sapiens
tccagcctccctgtctccagctg

SEQ ID NO: 3611209 - DNA, 11 bp, Homo sapiens
tccagcctggg

SEQ ID NO: 3611210 - DNA, 21 bp, Homo sapiens
tccagcctgggcgacaaaaac

SEQ ID NO: 3611211 - DNA, 22 bp, Homo sapiens
tccagctaaacaccaacccctg

SEQ ID NO: 3611212 - DNA, 23 bp, Homo sapiens
tccagctcagccctggcctggct

SEQ ID NO: 3611213 - DNA, 12 bp, Homo sapiens
tccagctccaac

SEQ ID NO: 3611214 - DNA, 18 bp, Homo sapiens
tccagctccaacctgcaa

SEQ ID NO: 3611215 - DNA, 12 bp, Homo sapiens
tccagctctgac

SEQ ID NO: 3611216 - DNA, 17 bp, Homo sapiens
tccagctctgacatccc

SEQ ID NO: 3611217 - DNA, 18 bp, Homo sapiens
tccagctctgacatccct

SEQ ID NO: 3611218 - DNA, 19 bp, Homo sapiens
tccagctctgacatccctt

SEQ ID NO: 3611219 - DNA, 18 bp, Homo sapiens
tccagctgacagccacac

SEQ ID NO: 3611220 - DNA, 14 bp, Homo sapiens
tccagctgactaaa

SEQ ID NO: 3611221 - DNA, 12 bp, Homo sapiens
tccagctgcctg

SEQ ID NO: 3611222 - DNA, 17 bp, Homo sapiens
tccagctgcctgggccc

SEQ ID NO: 3611223 - DNA, 19 bp, Homo sapiens
tccagctgggaagcccttt

SEQ ID NO: 3611224 - DNA, 21 bp, Homo sapiens
tccagctgggaagcccttttt

SEQ ID NO: 3611225 - DNA, 17 bp, Homo sapiens
tccagcttgcattgatt

SEQ ID NO: 3611226 - DNA, 14 bp, Homo sapiens
tccaggaaagtgtg

SEQ ID NO: 3611227 - DNA, 19 bp, Homo sapiens
tccaggacaggagatgctg

SEQ ID NO: 3611228 - DNA, 22 bp, Homo sapiens
tccaggacaggagatgctgtgc

SEQ ID NO: 3611229 - DNA, 20 bp, Homo sapiens
tccaggactatatttgggcc

SEQ ID NO: 3611230 - DNA, 19 bp, Homo sapiens
tccaggactgtttcaaaca

SEQ ID NO: 3611231 - DNA, 17 bp, Homo sapiens
tccaggagagagccagg

SEQ ID NO: 3611232 - DNA, 16 bp, Homo sapiens
tccaggagagcctggg

SEQ ID NO: 3611233 - DNA, 18 bp, Homo sapiens
tccaggagcctgtgcctc

SEQ ID NO: 3611234 - DNA, 17 bp, Homo sapiens
tccaggcagatccagga

SEQ ID NO: 3611235 - DNA, 19 bp, Homo sapiens
tccaggcagatccaggact

SEQ ID NO: 3611236 - DNA, 20 bp, Homo sapiens
tccaggcagatccaggacta

SEQ ID NO: 3611237 - DNA, 21 bp, Homo sapiens
tccaggcatgtgtctggccct

SEQ ID NO: 3611238 - DNA, 22 bp, Homo sapiens
tccaggcatgtgtctggcccta

SEQ ID NO: 3611239 - DNA, 19 bp, Homo sapiens
tccaggccccaccggccag

SEQ ID NO: 3611240 - DNA, 23 bp, Homo sapiens
tccaggcctgtcaagagggagga

SEQ ID NO: 3611241 - DNA, 19 bp, Homo sapiens
tccaggctggagtgcaatg

SEQ ID NO: 3611242 - DNA, 14 bp, Homo sapiens
tccagggacagagg

SEQ ID NO: 3611243 - DNA, 19 bp, Homo sapiens
tccagggacagaggcccca

SEQ ID NO: 3611244 - DNA, 21 bp, Homo sapiens
tccagggacagaggccccagc

SEQ ID NO: 3611245 - DNA, 23 bp, Homo sapiens
tccagggacagaggccccagcct

SEQ ID NO: 3611246 - DNA, 16 bp, Homo sapiens
tccagggcagcaggcc

SEQ ID NO: 3611247 - DNA, 17 bp, Homo sapiens
tccagggcagcaggcca

SEQ ID NO: 3611248 - DNA, 21 bp, Homo sapiens
tccagggcagcaggccagaga

SEQ ID NO: 3611249 - DNA, 22 bp, Homo sapiens
tccagggcagcaggccagagaa

SEQ ID NO: 3611250 - DNA, 15 bp, Homo sapiens
tccagggcagcggct

SEQ ID NO: 3611251 - DNA, 12 bp, Homo sapiens
tccaggggcacc

SEQ ID NO: 3611252 - DNA, 13 bp, Homo sapiens
tccaggggcctgc

SEQ ID NO: 3611253 - DNA, 16 bp, Homo sapiens
tccaggggcctgcaga

SEQ ID NO: 3611254 - DNA, 20 bp, Homo sapiens
tccagggtgacaaggcctgc

SEQ ID NO: 3611255 - DNA, 19 bp, Homo sapiens
tccaggtcagcctggaagg

SEQ ID NO: 3611256 - DNA, 18 bp, Homo sapiens
tccaggttccctcccaga

SEQ ID NO: 3611257 - DNA, 13 bp, Homo sapiens
tccaggtttttca

SEQ ID NO: 3611258 - DNA, 17 bp, Homo sapiens
tccaggtttttcaatta

SEQ ID NO: 3611259 - DNA, 18 bp, Homo sapiens
tccaggtttttcaattaa

SEQ ID NO: 3611260 - DNA, 23 bp, Homo sapiens
tccagtcattatgttaatatttc

SEQ ID NO: 3611261 - DNA, 12 bp, Homo sapiens
tccagtgaaatg

SEQ ID NO: 3611262 - DNA, 23 bp, Homo sapiens
tccagtggtgggtaattgtacaa

SEQ ID NO: 3611263 - DNA, 16 bp, Homo sapiens
tccagtgtctgtctga

SEQ ID NO: 3611264 - DNA, 20 bp, Homo sapiens
tccagtgtgagatactgtgt

SEQ ID NO: 3611265 - DNA, 16 bp, Homo sapiens
tccagttttgcctgag

SEQ ID NO: 3611266 - DNA, 23 bp, Homo sapiens
tccataatctggactcctctgtc

SEQ ID NO: 3611267 - DNA, 19 bp, Homo sapiens
tccatacacacgctgcctt

SEQ ID NO: 3611268 - DNA, 19 bp, Homo sapiens
tccatacctgcccctgcct

SEQ ID NO: 3611269 - DNA, 22 bp, Homo sapiens
tccataccttttctcttttctt

SEQ ID NO: 3611270 - DNA, 14 bp, Homo sapiens
tccatataacaatt

SEQ ID NO: 3611271 - DNA, 14 bp, Homo sapiens
tccatcaaagagaa

SEQ ID NO: 3611272 - DNA, 22 bp, Homo sapiens
tccatcaactcccaacttcttc

SEQ ID NO: 3611273 - DNA, 23 bp, Homo sapiens
tccatcaactcccaacttcttcc

SEQ ID NO: 3611274 - DNA, 17 bp, Homo sapiens
tccatcagcaccccagt

SEQ ID NO: 3611275 - DNA, 13 bp, Homo sapiens
tccatcccctccc

SEQ ID NO: 3611276 - DNA, 15 bp, Homo sapiens
tccatccgactgccc

SEQ ID NO: 3611277 - DNA, 19 bp, Homo sapiens
tccatccgactgcccctgc

SEQ ID NO: 3611278 - DNA, 13 bp, Homo sapiens
tccatcctgcaga

SEQ ID NO: 3611279 - DNA, 17 bp, Homo sapiens
tccatgaaagaacttaa

SEQ ID NO: 3611280 - DNA, 13 bp, Homo sapiens
tccatgatgcaca

SEQ ID NO: 3611281 - DNA, 13 bp, Homo sapiens
tccatggagccta

SEQ ID NO: 3611282 - DNA, 17 bp, Homo sapiens
tccatggcaattttgta

SEQ ID NO: 3611283 - DNA, 13 bp, Homo sapiens
tccatgtaaatac

SEQ ID NO: 3611284 - DNA, 14 bp, Homo sapiens
tccatgtgcctttc

SEQ ID NO: 3611285 - DNA, 21 bp, Homo sapiens
tccatgtgcctttctttgcct

SEQ ID NO: 3611286 - DNA, 16 bp, Homo sapiens
tccatgttgactgact

SEQ ID NO: 3611287 - DNA, 22 bp, Homo sapiens
tccatgttttttcttcaaatgt

SEQ ID NO: 3611288 - DNA, 22 bp, Homo sapiens
tccattcacagttctttgggcc

SEQ ID NO: 3611289 - DNA, 13 bp, Homo sapiens
tccattgtttcct

SEQ ID NO: 3611290 - DNA, 14 bp, Homo sapiens
tccatttcaggact

SEQ ID NO: 3611291 - DNA, 12 bp, Homo sapiens
tccatttctgat

SEQ ID NO: 3611292 - DNA, 14 bp, Homo sapiens
tccatttctttctt

SEQ ID NO: 3611293 - DNA, 16 bp, Homo sapiens
tccatttctttcttcc

SEQ ID NO: 3611294 - DNA, 21 bp, Homo sapiens
tccatttttctcccaagaaac

SEQ ID NO: 3611295 - DNA, 23 bp, Homo sapiens
tcccaaaacattttaaatgaaag

SEQ ID NO: 3611296 - DNA, 15 bp, Homo sapiens
tcccaaatcctagac

SEQ ID NO: 3611297 - DNA, 22 bp, Homo sapiens
tcccaacgtgcaaagccaaggc

SEQ ID NO: 3611298 - DNA, 15 bp, Homo sapiens
tcccaactctagctg

SEQ ID NO: 3611299 - DNA, 17 bp, Homo sapiens
tcccaacttcttcctgt

SEQ ID NO: 3611300 - DNA, 18 bp, Homo sapiens
tcccaaggctctgagcaa

SEQ ID NO: 3611301 - DNA, 16 bp, Homo sapiens
tcccaaggttacttaa

SEQ ID NO: 3611302 - DNA, 24 bp, Homo sapiens
tcccaatctttctatataaaatgt

SEQ ID NO: 3611303 - DNA, 16 bp, Homo sapiens
tcccaattgagaaaaa

SEQ ID NO: 3611304 - DNA, 22 bp, Homo sapiens
tcccacaaatgcaggtgtcctg

SEQ ID NO: 3611305 - DNA, 14 bp, Homo sapiens
tcccacaagtggtg

SEQ ID NO: 3611306 - DNA, 23 bp, Homo sapiens
tcccacactgtgcagacccagtc

SEQ ID NO: 3611307 - DNA, 16 bp, Homo sapiens
tcccacactgtggcca

SEQ ID NO: 3611308 - DNA, 19 bp, Homo sapiens
tcccacactgtggccaggc

SEQ ID NO: 3611309 - DNA, 22 bp, Homo sapiens
tcccacagcagccccaggagaa

SEQ ID NO: 3611310 - DNA, 23 bp, Homo sapiens
tcccacagcagccccaggagaag

SEQ ID NO: 3611311 - DNA, 16 bp, Homo sapiens
tcccacagcttcctga

SEQ ID NO: 3611312 - DNA, 17 bp, Homo sapiens
tcccacaggcccttcct

SEQ ID NO: 3611313 - DNA, 21 bp, Homo sapiens
tcccacaggcccttcctctcc

SEQ ID NO: 3611314 - DNA, 14 bp, Homo sapiens
tcccaccacaggca

SEQ ID NO: 3611315 - DNA, 14 bp, Homo sapiens
tcccaccccactca

SEQ ID NO: 3611316 - DNA, 21 bp, Homo sapiens
tcccaccccactcaggggacc

SEQ ID NO: 3611317 - DNA, 14 bp, Homo sapiens
tcccaccccctcct

SEQ ID NO: 3611318 - DNA, 15 bp, Homo sapiens
tcccaccccctcctc

SEQ ID NO: 3611319 - DNA, 23 bp, Homo sapiens
tcccacctctccttttgaggctt

SEQ ID NO: 3611320 - DNA, 19 bp, Homo sapiens
tcccacctgacacaccagg

SEQ ID NO: 3611321 - DNA, 23 bp, Homo sapiens
tcccacctgacacaccaggcgct

SEQ ID NO: 3611322 - DNA, 12 bp, Homo sapiens
tcccactccagc

SEQ ID NO: 3611323 - DNA, 15 bp, Homo sapiens
tcccactccagctga

SEQ ID NO: 3611324 - DNA, 20 bp, Homo sapiens
tcccactctgggcaaagccc

SEQ ID NO: 3611325 - DNA, 13 bp, Homo sapiens
tcccactgcccac

SEQ ID NO: 3611326 - DNA, 22 bp, Homo sapiens
tcccactttcatctaccttttc

SEQ ID NO: 3611327 - DNA, 14 bp, Homo sapiens
tcccagaacctcta

SEQ ID NO: 3611328 - DNA, 15 bp, Homo sapiens
tcccagacaggccct

SEQ ID NO: 3611329 - DNA, 17 bp, Homo sapiens
tcccagacaggccctcc

SEQ ID NO: 3611330 - DNA, 18 bp, Homo sapiens
tcccagacaggccctccc

SEQ ID NO: 3611331 - DNA, 23 bp, Homo sapiens
tcccagacaggccctccctgtct

SEQ ID NO: 3611332 - DNA, 16 bp, Homo sapiens
tcccagactactattt

SEQ ID NO: 3611333 - DNA, 16 bp, Homo sapiens
tcccagaggagccacc

SEQ ID NO: 3611334 - DNA, 23 bp, Homo sapiens
tcccagaggagccaccagttctc

SEQ ID NO: 3611335 - DNA, 21 bp, Homo sapiens
tcccagagtgctgggattaca

SEQ ID NO: 3611336 - DNA, 23 bp, Homo sapiens
tcccagcaagacctcatctgtgg

SEQ ID NO: 3611337 - DNA, 22 bp, Homo sapiens
tcccagcactttgggagtccaa

SEQ ID NO: 3611338 - DNA, 16 bp, Homo sapiens
tcccagctacctcaac

SEQ ID NO: 3611339 - DNA, 10 bp, Homo sapiens
tcccagctcc

SEQ ID NO: 3611340 - DNA, 18 bp, Homo sapiens
tcccagctctagcctctg

SEQ ID NO: 3611341 - DNA, 20 bp, Homo sapiens
tcccagctctagcctctgga

SEQ ID NO: 3611342 - DNA, 11 bp, Homo sapiens
tcccaggaact

SEQ ID NO: 3611343 - DNA, 18 bp, Homo sapiens
tcccaggcgccccttccc

SEQ ID NO: 3611344 - DNA, 14 bp, Homo sapiens
tcccatcctggggc

SEQ ID NO: 3611345 - DNA, 18 bp, Homo sapiens
tcccatcctggggcagca

SEQ ID NO: 3611346 - DNA, 16 bp, Homo sapiens
tcccattgtccctctg

SEQ ID NO: 3611347 - DNA, 20 bp, Homo sapiens
tcccatttagtgtgaatatt

SEQ ID NO: 3611348 - DNA, 14 bp, Homo sapiens
tcccatttcttccc

SEQ ID NO: 3611349 - DNA, 15 bp, Homo sapiens
tcccatttcttccca

SEQ ID NO: 3611350 - DNA, 23 bp, Homo sapiens
tccccactcccccgtttctcctt

SEQ ID NO: 3611351 - DNA, 11 bp, Homo sapiens
tccccagagaa

SEQ ID NO: 3611352 - DNA, 17 bp, Homo sapiens
tccccagccagcccttc

SEQ ID NO: 3611353 - DNA, 21 bp, Homo sapiens
tccccagccagcctggctggg

SEQ ID NO: 3611354 - DNA, 12 bp, Homo sapiens
tccccagcccag

SEQ ID NO: 3611355 - DNA, 15 bp, Homo sapiens
tccccagcccagaga

SEQ ID NO: 3611356 - DNA, 17 bp, Homo sapiens
tccccagcccagcaccc

SEQ ID NO: 3611357 - DNA, 24 bp, Homo sapiens
tccccagccccagccccttccatg

SEQ ID NO: 3611358 - DNA, 17 bp, Homo sapiens
tccccaggaggcctggg

SEQ ID NO: 3611359 - DNA, 13 bp, Homo sapiens
tccccagggagct

SEQ ID NO: 3611360 - DNA, 15 bp, Homo sapiens
tccccagggagctct

SEQ ID NO: 3611361 - DNA, 18 bp, Homo sapiens
tccccagggagctctggg

SEQ ID NO: 3611362 - DNA, 19 bp, Homo sapiens
tccccagggagctctgggg

SEQ ID NO: 3611363 - DNA, 16 bp, Homo sapiens
tccccagtgactccag

SEQ ID NO: 3611364 - DNA, 18 bp, Homo sapiens
tccccagtgactccaggg

SEQ ID NO: 3611365 - DNA, 21 bp, Homo sapiens
tccccagtgactccagggtga

SEQ ID NO: 3611366 - DNA, 19 bp, Homo sapiens
tccccatgggcacagtggt

SEQ ID NO: 3611367 - DNA, 22 bp, Homo sapiens
tccccattcttcctagttttct

SEQ ID NO: 3611368 - DNA, 20 bp, Homo sapiens
tcccccagcaacgcccctcc

SEQ ID NO: 3611369 - DNA, 13 bp, Homo sapiens
tcccccagcaagc

SEQ ID NO: 3611370 - DNA, 18 bp, Homo sapiens
tccccctccttgtgcctt

SEQ ID NO: 3611371 - DNA, 12 bp, Homo sapiens
tccccctgcaac

SEQ ID NO: 3611372 - DNA, 17 bp, Homo sapiens
tccccctggcactggtt

SEQ ID NO: 3611373 - DNA, 14 bp, Homo sapiens
tcccccttcacaaa

SEQ ID NO: 3611374 - DNA, 21 bp, Homo sapiens
tcccccttcatccatcctgag

SEQ ID NO: 3611375 - DNA, 13 bp, Homo sapiens
tcccccttcccct

SEQ ID NO: 3611376 - DNA, 19 bp, Homo sapiens
tccccctttcacactggat

SEQ ID NO: 3611377 - DNA, 22 bp, Homo sapiens
tccccgcagtgtgcactaaggg

SEQ ID NO: 3611378 - DNA, 12 bp, Homo sapiens
tccccgcccctg

SEQ ID NO: 3611379 - DNA, 16 bp, Homo sapiens
tccccgtctctgccct

SEQ ID NO: 3611380 - DNA, 22 bp, Homo sapiens
tccccgtctctgccctgggctc

SEQ ID NO: 3611381 - DNA, 15 bp, Homo sapiens
tcccctaaagcctca

SEQ ID NO: 3611382 - DNA, 14 bp, Homo sapiens
tcccctatgctggt

SEQ ID NO: 3611383 - DNA, 24 bp, Homo sapiens
tcccctatgctggtagatgctgag

SEQ ID NO: 3611384 - DNA, 15 bp, Homo sapiens
tcccctccctgcctg

SEQ ID NO: 3611385 - DNA, 18 bp, Homo sapiens
tcccctccctgcctgctc

SEQ ID NO: 3611386 - DNA, 13 bp, Homo sapiens
tcccctccctgta

SEQ ID NO: 3611387 - DNA, 16 bp, Homo sapiens
tcccctcggagaagag

SEQ ID NO: 3611388 - DNA, 15 bp, Homo sapiens
tcccctgttcactct

SEQ ID NO: 3611389 - DNA, 11 bp, Homo sapiens
tccccttccct

SEQ ID NO: 3611390 - DNA, 19 bp, Homo sapiens
tccccttcctaccacccgg

SEQ ID NO: 3611391 - DNA, 11 bp, Homo sapiens
tccccttcctg

SEQ ID NO: 3611392 - DNA, 13 bp, Homo sapiens
tccccttcctgtt

SEQ ID NO: 3611393 - DNA, 16 bp, Homo sapiens
tccccttctctgcctc

SEQ ID NO: 3611394 - DNA, 18 bp, Homo sapiens
tccccttctctgcctcac

SEQ ID NO: 3611395 - DNA, 13 bp, Homo sapiens
tcccgaaaaatgt

SEQ ID NO: 3611396 - DNA, 17 bp, Homo sapiens
tcccgcctccctctcag

SEQ ID NO: 3611397 - DNA, 13 bp, Homo sapiens
tcccgctcagccc

SEQ ID NO: 3611398 - DNA, 16 bp, Homo sapiens
tcccgctcagccctcc

SEQ ID NO: 3611399 - DNA, 20 bp, Homo sapiens
tcccgctcagccctccctgc

SEQ ID NO: 3611400 - DNA, 13 bp, Homo sapiens
tcccgctcccagg

SEQ ID NO: 3611401 - DNA, 13 bp, Homo sapiens
tcccggccagctc

SEQ ID NO: 3611402 - DNA, 18 bp, Homo sapiens
tcccggccagctctggag

SEQ ID NO: 3611403 - DNA, 20 bp, Homo sapiens
tcccggtgtatcctggccct

SEQ ID NO: 3611404 - DNA, 14 bp, Homo sapiens
tcccgtaaggctgt

SEQ ID NO: 3611405 - DNA, 19 bp, Homo sapiens
tcccgtaaggctgtacata

SEQ ID NO: 3611406 - DNA, 17 bp, Homo sapiens
tcccgtctggacctggg

SEQ ID NO: 3611407 - DNA, 12 bp, Homo sapiens
tccctaaactgc

SEQ ID NO: 3611408 - DNA, 22 bp, Homo sapiens
tccctaaactgcagcctctctg

SEQ ID NO: 3611409 - DNA, 16 bp, Homo sapiens
tccctacactgatgca

SEQ ID NO: 3611410 - DNA, 21 bp, Homo sapiens
tccctaccgagtctcttctcc

SEQ ID NO: 3611411 - DNA, 17 bp, Homo sapiens
tccctacttcctgtgac

SEQ ID NO: 3611412 - DNA, 20 bp, Homo sapiens
tccctcacctgtagcagcca

SEQ ID NO: 3611413 - DNA, 20 bp, Homo sapiens
tccctcaccttggcaccaga

SEQ ID NO: 3611414 - DNA, 13 bp, Homo sapiens
tccctccacccca

SEQ ID NO: 3611415 - DNA, 22 bp, Homo sapiens
tccctcccagaggagccaccag

SEQ ID NO: 3611416 - DNA, 12 bp, Homo sapiens
tccctccccccc

SEQ ID NO: 3611417 - DNA, 22 bp, Homo sapiens
tccctcctcagggatcacactg

SEQ ID NO: 3611418 - DNA, 15 bp, Homo sapiens
tccctcctttagtga

SEQ ID NO: 3611419 - DNA, 11 bp, Homo sapiens
tccctgagcag

SEQ ID NO: 3611420 - DNA, 15 bp, Homo sapiens
tccctgatcccaccc

SEQ ID NO: 3611421 - DNA, 16 bp, Homo sapiens
tccctgatcccacccc

SEQ ID NO: 3611422 - DNA, 18 bp, Homo sapiens
tccctgcatctgaccagc

SEQ ID NO: 3611423 - DNA, 18 bp, Homo sapiens
tccctgcctgctccttgg

SEQ ID NO: 3611424 - DNA, 15 bp, Homo sapiens
tccctgcctggaggc

SEQ ID NO: 3611425 - DNA, 16 bp, Homo sapiens
tccctgcctgtttccc

SEQ ID NO: 3611426 - DNA, 15 bp, Homo sapiens
tccctgcgagacgca

SEQ ID NO: 3611427 - DNA, 23 bp, Homo sapiens
tccctgcgagacgcacacagctg

SEQ ID NO: 3611428 - DNA, 22 bp, Homo sapiens
tccctgcggcctccacacctga

SEQ ID NO: 3611429 - DNA, 15 bp, Homo sapiens
tccctgctgaatgcc

SEQ ID NO: 3611430 - DNA, 15 bp, Homo sapiens
tccctgctgcgctgc

SEQ ID NO: 3611431 - DNA, 17 bp, Homo sapiens
tccctgctgctgccagg

SEQ ID NO: 3611432 - DNA, 20 bp, Homo sapiens
tccctgctgtgccatgctgg

SEQ ID NO: 3611433 - DNA, 16 bp, Homo sapiens
tccctgcttgcccgct

SEQ ID NO: 3611434 - DNA, 20 bp, Homo sapiens
tccctgcttgcccgctccca

SEQ ID NO: 3611435 - DNA, 13 bp, Homo sapiens
tccctgctttgca

SEQ ID NO: 3611436 - DNA, 10 bp, Homo sapiens
tccctggaca

SEQ ID NO: 3611437 - DNA, 11 bp, Homo sapiens
tccctggacac

SEQ ID NO: 3611438 - DNA, 18 bp, Homo sapiens
tccctggacacagctctt

SEQ ID NO: 3611439 - DNA, 18 bp, Homo sapiens
tccctggagcaggagccc

SEQ ID NO: 3611440 - DNA, 20 bp, Homo sapiens
tccctggctcactggcaggt

SEQ ID NO: 3611441 - DNA, 21 bp, Homo sapiens
tccctgtccctctagtgcctt

SEQ ID NO: 3611442 - DNA, 17 bp, Homo sapiens
tccctgtccttccctgt

SEQ ID NO: 3611443 - DNA, 21 bp, Homo sapiens
tccctgtccttccctgttctc

SEQ ID NO: 3611444 - DNA, 13 bp, Homo sapiens
tccctgtctccag

SEQ ID NO: 3611445 - DNA, 15 bp, Homo sapiens
tccctgtctccagct

SEQ ID NO: 3611446 - DNA, 16 bp, Homo sapiens
tccctgtctccagctg

SEQ ID NO: 3611447 - DNA, 21 bp, Homo sapiens
tccctgtctccagggccccca

SEQ ID NO: 3611448 - DNA, 23 bp, Homo sapiens
tccctgtctccagggcccccacc

SEQ ID NO: 3611449 - DNA, 17 bp, Homo sapiens
tccctgttccccagaga

SEQ ID NO: 3611450 - DNA, 19 bp, Homo sapiens
tccctgttctccctttctc

SEQ ID NO: 3611451 - DNA, 13 bp, Homo sapiens
tccctgttgtcag

SEQ ID NO: 3611452 - DNA, 13 bp, Homo sapiens
tcccttaataaaa

SEQ ID NO: 3611453 - DNA, 17 bp, Homo sapiens
tcccttaccctcctctg

SEQ ID NO: 3611454 - DNA, 22 bp, Homo sapiens
tcccttcaaccattccccatgg

SEQ ID NO: 3611455 - DNA, 17 bp, Homo sapiens
tcccttcccagcgctgc

SEQ ID NO: 3611456 - DNA, 13 bp, Homo sapiens
tcccttcctggaa

SEQ ID NO: 3611457 - DNA, 15 bp, Homo sapiens
tcccttcctggaaac

SEQ ID NO: 3611458 - DNA, 19 bp, Homo sapiens
tcccttcctggaaacagca

SEQ ID NO: 3611459 - DNA, 13 bp, Homo sapiens
tcccttctgctac

SEQ ID NO: 3611460 - DNA, 20 bp, Homo sapiens
tcccttctgctactggcaaa

SEQ ID NO: 3611461 - DNA, 21 bp, Homo sapiens
tcccttggacattttatgtct

SEQ ID NO: 3611462 - DNA, 23 bp, Homo sapiens
tcccttggacattttatgtcttt

SEQ ID NO: 3611463 - DNA, 14 bp, Homo sapiens
tccctttccctacc

SEQ ID NO: 3611464 - DNA, 16 bp, Homo sapiens
tccctttccctacctt

SEQ ID NO: 3611465 - DNA, 22 bp, Homo sapiens
tccctttctctctcctctctgc

SEQ ID NO: 3611466 - DNA, 14 bp, Homo sapiens
tcccttttccctta

SEQ ID NO: 3611467 - DNA, 19 bp, Homo sapiens
tccctttttttacatttca

SEQ ID NO: 3611468 - DNA, 23 bp, Homo sapiens
tccgactgcccctgctgtgctgc

SEQ ID NO: 3611469 - DNA, 17 bp, Homo sapiens
tccgagcctccagtcca

SEQ ID NO: 3611470 - DNA, 15 bp, Homo sapiens
tccgagctctggtgc

SEQ ID NO: 3611471 - DNA, 19 bp, Homo sapiens
tccgcagggcgcccagcgc

SEQ ID NO: 3611472 - DNA, 22 bp, Homo sapiens
tccgcagttgtagcagaaacca

SEQ ID NO: 3611473 - DNA, 18 bp, Homo sapiens
tccgcccactcctgggac

SEQ ID NO: 3611474 - DNA, 13 bp, Homo sapiens
tccgcctgtgggc

SEQ ID NO: 3611475 - DNA, 16 bp, Homo sapiens
tccgccttctcccaca

SEQ ID NO: 3611476 - DNA, 13 bp, Homo sapiens
tccggagcgccct

SEQ ID NO: 3611477 - DNA, 15 bp, Homo sapiens
tccggagcgccctgc

SEQ ID NO: 3611478 - DNA, 19 bp, Homo sapiens
tccggcggccccgccgcag

SEQ ID NO: 3611479 - DNA, 14 bp, Homo sapiens
tccgtcaccctggg

SEQ ID NO: 3611480 - DNA, 16 bp, Homo sapiens
tccgtcactacctggc

SEQ ID NO: 3611481 - DNA, 17 bp, Homo sapiens
tccgtcactacctggct

SEQ ID NO: 3611482 - DNA, 18 bp, Homo sapiens
tccgtcactacctggctg

SEQ ID NO: 3611483 - DNA, 17 bp, Homo sapiens
tccgtgccccttccctg

SEQ ID NO: 3611484 - DNA, 20 bp, Homo sapiens
tccgtgccccttccctgggt

SEQ ID NO: 3611485 - DNA, 13 bp, Homo sapiens
tccgtgctgacag

SEQ ID NO: 3611486 - DNA, 17 bp, Homo sapiens
tccgtgctgacagctgc

SEQ ID NO: 3611487 - DNA, 14 bp, Homo sapiens
tccgtgcttaacca

SEQ ID NO: 3611488 - DNA, 17 bp, Homo sapiens
tcctaaagaacaaagta

SEQ ID NO: 3611489 - DNA, 16 bp, Homo sapiens
tcctaaataaattatt

SEQ ID NO: 3611490 - DNA, 14 bp, Homo sapiens
tcctaatactgtca

SEQ ID NO: 3611491 - DNA, 15 bp, Homo sapiens
tcctaatactgtcat

SEQ ID NO: 3611492 - DNA, 22 bp, Homo sapiens
tcctaatcaaattctgtctggg

SEQ ID NO: 3611493 - DNA, 17 bp, Homo sapiens
tcctaatggctattttt

SEQ ID NO: 3611494 - DNA, 21 bp, Homo sapiens
tcctaccacccggtccccact

SEQ ID NO: 3611495 - DNA, 14 bp, Homo sapiens
tcctaccctcccac

SEQ ID NO: 3611496 - DNA, 15 bp, Homo sapiens
tcctacctcagcctc

SEQ ID NO: 3611497 - DNA, 14 bp, Homo sapiens
tcctacctgtctgc

SEQ ID NO: 3611498 - DNA, 17 bp, Homo sapiens
tcctacctgtctgctgc

SEQ ID NO: 3611499 - DNA, 21 bp, Homo sapiens
tcctacctgtctgctgccagc

SEQ ID NO: 3611500 - DNA, 19 bp, Homo sapiens
tcctactgcgcctcgtgct

SEQ ID NO: 3611501 - DNA, 15 bp, Homo sapiens
tcctagactgctcct

SEQ ID NO: 3611502 - DNA, 21 bp, Homo sapiens
tcctagactgctcctgggcat

SEQ ID NO: 3611503 - DNA, 22 bp, Homo sapiens
tcctagctaggagcaggcttgt

SEQ ID NO: 3611504 - DNA, 17 bp, Homo sapiens
tcctaggaaccagccaa

SEQ ID NO: 3611505 - DNA, 22 bp, Homo sapiens
tcctaggctccaccccatccag

SEQ ID NO: 3611506 - DNA, 22 bp, Homo sapiens
tcctatccttataggcctgtcc

SEQ ID NO: 3611507 - DNA, 17 bp, Homo sapiens
tcctatgatggatggca

SEQ ID NO: 3611508 - DNA, 19 bp, Homo sapiens
tcctatgatggatggcaga

SEQ ID NO: 3611509 - DNA, 13 bp, Homo sapiens
tcctcacacccct

SEQ ID NO: 3611510 - DNA, 12 bp, Homo sapiens
tcctcacccacc

SEQ ID NO: 3611511 - DNA, 22 bp, Homo sapiens
tcctcactctgtccctgtcctt

SEQ ID NO: 3611512 - DNA, 14 bp, Homo sapiens
tcctcactgtatcc

SEQ ID NO: 3611513 - DNA, 15 bp, Homo sapiens
tcctcagcacccctc

SEQ ID NO: 3611514 - DNA, 17 bp, Homo sapiens
tcctcagcacccctcca

SEQ ID NO: 3611515 - DNA, 20 bp, Homo sapiens
tcctcagcctcctcatctgg

SEQ ID NO: 3611516 - DNA, 18 bp, Homo sapiens
tcctcagccttgccagag

SEQ ID NO: 3611517 - DNA, 20 bp, Homo sapiens
tcctcagccttgccagagat

SEQ ID NO: 3611518 - DNA, 15 bp, Homo sapiens
tcctcagctccctgc

SEQ ID NO: 3611519 - DNA, 21 bp, Homo sapiens
tcctcagctccctgcctgttt

SEQ ID NO: 3611520 - DNA, 19 bp, Homo sapiens
tcctcagctgcctcctgcg

SEQ ID NO: 3611521 - DNA, 22 bp, Homo sapiens
tcctcagcttcttcacaggcac

SEQ ID NO: 3611522 - DNA, 21 bp, Homo sapiens
tcctcaggaagggggccgcca

SEQ ID NO: 3611523 - DNA, 21 bp, Homo sapiens
tcctcaggagccgaagcccag

SEQ ID NO: 3611524 - DNA, 19 bp, Homo sapiens
tcctcagtgatggaatatc

SEQ ID NO: 3611525 - DNA, 14 bp, Homo sapiens
tcctcatccctgac

SEQ ID NO: 3611526 - DNA, 22 bp, Homo sapiens
tcctcatctgagaggctctccg

SEQ ID NO: 3611527 - DNA, 20 bp, Homo sapiens
tcctcatctgggggagtgga

SEQ ID NO: 3611528 - DNA, 11 bp, Homo sapiens
tcctccacaga

SEQ ID NO: 3611529 - DNA, 14 bp, Homo sapiens
tcctccagcaggga

SEQ ID NO: 3611530 - DNA, 21 bp, Homo sapiens
tcctccaggtcggagtgcctg

SEQ ID NO: 3611531 - DNA, 12 bp, Homo sapiens
tcctccaggttt

SEQ ID NO: 3611532 - DNA, 13 bp, Homo sapiens
tcctccaggtttt

SEQ ID NO: 3611533 - DNA, 15 bp, Homo sapiens
tcctccaggtttttc

SEQ ID NO: 3611534 - DNA, 16 bp, Homo sapiens
tcctccaggtttttca

SEQ ID NO: 3611535 - DNA, 22 bp, Homo sapiens
tcctccaggtttttcaattaaa

SEQ ID NO: 3611536 - DNA, 20 bp, Homo sapiens
tcctcccaatttcagactcc

SEQ ID NO: 3611537 - DNA, 19 bp, Homo sapiens
tcctcccaggcgccccttc

SEQ ID NO: 3611538 - DNA, 21 bp, Homo sapiens
tcctcccaggcgccccttccc

SEQ ID NO: 3611539 - DNA, 18 bp, Homo sapiens
tcctcccctactctgccc

SEQ ID NO: 3611540 - DNA, 14 bp, Homo sapiens
tcctcccgccccgc

SEQ ID NO: 3611541 - DNA, 19 bp, Homo sapiens
tcctcccgccccgcccctc

SEQ ID NO: 3611542 - DNA, 19 bp, Homo sapiens
tcctcccgcccttccatgt

SEQ ID NO: 3611543 - DNA, 15 bp, Homo sapiens
tcctccctcagtgcc

SEQ ID NO: 3611544 - DNA, 22 bp, Homo sapiens
tcctccctgcatctgaccagca

SEQ ID NO: 3611545 - DNA, 14 bp, Homo sapiens
tcctcccttctgct

SEQ ID NO: 3611546 - DNA, 15 bp, Homo sapiens
tcctcccttctgcta

SEQ ID NO: 3611547 - DNA, 13 bp, Homo sapiens
tcctcctacctca

SEQ ID NO: 3611548 - DNA, 17 bp, Homo sapiens
tcctcctacctcagcct

SEQ ID NO: 3611549 - DNA, 19 bp, Homo sapiens
tcctcctacctcagcctcc

SEQ ID NO: 3611550 - DNA, 23 bp, Homo sapiens
tcctcctacctcagcctcctggg

SEQ ID NO: 3611551 - DNA, 21 bp, Homo sapiens
tcctcctcacccacctctggg

SEQ ID NO: 3611552 - DNA, 22 bp, Homo sapiens
tcctccttttcttcaccctccc

SEQ ID NO: 3611553 - DNA, 16 bp, Homo sapiens
tcctcggagagcagca

SEQ ID NO: 3611554 - DNA, 18 bp, Homo sapiens
tcctcggagagcagcagc

SEQ ID NO: 3611555 - DNA, 21 bp, Homo sapiens
tcctctagttgagtttctggc

SEQ ID NO: 3611556 - DNA, 13 bp, Homo sapiens
tcctctccactgc

SEQ ID NO: 3611557 - DNA, 15 bp, Homo sapiens
tcctctccactgcct

SEQ ID NO: 3611558 - DNA, 17 bp, Homo sapiens
tcctctccactgccttc

SEQ ID NO: 3611559 - DNA, 19 bp, Homo sapiens
tcctctcccattgtccctc

SEQ ID NO: 3611560 - DNA, 15 bp, Homo sapiens
tcctctccccagccc

SEQ ID NO: 3611561 - DNA, 19 bp, Homo sapiens
tcctctccccagcccagag

SEQ ID NO: 3611562 - DNA, 21 bp, Homo sapiens
tcctctccccagcccagagac

SEQ ID NO: 3611563 - DNA, 17 bp, Homo sapiens
tcctctcgagatagttt

SEQ ID NO: 3611564 - DNA, 23 bp, Homo sapiens
tcctctcggctgccaggggctct

SEQ ID NO: 3611565 - DNA, 19 bp, Homo sapiens
tcctctctgagtcaaatcc

SEQ ID NO: 3611566 - DNA, 11 bp, Homo sapiens
tcctctctgct

SEQ ID NO: 3611567 - DNA, 20 bp, Homo sapiens
tcctctgcacgctcaatgcc

SEQ ID NO: 3611568 - DNA, 22 bp, Homo sapiens
tcctctgcacgctcaatgccca

SEQ ID NO: 3611569 - DNA, 12 bp, Homo sapiens
tcctctgcactc

SEQ ID NO: 3611570 - DNA, 12 bp, Homo sapiens
tcctctgcagtt

SEQ ID NO: 3611571 - DNA, 22 bp, Homo sapiens
tcctctggctccccaaggctgc

SEQ ID NO: 3611572 - DNA, 18 bp, Homo sapiens
tcctcttgttcctgaaat

SEQ ID NO: 3611573 - DNA, 15 bp, Homo sapiens
tcctcttttcctggc

SEQ ID NO: 3611574 - DNA, 20 bp, Homo sapiens
tcctcttttcctggcagctg

SEQ ID NO: 3611575 - DNA, 17 bp, Homo sapiens
tcctgaaacaacttgga

SEQ ID NO: 3611576 - DNA, 17 bp, Homo sapiens
tcctgaaatatccagga

SEQ ID NO: 3611577 - DNA, 19 bp, Homo sapiens
tcctgaaatatccaggaat

SEQ ID NO: 3611578 - DNA, 20 bp, Homo sapiens
tcctgaaatgtgtttccttt

SEQ ID NO: 3611579 - DNA, 17 bp, Homo sapiens
tcctgaactttctccct

SEQ ID NO: 3611580 - DNA, 21 bp, Homo sapiens
tcctgaactttctccctcatc

SEQ ID NO: 3611581 - DNA, 16 bp, Homo sapiens
tcctgaagtgacctca

SEQ ID NO: 3611582 - DNA, 17 bp, Homo sapiens
tcctgaagtgacctcac

SEQ ID NO: 3611583 - DNA, 16 bp, Homo sapiens
tcctgaatctgtgcaa

SEQ ID NO: 3611584 - DNA, 16 bp, Homo sapiens
tcctgacccctgcctg

SEQ ID NO: 3611585 - DNA, 13 bp, Homo sapiens
tcctgacttttaa

SEQ ID NO: 3611586 - DNA, 15 bp, Homo sapiens
tcctgagtgccccac

SEQ ID NO: 3611587 - DNA, 18 bp, Homo sapiens
tcctgagtgccccacttc

SEQ ID NO: 3611588 - DNA, 20 bp, Homo sapiens
tcctgcaaaaggaggtgaaa

SEQ ID NO: 3611589 - DNA, 13 bp, Homo sapiens
tcctgcacacagg

SEQ ID NO: 3611590 - DNA, 18 bp, Homo sapiens
tcctgcacacagggcagt

SEQ ID NO: 3611591 - DNA, 19 bp, Homo sapiens
tcctgcacatgagtggaaa

SEQ ID NO: 3611592 - DNA, 22 bp, Homo sapiens
tcctgcagatactttgaagtgc

SEQ ID NO: 3611593 - DNA, 13 bp, Homo sapiens
tcctgcagcctgc

SEQ ID NO: 3611594 - DNA, 17 bp, Homo sapiens
tcctgcagcctgcagga

SEQ ID NO: 3611595 - DNA, 19 bp, Homo sapiens
tcctgcagggcttctcctc

SEQ ID NO: 3611596 - DNA, 21 bp, Homo sapiens
tcctgcagtctggctgagccc

SEQ ID NO: 3611597 - DNA, 16 bp, Homo sapiens
tcctgcatctctgtga

SEQ ID NO: 3611598 - DNA, 15 bp, Homo sapiens
tcctgccccctgcca

SEQ ID NO: 3611599 - DNA, 19 bp, Homo sapiens
tcctgcctattatctgtca

SEQ ID NO: 3611600 - DNA, 14 bp, Homo sapiens
tcctgcctcatgcg

SEQ ID NO: 3611601 - DNA, 18 bp, Homo sapiens
tcctgcctgtctgaagcc

SEQ ID NO: 3611602 - DNA, 13 bp, Homo sapiens
tcctgctgcaccc

SEQ ID NO: 3611603 - DNA, 15 bp, Homo sapiens
tcctgctgcaccctg

SEQ ID NO: 3611604 - DNA, 23 bp, Homo sapiens
tcctgctgcaccctgcgcctcca

SEQ ID NO: 3611605 - DNA, 12 bp, Homo sapiens
tcctgctgctgc

SEQ ID NO: 3611606 - DNA, 17 bp, Homo sapiens
tcctgctggggccgcca

SEQ ID NO: 3611607 - DNA, 14 bp, Homo sapiens
tcctgctggtacct

SEQ ID NO: 3611608 - DNA, 17 bp, Homo sapiens
tcctgcttttctgtcct

SEQ ID NO: 3611609 - DNA, 18 bp, Homo sapiens
tcctgcttttctgtcctg

SEQ ID NO: 3611610 - DNA, 22 bp, Homo sapiens
tcctgcttttctgtcctgggca

SEQ ID NO: 3611611 - DNA, 14 bp, Homo sapiens
tcctggaaacagca

SEQ ID NO: 3611612 - DNA, 15 bp, Homo sapiens
tcctggaaacagcat

SEQ ID NO: 3611613 - DNA, 16 bp, Homo sapiens
tcctggactcctgcca

SEQ ID NO: 3611614 - DNA, 22 bp, Homo sapiens
tcctggcacaatgttggagcag

SEQ ID NO: 3611615 - DNA, 13 bp, Homo sapiens
tcctggcagctgc

SEQ ID NO: 3611616 - DNA, 19 bp, Homo sapiens
tcctggcagggccacctgc

SEQ ID NO: 3611617 - DNA, 14 bp, Homo sapiens
tcctggccatccca

SEQ ID NO: 3611618 - DNA, 15 bp, Homo sapiens
tcctggccatcccac

SEQ ID NO: 3611619 - DNA, 23 bp, Homo sapiens
tcctgggcacacgctgctctgcc

SEQ ID NO: 3611620 - DNA, 22 bp, Homo sapiens
tcctgggcatgggtccagggcc

SEQ ID NO: 3611621 - DNA, 23 bp, Homo sapiens
tcctgggcatgggtccagggcct

SEQ ID NO: 3611622 - DNA, 21 bp, Homo sapiens
tcctgggccggctgagtggca

SEQ ID NO: 3611623 - DNA, 13 bp, Homo sapiens
tcctgggcctgca

SEQ ID NO: 3611624 - DNA, 13 bp, Homo sapiens
tcctgggcctttg

SEQ ID NO: 3611625 - DNA, 15 bp, Homo sapiens
tcctgtaccaaatct

SEQ ID NO: 3611626 - DNA, 23 bp, Homo sapiens
tcctgtaccaaatctgacatatt

SEQ ID NO: 3611627 - DNA, 15 bp, Homo sapiens
tcctgtccagctcca

SEQ ID NO: 3611628 - DNA, 14 bp, Homo sapiens
tcctgtcccttttc

SEQ ID NO: 3611629 - DNA, 18 bp, Homo sapiens
tcctgtcccttttccctt

SEQ ID NO: 3611630 - DNA, 24 bp, Homo sapiens
tcctgtcctgctcattatgccact

SEQ ID NO: 3611631 - DNA, 22 bp, Homo sapiens
tcctgtcgaaggggaggcacac

SEQ ID NO: 3611632 - DNA, 23 bp, Homo sapiens
tcctgtcgaaggggaggcacact

SEQ ID NO: 3611633 - DNA, 14 bp, Homo sapiens
tcctgtcttctttc

SEQ ID NO: 3611634 - DNA, 15 bp, Homo sapiens
tcctgtcttctttct

SEQ ID NO: 3611635 - DNA, 18 bp, Homo sapiens
tcctgtcttctttctcca

SEQ ID NO: 3611636 - DNA, 21 bp, Homo sapiens
tcctgtcttctttctccatgg

SEQ ID NO: 3611637 - DNA, 18 bp, Homo sapiens
tcctgtgacttcagctct

SEQ ID NO: 3611638 - DNA, 24 bp, Homo sapiens
tcctgtgccctagatgcacgtggg

SEQ ID NO: 3611639 - DNA, 16 bp, Homo sapiens
tcctgtgcctttccta

SEQ ID NO: 3611640 - DNA, 17 bp, Homo sapiens
tcctgtggatgcaaata

SEQ ID NO: 3611641 - DNA, 19 bp, Homo sapiens
tcctgtgtgaccctgggca

SEQ ID NO: 3611642 - DNA, 20 bp, Homo sapiens
tcctgtgtgaccctgggcag

SEQ ID NO: 3611643 - DNA, 20 bp, Homo sapiens
tcctgttctgcgctgtgtac

SEQ ID NO: 3611644 - DNA, 15 bp, Homo sapiens
tcctgttgccatgga

SEQ ID NO: 3611645 - DNA, 17 bp, Homo sapiens
tcctgttgtcaagaata

SEQ ID NO: 3611646 - DNA, 15 bp, Homo sapiens
tccttaacccacctc

SEQ ID NO: 3611647 - DNA, 21 bp, Homo sapiens
tccttaagtatatcatgtaaa

SEQ ID NO: 3611648 - DNA, 15 bp, Homo sapiens
tccttatccctctct

SEQ ID NO: 3611649 - DNA, 16 bp, Homo sapiens
tccttatctctttcca

SEQ ID NO: 3611650 - DNA, 21 bp, Homo sapiens
tccttatgtatcagtgtcctt

SEQ ID NO: 3611651 - DNA, 15 bp, Homo sapiens
tccttatgtcctgtc

SEQ ID NO: 3611652 - DNA, 18 bp, Homo sapiens
tccttatgtcctgtcata

SEQ ID NO: 3611653 - DNA, 16 bp, Homo sapiens
tccttattcagcctta

SEQ ID NO: 3611654 - DNA, 14 bp, Homo sapiens
tccttatttgcctt

SEQ ID NO: 3611655 - DNA, 16 bp, Homo sapiens
tccttatttgccttct

SEQ ID NO: 3611656 - DNA, 21 bp, Homo sapiens
tccttatttgccttctactcc

SEQ ID NO: 3611657 - DNA, 14 bp, Homo sapiens
tccttcagatattt

SEQ ID NO: 3611658 - DNA, 12 bp, Homo sapiens
tccttcaggcag

SEQ ID NO: 3611659 - DNA, 13 bp, Homo sapiens
tccttcaggcagc

SEQ ID NO: 3611660 - DNA, 20 bp, Homo sapiens
tccttcagtgagcccctccc

SEQ ID NO: 3611661 - DNA, 14 bp, Homo sapiens
tccttctcactgcc

SEQ ID NO: 3611662 - DNA, 17 bp, Homo sapiens
tccttctcactgccatg

SEQ ID NO: 3611663 - DNA, 23 bp, Homo sapiens
tccttctgaagtctgagcccatt

SEQ ID NO: 3611664 - DNA, 13 bp, Homo sapiens
tccttcttcccaa

SEQ ID NO: 3611665 - DNA, 14 bp, Homo sapiens
tccttctttcctct

SEQ ID NO: 3611666 - DNA, 22 bp, Homo sapiens
tccttctttctagttcagctgc

SEQ ID NO: 3611667 - DNA, 22 bp, Homo sapiens
tccttgaacaagatgtgggcct

SEQ ID NO: 3611668 - DNA, 19 bp, Homo sapiens
tccttgaatatctttcgat

SEQ ID NO: 3611669 - DNA, 17 bp, Homo sapiens
tccttgattacttccac

SEQ ID NO: 3611670 - DNA, 22 bp, Homo sapiens
tccttggaaatcaaatgtaaag

SEQ ID NO: 3611671 - DNA, 12 bp, Homo sapiens
tccttggactcc

SEQ ID NO: 3611672 - DNA, 18 bp, Homo sapiens
tccttggcacccccatgc

SEQ ID NO: 3611673 - DNA, 19 bp, Homo sapiens
tccttggcacccccatgct

SEQ ID NO: 3611674 - DNA, 23 bp, Homo sapiens
tccttggcacccccatgctgcct

SEQ ID NO: 3611675 - DNA, 15 bp, Homo sapiens
tccttggccacagac

SEQ ID NO: 3611676 - DNA, 20 bp, Homo sapiens
tccttggctttatgcaaata

SEQ ID NO: 3611677 - DNA, 22 bp, Homo sapiens
tccttggctttatgcaaataca

SEQ ID NO: 3611678 - DNA, 18 bp, Homo sapiens
tccttggctttcagagcc

SEQ ID NO: 3611679 - DNA, 20 bp, Homo sapiens
tccttgggcgtctctaatgt

SEQ ID NO: 3611680 - DNA, 21 bp, Homo sapiens
tccttgtcacgatcacaggcc

SEQ ID NO: 3611681 - DNA, 13 bp, Homo sapiens
tccttgtcactgg

SEQ ID NO: 3611682 - DNA, 13 bp, Homo sapiens
tccttgtggccta

SEQ ID NO: 3611683 - DNA, 18 bp, Homo sapiens
tccttgtggcctatgaaa

SEQ ID NO: 3611684 - DNA, 20 bp, Homo sapiens
tcctttaaatttcagctttg

SEQ ID NO: 3611685 - DNA, 18 bp, Homo sapiens
tcctttaatatgaaattt

SEQ ID NO: 3611686 - DNA, 21 bp, Homo sapiens
tcctttaattttttactattt

SEQ ID NO: 3611687 - DNA, 15 bp, Homo sapiens
tcctttacctttcag

SEQ ID NO: 3611688 - DNA, 14 bp, Homo sapiens
tcctttatctgtaa

SEQ ID NO: 3611689 - DNA, 12 bp, Homo sapiens
tcctttcttgat

SEQ ID NO: 3611690 - DNA, 13 bp, Homo sapiens
tcctttgtacttt

SEQ ID NO: 3611691 - DNA, 15 bp, Homo sapiens
tcctttgtctttctt

SEQ ID NO: 3611692 - DNA, 19 bp, Homo sapiens
tccttttaaaacacttcca

SEQ ID NO: 3611693 - DNA, 13 bp, Homo sapiens
tccttttatataa

SEQ ID NO: 3611694 - DNA, 17 bp, Homo sapiens
tccttttatctccttgt

SEQ ID NO: 3611695 - DNA, 12 bp, Homo sapiens
tccttttcactg

SEQ ID NO: 3611696 - DNA, 23 bp, Homo sapiens
tccttttccttatttgccttcta

SEQ ID NO: 3611697 - DNA, 19 bp, Homo sapiens
tccttttcttcaccctccc

SEQ ID NO: 3611698 - DNA, 14 bp, Homo sapiens
tccttttgctcttt

SEQ ID NO: 3611699 - DNA, 21 bp, Homo sapiens
tcctttttcttcgctggacta

SEQ ID NO: 3611700 - DNA, 14 bp, Homo sapiens
tccttttttataca

SEQ ID NO: 3611701 - DNA, 14 bp, Homo sapiens
tcgaactcctgacc

SEQ ID NO: 3611702 - DNA, 21 bp, Homo sapiens
tcgaactcttctttgctgcat

SEQ ID NO: 3611703 - DNA, 16 bp, Homo sapiens
tcgaaggggaggcaca

SEQ ID NO: 3611704 - DNA, 22 bp, Homo sapiens
tcgaaggggaggcacactttct

SEQ ID NO: 3611705 - DNA, 18 bp, Homo sapiens
tcgacagggcctggagcc

SEQ ID NO: 3611706 - DNA, 21 bp, Homo sapiens
tcgacagggcctggagcccca

SEQ ID NO: 3611707 - DNA, 21 bp, Homo sapiens
tcgaccccaaaggaacactga

SEQ ID NO: 3611708 - DNA, 23 bp, Homo sapiens
tcgaccccaaaggaacactgaca

SEQ ID NO: 3611709 - DNA, 15 bp, Homo sapiens
tcgactggtccagct

SEQ ID NO: 3611710 - DNA, 16 bp, Homo sapiens
tcgactggtccagctc

SEQ ID NO: 3611711 - DNA, 18 bp, Homo sapiens
tcgactggtccagctctg

SEQ ID NO: 3611712 - DNA, 19 bp, Homo sapiens
tcgactggtccagctctga

SEQ ID NO: 3611713 - DNA, 23 bp, Homo sapiens
tcgaggccacattgctggctgcc

SEQ ID NO: 3611714 - DNA, 22 bp, Homo sapiens
tcgatatttattgatgttttca

SEQ ID NO: 3611715 - DNA, 21 bp, Homo sapiens
tcgattgtgtacttttccttt

SEQ ID NO: 3611716 - DNA, 21 bp, Homo sapiens
tcgcactctggcagcaccgcc

SEQ ID NO: 3611717 - DNA, 17 bp, Homo sapiens
tcgcagccccgggcgga

SEQ ID NO: 3611718 - DNA, 11 bp, Homo sapiens
tcgcccagcag

SEQ ID NO: 3611719 - DNA, 13 bp, Homo sapiens
tcgcccagcagga

SEQ ID NO: 3611720 - DNA, 14 bp, Homo sapiens
tcgcccagcaggag

SEQ ID NO: 3611721 - DNA, 15 bp, Homo sapiens
tcgcccagcaggaga

SEQ ID NO: 3611722 - DNA, 13 bp, Homo sapiens
tcgccctcccagg

SEQ ID NO: 3611723 - DNA, 16 bp, Homo sapiens
tcgccgtgtctcagcc

SEQ ID NO: 3611724 - DNA, 23 bp, Homo sapiens
tcgccgtgtctcagcctctgcca

SEQ ID NO: 3611725 - DNA, 13 bp, Homo sapiens
tcgcctgcctgca

SEQ ID NO: 3611726 - DNA, 15 bp, Homo sapiens
tcgcgctggaatcca

SEQ ID NO: 3611727 - DNA, 21 bp, Homo sapiens
tcgctctgttgcccaggctgg

SEQ ID NO: 3611728 - DNA, 20 bp, Homo sapiens
tcggactgcccccagaaagc

SEQ ID NO: 3611729 - DNA, 12 bp, Homo sapiens
tcggagaagagc

SEQ ID NO: 3611730 - DNA, 14 bp, Homo sapiens
tcggagagcagcag

SEQ ID NO: 3611731 - DNA, 18 bp, Homo sapiens
tcggagagggacatagaa

SEQ ID NO: 3611732 - DNA, 17 bp, Homo sapiens
tcggaggcccatgccct

SEQ ID NO: 3611733 - DNA, 21 bp, Homo sapiens
tcggagggatggagaaagaag

SEQ ID NO: 3611734 - DNA, 14 bp, Homo sapiens
tcggagggtgccgt

SEQ ID NO: 3611735 - DNA, 19 bp, Homo sapiens
tcggagtgcctggagtcag

SEQ ID NO: 3611736 - DNA, 15 bp, Homo sapiens
tcggatccccttcct

SEQ ID NO: 3611737 - DNA, 12 bp, Homo sapiens
tcggcacacact

SEQ ID NO: 3611738 - DNA, 20 bp, Homo sapiens
tcggcagccttaaggccctc

SEQ ID NO: 3611739 - DNA, 20 bp, Homo sapiens
tcggctactggttacctgga

SEQ ID NO: 3611740 - DNA, 21 bp, Homo sapiens
tcggctactggttacctggag

SEQ ID NO: 3611741 - DNA, 22 bp, Homo sapiens
tcggctactggttacctggaga

SEQ ID NO: 3611742 - DNA, 16 bp, Homo sapiens
tcggctctgcatgttt

SEQ ID NO: 3611743 - DNA, 13 bp, Homo sapiens
tcggctgccaggg

SEQ ID NO: 3611744 - DNA, 20 bp, Homo sapiens
tcgggagccttgtcagtgtg

SEQ ID NO: 3611745 - DNA, 13 bp, Homo sapiens
tcgggcagccagc

SEQ ID NO: 3611746 - DNA, 15 bp, Homo sapiens
tcgggcagccagcag

SEQ ID NO: 3611747 - DNA, 16 bp, Homo sapiens
tcgggcagccagcaga

SEQ ID NO: 3611748 - DNA, 23 bp, Homo sapiens
tcgggccccatcctcatccctga

SEQ ID NO: 3611749 - DNA, 18 bp, Homo sapiens
tcgggtgaatctgtctat

SEQ ID NO: 3611750 - DNA, 20 bp, Homo sapiens
tcggtatctggcttccctgg

SEQ ID NO: 3611751 - DNA, 21 bp, Homo sapiens
tcggtgtccccaccatctgct

SEQ ID NO: 3611752 - DNA, 12 bp, Homo sapiens
tcgtccagggag

SEQ ID NO: 3611753 - DNA, 18 bp, Homo sapiens
tcgtcttgaacgagcagc

SEQ ID NO: 3611754 - DNA, 19 bp, Homo sapiens
tcgtcttgaacgagcagcc

SEQ ID NO: 3611755 - DNA, 22 bp, Homo sapiens
tcgtcttgaacgagcagcccag

SEQ ID NO: 3611756 - DNA, 14 bp, Homo sapiens
tcgtgagtcattta

SEQ ID NO: 3611757 - DNA, 19 bp, Homo sapiens
tcgtgagtcatttaaatgt

SEQ ID NO: 3611758 - DNA, 13 bp, Homo sapiens
tcgtgggaaaggg

SEQ ID NO: 3611759 - DNA, 15 bp, Homo sapiens
tcgtgggaaagggga

SEQ ID NO: 3611760 - DNA, 15 bp, Homo sapiens
tcgtgtatttattac

SEQ ID NO: 3611761 - DNA, 21 bp, Homo sapiens
tcgtgtgtttctattttttga

SEQ ID NO: 3611762 - DNA, 15 bp, Homo sapiens
tcgtgttggtatttt

SEQ ID NO: 3611763 - DNA, 19 bp, Homo sapiens
tcgttacattgtgtcctgc

SEQ ID NO: 3611764 - DNA, 23 bp, Homo sapiens
tctaaaagtttctacattcagat

SEQ ID NO: 3611765 - DNA, 12 bp, Homo sapiens
tctaaaatggca

SEQ ID NO: 3611766 - DNA, 22 bp, Homo sapiens
tctaaacagacaggaatttaga

SEQ ID NO: 3611767 - DNA, 14 bp, Homo sapiens
tctaaagagcatct

SEQ ID NO: 3611768 - DNA, 16 bp, Homo sapiens
tctaaaggctgttaaa

SEQ ID NO: 3611769 - DNA, 21 bp, Homo sapiens
tctaaataggatcctggaggc

SEQ ID NO: 3611770 - DNA, 21 bp, Homo sapiens
tctaaatggtgctgcagattt

SEQ ID NO: 3611771 - DNA, 19 bp, Homo sapiens
tctaaattttctaaataac

SEQ ID NO: 3611772 - DNA, 23 bp, Homo sapiens
tctaacaagtcataggttaatat

SEQ ID NO: 3611773 - DNA, 12 bp, Homo sapiens
tctaacagccct

SEQ ID NO: 3611774 - DNA, 13 bp, Homo sapiens
tctaacagccctc

SEQ ID NO: 3611775 - DNA, 21 bp, Homo sapiens
tctaacagccctcctctgcac

SEQ ID NO: 3611776 - DNA, 23 bp, Homo sapiens
tctaagcaaccacactgcttggc

SEQ ID NO: 3611777 - DNA, 14 bp, Homo sapiens
tctaagtaaaacca

SEQ ID NO: 3611778 - DNA, 21 bp, Homo sapiens
tctaagtaaaaccacagcagt

SEQ ID NO: 3611779 - DNA, 17 bp, Homo sapiens
tctaagtatttaaatgt

SEQ ID NO: 3611780 - DNA, 19 bp, Homo sapiens
tctaagtatttaaatgttc

SEQ ID NO: 3611781 - DNA, 17 bp, Homo sapiens
tctaagtgctgctgtgg

SEQ ID NO: 3611782 - DNA, 17 bp, Homo sapiens
tctaataaacactgttt

SEQ ID NO: 3611783 - DNA, 13 bp, Homo sapiens
tctaatattagtt

SEQ ID NO: 3611784 - DNA, 16 bp, Homo sapiens
tctaatcagtgattat

SEQ ID NO: 3611785 - DNA, 15 bp, Homo sapiens
tctaatctgaactga

SEQ ID NO: 3611786 - DNA, 17 bp, Homo sapiens
tctaatgattcaaatgt

SEQ ID NO: 3611787 - DNA, 18 bp, Homo sapiens
tctaatgccttttgaata

SEQ ID NO: 3611788 - DNA, 16 bp, Homo sapiens
tctaattaaaacactt

SEQ ID NO: 3611789 - DNA, 17 bp, Homo sapiens
tctaattcttcctttgt

SEQ ID NO: 3611790 - DNA, 20 bp, Homo sapiens
tctacagctaatcagcattc

SEQ ID NO: 3611791 - DNA, 12 bp, Homo sapiens
tctaccaagctg

SEQ ID NO: 3611792 - DNA, 15 bp, Homo sapiens
tctacctcttggctg

SEQ ID NO: 3611793 - DNA, 15 bp, Homo sapiens
tctactaaaaatgca

SEQ ID NO: 3611794 - DNA, 15 bp, Homo sapiens
tctactaagttattt

SEQ ID NO: 3611795 - DNA, 21 bp, Homo sapiens
tctactaagttattttatgac

SEQ ID NO: 3611796 - DNA, 12 bp, Homo sapiens
tctactcccctt

SEQ ID NO: 3611797 - DNA, 16 bp, Homo sapiens
tctactggtcttgtgg

SEQ ID NO: 3611798 - DNA, 20 bp, Homo sapiens
tctactggtcttgtggaatt

SEQ ID NO: 3611799 - DNA, 23 bp, Homo sapiens
tctactggtcttgtggaattggg

SEQ ID NO: 3611800 - DNA, 15 bp, Homo sapiens
tctagaacacaggca

SEQ ID NO: 3611801 - DNA, 16 bp, Homo sapiens
tctagaacacaggcaa

SEQ ID NO: 3611802 - DNA, 23 bp, Homo sapiens
tctagagagggaggcaagccctg

SEQ ID NO: 3611803 - DNA, 22 bp, Homo sapiens
tctagcaaccgcctcaaaatgt

SEQ ID NO: 3611804 - DNA, 17 bp, Homo sapiens
tctagcctctggactgg

SEQ ID NO: 3611805 - DNA, 22 bp, Homo sapiens
tctagcctctggactggaaagc

SEQ ID NO: 3611806 - DNA, 13 bp, Homo sapiens
tctagctctcaca

SEQ ID NO: 3611807 - DNA, 14 bp, Homo sapiens
tctagctctcacag

SEQ ID NO: 3611808 - DNA, 16 bp, Homo sapiens
tctagctttgtttagt

SEQ ID NO: 3611809 - DNA, 16 bp, Homo sapiens
tctaggcactgagcag

SEQ ID NO: 3611810 - DNA, 12 bp, Homo sapiens
tctaggccctgt

SEQ ID NO: 3611811 - DNA, 22 bp, Homo sapiens
tctaggccctgtgagcacaaag

SEQ ID NO: 3611812 - DNA, 16 bp, Homo sapiens
tctaggcctttcctct

SEQ ID NO: 3611813 - DNA, 20 bp, Homo sapiens
tctaggcctttcctctgcac

SEQ ID NO: 3611814 - DNA, 22 bp, Homo sapiens
tctaggcctttcctctgcacgc

SEQ ID NO: 3611815 - DNA, 17 bp, Homo sapiens
tctaggttttacagatt

SEQ ID NO: 3611816 - DNA, 21 bp, Homo sapiens
tctagttctttcctccccctg

SEQ ID NO: 3611817 - DNA, 22 bp, Homo sapiens
tctataacagatcctttcaaaa

SEQ ID NO: 3611818 - DNA, 20 bp, Homo sapiens
tctataaccaaatgaaatat

SEQ ID NO: 3611819 - DNA, 12 bp, Homo sapiens
tctataatttac

SEQ ID NO: 3611820 - DNA, 16 bp, Homo sapiens
tctataatttacctaa

SEQ ID NO: 3611821 - DNA, 22 bp, Homo sapiens
tctatacagtagcttgaaattg

SEQ ID NO: 3611822 - DNA, 14 bp, Homo sapiens
tctatactgtggcc

SEQ ID NO: 3611823 - DNA, 19 bp, Homo sapiens
tctatactgtggcctgcag

SEQ ID NO: 3611824 - DNA, 21 bp, Homo sapiens
tctatataaaatgtattcaag

SEQ ID NO: 3611825 - DNA, 15 bp, Homo sapiens
tctatattcctccag

SEQ ID NO: 3611826 - DNA, 14 bp, Homo sapiens
tctatcagaaatac

SEQ ID NO: 3611827 - DNA, 19 bp, Homo sapiens
tctatcagaaatacaaaaa

SEQ ID NO: 3611828 - DNA, 20 bp, Homo sapiens
tctatcagaaatacaaaaaa

SEQ ID NO: 3611829 - DNA, 22 bp, Homo sapiens
tctatgtatcaaatgtaactta

SEQ ID NO: 3611830 - DNA, 21 bp, Homo sapiens
tctattaatcaagagaaactt

SEQ ID NO: 3611831 - DNA, 20 bp, Homo sapiens
tctattatgttatcatcctc

SEQ ID NO: 3611832 - DNA, 15 bp, Homo sapiens
tctattctccagaca

SEQ ID NO: 3611833 - DNA, 18 bp, Homo sapiens
tctattctgtcagtgtta

SEQ ID NO: 3611834 - DNA, 22 bp, Homo sapiens
tctattgatacaatattgtgca

SEQ ID NO: 3611835 - DNA, 13 bp, Homo sapiens
tctattgtttgtt

SEQ ID NO: 3611836 - DNA, 15 bp, Homo sapiens
tctatttaaaaaatg

SEQ ID NO: 3611837 - DNA, 14 bp, Homo sapiens
tctatttatttatt

SEQ ID NO: 3611838 - DNA, 13 bp, Homo sapiens
tctattttactgt

SEQ ID NO: 3611839 - DNA, 14 bp, Homo sapiens
tctattttagaata

SEQ ID NO: 3611840 - DNA, 13 bp, Homo sapiens
tctattttctcat

SEQ ID NO: 3611841 - DNA, 17 bp, Homo sapiens
tctattttgtaaactca

SEQ ID NO: 3611842 - DNA, 14 bp, Homo sapiens
tctcaaaacaaaac

SEQ ID NO: 3611843 - DNA, 16 bp, Homo sapiens
tctcaaagagaattgt

SEQ ID NO: 3611844 - DNA, 17 bp, Homo sapiens
tctcaaagtgtggtctc

SEQ ID NO: 3611845 - DNA, 12 bp, Homo sapiens
tctcaaagtttt

SEQ ID NO: 3611846 - DNA, 18 bp, Homo sapiens
tctcaagagggcactggt

SEQ ID NO: 3611847 - DNA, 15 bp, Homo sapiens
tctcaagtaaaacaa

SEQ ID NO: 3611848 - DNA, 19 bp, Homo sapiens
tctcaagtaaaacaaatga

SEQ ID NO: 3611849 - DNA, 18 bp, Homo sapiens
tctcacagacatatagaa

SEQ ID NO: 3611850 - DNA, 14 bp, Homo sapiens
tctcacgcagccag

SEQ ID NO: 3611851 - DNA, 12 bp, Homo sapiens
tctcactcacca

SEQ ID NO: 3611852 - DNA, 15 bp, Homo sapiens
tctcactctgttgcc

SEQ ID NO: 3611853 - DNA, 14 bp, Homo sapiens
tctcactgaactcc

SEQ ID NO: 3611854 - DNA, 18 bp, Homo sapiens
tctcactgaactccaccg

SEQ ID NO: 3611855 - DNA, 18 bp, Homo sapiens
tctcagaaataaatcaca

SEQ ID NO: 3611856 - DNA, 19 bp, Homo sapiens
tctcagaaataaatcacag

SEQ ID NO: 3611857 - DNA, 23 bp, Homo sapiens
tctcagaaataaatcacagatgc

SEQ ID NO: 3611858 - DNA, 20 bp, Homo sapiens
tctcagaggcctgctgccag

SEQ ID NO: 3611859 - DNA, 14 bp, Homo sapiens
tctcagctgtgcct

SEQ ID NO: 3611860 - DNA, 15 bp, Homo sapiens
tctcagctgtgcctt

SEQ ID NO: 3611861 - DNA, 16 bp, Homo sapiens
tctcaggagatggagg

SEQ ID NO: 3611862 - DNA, 17 bp, Homo sapiens
tctcaggaggggcagcg

SEQ ID NO: 3611863 - DNA, 18 bp, Homo sapiens
tctcaggaggggcagcgc

SEQ ID NO: 3611864 - DNA, 18 bp, Homo sapiens
tctcagggaactgaccct

SEQ ID NO: 3611865 - DNA, 19 bp, Homo sapiens
tctcagggatggagggaag

SEQ ID NO: 3611866 - DNA, 10 bp, Homo sapiens
tctcagggct

SEQ ID NO: 3611867 - DNA, 19 bp, Homo sapiens
tctcagggctggagcctgg

SEQ ID NO: 3611868 - DNA, 21 bp, Homo sapiens
tctcagggctggagcctgggg

SEQ ID NO: 3611869 - DNA, 17 bp, Homo sapiens
tctcagtactttggagg

SEQ ID NO: 3611870 - DNA, 16 bp, Homo sapiens
tctcataattttgcaa

SEQ ID NO: 3611871 - DNA, 16 bp, Homo sapiens
tctcataccctccctc

SEQ ID NO: 3611872 - DNA, 20 bp, Homo sapiens
tctcatcggaggcccatgcc

SEQ ID NO: 3611873 - DNA, 21 bp, Homo sapiens
tctcatcggaggcccatgccc

SEQ ID NO: 3611874 - DNA, 19 bp, Homo sapiens
tctcatgttttcaactgcc

SEQ ID NO: 3611875 - DNA, 15 bp, Homo sapiens
tctcattgcttacaa

SEQ ID NO: 3611876 - DNA, 21 bp, Homo sapiens
tctcattttatttacagctgt

SEQ ID NO: 3611877 - DNA, 14 bp, Homo sapiens
tctccactgccttc

SEQ ID NO: 3611878 - DNA, 11 bp, Homo sapiens
tctccagacat

SEQ ID NO: 3611879 - DNA, 12 bp, Homo sapiens
tctccagctgac

SEQ ID NO: 3611880 - DNA, 15 bp, Homo sapiens
tctccagctgactaa

SEQ ID NO: 3611881 - DNA, 15 bp, Homo sapiens
tctccagctgcctgg

SEQ ID NO: 3611882 - DNA, 16 bp, Homo sapiens
tctccagctgcctggg

SEQ ID NO: 3611883 - DNA, 11 bp, Homo sapiens
tctccaggcct

SEQ ID NO: 3611884 - DNA, 12 bp, Homo sapiens
tctccaggggcc

SEQ ID NO: 3611885 - DNA, 17 bp, Homo sapiens
tctccaggggcctgcag

SEQ ID NO: 3611886 - DNA, 20 bp, Homo sapiens
tctccaggggcctgcagaag

SEQ ID NO: 3611887 - DNA, 14 bp, Homo sapiens
tctccaggtcagcc

SEQ ID NO: 3611888 - DNA, 13 bp, Homo sapiens
tctccagtgaaat

SEQ ID NO: 3611889 - DNA, 13 bp, Homo sapiens
tctccatggagcc

SEQ ID NO: 3611890 - DNA, 14 bp, Homo sapiens
tctccatggagcct

SEQ ID NO: 3611891 - DNA, 19 bp, Homo sapiens
tctcccaagaaacctgact

SEQ ID NO: 3611892 - DNA, 17 bp, Homo sapiens
tctcccacatgaggcca

SEQ ID NO: 3611893 - DNA, 22 bp, Homo sapiens
tctcccacatgaggccatctca

SEQ ID NO: 3611894 - DNA, 24 bp, Homo sapiens
tctcccacatgaggccatctcagg

SEQ ID NO: 3611895 - DNA, 12 bp, Homo sapiens
tctcccagaact

SEQ ID NO: 3611896 - DNA, 21 bp, Homo sapiens
tctcccagaactattctgggg

SEQ ID NO: 3611897 - DNA, 15 bp, Homo sapiens
tctcccatcctgggg

SEQ ID NO: 3611898 - DNA, 18 bp, Homo sapiens
tctccccagcccagagac

SEQ ID NO: 3611899 - DNA, 17 bp, Homo sapiens
tctcccccactccacta

SEQ ID NO: 3611900 - DNA, 13 bp, Homo sapiens
tctcccctcagag

SEQ ID NO: 3611901 - DNA, 15 bp, Homo sapiens
tctcccctcctgcac

SEQ ID NO: 3611902 - DNA, 20 bp, Homo sapiens
tctcccctcctgcacacagg

SEQ ID NO: 3611903 - DNA, 19 bp, Homo sapiens
tctccctcctccaggtcgg

SEQ ID NO: 3611904 - DNA, 15 bp, Homo sapiens
tctcccttttccatg

SEQ ID NO: 3611905 - DNA, 23 bp, Homo sapiens
tctccgaaatgctgtctttcttg

SEQ ID NO: 3611906 - DNA, 16 bp, Homo sapiens
tctccgactctgcacc

SEQ ID NO: 3611907 - DNA, 13 bp, Homo sapiens
tctccgagctctg

SEQ ID NO: 3611908 - DNA, 18 bp, Homo sapiens
tctccgagctctggtgct

SEQ ID NO: 3611909 - DNA, 19 bp, Homo sapiens
tctccgagctctggtgctt

SEQ ID NO: 3611910 - DNA, 19 bp, Homo sapiens
tctccgggactgccctctc

SEQ ID NO: 3611911 - DNA, 20 bp, Homo sapiens
tctccgttccatctgggctt

SEQ ID NO: 3611912 - DNA, 13 bp, Homo sapiens
tctcctaaagctt

SEQ ID NO: 3611913 - DNA, 15 bp, Homo sapiens
tctcctcactctgtc

SEQ ID NO: 3611914 - DNA, 9 bp, Homo sapiens
tctcctctc

SEQ ID NO: 3611915 - DNA, 13 bp, Homo sapiens
tctcctctctgct

SEQ ID NO: 3611916 - DNA, 15 bp, Homo sapiens
tctcctctctgcttc

SEQ ID NO: 3611917 - DNA, 13 bp, Homo sapiens
tctcctcttgcca

SEQ ID NO: 3611918 - DNA, 14 bp, Homo sapiens
tctcctgccctgtg

SEQ ID NO: 3611919 - DNA, 23 bp, Homo sapiens
tctcctgcctcagcctccccagt

SEQ ID NO: 3611920 - DNA, 18 bp, Homo sapiens
tctccttaagagacaatt

SEQ ID NO: 3611921 - DNA, 21 bp, Homo sapiens
tctccttcccatttctctaca

SEQ ID NO: 3611922 - DNA, 13 bp, Homo sapiens
tctccttctcctt

SEQ ID NO: 3611923 - DNA, 16 bp, Homo sapiens
tctccttggccacaga

SEQ ID NO: 3611924 - DNA, 20 bp, Homo sapiens
tctccttggccacagactga

SEQ ID NO: 3611925 - DNA, 19 bp, Homo sapiens
tctccttgtggcctatgaa

SEQ ID NO: 3611926 - DNA, 16 bp, Homo sapiens
tctcctttcacaacct

SEQ ID NO: 3611927 - DNA, 22 bp, Homo sapiens
tctcctttgaagaaggcaaggc

SEQ ID NO: 3611928 - DNA, 23 bp, Homo sapiens
tctccttttgaggcttctccttc

SEQ ID NO: 3611929 - DNA, 19 bp, Homo sapiens
tctcggatgacaccctggc

SEQ ID NO: 3611930 - DNA, 15 bp, Homo sapiens
tctcgtgagtcattt

SEQ ID NO: 3611931 - DNA, 20 bp, Homo sapiens
tctcgttttgggtactttct

SEQ ID NO: 3611932 - DNA, 16 bp, Homo sapiens
tctctaaggaattatt

SEQ ID NO: 3611933 - DNA, 19 bp, Homo sapiens
tctctaaggaattatttca

SEQ ID NO: 3611934 - DNA, 18 bp, Homo sapiens
tctctaattcttcctttg

SEQ ID NO: 3611935 - DNA, 15 bp, Homo sapiens
tctctactaaaaatg

SEQ ID NO: 3611936 - DNA, 14 bp, Homo sapiens
tctctatcagaaat

SEQ ID NO: 3611937 - DNA, 22 bp, Homo sapiens
tctctatcagaaatacaaaaaa

SEQ ID NO: 3611938 - DNA, 15 bp, Homo sapiens
tctctatgtatcaaa

SEQ ID NO: 3611939 - DNA, 16 bp, Homo sapiens
tctctatgtatcaaat

SEQ ID NO: 3611940 - DNA, 13 bp, Homo sapiens
tctctcaaatctg

SEQ ID NO: 3611941 - DNA, 14 bp, Homo sapiens
tctctcaaattgtc

SEQ ID NO: 3611942 - DNA, 15 bp, Homo sapiens
tctctcaaattgtca

SEQ ID NO: 3611943 - DNA, 15 bp, Homo sapiens
tctctcataccctcc

SEQ ID NO: 3611944 - DNA, 19 bp, Homo sapiens
tctctccagctgactaaac

SEQ ID NO: 3611945 - DNA, 15 bp, Homo sapiens
tctctccaggagggc

SEQ ID NO: 3611946 - DNA, 18 bp, Homo sapiens
tctctccaggagggctcg

SEQ ID NO: 3611947 - DNA, 19 bp, Homo sapiens
tctctcccatcctggggca

SEQ ID NO: 3611948 - DNA, 21 bp, Homo sapiens
tctctccccatatataaatta

SEQ ID NO: 3611949 - DNA, 13 bp, Homo sapiens
tctctcctctctg

SEQ ID NO: 3611950 - DNA, 17 bp, Homo sapiens
tctctccttggccacag

SEQ ID NO: 3611951 - DNA, 16 bp, Homo sapiens
tctctcgggagcccta

SEQ ID NO: 3611952 - DNA, 22 bp, Homo sapiens
tctctcgttttgggtactttct

SEQ ID NO: 3611953 - DNA, 11 bp, Homo sapiens
tctctctcctc

SEQ ID NO: 3611954 - DNA, 14 bp, Homo sapiens
tctctctctacaaa

SEQ ID NO: 3611955 - DNA, 12 bp, Homo sapiens
tctctctgccca

SEQ ID NO: 3611956 - DNA, 13 bp, Homo sapiens
tctctcttgtcct

SEQ ID NO: 3611957 - DNA, 21 bp, Homo sapiens
tctctcttgtcctcttctgct

SEQ ID NO: 3611958 - DNA, 11 bp, Homo sapiens
tctctgaaccc

SEQ ID NO: 3611959 - DNA, 22 bp, Homo sapiens
tctctgaatgagcctttgtgct

SEQ ID NO: 3611960 - DNA, 18 bp, Homo sapiens
tctctgactgctttggat

SEQ ID NO: 3611961 - DNA, 16 bp, Homo sapiens
tctctgagtcaaatcc

SEQ ID NO: 3611962 - DNA, 22 bp, Homo sapiens
tctctgattagttgacagtatt

SEQ ID NO: 3611963 - DNA, 19 bp, Homo sapiens
tctctgcagtaaaacacat

SEQ ID NO: 3611964 - DNA, 21 bp, Homo sapiens
tctctgcagtaaaacacattt

SEQ ID NO: 3611965 - DNA, 22 bp, Homo sapiens
tctctgccagttacttgggctt

SEQ ID NO: 3611966 - DNA, 12 bp, Homo sapiens
tctctgcccaac

SEQ ID NO: 3611967 - DNA, 16 bp, Homo sapiens
tctctgccccagcctg

SEQ ID NO: 3611968 - DNA, 17 bp, Homo sapiens
tctctgccccagcctgt

SEQ ID NO: 3611969 - DNA, 19 bp, Homo sapiens
tctctgccctgggctcctc

SEQ ID NO: 3611970 - DNA, 20 bp, Homo sapiens
tctctgccctgggctcctct

SEQ ID NO: 3611971 - DNA, 13 bp, Homo sapiens
tctctggctgggg

SEQ ID NO: 3611972 - DNA, 15 bp, Homo sapiens
tctctggctggtctt

SEQ ID NO: 3611973 - DNA, 16 bp, Homo sapiens
tctctgggggctgagg

SEQ ID NO: 3611974 - DNA, 18 bp, Homo sapiens
tctctgggggctgaggag

SEQ ID NO: 3611975 - DNA, 21 bp, Homo sapiens
tctctgtgaagcctctctcct

SEQ ID NO: 3611976 - DNA, 18 bp, Homo sapiens
tctctgtgtgcacaaata

SEQ ID NO: 3611977 - DNA, 17 bp, Homo sapiens
tctcttccccttagaaa

SEQ ID NO: 3611978 - DNA, 16 bp, Homo sapiens
tctcttccccttccct

SEQ ID NO: 3611979 - DNA, 16 bp, Homo sapiens
tctcttccccttcctg

SEQ ID NO: 3611980 - DNA, 17 bp, Homo sapiens
tctcttctaacatgaaa

SEQ ID NO: 3611981 - DNA, 13 bp, Homo sapiens
tctcttctccact

SEQ ID NO: 3611982 - DNA, 15 bp, Homo sapiens
tctcttctccactgg

SEQ ID NO: 3611983 - DNA, 16 bp, Homo sapiens
tctcttctccactgga

SEQ ID NO: 3611984 - DNA, 12 bp, Homo sapiens
tctcttctctcc

SEQ ID NO: 3611985 - DNA, 15 bp, Homo sapiens
tctcttctctccagc

SEQ ID NO: 3611986 - DNA, 19 bp, Homo sapiens
tctcttctgaataaagcaa

SEQ ID NO: 3611987 - DNA, 21 bp, Homo sapiens
tctcttgccatttgtagcttt

SEQ ID NO: 3611988 - DNA, 12 bp, Homo sapiens
tctcttgccctt

SEQ ID NO: 3611989 - DNA, 15 bp, Homo sapiens
tctcttgcccttcct

SEQ ID NO: 3611990 - DNA, 18 bp, Homo sapiens
tctcttgtcctcttctgc

SEQ ID NO: 3611991 - DNA, 16 bp, Homo sapiens
tctctttaaccctccc

SEQ ID NO: 3611992 - DNA, 21 bp, Homo sapiens
tctctttcttattttgtaata

SEQ ID NO: 3611993 - DNA, 22 bp, Homo sapiens
tctctttcttattttgtaataa

SEQ ID NO: 3611994 - DNA, 20 bp, Homo sapiens
tctctttcttttctctgtct

SEQ ID NO: 3611995 - DNA, 19 bp, Homo sapiens
tctcttttatctgtttaaa

SEQ ID NO: 3611996 - DNA, 19 bp, Homo sapiens
tctcttttctttctgtctt

SEQ ID NO: 3611997 - DNA, 21 bp, Homo sapiens
tctcttttctttctgtcttgt

SEQ ID NO: 3611998 - DNA, 14 bp, Homo sapiens
tctgaaaacaaggt

SEQ ID NO: 3611999 - DNA, 12 bp, Homo sapiens
tctgaaactggc

SEQ ID NO: 3612000 - DNA, 20 bp, Homo sapiens
tctgaaaggccagcagctga

SEQ ID NO: 3612001 - DNA, 17 bp, Homo sapiens
tctgaaatataaagtct

SEQ ID NO: 3612002 - DNA, 17 bp, Homo sapiens
tctgaaggccttgttaa

SEQ ID NO: 3612003 - DNA, 20 bp, Homo sapiens
tctgaaggccttgttaaaat

SEQ ID NO: 3612004 - DNA, 15 bp, Homo sapiens
tctgaagtcactgca

SEQ ID NO: 3612005 - DNA, 16 bp, Homo sapiens
tctgaagtcactgcac

SEQ ID NO: 3612006 - DNA, 18 bp, Homo sapiens
tctgaagtcactgcacag

SEQ ID NO: 3612007 - DNA, 14 bp, Homo sapiens
tctgaataaagcaa

SEQ ID NO: 3612008 - DNA, 14 bp, Homo sapiens
tctgaataacttga

SEQ ID NO: 3612009 - DNA, 15 bp, Homo sapiens
tctgaataacttgaa

SEQ ID NO: 3612010 - DNA, 22 bp, Homo sapiens
tctgaatgaaaataactgaacc

SEQ ID NO: 3612011 - DNA, 21 bp, Homo sapiens
tctgacaactgtgaagccacc

SEQ ID NO: 3612012 - DNA, 17 bp, Homo sapiens
tctgacatattatgcct

SEQ ID NO: 3612013 - DNA, 15 bp, Homo sapiens
tctgacatcccttcc

SEQ ID NO: 3612014 - DNA, 17 bp, Homo sapiens
tctgacatcccttcctg

SEQ ID NO: 3612015 - DNA, 13 bp, Homo sapiens
tctgacccagtgc

SEQ ID NO: 3612016 - DNA, 19 bp, Homo sapiens
tctgacccagtgcccccac

SEQ ID NO: 3612017 - DNA, 23 bp, Homo sapiens
tctgacccagtgcccccactgac

SEQ ID NO: 3612018 - DNA, 13 bp, Homo sapiens
tctgaccccaagg

SEQ ID NO: 3612019 - DNA, 16 bp, Homo sapiens
tctgacgctgacaata

SEQ ID NO: 3612020 - DNA, 13 bp, Homo sapiens
tctgactcttatt

SEQ ID NO: 3612021 - DNA, 23 bp, Homo sapiens
tctgactgccaagccagattctc

SEQ ID NO: 3612022 - DNA, 19 bp, Homo sapiens
tctgagaaagactattcaa

SEQ ID NO: 3612023 - DNA, 20 bp, Homo sapiens
tctgagaaagactattcaaa

SEQ ID NO: 3612024 - DNA, 21 bp, Homo sapiens
tctgagaaagactattcaaac

SEQ ID NO: 3612025 - DNA, 23 bp, Homo sapiens
tctgagaaagactattcaaacag

SEQ ID NO: 3612026 - DNA, 15 bp, Homo sapiens
tctgagacaggtgcc

SEQ ID NO: 3612027 - DNA, 20 bp, Homo sapiens
tctgagaggctctccgtgca

SEQ ID NO: 3612028 - DNA, 22 bp, Homo sapiens
tctgagcaagaggattttgcgt

SEQ ID NO: 3612029 - DNA, 21 bp, Homo sapiens
tctgagcaggtacatttctga

SEQ ID NO: 3612030 - DNA, 17 bp, Homo sapiens
tctgagcagttgttata

SEQ ID NO: 3612031 - DNA, 18 bp, Homo sapiens
tctgagcccatttctggg

SEQ ID NO: 3612032 - DNA, 19 bp, Homo sapiens
tctgagcccatttctgggg

SEQ ID NO: 3612033 - DNA, 18 bp, Homo sapiens
tctgaggacaagagaaaa

SEQ ID NO: 3612034 - DNA, 20 bp, Homo sapiens
tctgaggccagaaaggtgtg

SEQ ID NO: 3612035 - DNA, 21 bp, Homo sapiens
tctgaggcctgccccctgggc

SEQ ID NO: 3612036 - DNA, 12 bp, Homo sapiens
tctgagggggag

SEQ ID NO: 3612037 - DNA, 23 bp, Homo sapiens
tctgagtagagcttgtaataaat

SEQ ID NO: 3612038 - DNA, 18 bp, Homo sapiens
tctgagtcaaatccagtg

SEQ ID NO: 3612039 - DNA, 20 bp, Homo sapiens
tctgagtcaaatccagtggt

SEQ ID NO: 3612040 - DNA, 22 bp, Homo sapiens
tctgatgtataatgtaatgttt

SEQ ID NO: 3612041 - DNA, 20 bp, Homo sapiens
tctgattagttgacagtatt

SEQ ID NO: 3612042 - DNA, 21 bp, Homo sapiens
tctgattagttgacagtatta

SEQ ID NO: 3612043 - DNA, 19 bp, Homo sapiens
tctgattgctatcagcaat

SEQ ID NO: 3612044 - DNA, 13 bp, Homo sapiens
tctgattggctgc

SEQ ID NO: 3612045 - DNA, 17 bp, Homo sapiens
tctgcaagcctcatgcc

SEQ ID NO: 3612046 - DNA, 19 bp, Homo sapiens
tctgcacagacaagcagcc

SEQ ID NO: 3612047 - DNA, 18 bp, Homo sapiens
tctgcaccaccatgccca

SEQ ID NO: 3612048 - DNA, 14 bp, Homo sapiens
tctgcacccgcctc

SEQ ID NO: 3612049 - DNA, 20 bp, Homo sapiens
tctgcacgctcaatgcccag

SEQ ID NO: 3612050 - DNA, 18 bp, Homo sapiens
tctgcactcccacctgac

SEQ ID NO: 3612051 - DNA, 22 bp, Homo sapiens
tctgcactcctttatctgtaat

SEQ ID NO: 3612052 - DNA, 21 bp, Homo sapiens
tctgcactggggcgtttccta

SEQ ID NO: 3612053 - DNA, 12 bp, Homo sapiens
tctgcagagcag

SEQ ID NO: 3612054 - DNA, 22 bp, Homo sapiens
tctgcagcccattcccaaggga

SEQ ID NO: 3612055 - DNA, 23 bp, Homo sapiens
tctgcagctcaagggctggcact

SEQ ID NO: 3612056 - DNA, 11 bp, Homo sapiens
tctgcagctgt

SEQ ID NO: 3612057 - DNA, 22 bp, Homo sapiens
tctgcaggcctaggtgcagctc

SEQ ID NO: 3612058 - DNA, 17 bp, Homo sapiens
tctgcagtaaaacacat

SEQ ID NO: 3612059 - DNA, 12 bp, Homo sapiens
tctgccagcgcc

SEQ ID NO: 3612060 - DNA, 19 bp, Homo sapiens
tctgccagttacttgggct

SEQ ID NO: 3612061 - DNA, 14 bp, Homo sapiens
tctgccccagcctg

SEQ ID NO: 3612062 - DNA, 15 bp, Homo sapiens
tctgccccagcctgt

SEQ ID NO: 3612063 - DNA, 17 bp, Homo sapiens
tctgccccagcctgtcc

SEQ ID NO: 3612064 - DNA, 14 bp, Homo sapiens
tctgccccagcttg

SEQ ID NO: 3612065 - DNA, 18 bp, Homo sapiens
tctgccccagcttgggca

SEQ ID NO: 3612066 - DNA, 15 bp, Homo sapiens
tctgccccatcctcc

SEQ ID NO: 3612067 - DNA, 23 bp, Homo sapiens
tctgccccctcccccatgggctg

SEQ ID NO: 3612068 - DNA, 12 bp, Homo sapiens
tctgccctggat

SEQ ID NO: 3612069 - DNA, 17 bp, Homo sapiens
tctgccctgggctcctc

SEQ ID NO: 3612070 - DNA, 20 bp, Homo sapiens
tctgcctcacatagcttaca

SEQ ID NO: 3612071 - DNA, 15 bp, Homo sapiens
tctgcctcctcttca

SEQ ID NO: 3612072 - DNA, 16 bp, Homo sapiens
tctgcctctccctggg

SEQ ID NO: 3612073 - DNA, 18 bp, Homo sapiens
tctgcctctccctgggtc

SEQ ID NO: 3612074 - DNA, 16 bp, Homo sapiens
tctgcctgccagctgc

SEQ ID NO: 3612075 - DNA, 22 bp, Homo sapiens
tctgcctgccagctgcactgat

SEQ ID NO: 3612076 - DNA, 23 bp, Homo sapiens
tctgcctggaggcaaaggcctgg

SEQ ID NO: 3612077 - DNA, 17 bp, Homo sapiens
tctgccttagcctacca

SEQ ID NO: 3612078 - DNA, 17 bp, Homo sapiens
tctgcgctgtgtacaat

SEQ ID NO: 3612079 - DNA, 23 bp, Homo sapiens
tctgctaagtaatttagaagata

SEQ ID NO: 3612080 - DNA, 13 bp, Homo sapiens
tctgctcctcttg

SEQ ID NO: 3612081 - DNA, 11 bp, Homo sapiens
tctgctcctgc

SEQ ID NO: 3612082 - DNA, 14 bp, Homo sapiens
tctgctcctgcttt

SEQ ID NO: 3612083 - DNA, 19 bp, Homo sapiens
tctgctcctgcttttctgt

SEQ ID NO: 3612084 - DNA, 14 bp, Homo sapiens
tctgctgaaagact

SEQ ID NO: 3612085 - DNA, 13 bp, Homo sapiens
tctgctgccagca

SEQ ID NO: 3612086 - DNA, 16 bp, Homo sapiens
tctgctgccagcacag

SEQ ID NO: 3612087 - DNA, 14 bp, Homo sapiens
tctgctgccggctc

SEQ ID NO: 3612088 - DNA, 22 bp, Homo sapiens
tctgctgccggctctgggcctg

SEQ ID NO: 3612089 - DNA, 12 bp, Homo sapiens
tctgctgctgat

SEQ ID NO: 3612090 - DNA, 18 bp, Homo sapiens
tctgctgttcttcagtcc

SEQ ID NO: 3612091 - DNA, 19 bp, Homo sapiens
tctgcttcatccaatgtga

SEQ ID NO: 3612092 - DNA, 20 bp, Homo sapiens
tctgcttcatccaatgtgaa

SEQ ID NO: 3612093 - DNA, 20 bp, Homo sapiens
tctgctttaaaaatgtctta

SEQ ID NO: 3612094 - DNA, 13 bp, Homo sapiens
tctggaacccaga

SEQ ID NO: 3612095 - DNA, 14 bp, Homo sapiens
tctggaacccagac

SEQ ID NO: 3612096 - DNA, 15 bp, Homo sapiens
tctggaacccagact

SEQ ID NO: 3612097 - DNA, 17 bp, Homo sapiens
tctggaacccagactca

SEQ ID NO: 3612098 - DNA, 18 bp, Homo sapiens
tctggaacccagactcag

SEQ ID NO: 3612099 - DNA, 23 bp, Homo sapiens
tctggaacccagactcagacatt

SEQ ID NO: 3612100 - DNA, 15 bp, Homo sapiens
tctggaacctcagcc

SEQ ID NO: 3612101 - DNA, 16 bp, Homo sapiens
tctggaacctcagcct

SEQ ID NO: 3612102 - DNA, 20 bp, Homo sapiens
tctggaacctcagcctggcc

SEQ ID NO: 3612103 - DNA, 23 bp, Homo sapiens
tctggaacctcagcctggccaga

SEQ ID NO: 3612104 - DNA, 17 bp, Homo sapiens
tctggaagacgtggctc

SEQ ID NO: 3612105 - DNA, 18 bp, Homo sapiens
tctggaagacgtggctct

SEQ ID NO: 3612106 - DNA, 22 bp, Homo sapiens
tctggaatacatgaaatataga

SEQ ID NO: 3612107 - DNA, 16 bp, Homo sapiens
tctggactcctctgtc

SEQ ID NO: 3612108 - DNA, 18 bp, Homo sapiens
tctggactcctctgtcca

SEQ ID NO: 3612109 - DNA, 14 bp, Homo sapiens
tctggactggaaag

SEQ ID NO: 3612110 - DNA, 17 bp, Homo sapiens
tctggagaaggcctgga

SEQ ID NO: 3612111 - DNA, 19 bp, Homo sapiens
tctggagaaggcctggaag

SEQ ID NO: 3612112 - DNA, 16 bp, Homo sapiens
tctggagatggaagct

SEQ ID NO: 3612113 - DNA, 15 bp, Homo sapiens
tctggagtggccact

SEQ ID NO: 3612114 - DNA, 16 bp, Homo sapiens
tctggattcatattta

SEQ ID NO: 3612115 - DNA, 21 bp, Homo sapiens
tctggccatatttactacctt

SEQ ID NO: 3612116 - DNA, 16 bp, Homo sapiens
tctggccctaactcct

SEQ ID NO: 3612117 - DNA, 21 bp, Homo sapiens
tctggccctggggatcttccc

SEQ ID NO: 3612118 - DNA, 14 bp, Homo sapiens
tctggcctcccaca

SEQ ID NO: 3612119 - DNA, 19 bp, Homo sapiens
tctggcggaggtctctggg

SEQ ID NO: 3612120 - DNA, 22 bp, Homo sapiens
tctggcggaggtctctgggagc

SEQ ID NO: 3612121 - DNA, 16 bp, Homo sapiens
tctggctccccaaggc

SEQ ID NO: 3612122 - DNA, 12 bp, Homo sapiens
tctggctctaat

SEQ ID NO: 3612123 - DNA, 16 bp, Homo sapiens
tctggctctaattcac

SEQ ID NO: 3612124 - DNA, 22 bp, Homo sapiens
tctggctctaattcacagtgct

SEQ ID NO: 3612125 - DNA, 13 bp, Homo sapiens
tctggctgagccc

SEQ ID NO: 3612126 - DNA, 17 bp, Homo sapiens
tctggctgagcccctgg

SEQ ID NO: 3612127 - DNA, 20 bp, Homo sapiens
tctggctgagcccctgggga

SEQ ID NO: 3612128 - DNA, 16 bp, Homo sapiens
tctggctgagccctgc

SEQ ID NO: 3612129 - DNA, 22 bp, Homo sapiens
tctggctggtcttcactttcct

SEQ ID NO: 3612130 - DNA, 20 bp, Homo sapiens
tctggcttcaaaaagccaca

SEQ ID NO: 3612131 - DNA, 12 bp, Homo sapiens
tctggcttccct

SEQ ID NO: 3612132 - DNA, 22 bp, Homo sapiens
tctggcttccctaaactgcagc

SEQ ID NO: 3612133 - DNA, 15 bp, Homo sapiens
tctggcttccctgga

SEQ ID NO: 3612134 - DNA, 17 bp, Homo sapiens
tctgggacccacagaac

SEQ ID NO: 3612135 - DNA, 19 bp, Homo sapiens
tctgggacccacagaactt

SEQ ID NO: 3612136 - DNA, 18 bp, Homo sapiens
tctgggagcccagaaccc

SEQ ID NO: 3612137 - DNA, 15 bp, Homo sapiens
tctgggagttgctgt

SEQ ID NO: 3612138 - DNA, 21 bp, Homo sapiens
tctgggatatggctgcccagg

SEQ ID NO: 3612139 - DNA, 23 bp, Homo sapiens
tctgggatatggctgcccaggag

SEQ ID NO: 3612140 - DNA, 13 bp, Homo sapiens
tctgggatattta

SEQ ID NO: 3612141 - DNA, 13 bp, Homo sapiens
tctggggagagcg

SEQ ID NO: 3612142 - DNA, 13 bp, Homo sapiens
tctggggctgtgt

SEQ ID NO: 3612143 - DNA, 15 bp, Homo sapiens
tctggggctgtgtta

SEQ ID NO: 3612144 - DNA, 20 bp, Homo sapiens
tctgggggcccgacaggtgg

SEQ ID NO: 3612145 - DNA, 17 bp, Homo sapiens
tctggggggagaaaaaa

SEQ ID NO: 3612146 - DNA, 22 bp, Homo sapiens
tctgggggtcctctctgagtca

SEQ ID NO: 3612147 - DNA, 17 bp, Homo sapiens
tctggggtgggcagttt

SEQ ID NO: 3612148 - DNA, 14 bp, Homo sapiens
tctgggtccaggga

SEQ ID NO: 3612149 - DNA, 18 bp, Homo sapiens
tctgggtcttggccatga

SEQ ID NO: 3612150 - DNA, 18 bp, Homo sapiens
tctgggtgctagatccag

SEQ ID NO: 3612151 - DNA, 17 bp, Homo sapiens
tctggtactctgtgaaa

SEQ ID NO: 3612152 - DNA, 23 bp, Homo sapiens
tctggtagggatatggcaggact

SEQ ID NO: 3612153 - DNA, 13 bp, Homo sapiens
tctggtcctaccc

SEQ ID NO: 3612154 - DNA, 14 bp, Homo sapiens
tctggtcctaccca

SEQ ID NO: 3612155 - DNA, 18 bp, Homo sapiens
tctggtctcctcagcctc

SEQ ID NO: 3612156 - DNA, 17 bp, Homo sapiens
tctggtgagtcaccact

SEQ ID NO: 3612157 - DNA, 20 bp, Homo sapiens
tctggtgagtcaccacttca

SEQ ID NO: 3612158 - DNA, 12 bp, Homo sapiens
tctggtgcttta

SEQ ID NO: 3612159 - DNA, 17 bp, Homo sapiens
tctggtgtgtggtgagg

SEQ ID NO: 3612160 - DNA, 15 bp, Homo sapiens
tctggtgtttgtcat

SEQ ID NO: 3612161 - DNA, 17 bp, Homo sapiens
tctggtgtttgtcatgg

SEQ ID NO: 3612162 - DNA, 16 bp, Homo sapiens
tctggttccctgctgc

SEQ ID NO: 3612163 - DNA, 12 bp, Homo sapiens
tctggttctata

SEQ ID NO: 3612164 - DNA, 23 bp, Homo sapiens
tctgtaacaggtattttgtttct

SEQ ID NO: 3612165 - DNA, 21 bp, Homo sapiens
tctgtaacatcgcacagttta

SEQ ID NO: 3612166 - DNA, 23 bp, Homo sapiens
tctgtaggccagtagttctcaaa

SEQ ID NO: 3612167 - DNA, 13 bp, Homo sapiens
tctgtatgtcatg

SEQ ID NO: 3612168 - DNA, 14 bp, Homo sapiens
tctgtatgtcatgg

SEQ ID NO: 3612169 - DNA, 19 bp, Homo sapiens
tctgtcataggactctgga

SEQ ID NO: 3612170 - DNA, 22 bp, Homo sapiens
tctgtccaatttcgggagcctt

SEQ ID NO: 3612171 - DNA, 15 bp, Homo sapiens
tctgtccctgtcctt

SEQ ID NO: 3612172 - DNA, 19 bp, Homo sapiens
tctgtccctgtccttccct

SEQ ID NO: 3612173 - DNA, 20 bp, Homo sapiens
tctgtccctgtccttccctg

SEQ ID NO: 3612174 - DNA, 15 bp, Homo sapiens
tctgtccgtgcccct

SEQ ID NO: 3612175 - DNA, 23 bp, Homo sapiens
tctgtcctcagccttgccagaga

SEQ ID NO: 3612176 - DNA, 21 bp, Homo sapiens
tctgtcctgggcatgggtcca

SEQ ID NO: 3612177 - DNA, 15 bp, Homo sapiens
tctgtctatctgtga

SEQ ID NO: 3612178 - DNA, 16 bp, Homo sapiens
tctgtctatctgtgaa

SEQ ID NO: 3612179 - DNA, 17 bp, Homo sapiens
tctgtctcggctctgca

SEQ ID NO: 3612180 - DNA, 19 bp, Homo sapiens
tctgtctctaatttaactt

SEQ ID NO: 3612181 - DNA, 18 bp, Homo sapiens
tctgtcttgttaatgctt

SEQ ID NO: 3612182 - DNA, 15 bp, Homo sapiens
tctgtctttaagaac

SEQ ID NO: 3612183 - DNA, 18 bp, Homo sapiens
tctgtgaagcctctctcc

SEQ ID NO: 3612184 - DNA, 15 bp, Homo sapiens
tctgtgaattgcctg

SEQ ID NO: 3612185 - DNA, 13 bp, Homo sapiens
tctgtgattggct

SEQ ID NO: 3612186 - DNA, 18 bp, Homo sapiens
tctgtggagatggactca

SEQ ID NO: 3612187 - DNA, 18 bp, Homo sapiens
tctgtggagctgccacag

SEQ ID NO: 3612188 - DNA, 21 bp, Homo sapiens
tctgtggatcagcattttaga

SEQ ID NO: 3612189 - DNA, 17 bp, Homo sapiens
tctgtgggcactggtgg

SEQ ID NO: 3612190 - DNA, 18 bp, Homo sapiens
tctgtggtcacccatgca

SEQ ID NO: 3612191 - DNA, 21 bp, Homo sapiens
tctgtgtaccacttcctgagg

SEQ ID NO: 3612192 - DNA, 14 bp, Homo sapiens
tctgtgtcatttct

SEQ ID NO: 3612193 - DNA, 23 bp, Homo sapiens
tctgtgtcctctgcctgggctct

SEQ ID NO: 3612194 - DNA, 14 bp, Homo sapiens
tctgtgtgcacaaa

SEQ ID NO: 3612195 - DNA, 21 bp, Homo sapiens
tctgtgtgcacaaatatttat

SEQ ID NO: 3612196 - DNA, 16 bp, Homo sapiens
tctgtgtggctcctgg

SEQ ID NO: 3612197 - DNA, 15 bp, Homo sapiens
tctgtgtgtgtgtat

SEQ ID NO: 3612198 - DNA, 18 bp, Homo sapiens
tctgtgtgtgtgtatgtg

SEQ ID NO: 3612199 - DNA, 19 bp, Homo sapiens
tctgttacactttttggaa

SEQ ID NO: 3612200 - DNA, 13 bp, Homo sapiens
tctgttccccctt

SEQ ID NO: 3612201 - DNA, 20 bp, Homo sapiens
tctgttcctttctctgggct

SEQ ID NO: 3612202 - DNA, 15 bp, Homo sapiens
tctgttctaacatgt

SEQ ID NO: 3612203 - DNA, 16 bp, Homo sapiens
tctgttgcccaggctg

SEQ ID NO: 3612204 - DNA, 13 bp, Homo sapiens
tctgttggagaaa

SEQ ID NO: 3612205 - DNA, 17 bp, Homo sapiens
tctgttggagaaagaaa

SEQ ID NO: 3612206 - DNA, 20 bp, Homo sapiens
tctgttggtctgccttctgc

SEQ ID NO: 3612207 - DNA, 13 bp, Homo sapiens
tctgtttgaaact

SEQ ID NO: 3612208 - DNA, 21 bp, Homo sapiens
tctgtttgctcaaaattgctt

SEQ ID NO: 3612209 - DNA, 21 bp, Homo sapiens
tcttaaacataataaatcaca

SEQ ID NO: 3612210 - DNA, 14 bp, Homo sapiens
tcttaacgtaaatc

SEQ ID NO: 3612211 - DNA, 16 bp, Homo sapiens
tcttaacttcttgctt

SEQ ID NO: 3612212 - DNA, 13 bp, Homo sapiens
tcttaagcagcat

SEQ ID NO: 3612213 - DNA, 14 bp, Homo sapiens
tcttaagcagcatg

SEQ ID NO: 3612214 - DNA, 17 bp, Homo sapiens
tcttaatgtatcaaact

SEQ ID NO: 3612215 - DNA, 23 bp, Homo sapiens
tcttaatgtctggtgtttgtcat

SEQ ID NO: 3612216 - DNA, 17 bp, Homo sapiens
tcttaccagtctcctcc

SEQ ID NO: 3612217 - DNA, 15 bp, Homo sapiens
tcttactaatgtaaa

SEQ ID NO: 3612218 - DNA, 13 bp, Homo sapiens
tcttagcaataaa

SEQ ID NO: 3612219 - DNA, 16 bp, Homo sapiens
tcttagcaataaatgc

SEQ ID NO: 3612220 - DNA, 19 bp, Homo sapiens
tcttagcaataaatgcttt

SEQ ID NO: 3612221 - DNA, 18 bp, Homo sapiens
tcttagccctcaccacag

SEQ ID NO: 3612222 - DNA, 14 bp, Homo sapiens
tcttagtgtatgat

SEQ ID NO: 3612223 - DNA, 14 bp, Homo sapiens
tcttatacatttga

SEQ ID NO: 3612224 - DNA, 17 bp, Homo sapiens
tcttatgcaaaatggaa

SEQ ID NO: 3612225 - DNA, 14 bp, Homo sapiens
tcttatgtgtgcct

SEQ ID NO: 3612226 - DNA, 19 bp, Homo sapiens
tcttattgtttaatctttt

SEQ ID NO: 3612227 - DNA, 14 bp, Homo sapiens
tcttattttgtaat

SEQ ID NO: 3612228 - DNA, 22 bp, Homo sapiens
tcttattttgtaataaactctc

SEQ ID NO: 3612229 - DNA, 22 bp, Homo sapiens
tcttcaaatgtttaaaccacta

SEQ ID NO: 3612230 - DNA, 14 bp, Homo sapiens
tcttcactctggct

SEQ ID NO: 3612231 - DNA, 16 bp, Homo sapiens
tcttcagaactgccct

SEQ ID NO: 3612232 - DNA, 22 bp, Homo sapiens
tcttcagaactgcccttgctgc

SEQ ID NO: 3612233 - DNA, 16 bp, Homo sapiens
tcttcagcgtaaaatg

SEQ ID NO: 3612234 - DNA, 12 bp, Homo sapiens
tcttcagtcctt

SEQ ID NO: 3612235 - DNA, 17 bp, Homo sapiens
tcttcagtcctttgtct

SEQ ID NO: 3612236 - DNA, 17 bp, Homo sapiens
tcttcattccattgact

SEQ ID NO: 3612237 - DNA, 18 bp, Homo sapiens
tcttccacccacaaactc

SEQ ID NO: 3612238 - DNA, 22 bp, Homo sapiens
tcttccacccacaaactccagg

SEQ ID NO: 3612239 - DNA, 15 bp, Homo sapiens
tcttccattccttca

SEQ ID NO: 3612240 - DNA, 15 bp, Homo sapiens
tcttcccactccagc

SEQ ID NO: 3612241 - DNA, 17 bp, Homo sapiens
tcttcccactccagctg

SEQ ID NO: 3612242 - DNA, 18 bp, Homo sapiens
tcttcccactccagctga

SEQ ID NO: 3612243 - DNA, 14 bp, Homo sapiens
tcttccccttccct

SEQ ID NO: 3612244 - DNA, 14 bp, Homo sapiens
tcttccccttcctg

SEQ ID NO: 3612245 - DNA, 22 bp, Homo sapiens
tcttccccttcctgtttcagac

SEQ ID NO: 3612246 - DNA, 21 bp, Homo sapiens
tcttcccttattcctaatggc

SEQ ID NO: 3612247 - DNA, 20 bp, Homo sapiens
tcttcctaattgtgccccta

SEQ ID NO: 3612248 - DNA, 21 bp, Homo sapiens
tcttcctagttttctcctccc

SEQ ID NO: 3612249 - DNA, 15 bp, Homo sapiens
tcttcctccacttca

SEQ ID NO: 3612250 - DNA, 17 bp, Homo sapiens
tcttcctcctcccaagg

SEQ ID NO: 3612251 - DNA, 22 bp, Homo sapiens
tcttcctgtgaagtttaattgt

SEQ ID NO: 3612252 - DNA, 13 bp, Homo sapiens
tcttcctttgtaa

SEQ ID NO: 3612253 - DNA, 10 bp, Homo sapiens
tcttcctttt

SEQ ID NO: 3612254 - DNA, 18 bp, Homo sapiens
tcttcgaagccttgccta

SEQ ID NO: 3612255 - DNA, 21 bp, Homo sapiens
tcttcgctggactattgtgcc

SEQ ID NO: 3612256 - DNA, 19 bp, Homo sapiens
tcttctatagtgatgatga

SEQ ID NO: 3612257 - DNA, 19 bp, Homo sapiens
tcttctattaatcaagaga

SEQ ID NO: 3612258 - DNA, 12 bp, Homo sapiens
tcttctatttat

SEQ ID NO: 3612259 - DNA, 18 bp, Homo sapiens
tcttctctccagctgact

SEQ ID NO: 3612260 - DNA, 17 bp, Homo sapiens
tcttctgaataaagcaa

SEQ ID NO: 3612261 - DNA, 17 bp, Homo sapiens
tcttctgcaacatttga

SEQ ID NO: 3612262 - DNA, 17 bp, Homo sapiens
tcttctgcaagcctcat

SEQ ID NO: 3612263 - DNA, 15 bp, Homo sapiens
tcttctgttgacatt

SEQ ID NO: 3612264 - DNA, 17 bp, Homo sapiens
tcttcttaaaagtttct

SEQ ID NO: 3612265 - DNA, 12 bp, Homo sapiens
tcttcttatgca

SEQ ID NO: 3612266 - DNA, 14 bp, Homo sapiens
tcttcttctgaaga

SEQ ID NO: 3612267 - DNA, 21 bp, Homo sapiens
tcttctttgtgcctttggcct

SEQ ID NO: 3612268 - DNA, 22 bp, Homo sapiens
tcttctttgtgcctttggcctg

SEQ ID NO: 3612269 - DNA, 23 bp, Homo sapiens
tcttctttgtgcctttggcctgg

SEQ ID NO: 3612270 - DNA, 19 bp, Homo sapiens
tcttctttttgcttcaaaa

SEQ ID NO: 3612271 - DNA, 18 bp, Homo sapiens
tcttctttttttgtgatg

SEQ ID NO: 3612272 - DNA, 22 bp, Homo sapiens
tcttgaactgggctcaagtgat

SEQ ID NO: 3612273 - DNA, 14 bp, Homo sapiens
tcttgaatttctgc

SEQ ID NO: 3612274 - DNA, 21 bp, Homo sapiens
tcttgaccaacagaaaccttt

SEQ ID NO: 3612275 - DNA, 21 bp, Homo sapiens
tcttgagagaaacgtgaaacg

SEQ ID NO: 3612276 - DNA, 12 bp, Homo sapiens
tcttgagccaca

SEQ ID NO: 3612277 - DNA, 17 bp, Homo sapiens
tcttgagttcctctgca

SEQ ID NO: 3612278 - DNA, 21 bp, Homo sapiens
tcttgataattttcctttaat

SEQ ID NO: 3612279 - DNA, 14 bp, Homo sapiens
tcttgatctctctt

SEQ ID NO: 3612280 - DNA, 14 bp, Homo sapiens
tcttgatgtatttc

SEQ ID NO: 3612281 - DNA, 16 bp, Homo sapiens
tcttgcagcatttact

SEQ ID NO: 3612282 - DNA, 23 bp, Homo sapiens
tcttgcatggcaaggactgcagg

SEQ ID NO: 3612283 - DNA, 23 bp, Homo sapiens
tcttgcatttaaaagacagcttt

SEQ ID NO: 3612284 - DNA, 17 bp, Homo sapiens
tcttgccactgcctctt

SEQ ID NO: 3612285 - DNA, 20 bp, Homo sapiens
tcttgctaccagtatttaga

SEQ ID NO: 3612286 - DNA, 15 bp, Homo sapiens
tcttgctctctttta

SEQ ID NO: 3612287 - DNA, 11 bp, Homo sapiens
tcttgcttctt

SEQ ID NO: 3612288 - DNA, 18 bp, Homo sapiens
tcttgcttctttctagaa

SEQ ID NO: 3612289 - DNA, 18 bp, Homo sapiens
tcttggccatgatgtcct

SEQ ID NO: 3612290 - DNA, 17 bp, Homo sapiens
tcttggccctcctcagc

SEQ ID NO: 3612291 - DNA, 21 bp, Homo sapiens
tcttggccctcctcagctccc

SEQ ID NO: 3612292 - DNA, 16 bp, Homo sapiens
tcttggccgactcagg

SEQ ID NO: 3612293 - DNA, 22 bp, Homo sapiens
tcttggccgactcagggaccta

SEQ ID NO: 3612294 - DNA, 13 bp, Homo sapiens
tcttggctgaccc

SEQ ID NO: 3612295 - DNA, 14 bp, Homo sapiens
tcttggctgacccc

SEQ ID NO: 3612296 - DNA, 15 bp, Homo sapiens
tcttggctgacccct

SEQ ID NO: 3612297 - DNA, 16 bp, Homo sapiens
tcttggctgacccctc

SEQ ID NO: 3612298 - DNA, 19 bp, Homo sapiens
tcttggctgacccctctgg

SEQ ID NO: 3612299 - DNA, 19 bp, Homo sapiens
tcttggctgcctgtgggct

SEQ ID NO: 3612300 - DNA, 20 bp, Homo sapiens
tcttgggatagtgttctgct

SEQ ID NO: 3612301 - DNA, 21 bp, Homo sapiens
tcttggggccactttcagagc

SEQ ID NO: 3612302 - DNA, 23 bp, Homo sapiens
tcttggggccactttcagagccc

SEQ ID NO: 3612303 - DNA, 21 bp, Homo sapiens
tcttgtattatctcctttgaa

SEQ ID NO: 3612304 - DNA, 20 bp, Homo sapiens
tcttgtccctttccctacct

SEQ ID NO: 3612305 - DNA, 21 bp, Homo sapiens
tcttgtcctcttctgctcttt

SEQ ID NO: 3612306 - DNA, 21 bp, Homo sapiens
tcttgttttttttttccactt

SEQ ID NO: 3612307 - DNA, 14 bp, Homo sapiens
gtcagccactgtga

SEQ ID NO: 3612308 - DNA, 20 bp, Homo sapiens
gtcagcctggaagggacagt

SEQ ID NO: 3612309 - DNA, 23 bp, Homo sapiens
gtcagctcccctcggagaagagc

SEQ ID NO: 3612310 - DNA, 19 bp, Homo sapiens
gtcagctgggatgtgaagt

SEQ ID NO: 3612311 - DNA, 23 bp, Homo sapiens
gtcagctgtggggaacacagcta

SEQ ID NO: 3612312 - DNA, 23 bp, Homo sapiens
gtcaggagttcgagaccagcctg

SEQ ID NO: 3612313 - DNA, 22 bp, Homo sapiens
gtcaggcccttattttcaagaa

SEQ ID NO: 3612314 - DNA, 15 bp, Homo sapiens
gtcaggtggctgtgg

SEQ ID NO: 3612315 - DNA, 13 bp, Homo sapiens
gtcaggtgggaga

SEQ ID NO: 3612316 - DNA, 17 bp, Homo sapiens
gtcaggtgtcgaggcca

SEQ ID NO: 3612317 - DNA, 18 bp, Homo sapiens
gtcaggtgtcgaggccac

SEQ ID NO: 3612318 - DNA, 10 bp, Homo sapiens
gtcagtgttt

SEQ ID NO: 3612319 - DNA, 18 bp, Homo sapiens
gtcagttgttatttattg

SEQ ID NO: 3612320 - DNA, 21 bp, Homo sapiens
gtcagttgttatttattgaaa

SEQ ID NO: 3612321 - DNA, 21 bp, Homo sapiens
gtcatctggcggaggtctctg

SEQ ID NO: 3612322 - DNA, 15 bp, Homo sapiens
gtcatcttgctacca

SEQ ID NO: 3612323 - DNA, 18 bp, Homo sapiens
gtcatcttgctaccagta

SEQ ID NO: 3612324 - DNA, 17 bp, Homo sapiens
gtcatgccctcctctcc

SEQ ID NO: 3612325 - DNA, 11 bp, Homo sapiens
gtcatgtgacc

SEQ ID NO: 3612326 - DNA, 15 bp, Homo sapiens
gtcatgttatgcagt

SEQ ID NO: 3612327 - DNA, 22 bp, Homo sapiens
gtcatgttatgcagtgaactat

SEQ ID NO: 3612328 - DNA, 11 bp, Homo sapiens
gtcattaaatg

SEQ ID NO: 3612329 - DNA, 23 bp, Homo sapiens
gtcattatgtagctgtcgtacat

SEQ ID NO: 3612330 - DNA, 14 bp, Homo sapiens
gtcattcagttcta

SEQ ID NO: 3612331 - DNA, 21 bp, Homo sapiens
gtcattggcaaagtgacaaag

SEQ ID NO: 3612332 - DNA, 14 bp, Homo sapiens
gtcatttaaatgtg

SEQ ID NO: 3612333 - DNA, 22 bp, Homo sapiens
gtcatttctatattcctccagc

SEQ ID NO: 3612334 - DNA, 16 bp, Homo sapiens
gtcatttgttaaaata

SEQ ID NO: 3612335 - DNA, 13 bp, Homo sapiens
gtcattttgggtt

SEQ ID NO: 3612336 - DNA, 14 bp, Homo sapiens
gtccaagcagagtg

SEQ ID NO: 3612337 - DNA, 12 bp, Homo sapiens
gtccactcccag

SEQ ID NO: 3612338 - DNA, 16 bp, Homo sapiens
gtccactcccagtgct

SEQ ID NO: 3612339 - DNA, 21 bp, Homo sapiens
gtccagacacaaagagacaaa

SEQ ID NO: 3612340 - DNA, 13 bp, Homo sapiens
gtccagcagtctg

SEQ ID NO: 3612341 - DNA, 13 bp, Homo sapiens
gtccagctcagcc

SEQ ID NO: 3612342 - DNA, 14 bp, Homo sapiens
gtccagctcagccc

SEQ ID NO: 3612343 - DNA, 14 bp, Homo sapiens
gtccagctccaacc

SEQ ID NO: 3612344 - DNA, 11 bp, Homo sapiens
gtccagctctg

SEQ ID NO: 3612345 - DNA, 12 bp, Homo sapiens
gtccagctctga

SEQ ID NO: 3612346 - DNA, 14 bp, Homo sapiens
gtccagctctgaca

SEQ ID NO: 3612347 - DNA, 19 bp, Homo sapiens
gtccagctgggaagccctt

SEQ ID NO: 3612348 - DNA, 20 bp, Homo sapiens
gtccaggccccaccggccag

SEQ ID NO: 3612349 - DNA, 21 bp, Homo sapiens
gtccagggagcattttcctcc

SEQ ID NO: 3612350 - DNA, 21 bp, Homo sapiens
gtccagggaggggtccctgca

SEQ ID NO: 3612351 - DNA, 21 bp, Homo sapiens
gtccagggcctgacaccccct

SEQ ID NO: 3612352 - DNA, 13 bp, Homo sapiens
gtcccacactgtg

SEQ ID NO: 3612353 - DNA, 20 bp, Homo sapiens
gtcccacactgtggccaggc

SEQ ID NO: 3612354 - DNA, 14 bp, Homo sapiens
gtcccacatggcca

SEQ ID NO: 3612355 - DNA, 18 bp, Homo sapiens
gtcccagctgaaggcagt

SEQ ID NO: 3612356 - DNA, 17 bp, Homo sapiens
gtccccaccatctgctg

SEQ ID NO: 3612357 - DNA, 13 bp, Homo sapiens
gtccccccaccct

SEQ ID NO: 3612358 - DNA, 17 bp, Homo sapiens
gtcccggccagctctgg

SEQ ID NO: 3612359 - DNA, 18 bp, Homo sapiens
gtcccggccagctctgga

SEQ ID NO: 3612360 - DNA, 19 bp, Homo sapiens
gtcccggccagctctggag

SEQ ID NO: 3612361 - DNA, 16 bp, Homo sapiens
gtcccggtgtatcctg

SEQ ID NO: 3612362 - DNA, 14 bp, Homo sapiens
gtccctctgcccca

SEQ ID NO: 3612363 - DNA, 22 bp, Homo sapiens
gtccctgcaaaactccaggcag

SEQ ID NO: 3612364 - DNA, 16 bp, Homo sapiens
gtccctgcagggccat

SEQ ID NO: 3612365 - DNA, 14 bp, Homo sapiens
gtccctggacacag

SEQ ID NO: 3612366 - DNA, 15 bp, Homo sapiens
gtccctggacacagc

SEQ ID NO: 3612367 - DNA, 17 bp, Homo sapiens
gtccctggacacagctc

SEQ ID NO: 3612368 - DNA, 18 bp, Homo sapiens
gtccctggacacagctct

SEQ ID NO: 3612369 - DNA, 23 bp, Homo sapiens
gtccctggacacagctcttcatt

SEQ ID NO: 3612370 - DNA, 15 bp, Homo sapiens
gtcccttcaatttct

SEQ ID NO: 3612371 - DNA, 18 bp, Homo sapiens
gtcccttgcctctgccct

SEQ ID NO: 3612372 - DNA, 20 bp, Homo sapiens
gtcccttgcctctgccctgg

SEQ ID NO: 3612373 - DNA, 23 bp, Homo sapiens
gtcccttgcctctgccctggatt

SEQ ID NO: 3612374 - DNA, 13 bp, Homo sapiens
gtccctttcccta

SEQ ID NO: 3612375 - DNA, 18 bp, Homo sapiens
gtccgcagttgtagcaga

SEQ ID NO: 3612376 - DNA, 21 bp, Homo sapiens
gtccgcagttgtagcagaaac

SEQ ID NO: 3612377 - DNA, 19 bp, Homo sapiens
gtccgtgccccttccctgg

SEQ ID NO: 3612378 - DNA, 20 bp, Homo sapiens
gtccgtgctgacagctgctc

SEQ ID NO: 3612379 - DNA, 22 bp, Homo sapiens
gtccgtgctgacagctgctcct

SEQ ID NO: 3612380 - DNA, 14 bp, Homo sapiens
gtcctaaggcccat

SEQ ID NO: 3612381 - DNA, 21 bp, Homo sapiens
gtcctatgtatatcttctaca

SEQ ID NO: 3612382 - DNA, 12 bp, Homo sapiens
gtcctcagcctt

SEQ ID NO: 3612383 - DNA, 21 bp, Homo sapiens
gtcctccactcgacccagaat

SEQ ID NO: 3612384 - DNA, 16 bp, Homo sapiens
gtcctccgtagggtct

SEQ ID NO: 3612385 - DNA, 11 bp, Homo sapiens
gtcctctctga

SEQ ID NO: 3612386 - DNA, 18 bp, Homo sapiens
gtcctctctgagtcaaat

SEQ ID NO: 3612387 - DNA, 19 bp, Homo sapiens
gtcctctctgagtcaaatc

SEQ ID NO: 3612388 - DNA, 21 bp, Homo sapiens
gtcctctctgagtcaaatcca

SEQ ID NO: 3612389 - DNA, 23 bp, Homo sapiens
gtcctctctgagtcaaatccagt

SEQ ID NO: 3612390 - DNA, 16 bp, Homo sapiens
gtcctctctggctggg

SEQ ID NO: 3612391 - DNA, 13 bp, Homo sapiens
gtcctctgcctgg

SEQ ID NO: 3612392 - DNA, 16 bp, Homo sapiens
gtcctctgcctgggct

SEQ ID NO: 3612393 - DNA, 18 bp, Homo sapiens
gtcctctgcctgggctct

SEQ ID NO: 3612394 - DNA, 19 bp, Homo sapiens
gtcctcttttcctggcagc

SEQ ID NO: 3612395 - DNA, 20 bp, Homo sapiens
gtcctgagcaccacacccag

SEQ ID NO: 3612396 - DNA, 10 bp, Homo sapiens
gtcctgcagc

SEQ ID NO: 3612397 - DNA, 19 bp, Homo sapiens
gtcctgcagtctggctgag

SEQ ID NO: 3612398 - DNA, 20 bp, Homo sapiens
gtcctgccacccagccccag

SEQ ID NO: 3612399 - DNA, 21 bp, Homo sapiens
gtcctgctcattatgccactt

SEQ ID NO: 3612400 - DNA, 22 bp, Homo sapiens
gtcctggactcctgccaccagc

SEQ ID NO: 3612401 - DNA, 22 bp, Homo sapiens
gtcctgggcatgggtccagggc

SEQ ID NO: 3612402 - DNA, 13 bp, Homo sapiens
gtcctgggcctgc

SEQ ID NO: 3612403 - DNA, 17 bp, Homo sapiens
gtcctgggcctgcagaa

SEQ ID NO: 3612404 - DNA, 14 bp, Homo sapiens
gtcctgggggcagg

SEQ ID NO: 3612405 - DNA, 11 bp, Homo sapiens
gtcctggtgcc

SEQ ID NO: 3612406 - DNA, 23 bp, Homo sapiens
gtcctgtcgaaggggaggcacac

SEQ ID NO: 3612407 - DNA, 22 bp, Homo sapiens
gtcctgttcagaaaggggctct

SEQ ID NO: 3612408 - DNA, 19 bp, Homo sapiens
gtccttaacccacctctcc

SEQ ID NO: 3612409 - DNA, 23 bp, Homo sapiens
gtccttaacccacctctcctgcc

SEQ ID NO: 3612410 - DNA, 17 bp, Homo sapiens
gtccttactcccccacc

SEQ ID NO: 3612411 - DNA, 12 bp, Homo sapiens
gtccttgccctt

SEQ ID NO: 3612412 - DNA, 21 bp, Homo sapiens
gtcctttcccaccattcctgc

SEQ ID NO: 3612413 - DNA, 14 bp, Homo sapiens
gtcctttgtctttc

SEQ ID NO: 3612414 - DNA, 16 bp, Homo sapiens
gtccttttgacactgc

SEQ ID NO: 3612415 - DNA, 20 bp, Homo sapiens
gtccttttgacactgctcta

SEQ ID NO: 3612416 - DNA, 21 bp, Homo sapiens
gtccttttgacactgctctaa

SEQ ID NO: 3612417 - DNA, 19 bp, Homo sapiens
gtcgaaggggaggcacact

SEQ ID NO: 3612418 - DNA, 17 bp, Homo sapiens
gtcgaccccaaaggaac

SEQ ID NO: 3612419 - DNA, 18 bp, Homo sapiens
gtcgaccccaaaggaaca

SEQ ID NO: 3612420 - DNA, 23 bp, Homo sapiens
gtcgaggccacattgctggctgc

SEQ ID NO: 3612421 - DNA, 16 bp, Homo sapiens
gtcgccaatccatgct

SEQ ID NO: 3612422 - DNA, 16 bp, Homo sapiens
gtcgctgtgccacagg

SEQ ID NO: 3612423 - DNA, 17 bp, Homo sapiens
gtcggactgcccccaga

SEQ ID NO: 3612424 - DNA, 14 bp, Homo sapiens
gtcggagtgcctgg

SEQ ID NO: 3612425 - DNA, 22 bp, Homo sapiens
gtcgggcatggtggctcatgcc

SEQ ID NO: 3612426 - DNA, 15 bp, Homo sapiens
gtcgtgggaaagggg

SEQ ID NO: 3612427 - DNA, 23 bp, Homo sapiens
gtcgttaaaaacagatttggaaa

SEQ ID NO: 3612428 - DNA, 21 bp, Homo sapiens
gtcgttgttgtggaagcatgt

SEQ ID NO: 3612429 - DNA, 11 bp, Homo sapiens
gtcgttttcca

SEQ ID NO: 3612430 - DNA, 15 bp, Homo sapiens
gtcgttttccaaaga

SEQ ID NO: 3612431 - DNA, 16 bp, Homo sapiens
gtctaaattttctaaa

SEQ ID NO: 3612432 - DNA, 22 bp, Homo sapiens
gtctaattaaaacactttcaaa

SEQ ID NO: 3612433 - DNA, 14 bp, Homo sapiens
gtctagagagaacc

SEQ ID NO: 3612434 - DNA, 14 bp, Homo sapiens
gtctagagagggag

SEQ ID NO: 3612435 - DNA, 16 bp, Homo sapiens
gtctagagagggaggc

SEQ ID NO: 3612436 - DNA, 17 bp, Homo sapiens
gtctagatggctcctct

SEQ ID NO: 3612437 - DNA, 18 bp, Homo sapiens
gtctcaacgcctccccct

SEQ ID NO: 3612438 - DNA, 15 bp, Homo sapiens
gtctcaagagggcac

SEQ ID NO: 3612439 - DNA, 14 bp, Homo sapiens
gtctcacgcagcca

SEQ ID NO: 3612440 - DNA, 13 bp, Homo sapiens
gtctcagcctctg

SEQ ID NO: 3612441 - DNA, 15 bp, Homo sapiens
gtctcattgcttctg

SEQ ID NO: 3612442 - DNA, 14 bp, Homo sapiens
gtctccaaagaaga

SEQ ID NO: 3612443 - DNA, 12 bp, Homo sapiens
gtctccagctgc

SEQ ID NO: 3612444 - DNA, 14 bp, Homo sapiens
gggccgctgccacc

SEQ ID NO: 3612445 - DNA, 15 bp, Homo sapiens
gggccgctgccaccc

SEQ ID NO: 3612446 - DNA, 18 bp, Homo sapiens
gggccggctgagtggcag

SEQ ID NO: 3612447 - DNA, 13 bp, Homo sapiens
gggccgggcaggg

SEQ ID NO: 3612448 - DNA, 21 bp, Homo sapiens
gggccgtaggggctcctgagt

SEQ ID NO: 3612449 - DNA, 17 bp, Homo sapiens
gggcctaggcctcagcc

SEQ ID NO: 3612450 - DNA, 14 bp, Homo sapiens
gggcctcaggctcc

SEQ ID NO: 3612451 - DNA, 20 bp, Homo sapiens
gggcctcaggctctgcacag

SEQ ID NO: 3612452 - DNA, 13 bp, Homo sapiens
gggcctccagggc

SEQ ID NO: 3612453 - DNA, 14 bp, Homo sapiens
gggcctccagggcc

SEQ ID NO: 3612454 - DNA, 11 bp, Homo sapiens
gggcctgcccc

SEQ ID NO: 3612455 - DNA, 14 bp, Homo sapiens
gggcctggagcccc

SEQ ID NO: 3612456 - DNA, 16 bp, Homo sapiens
gggcctggaggtctgg

SEQ ID NO: 3612457 - DNA, 22 bp, Homo sapiens
gggcctttaaaacgcgtctgcc

SEQ ID NO: 3612458 - DNA, 18 bp, Homo sapiens
gggcgttctcccaaagat

SEQ ID NO: 3612459 - DNA, 14 bp, Homo sapiens
gggcgttgggagcc

SEQ ID NO: 3612460 - DNA, 20 bp, Homo sapiens
gggctaattctgggaaggga

SEQ ID NO: 3612461 - DNA, 22 bp, Homo sapiens
gggctaattctgggaagggaga

SEQ ID NO: 3612462 - DNA, 18 bp, Homo sapiens
gggctcaatctctggggg

SEQ ID NO: 3612463 - DNA, 14 bp, Homo sapiens
gggctcagacatcc

SEQ ID NO: 3612464 - DNA, 20 bp, Homo sapiens
gggctcagcagccagaggag

SEQ ID NO: 3612465 - DNA, 11 bp, Homo sapiens
gggctcctctt

SEQ ID NO: 3612466 - DNA, 12 bp, Homo sapiens
gggctcctctta

SEQ ID NO: 3612467 - DNA, 13 bp, Homo sapiens
gggctctgtggca

SEQ ID NO: 3612468 - DNA, 16 bp, Homo sapiens
gggctgacccagcatc

SEQ ID NO: 3612469 - DNA, 15 bp, Homo sapiens
gggctgcaggcaggc

SEQ ID NO: 3612470 - DNA, 14 bp, Homo sapiens
gggctgccctggtg

SEQ ID NO: 3612471 - DNA, 15 bp, Homo sapiens
gggctgccctggtgc

SEQ ID NO: 3612472 - DNA, 12 bp, Homo sapiens
gggctgctgctc

SEQ ID NO: 3612473 - DNA, 17 bp, Homo sapiens
gggctgctgctcctctc

SEQ ID NO: 3612474 - DNA, 16 bp, Homo sapiens
gggctggagaaagagc

SEQ ID NO: 3612475 - DNA, 17 bp, Homo sapiens
gggctggagcctggggt

SEQ ID NO: 3612476 - DNA, 16 bp, Homo sapiens
gggctggggatgcgcc

SEQ ID NO: 3612477 - DNA, 17 bp, Homo sapiens
gggcttcaacagccaag

SEQ ID NO: 3612478 - DNA, 14 bp, Homo sapiens
gggcttctcctcct

SEQ ID NO: 3612479 - DNA, 15 bp, Homo sapiens
gggcttggggctgca

SEQ ID NO: 3612480 - DNA, 14 bp, Homo sapiens
gggctttctcttcc

SEQ ID NO: 3612481 - DNA, 17 bp, Homo sapiens
ggggaaaggcaaggtcc

SEQ ID NO: 3612482 - DNA, 22 bp, Homo sapiens
ggggaaaggcaaggtccggccc

SEQ ID NO: 3612483 - DNA, 13 bp, Homo sapiens
ggggaacacagct

SEQ ID NO: 3612484 - DNA, 15 bp, Homo sapiens
ggggacagcttcctc

SEQ ID NO: 3612485 - DNA, 22 bp, Homo sapiens
ggggacccaaaccccctgcagc

SEQ ID NO: 3612486 - DNA, 11 bp, Homo sapiens
ggggagaaaaa

SEQ ID NO: 3612487 - DNA, 23 bp, Homo sapiens
ggggagaggtgattctcagggct

SEQ ID NO: 3612488 - DNA, 11 bp, Homo sapiens
ggggagcccac

SEQ ID NO: 3612489 - DNA, 14 bp, Homo sapiens
ggggagcccagtga

SEQ ID NO: 3612490 - DNA, 12 bp, Homo sapiens
ggggaggagcct

SEQ ID NO: 3612491 - DNA, 19 bp, Homo sapiens
ggggaggagcctctggctt

SEQ ID NO: 3612492 - DNA, 14 bp, Homo sapiens
ggggagggaaggga

SEQ ID NO: 3612493 - DNA, 20 bp, Homo sapiens
ggggagggtgacagtggccg

SEQ ID NO: 3612494 - DNA, 17 bp, Homo sapiens
ggggaggttgtggggcc

SEQ ID NO: 3612495 - DNA, 15 bp, Homo sapiens
ggggagtagccaagc

SEQ ID NO: 3612496 - DNA, 11 bp, Homo sapiens
ggggagtggaa

SEQ ID NO: 3612497 - DNA, 15 bp, Homo sapiens
ggggatccagccact

SEQ ID NO: 3612498 - DNA, 17 bp, Homo sapiens
ggggatccagccacttc

SEQ ID NO: 3612499 - DNA, 23 bp, Homo sapiens
ggggatccctcccccccatgcac

SEQ ID NO: 3612500 - DNA, 22 bp, Homo sapiens
ggggatcttcccacaggagggc

SEQ ID NO: 3612501 - DNA, 15 bp, Homo sapiens
ggggattgcccctgg

SEQ ID NO: 3612502 - DNA, 20 bp, Homo sapiens
ggggattttttactgccctt

SEQ ID NO: 3612503 - DNA, 19 bp, Homo sapiens
ggggcagggaaggacagga

SEQ ID NO: 3612504 - DNA, 19 bp, Homo sapiens
ggggccagatccagcctgg

SEQ ID NO: 3612505 - DNA, 19 bp, Homo sapiens
ggggccatgcctcctcagg

SEQ ID NO: 3612506 - DNA, 20 bp, Homo sapiens
ggggccccgccagggctggg

SEQ ID NO: 3612507 - DNA, 21 bp, Homo sapiens
ggggccccgccagggctgggg

SEQ ID NO: 3612508 - DNA, 15 bp, Homo sapiens
ggggcccggagatag

SEQ ID NO: 3612509 - DNA, 15 bp, Homo sapiens
ggggcccggccagcc

SEQ ID NO: 3612510 - DNA, 14 bp, Homo sapiens
ggggccctgcccca

SEQ ID NO: 3612511 - DNA, 13 bp, Homo sapiens
ggggccctgctac

SEQ ID NO: 3612512 - DNA, 16 bp, Homo sapiens
ggggccggccagtggc

SEQ ID NO: 3612513 - DNA, 12 bp, Homo sapiens
ggggcctgcaga

SEQ ID NO: 3612514 - DNA, 11 bp, Homo sapiens
ggggcctggca

SEQ ID NO: 3612515 - DNA, 13 bp, Homo sapiens
ggggctcctgagt

SEQ ID NO: 3612516 - DNA, 24 bp, Homo sapiens
ggggctctcatgttttcaactgcc

SEQ ID NO: 3612517 - DNA, 14 bp, Homo sapiens
ggggctgcaggcag

SEQ ID NO: 3612518 - DNA, 22 bp, Homo sapiens
ggggctgcaggcaggcggctcc

SEQ ID NO: 3612519 - DNA, 23 bp, Homo sapiens
ggggctgctgctcctctcttggg

SEQ ID NO: 3612520 - DNA, 13 bp, Homo sapiens
ggggctttctctt

SEQ ID NO: 3612521 - DNA, 21 bp, Homo sapiens
ggggctttctcttccccttcc

SEQ ID NO: 3612522 - DNA, 15 bp, Homo sapiens
gggggagcaaaagaa

SEQ ID NO: 3612523 - DNA, 10 bp, Homo sapiens
gggggagccc

SEQ ID NO: 3612524 - DNA, 15 bp, Homo sapiens
gggggaggccacccc

SEQ ID NO: 3612525 - DNA, 16 bp, Homo sapiens
gggggagtagccaagc

SEQ ID NO: 3612526 - DNA, 13 bp, Homo sapiens
gggggagtggaat

SEQ ID NO: 3612527 - DNA, 22 bp, Homo sapiens
gggggccccgccagggctgggg

SEQ ID NO: 3612528 - DNA, 11 bp, Homo sapiens
gggggccctgc

SEQ ID NO: 3612529 - DNA, 13 bp, Homo sapiens
gggggctgtgcca

SEQ ID NO: 3612530 - DNA, 13 bp, Homo sapiens
gggggtcctctct

SEQ ID NO: 3612531 - DNA, 18 bp, Homo sapiens
ggggtaaagtttgctcta

SEQ ID NO: 3612532 - DNA, 18 bp, Homo sapiens
ggggtcatgccctcctct

SEQ ID NO: 3612533 - DNA, 19 bp, Homo sapiens
ggggtcatgccctcctctc

SEQ ID NO: 3612534 - DNA, 23 bp, Homo sapiens
ggggtcctctctgagtcaaatcc

SEQ ID NO: 3612535 - DNA, 24 bp, Homo sapiens
ggggtcctctctgagtcaaatcca

SEQ ID NO: 3612536 - DNA, 20 bp, Homo sapiens
ggggtctggagttgatctgg

SEQ ID NO: 3612537 - DNA, 23 bp, Homo sapiens
ggggtctgtgtgtttatgtgtgt

SEQ ID NO: 3612538 - DNA, 15 bp, Homo sapiens
ggggtgaggagctgg

SEQ ID NO: 3612539 - DNA, 18 bp, Homo sapiens
ggggtgccgctgtctctg

SEQ ID NO: 3612540 - DNA, 14 bp, Homo sapiens
ggggtgggccaggc

SEQ ID NO: 3612541 - DNA, 18 bp, Homo sapiens
ggggtgtttgggagctgc

SEQ ID NO: 3612542 - DNA, 22 bp, Homo sapiens
ggggttctttcttcctctgctg

SEQ ID NO: 3612543 - DNA, 20 bp, Homo sapiens
ggggtttgtgtttgattggc

SEQ ID NO: 3612544 - DNA, 20 bp, Homo sapiens
gggtaattgtacaataaatt

SEQ ID NO: 3612545 - DNA, 17 bp, Homo sapiens
gggtacagaggggacaa

SEQ ID NO: 3612546 - DNA, 14 bp, Homo sapiens
gggtccacctggag

SEQ ID NO: 3612547 - DNA, 15 bp, Homo sapiens
gggtccctgaacgcc

SEQ ID NO: 3612548 - DNA, 22 bp, Homo sapiens
gggtccctgaacgccctggtaa

SEQ ID NO: 3612549 - DNA, 24 bp, Homo sapiens
gggtccctgaacgccctggtaagg

SEQ ID NO: 3612550 - DNA, 18 bp, Homo sapiens
gggtcctctctgagtcaa

SEQ ID NO: 3612551 - DNA, 20 bp, Homo sapiens
gggtcctctctgagtcaaat

SEQ ID NO: 3612552 - DNA, 20 bp, Homo sapiens
gggtcgtgggaaaggggagt

SEQ ID NO: 3612553 - DNA, 17 bp, Homo sapiens
gggtctcactctgttgc

SEQ ID NO: 3612554 - DNA, 17 bp, Homo sapiens
gggtctcccctcctgca

SEQ ID NO: 3612555 - DNA, 21 bp, Homo sapiens
gggtctgagtcatggccgggt

SEQ ID NO: 3612556 - DNA, 14 bp, Homo sapiens
gggtctgattttct

SEQ ID NO: 3612557 - DNA, 14 bp, Homo sapiens
gggtctgggcgtcc

SEQ ID NO: 3612558 - DNA, 16 bp, Homo sapiens
gggtctggggacaggc

SEQ ID NO: 3612559 - DNA, 20 bp, Homo sapiens
gggtctggggacaggcccgc

SEQ ID NO: 3612560 - DNA, 14 bp, Homo sapiens
gggtctttcttggg

SEQ ID NO: 3612561 - DNA, 12 bp, Homo sapiens
gggtgagagagg

SEQ ID NO: 3612562 - DNA, 18 bp, Homo sapiens
gggtgaggtaggcgggaa

SEQ ID NO: 3612563 - DNA, 18 bp, Homo sapiens
gggtgctctctctgaggg

SEQ ID NO: 3612564 - DNA, 13 bp, Homo sapiens
gggtgctgctctc

SEQ ID NO: 3612565 - DNA, 14 bp, Homo sapiens
gggtgggccaggct

SEQ ID NO: 3612566 - DNA, 19 bp, Homo sapiens
gggtgggccaggctgatgg

SEQ ID NO: 3612567 - DNA, 22 bp, Homo sapiens
gggtgtaacttcctgctgcacc

SEQ ID NO: 3612568 - DNA, 19 bp, Homo sapiens
gggtgtggagaccaggctc

SEQ ID NO: 3612569 - DNA, 14 bp, Homo sapiens
gggttaaatatttt

SEQ ID NO: 3612570 - DNA, 20 bp, Homo sapiens
gggttaaatattttgctaac

SEQ ID NO: 3612571 - DNA, 22 bp, Homo sapiens
gggttcaagtgactctcctgcc

SEQ ID NO: 3612572 - DNA, 20 bp, Homo sapiens
gggttctgcctgccagctgc

SEQ ID NO: 3612573 - DNA, 21 bp, Homo sapiens
gggttctgcctgccagctgca

SEQ ID NO: 3612574 - DNA, 16 bp, Homo sapiens
gggttctttcttcctc

SEQ ID NO: 3612575 - DNA, 19 bp, Homo sapiens
gggtttcgactggtccagc

SEQ ID NO: 3612576 - DNA, 23 bp, Homo sapiens
gggtttcgactggtccagctctg

SEQ ID NO: 3612577 - DNA, 16 bp, Homo sapiens
gggtttgggagccagg

SEQ ID NO: 3612578 - DNA, 13 bp, Homo sapiens
ggtaaacaaagac

SEQ ID NO: 3612579 - DNA, 23 bp, Homo sapiens
ggtaaacattcctccagcctccc

SEQ ID NO: 3612580 - DNA, 17 bp, Homo sapiens
ggtaactaattggaagg

SEQ ID NO: 3612581 - DNA, 16 bp, Homo sapiens
ggtaactgtcctgtcc

SEQ ID NO: 3612582 - DNA, 22 bp, Homo sapiens
ggtaaggctggtgaggtcctgg

SEQ ID NO: 3612583 - DNA, 17 bp, Homo sapiens
ggtaataaatgtgactc

SEQ ID NO: 3612584 - DNA, 20 bp, Homo sapiens
ggtaatacttccagaagtgc

SEQ ID NO: 3612585 - DNA, 22 bp, Homo sapiens
ggtaattgttgctaatcttctt

SEQ ID NO: 3612586 - DNA, 19 bp, Homo sapiens
ggtacctggtccccactgc

SEQ ID NO: 3612587 - DNA, 20 bp, Homo sapiens
ggtactcccaaactgacaat

SEQ ID NO: 3612588 - DNA, 19 bp, Homo sapiens
ggtactctgtgaaagaaga

SEQ ID NO: 3612589 - DNA, 17 bp, Homo sapiens
ggtactgtaatgttaat

SEQ ID NO: 3612590 - DNA, 13 bp, Homo sapiens
ggtacttagagtt

SEQ ID NO: 3612591 - DNA, 21 bp, Homo sapiens
ggtacttagagtttctgtttg

SEQ ID NO: 3612592 - DNA, 19 bp, Homo sapiens
ggtacttcttgaaggtgct

SEQ ID NO: 3612593 - DNA, 16 bp, Homo sapiens
ggtacttggagggctc

SEQ ID NO: 3612594 - DNA, 15 bp, Homo sapiens
ggtagaaaaacccaa

SEQ ID NO: 3612595 - DNA, 23 bp, Homo sapiens
ggtagaatgttttcaaatgttct

SEQ ID NO: 3612596 - DNA, 17 bp, Homo sapiens
ggtagagccacaaaaga

SEQ ID NO: 3612597 - DNA, 19 bp, Homo sapiens
ggtagcaattggcagccct

SEQ ID NO: 3612598 - DNA, 18 bp, Homo sapiens
ggtagccttgtgttctga

SEQ ID NO: 3612599 - DNA, 17 bp, Homo sapiens
ggtagctggggagccct

SEQ ID NO: 3612600 - DNA, 13 bp, Homo sapiens
ggtatctggcttc

SEQ ID NO: 3612601 - DNA, 15 bp, Homo sapiens
ggtattttgtttctt

SEQ ID NO: 3612602 - DNA, 18 bp, Homo sapiens
ggtatttttgttaggttt

SEQ ID NO: 3612603 - DNA, 21 bp, Homo sapiens
ggtcaaacccaagttagttca

SEQ ID NO: 3612604 - DNA, 22 bp, Homo sapiens
ggtcaacatttctcatgttgaa

SEQ ID NO: 3612605 - DNA, 21 bp, Homo sapiens
ggtcaccaggggaggagcctg

SEQ ID NO: 3612606 - DNA, 13 bp, Homo sapiens
ggtcacccatgca

SEQ ID NO: 3612607 - DNA, 21 bp, Homo sapiens
ggtcactcgtggtgaggctga

SEQ ID NO: 3612608 - DNA, 18 bp, Homo sapiens
ggtcactctgggcctggg

SEQ ID NO: 3612609 - DNA, 14 bp, Homo sapiens
ggtcagcatccagt

SEQ ID NO: 3612610 - DNA, 20 bp, Homo sapiens
ggtcagcatccagtgtgaga

SEQ ID NO: 3612611 - DNA, 14 bp, Homo sapiens
ggtcagcctggaag

SEQ ID NO: 3612612 - DNA, 14 bp, Homo sapiens
ggtcatctggcgga

SEQ ID NO: 3612613 - DNA, 20 bp, Homo sapiens
ggtcatgccctcctctccca

SEQ ID NO: 3612614 - DNA, 17 bp, Homo sapiens
ggtcatgtgagtctggg

SEQ ID NO: 3612615 - DNA, 12 bp, Homo sapiens
ggtccacagctg

SEQ ID NO: 3612616 - DNA, 14 bp, Homo sapiens
ggtccacctggaga

SEQ ID NO: 3612617 - DNA, 12 bp, Homo sapiens
ggtccagctctg

SEQ ID NO: 3612618 - DNA, 15 bp, Homo sapiens
ggtccagctctgaca

SEQ ID NO: 3612619 - DNA, 18 bp, Homo sapiens
ggtccagctctgacatcc

SEQ ID NO: 3612620 - DNA, 22 bp, Homo sapiens
ggtccagctctgacatcccttc

SEQ ID NO: 3612621 - DNA, 11 bp, Homo sapiens
ggtccagggag

SEQ ID NO: 3612622 - DNA, 18 bp, Homo sapiens
ggtcccagagacctcatc

SEQ ID NO: 3612623 - DNA, 12 bp, Homo sapiens
ggtccccactgc

SEQ ID NO: 3612624 - DNA, 21 bp, Homo sapiens
ggtccccactgctgagctggc

SEQ ID NO: 3612625 - DNA, 22 bp, Homo sapiens
ggtccccactgctgagctggcc

SEQ ID NO: 3612626 - DNA, 19 bp, Homo sapiens
ggtcccggccagctctgga

SEQ ID NO: 3612627 - DNA, 14 bp, Homo sapiens
ggtccctccacccc

SEQ ID NO: 3612628 - DNA, 21 bp, Homo sapiens
ggtccctccaccccacagaac

SEQ ID NO: 3612629 - DNA, 20 bp, Homo sapiens
ggtcctacccatccccgcag

SEQ ID NO: 3612630 - DNA, 21 bp, Homo sapiens
ggtcctcctatctccctggct

SEQ ID NO: 3612631 - DNA, 12 bp, Homo sapiens
ggtcctctctga

SEQ ID NO: 3612632 - DNA, 20 bp, Homo sapiens
ggtcctctctgagtcaaatc

SEQ ID NO: 3612633 - DNA, 19 bp, Homo sapiens
ggtcctcttttcctggcag

SEQ ID NO: 3612634 - DNA, 20 bp, Homo sapiens
ggtcctcttttcctggcagc

SEQ ID NO: 3612635 - DNA, 20 bp, Homo sapiens
ggtcctgaagtgacctcact

SEQ ID NO: 3612636 - DNA, 15 bp, Homo sapiens
ggtcctgcagcctgc

SEQ ID NO: 3612637 - DNA, 12 bp, Homo sapiens
ggtcctggccat

SEQ ID NO: 3612638 - DNA, 21 bp, Homo sapiens
ggtcctggccatcccacaagt

SEQ ID NO: 3612639 - DNA, 12 bp, Homo sapiens
ggtcctggtgcc

SEQ ID NO: 3612640 - DNA, 24 bp, Homo sapiens
ggtcctggtgccctggatgcccag

SEQ ID NO: 3612641 - DNA, 10 bp, Homo sapiens
ggtccttcaa

SEQ ID NO: 3612642 - DNA, 18 bp, Homo sapiens
ggtcgccaatccatgctc

SEQ ID NO: 3612643 - DNA, 16 bp, Homo sapiens
ggtcggagtgcctgga

SEQ ID NO: 3612644 - DNA, 17 bp, Homo sapiens
ggtcggagtgcctggag

SEQ ID NO: 3612645 - DNA, 21 bp, Homo sapiens
ggtcggagtgcctggagtcag

SEQ ID NO: 3612646 - DNA, 15 bp, Homo sapiens
ggtcgggcagccagc

SEQ ID NO: 3612647 - DNA, 16 bp, Homo sapiens
ggtcgtgggaaagggg

SEQ ID NO: 3612648 - DNA, 19 bp, Homo sapiens
ggtcgtgggaaaggggagt

SEQ ID NO: 3612649 - DNA, 17 bp, Homo sapiens
ggtcgttttccaaagag

SEQ ID NO: 3612650 - DNA, 19 bp, Homo sapiens
ggtctcactctgttgccca

SEQ ID NO: 3612651 - DNA, 15 bp, Homo sapiens
ggtctccaggggcct

SEQ ID NO: 3612652 - DNA, 18 bp, Homo sapiens
ggtctccaggggcctgca

SEQ ID NO: 3612653 - DNA, 21 bp, Homo sapiens
ggtctccaggggcctgcagaa

SEQ ID NO: 3612654 - DNA, 13 bp, Homo sapiens
ggtctcccctcct

SEQ ID NO: 3612655 - DNA, 16 bp, Homo sapiens
ggtctcccctcctgca

SEQ ID NO: 3612656 - DNA, 21 bp, Homo sapiens
ggtctcccctcctgcacacag

SEQ ID NO: 3612657 - DNA, 22 bp, Homo sapiens
ggtctctcagggatggagggaa

SEQ ID NO: 3612658 - DNA, 14 bp, Homo sapiens
ggtctctctccagg

SEQ ID NO: 3612659 - DNA, 23 bp, Homo sapiens
ggtctctctccaggtcagcctgg

SEQ ID NO: 3612660 - DNA, 19 bp, Homo sapiens
ggtctctctctctctacaa

SEQ ID NO: 3612661 - DNA, 13 bp, Homo sapiens
ggtctctgcccca

SEQ ID NO: 3612662 - DNA, 14 bp, Homo sapiens
ggtctctgggagcc

SEQ ID NO: 3612663 - DNA, 12 bp, Homo sapiens
ggtctgactcca

SEQ ID NO: 3612664 - DNA, 15 bp, Homo sapiens
ggtctgccttctgct

SEQ ID NO: 3612665 - DNA, 16 bp, Homo sapiens
ggtctgggatatggct

SEQ ID NO: 3612666 - DNA, 16 bp, Homo sapiens
ggtctggttcctgtgt

SEQ ID NO: 3612667 - DNA, 19 bp, Homo sapiens
ggtctgtggagatggactc

SEQ ID NO: 3612668 - DNA, 11 bp, Homo sapiens
ggtctgtgtgt

SEQ ID NO: 3612669 - DNA, 17 bp, Homo sapiens
ggtctgtgtgtgtgtat

SEQ ID NO: 3612670 - DNA, 15 bp, Homo sapiens
ggtcttggctgcctg

SEQ ID NO: 3612671 - DNA, 14 bp, Homo sapiens
ggtctttctctcag

SEQ ID NO: 3612672 - DNA, 21 bp, Homo sapiens
ggtctttttctagggtccctg

SEQ ID NO: 3612673 - DNA, 13 bp, Homo sapiens
ggtgaatctgtct

SEQ ID NO: 3612674 - DNA, 17 bp, Homo sapiens
ggtgagcatggcagctg

SEQ ID NO: 3612675 - DNA, 18 bp, Homo sapiens
ggtgaggggcaggtctag

SEQ ID NO: 3612676 - DNA, 20 bp, Homo sapiens
ggtgcacgcaggcacagcag

SEQ ID NO: 3612677 - DNA, 14 bp, Homo sapiens
ggtgcactccagac

SEQ ID NO: 3612678 - DNA, 20 bp, Homo sapiens
ggtgcactccagactctggg

SEQ ID NO: 3612679 - DNA, 13 bp, Homo sapiens
ggtgcagacgcgg

SEQ ID NO: 3612680 - DNA, 14 bp, Homo sapiens
ggtgcagccccagg

SEQ ID NO: 3612681 - DNA, 15 bp, Homo sapiens
ggtgcagccttcccc

SEQ ID NO: 3612682 - DNA, 21 bp, Homo sapiens
ggtgcagccttcccctccctg

SEQ ID NO: 3612683 - DNA, 19 bp, Homo sapiens
ggtgccaccaccctgcccc

SEQ ID NO: 3612684 - DNA, 15 bp, Homo sapiens
ggtgcccagggccag

SEQ ID NO: 3612685 - DNA, 14 bp, Homo sapiens
ggtgccccaggacc

SEQ ID NO: 3612686 - DNA, 17 bp, Homo sapiens
ggtgccccaggaccagc

SEQ ID NO: 3612687 - DNA, 23 bp, Homo sapiens
ggtgccccaggaccagctcagga

SEQ ID NO: 3612688 - DNA, 17 bp, Homo sapiens
ggtgccgctgtctctga

SEQ ID NO: 3612689 - DNA, 16 bp, Homo sapiens
ggtgccgctttctctg

SEQ ID NO: 3612690 - DNA, 17 bp, Homo sapiens
ggtgccgctttctctga

SEQ ID NO: 3612691 - DNA, 20 bp, Homo sapiens
ggtgcctaacctgggacctg

SEQ ID NO: 3612692 - DNA, 19 bp, Homo sapiens
ggtgcggcggtcccagctc

SEQ ID NO: 3612693 - DNA, 19 bp, Homo sapiens
ggtgcgtttataattggct

SEQ ID NO: 3612694 - DNA, 23 bp, Homo sapiens
ggtgctacaaaaacacagcaagg

SEQ ID NO: 3612695 - DNA, 14 bp, Homo sapiens
ggtgctagatccag

SEQ ID NO: 3612696 - DNA, 13 bp, Homo sapiens
ggtgctcatgctg

SEQ ID NO: 3612697 - DNA, 12 bp, Homo sapiens
ggtgctctggtc

SEQ ID NO: 3612698 - DNA, 16 bp, Homo sapiens
ggtgctgacggccagg

SEQ ID NO: 3612699 - DNA, 17 bp, Homo sapiens
ggtgctgacggccaggg

SEQ ID NO: 3612700 - DNA, 17 bp, Homo sapiens
ggtgctgcagatttgat

SEQ ID NO: 3612701 - DNA, 23 bp, Homo sapiens
ggtgctgcagatttgatatttgc

SEQ ID NO: 3612702 - DNA, 14 bp, Homo sapiens
ggtgctgcaggagt

SEQ ID NO: 3612703 - DNA, 15 bp, Homo sapiens
ggtgctgcaggagtg

SEQ ID NO: 3612704 - DNA, 17 bp, Homo sapiens
ggtgcttttggcagaga

SEQ ID NO: 3612705 - DNA, 22 bp, Homo sapiens
ggtggcggctgcacaacagccc

SEQ ID NO: 3612706 - DNA, 21 bp, Homo sapiens
ggtggctagtcaagctcctcc

SEQ ID NO: 3612707 - DNA, 23 bp, Homo sapiens
ggtggctagtcaagctcctcctc

SEQ ID NO: 3612708 - DNA, 15 bp, Homo sapiens
ggtgggattttgcaa

SEQ ID NO: 3612709 - DNA, 13 bp, Homo sapiens
ggtgggcctggga

SEQ ID NO: 3612710 - DNA, 21 bp, Homo sapiens
ggtgggctttgttgtgagaat

SEQ ID NO: 3612711 - DNA, 14 bp, Homo sapiens
ggtgggggagggaa

SEQ ID NO: 3612712 - DNA, 15 bp, Homo sapiens
ggtgggggtgccgct

SEQ ID NO: 3612713 - DNA, 16 bp, Homo sapiens
ggtgggggtgccgctg

SEQ ID NO: 3612714 - DNA, 13 bp, Homo sapiens
ggtgggggtgctc

SEQ ID NO: 3612715 - DNA, 16 bp, Homo sapiens
ggtggggtggcacctg

SEQ ID NO: 3612716 - DNA, 21 bp, Homo sapiens
ggtgggtaattgtacaataaa

SEQ ID NO: 3612717 - DNA, 19 bp, Homo sapiens
ggtggttcgtgctgtgctc

SEQ ID NO: 3612718 - DNA, 21 bp, Homo sapiens
ggtggttgctgttttcctccc

SEQ ID NO: 3612719 - DNA, 24 bp, Homo sapiens
ggtgtaacttcctgctgcaccctg

SEQ ID NO: 3612720 - DNA, 20 bp, Homo sapiens
ggtgtatcctggccctgggg

SEQ ID NO: 3612721 - DNA, 21 bp, Homo sapiens
ggtgtatcctggccctggggg

SEQ ID NO: 3612722 - DNA, 23 bp, Homo sapiens
ggtgtcaaacattcgtgagctgg

SEQ ID NO: 3612723 - DNA, 13 bp, Homo sapiens
ggtgtccccacca

SEQ ID NO: 3612724 - DNA, 21 bp, Homo sapiens
ggtgtccccaccatctgctgt

SEQ ID NO: 3612725 - DNA, 12 bp, Homo sapiens
ggtgtcctgagc

SEQ ID NO: 3612726 - DNA, 22 bp, Homo sapiens
ggtgtcgaggccacattgctgg

SEQ ID NO: 3612727 - DNA, 15 bp, Homo sapiens
ggtgtgaggagagag

SEQ ID NO: 3612728 - DNA, 19 bp, Homo sapiens
ggtgtggagaccaggctcc

SEQ ID NO: 3612729 - DNA, 14 bp, Homo sapiens
ggtgtggggggctg

SEQ ID NO: 3612730 - DNA, 14 bp, Homo sapiens
ggtgtgtcatttct

SEQ ID NO: 3612731 - DNA, 16 bp, Homo sapiens
ggtgtgtccctggaca

SEQ ID NO: 3612732 - DNA, 20 bp, Homo sapiens
ggtgtgtccctggacacagc

SEQ ID NO: 3612733 - DNA, 12 bp, Homo sapiens
ggtgtgtctgct

SEQ ID NO: 3612734 - DNA, 19 bp, Homo sapiens
ggtgttatgtattcctatg

SEQ ID NO: 3612735 - DNA, 21 bp, Homo sapiens
ggtgttgactggactgcttgg

SEQ ID NO: 3612736 - DNA, 13 bp, Homo sapiens
ggtgttgcagccg

SEQ ID NO: 3612737 - DNA, 15 bp, Homo sapiens
ggtgttgcagccgca

SEQ ID NO: 3612738 - DNA, 23 bp, Homo sapiens
ggtgttgcagccgcagagaaatg

SEQ ID NO: 3612739 - DNA, 13 bp, Homo sapiens
ggttaaatatttt

SEQ ID NO: 3612740 - DNA, 19 bp, Homo sapiens
ggttcaagcaatcctccta

SEQ ID NO: 3612741 - DNA, 19 bp, Homo sapiens
ggttcaagtattaagcagt

SEQ ID NO: 3612742 - DNA, 23 bp, Homo sapiens
ggttcaagtgactctcctgcctc

SEQ ID NO: 3612743 - DNA, 18 bp, Homo sapiens
ggttcacctgtgactcct

SEQ ID NO: 3612744 - DNA, 17 bp, Homo sapiens
ggttcagacacagctct

SEQ ID NO: 3612745 - DNA, 14 bp, Homo sapiens
ggttccctgctgcg

SEQ ID NO: 3612746 - DNA, 21 bp, Homo sapiens
ggttccctgctgcgctgcttg

SEQ ID NO: 3612747 - DNA, 17 bp, Homo sapiens
ggttcgagacccaaacc

SEQ ID NO: 3612748 - DNA, 17 bp, Homo sapiens
ggttcgatacctggagc

SEQ ID NO: 3612749 - DNA, 16 bp, Homo sapiens
ggttcggctgctttta

SEQ ID NO: 3612750 - DNA, 15 bp, Homo sapiens
ggttcgtgctgtgct

SEQ ID NO: 3612751 - DNA, 14 bp, Homo sapiens
ggttctgaggccag

SEQ ID NO: 3612752 - DNA, 15 bp, Homo sapiens
ggttctgaggccaga

SEQ ID NO: 3612753 - DNA, 19 bp, Homo sapiens
ggttctgcctgccagctgc

SEQ ID NO: 3612754 - DNA, 15 bp, Homo sapiens
ggttgagtgtgtggt

SEQ ID NO: 3612755 - DNA, 20 bp, Homo sapiens
ggttgagttacattaaaata

SEQ ID NO: 3612756 - DNA, 17 bp, Homo sapiens
ggttgctggtcctgcac

SEQ ID NO: 3612757 - DNA, 13 bp, Homo sapiens
ggttgttacagag

SEQ ID NO: 3612758 - DNA, 16 bp, Homo sapiens
ggtttaattcagcaga

SEQ ID NO: 3612759 - DNA, 22 bp, Homo sapiens
ggtttaggctggtggcccagga

SEQ ID NO: 3612760 - DNA, 14 bp, Homo sapiens
ggtttatgactctt

SEQ ID NO: 3612761 - DNA, 19 bp, Homo sapiens
ggtttcaccatgttggcca

SEQ ID NO: 3612762 - DNA, 20 bp, Homo sapiens
ggtttcgtgtgctgcccatg

SEQ ID NO: 3612763 - DNA, 22 bp, Homo sapiens
ggtttctttcagattttttgaa

SEQ ID NO: 3612764 - DNA, 20 bp, Homo sapiens
ggtttgccttttatgtaaat

SEQ ID NO: 3612765 - DNA, 21 bp, Homo sapiens
ggtttgccttttatgtaaatt

SEQ ID NO: 3612766 - DNA, 18 bp, Homo sapiens
ggtttgggagccaggact

SEQ ID NO: 3612767 - DNA, 14 bp, Homo sapiens
ggtttttcaattaa

SEQ ID NO: 3612768 - DNA, 19 bp, Homo sapiens
ggtttttcaattaaacgga

SEQ ID NO: 3612769 - DNA, 20 bp, Homo sapiens
ggtttttcaattaaacggat

SEQ ID NO: 3612770 - DNA, 23 bp, Homo sapiens
ggtttttgtttgtttcctttgtt

SEQ ID NO: 3612771 - DNA, 17 bp, Homo sapiens
ggttttttcttctttct

SEQ ID NO: 3612772 - DNA, 22 bp, Homo sapiens
gtaaaacaataataataataaa

SEQ ID NO: 3612773 - DNA, 16 bp, Homo sapiens
gtaaaacttctgctcg

SEQ ID NO: 3612774 - DNA, 17 bp, Homo sapiens
gtaaaatattaacatat

SEQ ID NO: 3612775 - DNA, 22 bp, Homo sapiens
gtaaaatgctggtgaaatgctg

SEQ ID NO: 3612776 - DNA, 22 bp, Homo sapiens
gtaaaatgtatatttttaaaga

SEQ ID NO: 3612777 - DNA, 14 bp, Homo sapiens
gtaaaatttcagga

SEQ ID NO: 3612778 - DNA, 15 bp, Homo sapiens
gtaaacaaagacttt

SEQ ID NO: 3612779 - DNA, 22 bp, Homo sapiens
gtaaacattcctccagcctccc

SEQ ID NO: 3612780 - DNA, 16 bp, Homo sapiens
gtaaacgctgtcccta

SEQ ID NO: 3612781 - DNA, 22 bp, Homo sapiens
gtaaactatcttggtgaatttt

SEQ ID NO: 3612782 - DNA, 13 bp, Homo sapiens
gtaaactgtttct

SEQ ID NO: 3612783 - DNA, 15 bp, Homo sapiens
gtaaactgtttcttt

SEQ ID NO: 3612784 - DNA, 15 bp, Homo sapiens
gtaaagtttgctcta

SEQ ID NO: 3612785 - DNA, 20 bp, Homo sapiens
gtaaatactttccatgtttt

SEQ ID NO: 3612786 - DNA, 13 bp, Homo sapiens
gtaaatgaaactt

SEQ ID NO: 3612787 - DNA, 18 bp, Homo sapiens
gtaaatgaaacttaagaa

SEQ ID NO: 3612788 - DNA, 18 bp, Homo sapiens
gtaaatggttaaatttta

SEQ ID NO: 3612789 - DNA, 23 bp, Homo sapiens
gtaaatggttaaattttacatga

SEQ ID NO: 3612790 - DNA, 18 bp, Homo sapiens
gtaaatgtctgcactgag

SEQ ID NO: 3612791 - DNA, 17 bp, Homo sapiens
gtaacaaattgatctgt

SEQ ID NO: 3612792 - DNA, 11 bp, Homo sapiens
gtaacagacac

SEQ ID NO: 3612793 - DNA, 15 bp, Homo sapiens
gtaactaaaataatt

SEQ ID NO: 3612794 - DNA, 22 bp, Homo sapiens
gtaactaaaataattttgtaat

SEQ ID NO: 3612795 - DNA, 14 bp, Homo sapiens
gtaactactttata

SEQ ID NO: 3612796 - DNA, 15 bp, Homo sapiens
gtaactgagagaaag

SEQ ID NO: 3612797 - DNA, 20 bp, Homo sapiens
gtaactgtaaagatgaatgt

SEQ ID NO: 3612798 - DNA, 13 bp, Homo sapiens
gtaactgtcctgt

SEQ ID NO: 3612799 - DNA, 15 bp, Homo sapiens
gtaactgtcctgtcc

SEQ ID NO: 3612800 - DNA, 16 bp, Homo sapiens
gtaactgtcctgtcct

SEQ ID NO: 3612801 - DNA, 21 bp, Homo sapiens
gtaactgtcctgtcctgctca

SEQ ID NO: 3612802 - DNA, 18 bp, Homo sapiens
gtaacttccaaataaata

SEQ ID NO: 3612803 - DNA, 15 bp, Homo sapiens
gtaacttcctgctgc

SEQ ID NO: 3612804 - DNA, 13 bp, Homo sapiens
gtaacttttaaaa

SEQ ID NO: 3612805 - DNA, 14 bp, Homo sapiens
gtaacttttgtgaa

SEQ ID NO: 3612806 - DNA, 15 bp, Homo sapiens
gtaagacaaaggttt

SEQ ID NO: 3612807 - DNA, 18 bp, Homo sapiens
gtaagaccaaatgtagtt

SEQ ID NO: 3612808 - DNA, 18 bp, Homo sapiens
gtaaggctgtacatagtc

SEQ ID NO: 3612809 - DNA, 14 bp, Homo sapiens
gtaagttctgtggt

SEQ ID NO: 3612810 - DNA, 20 bp, Homo sapiens
gtaagttctgtggttccagt

SEQ ID NO: 3612811 - DNA, 17 bp, Homo sapiens
gtaataaaaagcctctt

SEQ ID NO: 3612812 - DNA, 10 bp, Homo sapiens
gtaataaact

SEQ ID NO: 3612813 - DNA, 15 bp, Homo sapiens
gtaataaactctcta

SEQ ID NO: 3612814 - DNA, 14 bp, Homo sapiens
gtaataaagagaaa

SEQ ID NO: 3612815 - DNA, 12 bp, Homo sapiens
gtaataaatact

SEQ ID NO: 3612816 - DNA, 17 bp, Homo sapiens
gtaataaatgtgactca

SEQ ID NO: 3612817 - DNA, 12 bp, Homo sapiens
gtaataataaag

SEQ ID NO: 3612818 - DNA, 17 bp, Homo sapiens
gtaatacttccagaagt

SEQ ID NO: 3612819 - DNA, 17 bp, Homo sapiens
gtaataggcattttaag

SEQ ID NO: 3612820 - DNA, 12 bp, Homo sapiens
gtaatattatta

SEQ ID NO: 3612821 - DNA, 20 bp, Homo sapiens
gtaatattattactttatga

SEQ ID NO: 3612822 - DNA, 18 bp, Homo sapiens
gtaatatttttatataca

SEQ ID NO: 3612823 - DNA, 13 bp, Homo sapiens
gtaatcattttaa

SEQ ID NO: 3612824 - DNA, 14 bp, Homo sapiens
gtaatcattttaaa

SEQ ID NO: 3612825 - DNA, 22 bp, Homo sapiens
gtaatgacagaacatgctgtta

SEQ ID NO: 3612826 - DNA, 17 bp, Homo sapiens
gtaatgctgcacttcct

SEQ ID NO: 3612827 - DNA, 19 bp, Homo sapiens
gtaatgctgcctcaggacc

SEQ ID NO: 3612828 - DNA, 19 bp, Homo sapiens
gtaatgtatcaaatacatt

SEQ ID NO: 3612829 - DNA, 14 bp, Homo sapiens
gtaattgggaactg

SEQ ID NO: 3612830 - DNA, 19 bp, Homo sapiens
gtaattgggaactgaaatc

SEQ ID NO: 3612831 - DNA, 12 bp, Homo sapiens
gtaattgtaatt

SEQ ID NO: 3612832 - DNA, 21 bp, Homo sapiens
gtaattgttgctaatcttctt

SEQ ID NO: 3612833 - DNA, 19 bp, Homo sapiens
gtaatttaaaattgtgatg

SEQ ID NO: 3612834 - DNA, 20 bp, Homo sapiens
gtaatttaaaattgtgatgt

SEQ ID NO: 3612835 - DNA, 23 bp, Homo sapiens
gtaatttaatttgtaaaacttct

SEQ ID NO: 3612836 - DNA, 14 bp, Homo sapiens
gtacaaaataaaca

SEQ ID NO: 3612837 - DNA, 16 bp, Homo sapiens
gtacaaaataaacaaa

SEQ ID NO: 3612838 - DNA, 13 bp, Homo sapiens
gtacaataaattt

SEQ ID NO: 3612839 - DNA, 12 bp, Homo sapiens
gtacaatgtgag

SEQ ID NO: 3612840 - DNA, 14 bp, Homo sapiens
gtacacgtgtaaca

SEQ ID NO: 3612841 - DNA, 21 bp, Homo sapiens
gtacacttctcttaagtggtc

SEQ ID NO: 3612842 - DNA, 22 bp, Homo sapiens
gtacacttctcttaagtggtct

SEQ ID NO: 3612843 - DNA, 15 bp, Homo sapiens
gtacaggagaggcag

SEQ ID NO: 3612844 - DNA, 19 bp, Homo sapiens
gtacaggagaggcagcatg

SEQ ID NO: 3612845 - DNA, 18 bp, Homo sapiens
gtacagtctgctcctctt

SEQ ID NO: 3612846 - DNA, 17 bp, Homo sapiens
gtacataactcctgtcc

SEQ ID NO: 3612847 - DNA, 14 bp, Homo sapiens
gtacattctgccta

SEQ ID NO: 3612848 - DNA, 18 bp, Homo sapiens
gtacatttccaaatgaac

SEQ ID NO: 3612849 - DNA, 18 bp, Homo sapiens
gtacatttctgattctga

SEQ ID NO: 3612850 - DNA, 15 bp, Homo sapiens
gtaccaaatctgaca

SEQ ID NO: 3612851 - DNA, 15 bp, Homo sapiens
gtaccacttcctgag

SEQ ID NO: 3612852 - DNA, 21 bp, Homo sapiens
gtaccaggtattattatcttt

SEQ ID NO: 3612853 - DNA, 10 bp, Homo sapiens
gtaccagtta

SEQ ID NO: 3612854 - DNA, 11 bp, Homo sapiens
gtaccagttaa

SEQ ID NO: 3612855 - DNA, 20 bp, Homo sapiens
gtaccagttaatttttccaa

SEQ ID NO: 3612856 - DNA, 23 bp, Homo sapiens
gtaccagttaatttttccaacta

SEQ ID NO: 3612857 - DNA, 21 bp, Homo sapiens
gtacccctaaaaagattgcca

SEQ ID NO: 3612858 - DNA, 12 bp, Homo sapiens
gtacctggtgga

SEQ ID NO: 3612859 - DNA, 12 bp, Homo sapiens
gtactaaaatta

SEQ ID NO: 3612860 - DNA, 16 bp, Homo sapiens
gtactacccagctctg

SEQ ID NO: 3612861 - DNA, 17 bp, Homo sapiens
gtactacccagctctgt

SEQ ID NO: 3612862 - DNA, 19 bp, Homo sapiens
gtactcccaaactgacaat

SEQ ID NO: 3612863 - DNA, 21 bp, Homo sapiens
gtactcccaaactgacaattt

SEQ ID NO: 3612864 - DNA, 22 bp, Homo sapiens
gtactcccaaactgacaatttt

SEQ ID NO: 3612865 - DNA, 13 bp, Homo sapiens
gtactctgtgaaa

SEQ ID NO: 3612866 - DNA, 21 bp, Homo sapiens
gtactctgtgaaagaagagaa

SEQ ID NO: 3612867 - DNA, 22 bp, Homo sapiens
gtactctgtgaaagaagagaaa

SEQ ID NO: 3612868 - DNA, 14 bp, Homo sapiens
gtactgagcactga

SEQ ID NO: 3612869 - DNA, 17 bp, Homo sapiens
gtacttagagtttctgt

SEQ ID NO: 3612870 - DNA, 18 bp, Homo sapiens
gtacttatttctcagctg

SEQ ID NO: 3612871 - DNA, 20 bp, Homo sapiens
gtacttatttctcagctgtg

SEQ ID NO: 3612872 - DNA, 20 bp, Homo sapiens
gtacttggcccccttcagga

SEQ ID NO: 3612873 - DNA, 23 bp, Homo sapiens
gtacttggcccccttcaggagcc

SEQ ID NO: 3612874 - DNA, 22 bp, Homo sapiens
gtactttcatattttaaacaga

SEQ ID NO: 3612875 - DNA, 14 bp, Homo sapiens
gtactttggaggcc

SEQ ID NO: 3612876 - DNA, 14 bp, Homo sapiens
gtagaatgttttca

SEQ ID NO: 3612877 - DNA, 15 bp, Homo sapiens
gtagacctctttttc

SEQ ID NO: 3612878 - DNA, 15 bp, Homo sapiens
gtagagccagaggtc

SEQ ID NO: 3612879 - DNA, 18 bp, Homo sapiens
gtagagcccctactgtgg

SEQ ID NO: 3612880 - DNA, 19 bp, Homo sapiens
gtagagcccctactgtggg

SEQ ID NO: 3612881 - DNA, 19 bp, Homo sapiens
gtagatcaccagaataaac

SEQ ID NO: 3612882 - DNA, 15 bp, Homo sapiens
gtagcactctcagag

SEQ ID NO: 3612883 - DNA, 16 bp, Homo sapiens
gtagcagcaggctcag

SEQ ID NO: 3612884 - DNA, 22 bp, Homo sapiens
gtagccaggtactgcattctct

SEQ ID NO: 3612885 - DNA, 14 bp, Homo sapiens
gtagcctaaagggc

SEQ ID NO: 3612886 - DNA, 15 bp, Homo sapiens
gtagcctaaagggca

SEQ ID NO: 3612887 - DNA, 21 bp, Homo sapiens
gtagcctcaatcgagtgagac

SEQ ID NO: 3612888 - DNA, 17 bp, Homo sapiens
gtagcctgggctcactg

SEQ ID NO: 3612889 - DNA, 20 bp, Homo sapiens
gtagcctgggctcactgtgc

SEQ ID NO: 3612890 - DNA, 13 bp, Homo sapiens
gtagcgtttttta

SEQ ID NO: 3612891 - DNA, 23 bp, Homo sapiens
gtagctatttttatacactgtaa

SEQ ID NO: 3612892 - DNA, 21 bp, Homo sapiens
gtagctcctataaagggccca

SEQ ID NO: 3612893 - DNA, 22 bp, Homo sapiens
gtagctctaggagggctggcaa

SEQ ID NO: 3612894 - DNA, 12 bp, Homo sapiens
gtagctctgctg

SEQ ID NO: 3612895 - DNA, 13 bp, Homo sapiens
gtagctctgctgc

SEQ ID NO: 3612896 - DNA, 15 bp, Homo sapiens
gtagctgtaagggca

SEQ ID NO: 3612897 - DNA, 17 bp, Homo sapiens
gtagctgtaagggcagt

SEQ ID NO: 3612898 - DNA, 20 bp, Homo sapiens
gtagctgtaagggcagtgcc

SEQ ID NO: 3612899 - DNA, 21 bp, Homo sapiens
gtaggaatgtacatgaagcaa

SEQ ID NO: 3612900 - DNA, 16 bp, Homo sapiens
gtaggacgcatgaagg

SEQ ID NO: 3612901 - DNA, 22 bp, Homo sapiens
gtagggatgcggatcctgctgg

SEQ ID NO: 3612902 - DNA, 17 bp, Homo sapiens
gtaggggctcctgagtg

SEQ ID NO: 3612903 - DNA, 21 bp, Homo sapiens
gtagggttttttcttctttct

SEQ ID NO: 3612904 - DNA, 22 bp, Homo sapiens
gtagggttttttcttctttctt

SEQ ID NO: 3612905 - DNA, 23 bp, Homo sapiens
gtaggtatgatctcttctggtgt

SEQ ID NO: 3612906 - DNA, 22 bp, Homo sapiens
gtaggtcccggccagctctgga

SEQ ID NO: 3612907 - DNA, 14 bp, Homo sapiens
gtagtaattgttac

SEQ ID NO: 3612908 - DNA, 15 bp, Homo sapiens
gtagtattttttgta

SEQ ID NO: 3612909 - DNA, 13 bp, Homo sapiens
gtagtggctgggg

SEQ ID NO: 3612910 - DNA, 12 bp, Homo sapiens
gtagtgtggcct

SEQ ID NO: 3612911 - DNA, 16 bp, Homo sapiens
gtagtgtggcctgtgc

SEQ ID NO: 3612912 - DNA, 23 bp, Homo sapiens
gtataactttaacttctgtttta

SEQ ID NO: 3612913 - DNA, 14 bp, Homo sapiens
gtataagaaatgca

SEQ ID NO: 3612914 - DNA, 15 bp, Homo sapiens
gtatagccatgattt

SEQ ID NO: 3612915 - DNA, 16 bp, Homo sapiens
gtatagtatctgtata

SEQ ID NO: 3612916 - DNA, 24 bp, Homo sapiens
gtatatcatgtaaagaaatgtctt

SEQ ID NO: 3612917 - DNA, 12 bp, Homo sapiens
gtatatgtattt

SEQ ID NO: 3612918 - DNA, 13 bp, Homo sapiens
gtatattacaatg

SEQ ID NO: 3612919 - DNA, 15 bp, Homo sapiens
gtatattacaatgat

SEQ ID NO: 3612920 - DNA, 17 bp, Homo sapiens
gtatattacaatgatca

SEQ ID NO: 3612921 - DNA, 14 bp, Homo sapiens
gtatcaaatacatt

SEQ ID NO: 3612922 - DNA, 13 bp, Homo sapiens
gtatcaaatgtaa

SEQ ID NO: 3612923 - DNA, 17 bp, Homo sapiens
gtatcagtgtcctttcc

SEQ ID NO: 3612924 - DNA, 12 bp, Homo sapiens
gtatccagagct

SEQ ID NO: 3612925 - DNA, 14 bp, Homo sapiens
gtatcctccaggtt

SEQ ID NO: 3612926 - DNA, 15 bp, Homo sapiens
gtatcctccaggttt

SEQ ID NO: 3612927 - DNA, 13 bp, Homo sapiens
gtatctgctgttc

SEQ ID NO: 3612928 - DNA, 14 bp, Homo sapiens
gtatctgctgttct

SEQ ID NO: 3612929 - DNA, 15 bp, Homo sapiens
gtatctggcttccct

SEQ ID NO: 3612930 - DNA, 21 bp, Homo sapiens
gtatctgtatataagttgctg

SEQ ID NO: 3612931 - DNA, 12 bp, Homo sapiens
gtatctgtgaac

SEQ ID NO: 3612932 - DNA, 18 bp, Homo sapiens
gtatcttttatcctggga

SEQ ID NO: 3612933 - DNA, 19 bp, Homo sapiens
gtatcttttatcctgggag

SEQ ID NO: 3612934 - DNA, 21 bp, Homo sapiens
gtatcttttatcctgggagca

SEQ ID NO: 3612935 - DNA, 17 bp, Homo sapiens
gtatgaagacagaggca

SEQ ID NO: 3612936 - DNA, 17 bp, Homo sapiens
gtatgccacacctggcc

SEQ ID NO: 3612937 - DNA, 14 bp, Homo sapiens
gtatggaaacactg

SEQ ID NO: 3612938 - DNA, 16 bp, Homo sapiens
gtatggtatctttaga

SEQ ID NO: 3612939 - DNA, 23 bp, Homo sapiens
gtatgtatattaaaaaagagaca

SEQ ID NO: 3612940 - DNA, 11 bp, Homo sapiens
gtatgtcatgg

SEQ ID NO: 3612941 - DNA, 22 bp, Homo sapiens
gtatgtgagctgtaaaaatgtt

SEQ ID NO: 3612942 - DNA, 17 bp, Homo sapiens
gtatgtgtgtctatttt

SEQ ID NO: 3612943 - DNA, 14 bp, Homo sapiens
gtattaaatggttt

SEQ ID NO: 3612944 - DNA, 14 bp, Homo sapiens
gtattaatttagaa

SEQ ID NO: 3612945 - DNA, 17 bp, Homo sapiens
gtattattatgttctta

SEQ ID NO: 3612946 - DNA, 21 bp, Homo sapiens
gtattcaagcaaacatcaaat

SEQ ID NO: 3612947 - DNA, 18 bp, Homo sapiens
gtattcaatatcctttgc

SEQ ID NO: 3612948 - DNA, 19 bp, Homo sapiens
gtattgaaaacttcaaagc

SEQ ID NO: 3612949 - DNA, 13 bp, Homo sapiens
gtattgcacattg

SEQ ID NO: 3612950 - DNA, 14 bp, Homo sapiens
gtattgcacattgt

SEQ ID NO: 3612951 - DNA, 18 bp, Homo sapiens
gtatttaaaaaaaagaaa

SEQ ID NO: 3612952 - DNA, 14 bp, Homo sapiens
gtatttaaatgttc

SEQ ID NO: 3612953 - DNA, 17 bp, Homo sapiens
gtatttaagatgtacat

SEQ ID NO: 3612954 - DNA, 19 bp, Homo sapiens
gtatttaagatgtacattt

SEQ ID NO: 3612955 - DNA, 22 bp, Homo sapiens
gtatttaagatgtacatttaat

SEQ ID NO: 3612956 - DNA, 18 bp, Homo sapiens
gtatttctatacagtagc

SEQ ID NO: 3612957 - DNA, 14 bp, Homo sapiens
gtattttaatcctg

SEQ ID NO: 3612958 - DNA, 15 bp, Homo sapiens
gtattttcagagaac

SEQ ID NO: 3612959 - DNA, 18 bp, Homo sapiens
gtatttttggtttatatg

SEQ ID NO: 3612960 - DNA, 17 bp, Homo sapiens
gtatttttgttaggttt

SEQ ID NO: 3612961 - DNA, 23 bp, Homo sapiens
gtattttttttttaaataaaagc

SEQ ID NO: 3612962 - DNA, 17 bp, Homo sapiens
gtcaaacattcgtgagc

SEQ ID NO: 3612963 - DNA, 19 bp, Homo sapiens
gtcaaagtgttgctgtggc

SEQ ID NO: 3612964 - DNA, 19 bp, Homo sapiens
gtcaaatccagtggtgggt

SEQ ID NO: 3612965 - DNA, 16 bp, Homo sapiens
gtcaagagcatgcaca

SEQ ID NO: 3612966 - DNA, 17 bp, Homo sapiens
gtcaagctcctcctccc

SEQ ID NO: 3612967 - DNA, 19 bp, Homo sapiens
gtcaagctcctcctccctg

SEQ ID NO: 3612968 - DNA, 12 bp, Homo sapiens
gtcaaggaacct

SEQ ID NO: 3612969 - DNA, 12 bp, Homo sapiens
gtcaatccaaga

SEQ ID NO: 3612970 - DNA, 19 bp, Homo sapiens
gtcacaggactctgcctcc

SEQ ID NO: 3612971 - DNA, 16 bp, Homo sapiens
gtcacaggttttcaga

SEQ ID NO: 3612972 - DNA, 22 bp, Homo sapiens
gtcacaggttttcagagaatta

SEQ ID NO: 3612973 - DNA, 16 bp, Homo sapiens
gtcacatctcagggaa

SEQ ID NO: 3612974 - DNA, 13 bp, Homo sapiens
gtcacatgactct

SEQ ID NO: 3612975 - DNA, 16 bp, Homo sapiens
gtcaccagacggggct

SEQ ID NO: 3612976 - DNA, 13 bp, Homo sapiens
gtcaccaggggag

SEQ ID NO: 3612977 - DNA, 14 bp, Homo sapiens
gtcacccacagacc

SEQ ID NO: 3612978 - DNA, 20 bp, Homo sapiens
gtcacccctttctgtcccac

SEQ ID NO: 3612979 - DNA, 17 bp, Homo sapiens
gtcaccctggggatagt

SEQ ID NO: 3612980 - DNA, 15 bp, Homo sapiens
gtcacgatcacaggc

SEQ ID NO: 3612981 - DNA, 17 bp, Homo sapiens
gtcactctgggcctggg

SEQ ID NO: 3612982 - DNA, 20 bp, Homo sapiens
gtcacttaaatttgttcttt

SEQ ID NO: 3612983 - DNA, 19 bp, Homo sapiens
gtcacttgtcgggggccca

SEQ ID NO: 3612984 - DNA, 19 bp, Homo sapiens
gtcactttttgaggcaaaa

SEQ ID NO: 3612985 - DNA, 13 bp, Homo sapiens
gtcagacatttct

SEQ ID NO: 3612986 - DNA, 17 bp, Homo sapiens
gtcagacatttctttgg

SEQ ID NO: 3612987 - DNA, 20 bp, Homo sapiens
gtcagacatttctttggaaa

SEQ ID NO: 3612988 - DNA, 13 bp, Homo sapiens
gtcagactgatag

SEQ ID NO: 3612989 - DNA, 22 bp, Homo sapiens
gtcagactttgtgttcatttca

SEQ ID NO: 3612990 - DNA, 22 bp, Homo sapiens
gtcagaggaacagtcctgttca

SEQ ID NO: 3612991 - DNA, 16 bp, Homo sapiens
gtcagcaatttaacta

SEQ ID NO: 3612992 - DNA, 13 bp, Homo sapiens
gtcagccacctgg

SEQ ID NO: 3612993 - DNA, 18 bp, Homo sapiens
gtctccagctgcctgggc

SEQ ID NO: 3612994 - DNA, 19 bp, Homo sapiens
gtctccagggcccccaccg

SEQ ID NO: 3612995 - DNA, 14 bp, Homo sapiens
gtctccaggggcct

SEQ ID NO: 3612996 - DNA, 19 bp, Homo sapiens
gtctccaggggcctgcaga

SEQ ID NO: 3612997 - DNA, 21 bp, Homo sapiens
gtctccagtatccactttgca

SEQ ID NO: 3612998 - DNA, 14 bp, Homo sapiens
gtctcccctcctgc

SEQ ID NO: 3612999 - DNA, 17 bp, Homo sapiens
gtctcctaaaactggga

SEQ ID NO: 3613000 - DNA, 22 bp, Homo sapiens
gtctcctaggctaaatgagaat

SEQ ID NO: 3613001 - DNA, 14 bp, Homo sapiens
gtctcctcagcctc

SEQ ID NO: 3613002 - DNA, 14 bp, Homo sapiens
gtctccttcagcac

SEQ ID NO: 3613003 - DNA, 15 bp, Homo sapiens
gtctcgaactcctga

SEQ ID NO: 3613004 - DNA, 21 bp, Homo sapiens
gtctcggatgacaccctggcc

SEQ ID NO: 3613005 - DNA, 22 bp, Homo sapiens
gtctctaatctgtgctgtttca

SEQ ID NO: 3613006 - DNA, 13 bp, Homo sapiens
gtctctcagggat

SEQ ID NO: 3613007 - DNA, 23 bp, Homo sapiens
gtctctcgttttgggtactttct

SEQ ID NO: 3613008 - DNA, 23 bp, Homo sapiens
gtctctctccaggtcagcctgga

SEQ ID NO: 3613009 - DNA, 15 bp, Homo sapiens
gtctctctctctcta

SEQ ID NO: 3613010 - DNA, 20 bp, Homo sapiens
gtctctcttctctccagctg

SEQ ID NO: 3613011 - DNA, 15 bp, Homo sapiens
gtctctgaggggtgg

SEQ ID NO: 3613012 - DNA, 22 bp, Homo sapiens
gtctctgaggggtgggggtgcc

SEQ ID NO: 3613013 - DNA, 20 bp, Homo sapiens
gtctctgattagttgacagt

SEQ ID NO: 3613014 - DNA, 22 bp, Homo sapiens
gtctctgattagttgacagtat

SEQ ID NO: 3613015 - DNA, 15 bp, Homo sapiens
gtctctgccccagcc

SEQ ID NO: 3613016 - DNA, 17 bp, Homo sapiens
gtctctgccccagcctg

SEQ ID NO: 3613017 - DNA, 18 bp, Homo sapiens
gtctctgccccagcctgt

SEQ ID NO: 3613018 - DNA, 14 bp, Homo sapiens
gtctctgccctggg

SEQ ID NO: 3613019 - DNA, 13 bp, Homo sapiens
gtctctgggagcc

SEQ ID NO: 3613020 - DNA, 17 bp, Homo sapiens
gtctcttctaacatctt

SEQ ID NO: 3613021 - DNA, 20 bp, Homo sapiens
gtctcttctgaataaagcaa

SEQ ID NO: 3613022 - DNA, 22 bp, Homo sapiens
gtctcttctgaataaagcaatt

SEQ ID NO: 3613023 - DNA, 23 bp, Homo sapiens
gtctcttctgaataaagcaatta

SEQ ID NO: 3613024 - DNA, 14 bp, Homo sapiens
gtctgaaactggct

SEQ ID NO: 3613025 - DNA, 21 bp, Homo sapiens
gtctgaaactggcttccccac

SEQ ID NO: 3613026 - DNA, 16 bp, Homo sapiens
gtctgaagtcactgca

SEQ ID NO: 3613027 - DNA, 17 bp, Homo sapiens
gtctgaagtcactgcac

SEQ ID NO: 3613028 - DNA, 19 bp, Homo sapiens
gtctgaagtcactgcacag

SEQ ID NO: 3613029 - DNA, 16 bp, Homo sapiens
gtctgactccaaagct

SEQ ID NO: 3613030 - DNA, 20 bp, Homo sapiens
gtctgagacaggtgcctaac

SEQ ID NO: 3613031 - DNA, 20 bp, Homo sapiens
gtctgagcccatttctgggg

SEQ ID NO: 3613032 - DNA, 14 bp, Homo sapiens
gtctgaggcctgcc

SEQ ID NO: 3613033 - DNA, 12 bp, Homo sapiens
gtctgattggct

SEQ ID NO: 3613034 - DNA, 20 bp, Homo sapiens
gtctgcactcctttatctgt

SEQ ID NO: 3613035 - DNA, 11 bp, Homo sapiens
gtctgccaggg

SEQ ID NO: 3613036 - DNA, 15 bp, Homo sapiens
gtctgccttctgctg

SEQ ID NO: 3613037 - DNA, 13 bp, Homo sapiens
gtctgctcctctt

SEQ ID NO: 3613038 - DNA, 18 bp, Homo sapiens
gtctgctgagttggcctg

SEQ ID NO: 3613039 - DNA, 22 bp, Homo sapiens
gtctggccctaactcctataaa

SEQ ID NO: 3613040 - DNA, 14 bp, Homo sapiens
gtctggggacaggc

SEQ ID NO: 3613041 - DNA, 14 bp, Homo sapiens
gtctggtgtttgtc

SEQ ID NO: 3613042 - DNA, 15 bp, Homo sapiens
gtctggttcctgtgt

SEQ ID NO: 3613043 - DNA, 19 bp, Homo sapiens
gtctgtcctgatttctaca

SEQ ID NO: 3613044 - DNA, 13 bp, Homo sapiens
gtctgtctctaat

SEQ ID NO: 3613045 - DNA, 15 bp, Homo sapiens
gtctgtggtgcagtg

SEQ ID NO: 3613046 - DNA, 15 bp, Homo sapiens
gtctgtgtcatttct

SEQ ID NO: 3613047 - DNA, 15 bp, Homo sapiens
gtctgtgtgctgttt

SEQ ID NO: 3613048 - DNA, 20 bp, Homo sapiens
gtctgtgtgctgtttgaaaa

SEQ ID NO: 3613049 - DNA, 12 bp, Homo sapiens
gtctgtgtgtgt

SEQ ID NO: 3613050 - DNA, 16 bp, Homo sapiens
gtctgtgtgtgtgtat

SEQ ID NO: 3613051 - DNA, 17 bp, Homo sapiens
gtctgttcacttttcct

SEQ ID NO: 3613052 - DNA, 13 bp, Homo sapiens
gtctgttgattaa

SEQ ID NO: 3613053 - DNA, 13 bp, Homo sapiens
gtctgtttaaagt

SEQ ID NO: 3613054 - DNA, 17 bp, Homo sapiens
gtcttaaaaaatgtgaa

SEQ ID NO: 3613055 - DNA, 14 bp, Homo sapiens
gtcttaaaacctgc

SEQ ID NO: 3613056 - DNA, 21 bp, Homo sapiens
gtcttaccagtgacgctgctg

SEQ ID NO: 3613057 - DNA, 22 bp, Homo sapiens
gtcttaccagtgacgctgctga

SEQ ID NO: 3613058 - DNA, 16 bp, Homo sapiens
gtcttagctctttctc

SEQ ID NO: 3613059 - DNA, 13 bp, Homo sapiens
gtcttcacaacag

SEQ ID NO: 3613060 - DNA, 17 bp, Homo sapiens
gtcttctatttatttat

SEQ ID NO: 3613061 - DNA, 18 bp, Homo sapiens
gtcttctttctccatgga

SEQ ID NO: 3613062 - DNA, 21 bp, Homo sapiens
gtcttctttctccatggagcc

SEQ ID NO: 3613063 - DNA, 17 bp, Homo sapiens
gtcttgaacgagcagcc

SEQ ID NO: 3613064 - DNA, 20 bp, Homo sapiens
gtcttgaacgagcagcccag

SEQ ID NO: 3613065 - DNA, 18 bp, Homo sapiens
gtcttgaattagtatttc

SEQ ID NO: 3613066 - DNA, 17 bp, Homo sapiens
gtcttgtcatacaaatt

SEQ ID NO: 3613067 - DNA, 18 bp, Homo sapiens
gtctttatttttttccca

SEQ ID NO: 3613068 - DNA, 16 bp, Homo sapiens
gtctttctctcagtga

SEQ ID NO: 3613069 - DNA, 22 bp, Homo sapiens
gtctttcttgtaaggcatactg

SEQ ID NO: 3613070 - DNA, 14 bp, Homo sapiens
gtctttctttgtca

SEQ ID NO: 3613071 - DNA, 22 bp, Homo sapiens
gtctttctttgtcattcagttc

SEQ ID NO: 3613072 - DNA, 21 bp, Homo sapiens
gtctttttctagggtccctga

SEQ ID NO: 3613073 - DNA, 15 bp, Homo sapiens
gtgaaaatgaagaag

SEQ ID NO: 3613074 - DNA, 19 bp, Homo sapiens
gtgaaataacaaaatggac

SEQ ID NO: 3613075 - DNA, 17 bp, Homo sapiens
gtgaacttgactgggtg

SEQ ID NO: 3613076 - DNA, 15 bp, Homo sapiens
gtgaagaggtctgat

SEQ ID NO: 3613077 - DNA, 20 bp, Homo sapiens
gtgaagaggtctgattggct

SEQ ID NO: 3613078 - DNA, 22 bp, Homo sapiens
gtgaagaggtctgattggctgc

SEQ ID NO: 3613079 - DNA, 19 bp, Homo sapiens
gtgaagttcatcttgcagc

SEQ ID NO: 3613080 - DNA, 19 bp, Homo sapiens
gtgaatatttttgtatttt

SEQ ID NO: 3613081 - DNA, 21 bp, Homo sapiens
gtgaattaattaaacattgtg

SEQ ID NO: 3613082 - DNA, 18 bp, Homo sapiens
gtgaattaggctgtaact

SEQ ID NO: 3613083 - DNA, 22 bp, Homo sapiens
gtgaattaggctgtaactactt

SEQ ID NO: 3613084 - DNA, 20 bp, Homo sapiens
gtgaatttgccagaggacca

SEQ ID NO: 3613085 - DNA, 14 bp, Homo sapiens
gtgacaaggcctgc

SEQ ID NO: 3613086 - DNA, 12 bp, Homo sapiens
gtgacagtgaag

SEQ ID NO: 3613087 - DNA, 22 bp, Homo sapiens
gtgacatttgggagacatgtga

SEQ ID NO: 3613088 - DNA, 21 bp, Homo sapiens
gtgacattttacattaaattt

SEQ ID NO: 3613089 - DNA, 17 bp, Homo sapiens
gtgaccactctgtcttg

SEQ ID NO: 3613090 - DNA, 21 bp, Homo sapiens
gtgacccccttgattcccacc

SEQ ID NO: 3613091 - DNA, 14 bp, Homo sapiens
gtgactccagggtg

SEQ ID NO: 3613092 - DNA, 20 bp, Homo sapiens
gtgactccagggtgacaagg

SEQ ID NO: 3613093 - DNA, 13 bp, Homo sapiens
gtgactccccagc

SEQ ID NO: 3613094 - DNA, 14 bp, Homo sapiens
gtgactccctggga

SEQ ID NO: 3613095 - DNA, 15 bp, Homo sapiens
gtgactccctgggag

SEQ ID NO: 3613096 - DNA, 16 bp, Homo sapiens
gtgactcctgctggta

SEQ ID NO: 3613097 - DNA, 19 bp, Homo sapiens
gtgacttaaaaaatcagaa

SEQ ID NO: 3613098 - DNA, 16 bp, Homo sapiens
gtgacttcagctctgt

SEQ ID NO: 3613099 - DNA, 21 bp, Homo sapiens
gtgagaaagggattgctgagg

SEQ ID NO: 3613100 - DNA, 21 bp, Homo sapiens
gtgagaatggcctggagcagg

SEQ ID NO: 3613101 - DNA, 13 bp, Homo sapiens
gtgagagaaagag

SEQ ID NO: 3613102 - DNA, 14 bp, Homo sapiens
gtgagagaaagaga

SEQ ID NO: 3613103 - DNA, 20 bp, Homo sapiens
gtgagagaaagagagaagcc

SEQ ID NO: 3613104 - DNA, 16 bp, Homo sapiens
gtgagagaatttatca

SEQ ID NO: 3613105 - DNA, 23 bp, Homo sapiens
gtgagcaagcaccaacctccaga

SEQ ID NO: 3613106 - DNA, 18 bp, Homo sapiens
gtgagcagtcgcctgcct

SEQ ID NO: 3613107 - DNA, 20 bp, Homo sapiens
gtgagcagtgttgcgttttt

SEQ ID NO: 3613108 - DNA, 19 bp, Homo sapiens
gtgagcatggggccaggaa

SEQ ID NO: 3613109 - DNA, 15 bp, Homo sapiens
gtgagcccctcccca

SEQ ID NO: 3613110 - DNA, 18 bp, Homo sapiens
gtgagcccctccccagcc

SEQ ID NO: 3613111 - DNA, 23 bp, Homo sapiens
gtgagctggggactcagggaccg

SEQ ID NO: 3613112 - DNA, 19 bp, Homo sapiens
gtgaggctgacatgctcac

SEQ ID NO: 3613113 - DNA, 24 bp, Homo sapiens
gtgagggtcctgcagcctgcagga

SEQ ID NO: 3613114 - DNA, 17 bp, Homo sapiens
gtgagtcacctgctcca

SEQ ID NO: 3613115 - DNA, 22 bp, Homo sapiens
gtgagtcatttaaatgtgtaca

SEQ ID NO: 3613116 - DNA, 13 bp, Homo sapiens
gtgagtctgggat

SEQ ID NO: 3613117 - DNA, 16 bp, Homo sapiens
gtgatcctcacgcctt

SEQ ID NO: 3613118 - DNA, 16 bp, Homo sapiens
gtgatctcccctcaca

SEQ ID NO: 3613119 - DNA, 23 bp, Homo sapiens
gtgatctcccctcacactttgcc

SEQ ID NO: 3613120 - DNA, 19 bp, Homo sapiens
gtgatctcggctcactgca

SEQ ID NO: 3613121 - DNA, 18 bp, Homo sapiens
gtgatctgggtctctaat

SEQ ID NO: 3613122 - DNA, 21 bp, Homo sapiens
gtgatcttaatatatttgaaa

SEQ ID NO: 3613123 - DNA, 16 bp, Homo sapiens
gtgatgggctaggcct

SEQ ID NO: 3613124 - DNA, 15 bp, Homo sapiens
gtgattggctgcagg

SEQ ID NO: 3613125 - DNA, 11 bp, Homo sapiens
gtgatttttgt

SEQ ID NO: 3613126 - DNA, 21 bp, Homo sapiens
gtgcaaacagtaacgtgtgcg

SEQ ID NO: 3613127 - DNA, 15 bp, Homo sapiens
gtgcaagcccctgct

SEQ ID NO: 3613128 - DNA, 21 bp, Homo sapiens
gtgcaaggagtgtaaaatgta

SEQ ID NO: 3613129 - DNA, 19 bp, Homo sapiens
gtgcaataaatctgaccca

SEQ ID NO: 3613130 - DNA, 21 bp, Homo sapiens
gtgcaataaatctgacccagt

SEQ ID NO: 3613131 - DNA, 15 bp, Homo sapiens
gtgcacctgcctcca

SEQ ID NO: 3613132 - DNA, 20 bp, Homo sapiens
gtgcacctgcctccaccagc

SEQ ID NO: 3613133 - DNA, 11 bp, Homo sapiens
gtgcactccag

SEQ ID NO: 3613134 - DNA, 19 bp, Homo sapiens
gtgcactccagactctggg

SEQ ID NO: 3613135 - DNA, 20 bp, Homo sapiens
gtgcactccagactctgggg

SEQ ID NO: 3613136 - DNA, 22 bp, Homo sapiens
gtgcacttacacttataaaata

SEQ ID NO: 3613137 - DNA, 13 bp, Homo sapiens
gtgcagacccagt

SEQ ID NO: 3613138 - DNA, 21 bp, Homo sapiens
gtgcagcctgtcctgggctgg

SEQ ID NO: 3613139 - DNA, 13 bp, Homo sapiens
gtgcagccttccc

SEQ ID NO: 3613140 - DNA, 18 bp, Homo sapiens
gtgcagccttcccctccc

SEQ ID NO: 3613141 - DNA, 18 bp, Homo sapiens
gtgcagtgatgtttgcca

SEQ ID NO: 3613142 - DNA, 23 bp, Homo sapiens
gtgcagtgtgtgaaaattcaggt

SEQ ID NO: 3613143 - DNA, 14 bp, Homo sapiens
gtgcagtttctttt

SEQ ID NO: 3613144 - DNA, 14 bp, Homo sapiens
gtgcagtttggaat

SEQ ID NO: 3613145 - DNA, 19 bp, Homo sapiens
gtgcatactggcattggcc

SEQ ID NO: 3613146 - DNA, 19 bp, Homo sapiens
gtgcatcattactgttcca

SEQ ID NO: 3613147 - DNA, 18 bp, Homo sapiens
gtgcatccgggggcagct

SEQ ID NO: 3613148 - DNA, 20 bp, Homo sapiens
gtgcatccgggggcagctct

SEQ ID NO: 3613149 - DNA, 12 bp, Homo sapiens
gtgcatctcctc

SEQ ID NO: 3613150 - DNA, 23 bp, Homo sapiens
gtgcatggcactgactgaatgct

SEQ ID NO: 3613151 - DNA, 18 bp, Homo sapiens
gtgcatgtgctgtgtgag

SEQ ID NO: 3613152 - DNA, 15 bp, Homo sapiens
gtgccaaatgctctc

SEQ ID NO: 3613153 - DNA, 13 bp, Homo sapiens
gtgccaagagcta

SEQ ID NO: 3613154 - DNA, 17 bp, Homo sapiens
gtgccaagagctactcc

SEQ ID NO: 3613155 - DNA, 18 bp, Homo sapiens
gtgccacttaatgtatgt

SEQ ID NO: 3613156 - DNA, 20 bp, Homo sapiens
gtgccagcaggggggctgtg

SEQ ID NO: 3613157 - DNA, 21 bp, Homo sapiens
gtgccaggatggaatgatggg

SEQ ID NO: 3613158 - DNA, 13 bp, Homo sapiens
gtgccatgctggg

SEQ ID NO: 3613159 - DNA, 15 bp, Homo sapiens
gtgccatgctgggcc

SEQ ID NO: 3613160 - DNA, 14 bp, Homo sapiens
gtgcccagggccag

SEQ ID NO: 3613161 - DNA, 22 bp, Homo sapiens
gtgccccaccactccccaaccc

SEQ ID NO: 3613162 - DNA, 12 bp, Homo sapiens
gtgccccaggac

SEQ ID NO: 3613163 - DNA, 21 bp, Homo sapiens
gtgccccaggaccagctcagg

SEQ ID NO: 3613164 - DNA, 15 bp, Homo sapiens
gtgcccccactgacc

SEQ ID NO: 3613165 - DNA, 17 bp, Homo sapiens
gtgcccctaaagagcat

SEQ ID NO: 3613166 - DNA, 23 bp, Homo sapiens
gtgcccctaaagagcatcctgat

SEQ ID NO: 3613167 - DNA, 14 bp, Homo sapiens
gtgccccttccctg

SEQ ID NO: 3613168 - DNA, 16 bp, Homo sapiens
gtgccccttccctggg

SEQ ID NO: 3613169 - DNA, 17 bp, Homo sapiens
gtgccccttccctgggt

SEQ ID NO: 3613170 - DNA, 15 bp, Homo sapiens
gtgcccgcatgtgtg

SEQ ID NO: 3613171 - DNA, 20 bp, Homo sapiens
gtgcccgcatgtgtgcctgg

SEQ ID NO: 3613172 - DNA, 16 bp, Homo sapiens
gtgccgctgtctctga

SEQ ID NO: 3613173 - DNA, 23 bp, Homo sapiens
gtgccgtgtcccctgacagggcc

SEQ ID NO: 3613174 - DNA, 19 bp, Homo sapiens
gtgcctaacctgggacctg

SEQ ID NO: 3613175 - DNA, 13 bp, Homo sapiens
gtgcctctgggac

SEQ ID NO: 3613176 - DNA, 20 bp, Homo sapiens
gtgcctgaaggctatccact

SEQ ID NO: 3613177 - DNA, 12 bp, Homo sapiens
gtgcctgagctg

SEQ ID NO: 3613178 - DNA, 19 bp, Homo sapiens
gtgcctggagtcaggtgtc

SEQ ID NO: 3613179 - DNA, 20 bp, Homo sapiens
gtgcctgggctcagcctggt

SEQ ID NO: 3613180 - DNA, 23 bp, Homo sapiens
gtgcctgtgagcatggggccagg

SEQ ID NO: 3613181 - DNA, 15 bp, Homo sapiens
gtgccttcagctcta

SEQ ID NO: 3613182 - DNA, 13 bp, Homo sapiens
gtgccttcccttt

SEQ ID NO: 3613183 - DNA, 18 bp, Homo sapiens
gtgcctttctttgcctct

SEQ ID NO: 3613184 - DNA, 22 bp, Homo sapiens
gtgcggcggtcccagctccctg

SEQ ID NO: 3613185 - DNA, 14 bp, Homo sapiens
gtgcggttcctcat

SEQ ID NO: 3613186 - DNA, 13 bp, Homo sapiens
gtgcgtcccagct

SEQ ID NO: 3613187 - DNA, 15 bp, Homo sapiens
gtgctacaaaaacac

SEQ ID NO: 3613188 - DNA, 24 bp, Homo sapiens
gtgctagaagcctactggtagaaa

SEQ ID NO: 3613189 - DNA, 23 bp, Homo sapiens
gtgctattgtagagccagaggtc

SEQ ID NO: 3613190 - DNA, 15 bp, Homo sapiens
gtgctccgcagggcg

SEQ ID NO: 3613191 - DNA, 13 bp, Homo sapiens
gtgctcttcccac

SEQ ID NO: 3613192 - DNA, 13 bp, Homo sapiens
gtgctcttggctg

SEQ ID NO: 3613193 - DNA, 21 bp, Homo sapiens
gtgctcttggctgacccctct

SEQ ID NO: 3613194 - DNA, 14 bp, Homo sapiens
gtgctcttttctcc

SEQ ID NO: 3613195 - DNA, 15 bp, Homo sapiens
gtgctgacagctgct

SEQ ID NO: 3613196 - DNA, 18 bp, Homo sapiens
gtgctgacggccagggag

SEQ ID NO: 3613197 - DNA, 12 bp, Homo sapiens
gtgctgctgtgg

SEQ ID NO: 3613198 - DNA, 18 bp, Homo sapiens
gtgctggaattctaacaa

SEQ ID NO: 3613199 - DNA, 15 bp, Homo sapiens
gtgctgtttattaat

SEQ ID NO: 3613200 - DNA, 14 bp, Homo sapiens
gtgctgtttcaaag

SEQ ID NO: 3613201 - DNA, 15 bp, Homo sapiens
gtgctgtttcaaagt

SEQ ID NO: 3613202 - DNA, 15 bp, Homo sapiens
gtgcttttggcagag

SEQ ID NO: 3613203 - DNA, 14 bp, Homo sapiens
gtgctttttgtcat

SEQ ID NO: 3613204 - DNA, 15 bp, Homo sapiens
gtgctttttgtcatg

SEQ ID NO: 3613205 - DNA, 19 bp, Homo sapiens
gtggaacataaaaaggaca

SEQ ID NO: 3613206 - DNA, 18 bp, Homo sapiens
gtggaagttccaagtcca

SEQ ID NO: 3613207 - DNA, 19 bp, Homo sapiens
gtggaatagtatcctccag

SEQ ID NO: 3613208 - DNA, 20 bp, Homo sapiens
gtggacatgcataaaaatta

SEQ ID NO: 3613209 - DNA, 16 bp, Homo sapiens
gtggacgttaggccag

SEQ ID NO: 3613210 - DNA, 17 bp, Homo sapiens
gtggacgttaggccagg

SEQ ID NO: 3613211 - DNA, 19 bp, Homo sapiens
gtggacgttaggccaggcc

SEQ ID NO: 3613212 - DNA, 18 bp, Homo sapiens
gtggagagagcagggcta

SEQ ID NO: 3613213 - DNA, 15 bp, Homo sapiens
gtggagatggactca

SEQ ID NO: 3613214 - DNA, 18 bp, Homo sapiens
gtggagctgccacagaga

SEQ ID NO: 3613215 - DNA, 13 bp, Homo sapiens
gtggagtttgaca

SEQ ID NO: 3613216 - DNA, 22 bp, Homo sapiens
gtggagtttgacaccttagaga

SEQ ID NO: 3613217 - DNA, 20 bp, Homo sapiens
gtggatcctggtttcgtgtg

SEQ ID NO: 3613218 - DNA, 13 bp, Homo sapiens
gtggatcttcaga

SEQ ID NO: 3613219 - DNA, 18 bp, Homo sapiens
gtggatgtttttgagtaa

SEQ ID NO: 3613220 - DNA, 16 bp, Homo sapiens
gtggcacctgtttccc

SEQ ID NO: 3613221 - DNA, 22 bp, Homo sapiens
gtggcactcagtctctcttctc

SEQ ID NO: 3613222 - DNA, 20 bp, Homo sapiens
gtggcagcttgctgggcttt

SEQ ID NO: 3613223 - DNA, 19 bp, Homo sapiens
gtggcagcttgtgaagatt

SEQ ID NO: 3613224 - DNA, 15 bp, Homo sapiens
gtggcaggggagcag

SEQ ID NO: 3613225 - DNA, 16 bp, Homo sapiens
gtggccaaggagctgc

SEQ ID NO: 3613226 - DNA, 15 bp, Homo sapiens
gtggccacagactga

SEQ ID NO: 3613227 - DNA, 21 bp, Homo sapiens
gtggccactccagacccctgg

SEQ ID NO: 3613228 - DNA, 17 bp, Homo sapiens
gtggcccgacagcctgg

SEQ ID NO: 3613229 - DNA, 18 bp, Homo sapiens
gtggcccgacagcctggc

SEQ ID NO: 3613230 - DNA, 22 bp, Homo sapiens
gtggccctgaacctcattctgg

SEQ ID NO: 3613231 - DNA, 14 bp, Homo sapiens
gtggccgccatgct

SEQ ID NO: 3613232 - DNA, 9 bp, Homo sapiens
gtggcctat

SEQ ID NO: 3613233 - DNA, 23 bp, Homo sapiens
gtggcctcgtgctccgcagggcg

SEQ ID NO: 3613234 - DNA, 21 bp, Homo sapiens
gtggctagtcaagctcctcct

SEQ ID NO: 3613235 - DNA, 23 bp, Homo sapiens
gtggctagtcaagctcctcctcc

SEQ ID NO: 3613236 - DNA, 15 bp, Homo sapiens
gtggctctgctggcc

SEQ ID NO: 3613237 - DNA, 23 bp, Homo sapiens
gtggctctgggaatgggagaggg

SEQ ID NO: 3613238 - DNA, 17 bp, Homo sapiens
gtggctctgggtgaggt

SEQ ID NO: 3613239 - DNA, 13 bp, Homo sapiens
gtggctgccccgg

SEQ ID NO: 3613240 - DNA, 24 bp, Homo sapiens
gtggctggaaccacattgaagaat

SEQ ID NO: 3613241 - DNA, 17 bp, Homo sapiens
gtggctggatctgtgag

SEQ ID NO: 3613242 - DNA, 16 bp, Homo sapiens
gtggctgtccctgtgg

SEQ ID NO: 3613243 - DNA, 21 bp, Homo sapiens
gtggcttggggattgtacacg

SEQ ID NO: 3613244 - DNA, 21 bp, Homo sapiens
gtgggaatgttctttctgctc

SEQ ID NO: 3613245 - DNA, 13 bp, Homo sapiens
gtgggagctgagc

SEQ ID NO: 3613246 - DNA, 14 bp, Homo sapiens
gtgggagtgtgtaa

SEQ ID NO: 3613247 - DNA, 15 bp, Homo sapiens
gtgggatctggggag

SEQ ID NO: 3613248 - DNA, 15 bp, Homo sapiens
gtgggcactggtggg

SEQ ID NO: 3613249 - DNA, 21 bp, Homo sapiens
gtgggccacacccaggaaggg

SEQ ID NO: 3613250 - DNA, 17 bp, Homo sapiens
gtgggccccgggctgga

SEQ ID NO: 3613251 - DNA, 21 bp, Homo sapiens
gtgggccccgggctggagaaa

SEQ ID NO: 3613252 - DNA, 22 bp, Homo sapiens
gtgggctttgttgtgagaatgg

SEQ ID NO: 3613253 - DNA, 16 bp, Homo sapiens
gtggggaacacagcta

SEQ ID NO: 3613254 - DNA, 22 bp, Homo sapiens
gtggggccatgcctcctcagga

SEQ ID NO: 3613255 - DNA, 22 bp, Homo sapiens
gtggggcctcaggctccgggca

SEQ ID NO: 3613256 - DNA, 17 bp, Homo sapiens
gtggggctgcaggcagg

SEQ ID NO: 3613257 - DNA, 21 bp, Homo sapiens
gtgggggaacactgagaaaga

SEQ ID NO: 3613258 - DNA, 14 bp, Homo sapiens
gtgggggagggaaa

SEQ ID NO: 3613259 - DNA, 15 bp, Homo sapiens
gtggggtcatgccct

SEQ ID NO: 3613260 - DNA, 15 bp, Homo sapiens
gtggggtgctctggt

SEQ ID NO: 3613261 - DNA, 19 bp, Homo sapiens
gtgggtaattgtacaataa

SEQ ID NO: 3613262 - DNA, 16 bp, Homo sapiens
gtgggtcccagagacc

SEQ ID NO: 3613263 - DNA, 16 bp, Homo sapiens
gtgggtctgtgtgtgt

SEQ ID NO: 3613264 - DNA, 12 bp, Homo sapiens
gtggtaaccctg

SEQ ID NO: 3613265 - DNA, 14 bp, Homo sapiens
gtggtaacttgaga

SEQ ID NO: 3613266 - DNA, 21 bp, Homo sapiens
gtggtcatgtgagtctgggat

SEQ ID NO: 3613267 - DNA, 17 bp, Homo sapiens
gtggtgacacctccccc

SEQ ID NO: 3613268 - DNA, 18 bp, Homo sapiens
gtggtgaccccaggaggg

SEQ ID NO: 3613269 - DNA, 17 bp, Homo sapiens
gtggtgaggggctttct

SEQ ID NO: 3613270 - DNA, 19 bp, Homo sapiens
gtggtgaggggctttctct

SEQ ID NO: 3613271 - DNA, 22 bp, Homo sapiens
gtggtgtgtccctggacacagc

SEQ ID NO: 3613272 - DNA, 14 bp, Homo sapiens
gtggttaggcagca

SEQ ID NO: 3613273 - DNA, 18 bp, Homo sapiens
gtggttcgtgctgtgctc

SEQ ID NO: 3613274 - DNA, 13 bp, Homo sapiens
gtggttgcctggg

SEQ ID NO: 3613275 - DNA, 14 bp, Homo sapiens
gtggtttcatgtta

SEQ ID NO: 3613276 - DNA, 21 bp, Homo sapiens
gtgtaacaggatacaggtgac

SEQ ID NO: 3613277 - DNA, 17 bp, Homo sapiens
gtgtaacttcctgctgc

SEQ ID NO: 3613278 - DNA, 14 bp, Homo sapiens
gtgtacaatgtaca

SEQ ID NO: 3613279 - DNA, 16 bp, Homo sapiens
gtgtacaatgtacaca

SEQ ID NO: 3613280 - DNA, 12 bp, Homo sapiens
gtgtacatatgt

SEQ ID NO: 3613281 - DNA, 18 bp, Homo sapiens
gtgtaccacttcctgagg

SEQ ID NO: 3613282 - DNA, 19 bp, Homo sapiens
gtgtaccacttcctgaggc

SEQ ID NO: 3613283 - DNA, 23 bp, Homo sapiens
gtgtacccatctttaatttatat

SEQ ID NO: 3613284 - DNA, 14 bp, Homo sapiens
gtgtagctttgctc

SEQ ID NO: 3613285 - DNA, 17 bp, Homo sapiens
gtgtagttataaaccaa

SEQ ID NO: 3613286 - DNA, 14 bp, Homo sapiens
gtgtataaatgtac

SEQ ID NO: 3613287 - DNA, 13 bp, Homo sapiens
gtgtatcctggcc

SEQ ID NO: 3613288 - DNA, 21 bp, Homo sapiens
gtgtatgtgggggtctgtgtg

SEQ ID NO: 3613289 - DNA, 16 bp, Homo sapiens
gtgtattggtgttgca

SEQ ID NO: 3613290 - DNA, 14 bp, Homo sapiens
gtgtcagtttttcc

SEQ ID NO: 3613291 - DNA, 21 bp, Homo sapiens
gtgtccataaataaagtttca

SEQ ID NO: 3613292 - DNA, 13 bp, Homo sapiens
gtgtccctggaca

SEQ ID NO: 3613293 - DNA, 16 bp, Homo sapiens
gtgtccctggacacag

SEQ ID NO: 3613294 - DNA, 15 bp, Homo sapiens
gtgtcctccaccatg

SEQ ID NO: 3613295 - DNA, 21 bp, Homo sapiens
gtgtcctccaccatgcactca

SEQ ID NO: 3613296 - DNA, 20 bp, Homo sapiens
gtgtctaggcactgagcagg

SEQ ID NO: 3613297 - DNA, 17 bp, Homo sapiens
gtgtctcagcctctgcc

SEQ ID NO: 3613298 - DNA, 18 bp, Homo sapiens
gtgtctcagcctctgcca

SEQ ID NO: 3613299 - DNA, 22 bp, Homo sapiens
gtgtgaactcaccctgggagcc

SEQ ID NO: 3613300 - DNA, 22 bp, Homo sapiens
gtgtgaatttgccagaggacca

SEQ ID NO: 3613301 - DNA, 11 bp, Homo sapiens
gtgtgactcct

SEQ ID NO: 3613302 - DNA, 20 bp, Homo sapiens
gtgtgactccttatctcttt

SEQ ID NO: 3613303 - DNA, 21 bp, Homo sapiens
gtgtgactccttatctctttc

SEQ ID NO: 3613304 - DNA, 17 bp, Homo sapiens
gtgtgagctcttccctt

SEQ ID NO: 3613305 - DNA, 17 bp, Homo sapiens
gtgtgagtgagcacacc

SEQ ID NO: 3613306 - DNA, 22 bp, Homo sapiens
gtgtgatcttaatatatttgaa

SEQ ID NO: 3613307 - DNA, 19 bp, Homo sapiens
gtgtgcctggccgcagggc

SEQ ID NO: 3613308 - DNA, 20 bp, Homo sapiens
gtgtgctgggcagagggagg

SEQ ID NO: 3613309 - DNA, 17 bp, Homo sapiens
gtgtggagaccaggctc

SEQ ID NO: 3613310 - DNA, 19 bp, Homo sapiens
gtgtggagaccaggctcct

SEQ ID NO: 3613311 - DNA, 14 bp, Homo sapiens
gtgtggctcctggg

SEQ ID NO: 3613312 - DNA, 17 bp, Homo sapiens
gtgtgggatctggggag

SEQ ID NO: 3613313 - DNA, 21 bp, Homo sapiens
gtgtggggccatgcctcctca

SEQ ID NO: 3613314 - DNA, 23 bp, Homo sapiens
gtgtggggccatgcctcctcagg

SEQ ID NO: 3613315 - DNA, 17 bp, Homo sapiens
gtgtgggtacctgtatt

SEQ ID NO: 3613316 - DNA, 17 bp, Homo sapiens
gtgtgtatatgtattta

SEQ ID NO: 3613317 - DNA, 13 bp, Homo sapiens
gtgtgtatgtggg

SEQ ID NO: 3613318 - DNA, 18 bp, Homo sapiens
gtgtgtccctggacacag

SEQ ID NO: 3613319 - DNA, 19 bp, Homo sapiens
gtgtgtccctggacacagc

SEQ ID NO: 3613320 - DNA, 21 bp, Homo sapiens
gtgtgtccctggacacagctc

SEQ ID NO: 3613321 - DNA, 13 bp, Homo sapiens
gtgtgtctgtcct

SEQ ID NO: 3613322 - DNA, 13 bp, Homo sapiens
gtgttacatgtat

SEQ ID NO: 3613323 - DNA, 15 bp, Homo sapiens
gtgttatgagccagg

SEQ ID NO: 3613324 - DNA, 22 bp, Homo sapiens
gtgttatttatttctttctatt

SEQ ID NO: 3613325 - DNA, 20 bp, Homo sapiens
gtgttccagtgtctgtctga

SEQ ID NO: 3613326 - DNA, 16 bp, Homo sapiens
gtgttcctgaagctgc

SEQ ID NO: 3613327 - DNA, 20 bp, Homo sapiens
gtgttcctgaagctgctgtg

SEQ ID NO: 3613328 - DNA, 12 bp, Homo sapiens
gtgttctgctcc

SEQ ID NO: 3613329 - DNA, 23 bp, Homo sapiens
gtgttctgctccataccttttct

SEQ ID NO: 3613330 - DNA, 22 bp, Homo sapiens
gtgttctgctcctgcttttctg

SEQ ID NO: 3613331 - DNA, 14 bp, Homo sapiens
gtgttgaggttttt

SEQ ID NO: 3613332 - DNA, 13 bp, Homo sapiens
gtgttgtatttct

SEQ ID NO: 3613333 - DNA, 18 bp, Homo sapiens
gtgtttccacagcctgca

SEQ ID NO: 3613334 - DNA, 15 bp, Homo sapiens
gtgtttgattggctt

SEQ ID NO: 3613335 - DNA, 20 bp, Homo sapiens
gtgtttggtttcccattggt

SEQ ID NO: 3613336 - DNA, 11 bp, Homo sapiens
gtgtttgtcat

SEQ ID NO: 3613337 - DNA, 12 bp, Homo sapiens
gtgtttgtcatg

SEQ ID NO: 3613338 - DNA, 13 bp, Homo sapiens
gtgtttgtcatgg

SEQ ID NO: 3613339 - DNA, 17 bp, Homo sapiens
gtgtttgtttttgcaca

SEQ ID NO: 3613340 - DNA, 13 bp, Homo sapiens
gtgttttcatcat

SEQ ID NO: 3613341 - DNA, 19 bp, Homo sapiens
gtgttttcatcatttcagc

SEQ ID NO: 3613342 - DNA, 18 bp, Homo sapiens
gtgtttttttctaaaaag

SEQ ID NO: 3613343 - DNA, 20 bp, Homo sapiens
gtgttttttttttttttgtg

SEQ ID NO: 3613344 - DNA, 20 bp, Homo sapiens
gttaaaaacagatttggaaa

SEQ ID NO: 3613345 - DNA, 18 bp, Homo sapiens
gttaaaacataaacacat

SEQ ID NO: 3613346 - DNA, 14 bp, Homo sapiens
gttaaaagatgaaa

SEQ ID NO: 3613347 - DNA, 16 bp, Homo sapiens
gttaaaagatgaaaat

SEQ ID NO: 3613348 - DNA, 20 bp, Homo sapiens
gttaaaagatgaaaatattt

SEQ ID NO: 3613349 - DNA, 19 bp, Homo sapiens
gttaaacattaatatttac

SEQ ID NO: 3613350 - DNA, 21 bp, Homo sapiens
gttaaacattaatatttacca

SEQ ID NO: 3613351 - DNA, 14 bp, Homo sapiens
gttaacaggacagt

SEQ ID NO: 3613352 - DNA, 17 bp, Homo sapiens
gttaactattgcattta

SEQ ID NO: 3613353 - DNA, 19 bp, Homo sapiens
gttaactgttaactatgac

SEQ ID NO: 3613354 - DNA, 15 bp, Homo sapiens
gttaatatttaagac

SEQ ID NO: 3613355 - DNA, 13 bp, Homo sapiens
gttaatatttctt

SEQ ID NO: 3613356 - DNA, 19 bp, Homo sapiens
gttaatgtagtatggtata

SEQ ID NO: 3613357 - DNA, 16 bp, Homo sapiens
gttaatttataatgta

SEQ ID NO: 3613358 - DNA, 20 bp, Homo sapiens
gttaatttataatgtatttg

SEQ ID NO: 3613359 - DNA, 16 bp, Homo sapiens
gttaattttgctaact

SEQ ID NO: 3613360 - DNA, 16 bp, Homo sapiens
gttacacaaaaatcta

SEQ ID NO: 3613361 - DNA, 22 bp, Homo sapiens
gttaccattttaacgctgccta

SEQ ID NO: 3613362 - DNA, 21 bp, Homo sapiens
gttacctggagaagtagtatt

SEQ ID NO: 3613363 - DNA, 22 bp, Homo sapiens
gttaccttatagttactgtgta

SEQ ID NO: 3613364 - DNA, 16 bp, Homo sapiens
gttacgtgaagaaata

SEQ ID NO: 3613365 - DNA, 21 bp, Homo sapiens
gttacgtgaagaaataaatga

SEQ ID NO: 3613366 - DNA, 13 bp, Homo sapiens
gttacttccttat

SEQ ID NO: 3613367 - DNA, 21 bp, Homo sapiens
gttagaaaatgacttatttct

SEQ ID NO: 3613368 - DNA, 23 bp, Homo sapiens
gttagactgttgggacagccatt

SEQ ID NO: 3613369 - DNA, 16 bp, Homo sapiens
gttagattaagaaata

SEQ ID NO: 3613370 - DNA, 19 bp, Homo sapiens
gttagcattaaagttctag

SEQ ID NO: 3613371 - DNA, 20 bp, Homo sapiens
gttagctgacagtcagctgt

SEQ ID NO: 3613372 - DNA, 18 bp, Homo sapiens
gttagcttaatcttaatg

SEQ ID NO: 3613373 - DNA, 12 bp, Homo sapiens
gttaggccaggc

SEQ ID NO: 3613374 - DNA, 16 bp, Homo sapiens
gttagtaaaggaacca

SEQ ID NO: 3613375 - DNA, 14 bp, Homo sapiens
gttagtattttaat

SEQ ID NO: 3613376 - DNA, 23 bp, Homo sapiens
gttagttaccttatagttactgt

SEQ ID NO: 3613377 - DNA, 16 bp, Homo sapiens
gttagttccactgaga

SEQ ID NO: 3613378 - DNA, 17 bp, Homo sapiens
gttatgactatgtaaac

SEQ ID NO: 3613379 - DNA, 18 bp, Homo sapiens
gttatgctgtttcctagc

SEQ ID NO: 3613380 - DNA, 17 bp, Homo sapiens
gttattaattaaagaaa

SEQ ID NO: 3613381 - DNA, 22 bp, Homo sapiens
gttattggtgtaaggtactttc

SEQ ID NO: 3613382 - DNA, 19 bp, Homo sapiens
gttatttatgctataaatt

SEQ ID NO: 3613383 - DNA, 13 bp, Homo sapiens
gttatttcttccc

SEQ ID NO: 3613384 - DNA, 14 bp, Homo sapiens
gttatttcttccct

SEQ ID NO: 3613385 - DNA, 15 bp, Homo sapiens
gttattttccttctg

SEQ ID NO: 3613386 - DNA, 18 bp, Homo sapiens
gttcaaggccatccttcc

SEQ ID NO: 3613387 - DNA, 19 bp, Homo sapiens
gttcaaggccatccttccc

SEQ ID NO: 3613388 - DNA, 17 bp, Homo sapiens
gttcaagtttgctgcaa

SEQ ID NO: 3613389 - DNA, 22 bp, Homo sapiens
gttcacctccaagcatttcatg

SEQ ID NO: 3613390 - DNA, 19 bp, Homo sapiens
gttcagaagaatcttcctg

SEQ ID NO: 3613391 - DNA, 23 bp, Homo sapiens
gttcagaatggcagtcctggagg

SEQ ID NO: 3613392 - DNA, 16 bp, Homo sapiens
gttcagacacagctct

SEQ ID NO: 3613393 - DNA, 14 bp, Homo sapiens
gttcagcagactgg

SEQ ID NO: 3613394 - DNA, 22 bp, Homo sapiens
gttcagctaagctaggaatgaa

SEQ ID NO: 3613395 - DNA, 15 bp, Homo sapiens
gttcagctgccccac

SEQ ID NO: 3613396 - DNA, 19 bp, Homo sapiens
gttcagctttaaaggccag

SEQ ID NO: 3613397 - DNA, 13 bp, Homo sapiens
gttcatcttgcag

SEQ ID NO: 3613398 - DNA, 16 bp, Homo sapiens
gttcatttgaagaaaa

SEQ ID NO: 3613399 - DNA, 19 bp, Homo sapiens
gttccaaaatattgacatt

SEQ ID NO: 3613400 - DNA, 23 bp, Homo sapiens
gttccaacatgcaatactggtca

SEQ ID NO: 3613401 - DNA, 22 bp, Homo sapiens
gttccagattcctatgatggat

SEQ ID NO: 3613402 - DNA, 17 bp, Homo sapiens
gttccatgttgactgac

SEQ ID NO: 3613403 - DNA, 13 bp, Homo sapiens
gttcccactctgg

SEQ ID NO: 3613404 - DNA, 14 bp, Homo sapiens
gttccccagagaaa

SEQ ID NO: 3613405 - DNA, 21 bp, Homo sapiens
gttcccccttcacaaagccca

SEQ ID NO: 3613406 - DNA, 15 bp, Homo sapiens
gttcccctgttcact

SEQ ID NO: 3613407 - DNA, 18 bp, Homo sapiens
gttcccctgttcactcta

SEQ ID NO: 3613408 - DNA, 13 bp, Homo sapiens
gttccctcccaga

SEQ ID NO: 3613409 - DNA, 16 bp, Homo sapiens
gttccctgctgcgctg

SEQ ID NO: 3613410 - DNA, 23 bp, Homo sapiens
gttccgcccgccctcccggagag

SEQ ID NO: 3613411 - DNA, 21 bp, Homo sapiens
gttcctcatctgagaggctct

SEQ ID NO: 3613412 - DNA, 20 bp, Homo sapiens
gttcctgaaatgtgtttcct

SEQ ID NO: 3613413 - DNA, 14 bp, Homo sapiens
gttcctgaagctgc

SEQ ID NO: 3613414 - DNA, 18 bp, Homo sapiens
gttcctgaagctgctgtg

SEQ ID NO: 3613415 - DNA, 19 bp, Homo sapiens
gttcctgaagctgctgtgt

SEQ ID NO: 3613416 - DNA, 22 bp, Homo sapiens
gttcctgtgtgaccctgggcag

SEQ ID NO: 3613417 - DNA, 12 bp, Homo sapiens
gttccttctctg

SEQ ID NO: 3613418 - DNA, 14 bp, Homo sapiens
gttccttctctggg

SEQ ID NO: 3613419 - DNA, 18 bp, Homo sapiens
gttcctttctctgggctt

SEQ ID NO: 3613420 - DNA, 22 bp, Homo sapiens
gttccttttttcaatatgcaag

SEQ ID NO: 3613421 - DNA, 20 bp, Homo sapiens
gttctaaagatggaaaaacc

SEQ ID NO: 3613422 - DNA, 20 bp, Homo sapiens
gttctaacagatcagaacat

SEQ ID NO: 3613423 - DNA, 13 bp, Homo sapiens
gttctaggccttt

SEQ ID NO: 3613424 - DNA, 14 bp, Homo sapiens
gttctaggcctttc

SEQ ID NO: 3613425 - DNA, 20 bp, Homo sapiens
gttctaggcctttcctctgc

SEQ ID NO: 3613426 - DNA, 21 bp, Homo sapiens
gttctaggcctttcctctgca

SEQ ID NO: 3613427 - DNA, 22 bp, Homo sapiens
gttctaggcctttcctctgcac

SEQ ID NO: 3613428 - DNA, 15 bp, Homo sapiens
gttctatttaaaatg

SEQ ID NO: 3613429 - DNA, 14 bp, Homo sapiens
gttctattttactg

SEQ ID NO: 3613430 - DNA, 19 bp, Homo sapiens
gttctcatgggtggcactc

SEQ ID NO: 3613431 - DNA, 20 bp, Homo sapiens
gttctccagtcattatgtta

SEQ ID NO: 3613432 - DNA, 14 bp, Homo sapiens
gttctccctttctc

SEQ ID NO: 3613433 - DNA, 15 bp, Homo sapiens
gttctccctttctct

SEQ ID NO: 3613434 - DNA, 16 bp, Homo sapiens
gttctccctttctctc

SEQ ID NO: 3613435 - DNA, 17 bp, Homo sapiens
gttctccctttctctct

SEQ ID NO: 3613436 - DNA, 19 bp, Homo sapiens
gttctccctttctctctcc

SEQ ID NO: 3613437 - DNA, 21 bp, Homo sapiens
gttctccctttctctctcctc

SEQ ID NO: 3613438 - DNA, 18 bp, Homo sapiens
gttctgacgctgacaata

SEQ ID NO: 3613439 - DNA, 15 bp, Homo sapiens
gttctgaggccagaa

SEQ ID NO: 3613440 - DNA, 16 bp, Homo sapiens
gttctgaggccagaaa

SEQ ID NO: 3613441 - DNA, 18 bp, Homo sapiens
gttctgaggccagaaagg

SEQ ID NO: 3613442 - DNA, 23 bp, Homo sapiens
gttctgagtagagcttgtaataa

SEQ ID NO: 3613443 - DNA, 13 bp, Homo sapiens
gttctgattatgt

SEQ ID NO: 3613444 - DNA, 15 bp, Homo sapiens
gttctgcctgccagc

SEQ ID NO: 3613445 - DNA, 19 bp, Homo sapiens
gttctgcgctgtgtacaat

SEQ ID NO: 3613446 - DNA, 12 bp, Homo sapiens
gttctgctcctg

SEQ ID NO: 3613447 - DNA, 15 bp, Homo sapiens
gttctgctcctgctt

SEQ ID NO: 3613448 - DNA, 18 bp, Homo sapiens
gttctgggagttgctgtt

SEQ ID NO: 3613449 - DNA, 11 bp, Homo sapiens
gttctgggcaa

SEQ ID NO: 3613450 - DNA, 18 bp, Homo sapiens
gttcttatgcaaaatgga

SEQ ID NO: 3613451 - DNA, 13 bp, Homo sapiens
gttcttcagtcct

SEQ ID NO: 3613452 - DNA, 22 bp, Homo sapiens
gttctttcatttgctttggaag

SEQ ID NO: 3613453 - DNA, 16 bp, Homo sapiens
gttctttcttcctctg

SEQ ID NO: 3613454 - DNA, 17 bp, Homo sapiens
gttctttcttcctctgc

SEQ ID NO: 3613455 - DNA, 22 bp, Homo sapiens
gttctttgggccagacatgcca

SEQ ID NO: 3613456 - DNA, 19 bp, Homo sapiens
gttcttttcaatatatttg

SEQ ID NO: 3613457 - DNA, 23 bp, Homo sapiens
gttgaaaagactccaaagaaatg

SEQ ID NO: 3613458 - DNA, 15 bp, Homo sapiens
gttgacacaggtctt

SEQ ID NO: 3613459 - DNA, 21 bp, Homo sapiens
gttgacaggtacttggagggc

SEQ ID NO: 3613460 - DNA, 22 bp, Homo sapiens
gttgacagtattaacactaaat

SEQ ID NO: 3613461 - DNA, 17 bp, Homo sapiens
gttgacattcggggtga

SEQ ID NO: 3613462 - DNA, 19 bp, Homo sapiens
gttgacttatagtacatga

SEQ ID NO: 3613463 - DNA, 22 bp, Homo sapiens
gttgatctggaacccagactca

SEQ ID NO: 3613464 - DNA, 19 bp, Homo sapiens
gttgatgtatggtatcttt

SEQ ID NO: 3613465 - DNA, 14 bp, Homo sapiens
gttgattaaagatg

SEQ ID NO: 3613466 - DNA, 19 bp, Homo sapiens
gttgcactaaaatgaggat

SEQ ID NO: 3613467 - DNA, 19 bp, Homo sapiens
gttgcagccgcagagaaat

SEQ ID NO: 3613468 - DNA, 18 bp, Homo sapiens
gttgcccccattcccagc

SEQ ID NO: 3613469 - DNA, 21 bp, Homo sapiens
gttgcccccattcccagcctg

SEQ ID NO: 3613470 - DNA, 15 bp, Homo sapiens
gttgcctttatttgc

SEQ ID NO: 3613471 - DNA, 15 bp, Homo sapiens
gttgctatagtgaca

SEQ ID NO: 3613472 - DNA, 20 bp, Homo sapiens
gttgctatagtgacatgcag

SEQ ID NO: 3613473 - DNA, 22 bp, Homo sapiens
gttgctatagtgacatgcagtt

SEQ ID NO: 3613474 - DNA, 15 bp, Homo sapiens
gttgctgattgtcaa

SEQ ID NO: 3613475 - DNA, 21 bp, Homo sapiens
gttgctggtcctgcacatgag

SEQ ID NO: 3613476 - DNA, 17 bp, Homo sapiens
gttggaaatgtgttttt

SEQ ID NO: 3613477 - DNA, 13 bp, Homo sapiens
gttggagaaagaa

SEQ ID NO: 3613478 - DNA, 16 bp, Homo sapiens
gttggagcagcaggcc

SEQ ID NO: 3613479 - DNA, 17 bp, Homo sapiens
gttggagcagcaggcct

SEQ ID NO: 3613480 - DNA, 18 bp, Homo sapiens
gttggagcagcaggcctc

SEQ ID NO: 3613481 - DNA, 18 bp, Homo sapiens
gttggcaccttccccctc

SEQ ID NO: 3613482 - DNA, 14 bp, Homo sapiens
gttggcaggcccac

SEQ ID NO: 3613483 - DNA, 14 bp, Homo sapiens
gttggccatggtga

SEQ ID NO: 3613484 - DNA, 15 bp, Homo sapiens
gttgggagcctagct

SEQ ID NO: 3613485 - DNA, 17 bp, Homo sapiens
gttgggcccctgaggag

SEQ ID NO: 3613486 - DNA, 19 bp, Homo sapiens
gttggtattttcagagaac

SEQ ID NO: 3613487 - DNA, 14 bp, Homo sapiens
gttggtcaggctgg

SEQ ID NO: 3613488 - DNA, 13 bp, Homo sapiens
gttggtctgcctt

SEQ ID NO: 3613489 - DNA, 16 bp, Homo sapiens
gttggtctgccttctg

SEQ ID NO: 3613490 - DNA, 15 bp, Homo sapiens
gttggttttgctgtt

SEQ ID NO: 3613491 - DNA, 18 bp, Homo sapiens
gttgtatcagcacgtgtg

SEQ ID NO: 3613492 - DNA, 12 bp, Homo sapiens
gttgtattcatt

SEQ ID NO: 3613493 - DNA, 18 bp, Homo sapiens
gttgtatttctatacagt

SEQ ID NO: 3613494 - DNA, 14 bp, Homo sapiens
gttgtcaagaatag

SEQ ID NO: 3613495 - DNA, 13 bp, Homo sapiens
gttgtccaggctg

SEQ ID NO: 3613496 - DNA, 18 bp, Homo sapiens
gttgtctacgggggcact

SEQ ID NO: 3613497 - DNA, 22 bp, Homo sapiens
gttgtgagaatggcctggagca

SEQ ID NO: 3613498 - DNA, 20 bp, Homo sapiens
gttgtgagtttaccttgtat

SEQ ID NO: 3613499 - DNA, 20 bp, Homo sapiens
gttgtggggcctcaggctcc

SEQ ID NO: 3613500 - DNA, 14 bp, Homo sapiens
gttgtggttaatct

SEQ ID NO: 3613501 - DNA, 16 bp, Homo sapiens
gttgtgtgtgggagtg

SEQ ID NO: 3613502 - DNA, 14 bp, Homo sapiens
gttgttatattcat

SEQ ID NO: 3613503 - DNA, 14 bp, Homo sapiens
gttgttattattca

SEQ ID NO: 3613504 - DNA, 24 bp, Homo sapiens
gttgttatttattgaaatgatttc

SEQ ID NO: 3613505 - DNA, 13 bp, Homo sapiens
gttgttctgcctg

SEQ ID NO: 3613506 - DNA, 17 bp, Homo sapiens
gttgttgcatgtttgaa

SEQ ID NO: 3613507 - DNA, 15 bp, Homo sapiens
gttgttgtggaagca

SEQ ID NO: 3613508 - DNA, 15 bp, Homo sapiens
gttgtttataataaa

SEQ ID NO: 3613509 - DNA, 12 bp, Homo sapiens
gttgtttcatga

SEQ ID NO: 3613510 - DNA, 20 bp, Homo sapiens
gtttaaaaagatgaaaaaga

SEQ ID NO: 3613511 - DNA, 14 bp, Homo sapiens
gtttaaacaaaaaa

SEQ ID NO: 3613512 - DNA, 20 bp, Homo sapiens
gtttaaataaaatttaattt

SEQ ID NO: 3613513 - DNA, 12 bp, Homo sapiens
gtttaaatgtat

SEQ ID NO: 3613514 - DNA, 21 bp, Homo sapiens
gtttaactttaaggatttgaa

SEQ ID NO: 3613515 - DNA, 22 bp, Homo sapiens
gtttaagccgcagacctggagc

SEQ ID NO: 3613516 - DNA, 23 bp, Homo sapiens
gtttaagccgcagacctggagct

SEQ ID NO: 3613517 - DNA, 17 bp, Homo sapiens
gtttaatggtagtttta

SEQ ID NO: 3613518 - DNA, 19 bp, Homo sapiens
gtttaatgttaattatgca

SEQ ID NO: 3613519 - DNA, 15 bp, Homo sapiens
gtttacagtatttct

SEQ ID NO: 3613520 - DNA, 19 bp, Homo sapiens
gtttacagtatttctacat

SEQ ID NO: 3613521 - DNA, 17 bp, Homo sapiens
gtttacatgaagcagaa

SEQ ID NO: 3613522 - DNA, 21 bp, Homo sapiens
gtttacatgaagcagaacctt

SEQ ID NO: 3613523 - DNA, 15 bp, Homo sapiens
gtttagaatgtcagt

SEQ ID NO: 3613524 - DNA, 18 bp, Homo sapiens
gtttaggctggtggccca

SEQ ID NO: 3613525 - DNA, 16 bp, Homo sapiens
gtttagggttctggtg

SEQ ID NO: 3613526 - DNA, 15 bp, Homo sapiens
gtttaggtgaattaa

SEQ ID NO: 3613527 - DNA, 13 bp, Homo sapiens
gtttataataaaa

SEQ ID NO: 3613528 - DNA, 15 bp, Homo sapiens
gtttataataaaaat

SEQ ID NO: 3613529 - DNA, 14 bp, Homo sapiens
gtttataataaact

SEQ ID NO: 3613530 - DNA, 15 bp, Homo sapiens
gtttataattggctt

SEQ ID NO: 3613531 - DNA, 22 bp, Homo sapiens
gtttataggagaaagcaaaata

SEQ ID NO: 3613532 - DNA, 19 bp, Homo sapiens
gtttatatggataatctga

SEQ ID NO: 3613533 - DNA, 12 bp, Homo sapiens
gtttatccaaat

SEQ ID NO: 3613534 - DNA, 23 bp, Homo sapiens
gtttattaatcttagtgtatgat

SEQ ID NO: 3613535 - DNA, 18 bp, Homo sapiens
gtttattataaactgtat

SEQ ID NO: 3613536 - DNA, 15 bp, Homo sapiens
gtttattctttgcaa

SEQ ID NO: 3613537 - DNA, 18 bp, Homo sapiens
gtttattgatattcaata

SEQ ID NO: 3613538 - DNA, 12 bp, Homo sapiens
gtttcactgcaa

SEQ ID NO: 3613539 - DNA, 18 bp, Homo sapiens
gtttccagagagtggaga

SEQ ID NO: 3613540 - DNA, 19 bp, Homo sapiens
gtttcccatcactgtatcc

SEQ ID NO: 3613541 - DNA, 15 bp, Homo sapiens
gtttcccgtaaggct

SEQ ID NO: 3613542 - DNA, 20 bp, Homo sapiens
gtttcctactgcgcctcgtg

SEQ ID NO: 3613543 - DNA, 14 bp, Homo sapiens
gtttcctcagtgat

SEQ ID NO: 3613544 - DNA, 22 bp, Homo sapiens
gtttcctgaaacaacttggaaa

SEQ ID NO: 3613545 - DNA, 14 bp, Homo sapiens
gtttcctgcaggcc

SEQ ID NO: 3613546 - DNA, 15 bp, Homo sapiens
gtttcgactggtcca

SEQ ID NO: 3613547 - DNA, 17 bp, Homo sapiens
gtttcgactggtccagc

SEQ ID NO: 3613548 - DNA, 20 bp, Homo sapiens
gtttcgactggtccagctct

SEQ ID NO: 3613549 - DNA, 22 bp, Homo sapiens
gtttcgactggtccagctctga

SEQ ID NO: 3613550 - DNA, 15 bp, Homo sapiens
gtttcgatatttatt

SEQ ID NO: 3613551 - DNA, 13 bp, Homo sapiens
gtttctacattca

SEQ ID NO: 3613552 - DNA, 17 bp, Homo sapiens
gtttctattttttgaaa

SEQ ID NO: 3613553 - DNA, 13 bp, Homo sapiens
gtttctcaaatct

SEQ ID NO: 3613554 - DNA, 16 bp, Homo sapiens
gtttctcaaatctgct

SEQ ID NO: 3613555 - DNA, 15 bp, Homo sapiens
gtttctctaaggaat

SEQ ID NO: 3613556 - DNA, 17 bp, Homo sapiens
gtttctgtcgttaaaaa

SEQ ID NO: 3613557 - DNA, 13 bp, Homo sapiens
gtttcttcattct

SEQ ID NO: 3613558 - DNA, 19 bp, Homo sapiens
gtttcttgcttggaagcca

SEQ ID NO: 3613559 - DNA, 20 bp, Homo sapiens
gtttgaaatgaggtctgttt

SEQ ID NO: 3613560 - DNA, 21 bp, Homo sapiens
gtttgaagattatatgaagtt

SEQ ID NO: 3613561 - DNA, 18 bp, Homo sapiens
gtttgatgtttttaaagg

SEQ ID NO: 3613562 - DNA, 16 bp, Homo sapiens
gtttgccttttatgta

SEQ ID NO: 3613563 - DNA, 19 bp, Homo sapiens
gtttgctctaccaaatagt

SEQ ID NO: 3613564 - DNA, 13 bp, Homo sapiens
gtttgctgtgctt

SEQ ID NO: 3613565 - DNA, 14 bp, Homo sapiens
gtttggacagctga

SEQ ID NO: 3613566 - DNA, 16 bp, Homo sapiens
gtttggatacagctgc

SEQ ID NO: 3613567 - DNA, 17 bp, Homo sapiens
gtttggatacagctgct

SEQ ID NO: 3613568 - DNA, 12 bp, Homo sapiens
gtttgggagcca

SEQ ID NO: 3613569 - DNA, 13 bp, Homo sapiens
gtttgggagccag

SEQ ID NO: 3613570 - DNA, 15 bp, Homo sapiens
gtttgggagccagga

SEQ ID NO: 3613571 - DNA, 16 bp, Homo sapiens
gtttgggagccaggac

SEQ ID NO: 3613572 - DNA, 17 bp, Homo sapiens
gtttgggagccaggact

SEQ ID NO: 3613573 - DNA, 18 bp, Homo sapiens
gtttgggagccaggactc

SEQ ID NO: 3613574 - DNA, 22 bp, Homo sapiens
gtttgggagccaggactcccag

SEQ ID NO: 3613575 - DNA, 21 bp, Homo sapiens
gtttggtttcccattggttca

SEQ ID NO: 3613576 - DNA, 13 bp, Homo sapiens
gtttgtagccagg

SEQ ID NO: 3613577 - DNA, 20 bp, Homo sapiens
gtttgttttagaaccagccg

SEQ ID NO: 3613578 - DNA, 17 bp, Homo sapiens
gttttaacaagaagcaa

SEQ ID NO: 3613579 - DNA, 15 bp, Homo sapiens
gttttaacttccagt

SEQ ID NO: 3613580 - DNA, 20 bp, Homo sapiens
gttttaataccacagctatt

SEQ ID NO: 3613581 - DNA, 13 bp, Homo sapiens
gttttacaatagt

SEQ ID NO: 3613582 - DNA, 17 bp, Homo sapiens
gttttagaagattctat

SEQ ID NO: 3613583 - DNA, 15 bp, Homo sapiens
gttttagcatttgta

SEQ ID NO: 3613584 - DNA, 16 bp, Homo sapiens
gttttataatgaaccc

SEQ ID NO: 3613585 - DNA, 13 bp, Homo sapiens
gttttatttgtat

SEQ ID NO: 3613586 - DNA, 15 bp, Homo sapiens
gttttatttgtatta

SEQ ID NO: 3613587 - DNA, 13 bp, Homo sapiens
gttttcatcattt

SEQ ID NO: 3613588 - DNA, 15 bp, Homo sapiens
gttttcatcatttca

SEQ ID NO: 3613589 - DNA, 20 bp, Homo sapiens
gttttcattcattggtgaag

SEQ ID NO: 3613590 - DNA, 13 bp, Homo sapiens
gttttccaaagag

SEQ ID NO: 3613591 - DNA, 18 bp, Homo sapiens
gttttccgaagtctctga

SEQ ID NO: 3613592 - DNA, 18 bp, Homo sapiens
gttttcctcccttctgct

SEQ ID NO: 3613593 - DNA, 15 bp, Homo sapiens
gttttcggcagcctt

SEQ ID NO: 3613594 - DNA, 15 bp, Homo sapiens
gttttctatgtgact

SEQ ID NO: 3613595 - DNA, 21 bp, Homo sapiens
gttttctcctcccaggaactg

SEQ ID NO: 3613596 - DNA, 17 bp, Homo sapiens
gttttctgagaaagact

SEQ ID NO: 3613597 - DNA, 23 bp, Homo sapiens
gttttctgagaaagactattcaa

SEQ ID NO: 3613598 - DNA, 16 bp, Homo sapiens
gttttcttaacttaaa

SEQ ID NO: 3613599 - DNA, 16 bp, Homo sapiens
gttttgaagattctat

SEQ ID NO: 3613600 - DNA, 13 bp, Homo sapiens
gttttgcctgaga

SEQ ID NO: 3613601 - DNA, 17 bp, Homo sapiens
gttttggatgttgctat

SEQ ID NO: 3613602 - DNA, 22 bp, Homo sapiens
gttttggatgttgctatagtga

SEQ ID NO: 3613603 - DNA, 23 bp, Homo sapiens
gttttgtggtagtccttttggga

SEQ ID NO: 3613604 - DNA, 18 bp, Homo sapiens
gtttttagaatgttgaaa

SEQ ID NO: 3613605 - DNA, 20 bp, Homo sapiens
gtttttagcatgttcctcct

SEQ ID NO: 3613606 - DNA, 15 bp, Homo sapiens
gtttttatatattat

SEQ ID NO: 3613607 - DNA, 12 bp, Homo sapiens
gtttttatttca

SEQ ID NO: 3613608 - DNA, 19 bp, Homo sapiens
gtttttatttcaattgttt

SEQ ID NO: 3613609 - DNA, 23 bp, Homo sapiens
gtttttatttcaattgtttatat

SEQ ID NO: 3613610 - DNA, 12 bp, Homo sapiens
gtttttcaatta

SEQ ID NO: 3613611 - DNA, 17 bp, Homo sapiens
gtttttcaattaaacgg

SEQ ID NO: 3613612 - DNA, 19 bp, Homo sapiens
gtttttcaattaaacggat

SEQ ID NO: 3613613 - DNA, 17 bp, Homo sapiens
gtttttcatcttttgaa

SEQ ID NO: 3613614 - DNA, 13 bp, Homo sapiens
gtttttcatgttt

SEQ ID NO: 3613615 - DNA, 21 bp, Homo sapiens
gtttttcatgttttagcattt

SEQ ID NO: 3613616 - DNA, 13 bp, Homo sapiens
gtttttgaaatac

SEQ ID NO: 3613617 - DNA, 17 bp, Homo sapiens
gtttttgtatccagagc

SEQ ID NO: 3613618 - DNA, 14 bp, Homo sapiens
gttttttcgtgttt

SEQ ID NO: 3613619 - DNA, 19 bp, Homo sapiens
gtttttttgtatagaccaa

SEQ ID NO: 3613620 - DNA, 17 bp, Homo sapiens
gtttttttgttattaaa

SEQ ID NO: 3613621 - DNA, 20 bp, Homo sapiens
gtttttttttttttacatgt

SEQ ID NO: 3613622 - DNA, 23 bp, Homo sapiens
taaaaaaactggatatttcaatc

SEQ ID NO: 3613623 - DNA, 14 bp, Homo sapiens
taaaaaatgacaaa

SEQ ID NO: 3613624 - DNA, 14 bp, Homo sapiens
taaaaaatgtgaaa

SEQ ID NO: 3613625 - DNA, 20 bp, Homo sapiens
taaaaacacaaaaaaaattt

SEQ ID NO: 3613626 - DNA, 20 bp, Homo sapiens
taaaaacagatttggaaaga

SEQ ID NO: 3613627 - DNA, 22 bp, Homo sapiens
taaaaacagatttggaaagact

SEQ ID NO: 3613628 - DNA, 15 bp, Homo sapiens
taaaaactgtgattt

SEQ ID NO: 3613629 - DNA, 16 bp, Homo sapiens
taaaaacttttgagga

SEQ ID NO: 3613630 - DNA, 20 bp, Homo sapiens
taaaaagatgaaaaagaata

SEQ ID NO: 3613631 - DNA, 17 bp, Homo sapiens
taaaaagcctctttctt

SEQ ID NO: 3613632 - DNA, 21 bp, Homo sapiens
taaaaaggacatcagcaaaca

SEQ ID NO: 3613633 - DNA, 22 bp, Homo sapiens
taaaaaggcccttagagggaat

SEQ ID NO: 3613634 - DNA, 13 bp, Homo sapiens
taaaaagtgcagt

SEQ ID NO: 3613635 - DNA, 12 bp, Homo sapiens
taaaaatacacc

SEQ ID NO: 3613636 - DNA, 15 bp, Homo sapiens
taaaaatcatataga

SEQ ID NO: 3613637 - DNA, 17 bp, Homo sapiens
taaaaatgggtgttatt

SEQ ID NO: 3613638 - DNA, 13 bp, Homo sapiens
taaaaatgtctta

SEQ ID NO: 3613639 - DNA, 18 bp, Homo sapiens
taaaaatgttagtatttt

SEQ ID NO: 3613640 - DNA, 11 bp, Homo sapiens
taaaaatttat

SEQ ID NO: 3613641 - DNA, 12 bp, Homo sapiens
taaaacaaatga

SEQ ID NO: 3613642 - DNA, 16 bp, Homo sapiens
taaaacaaatgaaatt

SEQ ID NO: 3613643 - DNA, 19 bp, Homo sapiens
taaaacacttccataatct

SEQ ID NO: 3613644 - DNA, 17 bp, Homo sapiens
taaaacactttcaaaac

SEQ ID NO: 3613645 - DNA, 12 bp, Homo sapiens
taaaacattaaa

SEQ ID NO: 3613646 - DNA, 15 bp, Homo sapiens
taaaaccacagcagt

SEQ ID NO: 3613647 - DNA, 17 bp, Homo sapiens
taaaacctgcttttcaa

SEQ ID NO: 3613648 - DNA, 15 bp, Homo sapiens
taaaactctgggtct

SEQ ID NO: 3613649 - DNA, 18 bp, Homo sapiens
taaaactggctttggctt

SEQ ID NO: 3613650 - DNA, 14 bp, Homo sapiens
taaaacttctgctc

SEQ ID NO: 3613651 - DNA, 16 bp, Homo sapiens
taaaacttctgctcgt

SEQ ID NO: 3613652 - DNA, 13 bp, Homo sapiens
taaaagaatattt

SEQ ID NO: 3613653 - DNA, 14 bp, Homo sapiens
taaaagacagcagg

SEQ ID NO: 3613654 - DNA, 11 bp, Homo sapiens
taaaagcacac

SEQ ID NO: 3613655 - DNA, 14 bp, Homo sapiens
taaaagcattttgt

SEQ ID NO: 3613656 - DNA, 14 bp, Homo sapiens
taaaagccccagct

SEQ ID NO: 3613657 - DNA, 22 bp, Homo sapiens
taaaaggtattaaattgatgtt

SEQ ID NO: 3613658 - DNA, 21 bp, Homo sapiens
taaaaggtcaaaactgaagct

SEQ ID NO: 3613659 - DNA, 15 bp, Homo sapiens
taaaagtaataaaga

SEQ ID NO: 3613660 - DNA, 14 bp, Homo sapiens
taaaagtattcata

SEQ ID NO: 3613661 - DNA, 13 bp, Homo sapiens
taaaataaaccaa

SEQ ID NO: 3613662 - DNA, 21 bp, Homo sapiens
taaaataaggttatgattgaa

SEQ ID NO: 3613663 - DNA, 13 bp, Homo sapiens
taaaataattttg

SEQ ID NO: 3613664 - DNA, 21 bp, Homo sapiens
taaaataattttgtaatgtat

SEQ ID NO: 3613665 - DNA, 20 bp, Homo sapiens
taaaatacctctaataaaca

SEQ ID NO: 3613666 - DNA, 14 bp, Homo sapiens
taaaatagaaaaag

SEQ ID NO: 3613667 - DNA, 13 bp, Homo sapiens
taaaatattcctg

SEQ ID NO: 3613668 - DNA, 13 bp, Homo sapiens
taaaatatttatt

SEQ ID NO: 3613669 - DNA, 17 bp, Homo sapiens
taaaatcaaaacaagtg

SEQ ID NO: 3613670 - DNA, 13 bp, Homo sapiens
taaaatcatttct

SEQ ID NO: 3613671 - DNA, 16 bp, Homo sapiens
taaaatctaaaatttc

SEQ ID NO: 3613672 - DNA, 14 bp, Homo sapiens
taaaatgatcctgc

SEQ ID NO: 3613673 - DNA, 23 bp, Homo sapiens
taaaatgcttacatttgaacttg

SEQ ID NO: 3613674 - DNA, 23 bp, Homo sapiens
taaaatggaattgaaaaactctt

SEQ ID NO: 3613675 - DNA, 15 bp, Homo sapiens
taaaatgtaaactgt

SEQ ID NO: 3613676 - DNA, 13 bp, Homo sapiens
taaaatgtatatt

SEQ ID NO: 3613677 - DNA, 19 bp, Homo sapiens
taaaatgtatatttttaaa

SEQ ID NO: 3613678 - DNA, 15 bp, Homo sapiens
taaaattaatgcaga

SEQ ID NO: 3613679 - DNA, 18 bp, Homo sapiens
taaaattatatagctgct

SEQ ID NO: 3613680 - DNA, 22 bp, Homo sapiens
taaaattgttaaccttgtaaga

SEQ ID NO: 3613681 - DNA, 12 bp, Homo sapiens
taaaattgttat

SEQ ID NO: 3613682 - DNA, 15 bp, Homo sapiens
taaaattgttatcaa

SEQ ID NO: 3613683 - DNA, 21 bp, Homo sapiens
taaaatttcataattctgaaa

SEQ ID NO: 3613684 - DNA, 22 bp, Homo sapiens
taaaatttcataattctgaaac

SEQ ID NO: 3613685 - DNA, 15 bp, Homo sapiens
taaacaaagacattg

SEQ ID NO: 3613686 - DNA, 21 bp, Homo sapiens
taaacaatctttcatgtcttg

SEQ ID NO: 3613687 - DNA, 15 bp, Homo sapiens
taaacacaggctgtc

SEQ ID NO: 3613688 - DNA, 17 bp, Homo sapiens
taaacacaggctgtcct

SEQ ID NO: 3613689 - DNA, 19 bp, Homo sapiens
taaacacaggctgtcctta

SEQ ID NO: 3613690 - DNA, 20 bp, Homo sapiens
taaacagtgagcctgaattt

SEQ ID NO: 3613691 - DNA, 16 bp, Homo sapiens
taaacagttatgaaaa

SEQ ID NO: 3613692 - DNA, 15 bp, Homo sapiens
taaacataagtgtac

SEQ ID NO: 3613693 - DNA, 22 bp, Homo sapiens
taaacataataaatcacacatt

SEQ ID NO: 3613694 - DNA, 20 bp, Homo sapiens
taaacattcctccagcctcc

SEQ ID NO: 3613695 - DNA, 21 bp, Homo sapiens
taaacattcctccagcctccc

SEQ ID NO: 3613696 - DNA, 23 bp, Homo sapiens
taaacattcctccagcctcccct

SEQ ID NO: 3613697 - DNA, 20 bp, Homo sapiens
taaaccataaaataaataat

SEQ ID NO: 3613698 - DNA, 16 bp, Homo sapiens
taaacccctcagacag

SEQ ID NO: 3613699 - DNA, 16 bp, Homo sapiens
taaacggttcctggtg

SEQ ID NO: 3613700 - DNA, 15 bp, Homo sapiens
taaactactctttga

SEQ ID NO: 3613701 - DNA, 18 bp, Homo sapiens
taaactactctttgattt

SEQ ID NO: 3613702 - DNA, 16 bp, Homo sapiens
taaactcaaaatattt

SEQ ID NO: 3613703 - DNA, 19 bp, Homo sapiens
taaactcaaaatatttgta

SEQ ID NO: 3613704 - DNA, 21 bp, Homo sapiens
taaactcaaaatatttgtaca

SEQ ID NO: 3613705 - DNA, 21 bp, Homo sapiens
taaactggaaaggatctgtga

SEQ ID NO: 3613706 - DNA, 20 bp, Homo sapiens
taaactgtgttttagtgtaa

SEQ ID NO: 3613707 - DNA, 12 bp, Homo sapiens
taaacttcagca

SEQ ID NO: 3613708 - DNA, 17 bp, Homo sapiens
taaacttcagcaaccct

SEQ ID NO: 3613709 - DNA, 15 bp, Homo sapiens
taaacttgtcttttc

SEQ ID NO: 3613710 - DNA, 21 bp, Homo sapiens
taaactttgaagcaactgtga

SEQ ID NO: 3613711 - DNA, 16 bp, Homo sapiens
taaactttttttctgt

SEQ ID NO: 3613712 - DNA, 18 bp, Homo sapiens
taaactttttttctgtac

SEQ ID NO: 3613713 - DNA, 20 bp, Homo sapiens
taaactttttttctgtacca

SEQ ID NO: 3613714 - DNA, 13 bp, Homo sapiens
taaagaaagtgta

SEQ ID NO: 3613715 - DNA, 14 bp, Homo sapiens
taaagaaagtgtat

SEQ ID NO: 3613716 - DNA, 15 bp, Homo sapiens
taaagaaagtgtatt

SEQ ID NO: 3613717 - DNA, 22 bp, Homo sapiens
taaagaagaggagaaaaagaag

SEQ ID NO: 3613718 - DNA, 15 bp, Homo sapiens
taaagacacctactg

SEQ ID NO: 3613719 - DNA, 22 bp, Homo sapiens
taaagacttgtatagcatgaaa

SEQ ID NO: 3613720 - DNA, 16 bp, Homo sapiens
taaagagcatcctgat

SEQ ID NO: 3613721 - DNA, 12 bp, Homo sapiens
taaagaggagat

SEQ ID NO: 3613722 - DNA, 16 bp, Homo sapiens
taaagatacaaaatgt

SEQ ID NO: 3613723 - DNA, 17 bp, Homo sapiens
taaagatacaaaatgtt

SEQ ID NO: 3613724 - DNA, 20 bp, Homo sapiens
taaagatacaaaatgttact

SEQ ID NO: 3613725 - DNA, 16 bp, Homo sapiens
taaagccaggctcagg

SEQ ID NO: 3613726 - DNA, 11 bp, Homo sapiens
taaagcttcag

SEQ ID NO: 3613727 - DNA, 15 bp, Homo sapiens
taaagcttttggaag

SEQ ID NO: 3613728 - DNA, 17 bp, Homo sapiens
taaagcttttggaagcc

SEQ ID NO: 3613729 - DNA, 21 bp, Homo sapiens
taaaggaaaataatgtttgat

SEQ ID NO: 3613730 - DNA, 17 bp, Homo sapiens
taaagggaccatctgct

SEQ ID NO: 3613731 - DNA, 20 bp, Homo sapiens
taaagggaccatctgctgca

SEQ ID NO: 3613732 - DNA, 21 bp, Homo sapiens
taaagggactacctctgtgcc

SEQ ID NO: 3613733 - DNA, 22 bp, Homo sapiens
taaaggtacactggtatttata

SEQ ID NO: 3613734 - DNA, 15 bp, Homo sapiens
taaagtcagatggaa

SEQ ID NO: 3613735 - DNA, 22 bp, Homo sapiens
taaagttgcctttatttgctgt

SEQ ID NO: 3613736 - DNA, 14 bp, Homo sapiens
taaataaaagcaca

SEQ ID NO: 3613737 - DNA, 22 bp, Homo sapiens
taaataaaagcacaagtacttt

SEQ ID NO: 3613738 - DNA, 13 bp, Homo sapiens
taaataaaccctt

SEQ ID NO: 3613739 - DNA, 17 bp, Homo sapiens
taaataaagcttgggaa

SEQ ID NO: 3613740 - DNA, 14 bp, Homo sapiens
taaataatctcatc

SEQ ID NO: 3613741 - DNA, 20 bp, Homo sapiens
taaatacatgcatataatga

SEQ ID NO: 3613742 - DNA, 21 bp, Homo sapiens
taaatacatgcatataatgaa

SEQ ID NO: 3613743 - DNA, 19 bp, Homo sapiens
taaatactttccatgtttt

SEQ ID NO: 3613744 - DNA, 23 bp, Homo sapiens
taaatagggaagatggagacacc

SEQ ID NO: 3613745 - DNA, 22 bp, Homo sapiens
taaatatagatgtaatttttca

SEQ ID NO: 3613746 - DNA, 21 bp, Homo sapiens
taaatatagcagtagtctttt

SEQ ID NO: 3613747 - DNA, 21 bp, Homo sapiens
taaatatatattttgtacttt

SEQ ID NO: 3613748 - DNA, 22 bp, Homo sapiens
taaatatcaatcaagccatgta

SEQ ID NO: 3613749 - DNA, 22 bp, Homo sapiens
taaatatcccttggacatttta

SEQ ID NO: 3613750 - DNA, 21 bp, Homo sapiens
taaatattagttaatggatta

SEQ ID NO: 3613751 - DNA, 17 bp, Homo sapiens
taaatcacagatgcata

SEQ ID NO: 3613752 - DNA, 16 bp, Homo sapiens
taaatccattatgact

SEQ ID NO: 3613753 - DNA, 17 bp, Homo sapiens
taaatgaaacttaagaa

SEQ ID NO: 3613754 - DNA, 19 bp, Homo sapiens
taaatgcaaccatttgaaa

SEQ ID NO: 3613755 - DNA, 16 bp, Homo sapiens
taaatgcataaatgca

SEQ ID NO: 3613756 - DNA, 18 bp, Homo sapiens
taaatggtgctgcagatt

SEQ ID NO: 3613757 - DNA, 16 bp, Homo sapiens
taaatggtttttaaat

SEQ ID NO: 3613758 - DNA, 22 bp, Homo sapiens
taaatgtacatttccaaatgaa

SEQ ID NO: 3613759 - DNA, 17 bp, Homo sapiens
taaatgtcaaatgtgaa

SEQ ID NO: 3613760 - DNA, 23 bp, Homo sapiens
taaatgtcactttttgaggcaaa

SEQ ID NO: 3613761 - DNA, 16 bp, Homo sapiens
taaatgtctgcactga

SEQ ID NO: 3613762 - DNA, 17 bp, Homo sapiens
taaatgtttatattgtt

SEQ ID NO: 3613763 - DNA, 24 bp, Homo sapiens
taaattaatggtttattctttgca

SEQ ID NO: 3613764 - DNA, 16 bp, Homo sapiens
taaattatgttttact

SEQ ID NO: 3613765 - DNA, 15 bp, Homo sapiens
taaattattacttta

SEQ ID NO: 3613766 - DNA, 10 bp, Homo sapiens
taaattattt

SEQ ID NO: 3613767 - DNA, 22 bp, Homo sapiens
taaattatttgattatttaaga

SEQ ID NO: 3613768 - DNA, 17 bp, Homo sapiens
taaattccactgaaaat

SEQ ID NO: 3613769 - DNA, 23 bp, Homo sapiens
taaattccactgaaaatttaaca

SEQ ID NO: 3613770 - DNA, 18 bp, Homo sapiens
taaattcccgttttgtca

SEQ ID NO: 3613771 - DNA, 14 bp, Homo sapiens
taaattcctctttg

SEQ ID NO: 3613772 - DNA, 18 bp, Homo sapiens
taaattcctctttgcttt

SEQ ID NO: 3613773 - DNA, 19 bp, Homo sapiens
taaattcctctttgctttg

SEQ ID NO: 3613774 - DNA, 12 bp, Homo sapiens
taaattctaaat

SEQ ID NO: 3613775 - DNA, 16 bp, Homo sapiens
taaattctactaagtt

SEQ ID NO: 3613776 - DNA, 16 bp, Homo sapiens
taaattctcaaagttt

SEQ ID NO: 3613777 - DNA, 21 bp, Homo sapiens
taaattgataacatggaaatg

SEQ ID NO: 3613778 - DNA, 16 bp, Homo sapiens
taaattgatgttgctg

SEQ ID NO: 3613779 - DNA, 18 bp, Homo sapiens
taaattgcagtttacagt

SEQ ID NO: 3613780 - DNA, 21 bp, Homo sapiens
taaattgcagtttacagtatt

SEQ ID NO: 3613781 - DNA, 23 bp, Homo sapiens
taaattggggtttatttcagcaa

SEQ ID NO: 3613782 - DNA, 14 bp, Homo sapiens
taaatttaatcctt

SEQ ID NO: 3613783 - DNA, 15 bp, Homo sapiens
taaatttaatgctgc

SEQ ID NO: 3613784 - DNA, 13 bp, Homo sapiens
taaattttctaaa

SEQ ID NO: 3613785 - DNA, 15 bp, Homo sapiens
taaattttctgaaac

SEQ ID NO: 3613786 - DNA, 18 bp, Homo sapiens
taaatttttaggcaaaga

SEQ ID NO: 3613787 - DNA, 19 bp, Homo sapiens
taaatttttaggcaaagat

SEQ ID NO: 3613788 - DNA, 20 bp, Homo sapiens
taaatttttaggcaaagata

SEQ ID NO: 3613789 - DNA, 15 bp, Homo sapiens
taaattttttacgta

SEQ ID NO: 3613790 - DNA, 22 bp, Homo sapiens
taaattttttacgtagctattt

SEQ ID NO: 3613791 - DNA, 15 bp, Homo sapiens
taaattttttgaaac

SEQ ID NO: 3613792 - DNA, 19 bp, Homo sapiens
taaattttttttggtcaaa

SEQ ID NO: 3613793 - DNA, 11 bp, Homo sapiens
taacaaaatgg

SEQ ID NO: 3613794 - DNA, 12 bp, Homo sapiens
taacaaaatgga

SEQ ID NO: 3613795 - DNA, 15 bp, Homo sapiens
taacaaaatggacat

SEQ ID NO: 3613796 - DNA, 13 bp, Homo sapiens
taacaaacaaatt

SEQ ID NO: 3613797 - DNA, 14 bp, Homo sapiens
taacaatataactg

SEQ ID NO: 3613798 - DNA, 22 bp, Homo sapiens
taacaatgatgaccccggcctg

SEQ ID NO: 3613799 - DNA, 17 bp, Homo sapiens
taacaatgtaataaaaa

SEQ ID NO: 3613800 - DNA, 19 bp, Homo sapiens
taacactaaattgcagttt

SEQ ID NO: 3613801 - DNA, 20 bp, Homo sapiens
taacagatcagaacatgaaa

SEQ ID NO: 3613802 - DNA, 20 bp, Homo sapiens
taacagccctcctctgcact

SEQ ID NO: 3613803 - DNA, 17 bp, Homo sapiens
taacaggatacaggtga

SEQ ID NO: 3613804 - DNA, 20 bp, Homo sapiens
taacaggtattttgtttctt

SEQ ID NO: 3613805 - DNA, 17 bp, Homo sapiens
taacagtggacaaagtt

SEQ ID NO: 3613806 - DNA, 14 bp, Homo sapiens
taacatcaagccat

SEQ ID NO: 3613807 - DNA, 11 bp, Homo sapiens
taacatgggct

SEQ ID NO: 3613808 - DNA, 18 bp, Homo sapiens
taacatgggctcttcact

SEQ ID NO: 3613809 - DNA, 11 bp, Homo sapiens
taaccaagttc

SEQ ID NO: 3613810 - DNA, 14 bp, Homo sapiens
taacccacctctcc

SEQ ID NO: 3613811 - DNA, 20 bp, Homo sapiens
taaccctggtggttgctgtt

SEQ ID NO: 3613812 - DNA, 16 bp, Homo sapiens
taacctgcaaaatctg

SEQ ID NO: 3613813 - DNA, 18 bp, Homo sapiens
taacctgtctcacctgga

SEQ ID NO: 3613814 - DNA, 14 bp, Homo sapiens
taaccttttcaaat

SEQ ID NO: 3613815 - DNA, 22 bp, Homo sapiens
taacggaaagtttttagaatgt

SEQ ID NO: 3613816 - DNA, 12 bp, Homo sapiens
taactaaaataa

SEQ ID NO: 3613817 - DNA, 20 bp, Homo sapiens
taactaaaataattttgtaa

SEQ ID NO: 3613818 - DNA, 21 bp, Homo sapiens
taactaaaataattttgtaat

SEQ ID NO: 3613819 - DNA, 20 bp, Homo sapiens
taactaaagaagaggagaaa

SEQ ID NO: 3613820 - DNA, 15 bp, Homo sapiens
taactaactggcagg

SEQ ID NO: 3613821 - DNA, 23 bp, Homo sapiens
taactactttataactaacatgt

SEQ ID NO: 3613822 - DNA, 15 bp, Homo sapiens
taactattacagtgt

SEQ ID NO: 3613823 - DNA, 21 bp, Homo sapiens
taactattgcatttatatgta

SEQ ID NO: 3613824 - DNA, 14 bp, Homo sapiens
taactgagagaaag

SEQ ID NO: 3613825 - DNA, 14 bp, Homo sapiens
taactgagttatat

SEQ ID NO: 3613826 - DNA, 16 bp, Homo sapiens
taactgagttatattg

SEQ ID NO: 3613827 - DNA, 16 bp, Homo sapiens
taactgtaaagatgaa

SEQ ID NO: 3613828 - DNA, 21 bp, Homo sapiens
taactgtaggtatgatctctt

SEQ ID NO: 3613829 - DNA, 17 bp, Homo sapiens
taacttccaatttacat

SEQ ID NO: 3613830 - DNA, 21 bp, Homo sapiens
taacttcctgctgcaccctgc

SEQ ID NO: 3613831 - DNA, 20 bp, Homo sapiens
taacttcctgtgcctttcct

SEQ ID NO: 3613832 - DNA, 14 bp, Homo sapiens
taacttcctgtgga

SEQ ID NO: 3613833 - DNA, 16 bp, Homo sapiens
taacttctgttttacc

SEQ ID NO: 3613834 - DNA, 20 bp, Homo sapiens
taacttcttgcttctttcta

SEQ ID NO: 3613835 - DNA, 14 bp, Homo sapiens
taacttgagattca

SEQ ID NO: 3613836 - DNA, 18 bp, Homo sapiens
taacttgagattcaagac

SEQ ID NO: 3613837 - DNA, 18 bp, Homo sapiens
taactttaaggatttgaa

SEQ ID NO: 3613838 - DNA, 13 bp, Homo sapiens
taacttttgtaag

SEQ ID NO: 3613839 - DNA, 18 bp, Homo sapiens
taacttttgtaagacaaa

SEQ ID NO: 3613840 - DNA, 16 bp, Homo sapiens
taacttttgtgaatta

SEQ ID NO: 3613841 - DNA, 20 bp, Homo sapiens
taacttttttttctctcttt

SEQ ID NO: 3613842 - DNA, 19 bp, Homo sapiens
taagaaaccttgctctcct

SEQ ID NO: 3613843 - DNA, 17 bp, Homo sapiens
taagaaagaaaatattt

SEQ ID NO: 3613844 - DNA, 17 bp, Homo sapiens
taagaaagtaatttaat

SEQ ID NO: 3613845 - DNA, 23 bp, Homo sapiens
taagaacaagttttggcagccat

SEQ ID NO: 3613846 - DNA, 16 bp, Homo sapiens
taagaactaaaatgtt

SEQ ID NO: 3613847 - DNA, 16 bp, Homo sapiens
taagaagaaggccaga

SEQ ID NO: 3613848 - DNA, 18 bp, Homo sapiens
taagaatagtagatgtgg

SEQ ID NO: 3613849 - DNA, 17 bp, Homo sapiens
taagaatagttctaaaa

SEQ ID NO: 3613850 - DNA, 19 bp, Homo sapiens
taagaatagttctaaaatt

SEQ ID NO: 3613851 - DNA, 19 bp, Homo sapiens
taagacataaacaaagaca

SEQ ID NO: 3613852 - DNA, 21 bp, Homo sapiens
taagacataaacaaagacatt

SEQ ID NO: 3613853 - DNA, 17 bp, Homo sapiens
taagacctggcagctct

SEQ ID NO: 3613854 - DNA, 12 bp, Homo sapiens
taagactggctt

SEQ ID NO: 3613855 - DNA, 13 bp, Homo sapiens
taagactttactt

SEQ ID NO: 3613856 - DNA, 20 bp, Homo sapiens
taagagacacatacagagtg

SEQ ID NO: 3613857 - DNA, 23 bp, Homo sapiens
taagagggcagactgtgaacttg

SEQ ID NO: 3613858 - DNA, 18 bp, Homo sapiens
taagatgtacatttaata

SEQ ID NO: 3613859 - DNA, 18 bp, Homo sapiens
taagcacctaaaacccaa

SEQ ID NO: 3613860 - DNA, 21 bp, Homo sapiens
taagcacctaaaacccaaagg

SEQ ID NO: 3613861 - DNA, 15 bp, Homo sapiens
taagcagaggagggg

SEQ ID NO: 3613862 - DNA, 16 bp, Homo sapiens
taagcagctaaatttt

SEQ ID NO: 3613863 - DNA, 22 bp, Homo sapiens
taagcagctaaattttctgaaa

SEQ ID NO: 3613864 - DNA, 21 bp, Homo sapiens
taagcaggagagaaatttctc

SEQ ID NO: 3613865 - DNA, 15 bp, Homo sapiens
taagcagttcattct

SEQ ID NO: 3613866 - DNA, 12 bp, Homo sapiens
taagcatttgta

SEQ ID NO: 3613867 - DNA, 12 bp, Homo sapiens
taagccaaagaa

SEQ ID NO: 3613868 - DNA, 23 bp, Homo sapiens
taagccaaagaaacaagctgtgc

SEQ ID NO: 3613869 - DNA, 15 bp, Homo sapiens
taagcccccagggcc

SEQ ID NO: 3613870 - DNA, 17 bp, Homo sapiens
taagcccccagggcctc

SEQ ID NO: 3613871 - DNA, 19 bp, Homo sapiens
taagccgcagacctggagc

SEQ ID NO: 3613872 - DNA, 17 bp, Homo sapiens
taagccttacaaaggga

SEQ ID NO: 3613873 - DNA, 22 bp, Homo sapiens
taagctatcacctagcagcctc

SEQ ID NO: 3613874 - DNA, 15 bp, Homo sapiens
taagctttgttctgg

SEQ ID NO: 3613875 - DNA, 14 bp, Homo sapiens
taaggaattatttc

SEQ ID NO: 3613876 - DNA, 20 bp, Homo sapiens
taaggatagtgtgaagatct

SEQ ID NO: 3613877 - DNA, 19 bp, Homo sapiens
taaggatttttatgtacat

SEQ ID NO: 3613878 - DNA, 20 bp, Homo sapiens
taaggcacagtgggagctga

SEQ ID NO: 3613879 - DNA, 10 bp, Homo sapiens
taaggctgta

SEQ ID NO: 3613880 - DNA, 14 bp, Homo sapiens
taaggctgtacata

SEQ ID NO: 3613881 - DNA, 14 bp, Homo sapiens
taagggcagtgccc

SEQ ID NO: 3613882 - DNA, 20 bp, Homo sapiens
taagggcagtgcccatgtgt

SEQ ID NO: 3613883 - DNA, 16 bp, Homo sapiens
taaggggcccggccag

SEQ ID NO: 3613884 - DNA, 14 bp, Homo sapiens
taaggtatatttag

SEQ ID NO: 3613885 - DNA, 21 bp, Homo sapiens
taaggttatctacttttactc

SEQ ID NO: 3613886 - DNA, 19 bp, Homo sapiens
taagtaaaagtctacctgt

SEQ ID NO: 3613887 - DNA, 21 bp, Homo sapiens
taagtaaaagtctacctgtgt

SEQ ID NO: 3613888 - DNA, 21 bp, Homo sapiens
taagtaacttatttatgaaag

SEQ ID NO: 3613889 - DNA, 15 bp, Homo sapiens
taagtgaaaatctta

SEQ ID NO: 3613890 - DNA, 22 bp, Homo sapiens
taagtgaactaccatgctttgt

SEQ ID NO: 3613891 - DNA, 16 bp, Homo sapiens
taagtggctgccttct

SEQ ID NO: 3613892 - DNA, 18 bp, Homo sapiens
taagtgtacatatgtgct

SEQ ID NO: 3613893 - DNA, 17 bp, Homo sapiens
taagttagttccactga

SEQ ID NO: 3613894 - DNA, 19 bp, Homo sapiens
taagttagttccactgaga

SEQ ID NO: 3613895 - DNA, 20 bp, Homo sapiens
taagttagttccactgagac

SEQ ID NO: 3613896 - DNA, 13 bp, Homo sapiens
taagttattttat

SEQ ID NO: 3613897 - DNA, 15 bp, Homo sapiens
taagttattttatga

SEQ ID NO: 3613898 - DNA, 23 bp, Homo sapiens
taagttattttatgacatgaaaa

SEQ ID NO: 3613899 - DNA, 14 bp, Homo sapiens
taataaaaagcctc

SEQ ID NO: 3613900 - DNA, 18 bp, Homo sapiens
taataaacactgttttat

SEQ ID NO: 3613901 - DNA, 13 bp, Homo sapiens
taataaactctct

SEQ ID NO: 3613902 - DNA, 18 bp, Homo sapiens
taataaagagaaatatat

SEQ ID NO: 3613903 - DNA, 14 bp, Homo sapiens
taataaatcacaca

SEQ ID NO: 3613904 - DNA, 13 bp, Homo sapiens
taataaattgctt

SEQ ID NO: 3613905 - DNA, 14 bp, Homo sapiens
taataatgaagtag

SEQ ID NO: 3613906 - DNA, 19 bp, Homo sapiens
taataatgaagtagaagtt

SEQ ID NO: 3613907 - DNA, 20 bp, Homo sapiens
taatagaataaaggcagttt

SEQ ID NO: 3613908 - DNA, 22 bp, Homo sapiens
taatagaataaaggcagttttc

SEQ ID NO: 3613909 - DNA, 22 bp, Homo sapiens
taatagactgtaacttccaaat

SEQ ID NO: 3613910 - DNA, 14 bp, Homo sapiens
taataggtcatatg

SEQ ID NO: 3613911 - DNA, 16 bp, Homo sapiens
taatagtttttcactt

SEQ ID NO: 3613912 - DNA, 24 bp, Homo sapiens
taatatgacaaacatcattgttta

SEQ ID NO: 3613913 - DNA, 16 bp, Homo sapiens
taatattgacttgtat

SEQ ID NO: 3613914 - DNA, 14 bp, Homo sapiens
taatattttatgtg

SEQ ID NO: 3613915 - DNA, 18 bp, Homo sapiens
taatcaaattctgtctgg

SEQ ID NO: 3613916 - DNA, 13 bp, Homo sapiens
taatcaagagaaa

SEQ ID NO: 3613917 - DNA, 15 bp, Homo sapiens
taatcaagagaaact

SEQ ID NO: 3613918 - DNA, 19 bp, Homo sapiens
taatcaggtcctcagagaa

SEQ ID NO: 3613919 - DNA, 22 bp, Homo sapiens
taatcaggtcctcagagaattt

SEQ ID NO: 3613920 - DNA, 22 bp, Homo sapiens
taatcatacaaactctcaccat

SEQ ID NO: 3613921 - DNA, 14 bp, Homo sapiens
taatcatatttgaa

SEQ ID NO: 3613922 - DNA, 15 bp, Homo sapiens
taatcatatttgaaa

SEQ ID NO: 3613923 - DNA, 19 bp, Homo sapiens
taatcattttaaattccac

SEQ ID NO: 3613924 - DNA, 15 bp, Homo sapiens
taatccatttcagga

SEQ ID NO: 3613925 - DNA, 19 bp, Homo sapiens
taatccatttcaggactct

SEQ ID NO: 3613926 - DNA, 19 bp, Homo sapiens
taatcctgtaccaaatctg

SEQ ID NO: 3613927 - DNA, 23 bp, Homo sapiens
taatctgagcaggtacatttctg

SEQ ID NO: 3613928 - DNA, 16 bp, Homo sapiens
taatctgatgtataat

SEQ ID NO: 3613929 - DNA, 17 bp, Homo sapiens
taatctgatgtataatg

SEQ ID NO: 3613930 - DNA, 18 bp, Homo sapiens
taatctggactcctctgt

SEQ ID NO: 3613931 - DNA, 21 bp, Homo sapiens
taatctgtgctgtttcaaagt

SEQ ID NO: 3613932 - DNA, 22 bp, Homo sapiens
taatctgtgctgtttcaaagtt

SEQ ID NO: 3613933 - DNA, 17 bp, Homo sapiens
taatcttaatgtctggt

SEQ ID NO: 3613934 - DNA, 13 bp, Homo sapiens
taatcttagtgta

SEQ ID NO: 3613935 - DNA, 15 bp, Homo sapiens
taatcttagtgtatg

SEQ ID NO: 3613936 - DNA, 18 bp, Homo sapiens
taatcttagtgtatgatt

SEQ ID NO: 3613937 - DNA, 15 bp, Homo sapiens
taatcttatttagga

SEQ ID NO: 3613938 - DNA, 22 bp, Homo sapiens
taatcttttttttaaaaaaact

SEQ ID NO: 3613939 - DNA, 13 bp, Homo sapiens
taatgaaatggag

SEQ ID NO: 3613940 - DNA, 15 bp, Homo sapiens
taatgaaatggagga

SEQ ID NO: 3613941 - DNA, 14 bp, Homo sapiens
taatgacaaaagat

SEQ ID NO: 3613942 - DNA, 22 bp, Homo sapiens
taatgacaacacttaatagcaa

SEQ ID NO: 3613943 - DNA, 13 bp, Homo sapiens
taatgacagcctt

SEQ ID NO: 3613944 - DNA, 24 bp, Homo sapiens
taatgagtgcacctgcctccacca

SEQ ID NO: 3613945 - DNA, 12 bp, Homo sapiens
taatgctgcctt

SEQ ID NO: 3613946 - DNA, 15 bp, Homo sapiens
taatgggattttctt

SEQ ID NO: 3613947 - DNA, 22 bp, Homo sapiens
taatggggtcctggccatccca

SEQ ID NO: 3613948 - DNA, 16 bp, Homo sapiens
taatggtttattcttt

SEQ ID NO: 3613949 - DNA, 13 bp, Homo sapiens
taatgtatcaaac

SEQ ID NO: 3613950 - DNA, 17 bp, Homo sapiens
taatgtatgttaccaaa

SEQ ID NO: 3613951 - DNA, 17 bp, Homo sapiens
taatgtcagtatttcaa

SEQ ID NO: 3613952 - DNA, 20 bp, Homo sapiens
taatgtctggtgtttgtcat

SEQ ID NO: 3613953 - DNA, 21 bp, Homo sapiens
taatgttattttccttctgaa

SEQ ID NO: 3613954 - DNA, 19 bp, Homo sapiens
taatgttccagtttgaaga

SEQ ID NO: 3613955 - DNA, 22 bp, Homo sapiens
taatgttcttatgcaaaatgga

SEQ ID NO: 3613956 - DNA, 15 bp, Homo sapiens
taatgtttgatagta

SEQ ID NO: 3613957 - DNA, 14 bp, Homo sapiens
taattaaaaactgt

SEQ ID NO: 3613958 - DNA, 21 bp, Homo sapiens
taattaaaattggtaaaaata

SEQ ID NO: 3613959 - DNA, 15 bp, Homo sapiens
taattaattgtcatt

SEQ ID NO: 3613960 - DNA, 21 bp, Homo sapiens
taattactgctataaataggt

SEQ ID NO: 3613961 - DNA, 22 bp, Homo sapiens
taattagtgccacttaatgtat

SEQ ID NO: 3613962 - DNA, 15 bp, Homo sapiens
taattatgcagtgtt

SEQ ID NO: 3613963 - DNA, 18 bp, Homo sapiens
taattattgatgttttca

SEQ ID NO: 3613964 - DNA, 17 bp, Homo sapiens
taattcaagcctctaaa

SEQ ID NO: 3613965 - DNA, 21 bp, Homo sapiens
taattcacagtgctcttttct

SEQ ID NO: 3613966 - DNA, 13 bp, Homo sapiens
taattcacgtgct

SEQ ID NO: 3613967 - DNA, 18 bp, Homo sapiens
taattcaggttttttagt

SEQ ID NO: 3613968 - DNA, 12 bp, Homo sapiens
taattctgaaac

SEQ ID NO: 3613969 - DNA, 17 bp, Homo sapiens
taattctggagatactg

SEQ ID NO: 3613970 - DNA, 17 bp, Homo sapiens
taattctgggaagggag

SEQ ID NO: 3613971 - DNA, 19 bp, Homo sapiens
taattcttcagcgtaaaat

SEQ ID NO: 3613972 - DNA, 22 bp, Homo sapiens
taattcttcagcgtaaaatggt

SEQ ID NO: 3613973 - DNA, 20 bp, Homo sapiens
taattgccagcaaataaata

SEQ ID NO: 3613974 - DNA, 16 bp, Homo sapiens
taattggaagtgcagt

SEQ ID NO: 3613975 - DNA, 16 bp, Homo sapiens
taattgggaactgaaa

SEQ ID NO: 3613976 - DNA, 18 bp, Homo sapiens
taattgggaactgaaatc

SEQ ID NO: 3613977 - DNA, 18 bp, Homo sapiens
taattgtaattccaaaat

SEQ ID NO: 3613978 - DNA, 15 bp, Homo sapiens
taattgtacaataaa

SEQ ID NO: 3613979 - DNA, 13 bp, Homo sapiens
taattgtgcccct

SEQ ID NO: 3613980 - DNA, 16 bp, Homo sapiens
taattgttacaatttt

SEQ ID NO: 3613981 - DNA, 17 bp, Homo sapiens
taatttaaaaacacaaa

SEQ ID NO: 3613982 - DNA, 14 bp, Homo sapiens
taatttaaaaatat

SEQ ID NO: 3613983 - DNA, 22 bp, Homo sapiens
taatttaaaaatatatttataa

SEQ ID NO: 3613984 - DNA, 16 bp, Homo sapiens
taatttaaaattgtga

SEQ ID NO: 3613985 - DNA, 19 bp, Homo sapiens
taatttaaaattgtgatgt

SEQ ID NO: 3613986 - DNA, 20 bp, Homo sapiens
taatttaaaattgtgatgtg

SEQ ID NO: 3613987 - DNA, 19 bp, Homo sapiens
taatttaacttattgctag

SEQ ID NO: 3613988 - DNA, 17 bp, Homo sapiens
taatttaatttttcctt

SEQ ID NO: 3613989 - DNA, 21 bp, Homo sapiens
taatttacctaagattacaaa

SEQ ID NO: 3613990 - DNA, 15 bp, Homo sapiens
taatttagaagatat

SEQ ID NO: 3613991 - DNA, 20 bp, Homo sapiens
taatttagaagatattattt

SEQ ID NO: 3613992 - DNA, 14 bp, Homo sapiens
taatttataatgta

SEQ ID NO: 3613993 - DNA, 15 bp, Homo sapiens
taatttataatgtat

SEQ ID NO: 3613994 - DNA, 18 bp, Homo sapiens
taatttataatgtatttg

SEQ ID NO: 3613995 - DNA, 22 bp, Homo sapiens
taatttatttcaataaatcttt

SEQ ID NO: 3613996 - DNA, 14 bp, Homo sapiens
taatttccttcagg

SEQ ID NO: 3613997 - DNA, 15 bp, Homo sapiens
taatttccttcaggc

SEQ ID NO: 3613998 - DNA, 19 bp, Homo sapiens
taatttctgccaataaatt

SEQ ID NO: 3613999 - DNA, 20 bp, Homo sapiens
taatttgaaggtagaatgtt

SEQ ID NO: 3614000 - DNA, 22 bp, Homo sapiens
taatttgaggacaaccattcca

SEQ ID NO: 3614001 - DNA, 22 bp, Homo sapiens
taatttgtaaaacttctgctcg

SEQ ID NO: 3614002 - DNA, 23 bp, Homo sapiens
taatttgtaaaacttctgctcgt

SEQ ID NO: 3614003 - DNA, 15 bp, Homo sapiens
taatttgtaagaata

SEQ ID NO: 3614004 - DNA, 16 bp, Homo sapiens
taattttcacttctgt

SEQ ID NO: 3614005 - DNA, 22 bp, Homo sapiens
taattttgaagtgctgtttatt

SEQ ID NO: 3614006 - DNA, 12 bp, Homo sapiens
taattttgctaa

SEQ ID NO: 3614007 - DNA, 13 bp, Homo sapiens
taattttgctaac

SEQ ID NO: 3614008 - DNA, 15 bp, Homo sapiens
taattttgctaactg

SEQ ID NO: 3614009 - DNA, 17 bp, Homo sapiens
taattttgctaactggg

SEQ ID NO: 3614010 - DNA, 19 bp, Homo sapiens
taattttgtaatgtatcaa

SEQ ID NO: 3614011 - DNA, 13 bp, Homo sapiens
taattttgtgtaa

SEQ ID NO: 3614012 - DNA, 14 bp, Homo sapiens
taatttttcaaaat

SEQ ID NO: 3614013 - DNA, 13 bp, Homo sapiens
taatttttccttt

SEQ ID NO: 3614014 - DNA, 20 bp, Homo sapiens
taatttttgctgaattcctt

SEQ ID NO: 3614015 - DNA, 21 bp, Homo sapiens
taatttttttcacctagattt

SEQ ID NO: 3614016 - DNA, 14 bp, Homo sapiens
tacaaaaacacagc

SEQ ID NO: 3614017 - DNA, 17 bp, Homo sapiens
tacaaaaattagccggg

SEQ ID NO: 3614018 - DNA, 12 bp, Homo sapiens
tacaaaacatta

SEQ ID NO: 3614019 - DNA, 18 bp, Homo sapiens
tacaaacaataagaacaa

SEQ ID NO: 3614020 - DNA, 18 bp, Homo sapiens
tacaaactcagatccttg

SEQ ID NO: 3614021 - DNA, 14 bp, Homo sapiens
tacaaactctcacc

SEQ ID NO: 3614022 - DNA, 23 bp, Homo sapiens
tacaaagaaccatgcaggaagga

SEQ ID NO: 3614023 - DNA, 21 bp, Homo sapiens
tacaaagggaaagcctctggc

SEQ ID NO: 3614024 - DNA, 17 bp, Homo sapiens
tacaaagttaaaattgt

SEQ ID NO: 3614025 - DNA, 23 bp, Homo sapiens
tacaaatgcctccaaagtattgt

SEQ ID NO: 3614026 - DNA, 13 bp, Homo sapiens
tacaaatgcctta

SEQ ID NO: 3614027 - DNA, 20 bp, Homo sapiens
tacaaatgccttaaaatgga

SEQ ID NO: 3614028 - DNA, 19 bp, Homo sapiens
tacaaatttataaaggtct

SEQ ID NO: 3614029 - DNA, 21 bp, Homo sapiens
tacaacagaaaccagaaaagc

SEQ ID NO: 3614030 - DNA, 11 bp, Homo sapiens
tacaataaatt

SEQ ID NO: 3614031 - DNA, 16 bp, Homo sapiens
tacaatattgtgcatg

SEQ ID NO: 3614032 - DNA, 22 bp, Homo sapiens
tacaatattgtgcatgctagtg

SEQ ID NO: 3614033 - DNA, 23 bp, Homo sapiens
tacaatgatatccaatattaaaa

SEQ ID NO: 3614034 - DNA, 13 bp, Homo sapiens
tacaatgtagatg

SEQ ID NO: 3614035 - DNA, 23 bp, Homo sapiens
tacacaaagaacttgctgctgcc

SEQ ID NO: 3614036 - DNA, 13 bp, Homo sapiens
tacacaattctta

SEQ ID NO: 3614037 - DNA, 22 bp, Homo sapiens
tacacacacacagacatatata

SEQ ID NO: 3614038 - DNA, 16 bp, Homo sapiens
tacacactcaaatcaa

SEQ ID NO: 3614039 - DNA, 18 bp, Homo sapiens
tacacactggtacttaga

SEQ ID NO: 3614040 - DNA, 20 bp, Homo sapiens
tacacatttttaaattgtta

SEQ ID NO: 3614041 - DNA, 20 bp, Homo sapiens
tacaccagcattccttttga

SEQ ID NO: 3614042 - DNA, 14 bp, Homo sapiens
tacacccaaagagg

SEQ ID NO: 3614043 - DNA, 18 bp, Homo sapiens
tacacccagttctgaata

SEQ ID NO: 3614044 - DNA, 19 bp, Homo sapiens
tacacccatgaaagaaaac

SEQ ID NO: 3614045 - DNA, 15 bp, Homo sapiens
tacaccctttccagg

SEQ ID NO: 3614046 - DNA, 15 bp, Homo sapiens
tacaccgggcctgga

SEQ ID NO: 3614047 - DNA, 18 bp, Homo sapiens
tacacctttctcctttgt

SEQ ID NO: 3614048 - DNA, 15 bp, Homo sapiens
tacactgtaagcttt

SEQ ID NO: 3614049 - DNA, 18 bp, Homo sapiens
tacactgtaagctttgtt

SEQ ID NO: 3614050 - DNA, 20 bp, Homo sapiens
tacactgtaagctttgttct

SEQ ID NO: 3614051 - DNA, 15 bp, Homo sapiens
tacagaaaatatggt

SEQ ID NO: 3614052 - DNA, 13 bp, Homo sapiens
tacagaaactgat

SEQ ID NO: 3614053 - DNA, 14 bp, Homo sapiens
tacagaaactgatg

SEQ ID NO: 3614054 - DNA, 22 bp, Homo sapiens
tacagacagcttacaggagcca

SEQ ID NO: 3614055 - DNA, 15 bp, Homo sapiens
tacagactccatctc

SEQ ID NO: 3614056 - DNA, 20 bp, Homo sapiens
tacagactccatctcttctg

SEQ ID NO: 3614057 - DNA, 11 bp, Homo sapiens
tacagaggaga

SEQ ID NO: 3614058 - DNA, 12 bp, Homo sapiens
tacagaggagat

SEQ ID NO: 3614059 - DNA, 13 bp, Homo sapiens
tacagaggggaca

SEQ ID NO: 3614060 - DNA, 13 bp, Homo sapiens
tacagcaaaagat

SEQ ID NO: 3614061 - DNA, 19 bp, Homo sapiens
tacagcctatagtaaatgt

SEQ ID NO: 3614062 - DNA, 21 bp, Homo sapiens
tacagcctatagtaaatgtgt

SEQ ID NO: 3614063 - DNA, 13 bp, Homo sapiens
tacagctgtgctc

SEQ ID NO: 3614064 - DNA, 15 bp, Homo sapiens
tacagctgtgctcca

SEQ ID NO: 3614065 - DNA, 14 bp, Homo sapiens
tacaggagaggcag

SEQ ID NO: 3614066 - DNA, 16 bp, Homo sapiens
tacaggagaggcagca

SEQ ID NO: 3614067 - DNA, 18 bp, Homo sapiens
tacaggagaggcagcatg

SEQ ID NO: 3614068 - DNA, 12 bp, Homo sapiens
tacaggagccag

SEQ ID NO: 3614069 - DNA, 20 bp, Homo sapiens
tacaggggtagtttgtttta

SEQ ID NO: 3614070 - DNA, 20 bp, Homo sapiens
tacaggtgacagtgaagata

SEQ ID NO: 3614071 - DNA, 19 bp, Homo sapiens
tacaggtttgcatttgttt

SEQ ID NO: 3614072 - DNA, 17 bp, Homo sapiens
tacagtgactccctggg

SEQ ID NO: 3614073 - DNA, 18 bp, Homo sapiens
tacagtgactccctggga

SEQ ID NO: 3614074 - DNA, 16 bp, Homo sapiens
tacataactcctgtcc

SEQ ID NO: 3614075 - DNA, 18 bp, Homo sapiens
tacataactcctgtccct

SEQ ID NO: 3614076 - DNA, 20 bp, Homo sapiens
tacataactcctgtcccttt

SEQ ID NO: 3614077 - DNA, 22 bp, Homo sapiens
tacataactcctgtcccttttc

SEQ ID NO: 3614078 - DNA, 13 bp, Homo sapiens
tacataatggtac

SEQ ID NO: 3614079 - DNA, 20 bp, Homo sapiens
tacatacaccagcattcctt

SEQ ID NO: 3614080 - DNA, 19 bp, Homo sapiens
tacatactatgaaatatgt

SEQ ID NO: 3614081 - DNA, 15 bp, Homo sapiens
tacatatatttttaa

SEQ ID NO: 3614082 - DNA, 12 bp, Homo sapiens
tacatatgtaaa

SEQ ID NO: 3614083 - DNA, 17 bp, Homo sapiens
tacatatgtaaacataa

SEQ ID NO: 3614084 - DNA, 19 bp, Homo sapiens
tacatccttgattacttcc

SEQ ID NO: 3614085 - DNA, 14 bp, Homo sapiens
tacatgaagcagaa

SEQ ID NO: 3614086 - DNA, 13 bp, Homo sapiens
gcagcaggagggg

SEQ ID NO: 3614087 - DNA, 12 bp, Homo sapiens
gcagcaggccag

SEQ ID NO: 3614088 - DNA, 13 bp, Homo sapiens
gcagcaggccaga

SEQ ID NO: 3614089 - DNA, 15 bp, Homo sapiens
gcagcaggccagaga

SEQ ID NO: 3614090 - DNA, 19 bp, Homo sapiens
gcagcaggccagagaaagc

SEQ ID NO: 3614091 - DNA, 14 bp, Homo sapiens
gcagcaggcctctg

SEQ ID NO: 3614092 - DNA, 15 bp, Homo sapiens
gcagcaggcctctgg

SEQ ID NO: 3614093 - DNA, 16 bp, Homo sapiens
gcagcaggcctctggg

SEQ ID NO: 3614094 - DNA, 14 bp, Homo sapiens
gcagcaggctcagg

SEQ ID NO: 3614095 - DNA, 15 bp, Homo sapiens
gcagcagggatgccc

SEQ ID NO: 3614096 - DNA, 20 bp, Homo sapiens
gcagcagggatgccctggag

SEQ ID NO: 3614097 - DNA, 14 bp, Homo sapiens
gcagcatggaaaaa

SEQ ID NO: 3614098 - DNA, 15 bp, Homo sapiens
gcagcatggaaaaat

SEQ ID NO: 3614099 - DNA, 13 bp, Homo sapiens
gcagcatttacta

SEQ ID NO: 3614100 - DNA, 14 bp, Homo sapiens
gcagcatttactat

SEQ ID NO: 3614101 - DNA, 13 bp, Homo sapiens
gcagcatttcact

SEQ ID NO: 3614102 - DNA, 14 bp, Homo sapiens
gcagcatttcactt

SEQ ID NO: 3614103 - DNA, 13 bp, Homo sapiens
gcagccatatatg

SEQ ID NO: 3614104 - DNA, 13 bp, Homo sapiens
gcagcccattccc

SEQ ID NO: 3614105 - DNA, 15 bp, Homo sapiens
gcagccccaggagaa

SEQ ID NO: 3614106 - DNA, 16 bp, Homo sapiens
gcagccccaggagaag

SEQ ID NO: 3614107 - DNA, 20 bp, Homo sapiens
gcagccccagggcctgcgga

SEQ ID NO: 3614108 - DNA, 18 bp, Homo sapiens
gcagccccgttttgggga

SEQ ID NO: 3614109 - DNA, 13 bp, Homo sapiens
gcagccctgcttt

SEQ ID NO: 3614110 - DNA, 23 bp, Homo sapiens
gcagcccttgctttcggagctcc

SEQ ID NO: 3614111 - DNA, 15 bp, Homo sapiens
gcagccgtgccttca

SEQ ID NO: 3614112 - DNA, 17 bp, Homo sapiens
gcagccgtgccttcagc

SEQ ID NO: 3614113 - DNA, 19 bp, Homo sapiens
gcagcctaagaagaaggcc

SEQ ID NO: 3614114 - DNA, 20 bp, Homo sapiens
gcagcctaagaagaaggcca

SEQ ID NO: 3614115 - DNA, 21 bp, Homo sapiens
gcagcctcaacctcctgggtt

SEQ ID NO: 3614116 - DNA, 21 bp, Homo sapiens
gcagcctcacactggcgtctg

SEQ ID NO: 3614117 - DNA, 20 bp, Homo sapiens
gcagcctctctggctggtct

SEQ ID NO: 3614118 - DNA, 23 bp, Homo sapiens
gcagcctgcgccaccgcccagag

SEQ ID NO: 3614119 - DNA, 14 bp, Homo sapiens
gcagcgcagggctg

SEQ ID NO: 3614120 - DNA, 15 bp, Homo sapiens
gcagcgcagggctgg

SEQ ID NO: 3614121 - DNA, 16 bp, Homo sapiens
gcagcgcatgtgtgca

SEQ ID NO: 3614122 - DNA, 15 bp, Homo sapiens
gcagcgcctttccca

SEQ ID NO: 3614123 - DNA, 13 bp, Homo sapiens
gcagcggctcctg

SEQ ID NO: 3614124 - DNA, 14 bp, Homo sapiens
gcagcggctcctgc

SEQ ID NO: 3614125 - DNA, 13 bp, Homo sapiens
gcagcgggcggag

SEQ ID NO: 3614126 - DNA, 15 bp, Homo sapiens
gcagcgggcggaggg

SEQ ID NO: 3614127 - DNA, 22 bp, Homo sapiens
gcagcgggcggaggggatccag

SEQ ID NO: 3614128 - DNA, 22 bp, Homo sapiens
gcagcggggtggggggggagag

SEQ ID NO: 3614129 - DNA, 14 bp, Homo sapiens
gcagctagtgcctt

SEQ ID NO: 3614130 - DNA, 16 bp, Homo sapiens
gcagctatttcagcct

SEQ ID NO: 3614131 - DNA, 17 bp, Homo sapiens
gcagctatttcagcctc

SEQ ID NO: 3614132 - DNA, 19 bp, Homo sapiens
gcagctcaagggctggcac

SEQ ID NO: 3614133 - DNA, 15 bp, Homo sapiens
gcagctccctcctca

SEQ ID NO: 3614134 - DNA, 20 bp, Homo sapiens
gcagctctggacagccccac

SEQ ID NO: 3614135 - DNA, 12 bp, Homo sapiens
gcagctgaaatt

SEQ ID NO: 3614136 - DNA, 13 bp, Homo sapiens
gcagctgatgctg

SEQ ID NO: 3614137 - DNA, 11 bp, Homo sapiens
gcagctgccta

SEQ ID NO: 3614138 - DNA, 11 bp, Homo sapiens
gcagctgctgt

SEQ ID NO: 3614139 - DNA, 12 bp, Homo sapiens
gcagctgctgtg

SEQ ID NO: 3614140 - DNA, 13 bp, Homo sapiens
gcagctgctgtgg

SEQ ID NO: 3614141 - DNA, 22 bp, Homo sapiens
gcagctgctgtgggtggggccc

SEQ ID NO: 3614142 - DNA, 13 bp, Homo sapiens
gcagctggccccc

SEQ ID NO: 3614143 - DNA, 20 bp, Homo sapiens
gcagcttgaatggtttttct

SEQ ID NO: 3614144 - DNA, 12 bp, Homo sapiens
gcagcttgctgg

SEQ ID NO: 3614145 - DNA, 17 bp, Homo sapiens
gcagcttgctgggcttt

SEQ ID NO: 3614146 - DNA, 16 bp, Homo sapiens
gcagctttaaaaaaat

SEQ ID NO: 3614147 - DNA, 17 bp, Homo sapiens
gcaggaaagccacatct

SEQ ID NO: 3614148 - DNA, 18 bp, Homo sapiens
gcaggaaggaacaaagac

SEQ ID NO: 3614149 - DNA, 16 bp, Homo sapiens
gcaggaatttcttttt

SEQ ID NO: 3614150 - DNA, 12 bp, Homo sapiens
gcaggaccctgt

SEQ ID NO: 3614151 - DNA, 15 bp, Homo sapiens
gcaggactcctggca

SEQ ID NO: 3614152 - DNA, 22 bp, Homo sapiens
gcaggagagactgagcagccgc

SEQ ID NO: 3614153 - DNA, 14 bp, Homo sapiens
gcaggagcccccct

SEQ ID NO: 3614154 - DNA, 18 bp, Homo sapiens
gcaggagccccgccacag

SEQ ID NO: 3614155 - DNA, 16 bp, Homo sapiens
gcaggagtctctgcca

SEQ ID NO: 3614156 - DNA, 17 bp, Homo sapiens
gcaggagtctctgccag

SEQ ID NO: 3614157 - DNA, 21 bp, Homo sapiens
gcaggagtctctgccagttac

SEQ ID NO: 3614158 - DNA, 15 bp, Homo sapiens
gcaggagtgtcctgc

SEQ ID NO: 3614159 - DNA, 17 bp, Homo sapiens
gcaggagtgtcctgccc

SEQ ID NO: 3614160 - DNA, 18 bp, Homo sapiens
gcaggattctctgcagcc

SEQ ID NO: 3614161 - DNA, 14 bp, Homo sapiens
gcaggcaccgccac

SEQ ID NO: 3614162 - DNA, 14 bp, Homo sapiens
gcaggccagagaaa

SEQ ID NO: 3614163 - DNA, 15 bp, Homo sapiens
gcaggccaggccagc

SEQ ID NO: 3614164 - DNA, 16 bp, Homo sapiens
gcaggccaggccagct

SEQ ID NO: 3614165 - DNA, 17 bp, Homo sapiens
gcaggccaggccagctg

SEQ ID NO: 3614166 - DNA, 17 bp, Homo sapiens
gcaggcccactccccag

SEQ ID NO: 3614167 - DNA, 22 bp, Homo sapiens
gcaggcccatgggaggctggag

SEQ ID NO: 3614168 - DNA, 22 bp, Homo sapiens
gcaggcctccaacgcccctgtg

SEQ ID NO: 3614169 - DNA, 12 bp, Homo sapiens
gcaggcctctgg

SEQ ID NO: 3614170 - DNA, 19 bp, Homo sapiens
gcaggcctctgggacccac

SEQ ID NO: 3614171 - DNA, 22 bp, Homo sapiens
gcaggcgatggggcaagacaga

SEQ ID NO: 3614172 - DNA, 15 bp, Homo sapiens
gcaggctactgtcag

SEQ ID NO: 3614173 - DNA, 13 bp, Homo sapiens
gcaggcttgtggc

SEQ ID NO: 3614174 - DNA, 19 bp, Homo sapiens
gcagggaaggacaggaccc

SEQ ID NO: 3614175 - DNA, 21 bp, Homo sapiens
gcagggaaggacaggaccctc

SEQ ID NO: 3614176 - DNA, 16 bp, Homo sapiens
gcagggaatgcagcag

SEQ ID NO: 3614177 - DNA, 16 bp, Homo sapiens
gcagggacctgagagc

SEQ ID NO: 3614178 - DNA, 17 bp, Homo sapiens
gcagggacctgagagca

SEQ ID NO: 3614179 - DNA, 13 bp, Homo sapiens
gcagggagggctt

SEQ ID NO: 3614180 - DNA, 14 bp, Homo sapiens
gcagggatctgccc

SEQ ID NO: 3614181 - DNA, 17 bp, Homo sapiens
gcagggccacctgcagg

SEQ ID NO: 3614182 - DNA, 20 bp, Homo sapiens
gcagggccacctgcaggacc

SEQ ID NO: 3614183 - DNA, 22 bp, Homo sapiens
gcagggccatctgactgccaag

SEQ ID NO: 3614184 - DNA, 15 bp, Homo sapiens
gcagggccgggcagg

SEQ ID NO: 3614185 - DNA, 14 bp, Homo sapiens
gcagggcggggctg

SEQ ID NO: 3614186 - DNA, 13 bp, Homo sapiens
gcagggcttctcc

SEQ ID NO: 3614187 - DNA, 18 bp, Homo sapiens
gcaggggagacaggagcc

SEQ ID NO: 3614188 - DNA, 19 bp, Homo sapiens
gcaggggagacaggagcct

SEQ ID NO: 3614189 - DNA, 23 bp, Homo sapiens
gcagggggccccgccagggctgg

SEQ ID NO: 3614190 - DNA, 13 bp, Homo sapiens
gcagggggccctg

SEQ ID NO: 3614191 - DNA, 16 bp, Homo sapiens
gcagggtccacagctg

SEQ ID NO: 3614192 - DNA, 21 bp, Homo sapiens
gcaggtacatttctgattctg

SEQ ID NO: 3614193 - DNA, 17 bp, Homo sapiens
gcaggtctcctctggga

SEQ ID NO: 3614194 - DNA, 9 bp, Homo sapiens
gcaggtgct

SEQ ID NO: 3614195 - DNA, 16 bp, Homo sapiens
gcaggtgctcatgctg

SEQ ID NO: 3614196 - DNA, 15 bp, Homo sapiens
gcaggtgcttttggc

SEQ ID NO: 3614197 - DNA, 21 bp, Homo sapiens
gcaggtgcttttggcagagac

SEQ ID NO: 3614198 - DNA, 22 bp, Homo sapiens
gcaggtgcttttggcagagacc

SEQ ID NO: 3614199 - DNA, 21 bp, Homo sapiens
gcaggtgtgggatctggggag

SEQ ID NO: 3614200 - DNA, 15 bp, Homo sapiens
gcaggtgttctgctg

SEQ ID NO: 3614201 - DNA, 21 bp, Homo sapiens
gcaggttccccaagggccctg

SEQ ID NO: 3614202 - DNA, 23 bp, Homo sapiens
gcaggttccccaagggccctggc

SEQ ID NO: 3614203 - DNA, 16 bp, Homo sapiens
gcagtaaaacacattt

SEQ ID NO: 3614204 - DNA, 19 bp, Homo sapiens
gcagtacaaatgtttttca

SEQ ID NO: 3614205 - DNA, 14 bp, Homo sapiens
gcagtcccacactg

SEQ ID NO: 3614206 - DNA, 15 bp, Homo sapiens
gcagtcccacactgt

SEQ ID NO: 3614207 - DNA, 18 bp, Homo sapiens
gcagtcccacactgtgca

SEQ ID NO: 3614208 - DNA, 13 bp, Homo sapiens
gcagtcctggagg

SEQ ID NO: 3614209 - DNA, 14 bp, Homo sapiens
gcagtcctggaggc

SEQ ID NO: 3614210 - DNA, 16 bp, Homo sapiens
gcagtcgcctgcctgc

SEQ ID NO: 3614211 - DNA, 22 bp, Homo sapiens
gcagtctaaattttctaaataa

SEQ ID NO: 3614212 - DNA, 17 bp, Homo sapiens
gcagtctccttcagcac

SEQ ID NO: 3614213 - DNA, 16 bp, Homo sapiens
gcagtgatgtttgcca

SEQ ID NO: 3614214 - DNA, 16 bp, Homo sapiens
gcagtggcaggggagc

SEQ ID NO: 3614215 - DNA, 21 bp, Homo sapiens
gcagtgggacagggcatggcc

SEQ ID NO: 3614216 - DNA, 13 bp, Homo sapiens
gcagtgggtggat

SEQ ID NO: 3614217 - DNA, 18 bp, Homo sapiens
gcagtgttgcgtttttcc

SEQ ID NO: 3614218 - DNA, 23 bp, Homo sapiens
gcagttactccctacactgatgc

SEQ ID NO: 3614219 - DNA, 23 bp, Homo sapiens
gcagttcagaatggcagtcctgg

SEQ ID NO: 3614220 - DNA, 14 bp, Homo sapiens
gcagtttccagaga

SEQ ID NO: 3614221 - DNA, 16 bp, Homo sapiens
gcagtttcctcagtga

SEQ ID NO: 3614222 - DNA, 18 bp, Homo sapiens
gcagtttcctcagtgatg

SEQ ID NO: 3614223 - DNA, 17 bp, Homo sapiens
gcagtttcttttcacat

SEQ ID NO: 3614224 - DNA, 12 bp, Homo sapiens
gcagttttttga

SEQ ID NO: 3614225 - DNA, 18 bp, Homo sapiens
gcagttttttgaaaatgg

SEQ ID NO: 3614226 - DNA, 13 bp, Homo sapiens
gcataaagtaaat

SEQ ID NO: 3614227 - DNA, 16 bp, Homo sapiens
gcataaagtaaataca

SEQ ID NO: 3614228 - DNA, 17 bp, Homo sapiens
gcataatttaaaaatat

SEQ ID NO: 3614229 - DNA, 20 bp, Homo sapiens
gcataatttaaaaatatatt

SEQ ID NO: 3614230 - DNA, 20 bp, Homo sapiens
gcatacccacacaaataaca

SEQ ID NO: 3614231 - DNA, 22 bp, Homo sapiens
gcatactgccttgtttaatgtt

SEQ ID NO: 3614232 - DNA, 24 bp, Homo sapiens
gcataggctcttaagcagcatgga

SEQ ID NO: 3614233 - DNA, 16 bp, Homo sapiens
gcatatagacacacat

SEQ ID NO: 3614234 - DNA, 14 bp, Homo sapiens
gcatatagagatga

SEQ ID NO: 3614235 - DNA, 16 bp, Homo sapiens
gcatattataaaggat

SEQ ID NO: 3614236 - DNA, 18 bp, Homo sapiens
gcatatttgccaataaag

SEQ ID NO: 3614237 - DNA, 18 bp, Homo sapiens
gcatattttgagaaactg

SEQ ID NO: 3614238 - DNA, 21 bp, Homo sapiens
gcatattttgagaaactgctg

SEQ ID NO: 3614239 - DNA, 15 bp, Homo sapiens
gcatcaagggagaca

SEQ ID NO: 3614240 - DNA, 23 bp, Homo sapiens
gcatcagctgctgaaacaacaaa

SEQ ID NO: 3614241 - DNA, 21 bp, Homo sapiens
gcatcattactgttccagatt

SEQ ID NO: 3614242 - DNA, 20 bp, Homo sapiens
gcatccagtgtgagatactg

SEQ ID NO: 3614243 - DNA, 21 bp, Homo sapiens
gcatccctcacccatcctaga

SEQ ID NO: 3614244 - DNA, 21 bp, Homo sapiens
gcatccctggagcaggagccc

SEQ ID NO: 3614245 - DNA, 20 bp, Homo sapiens
gcatcctgcagggcttctcc

SEQ ID NO: 3614246 - DNA, 12 bp, Homo sapiens
gcatctcagccc

SEQ ID NO: 3614247 - DNA, 16 bp, Homo sapiens
gcatctcaggaggggc

SEQ ID NO: 3614248 - DNA, 18 bp, Homo sapiens
gcatctcaggaggggcag

SEQ ID NO: 3614249 - DNA, 21 bp, Homo sapiens
gcatctctccccatatataaa

SEQ ID NO: 3614250 - DNA, 23 bp, Homo sapiens
gcatctctccccatatataaatt

SEQ ID NO: 3614251 - DNA, 21 bp, Homo sapiens
gcatctgaatgaaaataactg

SEQ ID NO: 3614252 - DNA, 23 bp, Homo sapiens
gcatctgaatgaaaataactgaa

SEQ ID NO: 3614253 - DNA, 15 bp, Homo sapiens
gcatctgaccagcag

SEQ ID NO: 3614254 - DNA, 18 bp, Homo sapiens
gcatctgaccagcagcgc

SEQ ID NO: 3614255 - DNA, 15 bp, Homo sapiens
gcatctgagggggag

SEQ ID NO: 3614256 - DNA, 15 bp, Homo sapiens
gcatcttccactgga

SEQ ID NO: 3614257 - DNA, 14 bp, Homo sapiens
gcatgaaataaaat

SEQ ID NO: 3614258 - DNA, 12 bp, Homo sapiens
gcatgaaatttt

SEQ ID NO: 3614259 - DNA, 21 bp, Homo sapiens
gcatgaacagctaattgtacc

SEQ ID NO: 3614260 - DNA, 19 bp, Homo sapiens
gcatgaacgtggattgtat

SEQ ID NO: 3614261 - DNA, 20 bp, Homo sapiens
gcatgaacgtggattgtatt

SEQ ID NO: 3614262 - DNA, 14 bp, Homo sapiens
gcatgaataaaaca

SEQ ID NO: 3614263 - DNA, 18 bp, Homo sapiens
gcatgaataaaacactca

SEQ ID NO: 3614264 - DNA, 13 bp, Homo sapiens
gcatgagctggca

SEQ ID NO: 3614265 - DNA, 22 bp, Homo sapiens
gcatgagctggcaaccagccag

SEQ ID NO: 3614266 - DNA, 19 bp, Homo sapiens
gcatgcacatgctgtctgg

SEQ ID NO: 3614267 - DNA, 15 bp, Homo sapiens
gcatgctagtgttgt

SEQ ID NO: 3614268 - DNA, 14 bp, Homo sapiens
gcatggaaaaatgg

SEQ ID NO: 3614269 - DNA, 14 bp, Homo sapiens
gcatggagacagca

SEQ ID NO: 3614270 - DNA, 15 bp, Homo sapiens
gcatggagacagcag

SEQ ID NO: 3614271 - DNA, 18 bp, Homo sapiens
gcatggagacagcagttt

SEQ ID NO: 3614272 - DNA, 20 bp, Homo sapiens
gcatgggcccttggaaaaac

SEQ ID NO: 3614273 - DNA, 23 bp, Homo sapiens
gcatggtgccccaggaccagctc

SEQ ID NO: 3614274 - DNA, 17 bp, Homo sapiens
gcatggtggctcatgcc

SEQ ID NO: 3614275 - DNA, 15 bp, Homo sapiens
gcatgtaagaaataa

SEQ ID NO: 3614276 - DNA, 19 bp, Homo sapiens
gcatgtgtgcatgtgctgt

SEQ ID NO: 3614277 - DNA, 14 bp, Homo sapiens
gcatgttcctcctt

SEQ ID NO: 3614278 - DNA, 13 bp, Homo sapiens
gcattagcaaggc

SEQ ID NO: 3614279 - DNA, 17 bp, Homo sapiens
gcattagcaaggcagag

SEQ ID NO: 3614280 - DNA, 18 bp, Homo sapiens
gcattagcaaggcagagc

SEQ ID NO: 3614281 - DNA, 13 bp, Homo sapiens
gcattattttcca

SEQ ID NO: 3614282 - DNA, 17 bp, Homo sapiens
gcattcacatatctgct

SEQ ID NO: 3614283 - DNA, 14 bp, Homo sapiens
gcattcctgtgccc

SEQ ID NO: 3614284 - DNA, 18 bp, Homo sapiens
gcattctcactcctacct

SEQ ID NO: 3614285 - DNA, 14 bp, Homo sapiens
gcattctcccagct

SEQ ID NO: 3614286 - DNA, 20 bp, Homo sapiens
gcattctctcccatcctggg

SEQ ID NO: 3614287 - DNA, 13 bp, Homo sapiens
gcattgaaataat

SEQ ID NO: 3614288 - DNA, 18 bp, Homo sapiens
gcattgaaataataatat

SEQ ID NO: 3614289 - DNA, 21 bp, Homo sapiens
gcattgactttcagtaaacat

SEQ ID NO: 3614290 - DNA, 13 bp, Homo sapiens
gcattgcagccta

SEQ ID NO: 3614291 - DNA, 20 bp, Homo sapiens
gcattgccgctgtataaagc

SEQ ID NO: 3614292 - DNA, 16 bp, Homo sapiens
gcattgtaaatgtgct

SEQ ID NO: 3614293 - DNA, 23 bp, Homo sapiens
gcattgtgtggaatttgaggtct

SEQ ID NO: 3614294 - DNA, 13 bp, Homo sapiens
gcatttaaaaaaa

SEQ ID NO: 3614295 - DNA, 23 bp, Homo sapiens
gcatttaatggcagctagtgcct

SEQ ID NO: 3614296 - DNA, 22 bp, Homo sapiens
gcatttcatgaaaaagctgctt

SEQ ID NO: 3614297 - DNA, 15 bp, Homo sapiens
gcatttctaaaatgt

SEQ ID NO: 3614298 - DNA, 22 bp, Homo sapiens
gcatttgtttctttctctgagg

SEQ ID NO: 3614299 - DNA, 17 bp, Homo sapiens
gcattttagaaactaca

SEQ ID NO: 3614300 - DNA, 13 bp, Homo sapiens
gccaaaaatacag

SEQ ID NO: 3614301 - DNA, 21 bp, Homo sapiens
gccaaaatcctgaactttctc

SEQ ID NO: 3614302 - DNA, 19 bp, Homo sapiens
gccaaactcaggcccagaa

SEQ ID NO: 3614303 - DNA, 17 bp, Homo sapiens
gccaaactggtgcatga

SEQ ID NO: 3614304 - DNA, 17 bp, Homo sapiens
gccaaagaaacaagctg

SEQ ID NO: 3614305 - DNA, 17 bp, Homo sapiens
gccaaatgaccgagccc

SEQ ID NO: 3614306 - DNA, 19 bp, Homo sapiens
gccaaatgaccgagccctg

SEQ ID NO: 3614307 - DNA, 20 bp, Homo sapiens
gccaaatgaccgagccctgg

SEQ ID NO: 3614308 - DNA, 22 bp, Homo sapiens
gccaaatgaccgagccctggag

SEQ ID NO: 3614309 - DNA, 23 bp, Homo sapiens
gccaaatgaccgagccctggaga

SEQ ID NO: 3614310 - DNA, 14 bp, Homo sapiens
gccaaccatcatgt

SEQ ID NO: 3614311 - DNA, 19 bp, Homo sapiens
gccaaccctgggctattgc

SEQ ID NO: 3614312 - DNA, 21 bp, Homo sapiens
gccaactgcaaaaaaagcctc

SEQ ID NO: 3614313 - DNA, 17 bp, Homo sapiens
gccaactgccaggctgc

SEQ ID NO: 3614314 - DNA, 23 bp, Homo sapiens
gccaactgccaggctgcctcctg

SEQ ID NO: 3614315 - DNA, 18 bp, Homo sapiens
gccaactgtttccctgct

SEQ ID NO: 3614316 - DNA, 16 bp, Homo sapiens
gccaagaatacttgaa

SEQ ID NO: 3614317 - DNA, 22 bp, Homo sapiens
gccaagagatctgtgtggctcc

SEQ ID NO: 3614318 - DNA, 23 bp, Homo sapiens
gccaagagatctgtgtggctcct

SEQ ID NO: 3614319 - DNA, 22 bp, Homo sapiens
gccaagccagattctcttgaat

SEQ ID NO: 3614320 - DNA, 15 bp, Homo sapiens
gccaagctggcacaa

SEQ ID NO: 3614321 - DNA, 12 bp, Homo sapiens
gccaaggagcat

SEQ ID NO: 3614322 - DNA, 12 bp, Homo sapiens
gccaaggagctg

SEQ ID NO: 3614323 - DNA, 16 bp, Homo sapiens
gccaaggagctgctat

SEQ ID NO: 3614324 - DNA, 20 bp, Homo sapiens
gccaaggagctgctatagcc

SEQ ID NO: 3614325 - DNA, 21 bp, Homo sapiens
gccaaggagctgctatagcct

SEQ ID NO: 3614326 - DNA, 18 bp, Homo sapiens
gccaaggcagcgacccca

SEQ ID NO: 3614327 - DNA, 15 bp, Homo sapiens
gccaaggctctcccc

SEQ ID NO: 3614328 - DNA, 18 bp, Homo sapiens
gccaaggctctcccctct

SEQ ID NO: 3614329 - DNA, 19 bp, Homo sapiens
gccaagtaaacagggtacc

SEQ ID NO: 3614330 - DNA, 20 bp, Homo sapiens
gccaagtaaacagggtacct

SEQ ID NO: 3614331 - DNA, 18 bp, Homo sapiens
gccaagtgccaaatgctc

SEQ ID NO: 3614332 - DNA, 18 bp, Homo sapiens
gccaataaattctaaatt

SEQ ID NO: 3614333 - DNA, 21 bp, Homo sapiens
gccaatggagactgtctcaag

SEQ ID NO: 3614334 - DNA, 17 bp, Homo sapiens
gccacaaaaatagagaa

SEQ ID NO: 3614335 - DNA, 14 bp, Homo sapiens
gccacaaacctgcc

SEQ ID NO: 3614336 - DNA, 20 bp, Homo sapiens
gccacaactcctacatgatg

SEQ ID NO: 3614337 - DNA, 18 bp, Homo sapiens
gccacaaggacttcctgt

SEQ ID NO: 3614338 - DNA, 19 bp, Homo sapiens
gccacaaggacttcctgtc

SEQ ID NO: 3614339 - DNA, 18 bp, Homo sapiens
gccacacccaggaaggga

SEQ ID NO: 3614340 - DNA, 13 bp, Homo sapiens
gccacacctggcc

SEQ ID NO: 3614341 - DNA, 17 bp, Homo sapiens
gccacacgtggctggcg

SEQ ID NO: 3614342 - DNA, 20 bp, Homo sapiens
gccacacttcaggctcttct

SEQ ID NO: 3614343 - DNA, 22 bp, Homo sapiens
gccacacttcaggctcttctcc

SEQ ID NO: 3614344 - DNA, 23 bp, Homo sapiens
gccacacttcaggctcttctcct

SEQ ID NO: 3614345 - DNA, 13 bp, Homo sapiens
gccacagacccct

SEQ ID NO: 3614346 - DNA, 17 bp, Homo sapiens
gccacagacccctggga

SEQ ID NO: 3614347 - DNA, 20 bp, Homo sapiens
gccacagacccctgggagct

SEQ ID NO: 3614348 - DNA, 14 bp, Homo sapiens
gccacagcagagca

SEQ ID NO: 3614349 - DNA, 11 bp, Homo sapiens
gccacagtggg

SEQ ID NO: 3614350 - DNA, 13 bp, Homo sapiens
gccacatcagccc

SEQ ID NO: 3614351 - DNA, 16 bp, Homo sapiens
gccacatcagccccac

SEQ ID NO: 3614352 - DNA, 14 bp, Homo sapiens
gccacatcttgctc

SEQ ID NO: 3614353 - DNA, 21 bp, Homo sapiens
gccacatggagccccctctgc

SEQ ID NO: 3614354 - DNA, 23 bp, Homo sapiens
gccaccacctttggctggtagca

SEQ ID NO: 3614355 - DNA, 14 bp, Homo sapiens
gccaccagcatcca

SEQ ID NO: 3614356 - DNA, 21 bp, Homo sapiens
gccaccatgcttgcctgaagc

SEQ ID NO: 3614357 - DNA, 18 bp, Homo sapiens
gccacccacctccctgcc

SEQ ID NO: 3614358 - DNA, 21 bp, Homo sapiens
gccacccacctccctgcctcc

SEQ ID NO: 3614359 - DNA, 15 bp, Homo sapiens
gccacccagccccag

SEQ ID NO: 3614360 - DNA, 16 bp, Homo sapiens
gccaccccaaacccca

SEQ ID NO: 3614361 - DNA, 23 bp, Homo sapiens
gccaccccaaaccccagccccaa

SEQ ID NO: 3614362 - DNA, 15 bp, Homo sapiens
gccacccccttccct

SEQ ID NO: 3614363 - DNA, 23 bp, Homo sapiens
gccaccccgagggctgagcctgg

SEQ ID NO: 3614364 - DNA, 22 bp, Homo sapiens
gccaccctccacgaggtgtgac

SEQ ID NO: 3614365 - DNA, 21 bp, Homo sapiens
gccaccctcccctatgctggt

SEQ ID NO: 3614366 - DNA, 15 bp, Homo sapiens
gccaccggtgggcag

SEQ ID NO: 3614367 - DNA, 16 bp, Homo sapiens
gccaccggtgggcagt

SEQ ID NO: 3614368 - DNA, 19 bp, Homo sapiens
gccaccggtgggcagtggg

SEQ ID NO: 3614369 - DNA, 14 bp, Homo sapiens
gccacctccacacc

SEQ ID NO: 3614370 - DNA, 16 bp, Homo sapiens
gccacctccacaccca

SEQ ID NO: 3614371 - DNA, 13 bp, Homo sapiens
gccacctgcagga

SEQ ID NO: 3614372 - DNA, 23 bp, Homo sapiens
gccacctgggaacacagttctgg

SEQ ID NO: 3614373 - DNA, 15 bp, Homo sapiens
gccacgattgcagga

SEQ ID NO: 3614374 - DNA, 14 bp, Homo sapiens
gccacggcctggct

SEQ ID NO: 3614375 - DNA, 17 bp, Homo sapiens
gccacggcctggctggt

SEQ ID NO: 3614376 - DNA, 23 bp, Homo sapiens
gccacggcctggctggtgggaag

SEQ ID NO: 3614377 - DNA, 22 bp, Homo sapiens
gccacgggtctgtgttcgactc

SEQ ID NO: 3614378 - DNA, 23 bp, Homo sapiens
gccacgtcccagcatccctggag

SEQ ID NO: 3614379 - DNA, 15 bp, Homo sapiens
gccactaaagcttca

SEQ ID NO: 3614380 - DNA, 17 bp, Homo sapiens
gccactaaagcttcaga

SEQ ID NO: 3614381 - DNA, 16 bp, Homo sapiens
gccactaagcagagga

SEQ ID NO: 3614382 - DNA, 20 bp, Homo sapiens
gccactaagcagaggagggg

SEQ ID NO: 3614383 - DNA, 16 bp, Homo sapiens
gccactccagacccct

SEQ ID NO: 3614384 - DNA, 13 bp, Homo sapiens
gccactccccagc

SEQ ID NO: 3614385 - DNA, 17 bp, Homo sapiens
gccactgcgctcttggg

SEQ ID NO: 3614386 - DNA, 16 bp, Homo sapiens
gccactgggacagctg

SEQ ID NO: 3614387 - DNA, 19 bp, Homo sapiens
gccactgggacagctggct

SEQ ID NO: 3614388 - DNA, 12 bp, Homo sapiens
gccactgtgctt

SEQ ID NO: 3614389 - DNA, 14 bp, Homo sapiens
gccactgtgcttgg

SEQ ID NO: 3614390 - DNA, 16 bp, Homo sapiens
gccacttaatgtatgt

SEQ ID NO: 3614391 - DNA, 18 bp, Homo sapiens
gccacttccttttaactg

SEQ ID NO: 3614392 - DNA, 18 bp, Homo sapiens
gccacttctcactcacca

SEQ ID NO: 3614393 - DNA, 21 bp, Homo sapiens
gccacttgatgacccccaacc

SEQ ID NO: 3614394 - DNA, 19 bp, Homo sapiens
gccactttcagagccccca

SEQ ID NO: 3614395 - DNA, 21 bp, Homo sapiens
gccagaaaggtgtgaggagag

SEQ ID NO: 3614396 - DNA, 17 bp, Homo sapiens
gccagacacaggccctc

SEQ ID NO: 3614397 - DNA, 18 bp, Homo sapiens
gccagactggcacagttt

SEQ ID NO: 3614398 - DNA, 19 bp, Homo sapiens
gccagactggcacagtttt

SEQ ID NO: 3614399 - DNA, 13 bp, Homo sapiens
gccagagatccaa

SEQ ID NO: 3614400 - DNA, 12 bp, Homo sapiens
gccagagccagg

SEQ ID NO: 3614401 - DNA, 12 bp, Homo sapiens
gccagaggacca

SEQ ID NO: 3614402 - DNA, 14 bp, Homo sapiens
gccagatccagcct

SEQ ID NO: 3614403 - DNA, 15 bp, Homo sapiens
gccagatccagcctg

SEQ ID NO: 3614404 - DNA, 17 bp, Homo sapiens
gccagatccagcctggg

SEQ ID NO: 3614405 - DNA, 21 bp, Homo sapiens
gccagatgcacatccctggaa

SEQ ID NO: 3614406 - DNA, 13 bp, Homo sapiens
gccagattctctt

SEQ ID NO: 3614407 - DNA, 11 bp, Homo sapiens
gccagcaaata

SEQ ID NO: 3614408 - DNA, 21 bp, Homo sapiens
gccagcacagtaggtcccggc

SEQ ID NO: 3614409 - DNA, 20 bp, Homo sapiens
gccagcagctgatgctgtac

SEQ ID NO: 3614410 - DNA, 22 bp, Homo sapiens
gccagcagctgatgctgtacta

SEQ ID NO: 3614411 - DNA, 23 bp, Homo sapiens
gccagcagggcatcttggaaaag

SEQ ID NO: 3614412 - DNA, 16 bp, Homo sapiens
gccagcaggggggctg

SEQ ID NO: 3614413 - DNA, 21 bp, Homo sapiens
gccagcaggggggctgtgcca

SEQ ID NO: 3614414 - DNA, 12 bp, Homo sapiens
gccagcccagcc

SEQ ID NO: 3614415 - DNA, 13 bp, Homo sapiens
gccagcccagcca

SEQ ID NO: 3614416 - DNA, 15 bp, Homo sapiens
gccagcccagccagg

SEQ ID NO: 3614417 - DNA, 20 bp, Homo sapiens
gccagcccttccctggcccc

SEQ ID NO: 3614418 - DNA, 20 bp, Homo sapiens
gccagcctcagaaggcccca

SEQ ID NO: 3614419 - DNA, 11 bp, Homo sapiens
gccagcctggc

SEQ ID NO: 3614420 - DNA, 15 bp, Homo sapiens
gccagcctggctctg

SEQ ID NO: 3614421 - DNA, 14 bp, Homo sapiens
gccagcctggctgg

SEQ ID NO: 3614422 - DNA, 17 bp, Homo sapiens
gccagcctggctgggac

SEQ ID NO: 3614423 - DNA, 22 bp, Homo sapiens
gccagcgctgtggaccttacaa

SEQ ID NO: 3614424 - DNA, 14 bp, Homo sapiens
gccagctgcactga

SEQ ID NO: 3614425 - DNA, 14 bp, Homo sapiens
gccagcttctctct

SEQ ID NO: 3614426 - DNA, 19 bp, Homo sapiens
gccagcttctctctccagg

SEQ ID NO: 3614427 - DNA, 21 bp, Homo sapiens
gccagcttctctctccagggt

SEQ ID NO: 3614428 - DNA, 22 bp, Homo sapiens
gccagcttctctctccagggtg

SEQ ID NO: 3614429 - DNA, 20 bp, Homo sapiens
gccaggaatttcccaggacc

SEQ ID NO: 3614430 - DNA, 23 bp, Homo sapiens
gccaggaatttcccaggaccctg

SEQ ID NO: 3614431 - DNA, 15 bp, Homo sapiens
gccaggcaccacagc

SEQ ID NO: 3614432 - DNA, 20 bp, Homo sapiens
gccaggcaccacagcctcca

SEQ ID NO: 3614433 - DNA, 22 bp, Homo sapiens
gccaggccaacagcacctcccc

SEQ ID NO: 3614434 - DNA, 17 bp, Homo sapiens
gccaggccttatctgaa

SEQ ID NO: 3614435 - DNA, 19 bp, Homo sapiens
gccaggctgcctcctgccc

SEQ ID NO: 3614436 - DNA, 20 bp, Homo sapiens
gccaggctgcctcctgccct

SEQ ID NO: 3614437 - DNA, 20 bp, Homo sapiens
gccagggagaagctcctctc

SEQ ID NO: 3614438 - DNA, 12 bp, Homo sapiens
gccagggctggg

SEQ ID NO: 3614439 - DNA, 13 bp, Homo sapiens
gccagggctgggg

SEQ ID NO: 3614440 - DNA, 19 bp, Homo sapiens
gccagggctggggacagag

SEQ ID NO: 3614441 - DNA, 23 bp, Homo sapiens
gccagggcttcctcttccgggca

SEQ ID NO: 3614442 - DNA, 21 bp, Homo sapiens
gccaggtacaggagaggcagc

SEQ ID NO: 3614443 - DNA, 19 bp, Homo sapiens
gccaggtctgactccaaag

SEQ ID NO: 3614444 - DNA, 20 bp, Homo sapiens
gccaggtctgactccaaagc

SEQ ID NO: 3614445 - DNA, 22 bp, Homo sapiens
gccaggtctgactccaaagctg

SEQ ID NO: 3614446 - DNA, 14 bp, Homo sapiens
gccaggtgcagacc

SEQ ID NO: 3614447 - DNA, 15 bp, Homo sapiens
gccaggtgcagacct

SEQ ID NO: 3614448 - DNA, 16 bp, Homo sapiens
gccagtgaagtccttc

SEQ ID NO: 3614449 - DNA, 21 bp, Homo sapiens
gccagtggccttccccagcat

SEQ ID NO: 3614450 - DNA, 14 bp, Homo sapiens
gccagtgtctaggc

SEQ ID NO: 3614451 - DNA, 16 bp, Homo sapiens
gccagtgtctaggcac

SEQ ID NO: 3614452 - DNA, 15 bp, Homo sapiens
gccagttttccctgg

SEQ ID NO: 3614453 - DNA, 22 bp, Homo sapiens
gccataaacggttcctggtgac

SEQ ID NO: 3614454 - DNA, 15 bp, Homo sapiens
gccataggtgcagtt

SEQ ID NO: 3614455 - DNA, 22 bp, Homo sapiens
gccatatggaggactgtgacag

SEQ ID NO: 3614456 - DNA, 23 bp, Homo sapiens
gccatatggaggactgtgacaga

SEQ ID NO: 3614457 - DNA, 17 bp, Homo sapiens
gccatcatgtttacaga

SEQ ID NO: 3614458 - DNA, 21 bp, Homo sapiens
gccatcatgtttacagaggac

SEQ ID NO: 3614459 - DNA, 19 bp, Homo sapiens
gccatcgccgggactccag

SEQ ID NO: 3614460 - DNA, 13 bp, Homo sapiens
gccatctcaggag

SEQ ID NO: 3614461 - DNA, 22 bp, Homo sapiens
gccatctcaggagatggagggc

SEQ ID NO: 3614462 - DNA, 19 bp, Homo sapiens
gccatctgactgccaagcc

SEQ ID NO: 3614463 - DNA, 14 bp, Homo sapiens
gccatctggagagc

SEQ ID NO: 3614464 - DNA, 19 bp, Homo sapiens
gccatctggagagcccaga

SEQ ID NO: 3614465 - DNA, 17 bp, Homo sapiens
gccatgatggcaacaga

SEQ ID NO: 3614466 - DNA, 19 bp, Homo sapiens
gccatgatggcaacagatc

SEQ ID NO: 3614467 - DNA, 21 bp, Homo sapiens
gccatgatggcaacagatctg

SEQ ID NO: 3614468 - DNA, 19 bp, Homo sapiens
gccatgatgtccttggact

SEQ ID NO: 3614469 - DNA, 20 bp, Homo sapiens
gccatgatgtccttggactc

SEQ ID NO: 3614470 - DNA, 15 bp, Homo sapiens
gccatgcagaaagca

SEQ ID NO: 3614471 - DNA, 15 bp, Homo sapiens
gccatgctgggccac

SEQ ID NO: 3614472 - DNA, 16 bp, Homo sapiens
gccatgctgggccact

SEQ ID NO: 3614473 - DNA, 14 bp, Homo sapiens
gccatgggaggaag

SEQ ID NO: 3614474 - DNA, 19 bp, Homo sapiens
gccatgtcgccaaaaatac

SEQ ID NO: 3614475 - DNA, 15 bp, Homo sapiens
gccatttgctttttc

SEQ ID NO: 3614476 - DNA, 14 bp, Homo sapiens
gccattttaaaatg

SEQ ID NO: 3614477 - DNA, 20 bp, Homo sapiens
gcccaaacccttaactgaca

SEQ ID NO: 3614478 - DNA, 21 bp, Homo sapiens
gcccaaacctgggaaggccag

SEQ ID NO: 3614479 - DNA, 13 bp, Homo sapiens
gcccaacctctgt

SEQ ID NO: 3614480 - DNA, 21 bp, Homo sapiens
gcccaagaatagatgctgact

SEQ ID NO: 3614481 - DNA, 20 bp, Homo sapiens
gcccaagttcatgcagctgt

SEQ ID NO: 3614482 - DNA, 12 bp, Homo sapiens
gcccacacctgg

SEQ ID NO: 3614483 - DNA, 16 bp, Homo sapiens
gcccacacctggtgga

SEQ ID NO: 3614484 - DNA, 20 bp, Homo sapiens
gcccacagccgccggaagtg

SEQ ID NO: 3614485 - DNA, 16 bp, Homo sapiens
gcccaccccatggccg

SEQ ID NO: 3614486 - DNA, 21 bp, Homo sapiens
gcccacccctcactccccagg

SEQ ID NO: 3614487 - DNA, 22 bp, Homo sapiens
gcccacccctcactccccaggg

SEQ ID NO: 3614488 - DNA, 12 bp, Homo sapiens
gcccactcccca

SEQ ID NO: 3614489 - DNA, 19 bp, Homo sapiens
gcccactccccagccccag

SEQ ID NO: 3614490 - DNA, 12 bp, Homo sapiens
gcccactcctgg

SEQ ID NO: 3614491 - DNA, 14 bp, Homo sapiens
gcccactcctggga

SEQ ID NO: 3614492 - DNA, 21 bp, Homo sapiens
gcccactgtcctgggcctgca

SEQ ID NO: 3614493 - DNA, 23 bp, Homo sapiens
gcccactgtcctgggcctgcaga

SEQ ID NO: 3614494 - DNA, 24 bp, Homo sapiens
gcccactgtcctgggcctgcagaa

SEQ ID NO: 3614495 - DNA, 16 bp, Homo sapiens
gcccagagccacctgg

SEQ ID NO: 3614496 - DNA, 17 bp, Homo sapiens
gcccagagccacctgga

SEQ ID NO: 3614497 - DNA, 17 bp, Homo sapiens
gcccagatgaactgact

SEQ ID NO: 3614498 - DNA, 16 bp, Homo sapiens
gcccagcaccccttcc

SEQ ID NO: 3614499 - DNA, 17 bp, Homo sapiens
gcccagcaccccttcct

SEQ ID NO: 3614500 - DNA, 12 bp, Homo sapiens
gcccagcccaga

SEQ ID NO: 3614501 - DNA, 18 bp, Homo sapiens
gcccagcccagagccacc

SEQ ID NO: 3614502 - DNA, 16 bp, Homo sapiens
gcccagcctgggagcc

SEQ ID NO: 3614503 - DNA, 15 bp, Homo sapiens
gcccagctccaaggg

SEQ ID NO: 3614504 - DNA, 21 bp, Homo sapiens
gcccagctttccctgccaggc

SEQ ID NO: 3614505 - DNA, 23 bp, Homo sapiens
gcccaggcagctatttcagcctc

SEQ ID NO: 3614506 - DNA, 15 bp, Homo sapiens
gcccaggctggagtg

SEQ ID NO: 3614507 - DNA, 16 bp, Homo sapiens
gcccagggcccagagc

SEQ ID NO: 3614508 - DNA, 18 bp, Homo sapiens
gcccagggcccagagccc

SEQ ID NO: 3614509 - DNA, 14 bp, Homo sapiens
gcccagggcctaga

SEQ ID NO: 3614510 - DNA, 16 bp, Homo sapiens
gcccaggggagccctc

SEQ ID NO: 3614511 - DNA, 15 bp, Homo sapiens
gcccagtaaaatttc

SEQ ID NO: 3614512 - DNA, 16 bp, Homo sapiens
gcccagtcgaccccaa

SEQ ID NO: 3614513 - DNA, 15 bp, Homo sapiens
gcccagtgaagcctc

SEQ ID NO: 3614514 - DNA, 17 bp, Homo sapiens
gcccagtgaagcctctg

SEQ ID NO: 3614515 - DNA, 13 bp, Homo sapiens
gcccattgtaact

SEQ ID NO: 3614516 - DNA, 20 bp, Homo sapiens
gcccatttgggcagagaggc

SEQ ID NO: 3614517 - DNA, 22 bp, Homo sapiens
gccccaaactttctcataagca

SEQ ID NO: 3614518 - DNA, 20 bp, Homo sapiens
gccccaagtggtgagcaagc

SEQ ID NO: 3614519 - DNA, 22 bp, Homo sapiens
gccccaagtggtgagcaagcac

SEQ ID NO: 3614520 - DNA, 21 bp, Homo sapiens
gccccaccccatccagccaga

SEQ ID NO: 3614521 - DNA, 19 bp, Homo sapiens
gccccacctcccccttccc

SEQ ID NO: 3614522 - DNA, 14 bp, Homo sapiens
gccccacctcggca

SEQ ID NO: 3614523 - DNA, 18 bp, Homo sapiens
gccccacttctggccaca

SEQ ID NO: 3614524 - DNA, 12 bp, Homo sapiens
gccccagagaga

SEQ ID NO: 3614525 - DNA, 15 bp, Homo sapiens
gccccagagagaccc

SEQ ID NO: 3614526 - DNA, 14 bp, Homo sapiens
gccccagagctccg

SEQ ID NO: 3614527 - DNA, 15 bp, Homo sapiens
gccccagagctccga

SEQ ID NO: 3614528 - DNA, 14 bp, Homo sapiens
gccccagaggccct

SEQ ID NO: 3614529 - DNA, 16 bp, Homo sapiens
gccccagaggccctgg

SEQ ID NO: 3614530 - DNA, 20 bp, Homo sapiens
gccccagaggccctggaggt

SEQ ID NO: 3614531 - DNA, 16 bp, Homo sapiens
gccccagcctccctga

SEQ ID NO: 3614532 - DNA, 21 bp, Homo sapiens
gccccagcctccctgaagcct

SEQ ID NO: 3614533 - DNA, 11 bp, Homo sapiens
gccccagcttg

SEQ ID NO: 3614534 - DNA, 12 bp, Homo sapiens
gccccaggacca

SEQ ID NO: 3614535 - DNA, 14 bp, Homo sapiens
gccccaggaccagc

SEQ ID NO: 3614536 - DNA, 15 bp, Homo sapiens
gccccaggaccagct

SEQ ID NO: 3614537 - DNA, 23 bp, Homo sapiens
gccccaggaccagctcaggacag

SEQ ID NO: 3614538 - DNA, 15 bp, Homo sapiens
gccccagggcctgcg

SEQ ID NO: 3614539 - DNA, 19 bp, Homo sapiens
gccccatccagacctggct

SEQ ID NO: 3614540 - DNA, 14 bp, Homo sapiens
gccccatccctgct

SEQ ID NO: 3614541 - DNA, 23 bp, Homo sapiens
gccccatccctgcttgcccgctc

SEQ ID NO: 3614542 - DNA, 14 bp, Homo sapiens
gccccatcctccag

SEQ ID NO: 3614543 - DNA, 16 bp, Homo sapiens
gccccatcggccaaga

SEQ ID NO: 3614544 - DNA, 17 bp, Homo sapiens
gccccatggcagctcct

SEQ ID NO: 3614545 - DNA, 17 bp, Homo sapiens
gccccatggtgggtagg

SEQ ID NO: 3614546 - DNA, 15 bp, Homo sapiens
gccccattcctaaga

SEQ ID NO: 3614547 - DNA, 21 bp, Homo sapiens
gcccccaccgaggttcccagg

SEQ ID NO: 3614548 - DNA, 13 bp, Homo sapiens
gcccccacctcca

SEQ ID NO: 3614549 - DNA, 12 bp, Homo sapiens
gcccccactgac

SEQ ID NO: 3614550 - DNA, 21 bp, Homo sapiens
gcccccagctaagaacctgga

SEQ ID NO: 3614551 - DNA, 12 bp, Homo sapiens
gcccccagggcc

SEQ ID NO: 3614552 - DNA, 22 bp, Homo sapiens
gcccccagggcctccagggccc

SEQ ID NO: 3614553 - DNA, 13 bp, Homo sapiens
gcccccattccca

SEQ ID NO: 3614554 - DNA, 13 bp, Homo sapiens
gccccccgcgcgc

SEQ ID NO: 3614555 - DNA, 19 bp, Homo sapiens
gccccccgcgcgcccaccc

SEQ ID NO: 3614556 - DNA, 13 bp, Homo sapiens
gccccctccccca

SEQ ID NO: 3614557 - DNA, 16 bp, Homo sapiens
gccccctcccccatgg

SEQ ID NO: 3614558 - DNA, 17 bp, Homo sapiens
gccccctgggctggggc

SEQ ID NO: 3614559 - DNA, 21 bp, Homo sapiens
gccccctgggctggggcctca

SEQ ID NO: 3614560 - DNA, 18 bp, Homo sapiens
gcccccttcaggagcctg

SEQ ID NO: 3614561 - DNA, 18 bp, Homo sapiens
gccccgacacacggggct

SEQ ID NO: 3614562 - DNA, 13 bp, Homo sapiens
gccccgccagggc

SEQ ID NO: 3614563 - DNA, 15 bp, Homo sapiens
gccccgccccagagc

SEQ ID NO: 3614564 - DNA, 13 bp, Homo sapiens
gccccgcccctcc

SEQ ID NO: 3614565 - DNA, 16 bp, Homo sapiens
gccccgcccctcccac

SEQ ID NO: 3614566 - DNA, 13 bp, Homo sapiens
gccccgccgcaga

SEQ ID NO: 3614567 - DNA, 14 bp, Homo sapiens
gccccggcctcctc

SEQ ID NO: 3614568 - DNA, 19 bp, Homo sapiens
gccccgggctggagaaaga

SEQ ID NO: 3614569 - DNA, 22 bp, Homo sapiens
gccccgtcggactgcccccaga

SEQ ID NO: 3614570 - DNA, 23 bp, Homo sapiens
gccccgtcggactgcccccagaa

SEQ ID NO: 3614571 - DNA, 19 bp, Homo sapiens
gcccctaaagagcatcctg

SEQ ID NO: 3614572 - DNA, 20 bp, Homo sapiens
gcccctaaagagcatcctga

SEQ ID NO: 3614573 - DNA, 17 bp, Homo sapiens
gcccctaggtgcccagg

SEQ ID NO: 3614574 - DNA, 18 bp, Homo sapiens
gcccctaggtgcccaggg

SEQ ID NO: 3614575 - DNA, 19 bp, Homo sapiens
gcccctaggtgcccagggc

SEQ ID NO: 3614576 - DNA, 15 bp, Homo sapiens
gcccctcccttcaac

SEQ ID NO: 3614577 - DNA, 16 bp, Homo sapiens
gcccctgaacaagaat

SEQ ID NO: 3614578 - DNA, 13 bp, Homo sapiens
gcccctgcacaaa

SEQ ID NO: 3614579 - DNA, 16 bp, Homo sapiens
gcccctggctttgcct

SEQ ID NO: 3614580 - DNA, 14 bp, Homo sapiens
gcccctgtggccaa

SEQ ID NO: 3614581 - DNA, 14 bp, Homo sapiens
gcccctgtggccct

SEQ ID NO: 3614582 - DNA, 17 bp, Homo sapiens
gcccctgtggccctggc

SEQ ID NO: 3614583 - DNA, 22 bp, Homo sapiens
gccccttccatggtactgtagc

SEQ ID NO: 3614584 - DNA, 12 bp, Homo sapiens
gccccttccccc

SEQ ID NO: 3614585 - DNA, 12 bp, Homo sapiens
gccccttccctg

SEQ ID NO: 3614586 - DNA, 14 bp, Homo sapiens
gccccttccctggg

SEQ ID NO: 3614587 - DNA, 15 bp, Homo sapiens
gccccttccctgggt

SEQ ID NO: 3614588 - DNA, 16 bp, Homo sapiens
gcccgacagcctggca

SEQ ID NO: 3614589 - DNA, 20 bp, Homo sapiens
gcccgacaggtgggcctggg

SEQ ID NO: 3614590 - DNA, 15 bp, Homo sapiens
gcccgacagtgccat

SEQ ID NO: 3614591 - DNA, 17 bp, Homo sapiens
gcccgacagtgccatcc

SEQ ID NO: 3614592 - DNA, 21 bp, Homo sapiens
gcccgaccgggccaggcctgg

SEQ ID NO: 3614593 - DNA, 14 bp, Homo sapiens
gcccgcatgtgtgc

SEQ ID NO: 3614594 - DNA, 17 bp, Homo sapiens
gcccgcatgtgtgcctg

SEQ ID NO: 3614595 - DNA, 19 bp, Homo sapiens
gcccgcatgtgtgcctggc

SEQ ID NO: 3614596 - DNA, 17 bp, Homo sapiens
gcccgcgtctgtgccgc

SEQ ID NO: 3614597 - DNA, 13 bp, Homo sapiens
gcccgctcccaca

SEQ ID NO: 3614598 - DNA, 14 bp, Homo sapiens
gcccgctcccacag

SEQ ID NO: 3614599 - DNA, 21 bp, Homo sapiens
gcccggcagtgcacgcggctt

SEQ ID NO: 3614600 - DNA, 12 bp, Homo sapiens
gcccggccagcc

SEQ ID NO: 3614601 - DNA, 18 bp, Homo sapiens
gcccgtggcctcgtgctc

SEQ ID NO: 3614602 - DNA, 23 bp, Homo sapiens
gcccgtggtggcggtggctgccc

SEQ ID NO: 3614603 - DNA, 18 bp, Homo sapiens
gccctaagcccccagggc

SEQ ID NO: 3614604 - DNA, 19 bp, Homo sapiens
gccctaagcccccagggcc

SEQ ID NO: 3614605 - DNA, 20 bp, Homo sapiens
gccctagatgcacgtggggc

SEQ ID NO: 3614606 - DNA, 14 bp, Homo sapiens
gccctagccctgct

SEQ ID NO: 3614607 - DNA, 14 bp, Homo sapiens
gccctattgctgct

SEQ ID NO: 3614608 - DNA, 13 bp, Homo sapiens
gccctcaccacag

SEQ ID NO: 3614609 - DNA, 15 bp, Homo sapiens
gccctcaccacagcc

SEQ ID NO: 3614610 - DNA, 19 bp, Homo sapiens
gccctcaccacagccttct

SEQ ID NO: 3614611 - DNA, 13 bp, Homo sapiens
gccctccctgtct

SEQ ID NO: 3614612 - DNA, 18 bp, Homo sapiens
gccctccctgttccccag

SEQ ID NO: 3614613 - DNA, 13 bp, Homo sapiens
gccctcctcagct

SEQ ID NO: 3614614 - DNA, 14 bp, Homo sapiens
gccctcctcagctc

SEQ ID NO: 3614615 - DNA, 15 bp, Homo sapiens
gccctcctcagctcc

SEQ ID NO: 3614616 - DNA, 20 bp, Homo sapiens
gccctcctcagctccctgcc

SEQ ID NO: 3614617 - DNA, 12 bp, Homo sapiens
gccctcctctcc

SEQ ID NO: 3614618 - DNA, 17 bp, Homo sapiens
gccctcctctcccattg

SEQ ID NO: 3614619 - DNA, 20 bp, Homo sapiens
gccctcctctcccattgtcc

SEQ ID NO: 3614620 - DNA, 16 bp, Homo sapiens
gccctcctctgcactc

SEQ ID NO: 3614621 - DNA, 17 bp, Homo sapiens
gccctcctgagggccgg

SEQ ID NO: 3614622 - DNA, 15 bp, Homo sapiens
gccctctatttatta

SEQ ID NO: 3614623 - DNA, 21 bp, Homo sapiens
gccctctatttattagccaac

SEQ ID NO: 3614624 - DNA, 22 bp, Homo sapiens
gccctctatttattagccaact

SEQ ID NO: 3614625 - DNA, 23 bp, Homo sapiens
gccctctatttattagccaactg

SEQ ID NO: 3614626 - DNA, 14 bp, Homo sapiens
gccctctggagtgg

SEQ ID NO: 3614627 - DNA, 19 bp, Homo sapiens
gccctctttcatctgtaag

SEQ ID NO: 3614628 - DNA, 14 bp, Homo sapiens
gccctctttccctg

SEQ ID NO: 3614629 - DNA, 15 bp, Homo sapiens
gccctctttccctgc

SEQ ID NO: 3614630 - DNA, 19 bp, Homo sapiens
gccctctttccctgcgaga

SEQ ID NO: 3614631 - DNA, 13 bp, Homo sapiens
gccctgcagggcc

SEQ ID NO: 3614632 - DNA, 21 bp, Homo sapiens
gccctgcagggccgggcaggg

SEQ ID NO: 3614633 - DNA, 13 bp, Homo sapiens
gccctgccccacc

SEQ ID NO: 3614634 - DNA, 21 bp, Homo sapiens
gccctgccccaccccacctca

SEQ ID NO: 3614635 - DNA, 12 bp, Homo sapiens
gccctgccctgc

SEQ ID NO: 3614636 - DNA, 9 bp, Homo sapiens
gccctgcta

SEQ ID NO: 3614637 - DNA, 10 bp, Homo sapiens
gccctgctac

SEQ ID NO: 3614638 - DNA, 20 bp, Homo sapiens
gccctgctttgggctgccct

SEQ ID NO: 3614639 - DNA, 21 bp, Homo sapiens
gccctgctttgggctgccctg

SEQ ID NO: 3614640 - DNA, 18 bp, Homo sapiens
gccctggagagccccatg

SEQ ID NO: 3614641 - DNA, 20 bp, Homo sapiens
gccctggagagccccatggt

SEQ ID NO: 3614642 - DNA, 18 bp, Homo sapiens
gccctggaggtctccagg

SEQ ID NO: 3614643 - DNA, 20 bp, Homo sapiens
gccctggaggtctccagggg

SEQ ID NO: 3614644 - DNA, 20 bp, Homo sapiens
gccctggcacccccacaagc

SEQ ID NO: 3614645 - DNA, 14 bp, Homo sapiens
gccctggccaggac

SEQ ID NO: 3614646 - DNA, 15 bp, Homo sapiens
gccctggctcccaca

SEQ ID NO: 3614647 - DNA, 19 bp, Homo sapiens
gccctggctcccacaggcc

SEQ ID NO: 3614648 - DNA, 22 bp, Homo sapiens
gccctgggaaccactcccacca

SEQ ID NO: 3614649 - DNA, 14 bp, Homo sapiens
gccctgggctcctc

SEQ ID NO: 3614650 - DNA, 20 bp, Homo sapiens
gccctggggatcttcccaca

SEQ ID NO: 3614651 - DNA, 22 bp, Homo sapiens
gccctgggggattcctgagctg

SEQ ID NO: 3614652 - DNA, 17 bp, Homo sapiens
gccctgggggtctgggc

SEQ ID NO: 3614653 - DNA, 17 bp, Homo sapiens
gccctggtgctgccaca

SEQ ID NO: 3614654 - DNA, 21 bp, Homo sapiens
gccctggtgctgccacacttc

SEQ ID NO: 3614655 - DNA, 14 bp, Homo sapiens
gccctggttagctg

SEQ ID NO: 3614656 - DNA, 20 bp, Homo sapiens
gccctgtgcccgactgactg

SEQ ID NO: 3614657 - DNA, 20 bp, Homo sapiens
gccctgttgacacaggtctt

SEQ ID NO: 3614658 - DNA, 20 bp, Homo sapiens
gcccttattttcaagaaact

SEQ ID NO: 3614659 - DNA, 21 bp, Homo sapiens
gcccttccatgtcgcctctgc

SEQ ID NO: 3614660 - DNA, 16 bp, Homo sapiens
gcccttccatgtgcct

SEQ ID NO: 3614661 - DNA, 17 bp, Homo sapiens
gcccttccatgtgcctt

SEQ ID NO: 3614662 - DNA, 14 bp, Homo sapiens
gcccttcctctcca

SEQ ID NO: 3614663 - DNA, 15 bp, Homo sapiens
gcccttcctctccac

SEQ ID NO: 3614664 - DNA, 20 bp, Homo sapiens
gcccttcctctccactgcct

SEQ ID NO: 3614665 - DNA, 20 bp, Homo sapiens
gcccttctatacccacccag

SEQ ID NO: 3614666 - DNA, 18 bp, Homo sapiens
gcccttggaacaccctgg

SEQ ID NO: 3614667 - DNA, 16 bp, Homo sapiens
gccgactcagggacct

SEQ ID NO: 3614668 - DNA, 17 bp, Homo sapiens
gccgcagaccagctggc

SEQ ID NO: 3614669 - DNA, 20 bp, Homo sapiens
gccgccaccctcccctatgc

SEQ ID NO: 3614670 - DNA, 15 bp, Homo sapiens
gccgccagctgggag

SEQ ID NO: 3614671 - DNA, 17 bp, Homo sapiens
gccgccccgccccagag

SEQ ID NO: 3614672 - DNA, 14 bp, Homo sapiens
gccgccgctgccct

SEQ ID NO: 3614673 - DNA, 14 bp, Homo sapiens
gccgcgcccagcag

SEQ ID NO: 3614674 - DNA, 17 bp, Homo sapiens
gccgcgtcgccctccca

SEQ ID NO: 3614675 - DNA, 12 bp, Homo sapiens
gccgctgccacc

SEQ ID NO: 3614676 - DNA, 17 bp, Homo sapiens
gccgctgccacccacct

SEQ ID NO: 3614677 - DNA, 17 bp, Homo sapiens
gccgctggctggtgggc

SEQ ID NO: 3614678 - DNA, 13 bp, Homo sapiens
gccgctgtctctg

SEQ ID NO: 3614679 - DNA, 15 bp, Homo sapiens
gccgctgtctctgag

SEQ ID NO: 3614680 - DNA, 16 bp, Homo sapiens
gccgcttttgtgcctc

SEQ ID NO: 3614681 - DNA, 21 bp, Homo sapiens
gccggagtccactcccagtgc

SEQ ID NO: 3614682 - DNA, 15 bp, Homo sapiens
gccggcaagcgagca

SEQ ID NO: 3614683 - DNA, 14 bp, Homo sapiens
gccggctctgggcc

SEQ ID NO: 3614684 - DNA, 17 bp, Homo sapiens
gccggctgagtggcagc

SEQ ID NO: 3614685 - DNA, 16 bp, Homo sapiens
gccggctttcaggagc

SEQ ID NO: 3614686 - DNA, 16 bp, Homo sapiens
gccgggcaaactggcc

SEQ ID NO: 3614687 - DNA, 23 bp, Homo sapiens
gccggggctctgggtgctgccct

SEQ ID NO: 3614688 - DNA, 24 bp, Homo sapiens
gccggggctctgggtgctgccctg

SEQ ID NO: 3614689 - DNA, 19 bp, Homo sapiens
gccggggtgtaacttcctg

SEQ ID NO: 3614690 - DNA, 21 bp, Homo sapiens
gccggggtgtaacttcctgct

SEQ ID NO: 3614691 - DNA, 23 bp, Homo sapiens
gccggggtgtaacttcctgctgc

SEQ ID NO: 3614692 - DNA, 22 bp, Homo sapiens
gccggtaactgtcctgtcctgc

SEQ ID NO: 3614693 - DNA, 14 bp, Homo sapiens
gccggtcgggcagc

SEQ ID NO: 3614694 - DNA, 15 bp, Homo sapiens
gccggtcgggcagcc

SEQ ID NO: 3614695 - DNA, 22 bp, Homo sapiens
gccggtcgggcagccagcagag

SEQ ID NO: 3614696 - DNA, 14 bp, Homo sapiens
gccgtgccttcagc

SEQ ID NO: 3614697 - DNA, 14 bp, Homo sapiens
gccgtggcacagct

SEQ ID NO: 3614698 - DNA, 15 bp, Homo sapiens
gccgtggcacagctg

SEQ ID NO: 3614699 - DNA, 19 bp, Homo sapiens
gccgtggcttcccgctcag

SEQ ID NO: 3614700 - DNA, 22 bp, Homo sapiens
gccgtggcttcccgctcagccc

SEQ ID NO: 3614701 - DNA, 18 bp, Homo sapiens
gccgtgtcccctgacagg

SEQ ID NO: 3614702 - DNA, 13 bp, Homo sapiens
gcctaaagggcag

SEQ ID NO: 3614703 - DNA, 20 bp, Homo sapiens
gcctaaatttaatgctgcct

SEQ ID NO: 3614704 - DNA, 13 bp, Homo sapiens
gcctaacctggga

SEQ ID NO: 3614705 - DNA, 15 bp, Homo sapiens
gcctaacctgggacc

SEQ ID NO: 3614706 - DNA, 13 bp, Homo sapiens
gcctaagaagaag

SEQ ID NO: 3614707 - DNA, 14 bp, Homo sapiens
gcctaagaagaagg

SEQ ID NO: 3614708 - DNA, 19 bp, Homo sapiens
gcctaagaagaaggccaga

SEQ ID NO: 3614709 - DNA, 22 bp, Homo sapiens
gcctaaggttgtctacgggggc

SEQ ID NO: 3614710 - DNA, 16 bp, Homo sapiens
gcctaatgtgtttgag

SEQ ID NO: 3614711 - DNA, 21 bp, Homo sapiens
gcctaccgctggccctgccgt

SEQ ID NO: 3614712 - DNA, 15 bp, Homo sapiens
gcctacctctgtctg

SEQ ID NO: 3614713 - DNA, 16 bp, Homo sapiens
gcctacctctgtctga

SEQ ID NO: 3614714 - DNA, 20 bp, Homo sapiens
gcctacctctgtctgagaca

SEQ ID NO: 3614715 - DNA, 16 bp, Homo sapiens
gcctagaaagggcaag

SEQ ID NO: 3614716 - DNA, 12 bp, Homo sapiens
gcctagcctggc

SEQ ID NO: 3614717 - DNA, 16 bp, Homo sapiens
gcctagcggagcccag

SEQ ID NO: 3614718 - DNA, 17 bp, Homo sapiens
gcctaggtgcagctcct

SEQ ID NO: 3614719 - DNA, 21 bp, Homo sapiens
gcctatctaatttctttagtt

SEQ ID NO: 3614720 - DNA, 15 bp, Homo sapiens
gcctatctgcctgga

SEQ ID NO: 3614721 - DNA, 18 bp, Homo sapiens
gcctatctgcctggaggc

SEQ ID NO: 3614722 - DNA, 12 bp, Homo sapiens
gcctatttcccc

SEQ ID NO: 3614723 - DNA, 18 bp, Homo sapiens
gcctcaaaacgggtcagt

SEQ ID NO: 3614724 - DNA, 21 bp, Homo sapiens
gcctcagaaggccccagagag

SEQ ID NO: 3614725 - DNA, 22 bp, Homo sapiens
gcctcagaaggccccagagaga

SEQ ID NO: 3614726 - DNA, 19 bp, Homo sapiens
gcctcagcctgctttcctg

SEQ ID NO: 3614727 - DNA, 21 bp, Homo sapiens
gcctcagcctgctttcctgca

SEQ ID NO: 3614728 - DNA, 22 bp, Homo sapiens
gcctcagcctgctttcctgcag

SEQ ID NO: 3614729 - DNA, 13 bp, Homo sapiens
gcctcaggaccca

SEQ ID NO: 3614730 - DNA, 19 bp, Homo sapiens
gcctcaggacccatccctg

SEQ ID NO: 3614731 - DNA, 21 bp, Homo sapiens
gcctcaggccaagggaccagg

SEQ ID NO: 3614732 - DNA, 16 bp, Homo sapiens
gcctcaggctctgcac

SEQ ID NO: 3614733 - DNA, 21 bp, Homo sapiens
gcctcatttcactagagacaa

SEQ ID NO: 3614734 - DNA, 22 bp, Homo sapiens
gcctcattttgggggtcatctt

SEQ ID NO: 3614735 - DNA, 17 bp, Homo sapiens
gcctccaacgcccctgt

SEQ ID NO: 3614736 - DNA, 19 bp, Homo sapiens
gcctccaagggtttcgact

SEQ ID NO: 3614737 - DNA, 20 bp, Homo sapiens
gcctccacatgctgcctggc

SEQ ID NO: 3614738 - DNA, 21 bp, Homo sapiens
gcctccacatgctgcctggca

SEQ ID NO: 3614739 - DNA, 23 bp, Homo sapiens
gcctccacatgctgcctggcaca

SEQ ID NO: 3614740 - DNA, 16 bp, Homo sapiens
gcctccagaggtcctc

SEQ ID NO: 3614741 - DNA, 19 bp, Homo sapiens
gcctccagaggtcctccgt

SEQ ID NO: 3614742 - DNA, 12 bp, Homo sapiens
gcctccagtgca

SEQ ID NO: 3614743 - DNA, 19 bp, Homo sapiens
gcctcccaaagtgctggga

SEQ ID NO: 3614744 - DNA, 13 bp, Homo sapiens
gcctcccacagac

SEQ ID NO: 3614745 - DNA, 17 bp, Homo sapiens
gcctcccaccagagccg

SEQ ID NO: 3614746 - DNA, 19 bp, Homo sapiens
gcctcccagagtgctggga

SEQ ID NO: 3614747 - DNA, 22 bp, Homo sapiens
gcctccccctcccccattccct

SEQ ID NO: 3614748 - DNA, 20 bp, Homo sapiens
gcctcccctcccctggggac

SEQ ID NO: 3614749 - DNA, 21 bp, Homo sapiens
gcctcccctcccctggggacg

SEQ ID NO: 3614750 - DNA, 22 bp, Homo sapiens
gcctcccctcccctggggacgc

SEQ ID NO: 3614751 - DNA, 23 bp, Homo sapiens
gcctccctctcagaggcctgctg

SEQ ID NO: 3614752 - DNA, 11 bp, Homo sapiens
gcctccctgct

SEQ ID NO: 3614753 - DNA, 17 bp, Homo sapiens
gcctccctgctgtgcca

SEQ ID NO: 3614754 - DNA, 21 bp, Homo sapiens
gcctccgggcgtgtgaagaac

SEQ ID NO: 3614755 - DNA, 20 bp, Homo sapiens
gcctccgtcactacctggct

SEQ ID NO: 3614756 - DNA, 16 bp, Homo sapiens
gcctcctcacccccag

SEQ ID NO: 3614757 - DNA, 17 bp, Homo sapiens
gcctcctcggagagcag

SEQ ID NO: 3614758 - DNA, 15 bp, Homo sapiens
gcctcctgccccctg

SEQ ID NO: 3614759 - DNA, 16 bp, Homo sapiens
gcctcctgccccctgc

SEQ ID NO: 3614760 - DNA, 19 bp, Homo sapiens
gcctcctgccccctgccag

SEQ ID NO: 3614761 - DNA, 14 bp, Homo sapiens
gcctcctgggaaca

SEQ ID NO: 3614762 - DNA, 15 bp, Homo sapiens
gcctcctgtacctca

SEQ ID NO: 3614763 - DNA, 18 bp, Homo sapiens
gcctcctgtacctcagtg

SEQ ID NO: 3614764 - DNA, 19 bp, Homo sapiens
gcctcctgtacctcagtgg

SEQ ID NO: 3614765 - DNA, 14 bp, Homo sapiens
gcctcggacagtcc

SEQ ID NO: 3614766 - DNA, 22 bp, Homo sapiens
gcctcggatccccttcctacca

SEQ ID NO: 3614767 - DNA, 15 bp, Homo sapiens
gcctcggtatctggc

SEQ ID NO: 3614768 - DNA, 16 bp, Homo sapiens
gcctcggtatctggct

SEQ ID NO: 3614769 - DNA, 21 bp, Homo sapiens
gcctcggtatctggcttccct

SEQ ID NO: 3614770 - DNA, 15 bp, Homo sapiens
gcctcgtgaggggca

SEQ ID NO: 3614771 - DNA, 18 bp, Homo sapiens
gcctcgtgaggggcaagc

SEQ ID NO: 3614772 - DNA, 14 bp, Homo sapiens
gcctcgtgctggcg

SEQ ID NO: 3614773 - DNA, 21 bp, Homo sapiens
gcctcgttccagtggcggcac

SEQ ID NO: 3614774 - DNA, 20 bp, Homo sapiens
gcctctcattccagaggaag

SEQ ID NO: 3614775 - DNA, 13 bp, Homo sapiens
gcctctccctggg

SEQ ID NO: 3614776 - DNA, 16 bp, Homo sapiens
gcctctccctgggtct

SEQ ID NO: 3614777 - DNA, 19 bp, Homo sapiens
gcctctccctgggtctggg

SEQ ID NO: 3614778 - DNA, 14 bp, Homo sapiens
gcctctctccttgg

SEQ ID NO: 3614779 - DNA, 23 bp, Homo sapiens
gcctctctccttggccacagact

SEQ ID NO: 3614780 - DNA, 18 bp, Homo sapiens
gcctctctggctggtctt

SEQ ID NO: 3614781 - DNA, 20 bp, Homo sapiens
gcctctgacagtccacaggg

SEQ ID NO: 3614782 - DNA, 22 bp, Homo sapiens
gcctctgacagtccacaggggc

SEQ ID NO: 3614783 - DNA, 14 bp, Homo sapiens
gcctctgccctgga

SEQ ID NO: 3614784 - DNA, 15 bp, Homo sapiens
gcctctgccctggat

SEQ ID NO: 3614785 - DNA, 17 bp, Homo sapiens
gcctctggactggaaag

SEQ ID NO: 3614786 - DNA, 22 bp, Homo sapiens
gcctctggcttccctaaactgc

SEQ ID NO: 3614787 - DNA, 12 bp, Homo sapiens
gcctctgggacc

SEQ ID NO: 3614788 - DNA, 14 bp, Homo sapiens
gcctctgggaccca

SEQ ID NO: 3614789 - DNA, 19 bp, Homo sapiens
gcctctgtccgtgcccctt

SEQ ID NO: 3614790 - DNA, 20 bp, Homo sapiens
gcctctgttcctttctctgg

SEQ ID NO: 3614791 - DNA, 23 bp, Homo sapiens
gcctctgttcctttctctgggct

SEQ ID NO: 3614792 - DNA, 20 bp, Homo sapiens
gcctcttcccgccgcccagc

SEQ ID NO: 3614793 - DNA, 12 bp, Homo sapiens
gcctcttcctcc

SEQ ID NO: 3614794 - DNA, 15 bp, Homo sapiens
gcctcttctttgtgc

SEQ ID NO: 3614795 - DNA, 18 bp, Homo sapiens
gcctcttctttgtgcctt

SEQ ID NO: 3614796 - DNA, 18 bp, Homo sapiens
gcctcttgagttcctctg

SEQ ID NO: 3614797 - DNA, 21 bp, Homo sapiens
gcctcttgagttcctctgcag

SEQ ID NO: 3614798 - DNA, 13 bp, Homo sapiens
gcctgaaaacctt

SEQ ID NO: 3614799 - DNA, 20 bp, Homo sapiens
gcctgaagtcttctcctcca

SEQ ID NO: 3614800 - DNA, 17 bp, Homo sapiens
gcctgacaccccctccc

SEQ ID NO: 3614801 - DNA, 20 bp, Homo sapiens
gcctgacaccccctccccgc

SEQ ID NO: 3614802 - DNA, 17 bp, Homo sapiens
gcctgacagccttcccc

SEQ ID NO: 3614803 - DNA, 22 bp, Homo sapiens
gcctgacagccttccccagctc

SEQ ID NO: 3614804 - DNA, 19 bp, Homo sapiens
gcctgactagaactcctgt

SEQ ID NO: 3614805 - DNA, 16 bp, Homo sapiens
gcctgagaaggggcag

SEQ ID NO: 3614806 - DNA, 15 bp, Homo sapiens
gcctgagctggggaa

SEQ ID NO: 3614807 - DNA, 13 bp, Homo sapiens
gcctgagggtcca

SEQ ID NO: 3614808 - DNA, 16 bp, Homo sapiens
gcctgagggtccacct

SEQ ID NO: 3614809 - DNA, 18 bp, Homo sapiens
gcctgagggtccacctgg

SEQ ID NO: 3614810 - DNA, 19 bp, Homo sapiens
gcctgagggtccacctgga

SEQ ID NO: 3614811 - DNA, 20 bp, Homo sapiens
gcctgattcatagtaaaata

SEQ ID NO: 3614812 - DNA, 14 bp, Homo sapiens
gcctgattcggggc

SEQ ID NO: 3614813 - DNA, 19 bp, Homo sapiens
gcctgattcggggctgacc

SEQ ID NO: 3614814 - DNA, 12 bp, Homo sapiens
gcctgcagcagg

SEQ ID NO: 3614815 - DNA, 16 bp, Homo sapiens
gcctgcagcaggcagc

SEQ ID NO: 3614816 - DNA, 19 bp, Homo sapiens
gcctgcatgagctggcaac

SEQ ID NO: 3614817 - DNA, 20 bp, Homo sapiens
gcctgcatgagctggcaacc

SEQ ID NO: 3614818 - DNA, 13 bp, Homo sapiens
gcctgcctgcagc

SEQ ID NO: 3614819 - DNA, 20 bp, Homo sapiens
gcctgcctgcagcaggcagc

SEQ ID NO: 3614820 - DNA, 21 bp, Homo sapiens
gcctgcgtccgtttcgcgctg

SEQ ID NO: 3614821 - DNA, 13 bp, Homo sapiens
gcctgctccagac

SEQ ID NO: 3614822 - DNA, 16 bp, Homo sapiens
gcctgctccagacctg

SEQ ID NO: 3614823 - DNA, 21 bp, Homo sapiens
gcctgctccagacctgatcct

SEQ ID NO: 3614824 - DNA, 14 bp, Homo sapiens
gcctgctccttggc

SEQ ID NO: 3614825 - DNA, 21 bp, Homo sapiens
gcctgctccttggcaccccca

SEQ ID NO: 3614826 - DNA, 12 bp, Homo sapiens
gcctgctgccag

SEQ ID NO: 3614827 - DNA, 16 bp, Homo sapiens
gcctgctgccagtgca

SEQ ID NO: 3614828 - DNA, 21 bp, Homo sapiens
gcctgctgccagtgcagccac

SEQ ID NO: 3614829 - DNA, 23 bp, Homo sapiens
gcctgctgccagtgcagccactg

SEQ ID NO: 3614830 - DNA, 20 bp, Homo sapiens
gcctgcttcttctctccaca

SEQ ID NO: 3614831 - DNA, 20 bp, Homo sapiens
gcctggagacaaggtgctaa

SEQ ID NO: 3614832 - DNA, 21 bp, Homo sapiens
gcctggagacaaggtgctaac

SEQ ID NO: 3614833 - DNA, 13 bp, Homo sapiens
gcctggagcaggc

SEQ ID NO: 3614834 - DNA, 14 bp, Homo sapiens
gcctggagcaggcc

SEQ ID NO: 3614835 - DNA, 16 bp, Homo sapiens
gcctggagcaggccca

SEQ ID NO: 3614836 - DNA, 17 bp, Homo sapiens
gcctggagcaggcccaa

SEQ ID NO: 3614837 - DNA, 20 bp, Homo sapiens
gcctggaggcaaaggcctgg

SEQ ID NO: 3614838 - DNA, 17 bp, Homo sapiens
gcctggaggctcctcta

SEQ ID NO: 3614839 - DNA, 18 bp, Homo sapiens
gcctggaggtctggctga

SEQ ID NO: 3614840 - DNA, 17 bp, Homo sapiens
gcctggcaacagagcga

SEQ ID NO: 3614841 - DNA, 21 bp, Homo sapiens
gcctggcacagaccaggcctt

SEQ ID NO: 3614842 - DNA, 13 bp, Homo sapiens
gcctggcacaggg

SEQ ID NO: 3614843 - DNA, 14 bp, Homo sapiens
gcctggcacagggc

SEQ ID NO: 3614844 - DNA, 20 bp, Homo sapiens
gcctggcagccgtgccttca

SEQ ID NO: 3614845 - DNA, 13 bp, Homo sapiens
gcctggccagaca

SEQ ID NO: 3614846 - DNA, 16 bp, Homo sapiens
gcctggccagacacag

SEQ ID NO: 3614847 - DNA, 21 bp, Homo sapiens
gcctggccagacacaggccct

SEQ ID NO: 3614848 - DNA, 13 bp, Homo sapiens
gcctggccaggca

SEQ ID NO: 3614849 - DNA, 14 bp, Homo sapiens
gcctggccaggcag

SEQ ID NO: 3614850 - DNA, 15 bp, Homo sapiens
gcctggccaggcagg

SEQ ID NO: 3614851 - DNA, 14 bp, Homo sapiens
gcctggccatttcc

SEQ ID NO: 3614852 - DNA, 17 bp, Homo sapiens
gcctggctctgccccgc

SEQ ID NO: 3614853 - DNA, 14 bp, Homo sapiens
gcctggctggtggg

SEQ ID NO: 3614854 - DNA, 20 bp, Homo sapiens
gcctgggccgtggcacagct

SEQ ID NO: 3614855 - DNA, 15 bp, Homo sapiens
gcctgggctcactgt

SEQ ID NO: 3614856 - DNA, 18 bp, Homo sapiens
gcctggggtgcatctcct

SEQ ID NO: 3614857 - DNA, 19 bp, Homo sapiens
gcctggggtgcatctcctc

SEQ ID NO: 3614858 - DNA, 20 bp, Homo sapiens
gcctggggtgcatctcctcc

SEQ ID NO: 3614859 - DNA, 14 bp, Homo sapiens
gcctggggtggggt

SEQ ID NO: 3614860 - DNA, 19 bp, Homo sapiens
gcctgggtgatctgctgct

SEQ ID NO: 3614861 - DNA, 20 bp, Homo sapiens
gcctgggtgatctgctgctg

SEQ ID NO: 3614862 - DNA, 18 bp, Homo sapiens
gcctgtaacaatgtaata

SEQ ID NO: 3614863 - DNA, 15 bp, Homo sapiens
gcctgtcatgcgcaa

SEQ ID NO: 3614864 - DNA, 11 bp, Homo sapiens
gcctgtcccaa

SEQ ID NO: 3614865 - DNA, 22 bp, Homo sapiens
gcctgtcccaattctgcccgct

SEQ ID NO: 3614866 - DNA, 14 bp, Homo sapiens
gcctgtcccttgcc

SEQ ID NO: 3614867 - DNA, 19 bp, Homo sapiens
gcctgtcccttgcctctgc

SEQ ID NO: 3614868 - DNA, 21 bp, Homo sapiens
gcctgtctcatcttctgaaga

SEQ ID NO: 3614869 - DNA, 17 bp, Homo sapiens
gcctgtcttaattttct

SEQ ID NO: 3614870 - DNA, 22 bp, Homo sapiens
gcctgtgccagcaccacagccg

SEQ ID NO: 3614871 - DNA, 19 bp, Homo sapiens
gcctgtgcctcctcacccc

SEQ ID NO: 3614872 - DNA, 16 bp, Homo sapiens
gcctgtgcctctggga

SEQ ID NO: 3614873 - DNA, 17 bp, Homo sapiens
gcctgtgcctctgggac

SEQ ID NO: 3614874 - DNA, 15 bp, Homo sapiens
gcctgtgtgactcca

SEQ ID NO: 3614875 - DNA, 17 bp, Homo sapiens
gcctgttggcaggccca

SEQ ID NO: 3614876 - DNA, 22 bp, Homo sapiens
gcctgttggcaggcccactccc

SEQ ID NO: 3614877 - DNA, 19 bp, Homo sapiens
gcctgtttcccgtaaggct

SEQ ID NO: 3614878 - DNA, 15 bp, Homo sapiens
gccttaaacacacat

SEQ ID NO: 3614879 - DNA, 18 bp, Homo sapiens
gccttaaggccctcattc

SEQ ID NO: 3614880 - DNA, 20 bp, Homo sapiens
gccttaatgacattcccctc

SEQ ID NO: 3614881 - DNA, 17 bp, Homo sapiens
gccttacatctggctgg

SEQ ID NO: 3614882 - DNA, 22 bp, Homo sapiens
gccttacttcaaagtgcctggg

SEQ ID NO: 3614883 - DNA, 21 bp, Homo sapiens
gccttagagctcttgtgttca

SEQ ID NO: 3614884 - DNA, 15 bp, Homo sapiens
gccttatccaggttg

SEQ ID NO: 3614885 - DNA, 19 bp, Homo sapiens
gccttatctgaaaggccag

SEQ ID NO: 3614886 - DNA, 22 bp, Homo sapiens
gccttatctgaaaggccagcag

SEQ ID NO: 3614887 - DNA, 24 bp, Homo sapiens
gccttatctgaaaggccagcagct

SEQ ID NO: 3614888 - DNA, 22 bp, Homo sapiens
gccttcaacaacgtgagagaaa

SEQ ID NO: 3614889 - DNA, 18 bp, Homo sapiens
gccttcgatacaccgggc

SEQ ID NO: 3614890 - DNA, 15 bp, Homo sapiens
gccttctaaaggtgt

SEQ ID NO: 3614891 - DNA, 16 bp, Homo sapiens
gccttctaaattccca

SEQ ID NO: 3614892 - DNA, 20 bp, Homo sapiens
gccttctcccacatgaggcc

SEQ ID NO: 3614893 - DNA, 12 bp, Homo sapiens
gccttctgctga

SEQ ID NO: 3614894 - DNA, 13 bp, Homo sapiens
gccttgccagaga

SEQ ID NO: 3614895 - DNA, 17 bp, Homo sapiens
gccttgccagagatcca

SEQ ID NO: 3614896 - DNA, 13 bp, Homo sapiens
gccttgccagttt

SEQ ID NO: 3614897 - DNA, 15 bp, Homo sapiens
gccttgtttaatggt

SEQ ID NO: 3614898 - DNA, 17 bp, Homo sapiens
gcctttatgttctttca

SEQ ID NO: 3614899 - DNA, 18 bp, Homo sapiens
gcctttcccaactctagc

SEQ ID NO: 3614900 - DNA, 16 bp, Homo sapiens
gcctttcctctgcacg

SEQ ID NO: 3614901 - DNA, 15 bp, Homo sapiens
gcctttctttgcctc

SEQ ID NO: 3614902 - DNA, 17 bp, Homo sapiens
gcctttctttgcctctg

SEQ ID NO: 3614903 - DNA, 12 bp, Homo sapiens
gcctttggcctg

SEQ ID NO: 3614904 - DNA, 20 bp, Homo sapiens
gcctttgtgctttttgtcat

SEQ ID NO: 3614905 - DNA, 22 bp, Homo sapiens
gcctttgtgctttttgtcatgt

SEQ ID NO: 3614906 - DNA, 16 bp, Homo sapiens
gccttttatgtaaatt

SEQ ID NO: 3614907 - DNA, 21 bp, Homo sapiens
gccttttatgtaaatttttta

SEQ ID NO: 3614908 - DNA, 17 bp, Homo sapiens
gccttttccacacgcat

SEQ ID NO: 3614909 - DNA, 21 bp, Homo sapiens
gccttttccacacgcattaat

SEQ ID NO: 3614910 - DNA, 21 bp, Homo sapiens
gcctttttacctggcctagaa

SEQ ID NO: 3614911 - DNA, 16 bp, Homo sapiens
gcgaacagccttagag

SEQ ID NO: 3614912 - DNA, 22 bp, Homo sapiens
gcgaactctcagaaataaatca

SEQ ID NO: 3614913 - DNA, 17 bp, Homo sapiens
gcgaatctagaggaggg

SEQ ID NO: 3614914 - DNA, 21 bp, Homo sapiens
gcgaatctagaggagggggca

SEQ ID NO: 3614915 - DNA, 21 bp, Homo sapiens
gcgatggggcaagacagaaaa

SEQ ID NO: 3614916 - DNA, 14 bp, Homo sapiens
gcgcaggcagcgca

SEQ ID NO: 3614917 - DNA, 16 bp, Homo sapiens
gcgcaggcagcgcagg

SEQ ID NO: 3614918 - DNA, 21 bp, Homo sapiens
gcgcatgtgtgcatgtgctgt

SEQ ID NO: 3614919 - DNA, 14 bp, Homo sapiens
gcgccaccatgccc

SEQ ID NO: 3614920 - DNA, 15 bp, Homo sapiens
gcgccaccatgccct

SEQ ID NO: 3614921 - DNA, 15 bp, Homo sapiens
gcgcctccagaggtc

SEQ ID NO: 3614922 - DNA, 21 bp, Homo sapiens
gcgcctcgccggatctgaggg

SEQ ID NO: 3614923 - DNA, 18 bp, Homo sapiens
gcgcctcggtatctggct

SEQ ID NO: 3614924 - DNA, 15 bp, Homo sapiens
gcgctcgcccagcag

SEQ ID NO: 3614925 - DNA, 20 bp, Homo sapiens
gcgctcttgggaccccagag

SEQ ID NO: 3614926 - DNA, 21 bp, Homo sapiens
gcgctcttgggaccccagaga

SEQ ID NO: 3614927 - DNA, 23 bp, Homo sapiens
gcgctggaatccagaaggaagct

SEQ ID NO: 3614928 - DNA, 21 bp, Homo sapiens
gcggaagtacttccctcaggc

SEQ ID NO: 3614929 - DNA, 18 bp, Homo sapiens
gcggacccttctgggtcc

SEQ ID NO: 3614930 - DNA, 17 bp, Homo sapiens
gcggaggggatccagcc

SEQ ID NO: 3614931 - DNA, 19 bp, Homo sapiens
gcggaggggatccagccac

SEQ ID NO: 3614932 - DNA, 13 bp, Homo sapiens
gcggatcctgctg

SEQ ID NO: 3614933 - DNA, 15 bp, Homo sapiens
gcggcaccctggtct

SEQ ID NO: 3614934 - DNA, 16 bp, Homo sapiens
gcggcagtgttccttg

SEQ ID NO: 3614935 - DNA, 17 bp, Homo sapiens
gcggcccgcgcagctgc

SEQ ID NO: 3614936 - DNA, 20 bp, Homo sapiens
gcggcccgcgcagctgccta

SEQ ID NO: 3614937 - DNA, 20 bp, Homo sapiens
gcggccgaggtcactctggg

SEQ ID NO: 3614938 - DNA, 16 bp, Homo sapiens
gcggcctccatgcact

SEQ ID NO: 3614939 - DNA, 14 bp, Homo sapiens
gcggctgcacaaca

SEQ ID NO: 3614940 - DNA, 12 bp, Homo sapiens
gcggctggagaa

SEQ ID NO: 3614941 - DNA, 19 bp, Homo sapiens
gcggcttcgcgctggaatc

SEQ ID NO: 3614942 - DNA, 19 bp, Homo sapiens
gcgggatcctccacagaga

SEQ ID NO: 3614943 - DNA, 14 bp, Homo sapiens
gcgggcgtgggagg

SEQ ID NO: 3614944 - DNA, 19 bp, Homo sapiens
gcggggcccaggcagcctc

SEQ ID NO: 3614945 - DNA, 22 bp, Homo sapiens
gcgggtacttatttctcagctg

SEQ ID NO: 3614946 - DNA, 23 bp, Homo sapiens
gcgggtacttatttctcagctgt

SEQ ID NO: 3614947 - DNA, 22 bp, Homo sapiens
gcgggtgacagctccgggatca

SEQ ID NO: 3614948 - DNA, 22 bp, Homo sapiens
gcggtcccagctccctggctcc

SEQ ID NO: 3614949 - DNA, 18 bp, Homo sapiens
gcggtccctgtccctcta

SEQ ID NO: 3614950 - DNA, 21 bp, Homo sapiens
gcggtggctgccccggcctcc

SEQ ID NO: 3614951 - DNA, 16 bp, Homo sapiens
gcgtccagctcagccc

SEQ ID NO: 3614952 - DNA, 14 bp, Homo sapiens
gcgtcccagctgaa

SEQ ID NO: 3614953 - DNA, 18 bp, Homo sapiens
gcgtctggactgttctgt

SEQ ID NO: 3614954 - DNA, 12 bp, Homo sapiens
gcgtggcctccc

SEQ ID NO: 3614955 - DNA, 22 bp, Homo sapiens
gcgtgggtttttgtatccagag

SEQ ID NO: 3614956 - DNA, 18 bp, Homo sapiens
gcgtggtgtgtccctgga

SEQ ID NO: 3614957 - DNA, 21 bp, Homo sapiens
gcgtggtgtgtccctggacac

SEQ ID NO: 3614958 - DNA, 22 bp, Homo sapiens
gcgtggtgtgtccctggacaca

SEQ ID NO: 3614959 - DNA, 23 bp, Homo sapiens
gcgtggtgtgtccctggacacag

SEQ ID NO: 3614960 - DNA, 13 bp, Homo sapiens
gcgtgtgaagaac

SEQ ID NO: 3614961 - DNA, 22 bp, Homo sapiens
gcgtgtgaagaacacctcctcc

SEQ ID NO: 3614962 - DNA, 15 bp, Homo sapiens
gctaaaaatgaaaat

SEQ ID NO: 3614963 - DNA, 16 bp, Homo sapiens
gctaaataaagaggag

SEQ ID NO: 3614964 - DNA, 14 bp, Homo sapiens
gctaactggttaaa

SEQ ID NO: 3614965 - DNA, 17 bp, Homo sapiens
gctaagaccctgtgtcc

SEQ ID NO: 3614966 - DNA, 15 bp, Homo sapiens
gctaagctaggaatg

SEQ ID NO: 3614967 - DNA, 21 bp, Homo sapiens
gctaagtaatttagaagatat

SEQ ID NO: 3614968 - DNA, 22 bp, Homo sapiens
gctaagtacacaataagcaaaa

SEQ ID NO: 3614969 - DNA, 16 bp, Homo sapiens
gctaatcagcattctc

SEQ ID NO: 3614970 - DNA, 17 bp, Homo sapiens
gctaatcagcattctca

SEQ ID NO: 3614971 - DNA, 17 bp, Homo sapiens
gctaattcaaggaattt

SEQ ID NO: 3614972 - DNA, 18 bp, Homo sapiens
gctaattctgggaaggga

SEQ ID NO: 3614973 - DNA, 23 bp, Homo sapiens
gctaatttagagataggaaactg

SEQ ID NO: 3614974 - DNA, 19 bp, Homo sapiens
gctacaaaaacacagcaag

SEQ ID NO: 3614975 - DNA, 19 bp, Homo sapiens
gctacaaccctaccctggc

SEQ ID NO: 3614976 - DNA, 13 bp, Homo sapiens
gctacacctttct

SEQ ID NO: 3614977 - DNA, 14 bp, Homo sapiens
gctacagaaaccac

SEQ ID NO: 3614978 - DNA, 21 bp, Homo sapiens
gctacagaaaccacagtcttc

SEQ ID NO: 3614979 - DNA, 20 bp, Homo sapiens
gctaccaaagcaccttagct

SEQ ID NO: 3614980 - DNA, 15 bp, Homo sapiens
gctaccagtatttag

SEQ ID NO: 3614981 - DNA, 15 bp, Homo sapiens
gctacctcacctggg

SEQ ID NO: 3614982 - DNA, 18 bp, Homo sapiens
gctactagaattctgtat

SEQ ID NO: 3614983 - DNA, 23 bp, Homo sapiens
gctactcaggaggctgaggcagg

SEQ ID NO: 3614984 - DNA, 19 bp, Homo sapiens
gctactcagtggggctggc

SEQ ID NO: 3614985 - DNA, 17 bp, Homo sapiens
gctactggttacctgga

SEQ ID NO: 3614986 - DNA, 18 bp, Homo sapiens
gctactggttacctggag

SEQ ID NO: 3614987 - DNA, 23 bp, Homo sapiens
gctactgtaatgctgcctcagga

SEQ ID NO: 3614988 - DNA, 15 bp, Homo sapiens
gctactgtcagctcc

SEQ ID NO: 3614989 - DNA, 19 bp, Homo sapiens
gctagcaaatggcagaacc

SEQ ID NO: 3614990 - DNA, 19 bp, Homo sapiens
gctagctaagccaagaggc

SEQ ID NO: 3614991 - DNA, 16 bp, Homo sapiens
gctaggaaccctggag

SEQ ID NO: 3614992 - DNA, 18 bp, Homo sapiens
gctaggccccagaggccc

SEQ ID NO: 3614993 - DNA, 16 bp, Homo sapiens
gctagtcaagctcctc

SEQ ID NO: 3614994 - DNA, 17 bp, Homo sapiens
gctagtgttgtatttct

SEQ ID NO: 3614995 - DNA, 18 bp, Homo sapiens
gctagtgttgtatttcta

SEQ ID NO: 3614996 - DNA, 17 bp, Homo sapiens
gctataaattttttgaa

SEQ ID NO: 3614997 - DNA, 22 bp, Homo sapiens
gctataaattttttgaaacaca

SEQ ID NO: 3614998 - DNA, 22 bp, Homo sapiens
gctatacatgttggaaatgtgt

SEQ ID NO: 3614999 - DNA, 17 bp, Homo sapiens
gctatagcctggggtgg

SEQ ID NO: 3615000 - DNA, 14 bp, Homo sapiens
gctatagtgacatg

SEQ ID NO: 3615001 - DNA, 19 bp, Homo sapiens
gctatattgcccaggctgg

SEQ ID NO: 3615002 - DNA, 22 bp, Homo sapiens
gctatattgcccaggctggtct

SEQ ID NO: 3615003 - DNA, 14 bp, Homo sapiens
gctatcacctagca

SEQ ID NO: 3615004 - DNA, 20 bp, Homo sapiens
gctatcacctagcagcctca

SEQ ID NO: 3615005 - DNA, 13 bp, Homo sapiens
gctatcagcaatg

SEQ ID NO: 3615006 - DNA, 19 bp, Homo sapiens
gctatggggatagatgtgt

SEQ ID NO: 3615007 - DNA, 17 bp, Homo sapiens
gctattattttcactgt

SEQ ID NO: 3615008 - DNA, 18 bp, Homo sapiens
gctattattttcactgta

SEQ ID NO: 3615009 - DNA, 14 bp, Homo sapiens
gctcaaataaaaat

SEQ ID NO: 3615010 - DNA, 18 bp, Homo sapiens
gctcaacccccctcccag

SEQ ID NO: 3615011 - DNA, 21 bp, Homo sapiens
gctcaacccccctcccagaca

SEQ ID NO: 3615012 - DNA, 17 bp, Homo sapiens
gctcaagtgatcctcac

SEQ ID NO: 3615013 - DNA, 13 bp, Homo sapiens
gctcaatttcagc

SEQ ID NO: 3615014 - DNA, 14 bp, Homo sapiens
gctcacaaggccca

SEQ ID NO: 3615015 - DNA, 19 bp, Homo sapiens
gctcacaaggcccaggaga

SEQ ID NO: 3615016 - DNA, 15 bp, Homo sapiens
gctcactgtgctggg

SEQ ID NO: 3615017 - DNA, 18 bp, Homo sapiens
gctcactgtgctggggca

SEQ ID NO: 3615018 - DNA, 14 bp, Homo sapiens
gctcagactgggca

SEQ ID NO: 3615019 - DNA, 21 bp, Homo sapiens
gctcagactgggcactggggc

SEQ ID NO: 3615020 - DNA, 11 bp, Homo sapiens
gctcagccagt

SEQ ID NO: 3615021 - DNA, 16 bp, Homo sapiens
gctcagccccaactct

SEQ ID NO: 3615022 - DNA, 16 bp, Homo sapiens
gctcagccctccctgc

SEQ ID NO: 3615023 - DNA, 17 bp, Homo sapiens
gctcagccctccctgcc

SEQ ID NO: 3615024 - DNA, 21 bp, Homo sapiens
gctcagccctccctgcccctc

SEQ ID NO: 3615025 - DNA, 21 bp, Homo sapiens
gctcagccctggcctggctgg

SEQ ID NO: 3615026 - DNA, 17 bp, Homo sapiens
gctcagcctggtttctg

SEQ ID NO: 3615027 - DNA, 21 bp, Homo sapiens
gctcagcctggtttctgggtg

SEQ ID NO: 3615028 - DNA, 12 bp, Homo sapiens
gctcaggagaag

SEQ ID NO: 3615029 - DNA, 17 bp, Homo sapiens
gctcagggaaaagcagc

SEQ ID NO: 3615030 - DNA, 15 bp, Homo sapiens
gctcaggggcctgga

SEQ ID NO: 3615031 - DNA, 17 bp, Homo sapiens
gctcaggggcctggagg

SEQ ID NO: 3615032 - DNA, 21 bp, Homo sapiens
gctcaggggcctggaggtctg

SEQ ID NO: 3615033 - DNA, 20 bp, Homo sapiens
gctccaaccgggatgggagc

SEQ ID NO: 3615034 - DNA, 21 bp, Homo sapiens
gctccaagatgttctcctgat

SEQ ID NO: 3615035 - DNA, 17 bp, Homo sapiens
gctccaatgactgagca

SEQ ID NO: 3615036 - DNA, 22 bp, Homo sapiens
gctccacactcagaaaattccc

SEQ ID NO: 3615037 - DNA, 20 bp, Homo sapiens
gctccactcttgatctctct

SEQ ID NO: 3615038 - DNA, 22 bp, Homo sapiens
gctccagacctgatcctggagg

SEQ ID NO: 3615039 - DNA, 23 bp, Homo sapiens
gctccagacctgatcctggaggc

SEQ ID NO: 3615040 - DNA, 19 bp, Homo sapiens
gctccagcaggaaggaccc

SEQ ID NO: 3615041 - DNA, 20 bp, Homo sapiens
gctccatacacacgctgcct

SEQ ID NO: 3615042 - DNA, 21 bp, Homo sapiens
gctccatacacacgctgcctt

SEQ ID NO: 3615043 - DNA, 22 bp, Homo sapiens
gctccataccttttctcttttc

SEQ ID NO: 3615044 - DNA, 14 bp, Homo sapiens
gctccatctccact

SEQ ID NO: 3615045 - DNA, 18 bp, Homo sapiens
gctcccaaaacattttaa

SEQ ID NO: 3615046 - DNA, 20 bp, Homo sapiens
gctcccacaggcccttcctc

SEQ ID NO: 3615047 - DNA, 22 bp, Homo sapiens
gctcccacaggcccttcctctc

SEQ ID NO: 3615048 - DNA, 22 bp, Homo sapiens
gctcccaggttcccccagcaag

SEQ ID NO: 3615049 - DNA, 16 bp, Homo sapiens
gctcccctaaagccag

SEQ ID NO: 3615050 - DNA, 15 bp, Homo sapiens
gctcccgctcccagg

SEQ ID NO: 3615051 - DNA, 23 bp, Homo sapiens
gctccctcttcctctccatacct

SEQ ID NO: 3615052 - DNA, 12 bp, Homo sapiens
gctccctgactg

SEQ ID NO: 3615053 - DNA, 14 bp, Homo sapiens
gctccctgcctgtt

SEQ ID NO: 3615054 - DNA, 22 bp, Homo sapiens
gctcccttcaagacgaggggca

SEQ ID NO: 3615055 - DNA, 14 bp, Homo sapiens
gctccgatgcccgc

SEQ ID NO: 3615056 - DNA, 22 bp, Homo sapiens
gctccgcagggcgcccagcgcc

SEQ ID NO: 3615057 - DNA, 23 bp, Homo sapiens
gctccgtccaggagcctgtgcct

SEQ ID NO: 3615058 - DNA, 12 bp, Homo sapiens
gctccgtgtttc

SEQ ID NO: 3615059 - DNA, 16 bp, Homo sapiens
gctcctacctgtctgc

SEQ ID NO: 3615060 - DNA, 20 bp, Homo sapiens
gctcctacctgtctgctgcc

SEQ ID NO: 3615061 - DNA, 23 bp, Homo sapiens
gctcctataaagggcccacacct

SEQ ID NO: 3615062 - DNA, 16 bp, Homo sapiens
gctcctcagcggctcc

SEQ ID NO: 3615063 - DNA, 16 bp, Homo sapiens
gctcctcccggtgccc

SEQ ID NO: 3615064 - DNA, 16 bp, Homo sapiens
gctcctcctccctgca

SEQ ID NO: 3615065 - DNA, 21 bp, Homo sapiens
gctcctctaggccctgtgagc

SEQ ID NO: 3615066 - DNA, 19 bp, Homo sapiens
gctcctctcaggctgggcc

SEQ ID NO: 3615067 - DNA, 19 bp, Homo sapiens
gctcctctccccagcccag

SEQ ID NO: 3615068 - DNA, 20 bp, Homo sapiens
gctcctcttagctcagctga

SEQ ID NO: 3615069 - DNA, 14 bp, Homo sapiens
gctcctgaccttgg

SEQ ID NO: 3615070 - DNA, 20 bp, Homo sapiens
gctcctgaccttgggtcctg

SEQ ID NO: 3615071 - DNA, 15 bp, Homo sapiens
gctcctgcttttctg

SEQ ID NO: 3615072 - DNA, 18 bp, Homo sapiens
gctcctgcttttctgtcc

SEQ ID NO: 3615073 - DNA, 16 bp, Homo sapiens
gctcctgggccggctg

SEQ ID NO: 3615074 - DNA, 19 bp, Homo sapiens
gctcctgggccggctgagt

SEQ ID NO: 3615075 - DNA, 20 bp, Homo sapiens
gctccttggcacccccatgc

SEQ ID NO: 3615076 - DNA, 21 bp, Homo sapiens
gctccttggcacccccatgct

SEQ ID NO: 3615077 - DNA, 16 bp, Homo sapiens
gctccttttgctcttt

SEQ ID NO: 3615078 - DNA, 21 bp, Homo sapiens
gctcggctactggttacctgg

SEQ ID NO: 3615079 - DNA, 22 bp, Homo sapiens
gctcgggccgtaggggctcctg

SEQ ID NO: 3615080 - DNA, 15 bp, Homo sapiens
gctcggggtgtgtca

SEQ ID NO: 3615081 - DNA, 16 bp, Homo sapiens
gctcgtcagccacctg

SEQ ID NO: 3615082 - DNA, 19 bp, Homo sapiens
gctcgtcagccacctggga

SEQ ID NO: 3615083 - DNA, 23 bp, Homo sapiens
gctctagattgagagaagagaca

SEQ ID NO: 3615084 - DNA, 16 bp, Homo sapiens
gctctatactgtggcc

SEQ ID NO: 3615085 - DNA, 17 bp, Homo sapiens
gctctatactgtggcct

SEQ ID NO: 3615086 - DNA, 19 bp, Homo sapiens
gctctccgagctctggtgc

SEQ ID NO: 3615087 - DNA, 16 bp, Homo sapiens
gctctcctcccgcccc

SEQ ID NO: 3615088 - DNA, 20 bp, Homo sapiens
gctctcctcccgccccgccc

SEQ ID NO: 3615089 - DNA, 15 bp, Homo sapiens
gctctcctcttgcca

SEQ ID NO: 3615090 - DNA, 15 bp, Homo sapiens
gctctcgtctctcgt

SEQ ID NO: 3615091 - DNA, 14 bp, Homo sapiens
gctctgacatccct

SEQ ID NO: 3615092 - DNA, 17 bp, Homo sapiens
gctctgacatcccttcc

SEQ ID NO: 3615093 - DNA, 19 bp, Homo sapiens
gctctgacatcccttcctg

SEQ ID NO: 3615094 - DNA, 20 bp, Homo sapiens
gctctgagcaaatgtggctc

SEQ ID NO: 3615095 - DNA, 17 bp, Homo sapiens
gctctgcacagacaagc

SEQ ID NO: 3615096 - DNA, 22 bp, Homo sapiens
gctctgcacagacaagcagccc

SEQ ID NO: 3615097 - DNA, 23 bp, Homo sapiens
gctctgcacagacaagcagccct

SEQ ID NO: 3615098 - DNA, 19 bp, Homo sapiens
gctctgcatgttttccagg

SEQ ID NO: 3615099 - DNA, 21 bp, Homo sapiens
gctctgcgtcggtcctggtgc

SEQ ID NO: 3615100 - DNA, 22 bp, Homo sapiens
gctctggaataaagttgcagat

SEQ ID NO: 3615101 - DNA, 24 bp, Homo sapiens
gctctggaataaagttgcagatga

SEQ ID NO: 3615102 - DNA, 22 bp, Homo sapiens
gctctggacagccccaccctgg

SEQ ID NO: 3615103 - DNA, 15 bp, Homo sapiens
gctctggagaacagt

SEQ ID NO: 3615104 - DNA, 17 bp, Homo sapiens
gctctggcaccatcagc

SEQ ID NO: 3615105 - DNA, 19 bp, Homo sapiens
gctctggcaccatcagcct

SEQ ID NO: 3615106 - DNA, 20 bp, Homo sapiens
gctctggcaccatcagcctg

SEQ ID NO: 3615107 - DNA, 11 bp, Homo sapiens
gctctgggcct

SEQ ID NO: 3615108 - DNA, 15 bp, Homo sapiens
gctctgggcctgagg

SEQ ID NO: 3615109 - DNA, 11 bp, Homo sapiens
gctctggggac

SEQ ID NO: 3615110 - DNA, 17 bp, Homo sapiens
gctctggggacagcttc

SEQ ID NO: 3615111 - DNA, 19 bp, Homo sapiens
gctctggggacagcttcct

SEQ ID NO: 3615112 - DNA, 23 bp, Homo sapiens
gctctgtggcaaaaagagtcaga

SEQ ID NO: 3615113 - DNA, 19 bp, Homo sapiens
gctcttggcaggtactcag

SEQ ID NO: 3615114 - DNA, 16 bp, Homo sapiens
gctcttggctgacccc

SEQ ID NO: 3615115 - DNA, 19 bp, Homo sapiens
gctcttgggaccccagaga

SEQ ID NO: 3615116 - DNA, 21 bp, Homo sapiens
gctcttgggaccccagagaaa

SEQ ID NO: 3615117 - DNA, 12 bp, Homo sapiens
gctcttttcctg

SEQ ID NO: 3615118 - DNA, 23 bp, Homo sapiens
gctgaaatatccacccagcaggc

SEQ ID NO: 3615119 - DNA, 19 bp, Homo sapiens
gctgaaattcaccaagaac

SEQ ID NO: 3615120 - DNA, 16 bp, Homo sapiens
gctgaagagagggaca

SEQ ID NO: 3615121 - DNA, 12 bp, Homo sapiens
gctgaaggcagt

SEQ ID NO: 3615122 - DNA, 15 bp, Homo sapiens
gctgaaggcagtggc

SEQ ID NO: 3615123 - DNA, 14 bp, Homo sapiens
gctgacagccacac

SEQ ID NO: 3615124 - DNA, 17 bp, Homo sapiens
gctgacagctgctccta

SEQ ID NO: 3615125 - DNA, 13 bp, Homo sapiens
gctgacagtcagc

SEQ ID NO: 3615126 - DNA, 14 bp, Homo sapiens
gctgacatgctcac

SEQ ID NO: 3615127 - DNA, 15 bp, Homo sapiens
gctgacatgctcaca

SEQ ID NO: 3615128 - DNA, 20 bp, Homo sapiens
gctgacatgctcacacatta

SEQ ID NO: 3615129 - DNA, 12 bp, Homo sapiens
gctgaccagaca

SEQ ID NO: 3615130 - DNA, 20 bp, Homo sapiens
gctgaccatgcgtcaggggc

SEQ ID NO: 3615131 - DNA, 21 bp, Homo sapiens
gctgaccccgagaagtgctct

SEQ ID NO: 3615132 - DNA, 21 bp, Homo sapiens
gctgactgtactcctcccagg

SEQ ID NO: 3615133 - DNA, 14 bp, Homo sapiens
gctgagaccttgct

SEQ ID NO: 3615134 - DNA, 23 bp, Homo sapiens
gctgagacgccacggagggctgg

SEQ ID NO: 3615135 - DNA, 18 bp, Homo sapiens
gctgagagaccctggcct

SEQ ID NO: 3615136 - DNA, 17 bp, Homo sapiens
gctgagcatggagacag

SEQ ID NO: 3615137 - DNA, 15 bp, Homo sapiens
gctgagcccctgtct

SEQ ID NO: 3615138 - DNA, 15 bp, Homo sapiens
gctgagccctcctga

SEQ ID NO: 3615139 - DNA, 22 bp, Homo sapiens
gctgagctggaaggggccacgt

SEQ ID NO: 3615140 - DNA, 13 bp, Homo sapiens
gctgaggccccta

SEQ ID NO: 3615141 - DNA, 14 bp, Homo sapiens
gctgaggcctctca

SEQ ID NO: 3615142 - DNA, 14 bp, Homo sapiens
gctgagggtcgtgg

SEQ ID NO: 3615143 - DNA, 19 bp, Homo sapiens
gctgagggtcgtgggaaag

SEQ ID NO: 3615144 - DNA, 22 bp, Homo sapiens
gctgagggtcgtgggaaagggg

SEQ ID NO: 3615145 - DNA, 14 bp, Homo sapiens
gctgagtggcagca

SEQ ID NO: 3615146 - DNA, 15 bp, Homo sapiens
gctgagttggcctgg

SEQ ID NO: 3615147 - DNA, 23 bp, Homo sapiens
gctgagttggcctggccatttcc

SEQ ID NO: 3615148 - DNA, 17 bp, Homo sapiens
gctgattcctcgtgtcc

SEQ ID NO: 3615149 - DNA, 22 bp, Homo sapiens
gctgattgtcaacacaaactgg

SEQ ID NO: 3615150 - DNA, 20 bp, Homo sapiens
gctgcaaagcaaaacagact

SEQ ID NO: 3615151 - DNA, 12 bp, Homo sapiens
gctgcaaggttt

SEQ ID NO: 3615152 - DNA, 19 bp, Homo sapiens
gctgcaaggtttaggctgg

SEQ ID NO: 3615153 - DNA, 12 bp, Homo sapiens
gctgcacaggct

SEQ ID NO: 3615154 - DNA, 15 bp, Homo sapiens
gctgcaccccttcct

SEQ ID NO: 3615155 - DNA, 20 bp, Homo sapiens
gctgcaccccttcctgggca

SEQ ID NO: 3615156 - DNA, 15 bp, Homo sapiens
gctgcaccctgcgcc

SEQ ID NO: 3615157 - DNA, 20 bp, Homo sapiens
gctgcaccctgcgcctccag

SEQ ID NO: 3615158 - DNA, 23 bp, Homo sapiens
gctgcacctcctaccctcccacc

SEQ ID NO: 3615159 - DNA, 20 bp, Homo sapiens
gctgcactgatgctgcccct

SEQ ID NO: 3615160 - DNA, 21 bp, Homo sapiens
gctgcagattagttctttttg

SEQ ID NO: 3615161 - DNA, 12 bp, Homo sapiens
gctgcaggaaga

SEQ ID NO: 3615162 - DNA, 23 bp, Homo sapiens
gctgcaggagtgtcctgcccatg

SEQ ID NO: 3615163 - DNA, 21 bp, Homo sapiens
gctgcaggcaggcggctcctc

SEQ ID NO: 3615164 - DNA, 23 bp, Homo sapiens
gctgcaggcaggcggctcctcct

SEQ ID NO: 3615165 - DNA, 17 bp, Homo sapiens
gctgcaggggcctctgt

SEQ ID NO: 3615166 - DNA, 19 bp, Homo sapiens
gctgcaggtgttctgctga

SEQ ID NO: 3615167 - DNA, 15 bp, Homo sapiens
gctgccacacttcag

SEQ ID NO: 3615168 - DNA, 17 bp, Homo sapiens
gctgccacacttcaggc

SEQ ID NO: 3615169 - DNA, 18 bp, Homo sapiens
gctgccacacttcaggct

SEQ ID NO: 3615170 - DNA, 23 bp, Homo sapiens
gctgccacacttcaggctcttct

SEQ ID NO: 3615171 - DNA, 15 bp, Homo sapiens
gctgccacagagaag

SEQ ID NO: 3615172 - DNA, 17 bp, Homo sapiens
gctgccacccacctccc

SEQ ID NO: 3615173 - DNA, 21 bp, Homo sapiens
gctgccacccacctccctgcc

SEQ ID NO: 3615174 - DNA, 14 bp, Homo sapiens
gctgccagggcttc

SEQ ID NO: 3615175 - DNA, 18 bp, Homo sapiens
gctgccaggggctctgtg

SEQ ID NO: 3615176 - DNA, 21 bp, Homo sapiens
gctgccaggggctctgtggca

SEQ ID NO: 3615177 - DNA, 22 bp, Homo sapiens
gctgccaggggctctgtggcaa

SEQ ID NO: 3615178 - DNA, 19 bp, Homo sapiens
gctgccagtgcagccactg

SEQ ID NO: 3615179 - DNA, 13 bp, Homo sapiens
gctgcccaggaga

SEQ ID NO: 3615180 - DNA, 18 bp, Homo sapiens
gctgcccaggggagccct

SEQ ID NO: 3615181 - DNA, 22 bp, Homo sapiens
gctgcccctcatctctctgccc

SEQ ID NO: 3615182 - DNA, 19 bp, Homo sapiens
gctgcccctgtctggaaga

SEQ ID NO: 3615183 - DNA, 23 bp, Homo sapiens
gctgccccttaaacacaggctgt

SEQ ID NO: 3615184 - DNA, 20 bp, Homo sapiens
gctgccctggtgctgccaca

SEQ ID NO: 3615185 - DNA, 23 bp, Homo sapiens
gctgccctggtgctgccacactt

SEQ ID NO: 3615186 - DNA, 13 bp, Homo sapiens
gctgccgagccac

SEQ ID NO: 3615187 - DNA, 15 bp, Homo sapiens
gctgccggctctggg

SEQ ID NO: 3615188 - DNA, 12 bp, Homo sapiens
gctgcctcagga

SEQ ID NO: 3615189 - DNA, 15 bp, Homo sapiens
gctgcctcctgccct

SEQ ID NO: 3615190 - DNA, 21 bp, Homo sapiens
gctgcctcggatccccttcct

SEQ ID NO: 3615191 - DNA, 12 bp, Homo sapiens
gctgcctggcac

SEQ ID NO: 3615192 - DNA, 16 bp, Homo sapiens
gctgccttctttccat

SEQ ID NO: 3615193 - DNA, 13 bp, Homo sapiens
gctgctactgctg

SEQ ID NO: 3615194 - DNA, 15 bp, Homo sapiens
gctgctatagcctgg

SEQ ID NO: 3615195 - DNA, 21 bp, Homo sapiens
gctgctcagggaaaagcagct

SEQ ID NO: 3615196 - DNA, 22 bp, Homo sapiens
gctgctcccctaaagccaggct

SEQ ID NO: 3615197 - DNA, 15 bp, Homo sapiens
gctgctcctagaggg

SEQ ID NO: 3615198 - DNA, 17 bp, Homo sapiens
gctgctcctctcttggg

SEQ ID NO: 3615199 - DNA, 16 bp, Homo sapiens
gctgctcggctactgg

SEQ ID NO: 3615200 - DNA, 13 bp, Homo sapiens
gctgctctgcccc

SEQ ID NO: 3615201 - DNA, 22 bp, Homo sapiens
gctgctgatactgggtctgcga

SEQ ID NO: 3615202 - DNA, 22 bp, Homo sapiens
gctgctgcagctccctcctcag

SEQ ID NO: 3615203 - DNA, 15 bp, Homo sapiens
gctgctgccagggct

SEQ ID NO: 3615204 - DNA, 17 bp, Homo sapiens
gctgctgccagggcttc

SEQ ID NO: 3615205 - DNA, 15 bp, Homo sapiens
gctgctgctcctctc

SEQ ID NO: 3615206 - DNA, 19 bp, Homo sapiens
gctgctggggaagacagtg

SEQ ID NO: 3615207 - DNA, 13 bp, Homo sapiens
gctgctgggtggc

SEQ ID NO: 3615208 - DNA, 19 bp, Homo sapiens
gctgctgggtggcaggggg

SEQ ID NO: 3615209 - DNA, 15 bp, Homo sapiens
gctgcttaaactgga

SEQ ID NO: 3615210 - DNA, 18 bp, Homo sapiens
gctgcttaaactggaaag

SEQ ID NO: 3615211 - DNA, 21 bp, Homo sapiens
gctgcttttgggggtcagcat

SEQ ID NO: 3615212 - DNA, 20 bp, Homo sapiens
gctggaaagttgggcccctg

SEQ ID NO: 3615213 - DNA, 21 bp, Homo sapiens
gctggaaagttgggcccctga

SEQ ID NO: 3615214 - DNA, 20 bp, Homo sapiens
gctggaaggggccacgtgga

SEQ ID NO: 3615215 - DNA, 18 bp, Homo sapiens
gctggaatccagaaggaa

SEQ ID NO: 3615216 - DNA, 15 bp, Homo sapiens
gctggactattgtgc

SEQ ID NO: 3615217 - DNA, 16 bp, Homo sapiens
gctggagaaagagctg

SEQ ID NO: 3615218 - DNA, 18 bp, Homo sapiens
gctggagaaagagctgcc

SEQ ID NO: 3615219 - DNA, 19 bp, Homo sapiens
gctggagaaagagctgcct

SEQ ID NO: 3615220 - DNA, 20 bp, Homo sapiens
gctggagaaagagctgcctg

SEQ ID NO: 3615221 - DNA, 21 bp, Homo sapiens
gctggagaaagagctgcctgg

SEQ ID NO: 3615222 - DNA, 22 bp, Homo sapiens
gctggagaaagagctgcctgga

SEQ ID NO: 3615223 - DNA, 17 bp, Homo sapiens
gctggagaaagatgcag

SEQ ID NO: 3615224 - DNA, 12 bp, Homo sapiens
gctggagcctgg

SEQ ID NO: 3615225 - DNA, 14 bp, Homo sapiens
gctggagtccagtg

SEQ ID NO: 3615226 - DNA, 20 bp, Homo sapiens
gctggagtgcaatggtgtga

SEQ ID NO: 3615227 - DNA, 20 bp, Homo sapiens
gctggcaaatccaggctggt

SEQ ID NO: 3615228 - DNA, 15 bp, Homo sapiens
gctggcaaccagcca

SEQ ID NO: 3615229 - DNA, 16 bp, Homo sapiens
gctggcaaccagccag

SEQ ID NO: 3615230 - DNA, 14 bp, Homo sapiens
gctggcacaaaaga

SEQ ID NO: 3615231 - DNA, 19 bp, Homo sapiens
gctggcacttttttaaata

SEQ ID NO: 3615232 - DNA, 16 bp, Homo sapiens
gctggccgcctgcagc

SEQ ID NO: 3615233 - DNA, 13 bp, Homo sapiens
gctggctgggcct

SEQ ID NO: 3615234 - DNA, 10 bp, Homo sapiens
gctggctggt

SEQ ID NO: 3615235 - DNA, 19 bp, Homo sapiens
gctggctgtacctgttcct

SEQ ID NO: 3615236 - DNA, 21 bp, Homo sapiens
gctgggaacctagcacacctg

SEQ ID NO: 3615237 - DNA, 23 bp, Homo sapiens
gctgggaagagaagagggcccag

SEQ ID NO: 3615238 - DNA, 23 bp, Homo sapiens
gctgggagcctggttcagacaca

SEQ ID NO: 3615239 - DNA, 21 bp, Homo sapiens
gctgggattacaggcgtgagc

SEQ ID NO: 3615240 - DNA, 17 bp, Homo sapiens
gctgggattacagggat

SEQ ID NO: 3615241 - DNA, 13 bp, Homo sapiens
gctgggcaggaag

SEQ ID NO: 3615242 - DNA, 21 bp, Homo sapiens
gctgggccctctttccctgcg

SEQ ID NO: 3615243 - DNA, 15 bp, Homo sapiens
gctgggctctgcctt

SEQ ID NO: 3615244 - DNA, 22 bp, Homo sapiens
gctgggcttggcagcccgggtc

SEQ ID NO: 3615245 - DNA, 22 bp, Homo sapiens
gctgggctttgggaagtttgct

SEQ ID NO: 3615246 - DNA, 14 bp, Homo sapiens
gctggggagcccta

SEQ ID NO: 3615247 - DNA, 21 bp, Homo sapiens
gctggggccgccacggcctgg

SEQ ID NO: 3615248 - DNA, 20 bp, Homo sapiens
gctgggggctgccgagccac

SEQ ID NO: 3615249 - DNA, 20 bp, Homo sapiens
gctgggtgcagaagctgtgg

SEQ ID NO: 3615250 - DNA, 17 bp, Homo sapiens
gctggtacctgccctct

SEQ ID NO: 3615251 - DNA, 14 bp, Homo sapiens
gctggtagatgctg

SEQ ID NO: 3615252 - DNA, 18 bp, Homo sapiens
gctggtagatgctgaggc

SEQ ID NO: 3615253 - DNA, 20 bp, Homo sapiens
gctggtagcagcaggctcag

SEQ ID NO: 3615254 - DNA, 13 bp, Homo sapiens
gctggtcctgcac

SEQ ID NO: 3615255 - DNA, 15 bp, Homo sapiens
gctggtcctgcacat

SEQ ID NO: 3615256 - DNA, 22 bp, Homo sapiens
gctggtcttcactttcctcagt

SEQ ID NO: 3615257 - DNA, 15 bp, Homo sapiens
gctggtgaggtcctg

SEQ ID NO: 3615258 - DNA, 13 bp, Homo sapiens
gctggtggcccag

SEQ ID NO: 3615259 - DNA, 13 bp, Homo sapiens
gctggtgggaagg

SEQ ID NO: 3615260 - DNA, 15 bp, Homo sapiens
gctggttaatgggaa

SEQ ID NO: 3615261 - DNA, 16 bp, Homo sapiens
gctgtaaaaatgttac

SEQ ID NO: 3615262 - DNA, 13 bp, Homo sapiens
gctgtaagggcag

SEQ ID NO: 3615263 - DNA, 18 bp, Homo sapiens
gctgtaagggcagtgccc

SEQ ID NO: 3615264 - DNA, 15 bp, Homo sapiens
gctgtacctgttcct

SEQ ID NO: 3615265 - DNA, 15 bp, Homo sapiens
gctgtactgagcact

SEQ ID NO: 3615266 - DNA, 16 bp, Homo sapiens
gctgtactgagcactg

SEQ ID NO: 3615267 - DNA, 17 bp, Homo sapiens
gctgtactgagcactga

SEQ ID NO: 3615268 - DNA, 16 bp, Homo sapiens
gctgtataaagcatgt

SEQ ID NO: 3615269 - DNA, 15 bp, Homo sapiens
gctgtatgtgagctg

SEQ ID NO: 3615270 - DNA, 14 bp, Homo sapiens
gctgtcaaggctca

SEQ ID NO: 3615271 - DNA, 11 bp, Homo sapiens
gctgtccctgc

SEQ ID NO: 3615272 - DNA, 12 bp, Homo sapiens
gctgtccctgca

SEQ ID NO: 3615273 - DNA, 14 bp, Homo sapiens
gctgtccctgcagg

SEQ ID NO: 3615274 - DNA, 15 bp, Homo sapiens
gctgtccctgcaggg

SEQ ID NO: 3615275 - DNA, 18 bp, Homo sapiens
gctgtccctgcagggcca

SEQ ID NO: 3615276 - DNA, 22 bp, Homo sapiens
gctgtccttaacccacctctcc

SEQ ID NO: 3615277 - DNA, 13 bp, Homo sapiens
gctgtctgtctct

SEQ ID NO: 3615278 - DNA, 23 bp, Homo sapiens
gctgtctgttgtattcattgtgg

SEQ ID NO: 3615279 - DNA, 18 bp, Homo sapiens
gctgtctttcttgctccc

SEQ ID NO: 3615280 - DNA, 23 bp, Homo sapiens
gctgtctttcttgctccctgact

SEQ ID NO: 3615281 - DNA, 19 bp, Homo sapiens
gctgtgccaacctgttctt

SEQ ID NO: 3615282 - DNA, 13 bp, Homo sapiens
gctgtgccacagg

SEQ ID NO: 3615283 - DNA, 20 bp, Homo sapiens
gctgtgccacaggcttaggg

SEQ ID NO: 3615284 - DNA, 14 bp, Homo sapiens
gctgtgccagcagg

SEQ ID NO: 3615285 - DNA, 15 bp, Homo sapiens
gctgtgccatgctgg

SEQ ID NO: 3615286 - DNA, 17 bp, Homo sapiens
gctgtgccatgctgggc

SEQ ID NO: 3615287 - DNA, 14 bp, Homo sapiens
gctgtgcctctgcc

SEQ ID NO: 3615288 - DNA, 22 bp, Homo sapiens
gctgtgctccacactcagaaaa

SEQ ID NO: 3615289 - DNA, 14 bp, Homo sapiens
gctgtgctgggagg

SEQ ID NO: 3615290 - DNA, 18 bp, Homo sapiens
gctgtggagtgaggtgta

SEQ ID NO: 3615291 - DNA, 12 bp, Homo sapiens
gctgtggctcca

SEQ ID NO: 3615292 - DNA, 19 bp, Homo sapiens
gctgtggggaacacagcta

SEQ ID NO: 3615293 - DNA, 19 bp, Homo sapiens
gctgtggggcagctgagca

SEQ ID NO: 3615294 - DNA, 19 bp, Homo sapiens
gctgtgtcctaaggcccat

SEQ ID NO: 3615295 - DNA, 19 bp, Homo sapiens
gctgtgttgaaacagaaaa

SEQ ID NO: 3615296 - DNA, 19 bp, Homo sapiens
gctgttaatctgatgtata

SEQ ID NO: 3615297 - DNA, 20 bp, Homo sapiens
gctgttaatctgatgtataa

SEQ ID NO: 3615298 - DNA, 23 bp, Homo sapiens
gctgttaggggttattggtgtaa

SEQ ID NO: 3615299 - DNA, 13 bp, Homo sapiens
gctgttatgctgt

SEQ ID NO: 3615300 - DNA, 23 bp, Homo sapiens
gctgttatttaggtatttttctt

SEQ ID NO: 3615301 - DNA, 16 bp, Homo sapiens
gctgttcacagccaga

SEQ ID NO: 3615302 - DNA, 22 bp, Homo sapiens
gctgttccattacaccacagca

SEQ ID NO: 3615303 - DNA, 18 bp, Homo sapiens
gctgttcttcagtccttt

SEQ ID NO: 3615304 - DNA, 19 bp, Homo sapiens
gctgttgtcacatctcagg

SEQ ID NO: 3615305 - DNA, 20 bp, Homo sapiens
gctgttgtcacatctcaggg

SEQ ID NO: 3615306 - DNA, 21 bp, Homo sapiens
gctgttgtgaagctaatgtca

SEQ ID NO: 3615307 - DNA, 16 bp, Homo sapiens
gctgtttattaatctt

SEQ ID NO: 3615308 - DNA, 21 bp, Homo sapiens
gctgtttcctagctaggagca

SEQ ID NO: 3615309 - DNA, 12 bp, Homo sapiens
gctgtttcttgt

SEQ ID NO: 3615310 - DNA, 20 bp, Homo sapiens
gctgtttcttgtctgttatg

SEQ ID NO: 3615311 - DNA, 13 bp, Homo sapiens
gctgtttgaaaat

SEQ ID NO: 3615312 - DNA, 18 bp, Homo sapiens
gctgtttgtagtgaaata

SEQ ID NO: 3615313 - DNA, 16 bp, Homo sapiens
gctgttttcctccctt

SEQ ID NO: 3615314 - DNA, 13 bp, Homo sapiens
gctgtttttttgt

SEQ ID NO: 3615315 - DNA, 15 bp, Homo sapiens
gcttaaagggatgga

SEQ ID NO: 3615316 - DNA, 21 bp, Homo sapiens
gcttaataatattaataagaa

SEQ ID NO: 3615317 - DNA, 18 bp, Homo sapiens
gcttaatttaaatagcat

SEQ ID NO: 3615318 - DNA, 13 bp, Homo sapiens
gcttacaagccag

SEQ ID NO: 3615319 - DNA, 19 bp, Homo sapiens
gcttacaagccagctggag

SEQ ID NO: 3615320 - DNA, 13 bp, Homo sapiens
gcttacctgggca

SEQ ID NO: 3615321 - DNA, 22 bp, Homo sapiens
gcttaggagacagatcactcct

SEQ ID NO: 3615322 - DNA, 22 bp, Homo sapiens
gcttagggacaggaccccagct

SEQ ID NO: 3615323 - DNA, 14 bp, Homo sapiens
gcttagggtcctgt

SEQ ID NO: 3615324 - DNA, 17 bp, Homo sapiens
gcttataataaaggact

SEQ ID NO: 3615325 - DNA, 20 bp, Homo sapiens
gcttatacacttacacttta

SEQ ID NO: 3615326 - DNA, 18 bp, Homo sapiens
gcttatatgtacttttat

SEQ ID NO: 3615327 - DNA, 18 bp, Homo sapiens
gcttcaaaaagccacagc

SEQ ID NO: 3615328 - DNA, 21 bp, Homo sapiens
gcttcaaaaagccacagcaga

SEQ ID NO: 3615329 - DNA, 14 bp, Homo sapiens
gcttcaacagccaa

SEQ ID NO: 3615330 - DNA, 16 bp, Homo sapiens
gcttcaacagccaagc

SEQ ID NO: 3615331 - DNA, 19 bp, Homo sapiens
gcttcaacagccaagctgg

SEQ ID NO: 3615332 - DNA, 15 bp, Homo sapiens
gcttcagccaggtct

SEQ ID NO: 3615333 - DNA, 16 bp, Homo sapiens
gcttcagccaggtctg

SEQ ID NO: 3615334 - DNA, 14 bp, Homo sapiens
gcttcatccacagc

SEQ ID NO: 3615335 - DNA, 12 bp, Homo sapiens
gcttccaatttt

SEQ ID NO: 3615336 - DNA, 21 bp, Homo sapiens
gcttccactaccaaaagacat

SEQ ID NO: 3615337 - DNA, 23 bp, Homo sapiens
gcttccactaccaaaagacatta

SEQ ID NO: 3615338 - DNA, 17 bp, Homo sapiens
gcttcccgctcagccct

SEQ ID NO: 3615339 - DNA, 22 bp, Homo sapiens
gcttccctaaactgcagcctct

SEQ ID NO: 3615340 - DNA, 16 bp, Homo sapiens
gcttcctcacacccct

SEQ ID NO: 3615341 - DNA, 22 bp, Homo sapiens
gcttcctcacacccctgtccca

SEQ ID NO: 3615342 - DNA, 16 bp, Homo sapiens
gcttcggccgcgccac

SEQ ID NO: 3615343 - DNA, 19 bp, Homo sapiens
gcttcggccgcgccacccg

SEQ ID NO: 3615344 - DNA, 18 bp, Homo sapiens
gcttctactcctgcctca

SEQ ID NO: 3615345 - DNA, 15 bp, Homo sapiens
gcttctcacggcctg

SEQ ID NO: 3615346 - DNA, 14 bp, Homo sapiens
gcttctctctccag

SEQ ID NO: 3615347 - DNA, 16 bp, Homo sapiens
gcttctctctccaggg

SEQ ID NO: 3615348 - DNA, 13 bp, Homo sapiens
gcttctctgcagt

SEQ ID NO: 3615349 - DNA, 19 bp, Homo sapiens
gcttgaacctgggaggcag

SEQ ID NO: 3615350 - DNA, 14 bp, Homo sapiens
gcttgactgcattg

SEQ ID NO: 3615351 - DNA, 14 bp, Homo sapiens
gcttgactttccag

SEQ ID NO: 3615352 - DNA, 13 bp, Homo sapiens
gcttgcatggaga

SEQ ID NO: 3615353 - DNA, 18 bp, Homo sapiens
gcttgccctgttaaaaga

SEQ ID NO: 3615354 - DNA, 14 bp, Homo sapiens
gcttgctgggcttt

SEQ ID NO: 3615355 - DNA, 15 bp, Homo sapiens
gcttgctgggctttg

SEQ ID NO: 3615356 - DNA, 17 bp, Homo sapiens
gcttgctgggctttggg

SEQ ID NO: 3615357 - DNA, 15 bp, Homo sapiens
gcttggaagccaggt

SEQ ID NO: 3615358 - DNA, 12 bp, Homo sapiens
gcttggcccagc

SEQ ID NO: 3615359 - DNA, 15 bp, Homo sapiens
gcttggcccagcgcc

SEQ ID NO: 3615360 - DNA, 22 bp, Homo sapiens
gcttggctcacaaggcccagga

SEQ ID NO: 3615361 - DNA, 16 bp, Homo sapiens
gcttgggctgacccag

SEQ ID NO: 3615362 - DNA, 17 bp, Homo sapiens
gcttgggctgacccagc

SEQ ID NO: 3615363 - DNA, 21 bp, Homo sapiens
gcttgggctgacccagcatct

SEQ ID NO: 3615364 - DNA, 23 bp, Homo sapiens
gcttgggctgacccagcatctcc

SEQ ID NO: 3615365 - DNA, 21 bp, Homo sapiens
gcttggggattgtacacggga

SEQ ID NO: 3615366 - DNA, 20 bp, Homo sapiens
gcttggtgacaaaattcatt

SEQ ID NO: 3615367 - DNA, 23 bp, Homo sapiens
gcttgtaactaaaataattttgt

SEQ ID NO: 3615368 - DNA, 14 bp, Homo sapiens
gcttgtactgggac

SEQ ID NO: 3615369 - DNA, 18 bp, Homo sapiens
gcttgtatgcaatggatt

SEQ ID NO: 3615370 - DNA, 18 bp, Homo sapiens
gcttgtcctgggcctgcc

SEQ ID NO: 3615371 - DNA, 21 bp, Homo sapiens
gcttgtgatttccatttctga

SEQ ID NO: 3615372 - DNA, 23 bp, Homo sapiens
gcttgtgatttccatttctgatg

SEQ ID NO: 3615373 - DNA, 15 bp, Homo sapiens
gcttgtggcagcctg

SEQ ID NO: 3615374 - DNA, 16 bp, Homo sapiens
gcttgtggcagcctga

SEQ ID NO: 3615375 - DNA, 19 bp, Homo sapiens
gctttactccgtaacagat

SEQ ID NO: 3615376 - DNA, 18 bp, Homo sapiens
gctttagagataattgct

SEQ ID NO: 3615377 - DNA, 20 bp, Homo sapiens
gctttcacatttaaatggtt

SEQ ID NO: 3615378 - DNA, 13 bp, Homo sapiens
gctttcagagcca

SEQ ID NO: 3615379 - DNA, 17 bp, Homo sapiens
gctttcggagctcctgt

SEQ ID NO: 3615380 - DNA, 15 bp, Homo sapiens
gctttgaaagaagca

SEQ ID NO: 3615381 - DNA, 16 bp, Homo sapiens
gctttgaaagaagcaa

SEQ ID NO: 3615382 - DNA, 17 bp, Homo sapiens
gctttgaaagaagcaag

SEQ ID NO: 3615383 - DNA, 19 bp, Homo sapiens
gctttgagactcctcagca

SEQ ID NO: 3615384 - DNA, 15 bp, Homo sapiens
gctttgagctacagg

SEQ ID NO: 3615385 - DNA, 16 bp, Homo sapiens
gctttgctaccaaagc

SEQ ID NO: 3615386 - DNA, 18 bp, Homo sapiens
gctttgctgctgaaggct

SEQ ID NO: 3615387 - DNA, 19 bp, Homo sapiens
gctttgctgctgaaggctc

SEQ ID NO: 3615388 - DNA, 23 bp, Homo sapiens
gctttggacacagtgttttatca

SEQ ID NO: 3615389 - DNA, 15 bp, Homo sapiens
gctttgggctgccct

SEQ ID NO: 3615390 - DNA, 15 bp, Homo sapiens
gctttgtaggtgtct

SEQ ID NO: 3615391 - DNA, 13 bp, Homo sapiens
gctttgtctccaa

SEQ ID NO: 3615392 - DNA, 21 bp, Homo sapiens
gctttgtgaccagaaagcttc

SEQ ID NO: 3615393 - DNA, 12 bp, Homo sapiens
gcttttcactgc

SEQ ID NO: 3615394 - DNA, 22 bp, Homo sapiens
gcttttcactgctggctgcctt

SEQ ID NO: 3615395 - DNA, 17 bp, Homo sapiens
gcttttctgccactcca

SEQ ID NO: 3615396 - DNA, 12 bp, Homo sapiens
gcttttctgtcc

SEQ ID NO: 3615397 - DNA, 23 bp, Homo sapiens
gcttttgggggtcagcatccagt

SEQ ID NO: 3615398 - DNA, 13 bp, Homo sapiens
gctttttaaaatt

SEQ ID NO: 3615399 - DNA, 14 bp, Homo sapiens
gctttttattccct

SEQ ID NO: 3615400 - DNA, 13 bp, Homo sapiens
gctttttccagag

SEQ ID NO: 3615401 - DNA, 19 bp, Homo sapiens
ggaaaaaaatcgtccaggg

SEQ ID NO: 3615402 - DNA, 13 bp, Homo sapiens
ggaaaaatggttg

SEQ ID NO: 3615403 - DNA, 15 bp, Homo sapiens
ggaaaaatggttgat

SEQ ID NO: 3615404 - DNA, 21 bp, Homo sapiens
ggaaaaatggttgatggaaaa

SEQ ID NO: 3615405 - DNA, 14 bp, Homo sapiens
ggaaaattcatttt

SEQ ID NO: 3615406 - DNA, 12 bp, Homo sapiens
ggaaacagcatg

SEQ ID NO: 3615407 - DNA, 17 bp, Homo sapiens
ggaaaccttccacccag

SEQ ID NO: 3615408 - DNA, 15 bp, Homo sapiens
ggaaagaagggggcc

SEQ ID NO: 3615409 - DNA, 19 bp, Homo sapiens
ggaaagaagggggccctgc

SEQ ID NO: 3615410 - DNA, 13 bp, Homo sapiens
ggaaagagctagg

SEQ ID NO: 3615411 - DNA, 15 bp, Homo sapiens
ggaaagcagagcctc

SEQ ID NO: 3615412 - DNA, 14 bp, Homo sapiens
ggaaagcctctggc

SEQ ID NO: 3615413 - DNA, 20 bp, Homo sapiens
ggaaagtgtgagctcttccc

SEQ ID NO: 3615414 - DNA, 20 bp, Homo sapiens
ggaaagttgggcccctgagg

SEQ ID NO: 3615415 - DNA, 18 bp, Homo sapiens
ggaaatactgtatggttt

SEQ ID NO: 3615416 - DNA, 18 bp, Homo sapiens
ggaaatcaaatgtaaagt

SEQ ID NO: 3615417 - DNA, 19 bp, Homo sapiens
ggaacaaaaattacaaaga

SEQ ID NO: 3615418 - DNA, 14 bp, Homo sapiens
ggaacaaagacagg

SEQ ID NO: 3615419 - DNA, 17 bp, Homo sapiens
ggaacaaagacaggcaa

SEQ ID NO: 3615420 - DNA, 13 bp, Homo sapiens
ggaacaccctgga

SEQ ID NO: 3615421 - DNA, 18 bp, Homo sapiens
ggaacactgagaaagagg

SEQ ID NO: 3615422 - DNA, 13 bp, Homo sapiens
ggaacagtcctgt

SEQ ID NO: 3615423 - DNA, 13 bp, Homo sapiens
ggaacataaaaag

SEQ ID NO: 3615424 - DNA, 14 bp, Homo sapiens
ggaaccactcccac

SEQ ID NO: 3615425 - DNA, 22 bp, Homo sapiens
ggaaccactcccaccacaggca

SEQ ID NO: 3615426 - DNA, 11 bp, Homo sapiens
ggaacccagac

SEQ ID NO: 3615427 - DNA, 14 bp, Homo sapiens
ggaacccagactca

SEQ ID NO: 3615428 - DNA, 15 bp, Homo sapiens
ggaacccagactcag

SEQ ID NO: 3615429 - DNA, 23 bp, Homo sapiens
ggaaccctcaggccaccctccac

SEQ ID NO: 3615430 - DNA, 14 bp, Homo sapiens
ggaacctcagcctg

SEQ ID NO: 3615431 - DNA, 22 bp, Homo sapiens
ggaacgtttcactgcaaacaca

SEQ ID NO: 3615432 - DNA, 16 bp, Homo sapiens
ggaactgaccctcagg

SEQ ID NO: 3615433 - DNA, 20 bp, Homo sapiens
ggaactgaccctcaggcaca

SEQ ID NO: 3615434 - DNA, 15 bp, Homo sapiens
ggaactgctgggctt

SEQ ID NO: 3615435 - DNA, 23 bp, Homo sapiens
ggaacttggggagttaagacctg

SEQ ID NO: 3615436 - DNA, 12 bp, Homo sapiens
ggaagacctgaa

SEQ ID NO: 3615437 - DNA, 20 bp, Homo sapiens
ggaagacctgaaagagagga

SEQ ID NO: 3615438 - DNA, 20 bp, Homo sapiens
ggaagagaagagggcccagc

SEQ ID NO: 3615439 - DNA, 22 bp, Homo sapiens
ggaagagaagagggcccagccc

SEQ ID NO: 3615440 - DNA, 22 bp, Homo sapiens
ggaagagtgtgggggaggcgca

SEQ ID NO: 3615441 - DNA, 13 bp, Homo sapiens
ggaagatggagac

SEQ ID NO: 3615442 - DNA, 22 bp, Homo sapiens
ggaagatggagacaccctctgg

SEQ ID NO: 3615443 - DNA, 14 bp, Homo sapiens
ggaagatgtttaca

SEQ ID NO: 3615444 - DNA, 12 bp, Homo sapiens
ggaagccaggta

SEQ ID NO: 3615445 - DNA, 18 bp, Homo sapiens
ggaagccaggtacaggag

SEQ ID NO: 3615446 - DNA, 22 bp, Homo sapiens
ggaagccatgtggggttgctga

SEQ ID NO: 3615447 - DNA, 21 bp, Homo sapiens
ggaagccggggtgtaacttcc

SEQ ID NO: 3615448 - DNA, 23 bp, Homo sapiens
ggaagccggggtgtaacttcctg

SEQ ID NO: 3615449 - DNA, 19 bp, Homo sapiens
ggaagctgtgttgaaacag

SEQ ID NO: 3615450 - DNA, 20 bp, Homo sapiens
ggaagctgtgttgaaacaga

SEQ ID NO: 3615451 - DNA, 23 bp, Homo sapiens
ggaagctgtgttgaaacagaaaa

SEQ ID NO: 3615452 - DNA, 20 bp, Homo sapiens
ggaaggaacaaagacaggca

SEQ ID NO: 3615453 - DNA, 14 bp, Homo sapiens
ggaaggaccccaca

SEQ ID NO: 3615454 - DNA, 15 bp, Homo sapiens
ggaagggagccaagg

SEQ ID NO: 3615455 - DNA, 21 bp, Homo sapiens
ggaagggagccaagggatgga

SEQ ID NO: 3615456 - DNA, 23 bp, Homo sapiens
ggaagggctttggttccttctct

SEQ ID NO: 3615457 - DNA, 17 bp, Homo sapiens
ggaagtacttccctcag

SEQ ID NO: 3615458 - DNA, 23 bp, Homo sapiens
ggaagtacttggcccccttcagg

SEQ ID NO: 3615459 - DNA, 18 bp, Homo sapiens
ggaagtatgtatattaaa

SEQ ID NO: 3615460 - DNA, 17 bp, Homo sapiens
ggaagtggctgtccctg

SEQ ID NO: 3615461 - DNA, 16 bp, Homo sapiens
ggaagttaaaagcaca

SEQ ID NO: 3615462 - DNA, 17 bp, Homo sapiens
ggaagttacatgctgta

SEQ ID NO: 3615463 - DNA, 18 bp, Homo sapiens
ggaagttgacttatagta

SEQ ID NO: 3615464 - DNA, 15 bp, Homo sapiens
ggaagtttctgggtg

SEQ ID NO: 3615465 - DNA, 14 bp, Homo sapiens
ggaagtttgctgtg

SEQ ID NO: 3615466 - DNA, 18 bp, Homo sapiens
ggaatagtatcctccagg

SEQ ID NO: 3615467 - DNA, 17 bp, Homo sapiens
ggaatccagaaggaagc

SEQ ID NO: 3615468 - DNA, 22 bp, Homo sapiens
ggaatcctatatagaatgctgc

SEQ ID NO: 3615469 - DNA, 19 bp, Homo sapiens
ggaatgccgctgtctctga

SEQ ID NO: 3615470 - DNA, 15 bp, Homo sapiens
ggaatggccacaaac

SEQ ID NO: 3615471 - DNA, 15 bp, Homo sapiens
ggaatgtcagggcca

SEQ ID NO: 3615472 - DNA, 18 bp, Homo sapiens
ggaatgtcagggccaggt

SEQ ID NO: 3615473 - DNA, 19 bp, Homo sapiens
ggaattcagtgccttcaac

SEQ ID NO: 3615474 - DNA, 15 bp, Homo sapiens
ggaattccctccccc

SEQ ID NO: 3615475 - DNA, 16 bp, Homo sapiens
ggaattccctccccct

SEQ ID NO: 3615476 - DNA, 14 bp, Homo sapiens
ggaattccctcctg

SEQ ID NO: 3615477 - DNA, 19 bp, Homo sapiens
ggacaaagtccaagtctgt

SEQ ID NO: 3615478 - DNA, 12 bp, Homo sapiens
ggacacagctct

SEQ ID NO: 3615479 - DNA, 20 bp, Homo sapiens
ggacacagctcttcattcca

SEQ ID NO: 3615480 - DNA, 14 bp, Homo sapiens
ggacagaggcccca

SEQ ID NO: 3615481 - DNA, 15 bp, Homo sapiens
ggacagaggccccag

SEQ ID NO: 3615482 - DNA, 17 bp, Homo sapiens
ggacagaggccccagcc

SEQ ID NO: 3615483 - DNA, 23 bp, Homo sapiens
ggacagaggccccagcctccctg

SEQ ID NO: 3615484 - DNA, 15 bp, Homo sapiens
ggacagccccaccct

SEQ ID NO: 3615485 - DNA, 19 bp, Homo sapiens
ggacagctgataaatttaa

SEQ ID NO: 3615486 - DNA, 13 bp, Homo sapiens
ggacagctggctg

SEQ ID NO: 3615487 - DNA, 14 bp, Homo sapiens
ggacagctggctgg

SEQ ID NO: 3615488 - DNA, 21 bp, Homo sapiens
ggacaggaccccagctctgcg

SEQ ID NO: 3615489 - DNA, 12 bp, Homo sapiens
ggacaggaccct

SEQ ID NO: 3615490 - DNA, 16 bp, Homo sapiens
ggacaggaccctcagg

SEQ ID NO: 3615491 - DNA, 17 bp, Homo sapiens
ggacaggaccctcagga

SEQ ID NO: 3615492 - DNA, 18 bp, Homo sapiens
ggacaggagatgctgtgc

SEQ ID NO: 3615493 - DNA, 18 bp, Homo sapiens
ggacaggctgaagagagg

SEQ ID NO: 3615494 - DNA, 19 bp, Homo sapiens
ggacagtatttgtggggag

SEQ ID NO: 3615495 - DNA, 18 bp, Homo sapiens
ggacagttgatggagccc

SEQ ID NO: 3615496 - DNA, 23 bp, Homo sapiens
ggacataatggggtcctggccat

SEQ ID NO: 3615497 - DNA, 16 bp, Homo sapiens
ggacatactgctggag

SEQ ID NO: 3615498 - DNA, 12 bp, Homo sapiens
ggacatcagcaa

SEQ ID NO: 3615499 - DNA, 15 bp, Homo sapiens
ggacatcagcaaaca

SEQ ID NO: 3615500 - DNA, 22 bp, Homo sapiens
ggacatgcataaaaattaaatg

SEQ ID NO: 3615501 - DNA, 22 bp, Homo sapiens
ggacattgttctttccggccaa

SEQ ID NO: 3615502 - DNA, 15 bp, Homo sapiens
ggacattttatgtct

SEQ ID NO: 3615503 - DNA, 16 bp, Homo sapiens
ggaccaattctggaca

SEQ ID NO: 3615504 - DNA, 13 bp, Homo sapiens
ggaccagctcacg

SEQ ID NO: 3615505 - DNA, 13 bp, Homo sapiens
ggaccagctcagg

SEQ ID NO: 3615506 - DNA, 18 bp, Homo sapiens
ggaccagctcaggacaga

SEQ ID NO: 3615507 - DNA, 22 bp, Homo sapiens
ggaccagctcaggacagatgcc

SEQ ID NO: 3615508 - DNA, 17 bp, Homo sapiens
ggaccatcatcctactg

SEQ ID NO: 3615509 - DNA, 18 bp, Homo sapiens
ggaccatctgctgcagtt

SEQ ID NO: 3615510 - DNA, 18 bp, Homo sapiens
ggaccatctttagcagtt

SEQ ID NO: 3615511 - DNA, 21 bp, Homo sapiens
ggacccaaaccccctgcagcc

SEQ ID NO: 3615512 - DNA, 15 bp, Homo sapiens
ggaccccagctctgc

SEQ ID NO: 3615513 - DNA, 21 bp, Homo sapiens
ggaccccgagaaccctgagca

SEQ ID NO: 3615514 - DNA, 20 bp, Homo sapiens
ggacccggaggggcctggca

SEQ ID NO: 3615515 - DNA, 21 bp, Homo sapiens
ggacccggaggggcctggcag

SEQ ID NO: 3615516 - DNA, 13 bp, Homo sapiens
ggaccctgaaggg

SEQ ID NO: 3615517 - DNA, 17 bp, Homo sapiens
ggaccctgacctccgcc

SEQ ID NO: 3615518 - DNA, 22 bp, Homo sapiens
ggaccctgacctccgcccctgc

SEQ ID NO: 3615519 - DNA, 17 bp, Homo sapiens
ggaccctgtcctgcagt

SEQ ID NO: 3615520 - DNA, 17 bp, Homo sapiens
ggacccttctgggtcca

SEQ ID NO: 3615521 - DNA, 17 bp, Homo sapiens
ggaccggtgctgcagga

SEQ ID NO: 3615522 - DNA, 19 bp, Homo sapiens
ggaccggtgctgcaggagt

SEQ ID NO: 3615523 - DNA, 19 bp, Homo sapiens
ggaccgtccaggggagatg

SEQ ID NO: 3615524 - DNA, 23 bp, Homo sapiens
ggaccgtgccctcgtcagctggg

SEQ ID NO: 3615525 - DNA, 14 bp, Homo sapiens
ggacctctcccagg

SEQ ID NO: 3615526 - DNA, 15 bp, Homo sapiens
ggacctctcccaggg

SEQ ID NO: 3615527 - DNA, 20 bp, Homo sapiens
ggaccttcgggctgtgcccg

SEQ ID NO: 3615528 - DNA, 14 bp, Homo sapiens
ggacgactctgacc

SEQ ID NO: 3615529 - DNA, 22 bp, Homo sapiens
ggacgcatgaaggtcactcgtg

SEQ ID NO: 3615530 - DNA, 17 bp, Homo sapiens
ggacgctccctgctcca

SEQ ID NO: 3615531 - DNA, 16 bp, Homo sapiens
ggacgggccacacgtg

SEQ ID NO: 3615532 - DNA, 14 bp, Homo sapiens
ggacgttaggccag

SEQ ID NO: 3615533 - DNA, 14 bp, Homo sapiens
ggactatctttgct

SEQ ID NO: 3615534 - DNA, 11 bp, Homo sapiens
ggactcaggga

SEQ ID NO: 3615535 - DNA, 12 bp, Homo sapiens
ggactcctctgt

SEQ ID NO: 3615536 - DNA, 14 bp, Homo sapiens
ggactcctctgtcc

SEQ ID NO: 3615537 - DNA, 15 bp, Homo sapiens
ggactcctctgtcca

SEQ ID NO: 3615538 - DNA, 17 bp, Homo sapiens
ggactcctgccaccagc

SEQ ID NO: 3615539 - DNA, 20 bp, Homo sapiens
ggactcctggcagggccacc

SEQ ID NO: 3615540 - DNA, 17 bp, Homo sapiens
ggactgaaaacctctcc

SEQ ID NO: 3615541 - DNA, 16 bp, Homo sapiens
ggactgagctggggga

SEQ ID NO: 3615542 - DNA, 22 bp, Homo sapiens
ggactgcccccagaaagcctcc

SEQ ID NO: 3615543 - DNA, 12 bp, Homo sapiens
ggactgttctgt

SEQ ID NO: 3615544 - DNA, 19 bp, Homo sapiens
ggacttcctgtccagctcc

SEQ ID NO: 3615545 - DNA, 22 bp, Homo sapiens
ggacttgtgattggctgcagga

SEQ ID NO: 3615546 - DNA, 14 bp, Homo sapiens
ggagaaaaagaaga

SEQ ID NO: 3615547 - DNA, 15 bp, Homo sapiens
ggagaaaaagaagaa

SEQ ID NO: 3615548 - DNA, 23 bp, Homo sapiens
ggagaaacccacgacctgtcctg

SEQ ID NO: 3615549 - DNA, 15 bp, Homo sapiens
ggagaaacccagaga

SEQ ID NO: 3615550 - DNA, 16 bp, Homo sapiens
ggagaaagagctgcct

SEQ ID NO: 3615551 - DNA, 20 bp, Homo sapiens
ggagaaagtggaaaatgacc

SEQ ID NO: 3615552 - DNA, 21 bp, Homo sapiens
ggagaacagtggttgcctggg

SEQ ID NO: 3615553 - DNA, 11 bp, Homo sapiens
ggagaaccagg

SEQ ID NO: 3615554 - DNA, 18 bp, Homo sapiens
ggagaacttgctgcctcg

SEQ ID NO: 3615555 - DNA, 23 bp, Homo sapiens
ggagaagagctgttcacagccag

SEQ ID NO: 3615556 - DNA, 12 bp, Homo sapiens
ggagaagccagg

SEQ ID NO: 3615557 - DNA, 12 bp, Homo sapiens
ggagaagccagt

SEQ ID NO: 3615558 - DNA, 13 bp, Homo sapiens
ggagaaggcctgg

SEQ ID NO: 3615559 - DNA, 17 bp, Homo sapiens
ggagaaggcctggaaga

SEQ ID NO: 3615560 - DNA, 23 bp, Homo sapiens
ggagaaggtctgtggtgcagtgt

SEQ ID NO: 3615561 - DNA, 20 bp, Homo sapiens
ggagaagtcttctatttatt

SEQ ID NO: 3615562 - DNA, 21 bp, Homo sapiens
ggagaagtcttctatttattt

SEQ ID NO: 3615563 - DNA, 16 bp, Homo sapiens
ggagaatggcatggca

SEQ ID NO: 3615564 - DNA, 19 bp, Homo sapiens
ggagaatggcatggcagga

SEQ ID NO: 3615565 - DNA, 23 bp, Homo sapiens
ggagaatggcatggcaggagtct

SEQ ID NO: 3615566 - DNA, 23 bp, Homo sapiens
ggagacagcagtttccagagagt

SEQ ID NO: 3615567 - DNA, 17 bp, Homo sapiens
ggagacagcttctctgc

SEQ ID NO: 3615568 - DNA, 19 bp, Homo sapiens
ggagacatgtgacatttat

SEQ ID NO: 3615569 - DNA, 16 bp, Homo sapiens
ggagactgtctcaaga

SEQ ID NO: 3615570 - DNA, 16 bp, Homo sapiens
ggagagactgagcagc

SEQ ID NO: 3615571 - DNA, 17 bp, Homo sapiens
ggagagactgagcagcc

SEQ ID NO: 3615572 - DNA, 19 bp, Homo sapiens
ggagagactgagcagccgc

SEQ ID NO: 3615573 - DNA, 15 bp, Homo sapiens
ggagagagaccccgc

SEQ ID NO: 3615574 - DNA, 17 bp, Homo sapiens
ggagagaggaggaaaag

SEQ ID NO: 3615575 - DNA, 23 bp, Homo sapiens
ggagagcagcagcaccaaccaca

SEQ ID NO: 3615576 - DNA, 21 bp, Homo sapiens
ggagagccatacataaaagaa

SEQ ID NO: 3615577 - DNA, 14 bp, Homo sapiens
ggagagcggctgga

SEQ ID NO: 3615578 - DNA, 16 bp, Homo sapiens
ggagagcggctggaga

SEQ ID NO: 3615579 - DNA, 21 bp, Homo sapiens
ggagaggcagcatgcttgggc

SEQ ID NO: 3615580 - DNA, 22 bp, Homo sapiens
ggagaggcagcatgcttgggct

SEQ ID NO: 3615581 - DNA, 23 bp, Homo sapiens
ggagaggcagcatgcttgggctg

SEQ ID NO: 3615582 - DNA, 13 bp, Homo sapiens
ggagaggtggccg

SEQ ID NO: 3615583 - DNA, 18 bp, Homo sapiens
ggagagtttcctgaaaca

SEQ ID NO: 3615584 - DNA, 15 bp, Homo sapiens
ggagataaggtggct

SEQ ID NO: 3615585 - DNA, 16 bp, Homo sapiens
ggagataaggtggctt

SEQ ID NO: 3615586 - DNA, 13 bp, Homo sapiens
ggagatgaccagg

SEQ ID NO: 3615587 - DNA, 14 bp, Homo sapiens
ggagatgctgtgcc

SEQ ID NO: 3615588 - DNA, 15 bp, Homo sapiens
ggagatggactcagg

SEQ ID NO: 3615589 - DNA, 16 bp, Homo sapiens
ggagatggagggcttg

SEQ ID NO: 3615590 - DNA, 13 bp, Homo sapiens
ggagcaagcagga

SEQ ID NO: 3615591 - DNA, 23 bp, Homo sapiens
ggagcacccagagcaccccctgc

SEQ ID NO: 3615592 - DNA, 12 bp, Homo sapiens
ggagcagcagga

SEQ ID NO: 3615593 - DNA, 13 bp, Homo sapiens
ggagcagcaggcc

SEQ ID NO: 3615594 - DNA, 21 bp, Homo sapiens
ggagcagcaggcctctgggac

SEQ ID NO: 3615595 - DNA, 22 bp, Homo sapiens
ggagcagcaggcctctgggacc

SEQ ID NO: 3615596 - DNA, 20 bp, Homo sapiens
ggagcaggttccccaagggc

SEQ ID NO: 3615597 - DNA, 15 bp, Homo sapiens
ggagcatctccagtg

SEQ ID NO: 3615598 - DNA, 23 bp, Homo sapiens
ggagcattgcagcctaagaagaa

SEQ ID NO: 3615599 - DNA, 20 bp, Homo sapiens
ggagccaaatgaccgagccc

SEQ ID NO: 3615600 - DNA, 16 bp, Homo sapiens
ggagccaagggatgga

SEQ ID NO: 3615601 - DNA, 21 bp, Homo sapiens
ggagccagcctgcttcccaca

SEQ ID NO: 3615602 - DNA, 12 bp, Homo sapiens
ggagccaggact

SEQ ID NO: 3615603 - DNA, 13 bp, Homo sapiens
ggagccaggactc

SEQ ID NO: 3615604 - DNA, 20 bp, Homo sapiens
ggagcccactgtcctgggcc

SEQ ID NO: 3615605 - DNA, 12 bp, Homo sapiens
ggagcccagcct

SEQ ID NO: 3615606 - DNA, 13 bp, Homo sapiens
ggagcccagcctg

SEQ ID NO: 3615607 - DNA, 20 bp, Homo sapiens
ggagcccagcctgggagccc

SEQ ID NO: 3615608 - DNA, 13 bp, Homo sapiens
ggagccccctctg

SEQ ID NO: 3615609 - DNA, 15 bp, Homo sapiens
ggagccccctctgcc

SEQ ID NO: 3615610 - DNA, 16 bp, Homo sapiens
ggagccccgccacagc

SEQ ID NO: 3615611 - DNA, 17 bp, Homo sapiens
ggagccctattgctgct

SEQ ID NO: 3615612 - DNA, 19 bp, Homo sapiens
ggagccgaagcccaggggc

SEQ ID NO: 3615613 - DNA, 22 bp, Homo sapiens
ggagccgaagcccaggggccgg

SEQ ID NO: 3615614 - DNA, 19 bp, Homo sapiens
ggagccggtaactgtcctg

SEQ ID NO: 3615615 - DNA, 23 bp, Homo sapiens
ggagccggtaactgtcctgtcct

SEQ ID NO: 3615616 - DNA, 18 bp, Homo sapiens
ggagcctacctctgtctg

SEQ ID NO: 3615617 - DNA, 22 bp, Homo sapiens
ggagcctagcggagcccagcct

SEQ ID NO: 3615618 - DNA, 14 bp, Homo sapiens
ggagcctagctcct

SEQ ID NO: 3615619 - DNA, 14 bp, Homo sapiens
ggagcctctggctt

SEQ ID NO: 3615620 - DNA, 16 bp, Homo sapiens
ggagcctgaagggtgc

SEQ ID NO: 3615621 - DNA, 19 bp, Homo sapiens
ggagcctggccaggcaggg

SEQ ID NO: 3615622 - DNA, 21 bp, Homo sapiens
ggagcctgtgcgtcccagctg

SEQ ID NO: 3615623 - DNA, 16 bp, Homo sapiens
ggagcgccctgcaggg

SEQ ID NO: 3615624 - DNA, 23 bp, Homo sapiens
ggagcgccctgcagggccgggca

SEQ ID NO: 3615625 - DNA, 20 bp, Homo sapiens
ggagctctggggacagcttc

SEQ ID NO: 3615626 - DNA, 12 bp, Homo sapiens
ggagctgccaca

SEQ ID NO: 3615627 - DNA, 13 bp, Homo sapiens
ggagctgccacag

SEQ ID NO: 3615628 - DNA, 15 bp, Homo sapiens
ggagctgccacagag

SEQ ID NO: 3615629 - DNA, 14 bp, Homo sapiens
ggagctgctgggtg

SEQ ID NO: 3615630 - DNA, 16 bp, Homo sapiens
ggagctgctgggtggc

SEQ ID NO: 3615631 - DNA, 17 bp, Homo sapiens
ggagctggggatccctc

SEQ ID NO: 3615632 - DNA, 16 bp, Homo sapiens
ggagcttcagccaggt

SEQ ID NO: 3615633 - DNA, 19 bp, Homo sapiens
ggagcttctcccagtgtga

SEQ ID NO: 3615634 - DNA, 22 bp, Homo sapiens
ggaggaaaaccaagccgtggct

SEQ ID NO: 3615635 - DNA, 17 bp, Homo sapiens
ggaggaaaaggcccctg

SEQ ID NO: 3615636 - DNA, 23 bp, Homo sapiens
ggaggacctggcgtgctcagacc

SEQ ID NO: 3615637 - DNA, 15 bp, Homo sapiens
ggaggcacactttct

SEQ ID NO: 3615638 - DNA, 15 bp, Homo sapiens
ggaggccaaccagcc

SEQ ID NO: 3615639 - DNA, 13 bp, Homo sapiens
ggaggccacccca

SEQ ID NO: 3615640 - DNA, 17 bp, Homo sapiens
ggaggccatctggagag

SEQ ID NO: 3615641 - DNA, 15 bp, Homo sapiens
ggaggcccatgccct

SEQ ID NO: 3615642 - DNA, 18 bp, Homo sapiens
ggaggccgaggtgggcag

SEQ ID NO: 3615643 - DNA, 20 bp, Homo sapiens
ggaggctgctcggctactgg

SEQ ID NO: 3615644 - DNA, 17 bp, Homo sapiens
ggagggatgaccttccc

SEQ ID NO: 3615645 - DNA, 18 bp, Homo sapiens
ggagggatgaccttccca

SEQ ID NO: 3615646 - DNA, 12 bp, Homo sapiens
ggagggatttgg

SEQ ID NO: 3615647 - DNA, 14 bp, Homo sapiens
ggagggcagctggc

SEQ ID NO: 3615648 - DNA, 19 bp, Homo sapiens
ggagggcttggcccagcgc

SEQ ID NO: 3615649 - DNA, 13 bp, Homo sapiens
ggaggggcctagg

SEQ ID NO: 3615650 - DNA, 16 bp, Homo sapiens
ggaggggggagggaag

SEQ ID NO: 3615651 - DNA, 23 bp, Homo sapiens
ggagggggtttgctggggaactg

SEQ ID NO: 3615652 - DNA, 13 bp, Homo sapiens
ggaggtccaagca

SEQ ID NO: 3615653 - DNA, 22 bp, Homo sapiens
ggaggtccctggtcggagaggg

SEQ ID NO: 3615654 - DNA, 16 bp, Homo sapiens
ggaggtctccaggggc

SEQ ID NO: 3615655 - DNA, 21 bp, Homo sapiens
ggaggtctccaggggcctgca

SEQ ID NO: 3615656 - DNA, 22 bp, Homo sapiens
ggaggtctccaggggcctgcag

SEQ ID NO: 3615657 - DNA, 14 bp, Homo sapiens
ggaggtctctggga

SEQ ID NO: 3615658 - DNA, 21 bp, Homo sapiens
ggaggtctctgggagcccaga

SEQ ID NO: 3615659 - DNA, 17 bp, Homo sapiens
ggaggtctggctgagcc

SEQ ID NO: 3615660 - DNA, 22 bp, Homo sapiens
ggaggtctggctgagcccctgg

SEQ ID NO: 3615661 - DNA, 21 bp, Homo sapiens
ggaggtgggcaaagggaagta

SEQ ID NO: 3615662 - DNA, 12 bp, Homo sapiens
ggaggtggtcct

SEQ ID NO: 3615663 - DNA, 19 bp, Homo sapiens
ggagtccactcccagtgct

SEQ ID NO: 3615664 - DNA, 20 bp, Homo sapiens
ggagtccaggacaggagatg

SEQ ID NO: 3615665 - DNA, 20 bp, Homo sapiens
ggagtgcaatgacacagtct

SEQ ID NO: 3615666 - DNA, 13 bp, Homo sapiens
ggagtgcctggag

SEQ ID NO: 3615667 - DNA, 15 bp, Homo sapiens
ggagtgcctggagtc

SEQ ID NO: 3615668 - DNA, 17 bp, Homo sapiens
ggagtgcctggagtcag

SEQ ID NO: 3615669 - DNA, 22 bp, Homo sapiens
ggagtgctcttcccactccagc

SEQ ID NO: 3615670 - DNA, 22 bp, Homo sapiens
ggagtggaatagtatcctccag

SEQ ID NO: 3615671 - DNA, 17 bp, Homo sapiens
ggagtggttaggcagca

SEQ ID NO: 3615672 - DNA, 17 bp, Homo sapiens
ggagtgtcctgcccatg

SEQ ID NO: 3615673 - DNA, 15 bp, Homo sapiens
ggagttaagacctgg

SEQ ID NO: 3615674 - DNA, 22 bp, Homo sapiens
ggagttccttatccctctcttc

SEQ ID NO: 3615675 - DNA, 14 bp, Homo sapiens
ggagttgatctgga

SEQ ID NO: 3615676 - DNA, 22 bp, Homo sapiens
ggagttgatctggaacccagac

SEQ ID NO: 3615677 - DNA, 21 bp, Homo sapiens
ggagtttgtggtaacttgaga

SEQ ID NO: 3615678 - DNA, 15 bp, Homo sapiens
ggagttttataaatt

SEQ ID NO: 3615679 - DNA, 23 bp, Homo sapiens
ggataagtttctattctgtcagt

SEQ ID NO: 3615680 - DNA, 20 bp, Homo sapiens
ggatagatgctggcccaggg

SEQ ID NO: 3615681 - DNA, 14 bp, Homo sapiens
ggatagatgtgtgg

SEQ ID NO: 3615682 - DNA, 17 bp, Homo sapiens
ggatagtgttctgctcc

SEQ ID NO: 3615683 - DNA, 19 bp, Homo sapiens
ggatatataggctattttc

SEQ ID NO: 3615684 - DNA, 20 bp, Homo sapiens
ggatatggcaggactcctgg

SEQ ID NO: 3615685 - DNA, 14 bp, Homo sapiens
ggatatttcaatct

SEQ ID NO: 3615686 - DNA, 22 bp, Homo sapiens
ggatcaaaccccgaccacctgc

SEQ ID NO: 3615687 - DNA, 21 bp, Homo sapiens
ggatcagttaactattgcatt

SEQ ID NO: 3615688 - DNA, 12 bp, Homo sapiens
ggatccagccac

SEQ ID NO: 3615689 - DNA, 13 bp, Homo sapiens
ggatccagccact

SEQ ID NO: 3615690 - DNA, 21 bp, Homo sapiens
ggatccagccacttccccctc

SEQ ID NO: 3615691 - DNA, 17 bp, Homo sapiens
ggatccaggcccctccc

SEQ ID NO: 3615692 - DNA, 18 bp, Homo sapiens
ggatccaggcccctccct

SEQ ID NO: 3615693 - DNA, 19 bp, Homo sapiens
ggatccagggcagcaggcc

SEQ ID NO: 3615694 - DNA, 21 bp, Homo sapiens
ggatccatcttgagccacagt

SEQ ID NO: 3615695 - DNA, 14 bp, Homo sapiens
ggatcctccacaga

SEQ ID NO: 3615696 - DNA, 17 bp, Homo sapiens
ggatcctccacagagag

SEQ ID NO: 3615697 - DNA, 12 bp, Homo sapiens
ggatcctgctgg

SEQ ID NO: 3615698 - DNA, 17 bp, Homo sapiens
ggatctgctgggctctg

SEQ ID NO: 3615699 - DNA, 19 bp, Homo sapiens
ggatctggggagagcggct

SEQ ID NO: 3615700 - DNA, 20 bp, Homo sapiens
ggatctggggagagcggctg

SEQ ID NO: 3615701 - DNA, 16 bp, Homo sapiens
ggatcttcccacagga

SEQ ID NO: 3615702 - DNA, 18 bp, Homo sapiens
ggatcttcccacaggagg

SEQ ID NO: 3615703 - DNA, 19 bp, Homo sapiens
ggatcttcccacaggaggg

SEQ ID NO: 3615704 - DNA, 16 bp, Homo sapiens
ggatctttgtggccaa

SEQ ID NO: 3615705 - DNA, 19 bp, Homo sapiens
ggatgacaccctggcctga

SEQ ID NO: 3615706 - DNA, 22 bp, Homo sapiens
ggatgaccttcccagggagaaa

SEQ ID NO: 3615707 - DNA, 18 bp, Homo sapiens
ggatgagaaacagctcag

SEQ ID NO: 3615708 - DNA, 19 bp, Homo sapiens
ggatgatgagggaagcaat

SEQ ID NO: 3615709 - DNA, 18 bp, Homo sapiens
ggatgatggcagagccag

SEQ ID NO: 3615710 - DNA, 18 bp, Homo sapiens
ggatgcggatcctgctgg

SEQ ID NO: 3615711 - DNA, 21 bp, Homo sapiens
ggatgcggatcctgctggggc

SEQ ID NO: 3615712 - DNA, 23 bp, Homo sapiens
ggatgctactactgcagtcttta

SEQ ID NO: 3615713 - DNA, 15 bp, Homo sapiens
ggatgctgggctggg

SEQ ID NO: 3615714 - DNA, 13 bp, Homo sapiens
ggatggacatctt

SEQ ID NO: 3615715 - DNA, 19 bp, Homo sapiens
ggatggagaaagaagtgga

SEQ ID NO: 3615716 - DNA, 17 bp, Homo sapiens
ggatgggggaactcaga

SEQ ID NO: 3615717 - DNA, 20 bp, Homo sapiens
ggatggtaggattgctgggg

SEQ ID NO: 3615718 - DNA, 14 bp, Homo sapiens
ggatgttctgcctc

SEQ ID NO: 3615719 - DNA, 20 bp, Homo sapiens
ggattataggcatgagccac

SEQ ID NO: 3615720 - DNA, 16 bp, Homo sapiens
ggattattttttcaga

SEQ ID NO: 3615721 - DNA, 21 bp, Homo sapiens
ggattcacccccctctgctgc

SEQ ID NO: 3615722 - DNA, 23 bp, Homo sapiens
ggattcacccccctctgctgccg

SEQ ID NO: 3615723 - DNA, 22 bp, Homo sapiens
ggattcctgagctggcctgtct

SEQ ID NO: 3615724 - DNA, 16 bp, Homo sapiens
ggattgatcattcttt

SEQ ID NO: 3615725 - DNA, 23 bp, Homo sapiens
ggattgcccctggctttgcctct

SEQ ID NO: 3615726 - DNA, 20 bp, Homo sapiens
ggattggggggtgggctttg

SEQ ID NO: 3615727 - DNA, 16 bp, Homo sapiens
ggattggggtccctct

SEQ ID NO: 3615728 - DNA, 23 bp, Homo sapiens
ggattgtgcctaatgtgtttgag

SEQ ID NO: 3615729 - DNA, 18 bp, Homo sapiens
ggatttcctagtggagtt

SEQ ID NO: 3615730 - DNA, 13 bp, Homo sapiens
ggcaaagcccctc

SEQ ID NO: 3615731 - DNA, 16 bp, Homo sapiens
ggcaaaggcctggaca

SEQ ID NO: 3615732 - DNA, 14 bp, Homo sapiens
ggcaaatccaggct

SEQ ID NO: 3615733 - DNA, 12 bp, Homo sapiens
ggcaacaggatt

SEQ ID NO: 3615734 - DNA, 16 bp, Homo sapiens
ggcaacgcacaaaaca

SEQ ID NO: 3615735 - DNA, 19 bp, Homo sapiens
ggcaacgtagcctgggctc

SEQ ID NO: 3615736 - DNA, 23 bp, Homo sapiens
ggcaactgacattgctccaagat

SEQ ID NO: 3615737 - DNA, 16 bp, Homo sapiens
ggcaagaacagtgggc

SEQ ID NO: 3615738 - DNA, 21 bp, Homo sapiens
ggcaagacagaaaagtgcctg

SEQ ID NO: 3615739 - DNA, 14 bp, Homo sapiens
ggcaagcagatgac

SEQ ID NO: 3615740 - DNA, 19 bp, Homo sapiens
ggcaagctaggccccagag

SEQ ID NO: 3615741 - DNA, 21 bp, Homo sapiens
ggcaagctaggccccagaggc

SEQ ID NO: 3615742 - DNA, 20 bp, Homo sapiens
ggcaataaataaagcttggg

SEQ ID NO: 3615743 - DNA, 21 bp, Homo sapiens
ggcacaaaagacagctggcgg

SEQ ID NO: 3615744 - DNA, 13 bp, Homo sapiens
ggcacaaacagaa

SEQ ID NO: 3615745 - DNA, 23 bp, Homo sapiens
ggcacaatgttggagcagcaggc

SEQ ID NO: 3615746 - DNA, 21 bp, Homo sapiens
ggcacacactgtgccccacaa

SEQ ID NO: 3615747 - DNA, 16 bp, Homo sapiens
ggcacacctcctccca

SEQ ID NO: 3615748 - DNA, 20 bp, Homo sapiens
ggcacacctcctcccactgc

SEQ ID NO: 3615749 - DNA, 22 bp, Homo sapiens
ggcacacctcctcccactgccc

SEQ ID NO: 3615750 - DNA, 13 bp, Homo sapiens
ggcacaccttgca

SEQ ID NO: 3615751 - DNA, 18 bp, Homo sapiens
ggcacacgctgctctgcc

SEQ ID NO: 3615752 - DNA, 16 bp, Homo sapiens
ggcacactttctggca

SEQ ID NO: 3615753 - DNA, 13 bp, Homo sapiens
ggcacagaccagg

SEQ ID NO: 3615754 - DNA, 16 bp, Homo sapiens
ggcacagaccaggcct

SEQ ID NO: 3615755 - DNA, 17 bp, Homo sapiens
ggcacagaccaggcctt

SEQ ID NO: 3615756 - DNA, 16 bp, Homo sapiens
ggcacagtgggagctg

SEQ ID NO: 3615757 - DNA, 13 bp, Homo sapiens
ggcaccagacacc

SEQ ID NO: 3615758 - DNA, 17 bp, Homo sapiens
ggcaccagacacccagg

SEQ ID NO: 3615759 - DNA, 23 bp, Homo sapiens
ggcacccccacaagctgtccctg

SEQ ID NO: 3615760 - DNA, 24 bp, Homo sapiens
ggcacccccacaagctgtccctgc

SEQ ID NO: 3615761 - DNA, 16 bp, Homo sapiens
ggcaccgtccaggccc

SEQ ID NO: 3615762 - DNA, 15 bp, Homo sapiens
ggcacctaatccagg

SEQ ID NO: 3615763 - DNA, 16 bp, Homo sapiens
ggcacctaatccaggc

SEQ ID NO: 3615764 - DNA, 19 bp, Homo sapiens
ggcacctaatccaggcaga

SEQ ID NO: 3615765 - DNA, 16 bp, Homo sapiens
ggcacctcacaggccc

SEQ ID NO: 3615766 - DNA, 19 bp, Homo sapiens
ggcacctcacaggccccag

SEQ ID NO: 3615767 - DNA, 13 bp, Homo sapiens
ggcactgagcagg

SEQ ID NO: 3615768 - DNA, 15 bp, Homo sapiens
ggcactgagcaggga

SEQ ID NO: 3615769 - DNA, 17 bp, Homo sapiens
ggcagaaacaataaaac

SEQ ID NO: 3615770 - DNA, 23 bp, Homo sapiens
ggcagagaccataagagaaacct

SEQ ID NO: 3615771 - DNA, 21 bp, Homo sapiens
ggcagaggagaacttgctgcc

SEQ ID NO: 3615772 - DNA, 22 bp, Homo sapiens
ggcagaggagaacttgctgcct

SEQ ID NO: 3615773 - DNA, 19 bp, Homo sapiens
ggcagagtggcgtggcctc

SEQ ID NO: 3615774 - DNA, 19 bp, Homo sapiens
ggcagagttacagttctgt

SEQ ID NO: 3615775 - DNA, 16 bp, Homo sapiens
ggcagcaatttaaatg

SEQ ID NO: 3615776 - DNA, 22 bp, Homo sapiens
ggcagcactccccagagctgtg

SEQ ID NO: 3615777 - DNA, 13 bp, Homo sapiens
ggcagcagccccc

SEQ ID NO: 3615778 - DNA, 14 bp, Homo sapiens
ggcagcaggccaga

SEQ ID NO: 3615779 - DNA, 16 bp, Homo sapiens
ggcagcaggccagaga

SEQ ID NO: 3615780 - DNA, 18 bp, Homo sapiens
ggcagccccgttttgggg

SEQ ID NO: 3615781 - DNA, 18 bp, Homo sapiens
ggcagccgtgccttcagc

SEQ ID NO: 3615782 - DNA, 19 bp, Homo sapiens
ggcagccgtgccttcagct

SEQ ID NO: 3615783 - DNA, 14 bp, Homo sapiens
ggcagcgaccccag

SEQ ID NO: 3615784 - DNA, 19 bp, Homo sapiens
ggcagcgaccccaggacct

SEQ ID NO: 3615785 - DNA, 12 bp, Homo sapiens
ggcagcgcaggg

SEQ ID NO: 3615786 - DNA, 13 bp, Homo sapiens
ggcagcgcagggc

SEQ ID NO: 3615787 - DNA, 13 bp, Homo sapiens
ggcagctagtgcc

SEQ ID NO: 3615788 - DNA, 14 bp, Homo sapiens
ggcagctagtgcct

SEQ ID NO: 3615789 - DNA, 15 bp, Homo sapiens
ggcagctagtgcctt

SEQ ID NO: 3615790 - DNA, 17 bp, Homo sapiens
ggcagctagtgccttta

SEQ ID NO: 3615791 - DNA, 17 bp, Homo sapiens
ggcagctatttcagcct

SEQ ID NO: 3615792 - DNA, 15 bp, Homo sapiens
ggcagctctggacag

SEQ ID NO: 3615793 - DNA, 21 bp, Homo sapiens
ggcagctggcccccagccctg

SEQ ID NO: 3615794 - DNA, 23 bp, Homo sapiens
ggcagctggcccccagccctggg

SEQ ID NO: 3615795 - DNA, 23 bp, Homo sapiens
ggcaggaccttcgggctgtgccc

SEQ ID NO: 3615796 - DNA, 20 bp, Homo sapiens
ggcaggactcctggcagggc

SEQ ID NO: 3615797 - DNA, 21 bp, Homo sapiens
ggcaggacttctcaccagcag

SEQ ID NO: 3615798 - DNA, 14 bp, Homo sapiens
ggcaggagtctctg

SEQ ID NO: 3615799 - DNA, 19 bp, Homo sapiens
ggcaggagtctctgccagt

SEQ ID NO: 3615800 - DNA, 15 bp, Homo sapiens
ggcaggcccactccc

SEQ ID NO: 3615801 - DNA, 18 bp, Homo sapiens
ggcaggcccactccccag

SEQ ID NO: 3615802 - DNA, 21 bp, Homo sapiens
ggcagggaaggacaggaccct

SEQ ID NO: 3615803 - DNA, 16 bp, Homo sapiens
ggcagggacctaaagg

SEQ ID NO: 3615804 - DNA, 20 bp, Homo sapiens
ggcagggacctaaagggact

SEQ ID NO: 3615805 - DNA, 18 bp, Homo sapiens
ggcagggacctgagagca

SEQ ID NO: 3615806 - DNA, 22 bp, Homo sapiens
ggcagggatgatggcagagcca

SEQ ID NO: 3615807 - DNA, 12 bp, Homo sapiens
ggcagggcaaga

SEQ ID NO: 3615808 - DNA, 19 bp, Homo sapiens
ggcagggccacctgcagga

SEQ ID NO: 3615809 - DNA, 22 bp, Homo sapiens
ggcagggccacctgcaggaccc

SEQ ID NO: 3615810 - DNA, 23 bp, Homo sapiens
ggcaggggagacaggagcctagc

SEQ ID NO: 3615811 - DNA, 13 bp, Homo sapiens
ggcaggggagcag

SEQ ID NO: 3615812 - DNA, 20 bp, Homo sapiens
ggcaggggaggccatctgga

SEQ ID NO: 3615813 - DNA, 23 bp, Homo sapiens
ggcagggggccccgccagggctg

SEQ ID NO: 3615814 - DNA, 21 bp, Homo sapiens
ggcagggggccctgccccacc

SEQ ID NO: 3615815 - DNA, 17 bp, Homo sapiens
ggcaggggggctgtggg

SEQ ID NO: 3615816 - DNA, 13 bp, Homo sapiens
ggcagtcctggag

SEQ ID NO: 3615817 - DNA, 15 bp, Homo sapiens
ggcagtcctggaggc

SEQ ID NO: 3615818 - DNA, 16 bp, Homo sapiens
ggcagtcctggaggca

SEQ ID NO: 3615819 - DNA, 19 bp, Homo sapiens
ggcagtgactccccagccc

SEQ ID NO: 3615820 - DNA, 17 bp, Homo sapiens
ggcagtgcacgcggctt

SEQ ID NO: 3615821 - DNA, 14 bp, Homo sapiens
ggcagtgcccatgt

SEQ ID NO: 3615822 - DNA, 10 bp, Homo sapiens
ggcagttttt

SEQ ID NO: 3615823 - DNA, 13 bp, Homo sapiens
ggcatagctctgg

SEQ ID NO: 3615824 - DNA, 22 bp, Homo sapiens
ggcatataattttcacttctgt

SEQ ID NO: 3615825 - DNA, 22 bp, Homo sapiens
ggcatccctttttcataaatta

SEQ ID NO: 3615826 - DNA, 18 bp, Homo sapiens
ggcatgagccactgtgct

SEQ ID NO: 3615827 - DNA, 17 bp, Homo sapiens
ggcatggccaggtggcc

SEQ ID NO: 3615828 - DNA, 16 bp, Homo sapiens
ggcatgggtccagggc

SEQ ID NO: 3615829 - DNA, 24 bp, Homo sapiens
ggcatgggtccagggcctgacacc

SEQ ID NO: 3615830 - DNA, 16 bp, Homo sapiens
ggcatgtgtctggccc

SEQ ID NO: 3615831 - DNA, 17 bp, Homo sapiens
ggcatgtgtctggccct

SEQ ID NO: 3615832 - DNA, 17 bp, Homo sapiens
ggcattagcaaggcaga

SEQ ID NO: 3615833 - DNA, 12 bp, Homo sapiens
ggcatttcaatc

SEQ ID NO: 3615834 - DNA, 22 bp, Homo sapiens
ggcatttggtgagagtcaaagc

SEQ ID NO: 3615835 - DNA, 17 bp, Homo sapiens
ggcatttgtttctttct

SEQ ID NO: 3615836 - DNA, 15 bp, Homo sapiens
ggccaacctcaggct

SEQ ID NO: 3615837 - DNA, 18 bp, Homo sapiens
ggccaagaatacttgaag

SEQ ID NO: 3615838 - DNA, 16 bp, Homo sapiens
ggccaaggagctgcta

SEQ ID NO: 3615839 - DNA, 16 bp, Homo sapiens
ggccaaggagggtgag

SEQ ID NO: 3615840 - DNA, 16 bp, Homo sapiens
ggccaaggtgccacca

SEQ ID NO: 3615841 - DNA, 13 bp, Homo sapiens
ggccacaaacctg

SEQ ID NO: 3615842 - DNA, 11 bp, Homo sapiens
ggccacagact

SEQ ID NO: 3615843 - DNA, 22 bp, Homo sapiens
ggccacagaggactcacttgcc

SEQ ID NO: 3615844 - DNA, 14 bp, Homo sapiens
ggccacattgctgg

SEQ ID NO: 3615845 - DNA, 17 bp, Homo sapiens
ggccacattgctggctg

SEQ ID NO: 3615846 - DNA, 21 bp, Homo sapiens
ggccaccccaaaccccagccc

SEQ ID NO: 3615847 - DNA, 16 bp, Homo sapiens
ggccaccggtgggcag

SEQ ID NO: 3615848 - DNA, 19 bp, Homo sapiens
ggccaccggtgggcagtgg

SEQ ID NO: 3615849 - DNA, 16 bp, Homo sapiens
ggccacctgcaggacc

SEQ ID NO: 3615850 - DNA, 19 bp, Homo sapiens
ggccactaaagcttcagac

SEQ ID NO: 3615851 - DNA, 13 bp, Homo sapiens
ggccactggggac

SEQ ID NO: 3615852 - DNA, 17 bp, Homo sapiens
ggccactttcagagccc

SEQ ID NO: 3615853 - DNA, 14 bp, Homo sapiens
ggccagagagggaa

SEQ ID NO: 3615854 - DNA, 18 bp, Homo sapiens
ggccagagagggaaaagg

SEQ ID NO: 3615855 - DNA, 16 bp, Homo sapiens
ggccagatccagcctg

SEQ ID NO: 3615856 - DNA, 18 bp, Homo sapiens
ggccagatccagcctggg

SEQ ID NO: 3615857 - DNA, 18 bp, Homo sapiens
ggccagcaccatctcttt

SEQ ID NO: 3615858 - DNA, 14 bp, Homo sapiens
ggccagcagctgat

SEQ ID NO: 3615859 - DNA, 17 bp, Homo sapiens
ggccagcagctgatgct

SEQ ID NO: 3615860 - DNA, 15 bp, Homo sapiens
ggccagcccagccag

SEQ ID NO: 3615861 - DNA, 17 bp, Homo sapiens
ggccagcccagccaggc

SEQ ID NO: 3615862 - DNA, 12 bp, Homo sapiens
ggccagctctgg

SEQ ID NO: 3615863 - DNA, 16 bp, Homo sapiens
ggccaggacgggccac

SEQ ID NO: 3615864 - DNA, 15 bp, Homo sapiens
ggccaggccagctgc

SEQ ID NO: 3615865 - DNA, 17 bp, Homo sapiens
ggccaggccagctgcct

SEQ ID NO: 3615866 - DNA, 18 bp, Homo sapiens
ggccaggccttatctgaa

SEQ ID NO: 3615867 - DNA, 21 bp, Homo sapiens
ggccaggctgatgggacagaa

SEQ ID NO: 3615868 - DNA, 16 bp, Homo sapiens
ggccaggtgcagacct

SEQ ID NO: 3615869 - DNA, 21 bp, Homo sapiens
ggccagtgagatcaatgtgac

SEQ ID NO: 3615870 - DNA, 17 bp, Homo sapiens
ggccataaacggttcct

SEQ ID NO: 3615871 - DNA, 21 bp, Homo sapiens
ggccataaacggttcctggtg

SEQ ID NO: 3615872 - DNA, 22 bp, Homo sapiens
ggccataaacggttcctggtga

SEQ ID NO: 3615873 - DNA, 16 bp, Homo sapiens
ggccatccttctgtgt

SEQ ID NO: 3615874 - DNA, 17 bp, Homo sapiens
ggccatccttctgtgta

SEQ ID NO: 3615875 - DNA, 14 bp, Homo sapiens
ggccatctggagag

SEQ ID NO: 3615876 - DNA, 16 bp, Homo sapiens
ggccatctggagagcc

SEQ ID NO: 3615877 - DNA, 14 bp, Homo sapiens
ggccatcttctttc

SEQ ID NO: 3615878 - DNA, 18 bp, Homo sapiens
ggccatgatggcaacaga

SEQ ID NO: 3615879 - DNA, 18 bp, Homo sapiens
ggccatgcctcctcagga

SEQ ID NO: 3615880 - DNA, 11 bp, Homo sapiens
ggccatgctca

SEQ ID NO: 3615881 - DNA, 21 bp, Homo sapiens
ggccatttccaagaggctgta

SEQ ID NO: 3615882 - DNA, 21 bp, Homo sapiens
ggcccaagtggggtgctctgg

SEQ ID NO: 3615883 - DNA, 13 bp, Homo sapiens
ggcccacacctgg

SEQ ID NO: 3615884 - DNA, 13 bp, Homo sapiens
ggcccactcccca

SEQ ID NO: 3615885 - DNA, 14 bp, Homo sapiens
ggcccactccccag

SEQ ID NO: 3615886 - DNA, 22 bp, Homo sapiens
ggcccagcccagagccacctgg

SEQ ID NO: 3615887 - DNA, 16 bp, Homo sapiens
ggcccaggagacctcc

SEQ ID NO: 3615888 - DNA, 14 bp, Homo sapiens
ggcccagggcccag

SEQ ID NO: 3615889 - DNA, 21 bp, Homo sapiens
ggcccagggcccagagcccag

SEQ ID NO: 3615890 - DNA, 12 bp, Homo sapiens
ggccccaccggc

SEQ ID NO: 3615891 - DNA, 16 bp, Homo sapiens
ggccccaccggccagg

SEQ ID NO: 3615892 - DNA, 21 bp, Homo sapiens
ggccccacctcggcacacact

SEQ ID NO: 3615893 - DNA, 13 bp, Homo sapiens
ggccccagaggcc

SEQ ID NO: 3615894 - DNA, 14 bp, Homo sapiens
ggccccagaggccc

SEQ ID NO: 3615895 - DNA, 16 bp, Homo sapiens
ggccccagaggccctg

SEQ ID NO: 3615896 - DNA, 18 bp, Homo sapiens
ggccccagaggccctgga

SEQ ID NO: 3615897 - DNA, 19 bp, Homo sapiens
ggccccagtgcggttcctc

SEQ ID NO: 3615898 - DNA, 20 bp, Homo sapiens
ggccccagtgcggttcctca

SEQ ID NO: 3615899 - DNA, 21 bp, Homo sapiens
ggccccatcctcatccctgac

SEQ ID NO: 3615900 - DNA, 18 bp, Homo sapiens
ggccccatggcagctcct

SEQ ID NO: 3615901 - DNA, 14 bp, Homo sapiens
ggcccccagccctg

SEQ ID NO: 3615902 - DNA, 14 bp, Homo sapiens
ggccccctgtcctc

SEQ ID NO: 3615903 - DNA, 17 bp, Homo sapiens
ggcccccttcaggagcc

SEQ ID NO: 3615904 - DNA, 23 bp, Homo sapiens
ggccccgacgtttgcggcagtgt

SEQ ID NO: 3615905 - DNA, 13 bp, Homo sapiens
ggccccgccaggg

SEQ ID NO: 3615906 - DNA, 18 bp, Homo sapiens
ggccccgccagggctggg

SEQ ID NO: 3615907 - DNA, 14 bp, Homo sapiens
ggccccgggctgga

SEQ ID NO: 3615908 - DNA, 17 bp, Homo sapiens
ggccccgggctggagaa

SEQ ID NO: 3615909 - DNA, 20 bp, Homo sapiens
ggcccctaggtgcccagggc

SEQ ID NO: 3615910 - DNA, 15 bp, Homo sapiens
ggcccgacagcctgg

SEQ ID NO: 3615911 - DNA, 21 bp, Homo sapiens
ggcccgcatgtgcattctttt

SEQ ID NO: 3615912 - DNA, 17 bp, Homo sapiens
ggcccgcgcagctgcct

SEQ ID NO: 3615913 - DNA, 12 bp, Homo sapiens
ggcccggccagc

SEQ ID NO: 3615914 - DNA, 20 bp, Homo sapiens
ggcccggccagccatgtctg

SEQ ID NO: 3615915 - DNA, 17 bp, Homo sapiens
ggccctcattctcattt

SEQ ID NO: 3615916 - DNA, 22 bp, Homo sapiens
ggccctccctgtctccagggcc

SEQ ID NO: 3615917 - DNA, 23 bp, Homo sapiens
ggccctccctgttccccagagaa

SEQ ID NO: 3615918 - DNA, 15 bp, Homo sapiens
ggccctcctcagctc

SEQ ID NO: 3615919 - DNA, 16 bp, Homo sapiens
ggccctcctcagctcc

SEQ ID NO: 3615920 - DNA, 17 bp, Homo sapiens
ggccctcctcagctccc

SEQ ID NO: 3615921 - DNA, 19 bp, Homo sapiens
ggccctcctcagctccctg

SEQ ID NO: 3615922 - DNA, 20 bp, Homo sapiens
ggccctcctcagctccctgc

SEQ ID NO: 3615923 - DNA, 14 bp, Homo sapiens
ggccctctttccct

SEQ ID NO: 3615924 - DNA, 17 bp, Homo sapiens
ggccctctttccctgcg

SEQ ID NO: 3615925 - DNA, 19 bp, Homo sapiens
ggccctctttccctgcgag

SEQ ID NO: 3615926 - DNA, 20 bp, Homo sapiens
ggccctgccccaccccatcc

SEQ ID NO: 3615927 - DNA, 10 bp, Homo sapiens
ggccctgcta

SEQ ID NO: 3615928 - DNA, 12 bp, Homo sapiens
ggccctggaggt

SEQ ID NO: 3615929 - DNA, 11 bp, Homo sapiens
ggccctggggg

SEQ ID NO: 3615930 - DNA, 13 bp, Homo sapiens
ggcccttcctctc

SEQ ID NO: 3615931 - DNA, 17 bp, Homo sapiens
ggcccttcctctccact

SEQ ID NO: 3615932 - DNA, 19 bp, Homo sapiens
ggcccttcctctccactgc

SEQ ID NO: 3615933 - DNA, 22 bp, Homo sapiens
ggcccttcctctccactgcctt

SEQ ID NO: 3615934 - DNA, 14 bp, Homo sapiens
ggccgcagggcggg

SEQ ID NO: 3615935 - DNA, 18 bp, Homo sapiens
ggccgcagggcggggctg

SEQ ID NO: 3615936 - DNA, 22 bp, Homo sapiens
ggccgccacggcctggctggtg

SEQ ID NO: 3615937 - DNA, 18 bp, Homo sapiens
ggccgccccgccccagag

SEQ ID NO: 3615938 - DNA, 22 bp, Homo sapiens
ggccgccccgccccagagctcc

SEQ ID NO: 3615939 - DNA, 13 bp, Homo sapiens
ggccgcccggcag

SEQ ID NO: 3615940 - DNA, 14 bp, Homo sapiens
ggccgcccggcagt

SEQ ID NO: 3615941 - DNA, 16 bp, Homo sapiens
ggccgcccggcagtgc

SEQ ID NO: 3615942 - DNA, 14 bp, Homo sapiens
ggccgcgccacccg

SEQ ID NO: 3615943 - DNA, 16 bp, Homo sapiens
ggccgcgcccagcaga

SEQ ID NO: 3615944 - DNA, 15 bp, Homo sapiens
ggccgctgccaccca

SEQ ID NO: 3615945 - DNA, 23 bp, Homo sapiens
ggccgctgccacccacctccctg

SEQ ID NO: 3615946 - DNA, 19 bp, Homo sapiens
ggccggagggcaggaccct

SEQ ID NO: 3615947 - DNA, 18 bp, Homo sapiens
ggccggctttcaggagct

SEQ ID NO: 3615948 - DNA, 19 bp, Homo sapiens
ggccggctttcaggagctc

SEQ ID NO: 3615949 - DNA, 14 bp, Homo sapiens
ggccgggcaggggg

SEQ ID NO: 3615950 - DNA, 15 bp, Homo sapiens
ggcctcagccagaga

SEQ ID NO: 3615951 - DNA, 17 bp, Homo sapiens
ggcctcagccagagaag

SEQ ID NO: 3615952 - DNA, 13 bp, Homo sapiens
ggcctcagcctgc

SEQ ID NO: 3615953 - DNA, 14 bp, Homo sapiens
ggcctcaggctccg

SEQ ID NO: 3615954 - DNA, 13 bp, Homo sapiens
ggcctcaggctct

SEQ ID NO: 3615955 - DNA, 19 bp, Homo sapiens
ggcctccaacgcccctgtg

SEQ ID NO: 3615956 - DNA, 20 bp, Homo sapiens
ggcctccaacgcccctgtgg

SEQ ID NO: 3615957 - DNA, 13 bp, Homo sapiens
ggcctcccaaagt

SEQ ID NO: 3615958 - DNA, 19 bp, Homo sapiens
ggcctcccaaagtgctggg

SEQ ID NO: 3615959 - DNA, 16 bp, Homo sapiens
ggcctcccacagactc

SEQ ID NO: 3615960 - DNA, 22 bp, Homo sapiens
ggcctccctgctgtgccatgct

SEQ ID NO: 3615961 - DNA, 21 bp, Homo sapiens
ggcctccgtccaggagcctgg

SEQ ID NO: 3615962 - DNA, 19 bp, Homo sapiens
ggcctcctcggagagcagc

SEQ ID NO: 3615963 - DNA, 21 bp, Homo sapiens
ggcctcctcggagagcagcag

SEQ ID NO: 3615964 - DNA, 17 bp, Homo sapiens
ggcctcgtgaggggcaa

SEQ ID NO: 3615965 - DNA, 20 bp, Homo sapiens
ggcctcgtgctccgcagggc

SEQ ID NO: 3615966 - DNA, 19 bp, Homo sapiens
ggcctcttccgtgacgtca

SEQ ID NO: 3615967 - DNA, 20 bp, Homo sapiens
ggcctcttgagttcctctgc

SEQ ID NO: 3615968 - DNA, 16 bp, Homo sapiens
ggcctgaactgaggag

SEQ ID NO: 3615969 - DNA, 13 bp, Homo sapiens
ggcctgaagagtc

SEQ ID NO: 3615970 - DNA, 23 bp, Homo sapiens
ggcctgaagagtcctctgaatga

SEQ ID NO: 3615971 - DNA, 14 bp, Homo sapiens
ggcctgacaccccc

SEQ ID NO: 3615972 - DNA, 15 bp, Homo sapiens
ggcctgacaccccct

SEQ ID NO: 3615973 - DNA, 14 bp, Homo sapiens
ggcctgagggtcca

SEQ ID NO: 3615974 - DNA, 16 bp, Homo sapiens
ggcctgccccctgggc

SEQ ID NO: 3615975 - DNA, 13 bp, Homo sapiens
ggcctgctccaga

SEQ ID NO: 3615976 - DNA, 18 bp, Homo sapiens
ggcctgctgccagtgcag

SEQ ID NO: 3615977 - DNA, 19 bp, Homo sapiens
ggcctgctgccagtgcagc

SEQ ID NO: 3615978 - DNA, 19 bp, Homo sapiens
ggcctgcttgactttccag

SEQ ID NO: 3615979 - DNA, 20 bp, Homo sapiens
ggcctgcttgactttccaga

SEQ ID NO: 3615980 - DNA, 13 bp, Homo sapiens
ggcctggagcagg

SEQ ID NO: 3615981 - DNA, 15 bp, Homo sapiens
ggcctggagcaggcc

SEQ ID NO: 3615982 - DNA, 11 bp, Homo sapiens
ggcctggaggt

SEQ ID NO: 3615983 - DNA, 14 bp, Homo sapiens
ggcctggctggtgg

SEQ ID NO: 3615984 - DNA, 20 bp, Homo sapiens
ggcctgggtgatctgctgct

SEQ ID NO: 3615985 - DNA, 22 bp, Homo sapiens
ggcctgtcccaattctgcccgc

SEQ ID NO: 3615986 - DNA, 19 bp, Homo sapiens
ggcctgtcccttgcctctg

SEQ ID NO: 3615987 - DNA, 20 bp, Homo sapiens
ggcctgtcccttgcctctgc

SEQ ID NO: 3615988 - DNA, 19 bp, Homo sapiens
ggcctgtctcatcttctga

SEQ ID NO: 3615989 - DNA, 22 bp, Homo sapiens
ggcctgtctcatcttctgaaga

SEQ ID NO: 3615990 - DNA, 17 bp, Homo sapiens
ggcctgtctgcgtgggt

SEQ ID NO: 3615991 - DNA, 21 bp, Homo sapiens
ggcctgtgccagcaccacagc

SEQ ID NO: 3615992 - DNA, 16 bp, Homo sapiens
ggccttaaagagggac

SEQ ID NO: 3615993 - DNA, 18 bp, Homo sapiens
ggccttacatctggctgg

SEQ ID NO: 3615994 - DNA, 15 bp, Homo sapiens
ggccttcccatggcc

SEQ ID NO: 3615995 - DNA, 18 bp, Homo sapiens
ggcctttatgttctttca

SEQ ID NO: 3615996 - DNA, 19 bp, Homo sapiens
ggcctttcctctgcacgct

SEQ ID NO: 3615997 - DNA, 19 bp, Homo sapiens
ggcctttgcaagatgcttg

SEQ ID NO: 3615998 - DNA, 13 bp, Homo sapiens
ggcgcccagcgcc

SEQ ID NO: 3615999 - DNA, 18 bp, Homo sapiens
ggcgcccctgcctgtgcc

SEQ ID NO: 3616000 - DNA, 16 bp, Homo sapiens
ggcggaggggatccag

SEQ ID NO: 3616001 - DNA, 21 bp, Homo sapiens
ggcggaggggatccagccact

SEQ ID NO: 3616002 - DNA, 15 bp, Homo sapiens
ggcggcacagccttc

SEQ ID NO: 3616003 - DNA, 19 bp, Homo sapiens
ggcggcccggccggagggc

SEQ ID NO: 3616004 - DNA, 15 bp, Homo sapiens
ggcggctcctcctca

SEQ ID NO: 3616005 - DNA, 15 bp, Homo sapiens
ggcgggatcctccac

SEQ ID NO: 3616006 - DNA, 22 bp, Homo sapiens
ggcgggatcctccacagagagg

SEQ ID NO: 3616007 - DNA, 10 bp, Homo sapiens
ggcgggtgac

SEQ ID NO: 3616008 - DNA, 14 bp, Homo sapiens
ggcggtcccagctc

SEQ ID NO: 3616009 - DNA, 14 bp, Homo sapiens
ggcgtactacccag

SEQ ID NO: 3616010 - DNA, 20 bp, Homo sapiens
ggcgtactacccagctctgt

SEQ ID NO: 3616011 - DNA, 20 bp, Homo sapiens
ggcgtccagctcagccctgg

SEQ ID NO: 3616012 - DNA, 16 bp, Homo sapiens
ggcgtctgttccccct

SEQ ID NO: 3616013 - DNA, 13 bp, Homo sapiens
ggcgtgagccact

SEQ ID NO: 3616014 - DNA, 16 bp, Homo sapiens
ggcgtgctcagaccca

SEQ ID NO: 3616015 - DNA, 21 bp, Homo sapiens
ggcgtggtgtgtccctggaca

SEQ ID NO: 3616016 - DNA, 17 bp, Homo sapiens
ggctaaataaagaggag

SEQ ID NO: 3616017 - DNA, 16 bp, Homo sapiens
ggctaagaccctgtgt

SEQ ID NO: 3616018 - DNA, 19 bp, Homo sapiens
ggctacctcacctgggcag

SEQ ID NO: 3616019 - DNA, 18 bp, Homo sapiens
ggctactggttacctgga

SEQ ID NO: 3616020 - DNA, 23 bp, Homo sapiens
ggctaggcctccgttgtctggtt

SEQ ID NO: 3616021 - DNA, 17 bp, Homo sapiens
ggctagtcaagctcctc

SEQ ID NO: 3616022 - DNA, 22 bp, Homo sapiens
ggctagtcaagctcctcctccc

SEQ ID NO: 3616023 - DNA, 23 bp, Homo sapiens
ggctagtcaagctcctcctccct

SEQ ID NO: 3616024 - DNA, 23 bp, Homo sapiens
ggctataggtgctacaaaaacac

SEQ ID NO: 3616025 - DNA, 16 bp, Homo sapiens
ggctcacaaggcccag

SEQ ID NO: 3616026 - DNA, 17 bp, Homo sapiens
ggctcacgtcgcggccg

SEQ ID NO: 3616027 - DNA, 15 bp, Homo sapiens
ggctcactgcaacct

SEQ ID NO: 3616028 - DNA, 14 bp, Homo sapiens
ggctcactggcagg

SEQ ID NO: 3616029 - DNA, 13 bp, Homo sapiens
ggctcactgtgct

SEQ ID NO: 3616030 - DNA, 22 bp, Homo sapiens
ggctcagacatccacataaccc

SEQ ID NO: 3616031 - DNA, 18 bp, Homo sapiens
ggctcagagaggtagcac

SEQ ID NO: 3616032 - DNA, 16 bp, Homo sapiens
ggctcagattgtaata

SEQ ID NO: 3616033 - DNA, 13 bp, Homo sapiens
ggctcagcctggt

SEQ ID NO: 3616034 - DNA, 12 bp, Homo sapiens
ggctcatgcctg

SEQ ID NO: 3616035 - DNA, 21 bp, Homo sapiens
ggctcatgcctgtaatctcag

SEQ ID NO: 3616036 - DNA, 19 bp, Homo sapiens
ggctcccacaggcccttcc

SEQ ID NO: 3616037 - DNA, 20 bp, Homo sapiens
ggctcccacaggcccttcct

SEQ ID NO: 3616038 - DNA, 13 bp, Homo sapiens
ggctccccaaggc

SEQ ID NO: 3616039 - DNA, 14 bp, Homo sapiens
ggctccccaaggct

SEQ ID NO: 3616040 - DNA, 19 bp, Homo sapiens
ggctccgggcaccaggggc

SEQ ID NO: 3616041 - DNA, 21 bp, Homo sapiens
ggctcctacctgtctgctgcc

SEQ ID NO: 3616042 - DNA, 18 bp, Homo sapiens
ggctcctcctcacccacc

SEQ ID NO: 3616043 - DNA, 12 bp, Homo sapiens
ggctcctctcag

SEQ ID NO: 3616044 - DNA, 13 bp, Homo sapiens
ggctcctgagtgt

SEQ ID NO: 3616045 - DNA, 13 bp, Homo sapiens
ggctcctgggccg

SEQ ID NO: 3616046 - DNA, 17 bp, Homo sapiens
ggctctaattcacagtg

SEQ ID NO: 3616047 - DNA, 13 bp, Homo sapiens
ggctctcccctct

SEQ ID NO: 3616048 - DNA, 22 bp, Homo sapiens
ggctctcccctctcgccccatc

SEQ ID NO: 3616049 - DNA, 14 bp, Homo sapiens
ggctctgccccctc

SEQ ID NO: 3616050 - DNA, 16 bp, Homo sapiens
ggctctgccccctccc

SEQ ID NO: 3616051 - DNA, 19 bp, Homo sapiens
ggctctgccccctccccca

SEQ ID NO: 3616052 - DNA, 20 bp, Homo sapiens
ggctctgccccctcccccat

SEQ ID NO: 3616053 - DNA, 12 bp, Homo sapiens
ggctctgggcct

SEQ ID NO: 3616054 - DNA, 16 bp, Homo sapiens
ggctctgggcctgagg

SEQ ID NO: 3616055 - DNA, 14 bp, Homo sapiens
ggctcttaagcagc

SEQ ID NO: 3616056 - DNA, 19 bp, Homo sapiens
ggctcttatgtgtgccttt

SEQ ID NO: 3616057 - DNA, 13 bp, Homo sapiens
ggctcttctcctt

SEQ ID NO: 3616058 - DNA, 14 bp, Homo sapiens
ggctcttctccttt

SEQ ID NO: 3616059 - DNA, 13 bp, Homo sapiens
ggctgaaagacag

SEQ ID NO: 3616060 - DNA, 13 bp, Homo sapiens
ggctgaagagagg

SEQ ID NO: 3616061 - DNA, 19 bp, Homo sapiens
ggctgaagagagggacagg

SEQ ID NO: 3616062 - DNA, 17 bp, Homo sapiens
ggctgacagactcactg

SEQ ID NO: 3616063 - DNA, 19 bp, Homo sapiens
ggctgacatgctcacacat

SEQ ID NO: 3616064 - DNA, 23 bp, Homo sapiens
ggctgacccagcatctcccagca

SEQ ID NO: 3616065 - DNA, 14 bp, Homo sapiens
ggctgacccctctg

SEQ ID NO: 3616066 - DNA, 15 bp, Homo sapiens
ggctgacccctctgg

SEQ ID NO: 3616067 - DNA, 15 bp, Homo sapiens
ggctgagcccctggg

SEQ ID NO: 3616068 - DNA, 19 bp, Homo sapiens
ggctgagcccctggggaaa

SEQ ID NO: 3616069 - DNA, 15 bp, Homo sapiens
ggctgagccctcctg

SEQ ID NO: 3616070 - DNA, 11 bp, Homo sapiens
ggctgagcctg

SEQ ID NO: 3616071 - DNA, 15 bp, Homo sapiens
ggctgagggtcgtgg

SEQ ID NO: 3616072 - DNA, 13 bp, Homo sapiens
ggctgcacaacag

SEQ ID NO: 3616073 - DNA, 17 bp, Homo sapiens
ggctgcacaacagccct

SEQ ID NO: 3616074 - DNA, 22 bp, Homo sapiens
ggctgcacaacagccctgcctg

SEQ ID NO: 3616075 - DNA, 13 bp, Homo sapiens
ggctgcacctcct

SEQ ID NO: 3616076 - DNA, 14 bp, Homo sapiens
ggctgcaggcaggc

SEQ ID NO: 3616077 - DNA, 11 bp, Homo sapiens
ggctgccaggg

SEQ ID NO: 3616078 - DNA, 20 bp, Homo sapiens
ggctgccaggggctctgtgg

SEQ ID NO: 3616079 - DNA, 12 bp, Homo sapiens
ggctgccctggt

SEQ ID NO: 3616080 - DNA, 19 bp, Homo sapiens
ggctgccctggtgctgcca

SEQ ID NO: 3616081 - DNA, 20 bp, Homo sapiens
ggctgcgaatctagaggagg

SEQ ID NO: 3616082 - DNA, 11 bp, Homo sapiens
ggctgctgctc

SEQ ID NO: 3616083 - DNA, 13 bp, Homo sapiens
ggctggagaaaga

SEQ ID NO: 3616084 - DNA, 14 bp, Homo sapiens
ggctggagaaagag

SEQ ID NO: 3616085 - DNA, 17 bp, Homo sapiens
ggctggagaaagatgca

SEQ ID NO: 3616086 - DNA, 15 bp, Homo sapiens
ggctggagcctgggg

SEQ ID NO: 3616087 - DNA, 16 bp, Homo sapiens
ggctggagtgaggaaa

SEQ ID NO: 3616088 - DNA, 19 bp, Homo sapiens
ggctggcacgtgacaggct

SEQ ID NO: 3616089 - DNA, 20 bp, Homo sapiens
ggctggcacgtgacaggctc

SEQ ID NO: 3616090 - DNA, 14 bp, Homo sapiens
ggctggcggcctcg

SEQ ID NO: 3616091 - DNA, 21 bp, Homo sapiens
ggctgggccctctttccctgc

SEQ ID NO: 3616092 - DNA, 22 bp, Homo sapiens
ggctgggccctctttccctgcg

SEQ ID NO: 3616093 - DNA, 14 bp, Homo sapiens
ggctgggggctgcc

SEQ ID NO: 3616094 - DNA, 23 bp, Homo sapiens
ggctggggtggagtgggaaggga

SEQ ID NO: 3616095 - DNA, 17 bp, Homo sapiens
ggctggtagcagcaggc

SEQ ID NO: 3616096 - DNA, 18 bp, Homo sapiens
ggctggtagcagcaggct

SEQ ID NO: 3616097 - DNA, 13 bp, Homo sapiens
ggctggtggccca

SEQ ID NO: 3616098 - DNA, 14 bp, Homo sapiens
ggctggtggcccag

SEQ ID NO: 3616099 - DNA, 15 bp, Homo sapiens
ggctggtgggaaggc

SEQ ID NO: 3616100 - DNA, 18 bp, Homo sapiens
ggctggtgggaaggccgg

SEQ ID NO: 3616101 - DNA, 13 bp, Homo sapiens
ggctggtgggccc

SEQ ID NO: 3616102 - DNA, 14 bp, Homo sapiens
ggctggttaatgta

SEQ ID NO: 3616103 - DNA, 20 bp, Homo sapiens
ggctgtaactgagagaaaga

SEQ ID NO: 3616104 - DNA, 17 bp, Homo sapiens
ggctgtacctgttcctc

SEQ ID NO: 3616105 - DNA, 18 bp, Homo sapiens
ggctgtgcagcctgtcct

SEQ ID NO: 3616106 - DNA, 13 bp, Homo sapiens
ggctgtgcctctg

SEQ ID NO: 3616107 - DNA, 12 bp, Homo sapiens
ggctgtggaagg

SEQ ID NO: 3616108 - DNA, 22 bp, Homo sapiens
ggcttagggacaggaccccagc

SEQ ID NO: 3616109 - DNA, 19 bp, Homo sapiens
ggcttcaaaaagccacagc

SEQ ID NO: 3616110 - DNA, 20 bp, Homo sapiens
ggcttcaaaaagccacagca

SEQ ID NO: 3616111 - DNA, 19 bp, Homo sapiens
ggcttcaacagccaagctg

SEQ ID NO: 3616112 - DNA, 23 bp, Homo sapiens
ggcttccccactcccccgtttct

SEQ ID NO: 3616113 - DNA, 16 bp, Homo sapiens
ggcttcccgctcagcc

SEQ ID NO: 3616114 - DNA, 22 bp, Homo sapiens
ggcttcccgctcagccctccct

SEQ ID NO: 3616115 - DNA, 18 bp, Homo sapiens
ggcttccctaaactgcag

SEQ ID NO: 3616116 - DNA, 20 bp, Homo sapiens
ggcttccctaaactgcagcc

SEQ ID NO: 3616117 - DNA, 12 bp, Homo sapiens
ggcttccctgga

SEQ ID NO: 3616118 - DNA, 22 bp, Homo sapiens
ggcttcctcttccgggcagaaa

SEQ ID NO: 3616119 - DNA, 14 bp, Homo sapiens
ggcttctcctcctc

SEQ ID NO: 3616120 - DNA, 12 bp, Homo sapiens
ggcttctccttc

SEQ ID NO: 3616121 - DNA, 23 bp, Homo sapiens
ggcttgttgacttcgcagccccg

SEQ ID NO: 3616122 - DNA, 14 bp, Homo sapiens
ggctttatgcaaat

SEQ ID NO: 3616123 - DNA, 20 bp, Homo sapiens
ggctttctcttccccttcct

SEQ ID NO: 3616124 - DNA, 21 bp, Homo sapiens
ggctttctcttccccttcctg

SEQ ID NO: 3616125 - DNA, 17 bp, Homo sapiens
ggctttgcccacccctc

SEQ ID NO: 3616126 - DNA, 23 bp, Homo sapiens
ggctttgcccacccctcactccc

SEQ ID NO: 3616127 - DNA, 13 bp, Homo sapiens
ggctttgcctctt

SEQ ID NO: 3616128 - DNA, 13 bp, Homo sapiens
ggctttggcttct

SEQ ID NO: 3616129 - DNA, 20 bp, Homo sapiens
ggctttgggaagtttgctgt

SEQ ID NO: 3616130 - DNA, 16 bp, Homo sapiens
gggaaagcctctggcc

SEQ ID NO: 3616131 - DNA, 17 bp, Homo sapiens
gggaaagcctctggccg

SEQ ID NO: 3616132 - DNA, 22 bp, Homo sapiens
gggaaagtgtgagctcttccct

SEQ ID NO: 3616133 - DNA, 15 bp, Homo sapiens
gggaacactgagaaa

SEQ ID NO: 3616134 - DNA, 21 bp, Homo sapiens
gggaacactgagaaagaggca

SEQ ID NO: 3616135 - DNA, 11 bp, Homo sapiens
gggaactgacc

SEQ ID NO: 3616136 - DNA, 11 bp, Homo sapiens
gggaagacagt

SEQ ID NO: 3616137 - DNA, 14 bp, Homo sapiens
gggaagacagtggc

SEQ ID NO: 3616138 - DNA, 20 bp, Homo sapiens
gggaagacctgaaagagagg

SEQ ID NO: 3616139 - DNA, 20 bp, Homo sapiens
gggaagagaagagggcccag

SEQ ID NO: 3616140 - DNA, 23 bp, Homo sapiens
gggaagagaagagggcccagccc

SEQ ID NO: 3616141 - DNA, 17 bp, Homo sapiens
gggaagatgacctgccc

SEQ ID NO: 3616142 - DNA, 23 bp, Homo sapiens
gggaagctcccaccccactcagg

SEQ ID NO: 3616143 - DNA, 23 bp, Homo sapiens
gggaaggacaggaccctcaggaa

SEQ ID NO: 3616144 - DNA, 14 bp, Homo sapiens
gggaagtaacagac

SEQ ID NO: 3616145 - DNA, 15 bp, Homo sapiens
gggaatgcagcagga

SEQ ID NO: 3616146 - DNA, 15 bp, Homo sapiens
gggaatggcagctgc

SEQ ID NO: 3616147 - DNA, 19 bp, Homo sapiens
gggacagaggccccagcct

SEQ ID NO: 3616148 - DNA, 15 bp, Homo sapiens
gggacagctggctgg

SEQ ID NO: 3616149 - DNA, 19 bp, Homo sapiens
gggacaggaccccagctct

SEQ ID NO: 3616150 - DNA, 21 bp, Homo sapiens
gggacaggaccccagctctgc

SEQ ID NO: 3616151 - DNA, 18 bp, Homo sapiens
gggacaggctgaagagag

SEQ ID NO: 3616152 - DNA, 17 bp, Homo sapiens
gggaccactgggtgaga

SEQ ID NO: 3616153 - DNA, 19 bp, Homo sapiens
gggaccaggtttgcaggag

SEQ ID NO: 3616154 - DNA, 15 bp, Homo sapiens
gggaccatctgctgc

SEQ ID NO: 3616155 - DNA, 18 bp, Homo sapiens
gggaccggtgctgcagga

SEQ ID NO: 3616156 - DNA, 19 bp, Homo sapiens
gggaccggtgctgcaggag

SEQ ID NO: 3616157 - DNA, 12 bp, Homo sapiens
gggacctgagag

SEQ ID NO: 3616158 - DNA, 16 bp, Homo sapiens
gggacgatcaggagga

SEQ ID NO: 3616159 - DNA, 20 bp, Homo sapiens
gggactatctttgctgcaga

SEQ ID NO: 3616160 - DNA, 21 bp, Homo sapiens
gggactcggagggtgccgtgc

SEQ ID NO: 3616161 - DNA, 23 bp, Homo sapiens
gggactgccagtccccctgcccc

SEQ ID NO: 3616162 - DNA, 21 bp, Homo sapiens
gggactgccttgtctctagta

SEQ ID NO: 3616163 - DNA, 12 bp, Homo sapiens
gggacttttatt

SEQ ID NO: 3616164 - DNA, 10 bp, Homo sapiens
gggagaaaaa

SEQ ID NO: 3616165 - DNA, 18 bp, Homo sapiens
gggagaaacccagagatg

SEQ ID NO: 3616166 - DNA, 15 bp, Homo sapiens
gggagacatgtgaca

SEQ ID NO: 3616167 - DNA, 12 bp, Homo sapiens
gggagagagtag

SEQ ID NO: 3616168 - DNA, 21 bp, Homo sapiens
gggagaggtgattctcagggc

SEQ ID NO: 3616169 - DNA, 22 bp, Homo sapiens
gggagaggtgattctcagggct

SEQ ID NO: 3616170 - DNA, 16 bp, Homo sapiens
gggagatttggaatac

SEQ ID NO: 3616171 - DNA, 14 bp, Homo sapiens
gggagcaaaagaaa

SEQ ID NO: 3616172 - DNA, 20 bp, Homo sapiens
gggagcacggactgtcagtt

SEQ ID NO: 3616173 - DNA, 21 bp, Homo sapiens
gggagcatttaatggcagcta

SEQ ID NO: 3616174 - DNA, 11 bp, Homo sapiens
gggagccaagg

SEQ ID NO: 3616175 - DNA, 13 bp, Homo sapiens
gggagccaaggga

SEQ ID NO: 3616176 - DNA, 11 bp, Homo sapiens
gggagccagga

SEQ ID NO: 3616177 - DNA, 10 bp, Homo sapiens
gggagcccac

SEQ ID NO: 3616178 - DNA, 19 bp, Homo sapiens
gggagcccactgtcctggg

SEQ ID NO: 3616179 - DNA, 15 bp, Homo sapiens
gggagccctagccct

SEQ ID NO: 3616180 - DNA, 17 bp, Homo sapiens
gggagccctagccctgc

SEQ ID NO: 3616181 - DNA, 23 bp, Homo sapiens
gggagccctcaggcacctgcact

SEQ ID NO: 3616182 - DNA, 20 bp, Homo sapiens
gggagccggtaactgtcctg

SEQ ID NO: 3616183 - DNA, 21 bp, Homo sapiens
gggagcctagctcctgccaca

SEQ ID NO: 3616184 - DNA, 12 bp, Homo sapiens
gggagctctgca

SEQ ID NO: 3616185 - DNA, 14 bp, Homo sapiens
gggagctctgggga

SEQ ID NO: 3616186 - DNA, 15 bp, Homo sapiens
gggagctgctgccct

SEQ ID NO: 3616187 - DNA, 13 bp, Homo sapiens
gggagctgctggg

SEQ ID NO: 3616188 - DNA, 19 bp, Homo sapiens
gggagctgctgggtggcag

SEQ ID NO: 3616189 - DNA, 22 bp, Homo sapiens
gggagctgctgggtggcagggg

SEQ ID NO: 3616190 - DNA, 19 bp, Homo sapiens
gggagctggttagaaatgc

SEQ ID NO: 3616191 - DNA, 22 bp, Homo sapiens
gggagcttccgctttgaaagaa

SEQ ID NO: 3616192 - DNA, 14 bp, Homo sapiens
gggaggagaatgag

SEQ ID NO: 3616193 - DNA, 23 bp, Homo sapiens
gggaggagcctgtgcgtcccagc

SEQ ID NO: 3616194 - DNA, 20 bp, Homo sapiens
gggaggagggaggcggcctc

SEQ ID NO: 3616195 - DNA, 15 bp, Homo sapiens
gggaggatacagagg

SEQ ID NO: 3616196 - DNA, 19 bp, Homo sapiens
gggaggccatctggagagc

SEQ ID NO: 3616197 - DNA, 19 bp, Homo sapiens
gggaggccgaggtgggcag

SEQ ID NO: 3616198 - DNA, 12 bp, Homo sapiens
gggaggcggcct

SEQ ID NO: 3616199 - DNA, 15 bp, Homo sapiens
gggaggtccaagcag

SEQ ID NO: 3616200 - DNA, 14 bp, Homo sapiens
gggaggtggtcctc

SEQ ID NO: 3616201 - DNA, 23 bp, Homo sapiens
gggaggttgtggggcctcaggct

SEQ ID NO: 3616202 - DNA, 14 bp, Homo sapiens
gggagtagccaagc

SEQ ID NO: 3616203 - DNA, 11 bp, Homo sapiens
gggagtgtgta

SEQ ID NO: 3616204 - DNA, 13 bp, Homo sapiens
gggatagatgtgt

SEQ ID NO: 3616205 - DNA, 20 bp, Homo sapiens
gggatagtccttcctggcat

SEQ ID NO: 3616206 - DNA, 20 bp, Homo sapiens
gggatagtgttctgctcctg

SEQ ID NO: 3616207 - DNA, 21 bp, Homo sapiens
gggatagtgttctgctcctgc

SEQ ID NO: 3616208 - DNA, 16 bp, Homo sapiens
gggatatggcaggact

SEQ ID NO: 3616209 - DNA, 20 bp, Homo sapiens
gggatcctccacagagagga

SEQ ID NO: 3616210 - DNA, 22 bp, Homo sapiens
gggatcctccacagagaggagg

SEQ ID NO: 3616211 - DNA, 13 bp, Homo sapiens
gggatctgccccc

SEQ ID NO: 3616212 - DNA, 19 bp, Homo sapiens
gggatcttcccacaggagg

SEQ ID NO: 3616213 - DNA, 23 bp, Homo sapiens
gggatcttcccacaggagggcca

SEQ ID NO: 3616214 - DNA, 20 bp, Homo sapiens
gggatgacatgcactcagct

SEQ ID NO: 3616215 - DNA, 16 bp, Homo sapiens
gggatgccctggaggt

SEQ ID NO: 3616216 - DNA, 16 bp, Homo sapiens
gggatgcggatcctgc

SEQ ID NO: 3616217 - DNA, 16 bp, Homo sapiens
gggatggacatcttgt

SEQ ID NO: 3616218 - DNA, 21 bp, Homo sapiens
gggatggacttgtgattggct

SEQ ID NO: 3616219 - DNA, 15 bp, Homo sapiens
gggatgggagccggg

SEQ ID NO: 3616220 - DNA, 16 bp, Homo sapiens
gggatgggagccgggc

SEQ ID NO: 3616221 - DNA, 20 bp, Homo sapiens
gggatggtcggatctcacag

SEQ ID NO: 3616222 - DNA, 14 bp, Homo sapiens
gggatgtctctcat

SEQ ID NO: 3616223 - DNA, 16 bp, Homo sapiens
gggattcctgagctgg

SEQ ID NO: 3616224 - DNA, 17 bp, Homo sapiens
gggattcctgagctggc

SEQ ID NO: 3616225 - DNA, 21 bp, Homo sapiens
gggcaagacagaaaagtgcct

SEQ ID NO: 3616226 - DNA, 13 bp, Homo sapiens
gggcaagaggaat

SEQ ID NO: 3616227 - DNA, 13 bp, Homo sapiens
gggcaatggaaat

SEQ ID NO: 3616228 - DNA, 18 bp, Homo sapiens
gggcacacgctgctctgc

SEQ ID NO: 3616229 - DNA, 22 bp, Homo sapiens
gggcacacgctgctctgcccca

SEQ ID NO: 3616230 - DNA, 13 bp, Homo sapiens
gggcaccaggggc

SEQ ID NO: 3616231 - DNA, 20 bp, Homo sapiens
gggcacggcgggatcctcca

SEQ ID NO: 3616232 - DNA, 13 bp, Homo sapiens
gggcactggggcc

SEQ ID NO: 3616233 - DNA, 13 bp, Homo sapiens
gggcactggtggc

SEQ ID NO: 3616234 - DNA, 21 bp, Homo sapiens
gggcagaggagaacttgctgc

SEQ ID NO: 3616235 - DNA, 16 bp, Homo sapiens
gggcagcactccccag

SEQ ID NO: 3616236 - DNA, 13 bp, Homo sapiens
gggcagcaggcca

SEQ ID NO: 3616237 - DNA, 15 bp, Homo sapiens
gggcagcaggccaga

SEQ ID NO: 3616238 - DNA, 11 bp, Homo sapiens
gggcagccagc

SEQ ID NO: 3616239 - DNA, 18 bp, Homo sapiens
gggcagctggcccccagc

SEQ ID NO: 3616240 - DNA, 21 bp, Homo sapiens
gggcaggattctctgcagccc

SEQ ID NO: 3616241 - DNA, 15 bp, Homo sapiens
gggcagggaaggaca

SEQ ID NO: 3616242 - DNA, 23 bp, Homo sapiens
gggcagggatgatggcagagcca

SEQ ID NO: 3616243 - DNA, 20 bp, Homo sapiens
gggcaggtctagtgttcctg

SEQ ID NO: 3616244 - DNA, 19 bp, Homo sapiens
gggcagtgggtggatcctg

SEQ ID NO: 3616245 - DNA, 22 bp, Homo sapiens
gggcattagcaaggcagagcct

SEQ ID NO: 3616246 - DNA, 18 bp, Homo sapiens
gggccaagagatctgtgt

SEQ ID NO: 3616247 - DNA, 12 bp, Homo sapiens
gggccaccacct

SEQ ID NO: 3616248 - DNA, 17 bp, Homo sapiens
gggccaccggtgggcag

SEQ ID NO: 3616249 - DNA, 17 bp, Homo sapiens
gggccacctccacaccc

SEQ ID NO: 3616250 - DNA, 18 bp, Homo sapiens
gggccacgtggatgggca

SEQ ID NO: 3616251 - DNA, 13 bp, Homo sapiens
gggccactgggga

SEQ ID NO: 3616252 - DNA, 15 bp, Homo sapiens
gggccagagccaggg

SEQ ID NO: 3616253 - DNA, 18 bp, Homo sapiens
gggccagatccagcctgg

SEQ ID NO: 3616254 - DNA, 13 bp, Homo sapiens
gggccaggcctgg

SEQ ID NO: 3616255 - DNA, 22 bp, Homo sapiens
gggccatctgactgccaagcca

SEQ ID NO: 3616256 - DNA, 23 bp, Homo sapiens
gggccatctgactgccaagccag

SEQ ID NO: 3616257 - DNA, 22 bp, Homo sapiens
gggccatgatggcaacagatct

SEQ ID NO: 3616258 - DNA, 13 bp, Homo sapiens
gggccatgcctcc

SEQ ID NO: 3616259 - DNA, 23 bp, Homo sapiens
gggccatgcctcctcaggagccg

SEQ ID NO: 3616260 - DNA, 13 bp, Homo sapiens
gggcccagagccc

SEQ ID NO: 3616261 - DNA, 16 bp, Homo sapiens
gggcccagagcccagc

SEQ ID NO: 3616262 - DNA, 16 bp, Homo sapiens
gggcccagcccagagc

SEQ ID NO: 3616263 - DNA, 20 bp, Homo sapiens
gggcccccaatgacacccat

SEQ ID NO: 3616264 - DNA, 15 bp, Homo sapiens
gggccccgccagggc

SEQ ID NO: 3616265 - DNA, 20 bp, Homo sapiens
gggcccgacaggtgggcctg

SEQ ID NO: 3616266 - DNA, 21 bp, Homo sapiens
gggcccgacaggtgggcctgg

SEQ ID NO: 3616267 - DNA, 18 bp, Homo sapiens
gggccctgagctgagggc

SEQ ID NO: 3616268 - DNA, 11 bp, Homo sapiens
gggccctgcta

SEQ ID NO: 3616269 - DNA, 21 bp, Homo sapiens
cctgactcaattatttgcata

SEQ ID NO: 3616270 - DNA, 19 bp, Homo sapiens
cctgacttcagtgaatatt

SEQ ID NO: 3616271 - DNA, 19 bp, Homo sapiens
cctgagcagggtccacagc

SEQ ID NO: 3616272 - DNA, 22 bp, Homo sapiens
cctgagcagggtccacagctgg

SEQ ID NO: 3616273 - DNA, 23 bp, Homo sapiens
cctgagcagggtccacagctgga

SEQ ID NO: 3616274 - DNA, 14 bp, Homo sapiens
cctgagccagcagg

SEQ ID NO: 3616275 - DNA, 17 bp, Homo sapiens
cctgagcggcaccctgg

SEQ ID NO: 3616276 - DNA, 20 bp, Homo sapiens
cctgagcggcaccctggtct

SEQ ID NO: 3616277 - DNA, 12 bp, Homo sapiens
cctgagctggcc

SEQ ID NO: 3616278 - DNA, 14 bp, Homo sapiens
cctgagctggggaa

SEQ ID NO: 3616279 - DNA, 17 bp, Homo sapiens
cctgaggagctttgtgt

SEQ ID NO: 3616280 - DNA, 19 bp, Homo sapiens
cctgagggtccacctggag

SEQ ID NO: 3616281 - DNA, 19 bp, Homo sapiens
cctgagtagctggattaca

SEQ ID NO: 3616282 - DNA, 20 bp, Homo sapiens
cctgagtagctggattacag

SEQ ID NO: 3616283 - DNA, 20 bp, Homo sapiens
cctgataccattctattctc

SEQ ID NO: 3616284 - DNA, 14 bp, Homo sapiens
cctgatcccacccc

SEQ ID NO: 3616285 - DNA, 13 bp, Homo sapiens
cctgatcctggag

SEQ ID NO: 3616286 - DNA, 15 bp, Homo sapiens
cctgatcctggaggc

SEQ ID NO: 3616287 - DNA, 22 bp, Homo sapiens
cctgattgtattttttttttaa

SEQ ID NO: 3616288 - DNA, 20 bp, Homo sapiens
cctgcaacttccgctgaggg

SEQ ID NO: 3616289 - DNA, 20 bp, Homo sapiens
cctgcacaaagcccttccat

SEQ ID NO: 3616290 - DNA, 22 bp, Homo sapiens
cctgcacaaagcccttccatgt

SEQ ID NO: 3616291 - DNA, 14 bp, Homo sapiens
cctgcacacagggc

SEQ ID NO: 3616292 - DNA, 19 bp, Homo sapiens
cctgcacaggtggctgttt

SEQ ID NO: 3616293 - DNA, 18 bp, Homo sapiens
cctgcagaaggaaagaag

SEQ ID NO: 3616294 - DNA, 21 bp, Homo sapiens
cctgcagatactttgaagtgc

SEQ ID NO: 3616295 - DNA, 15 bp, Homo sapiens
cctgcagcagtcgcc

SEQ ID NO: 3616296 - DNA, 13 bp, Homo sapiens
cctgcagcccagg

SEQ ID NO: 3616297 - DNA, 17 bp, Homo sapiens
cctgcaggacctcgtgc

SEQ ID NO: 3616298 - DNA, 18 bp, Homo sapiens
cctgcaggacctcgtgcc

SEQ ID NO: 3616299 - DNA, 15 bp, Homo sapiens
cctgcagggccatct

SEQ ID NO: 3616300 - DNA, 20 bp, Homo sapiens
cctgcaggggttgagagctt

SEQ ID NO: 3616301 - DNA, 23 bp, Homo sapiens
cctgcagtcccacactgtgcaga

SEQ ID NO: 3616302 - DNA, 16 bp, Homo sapiens
cctgcatgagctggca

SEQ ID NO: 3616303 - DNA, 21 bp, Homo sapiens
cctgcatgagctggcaaccag

SEQ ID NO: 3616304 - DNA, 23 bp, Homo sapiens
cctgcatttgtgaaatgatggtg

SEQ ID NO: 3616305 - DNA, 24 bp, Homo sapiens
cctgccaaggagcatccttggcag

SEQ ID NO: 3616306 - DNA, 14 bp, Homo sapiens
cctgccaccagcat

SEQ ID NO: 3616307 - DNA, 16 bp, Homo sapiens
cctgccaccagcatcc

SEQ ID NO: 3616308 - DNA, 17 bp, Homo sapiens
cctgccacccagcccca

SEQ ID NO: 3616309 - DNA, 23 bp, Homo sapiens
cctgccacccccttccctgggag

SEQ ID NO: 3616310 - DNA, 17 bp, Homo sapiens
cctgccagtgaagtcct

SEQ ID NO: 3616311 - DNA, 20 bp, Homo sapiens
cctgccagtgaagtccttca

SEQ ID NO: 3616312 - DNA, 21 bp, Homo sapiens
cctgccagtgaagtccttcag

SEQ ID NO: 3616313 - DNA, 20 bp, Homo sapiens
cctgccatcatgtttacaga

SEQ ID NO: 3616314 - DNA, 15 bp, Homo sapiens
cctgcccaaaccctt

SEQ ID NO: 3616315 - DNA, 21 bp, Homo sapiens
cctgcccaaacccttaactga

SEQ ID NO: 3616316 - DNA, 12 bp, Homo sapiens
cctgcccaacct

SEQ ID NO: 3616317 - DNA, 13 bp, Homo sapiens
cctgcccaacctc

SEQ ID NO: 3616318 - DNA, 16 bp, Homo sapiens
cctgcccatgccccag

SEQ ID NO: 3616319 - DNA, 22 bp, Homo sapiens
cctgccccaccccatccagcca

SEQ ID NO: 3616320 - DNA, 20 bp, Homo sapiens
cctgccccccctaagagaca

SEQ ID NO: 3616321 - DNA, 18 bp, Homo sapiens
cctgccccctgggctggg

SEQ ID NO: 3616322 - DNA, 22 bp, Homo sapiens
cctgccccgtcggactgccccc

SEQ ID NO: 3616323 - DNA, 14 bp, Homo sapiens
cctgcccctccctt

SEQ ID NO: 3616324 - DNA, 13 bp, Homo sapiens
cctgcccctgcct

SEQ ID NO: 3616325 - DNA, 17 bp, Homo sapiens
cctgccctctatttatt

SEQ ID NO: 3616326 - DNA, 22 bp, Homo sapiens
cctgccgtttcccctccttggc

SEQ ID NO: 3616327 - DNA, 19 bp, Homo sapiens
cctgcctattatctgtcag

SEQ ID NO: 3616328 - DNA, 15 bp, Homo sapiens
cctgcctccaggaac

SEQ ID NO: 3616329 - DNA, 22 bp, Homo sapiens
cctgcctgacagccttccccag

SEQ ID NO: 3616330 - DNA, 13 bp, Homo sapiens
cctgcctgcagca

SEQ ID NO: 3616331 - DNA, 15 bp, Homo sapiens
cctgcctgcagcagg

SEQ ID NO: 3616332 - DNA, 11 bp, Homo sapiens
cctgcctggag

SEQ ID NO: 3616333 - DNA, 22 bp, Homo sapiens
cctgcctgttcccattcttgca

SEQ ID NO: 3616334 - DNA, 21 bp, Homo sapiens
cctgcctgttggcaggcccac

SEQ ID NO: 3616335 - DNA, 17 bp, Homo sapiens
cctgccttggagagggc

SEQ ID NO: 3616336 - DNA, 16 bp, Homo sapiens
cctgcctttaagccaa

SEQ ID NO: 3616337 - DNA, 23 bp, Homo sapiens
cctgcgagacgcacacagctgag

SEQ ID NO: 3616338 - DNA, 17 bp, Homo sapiens
cctgcgccctgtgcccg

SEQ ID NO: 3616339 - DNA, 16 bp, Homo sapiens
cctgcgcctccagagg

SEQ ID NO: 3616340 - DNA, 14 bp, Homo sapiens
cctgctccaactcc

SEQ ID NO: 3616341 - DNA, 13 bp, Homo sapiens
cctgctccaccag

SEQ ID NO: 3616342 - DNA, 12 bp, Homo sapiens
cctgctccagaa

SEQ ID NO: 3616343 - DNA, 19 bp, Homo sapiens
cctgctctcctcttgccac

SEQ ID NO: 3616344 - DNA, 13 bp, Homo sapiens
cctgctgccagtg

SEQ ID NO: 3616345 - DNA, 19 bp, Homo sapiens
cctgctgccagtgcagcca

SEQ ID NO: 3616346 - DNA, 21 bp, Homo sapiens
cctgctgccagtgcagccact

SEQ ID NO: 3616347 - DNA, 16 bp, Homo sapiens
cctgctgcgctgcttg

SEQ ID NO: 3616348 - DNA, 18 bp, Homo sapiens
cctgctgctgccagggct

SEQ ID NO: 3616349 - DNA, 20 bp, Homo sapiens
cctgctgctgccagggcttc

SEQ ID NO: 3616350 - DNA, 15 bp, Homo sapiens
cctgctgctgctact

SEQ ID NO: 3616351 - DNA, 16 bp, Homo sapiens
cctgctggggccgcca

SEQ ID NO: 3616352 - DNA, 18 bp, Homo sapiens
cctgctggtacctgccct

SEQ ID NO: 3616353 - DNA, 20 bp, Homo sapiens
cctgctggtacctgccctct

SEQ ID NO: 3616354 - DNA, 22 bp, Homo sapiens
cctgctggtacctgccctctat

SEQ ID NO: 3616355 - DNA, 21 bp, Homo sapiens
cctgctgtgccatgctgggcc

SEQ ID NO: 3616356 - DNA, 22 bp, Homo sapiens
cctgctgtgccatgctgggcca

SEQ ID NO: 3616357 - DNA, 22 bp, Homo sapiens
cctgcttgcccgctcccacagc

SEQ ID NO: 3616358 - DNA, 12 bp, Homo sapiens
cctgctttgcat

SEQ ID NO: 3616359 - DNA, 15 bp, Homo sapiens
cctgctttgcatctt

SEQ ID NO: 3616360 - DNA, 22 bp, Homo sapiens
cctgctttgggctgccctggtg

SEQ ID NO: 3616361 - DNA, 23 bp, Homo sapiens
cctgctttgggctgccctggtgc

SEQ ID NO: 3616362 - DNA, 12 bp, Homo sapiens
cctgcttttctg

SEQ ID NO: 3616363 - DNA, 19 bp, Homo sapiens
cctgcttttctgtcctggg

SEQ ID NO: 3616364 - DNA, 21 bp, Homo sapiens
cctgcttttctgtcctgggca

SEQ ID NO: 3616365 - DNA, 13 bp, Homo sapiens
cctggaaacagca

SEQ ID NO: 3616366 - DNA, 22 bp, Homo sapiens
cctggaaacagcatgaataaaa

SEQ ID NO: 3616367 - DNA, 17 bp, Homo sapiens
cctggaaaccttccacc

SEQ ID NO: 3616368 - DNA, 13 bp, Homo sapiens
cctggaacttggg

SEQ ID NO: 3616369 - DNA, 22 bp, Homo sapiens
cctggaaggacatccatgttcc

SEQ ID NO: 3616370 - DNA, 13 bp, Homo sapiens
cctggacacagct

SEQ ID NO: 3616371 - DNA, 14 bp, Homo sapiens
cctggacacagctc

SEQ ID NO: 3616372 - DNA, 20 bp, Homo sapiens
cctggaccttttgttttctg

SEQ ID NO: 3616373 - DNA, 20 bp, Homo sapiens
cctggacttaagcatctggc

SEQ ID NO: 3616374 - DNA, 12 bp, Homo sapiens
cctggagaacta

SEQ ID NO: 3616375 - DNA, 19 bp, Homo sapiens
cctggagacaaggtgctaa

SEQ ID NO: 3616376 - DNA, 14 bp, Homo sapiens
cctggagcagagga

SEQ ID NO: 3616377 - DNA, 23 bp, Homo sapiens
cctggagcagaggaggggaaagt

SEQ ID NO: 3616378 - DNA, 15 bp, Homo sapiens
cctggagcaggagcc

SEQ ID NO: 3616379 - DNA, 18 bp, Homo sapiens
cctggagcaggagccccg

SEQ ID NO: 3616380 - DNA, 21 bp, Homo sapiens
cctggagcaggcccaatgctg

SEQ ID NO: 3616381 - DNA, 18 bp, Homo sapiens
cctggagcttcagccagg

SEQ ID NO: 3616382 - DNA, 23 bp, Homo sapiens
cctggagcttcagccaggtctga

SEQ ID NO: 3616383 - DNA, 13 bp, Homo sapiens
cctggaggcccag

SEQ ID NO: 3616384 - DNA, 16 bp, Homo sapiens
cctggaggcccagttc

SEQ ID NO: 3616385 - DNA, 18 bp, Homo sapiens
cctggaggctcctctagg

SEQ ID NO: 3616386 - DNA, 22 bp, Homo sapiens
cctggaggctcctctaggccct

SEQ ID NO: 3616387 - DNA, 22 bp, Homo sapiens
cctggaggtccctggtcggaga

SEQ ID NO: 3616388 - DNA, 21 bp, Homo sapiens
cctggaggtctccaggggcct

SEQ ID NO: 3616389 - DNA, 21 bp, Homo sapiens
cctggaggtctggctgagccc

SEQ ID NO: 3616390 - DNA, 23 bp, Homo sapiens
cctggaggtggctgagcccctgt

SEQ ID NO: 3616391 - DNA, 18 bp, Homo sapiens
cctggatccagcactggt

SEQ ID NO: 3616392 - DNA, 21 bp, Homo sapiens
cctggatccatcaggccactt

SEQ ID NO: 3616393 - DNA, 17 bp, Homo sapiens
cctggatctatccctgc

SEQ ID NO: 3616394 - DNA, 20 bp, Homo sapiens
cctggatgagaaacagctca

SEQ ID NO: 3616395 - DNA, 16 bp, Homo sapiens
cctggcaacagagcga

SEQ ID NO: 3616396 - DNA, 23 bp, Homo sapiens
cctggcaacagagcgagattcca

SEQ ID NO: 3616397 - DNA, 17 bp, Homo sapiens
cctggcacagaccaggc

SEQ ID NO: 3616398 - DNA, 19 bp, Homo sapiens
cctggcacagaccaggcct

SEQ ID NO: 3616399 - DNA, 17 bp, Homo sapiens
cctggcacagggcagtg

SEQ ID NO: 3616400 - DNA, 12 bp, Homo sapiens
cctggcagccgt

SEQ ID NO: 3616401 - DNA, 19 bp, Homo sapiens
cctggcagccgtgccttca

SEQ ID NO: 3616402 - DNA, 22 bp, Homo sapiens
cctggcagccgtgccttcagct

SEQ ID NO: 3616403 - DNA, 15 bp, Homo sapiens
cctggcagctctgga

SEQ ID NO: 3616404 - DNA, 16 bp, Homo sapiens
cctggcagctgctgtg

SEQ ID NO: 3616405 - DNA, 20 bp, Homo sapiens
cctggccactaaagcttcag

SEQ ID NO: 3616406 - DNA, 18 bp, Homo sapiens
cctggccagacacaggcc

SEQ ID NO: 3616407 - DNA, 12 bp, Homo sapiens
cctggccaggac

SEQ ID NO: 3616408 - DNA, 17 bp, Homo sapiens
cctggccaggcagggag

SEQ ID NO: 3616409 - DNA, 17 bp, Homo sapiens
cctggccatcccacaag

SEQ ID NO: 3616410 - DNA, 19 bp, Homo sapiens
cctggccatcccacaagtg

SEQ ID NO: 3616411 - DNA, 14 bp, Homo sapiens
cctggccctggggg

SEQ ID NO: 3616412 - DNA, 21 bp, Homo sapiens
cctggcctagaaagggcaagg

SEQ ID NO: 3616413 - DNA, 13 bp, Homo sapiens
cctggcctcaagt

SEQ ID NO: 3616414 - DNA, 19 bp, Homo sapiens
cctggcctgaactgaggag

SEQ ID NO: 3616415 - DNA, 20 bp, Homo sapiens
cctggcctgaactgaggaga

SEQ ID NO: 3616416 - DNA, 21 bp, Homo sapiens
cctggcctgaactgaggagat

SEQ ID NO: 3616417 - DNA, 19 bp, Homo sapiens
cctggcgtgctcagaccca

SEQ ID NO: 3616418 - DNA, 18 bp, Homo sapiens
cctggctcactggcaggt

SEQ ID NO: 3616419 - DNA, 21 bp, Homo sapiens
cctggctccgtccaggagcct

SEQ ID NO: 3616420 - DNA, 19 bp, Homo sapiens
cctggctctgccccctccc

SEQ ID NO: 3616421 - DNA, 12 bp, Homo sapiens
cctggctgccaa

SEQ ID NO: 3616422 - DNA, 12 bp, Homo sapiens
cctggctttgcc

SEQ ID NO: 3616423 - DNA, 18 bp, Homo sapiens
cctggcttttcactgctg

SEQ ID NO: 3616424 - DNA, 20 bp, Homo sapiens
cctggcttttcactgctggc

SEQ ID NO: 3616425 - DNA, 21 bp, Homo sapiens
cctggcttttcactgctggct

SEQ ID NO: 3616426 - DNA, 17 bp, Homo sapiens
cctgggaacacagttct

SEQ ID NO: 3616427 - DNA, 22 bp, Homo sapiens
cctgggaacacagttctgggca

SEQ ID NO: 3616428 - DNA, 21 bp, Homo sapiens
cctgggacctgtggtcatgtg

SEQ ID NO: 3616429 - DNA, 16 bp, Homo sapiens
cctgggagcccagagg

SEQ ID NO: 3616430 - DNA, 15 bp, Homo sapiens
cctgggagccgcctg

SEQ ID NO: 3616431 - DNA, 18 bp, Homo sapiens
cctgggaggaagatgttt

SEQ ID NO: 3616432 - DNA, 20 bp, Homo sapiens
cctgggaggcagaggttgca

SEQ ID NO: 3616433 - DNA, 14 bp, Homo sapiens
cctgggagggaggt

SEQ ID NO: 3616434 - DNA, 15 bp, Homo sapiens
cctgggcacacgctg

SEQ ID NO: 3616435 - DNA, 16 bp, Homo sapiens
cctgggcatccttctt

SEQ ID NO: 3616436 - DNA, 19 bp, Homo sapiens
cctgggcatgggtccaggg

SEQ ID NO: 3616437 - DNA, 20 bp, Homo sapiens
cctgggcatgggtccagggc

SEQ ID NO: 3616438 - DNA, 19 bp, Homo sapiens
cctgggcatttggtgagag

SEQ ID NO: 3616439 - DNA, 21 bp, Homo sapiens
cctgggccggctgagtggcag

SEQ ID NO: 3616440 - DNA, 21 bp, Homo sapiens
cctgggccgtggcacagctgg

SEQ ID NO: 3616441 - DNA, 17 bp, Homo sapiens
cctgggcctgcccctgt

SEQ ID NO: 3616442 - DNA, 12 bp, Homo sapiens
cctgggctcctc

SEQ ID NO: 3616443 - DNA, 13 bp, Homo sapiens
cctgggctctgga

SEQ ID NO: 3616444 - DNA, 13 bp, Homo sapiens
cctggggatagtc

SEQ ID NO: 3616445 - DNA, 18 bp, Homo sapiens
cctgggggttctttcttc

SEQ ID NO: 3616446 - DNA, 21 bp, Homo sapiens
cctgggggttctttcttcctc

SEQ ID NO: 3616447 - DNA, 21 bp, Homo sapiens
cctggggtgaatacttatttt

SEQ ID NO: 3616448 - DNA, 14 bp, Homo sapiens
cctggggtgcatct

SEQ ID NO: 3616449 - DNA, 22 bp, Homo sapiens
cctggggtgtcctacagtgact

SEQ ID NO: 3616450 - DNA, 23 bp, Homo sapiens
cctggggtgtcctacagtgactc

SEQ ID NO: 3616451 - DNA, 13 bp, Homo sapiens
cctgggtgacatt

SEQ ID NO: 3616452 - DNA, 15 bp, Homo sapiens
cctgggtgacatttg

SEQ ID NO: 3616453 - DNA, 20 bp, Homo sapiens
cctgggtttgggagccagga

SEQ ID NO: 3616454 - DNA, 21 bp, Homo sapiens
cctggtcacaggactctgcct

SEQ ID NO: 3616455 - DNA, 22 bp, Homo sapiens
cctggtcacaggactctgcctc

SEQ ID NO: 3616456 - DNA, 23 bp, Homo sapiens
cctggtcacaggactctgcctcc

SEQ ID NO: 3616457 - DNA, 14 bp, Homo sapiens
cctggtccccactg

SEQ ID NO: 3616458 - DNA, 15 bp, Homo sapiens
cctggtccccactgc

SEQ ID NO: 3616459 - DNA, 13 bp, Homo sapiens
cctggtgactcct

SEQ ID NO: 3616460 - DNA, 12 bp, Homo sapiens
cctggtgccctg

SEQ ID NO: 3616461 - DNA, 20 bp, Homo sapiens
cctggtgcctatctgcctgg

SEQ ID NO: 3616462 - DNA, 21 bp, Homo sapiens
cctggtggttgctgttttcct

SEQ ID NO: 3616463 - DNA, 15 bp, Homo sapiens
cctggttcagacaca

SEQ ID NO: 3616464 - DNA, 18 bp, Homo sapiens
cctggttcagacacagct

SEQ ID NO: 3616465 - DNA, 20 bp, Homo sapiens
cctggtttaattcagcagag

SEQ ID NO: 3616466 - DNA, 13 bp, Homo sapiens
cctggtttctggg

SEQ ID NO: 3616467 - DNA, 18 bp, Homo sapiens
cctgtaatcccagcactt

SEQ ID NO: 3616468 - DNA, 14 bp, Homo sapiens
cctgtaccccagca

SEQ ID NO: 3616469 - DNA, 14 bp, Homo sapiens
cctgtacctcagtg

SEQ ID NO: 3616470 - DNA, 23 bp, Homo sapiens
cctgtactgtatggaaacactga

SEQ ID NO: 3616471 - DNA, 20 bp, Homo sapiens
cctgtcatttgaacctggat

SEQ ID NO: 3616472 - DNA, 13 bp, Homo sapiens
cctgtccagctcc

SEQ ID NO: 3616473 - DNA, 18 bp, Homo sapiens
cctgtcccaattctgccc

SEQ ID NO: 3616474 - DNA, 23 bp, Homo sapiens
cctgtcccacccacacagctgcc

SEQ ID NO: 3616475 - DNA, 16 bp, Homo sapiens
cctgtcccttgcctct

SEQ ID NO: 3616476 - DNA, 17 bp, Homo sapiens
cctgtcccttgcctctg

SEQ ID NO: 3616477 - DNA, 19 bp, Homo sapiens
cctgtcccttgcctctgcc

SEQ ID NO: 3616478 - DNA, 13 bp, Homo sapiens
cctgtcccttttc

SEQ ID NO: 3616479 - DNA, 16 bp, Homo sapiens
cctgtcccttttccct

SEQ ID NO: 3616480 - DNA, 12 bp, Homo sapiens
cctgtcctcttt

SEQ ID NO: 3616481 - DNA, 14 bp, Homo sapiens
cctgtcctctttgt

SEQ ID NO: 3616482 - DNA, 16 bp, Homo sapiens
cctgtcctgggctggt

SEQ ID NO: 3616483 - DNA, 13 bp, Homo sapiens
cctgtcctgtctt

SEQ ID NO: 3616484 - DNA, 15 bp, Homo sapiens
cctgtctcacctgga

SEQ ID NO: 3616485 - DNA, 15 bp, Homo sapiens
cctgtctccagctgc

SEQ ID NO: 3616486 - DNA, 17 bp, Homo sapiens
cctgtctccagctgcct

SEQ ID NO: 3616487 - DNA, 20 bp, Homo sapiens
cctgtctccagctgcctggg

SEQ ID NO: 3616488 - DNA, 13 bp, Homo sapiens
cctgtcttctttc

SEQ ID NO: 3616489 - DNA, 22 bp, Homo sapiens
cctgtgaagtttaattgtctca

SEQ ID NO: 3616490 - DNA, 18 bp, Homo sapiens
cctgtgacttcagctctg

SEQ ID NO: 3616491 - DNA, 16 bp, Homo sapiens
cctgtgatatgtctgc

SEQ ID NO: 3616492 - DNA, 20 bp, Homo sapiens
cctgtgcccgactgactgga

SEQ ID NO: 3616493 - DNA, 15 bp, Homo sapiens
cctgtgcgtcccagc

SEQ ID NO: 3616494 - DNA, 17 bp, Homo sapiens
cctgtggccaactgcaa

SEQ ID NO: 3616495 - DNA, 16 bp, Homo sapiens
cctgtggggttgtttt

SEQ ID NO: 3616496 - DNA, 19 bp, Homo sapiens
cctgtggtcatgtgagtct

SEQ ID NO: 3616497 - DNA, 15 bp, Homo sapiens
cctgtgtgaccctgg

SEQ ID NO: 3616498 - DNA, 18 bp, Homo sapiens
cctgtgtttttttctaaa

SEQ ID NO: 3616499 - DNA, 16 bp, Homo sapiens
cctgttaatttataat

SEQ ID NO: 3616500 - DNA, 21 bp, Homo sapiens
cctgttaatttataatgtatt

SEQ ID NO: 3616501 - DNA, 22 bp, Homo sapiens
cctgttaatttataatgtattt

SEQ ID NO: 3616502 - DNA, 16 bp, Homo sapiens
cctgttccccagagaa

SEQ ID NO: 3616503 - DNA, 12 bp, Homo sapiens
cctgttcctccc

SEQ ID NO: 3616504 - DNA, 13 bp, Homo sapiens
cctgttctccctt

SEQ ID NO: 3616505 - DNA, 17 bp, Homo sapiens
cctgttctccctttctc

SEQ ID NO: 3616506 - DNA, 19 bp, Homo sapiens
cctgttctccctttctctc

SEQ ID NO: 3616507 - DNA, 21 bp, Homo sapiens
cctgttctccctttctctctc

SEQ ID NO: 3616508 - DNA, 22 bp, Homo sapiens
cctgttctccctttctctctcc

SEQ ID NO: 3616509 - DNA, 15 bp, Homo sapiens
cctgttctgcgctgt

SEQ ID NO: 3616510 - DNA, 21 bp, Homo sapiens
cctgttcttagagtgtagctg

SEQ ID NO: 3616511 - DNA, 18 bp, Homo sapiens
cctgttggcaggcccact

SEQ ID NO: 3616512 - DNA, 17 bp, Homo sapiens
cctgtttaaataaaatt

SEQ ID NO: 3616513 - DNA, 19 bp, Homo sapiens
cctgtttaaataaaattta

SEQ ID NO: 3616514 - DNA, 16 bp, Homo sapiens
cctgtttggtggggtg

SEQ ID NO: 3616515 - DNA, 17 bp, Homo sapiens
ccttaaaagtaataaag

SEQ ID NO: 3616516 - DNA, 19 bp, Homo sapiens
ccttaaaagtaataaagag

SEQ ID NO: 3616517 - DNA, 21 bp, Homo sapiens
ccttaaaagtaataaagagaa

SEQ ID NO: 3616518 - DNA, 23 bp, Homo sapiens
ccttaaaatgcattgaaagaatt

SEQ ID NO: 3616519 - DNA, 16 bp, Homo sapiens
ccttaaccattctgtc

SEQ ID NO: 3616520 - DNA, 17 bp, Homo sapiens
ccttaacccacctctcc

SEQ ID NO: 3616521 - DNA, 18 bp, Homo sapiens
ccttaacccacctctcct

SEQ ID NO: 3616522 - DNA, 19 bp, Homo sapiens
ccttaagccaaactcaggc

SEQ ID NO: 3616523 - DNA, 23 bp, Homo sapiens
ccttaagccaaactcaggcccag

SEQ ID NO: 3616524 - DNA, 20 bp, Homo sapiens
ccttaaggcacagtgggagc

SEQ ID NO: 3616525 - DNA, 23 bp, Homo sapiens
ccttaatcaggtcctcagagaat

SEQ ID NO: 3616526 - DNA, 14 bp, Homo sapiens
ccttacagcctctg

SEQ ID NO: 3616527 - DNA, 18 bp, Homo sapiens
ccttacagcctctgactt

SEQ ID NO: 3616528 - DNA, 20 bp, Homo sapiens
ccttaccctcctctgctggg

SEQ ID NO: 3616529 - DNA, 21 bp, Homo sapiens
ccttactcccccaccactcag

SEQ ID NO: 3616530 - DNA, 22 bp, Homo sapiens
ccttactcccccaccactcagg

SEQ ID NO: 3616531 - DNA, 23 bp, Homo sapiens
ccttacttcaaagtgcctgggct

SEQ ID NO: 3616532 - DNA, 18 bp, Homo sapiens
ccttagaacctttcttac

SEQ ID NO: 3616533 - DNA, 14 bp, Homo sapiens
ccttagagctcttg

SEQ ID NO: 3616534 - DNA, 22 bp, Homo sapiens
ccttagctattcccagggaacc

SEQ ID NO: 3616535 - DNA, 15 bp, Homo sapiens
ccttaggaggccccc

SEQ ID NO: 3616536 - DNA, 16 bp, Homo sapiens
ccttataaaccaatct

SEQ ID NO: 3616537 - DNA, 21 bp, Homo sapiens
ccttatagttactgtgtaatt

SEQ ID NO: 3616538 - DNA, 21 bp, Homo sapiens
ccttatcacccccttgttgta

SEQ ID NO: 3616539 - DNA, 15 bp, Homo sapiens
ccttatctctttcca

SEQ ID NO: 3616540 - DNA, 14 bp, Homo sapiens
ccttatttgccttc

SEQ ID NO: 3616541 - DNA, 14 bp, Homo sapiens
ccttcaaccattcc

SEQ ID NO: 3616542 - DNA, 15 bp, Homo sapiens
ccttcaacccagtgg

SEQ ID NO: 3616543 - DNA, 18 bp, Homo sapiens
ccttcacaaagcccaagg

SEQ ID NO: 3616544 - DNA, 19 bp, Homo sapiens
ccttcacctcggagggatg

SEQ ID NO: 3616545 - DNA, 15 bp, Homo sapiens
ccttcaggagcctgg

SEQ ID NO: 3616546 - DNA, 15 bp, Homo sapiens
ccttcaggcagctga

SEQ ID NO: 3616547 - DNA, 16 bp, Homo sapiens
ccttcagggagacagg

SEQ ID NO: 3616548 - DNA, 19 bp, Homo sapiens
ccttcagggagacaggcag

SEQ ID NO: 3616549 - DNA, 19 bp, Homo sapiens
ccttcagtgagcccctccc

SEQ ID NO: 3616550 - DNA, 22 bp, Homo sapiens
ccttcagtgagcccctccccag

SEQ ID NO: 3616551 - DNA, 15 bp, Homo sapiens
ccttcatcagaactc

SEQ ID NO: 3616552 - DNA, 15 bp, Homo sapiens
ccttcatccatcctg

SEQ ID NO: 3616553 - DNA, 17 bp, Homo sapiens
ccttcatccatcctgag

SEQ ID NO: 3616554 - DNA, 13 bp, Homo sapiens
ccttccaacattt

SEQ ID NO: 3616555 - DNA, 19 bp, Homo sapiens
ccttccatggtactgtagc

SEQ ID NO: 3616556 - DNA, 20 bp, Homo sapiens
ccttccatgtcgcctctgca

SEQ ID NO: 3616557 - DNA, 23 bp, Homo sapiens
ccttccatgtcgcctctgcattc

SEQ ID NO: 3616558 - DNA, 17 bp, Homo sapiens
ccttccatgtgcctttc

SEQ ID NO: 3616559 - DNA, 22 bp, Homo sapiens
ccttccatgtgcctttctttgc

SEQ ID NO: 3616560 - DNA, 20 bp, Homo sapiens
ccttcccagggagaaaccca

SEQ ID NO: 3616561 - DNA, 15 bp, Homo sapiens
ccttcccatgccctg

SEQ ID NO: 3616562 - DNA, 14 bp, Homo sapiens
ccttcccatggcca

SEQ ID NO: 3616563 - DNA, 15 bp, Homo sapiens
ccttcccatggccat

SEQ ID NO: 3616564 - DNA, 14 bp, Homo sapiens
ccttcccatttctt

SEQ ID NO: 3616565 - DNA, 18 bp, Homo sapiens
ccttcccatttcttccca

SEQ ID NO: 3616566 - DNA, 12 bp, Homo sapiens
ccttccccagca

SEQ ID NO: 3616567 - DNA, 13 bp, Homo sapiens
ccttccccagcat

SEQ ID NO: 3616568 - DNA, 19 bp, Homo sapiens
ccttccccctccaatccca

SEQ ID NO: 3616569 - DNA, 12 bp, Homo sapiens
ccttccctggcc

SEQ ID NO: 3616570 - DNA, 12 bp, Homo sapiens
ccttccctgggt

SEQ ID NO: 3616571 - DNA, 20 bp, Homo sapiens
ccttccctgggtttgggagc

SEQ ID NO: 3616572 - DNA, 15 bp, Homo sapiens
ccttccctgttctcc

SEQ ID NO: 3616573 - DNA, 14 bp, Homo sapiens
ccttcctaccaccc

SEQ ID NO: 3616574 - DNA, 17 bp, Homo sapiens
ccttcctactcctcata

SEQ ID NO: 3616575 - DNA, 15 bp, Homo sapiens
ccttcctctccactg

SEQ ID NO: 3616576 - DNA, 18 bp, Homo sapiens
ccttcctggaaacagcat

SEQ ID NO: 3616577 - DNA, 19 bp, Homo sapiens
ccttcctggaaacagcatg

SEQ ID NO: 3616578 - DNA, 21 bp, Homo sapiens
ccttcctgggcacacgctgct

SEQ ID NO: 3616579 - DNA, 23 bp, Homo sapiens
ccttcctgggcacacgctgctct

SEQ ID NO: 3616580 - DNA, 16 bp, Homo sapiens
ccttcctgtttcagac

SEQ ID NO: 3616581 - DNA, 21 bp, Homo sapiens
ccttcctgtttcagacccccc

SEQ ID NO: 3616582 - DNA, 15 bp, Homo sapiens
ccttcgatacaccgg

SEQ ID NO: 3616583 - DNA, 15 bp, Homo sapiens
ccttcgggctgtgcc

SEQ ID NO: 3616584 - DNA, 16 bp, Homo sapiens
ccttcgggctgtgccc

SEQ ID NO: 3616585 - DNA, 18 bp, Homo sapiens
ccttctaaattcccaaat

SEQ ID NO: 3616586 - DNA, 21 bp, Homo sapiens
ccttctctgcctcacctggtc

SEQ ID NO: 3616587 - DNA, 23 bp, Homo sapiens
ccttctctgggtctgattttctc

SEQ ID NO: 3616588 - DNA, 14 bp, Homo sapiens
ccttctctgttggt

SEQ ID NO: 3616589 - DNA, 22 bp, Homo sapiens
ccttctgaagtctgagcccatt

SEQ ID NO: 3616590 - DNA, 13 bp, Homo sapiens
ccttctgctactg

SEQ ID NO: 3616591 - DNA, 20 bp, Homo sapiens
ccttctgggcagaccttgac

SEQ ID NO: 3616592 - DNA, 11 bp, Homo sapiens
ccttcttccca

SEQ ID NO: 3616593 - DNA, 23 bp, Homo sapiens
ccttcttcccaatagcaaggctg

SEQ ID NO: 3616594 - DNA, 11 bp, Homo sapiens
ccttcttgtca

SEQ ID NO: 3616595 - DNA, 10 bp, Homo sapiens
ccttctttct

SEQ ID NO: 3616596 - DNA, 13 bp, Homo sapiens
ccttctttgtaat

SEQ ID NO: 3616597 - DNA, 13 bp, Homo sapiens
ccttctttgtata

SEQ ID NO: 3616598 - DNA, 23 bp, Homo sapiens
ccttctttttctgagacagcttg

SEQ ID NO: 3616599 - DNA, 12 bp, Homo sapiens
ccttgaaggtct

SEQ ID NO: 3616600 - DNA, 22 bp, Homo sapiens
ccttgagagttccggggagaaa

SEQ ID NO: 3616601 - DNA, 18 bp, Homo sapiens
ccttgagttaacaggaca

SEQ ID NO: 3616602 - DNA, 15 bp, Homo sapiens
ccttgatgatttaat

SEQ ID NO: 3616603 - DNA, 18 bp, Homo sapiens
ccttgcagaaggcaaggc

SEQ ID NO: 3616604 - DNA, 20 bp, Homo sapiens
ccttgcagaaggcaaggccc

SEQ ID NO: 3616605 - DNA, 18 bp, Homo sapiens
ccttgcagcggctcctgc

SEQ ID NO: 3616606 - DNA, 12 bp, Homo sapiens
ccttgccagaga

SEQ ID NO: 3616607 - DNA, 14 bp, Homo sapiens
ccttgccagttttc

SEQ ID NO: 3616608 - DNA, 16 bp, Homo sapiens
ccttgccagttttccg

SEQ ID NO: 3616609 - DNA, 22 bp, Homo sapiens
ccttgcctaaatttaatgctgc

SEQ ID NO: 3616610 - DNA, 12 bp, Homo sapiens
ccttgcctctgc

SEQ ID NO: 3616611 - DNA, 13 bp, Homo sapiens
ccttgcctctgcc

SEQ ID NO: 3616612 - DNA, 15 bp, Homo sapiens
ccttgctctcctcat

SEQ ID NO: 3616613 - DNA, 12 bp, Homo sapiens
ccttgctgcccg

SEQ ID NO: 3616614 - DNA, 13 bp, Homo sapiens
ccttgctgcccgc

SEQ ID NO: 3616615 - DNA, 23 bp, Homo sapiens
ccttgctgcccgcgggagacagc

SEQ ID NO: 3616616 - DNA, 18 bp, Homo sapiens
ccttgcttatgacatcac

SEQ ID NO: 3616617 - DNA, 13 bp, Homo sapiens
ccttgctttcctg

SEQ ID NO: 3616618 - DNA, 16 bp, Homo sapiens
ccttgctttcctgggc

SEQ ID NO: 3616619 - DNA, 17 bp, Homo sapiens
ccttgctttcctgggcc

SEQ ID NO: 3616620 - DNA, 18 bp, Homo sapiens
ccttgctttcctgggcct

SEQ ID NO: 3616621 - DNA, 20 bp, Homo sapiens
ccttggaaatcaaatgtaaa

SEQ ID NO: 3616622 - DNA, 22 bp, Homo sapiens
ccttggaaatcaaatgtaaagt

SEQ ID NO: 3616623 - DNA, 16 bp, Homo sapiens
ccttggacattttatg

SEQ ID NO: 3616624 - DNA, 20 bp, Homo sapiens
ccttggacattttatgtctt

SEQ ID NO: 3616625 - DNA, 16 bp, Homo sapiens
ccttggactccatcgc

SEQ ID NO: 3616626 - DNA, 16 bp, Homo sapiens
ccttggagaagtggca

SEQ ID NO: 3616627 - DNA, 20 bp, Homo sapiens
ccttggaggagagagacccc

SEQ ID NO: 3616628 - DNA, 16 bp, Homo sapiens
ccttggcacccccatg

SEQ ID NO: 3616629 - DNA, 21 bp, Homo sapiens
ccttggcacccccatgctgcc

SEQ ID NO: 3616630 - DNA, 22 bp, Homo sapiens
ccttggcacccccatgctgcct

SEQ ID NO: 3616631 - DNA, 15 bp, Homo sapiens
ccttggccacagact

SEQ ID NO: 3616632 - DNA, 15 bp, Homo sapiens
ccttggccatgcaga

SEQ ID NO: 3616633 - DNA, 24 bp, Homo sapiens
ccttggcctcccaaagtgctggga

SEQ ID NO: 3616634 - DNA, 23 bp, Homo sapiens
ccttggctttatgcaaatacaat

SEQ ID NO: 3616635 - DNA, 20 bp, Homo sapiens
ccttggctttcagagccagc

SEQ ID NO: 3616636 - DNA, 21 bp, Homo sapiens
ccttggcttttactgaagcct

SEQ ID NO: 3616637 - DNA, 19 bp, Homo sapiens
ccttggggtccctccaccc

SEQ ID NO: 3616638 - DNA, 21 bp, Homo sapiens
ccttggggtccctccacccca

SEQ ID NO: 3616639 - DNA, 13 bp, Homo sapiens
ccttgggtccccc

SEQ ID NO: 3616640 - DNA, 15 bp, Homo sapiens
ccttgtacagtctgc

SEQ ID NO: 3616641 - DNA, 16 bp, Homo sapiens
ccttgtacagtctgct

SEQ ID NO: 3616642 - DNA, 19 bp, Homo sapiens
ccttgtacagtctgctcct

SEQ ID NO: 3616643 - DNA, 15 bp, Homo sapiens
ccttgtcagtgtgtc

SEQ ID NO: 3616644 - DNA, 20 bp, Homo sapiens
ccttgttgtaaaaagcccag

SEQ ID NO: 3616645 - DNA, 19 bp, Homo sapiens
ccttgtttacacataccct

SEQ ID NO: 3616646 - DNA, 23 bp, Homo sapiens
cctttaaaacgcgtctgcctggg

SEQ ID NO: 3616647 - DNA, 18 bp, Homo sapiens
cctttaacttttttttct

SEQ ID NO: 3616648 - DNA, 22 bp, Homo sapiens
cctttaacttttttttctctct

SEQ ID NO: 3616649 - DNA, 23 bp, Homo sapiens
cctttaagccaaagaaacaagct

SEQ ID NO: 3616650 - DNA, 22 bp, Homo sapiens
cctttcagtgcagtttcttttc

SEQ ID NO: 3616651 - DNA, 18 bp, Homo sapiens
cctttccagagcaaccag

SEQ ID NO: 3616652 - DNA, 18 bp, Homo sapiens
cctttcccaccattcctg

SEQ ID NO: 3616653 - DNA, 19 bp, Homo sapiens
cctttcccaccattcctgc

SEQ ID NO: 3616654 - DNA, 22 bp, Homo sapiens
cctttcccaccattcctgcctt

SEQ ID NO: 3616655 - DNA, 16 bp, Homo sapiens
cctttcctctgcacgc

SEQ ID NO: 3616656 - DNA, 21 bp, Homo sapiens
cctttctaagcaaccacactg

SEQ ID NO: 3616657 - DNA, 15 bp, Homo sapiens
cctttctcctttgta

SEQ ID NO: 3616658 - DNA, 13 bp, Homo sapiens
cctttctctctcc

SEQ ID NO: 3616659 - DNA, 16 bp, Homo sapiens
cctttctctctcctct

SEQ ID NO: 3616660 - DNA, 14 bp, Homo sapiens
cctttctctgggct

SEQ ID NO: 3616661 - DNA, 13 bp, Homo sapiens
cctttctgtccca

SEQ ID NO: 3616662 - DNA, 16 bp, Homo sapiens
cctttcttcctattta

SEQ ID NO: 3616663 - DNA, 12 bp, Homo sapiens
cctttctttgcc

SEQ ID NO: 3616664 - DNA, 16 bp, Homo sapiens
cctttctttgcctctg

SEQ ID NO: 3616665 - DNA, 18 bp, Homo sapiens
cctttgcaagatgcttgg

SEQ ID NO: 3616666 - DNA, 23 bp, Homo sapiens
cctttggcctggggtgcatctcc

SEQ ID NO: 3616667 - DNA, 21 bp, Homo sapiens
cctttggctggtagcagcagg

SEQ ID NO: 3616668 - DNA, 22 bp, Homo sapiens
cctttgtctttctttgtcattc

SEQ ID NO: 3616669 - DNA, 23 bp, Homo sapiens
cctttgtctttctttgtcattca

SEQ ID NO: 3616670 - DNA, 20 bp, Homo sapiens
cctttgtgctttttgtcatg

SEQ ID NO: 3616671 - DNA, 22 bp, Homo sapiens
ccttttatctccttgtggccta

SEQ ID NO: 3616672 - DNA, 14 bp, Homo sapiens
ccttttatgtattt

SEQ ID NO: 3616673 - DNA, 23 bp, Homo sapiens
ccttttatttttatttctgactc

SEQ ID NO: 3616674 - DNA, 13 bp, Homo sapiens
ccttttcaggaga

SEQ ID NO: 3616675 - DNA, 16 bp, Homo sapiens
ccttttccacacgcat

SEQ ID NO: 3616676 - DNA, 10 bp, Homo sapiens
ccttttccta

SEQ ID NO: 3616677 - DNA, 13 bp, Homo sapiens
ccttttcctatcc

SEQ ID NO: 3616678 - DNA, 10 bp, Homo sapiens
ccttttcctt

SEQ ID NO: 3616679 - DNA, 20 bp, Homo sapiens
ccttttgaatacatttgtat

SEQ ID NO: 3616680 - DNA, 15 bp, Homo sapiens
ccttttgacactgct

SEQ ID NO: 3616681 - DNA, 11 bp, Homo sapiens
ccttttgctct

SEQ ID NO: 3616682 - DNA, 19 bp, Homo sapiens
cctttttcataaattattt

SEQ ID NO: 3616683 - DNA, 13 bp, Homo sapiens
cctttttcattta

SEQ ID NO: 3616684 - DNA, 20 bp, Homo sapiens
ccttttttcaatatgcaagc

SEQ ID NO: 3616685 - DNA, 21 bp, Homo sapiens
ccttttttcaatatgcaagca

SEQ ID NO: 3616686 - DNA, 20 bp, Homo sapiens
cgaaactccatctcaaaaca

SEQ ID NO: 3616687 - DNA, 23 bp, Homo sapiens
cgaaactccatctcaaaacaaaa

SEQ ID NO: 3616688 - DNA, 17 bp, Homo sapiens
cgaaatatcaaagtcat

SEQ ID NO: 3616689 - DNA, 13 bp, Homo sapiens
cgaaatgctgtct

SEQ ID NO: 3616690 - DNA, 13 bp, Homo sapiens
cgaagacacagac

SEQ ID NO: 3616691 - DNA, 21 bp, Homo sapiens
cgaagatggtggccacagact

SEQ ID NO: 3616692 - DNA, 24 bp, Homo sapiens
cgaagctcattcccaacgtgcaaa

SEQ ID NO: 3616693 - DNA, 12 bp, Homo sapiens
cgaagtctctga

SEQ ID NO: 3616694 - DNA, 18 bp, Homo sapiens
cgacacacggggctcggg

SEQ ID NO: 3616695 - DNA, 13 bp, Homo sapiens
cgacagcctggca

SEQ ID NO: 3616696 - DNA, 14 bp, Homo sapiens
cgacagggcctgga

SEQ ID NO: 3616697 - DNA, 16 bp, Homo sapiens
cgacagggcctggagc

SEQ ID NO: 3616698 - DNA, 19 bp, Homo sapiens
cgacagggcctggagcccc

SEQ ID NO: 3616699 - DNA, 16 bp, Homo sapiens
cgacagtgccatcccc

SEQ ID NO: 3616700 - DNA, 15 bp, Homo sapiens
cgaccaactgcccta

SEQ ID NO: 3616701 - DNA, 14 bp, Homo sapiens
cgaccacctgccca

SEQ ID NO: 3616702 - DNA, 20 bp, Homo sapiens
cgaccccaaaggaacactga

SEQ ID NO: 3616703 - DNA, 19 bp, Homo sapiens
cgaccccgtcacagcctca

SEQ ID NO: 3616704 - DNA, 19 bp, Homo sapiens
cgacgtttgcggcagtgtt

SEQ ID NO: 3616705 - DNA, 14 bp, Homo sapiens
cgactcagggacct

SEQ ID NO: 3616706 - DNA, 18 bp, Homo sapiens
cgactgaaaatattgttt

SEQ ID NO: 3616707 - DNA, 18 bp, Homo sapiens
cgactggtccagctctga

SEQ ID NO: 3616708 - DNA, 19 bp, Homo sapiens
cgactgtcagtggggcagc

SEQ ID NO: 3616709 - DNA, 22 bp, Homo sapiens
cgactgtcagtggggcagcctc

SEQ ID NO: 3616710 - DNA, 23 bp, Homo sapiens
cgactgtcagtggggcagcctct

SEQ ID NO: 3616711 - DNA, 12 bp, Homo sapiens
cgagaagtgctc

SEQ ID NO: 3616712 - DNA, 13 bp, Homo sapiens
cgagaagtgctct

SEQ ID NO: 3616713 - DNA, 23 bp, Homo sapiens
cgagagccttacttcaaagtgcc

SEQ ID NO: 3616714 - DNA, 14 bp, Homo sapiens
cgagcaagccggca

SEQ ID NO: 3616715 - DNA, 11 bp, Homo sapiens
cgagcagccca

SEQ ID NO: 3616716 - DNA, 12 bp, Homo sapiens
cgagcagcccag

SEQ ID NO: 3616717 - DNA, 20 bp, Homo sapiens
cgagcagcccagggcctaga

SEQ ID NO: 3616718 - DNA, 22 bp, Homo sapiens
cgagcagcccagggcctagagg

SEQ ID NO: 3616719 - DNA, 18 bp, Homo sapiens
cgagcaggctactgtcag

SEQ ID NO: 3616720 - DNA, 11 bp, Homo sapiens
cgagccctgga

SEQ ID NO: 3616721 - DNA, 13 bp, Homo sapiens
cgagccctggaga

SEQ ID NO: 3616722 - DNA, 14 bp, Homo sapiens
cgagccctggagag

SEQ ID NO: 3616723 - DNA, 14 bp, Homo sapiens
cgaggacatttgtg

SEQ ID NO: 3616724 - DNA, 20 bp, Homo sapiens
cgaggccacattgctggctg

SEQ ID NO: 3616725 - DNA, 17 bp, Homo sapiens
cgagggatgatgaggga

SEQ ID NO: 3616726 - DNA, 21 bp, Homo sapiens
cgagggatgatgagggaagca

SEQ ID NO: 3616727 - DNA, 22 bp, Homo sapiens
cgagggtctcccctcctgcaca

SEQ ID NO: 3616728 - DNA, 20 bp, Homo sapiens
cgagtctccgggactgccct

SEQ ID NO: 3616729 - DNA, 18 bp, Homo sapiens
cgatacaccgggcctgga

SEQ ID NO: 3616730 - DNA, 20 bp, Homo sapiens
cgatacaccgggcctggaga

SEQ ID NO: 3616731 - DNA, 21 bp, Homo sapiens
cgatacaccgggcctggagaa

SEQ ID NO: 3616732 - DNA, 13 bp, Homo sapiens
cgatacctggagc

SEQ ID NO: 3616733 - DNA, 22 bp, Homo sapiens
cgatggggcaagacagaaaagt

SEQ ID NO: 3616734 - DNA, 13 bp, Homo sapiens
cgatgttgtattg

SEQ ID NO: 3616735 - DNA, 15 bp, Homo sapiens
cgatgttgtcaagga

SEQ ID NO: 3616736 - DNA, 20 bp, Homo sapiens
cgatgttgtcaaggatggtt

SEQ ID NO: 3616737 - DNA, 19 bp, Homo sapiens
cgattgacctgtcctcttt

SEQ ID NO: 3616738 - DNA, 21 bp, Homo sapiens
cgattgacctgtcctctttgt

SEQ ID NO: 3616739 - DNA, 20 bp, Homo sapiens
cgattgtgtacttttccttt

SEQ ID NO: 3616740 - DNA, 18 bp, Homo sapiens
cgatttggggggggaggg

SEQ ID NO: 3616741 - DNA, 12 bp, Homo sapiens
cgcacagtttac

SEQ ID NO: 3616742 - DNA, 15 bp, Homo sapiens
cgcagaccagctggc

SEQ ID NO: 3616743 - DNA, 13 bp, Homo sapiens
cgcagacctggag

SEQ ID NO: 3616744 - DNA, 14 bp, Homo sapiens
cgcagacctggagc

SEQ ID NO: 3616745 - DNA, 18 bp, Homo sapiens
cgcagagaaatgccccag

SEQ ID NO: 3616746 - DNA, 19 bp, Homo sapiens
cgcagagaaatgccccagt

SEQ ID NO: 3616747 - DNA, 21 bp, Homo sapiens
cgcagagaaatgccccagtgt

SEQ ID NO: 3616748 - DNA, 10 bp, Homo sapiens
cgcagccctg

SEQ ID NO: 3616749 - DNA, 13 bp, Homo sapiens
cgcagccctgctt

SEQ ID NO: 3616750 - DNA, 19 bp, Homo sapiens
cgcaggcagcgcagggctg

SEQ ID NO: 3616751 - DNA, 18 bp, Homo sapiens
cgcagggaatgcagcagg

SEQ ID NO: 3616752 - DNA, 12 bp, Homo sapiens
cgcagggcgccc

SEQ ID NO: 3616753 - DNA, 17 bp, Homo sapiens
cgcagggcgcccagcgc

SEQ ID NO: 3616754 - DNA, 23 bp, Homo sapiens
cgcaggtgctcatgctgctcccc

SEQ ID NO: 3616755 - DNA, 23 bp, Homo sapiens
cgcagtgtgcactaaggggcccg

SEQ ID NO: 3616756 - DNA, 20 bp, Homo sapiens
cgcagttgtagcagaaacca

SEQ ID NO: 3616757 - DNA, 13 bp, Homo sapiens
cgcatgtgtgcct

SEQ ID NO: 3616758 - DNA, 20 bp, Homo sapiens
cgccacaaaaatagagaaaa

SEQ ID NO: 3616759 - DNA, 19 bp, Homo sapiens
cgccacccgggcaagggtc

SEQ ID NO: 3616760 - DNA, 19 bp, Homo sapiens
cgccacggcctggctggtg

SEQ ID NO: 3616761 - DNA, 17 bp, Homo sapiens
cgccacgtcccagcatc

SEQ ID NO: 3616762 - DNA, 20 bp, Homo sapiens
cgccagctgggagcactggt

SEQ ID NO: 3616763 - DNA, 13 bp, Homo sapiens
cgccagggctggg

SEQ ID NO: 3616764 - DNA, 13 bp, Homo sapiens
cgccccagagctc

SEQ ID NO: 3616765 - DNA, 14 bp, Homo sapiens
cgcccccacctcca

SEQ ID NO: 3616766 - DNA, 14 bp, Homo sapiens
cgccccgccccaga

SEQ ID NO: 3616767 - DNA, 15 bp, Homo sapiens
cgccccgccccagag

SEQ ID NO: 3616768 - DNA, 17 bp, Homo sapiens
cgccccgccccagagct

SEQ ID NO: 3616769 - DNA, 20 bp, Homo sapiens
cgcccctccaaacctccagc

SEQ ID NO: 3616770 - DNA, 22 bp, Homo sapiens
cgcccctccaaacctccagcct

SEQ ID NO: 3616771 - DNA, 23 bp, Homo sapiens
cgcccctccaaacctccagcctc

SEQ ID NO: 3616772 - DNA, 16 bp, Homo sapiens
cgcccctcccacgcct

SEQ ID NO: 3616773 - DNA, 21 bp, Homo sapiens
cgcccctgtggccctggccac

SEQ ID NO: 3616774 - DNA, 14 bp, Homo sapiens
cgcccggggagttt

SEQ ID NO: 3616775 - DNA, 14 bp, Homo sapiens
cgccctgcagggcc

SEQ ID NO: 3616776 - DNA, 22 bp, Homo sapiens
cgccctgcagggccgggcaggg

SEQ ID NO: 3616777 - DNA, 18 bp, Homo sapiens
cgcccttccatgtgcctt

SEQ ID NO: 3616778 - DNA, 20 bp, Homo sapiens
cgcccttccatgtgcctttc

SEQ ID NO: 3616779 - DNA, 22 bp, Homo sapiens
cgccgccggagtccactcccag

SEQ ID NO: 3616780 - DNA, 13 bp, Homo sapiens
cgcctcaccagcc

SEQ ID NO: 3616781 - DNA, 16 bp, Homo sapiens
cgcctcaccagccccc

SEQ ID NO: 3616782 - DNA, 19 bp, Homo sapiens
cgcctcaccagccccccgc

SEQ ID NO: 3616783 - DNA, 15 bp, Homo sapiens
cgcctccctctcaga

SEQ ID NO: 3616784 - DNA, 22 bp, Homo sapiens
cgcctcgacctccccacccgct

SEQ ID NO: 3616785 - DNA, 20 bp, Homo sapiens
cgcctgacaccgtgggtcat

SEQ ID NO: 3616786 - DNA, 19 bp, Homo sapiens
cgcctgcttcttctctcca

SEQ ID NO: 3616787 - DNA, 12 bp, Homo sapiens
cgcgcccagcag

SEQ ID NO: 3616788 - DNA, 13 bp, Homo sapiens
cgcgcccagcaga

SEQ ID NO: 3616789 - DNA, 21 bp, Homo sapiens
cgcgcgcccaccctccggcgg

SEQ ID NO: 3616790 - DNA, 15 bp, Homo sapiens
cgcgctcgcccagca

SEQ ID NO: 3616791 - DNA, 17 bp, Homo sapiens
cgcgctcgcccagcagg

SEQ ID NO: 3616792 - DNA, 22 bp, Homo sapiens
cgcgggagacagcttctctgca

SEQ ID NO: 3616793 - DNA, 23 bp, Homo sapiens
cgctaaagggaccatctgctgca

SEQ ID NO: 3616794 - DNA, 16 bp, Homo sapiens
cgctcaatgcccagta

SEQ ID NO: 3616795 - DNA, 16 bp, Homo sapiens
cgctcaggggcctgga

SEQ ID NO: 3616796 - DNA, 18 bp, Homo sapiens
cgctcaggggcctggagg

SEQ ID NO: 3616797 - DNA, 19 bp, Homo sapiens
cgctcaggggcctggaggt

SEQ ID NO: 3616798 - DNA, 22 bp, Homo sapiens
cgctcaggggcctggaggtctg

SEQ ID NO: 3616799 - DNA, 13 bp, Homo sapiens
cgctcccacagct

SEQ ID NO: 3616800 - DNA, 16 bp, Homo sapiens
cgctcccgctcccagg

SEQ ID NO: 3616801 - DNA, 15 bp, Homo sapiens
cgctcgcccagcagg

SEQ ID NO: 3616802 - DNA, 17 bp, Homo sapiens
cgctctcgggtcaccct

SEQ ID NO: 3616803 - DNA, 18 bp, Homo sapiens
cgctctcgggtcaccctg

SEQ ID NO: 3616804 - DNA, 15 bp, Homo sapiens
cgctgattcctcgtg

SEQ ID NO: 3616805 - DNA, 18 bp, Homo sapiens
cgctgcccaggggagccc

SEQ ID NO: 3616806 - DNA, 22 bp, Homo sapiens
cgctgcccttgggtccccccga

SEQ ID NO: 3616807 - DNA, 24 bp, Homo sapiens
cgctgcttggtgtgacccacggag

SEQ ID NO: 3616808 - DNA, 16 bp, Homo sapiens
cgctgtataaagcatg

SEQ ID NO: 3616809 - DNA, 10 bp, Homo sapiens
cgctgtctct

SEQ ID NO: 3616810 - DNA, 15 bp, Homo sapiens
cgctgtgccacaggc

SEQ ID NO: 3616811 - DNA, 13 bp, Homo sapiens
cgctgtgtacaat

SEQ ID NO: 3616812 - DNA, 23 bp, Homo sapiens
cgcttctgaagctgctgcagctc

SEQ ID NO: 3616813 - DNA, 21 bp, Homo sapiens
cgcttgaacctgggaggcaga

SEQ ID NO: 3616814 - DNA, 16 bp, Homo sapiens
cgctttgaaagaagca

SEQ ID NO: 3616815 - DNA, 19 bp, Homo sapiens
cggaaagtttttagaatgt

SEQ ID NO: 3616816 - DNA, 13 bp, Homo sapiens
cggaaggaggcca

SEQ ID NO: 3616817 - DNA, 20 bp, Homo sapiens
cggaagtacttccctcaggc

SEQ ID NO: 3616818 - DNA, 17 bp, Homo sapiens
cggacccttctgggtcc

SEQ ID NO: 3616819 - DNA, 13 bp, Homo sapiens
cggagaggtggcc

SEQ ID NO: 3616820 - DNA, 14 bp, Homo sapiens
cggagaggtggccg

SEQ ID NO: 3616821 - DNA, 19 bp, Homo sapiens
cggagaggtggccgccatg

SEQ ID NO: 3616822 - DNA, 20 bp, Homo sapiens
cggagatagatgactttgca

SEQ ID NO: 3616823 - DNA, 21 bp, Homo sapiens
cggagcccagcctgggagccc

SEQ ID NO: 3616824 - DNA, 12 bp, Homo sapiens
cggagccgagcc

SEQ ID NO: 3616825 - DNA, 12 bp, Homo sapiens
cggagctcctgt

SEQ ID NO: 3616826 - DNA, 14 bp, Homo sapiens
cggaggggatccag

SEQ ID NO: 3616827 - DNA, 17 bp, Homo sapiens
cggaggggatccagcca

SEQ ID NO: 3616828 - DNA, 18 bp, Homo sapiens
cggaggggatccagccac

SEQ ID NO: 3616829 - DNA, 15 bp, Homo sapiens
cggaggggcctggca

SEQ ID NO: 3616830 - DNA, 18 bp, Homo sapiens
cggaggtctctgggagcc

SEQ ID NO: 3616831 - DNA, 20 bp, Homo sapiens
cggaggtctctgggagccca

SEQ ID NO: 3616832 - DNA, 22 bp, Homo sapiens
cggaggtctctgggagcccaga

SEQ ID NO: 3616833 - DNA, 19 bp, Homo sapiens
cggagtcagtgccaggtcc

SEQ ID NO: 3616834 - DNA, 15 bp, Homo sapiens
cggagtgcctggagt

SEQ ID NO: 3616835 - DNA, 12 bp, Homo sapiens
cggatcctgctg

SEQ ID NO: 3616836 - DNA, 19 bp, Homo sapiens
cggatgctactactgcagt

SEQ ID NO: 3616837 - DNA, 23 bp, Homo sapiens
cggatgctactactgcagtcttt

SEQ ID NO: 3616838 - DNA, 23 bp, Homo sapiens
cggcaacgtagcctgggctcact

SEQ ID NO: 3616839 - DNA, 16 bp, Homo sapiens
cggcaccctggtctgt

SEQ ID NO: 3616840 - DNA, 20 bp, Homo sapiens
cggcaccctggtctgtggag

SEQ ID NO: 3616841 - DNA, 21 bp, Homo sapiens
cggcaccctggtctgtggaga

SEQ ID NO: 3616842 - DNA, 15 bp, Homo sapiens
cggcacgtccttggg

SEQ ID NO: 3616843 - DNA, 14 bp, Homo sapiens
cggcagcgggcgga

SEQ ID NO: 3616844 - DNA, 18 bp, Homo sapiens
cggcagggaaatgtatgt

SEQ ID NO: 3616845 - DNA, 14 bp, Homo sapiens
cggccagctctgga

SEQ ID NO: 3616846 - DNA, 15 bp, Homo sapiens
cggccagctctggag

SEQ ID NO: 3616847 - DNA, 20 bp, Homo sapiens
cggccaggccgcgcccagca

SEQ ID NO: 3616848 - DNA, 17 bp, Homo sapiens
cggccagggagaagctc

SEQ ID NO: 3616849 - DNA, 22 bp, Homo sapiens
cggccagtggccttccccagca

SEQ ID NO: 3616850 - DNA, 19 bp, Homo sapiens
cggcccgcgcagctgccta

SEQ ID NO: 3616851 - DNA, 14 bp, Homo sapiens
cggccgcgccaccc

SEQ ID NO: 3616852 - DNA, 17 bp, Homo sapiens
cggccggagggcaggac

SEQ ID NO: 3616853 - DNA, 17 bp, Homo sapiens
cggcctcctcggagagc

SEQ ID NO: 3616854 - DNA, 16 bp, Homo sapiens
cggcctggctggtggg

SEQ ID NO: 3616855 - DNA, 18 bp, Homo sapiens
cggcgctgattcctcgtg

SEQ ID NO: 3616856 - DNA, 22 bp, Homo sapiens
cggcggaattcaccagtgttcc

SEQ ID NO: 3616857 - DNA, 19 bp, Homo sapiens
cggcgggatcctccacaga

SEQ ID NO: 3616858 - DNA, 13 bp, Homo sapiens
cggctccagctca

SEQ ID NO: 3616859 - DNA, 19 bp, Homo sapiens
cggctcgtgtatttattac

SEQ ID NO: 3616860 - DNA, 20 bp, Homo sapiens
cggctcgtgtatttattacc

SEQ ID NO: 3616861 - DNA, 18 bp, Homo sapiens
cggctctgcatgttttcc

SEQ ID NO: 3616862 - DNA, 13 bp, Homo sapiens
cggctctgggcct

SEQ ID NO: 3616863 - DNA, 19 bp, Homo sapiens
cggctctgggcctgagggt

SEQ ID NO: 3616864 - DNA, 21 bp, Homo sapiens
cggctgccaggggctctgtgg

SEQ ID NO: 3616865 - DNA, 12 bp, Homo sapiens
cggctggagaaa

SEQ ID NO: 3616866 - DNA, 13 bp, Homo sapiens
cgggaccagctca

SEQ ID NO: 3616867 - DNA, 18 bp, Homo sapiens
cgggagcacccagagcac

SEQ ID NO: 3616868 - DNA, 20 bp, Homo sapiens
cgggagcgagtaaagtctgg

SEQ ID NO: 3616869 - DNA, 20 bp, Homo sapiens
cgggatcctccacagagagg

SEQ ID NO: 3616870 - DNA, 14 bp, Homo sapiens
cgggatgacctcca

SEQ ID NO: 3616871 - DNA, 21 bp, Homo sapiens
cgggcagggggacagcaggga

SEQ ID NO: 3616872 - DNA, 21 bp, Homo sapiens
cgggcatggtggctcatgcct

SEQ ID NO: 3616873 - DNA, 23 bp, Homo sapiens
cgggccacacgtggctggcggcc

SEQ ID NO: 3616874 - DNA, 20 bp, Homo sapiens
cgggcctggagaactagaga

SEQ ID NO: 3616875 - DNA, 15 bp, Homo sapiens
cgggctggagaaaga

SEQ ID NO: 3616876 - DNA, 16 bp, Homo sapiens
cgggctgggagctctg

SEQ ID NO: 3616877 - DNA, 23 bp, Homo sapiens
cggggagtttccgcggcggcttc

SEQ ID NO: 3616878 - DNA, 22 bp, Homo sapiens
cggggtgtaacttcctgctgca

SEQ ID NO: 3616879 - DNA, 18 bp, Homo sapiens
cgggtcaccctgctttgg

SEQ ID NO: 3616880 - DNA, 22 bp, Homo sapiens
cgggtcatctgtacctctgcct

SEQ ID NO: 3616881 - DNA, 18 bp, Homo sapiens
cgggtgaatctgtctatc

SEQ ID NO: 3616882 - DNA, 20 bp, Homo sapiens
cgggtgggcggcacagcctt

SEQ ID NO: 3616883 - DNA, 16 bp, Homo sapiens
cggtcagaggagcgca

SEQ ID NO: 3616884 - DNA, 18 bp, Homo sapiens
cggtcagaggagcgcagg

SEQ ID NO: 3616885 - DNA, 13 bp, Homo sapiens
cggtccctgtccc

SEQ ID NO: 3616886 - DNA, 13 bp, Homo sapiens
cggtcctggtgcc

SEQ ID NO: 3616887 - DNA, 16 bp, Homo sapiens
cggtcgggcagccagc

SEQ ID NO: 3616888 - DNA, 22 bp, Homo sapiens
cggtcgggttttattgtttaaa

SEQ ID NO: 3616889 - DNA, 15 bp, Homo sapiens
cggtgcgttctcctg

SEQ ID NO: 3616890 - DNA, 16 bp, Homo sapiens
cggtgctgcaggagtg

SEQ ID NO: 3616891 - DNA, 22 bp, Homo sapiens
cggtggctagtcaagctcctcc

SEQ ID NO: 3616892 - DNA, 13 bp, Homo sapiens
cggtggctgcccc

SEQ ID NO: 3616893 - DNA, 15 bp, Homo sapiens
cggtgtatcctggcc

SEQ ID NO: 3616894 - DNA, 21 bp, Homo sapiens
cggtgtatcctggccctgggg

SEQ ID NO: 3616895 - DNA, 16 bp, Homo sapiens
cggtgtccccaccatc

SEQ ID NO: 3616896 - DNA, 22 bp, Homo sapiens
cggtgtccccaccatctgctgt

SEQ ID NO: 3616897 - DNA, 19 bp, Homo sapiens
cggtgttaattttgctaac

SEQ ID NO: 3616898 - DNA, 18 bp, Homo sapiens
cggttcctcatctgagag

SEQ ID NO: 3616899 - DNA, 21 bp, Homo sapiens
cggttgttctttcctcacatt

SEQ ID NO: 3616900 - DNA, 20 bp, Homo sapiens
cggtttgccatgttgccaga

SEQ ID NO: 3616901 - DNA, 22 bp, Homo sapiens
cggtttttttctttggctgcag

SEQ ID NO: 3616902 - DNA, 22 bp, Homo sapiens
cgtaagaccaaatgtagttttg

SEQ ID NO: 3616903 - DNA, 19 bp, Homo sapiens
cgtacaaccccctccaccc

SEQ ID NO: 3616904 - DNA, 18 bp, Homo sapiens
cgtactacccagctctgt

SEQ ID NO: 3616905 - DNA, 21 bp, Homo sapiens
cgtagattcccatcatacact

SEQ ID NO: 3616906 - DNA, 22 bp, Homo sapiens
cgtagcctgggctcactgtgct

SEQ ID NO: 3616907 - DNA, 23 bp, Homo sapiens
cgtagcctgggctcactgtgctg

SEQ ID NO: 3616908 - DNA, 13 bp, Homo sapiens
cgtagctctctta

SEQ ID NO: 3616909 - DNA, 14 bp, Homo sapiens
cgtagctctgctgc

SEQ ID NO: 3616910 - DNA, 16 bp, Homo sapiens
cgtagctctgctgctg

SEQ ID NO: 3616911 - DNA, 15 bp, Homo sapiens
cgtaggggctcctga

SEQ ID NO: 3616912 - DNA, 22 bp, Homo sapiens
cgtatatgtctcaggtccctgc

SEQ ID NO: 3616913 - DNA, 16 bp, Homo sapiens
cgtcactacctggctg

SEQ ID NO: 3616914 - DNA, 14 bp, Homo sapiens
cgtcagccacctgg

SEQ ID NO: 3616915 - DNA, 21 bp, Homo sapiens
cgtcagccacctgggaacaca

SEQ ID NO: 3616916 - DNA, 13 bp, Homo sapiens
cgtccagctcagc

SEQ ID NO: 3616917 - DNA, 19 bp, Homo sapiens
cgtccaggagcctgtgcct

SEQ ID NO: 3616918 - DNA, 19 bp, Homo sapiens
cgtccatccgactgcccct

SEQ ID NO: 3616919 - DNA, 15 bp, Homo sapiens
cgtcccagcatccct

SEQ ID NO: 3616920 - DNA, 17 bp, Homo sapiens
cgtcccagcatccctgg

SEQ ID NO: 3616921 - DNA, 18 bp, Homo sapiens
cgtcctctcggctgccag

SEQ ID NO: 3616922 - DNA, 19 bp, Homo sapiens
cgtctactgcaagagccaa

SEQ ID NO: 3616923 - DNA, 15 bp, Homo sapiens
cgtctccccttctct

SEQ ID NO: 3616924 - DNA, 16 bp, Homo sapiens
cgtctggactgttctg

SEQ ID NO: 3616925 - DNA, 14 bp, Homo sapiens
cgtctgttccccct

SEQ ID NO: 3616926 - DNA, 17 bp, Homo sapiens
cgtcttctccctattcc

SEQ ID NO: 3616927 - DNA, 21 bp, Homo sapiens
cgtcttgaacgagcagcccag

SEQ ID NO: 3616928 - DNA, 17 bp, Homo sapiens
cgtgaagaaataaatga

SEQ ID NO: 3616929 - DNA, 14 bp, Homo sapiens
cgtgagagaaagag

SEQ ID NO: 3616930 - DNA, 21 bp, Homo sapiens
cgtgagagaaagagagaagcc

SEQ ID NO: 3616931 - DNA, 23 bp, Homo sapiens
cgtgagagaaagagagaagccag

SEQ ID NO: 3616932 - DNA, 19 bp, Homo sapiens
cgtgagctggggactcagg

SEQ ID NO: 3616933 - DNA, 13 bp, Homo sapiens
cgtgaggcctggg

SEQ ID NO: 3616934 - DNA, 19 bp, Homo sapiens
cgtgaggggcaagctaggc

SEQ ID NO: 3616935 - DNA, 16 bp, Homo sapiens
cgtgagtcatttaaat

SEQ ID NO: 3616936 - DNA, 21 bp, Homo sapiens
cgtgatcaaagccacactctg

SEQ ID NO: 3616937 - DNA, 21 bp, Homo sapiens
cgtgatctctgttacaaaaga

SEQ ID NO: 3616938 - DNA, 20 bp, Homo sapiens
cgtgatgacatatcacatgt

SEQ ID NO: 3616939 - DNA, 13 bp, Homo sapiens
cgtgcacttccca

SEQ ID NO: 3616940 - DNA, 15 bp, Homo sapiens
cgtgcacttcccaga

SEQ ID NO: 3616941 - DNA, 14 bp, Homo sapiens
cgtgccccttccct

SEQ ID NO: 3616942 - DNA, 19 bp, Homo sapiens
cgtgccctcgtcagctggg

SEQ ID NO: 3616943 - DNA, 16 bp, Homo sapiens
cgtgccttcagctcta

SEQ ID NO: 3616944 - DNA, 15 bp, Homo sapiens
cgtgcgggcgaggcc

SEQ ID NO: 3616945 - DNA, 16 bp, Homo sapiens
cgtgctccgcagggcg

SEQ ID NO: 3616946 - DNA, 16 bp, Homo sapiens
cgtgctgacagctgct

SEQ ID NO: 3616947 - DNA, 16 bp, Homo sapiens
cgtgctgtctcctttg

SEQ ID NO: 3616948 - DNA, 14 bp, Homo sapiens
cgtgctgtgctctg

SEQ ID NO: 3616949 - DNA, 15 bp, Homo sapiens
cgtgctgtgctctgg

SEQ ID NO: 3616950 - DNA, 13 bp, Homo sapiens
cgtggactgtgct

SEQ ID NO: 3616951 - DNA, 19 bp, Homo sapiens
cgtggatgggcaaagcttg

SEQ ID NO: 3616952 - DNA, 19 bp, Homo sapiens
cgtggattgtatttaagac

SEQ ID NO: 3616953 - DNA, 14 bp, Homo sapiens
cgtggcagcttgct

SEQ ID NO: 3616954 - DNA, 21 bp, Homo sapiens
cgtggcagcttgctgggcttt

SEQ ID NO: 3616955 - DNA, 21 bp, Homo sapiens
cgtggcctcgtgctccgcagg

SEQ ID NO: 3616956 - DNA, 18 bp, Homo sapiens
cgtggcttcccgctcagc

SEQ ID NO: 3616957 - DNA, 13 bp, Homo sapiens
cgtgggaaagggg

SEQ ID NO: 3616958 - DNA, 17 bp, Homo sapiens
cgtggggtaacatctgt

SEQ ID NO: 3616959 - DNA, 12 bp, Homo sapiens
cgtggtgaggct

SEQ ID NO: 3616960 - DNA, 22 bp, Homo sapiens
cgtggtgggggaggagcctctg

SEQ ID NO: 3616961 - DNA, 20 bp, Homo sapiens
cgtggtgtgtccctggacac

SEQ ID NO: 3616962 - DNA, 22 bp, Homo sapiens
cgtggtgtgtccctggacacag

SEQ ID NO: 3616963 - DNA, 10 bp, Homo sapiens
cgtggtttgc

SEQ ID NO: 3616964 - DNA, 17 bp, Homo sapiens
cgtgtatttattaccgt

SEQ ID NO: 3616965 - DNA, 16 bp, Homo sapiens
cgtgtcccctgacagg

SEQ ID NO: 3616966 - DNA, 21 bp, Homo sapiens
cgtgtcccttcccagcgctgc

SEQ ID NO: 3616967 - DNA, 14 bp, Homo sapiens
cgtgtctcagcctc

SEQ ID NO: 3616968 - DNA, 13 bp, Homo sapiens
cgttaggccaggc

SEQ ID NO: 3616969 - DNA, 22 bp, Homo sapiens
cgttatatttgacttgaaaaga

SEQ ID NO: 3616970 - DNA, 22 bp, Homo sapiens
cgttcacctccaagcatttcat

SEQ ID NO: 3616971 - DNA, 15 bp, Homo sapiens
cgttgggagcctagc

SEQ ID NO: 3616972 - DNA, 20 bp, Homo sapiens
cgttgttgcatgtttgaaat

SEQ ID NO: 3616973 - DNA, 16 bp, Homo sapiens
cgtttataattggctt

SEQ ID NO: 3616974 - DNA, 18 bp, Homo sapiens
cgtttggtgcttctcaga

SEQ ID NO: 3616975 - DNA, 14 bp, Homo sapiens
cgttttccaaagag

SEQ ID NO: 3616976 - DNA, 17 bp, Homo sapiens
cgttttgggtactttct

SEQ ID NO: 3616977 - DNA, 17 bp, Homo sapiens
cgttttttaaatgtata

SEQ ID NO: 3616978 - DNA, 13 bp, Homo sapiens
ctaaaaatacacc

SEQ ID NO: 3616979 - DNA, 15 bp, Homo sapiens
ctaaaaatgaaaatt

SEQ ID NO: 3616980 - DNA, 19 bp, Homo sapiens
ctaaaagacagcagggaca

SEQ ID NO: 3616981 - DNA, 15 bp, Homo sapiens
ctaaaataattttgt

SEQ ID NO: 3616982 - DNA, 15 bp, Homo sapiens
ctaaaatatttattt

SEQ ID NO: 3616983 - DNA, 18 bp, Homo sapiens
ctaaaatgaggatccagg

SEQ ID NO: 3616984 - DNA, 22 bp, Homo sapiens
ctaaaatgaggatccagggcag

SEQ ID NO: 3616985 - DNA, 19 bp, Homo sapiens
ctaaaatggcgaacatgtg

SEQ ID NO: 3616986 - DNA, 20 bp, Homo sapiens
ctaaaatgttaaaacataaa

SEQ ID NO: 3616987 - DNA, 15 bp, Homo sapiens
ctaaaattgggcttg

SEQ ID NO: 3616988 - DNA, 21 bp, Homo sapiens
ctaaaatttcataattctgaa

SEQ ID NO: 3616989 - DNA, 14 bp, Homo sapiens
ctaaaccccaagct

SEQ ID NO: 3616990 - DNA, 21 bp, Homo sapiens
ctaaactgcagcctctctggc

SEQ ID NO: 3616991 - DNA, 23 bp, Homo sapiens
ctaaactgcagcctctctggctg

SEQ ID NO: 3616992 - DNA, 11 bp, Homo sapiens
ctaaagaagag

SEQ ID NO: 3616993 - DNA, 12 bp, Homo sapiens
ctaaagccaggc

SEQ ID NO: 3616994 - DNA, 16 bp, Homo sapiens
ctaaagccaggctcag

SEQ ID NO: 3616995 - DNA, 19 bp, Homo sapiens
ctaaagccaggctcaggag

SEQ ID NO: 3616996 - DNA, 22 bp, Homo sapiens
ctaaagccaggctcaggagaag

SEQ ID NO: 3616997 - DNA, 16 bp, Homo sapiens
ctaaagcctcaaaaca

SEQ ID NO: 3616998 - DNA, 23 bp, Homo sapiens
ctaaagggaccatctgctgcagt

SEQ ID NO: 3616999 - DNA, 19 bp, Homo sapiens
ctaaagggactacctctgt

SEQ ID NO: 3617000 - DNA, 17 bp, Homo sapiens
ctaaagggcagggccca

SEQ ID NO: 3617001 - DNA, 18 bp, Homo sapiens
ctaaagggcagggcccac

SEQ ID NO: 3617002 - DNA, 20 bp, Homo sapiens
ctaaaggtgttgtcccttct

SEQ ID NO: 3617003 - DNA, 12 bp, Homo sapiens
ctaaataaagag

SEQ ID NO: 3617004 - DNA, 19 bp, Homo sapiens
ctaaataaattatttgtta

SEQ ID NO: 3617005 - DNA, 15 bp, Homo sapiens
ctaaatattgtttac

SEQ ID NO: 3617006 - DNA, 22 bp, Homo sapiens
ctaaattcccaaatcctagact

SEQ ID NO: 3617007 - DNA, 12 bp, Homo sapiens
ctaaattgcagt

SEQ ID NO: 3617008 - DNA, 15 bp, Homo sapiens
ctaaattgcagttta

SEQ ID NO: 3617009 - DNA, 16 bp, Homo sapiens
ctaaatttaatgctgc

SEQ ID NO: 3617010 - DNA, 18 bp, Homo sapiens
ctaaatttaatgctgcct

SEQ ID NO: 3617011 - DNA, 13 bp, Homo sapiens
ctaaattttctga

SEQ ID NO: 3617012 - DNA, 16 bp, Homo sapiens
ctaaattttctgaaac

SEQ ID NO: 3617013 - DNA, 20 bp, Homo sapiens
ctaacaacattgtagcctca

SEQ ID NO: 3617014 - DNA, 15 bp, Homo sapiens
ctaacaccagacaga

SEQ ID NO: 3617015 - DNA, 13 bp, Homo sapiens
ctaacccagtctt

SEQ ID NO: 3617016 - DNA, 12 bp, Homo sapiens
ctaacctgggac

SEQ ID NO: 3617017 - DNA, 15 bp, Homo sapiens
ctaacctgggacctg

SEQ ID NO: 3617018 - DNA, 20 bp, Homo sapiens
ctaacgaaatatcaaagtca

SEQ ID NO: 3617019 - DNA, 14 bp, Homo sapiens
ctaactctgagagc

SEQ ID NO: 3617020 - DNA, 14 bp, Homo sapiens
ctaactggactggt

SEQ ID NO: 3617021 - DNA, 23 bp, Homo sapiens
ctaactgggttaaatattttgct

SEQ ID NO: 3617022 - DNA, 21 bp, Homo sapiens
ctaacttacaaagattctcta

SEQ ID NO: 3617023 - DNA, 21 bp, Homo sapiens
ctaacttcctgtgcctttcct

SEQ ID NO: 3617024 - DNA, 23 bp, Homo sapiens
ctaacttcctgtgcctttcctat

SEQ ID NO: 3617025 - DNA, 14 bp, Homo sapiens
ctaagaacctggaa

SEQ ID NO: 3617026 - DNA, 16 bp, Homo sapiens
ctaagaacctggaact

SEQ ID NO: 3617027 - DNA, 18 bp, Homo sapiens
ctaagaataaacatttgt

SEQ ID NO: 3617028 - DNA, 21 bp, Homo sapiens
ctaagagacacatacagagtg

SEQ ID NO: 3617029 - DNA, 23 bp, Homo sapiens
ctaagattacaaatcagaagtca

SEQ ID NO: 3617030 - DNA, 16 bp, Homo sapiens
ctaagcagaggagggg

SEQ ID NO: 3617031 - DNA, 12 bp, Homo sapiens
ctaagcccccag

SEQ ID NO: 3617032 - DNA, 18 bp, Homo sapiens
ctaagcccccagggcctc

SEQ ID NO: 3617033 - DNA, 20 bp, Homo sapiens
ctaagcccccagggcctcca

SEQ ID NO: 3617034 - DNA, 17 bp, Homo sapiens
ctaagctaggaatgaaa

SEQ ID NO: 3617035 - DNA, 20 bp, Homo sapiens
ctaaggatttttcaagagat

SEQ ID NO: 3617036 - DNA, 23 bp, Homo sapiens
ctaaggccatggcatcccttttt

SEQ ID NO: 3617037 - DNA, 12 bp, Homo sapiens
ctaaggggcccg

SEQ ID NO: 3617038 - DNA, 13 bp, Homo sapiens
ctaaggggcccgg

SEQ ID NO: 3617039 - DNA, 18 bp, Homo sapiens
ctaaggggcccggccagc

SEQ ID NO: 3617040 - DNA, 22 bp, Homo sapiens
ctaaggggcccggccagccatg

SEQ ID NO: 3617041 - DNA, 23 bp, Homo sapiens
ctaaggggcttgtgttctgctcc

SEQ ID NO: 3617042 - DNA, 22 bp, Homo sapiens
ctaaggttgtctacgggggcac

SEQ ID NO: 3617043 - DNA, 14 bp, Homo sapiens
ctaagtaaaaccac

SEQ ID NO: 3617044 - DNA, 19 bp, Homo sapiens
ctaagtaaaaccacagcag

SEQ ID NO: 3617045 - DNA, 20 bp, Homo sapiens
ctaagtaaaaccacagcagt

SEQ ID NO: 3617046 - DNA, 22 bp, Homo sapiens
ctaagtagaataaagaaaaacg

SEQ ID NO: 3617047 - DNA, 16 bp, Homo sapiens
ctaagtatttaaatgt

SEQ ID NO: 3617048 - DNA, 17 bp, Homo sapiens
ctaagtatttaaatgtt

SEQ ID NO: 3617049 - DNA, 16 bp, Homo sapiens
ctaagtgatataaatc

SEQ ID NO: 3617050 - DNA, 15 bp, Homo sapiens
ctaagtgctgctgtg

SEQ ID NO: 3617051 - DNA, 19 bp, Homo sapiens
ctaagtgctgctgtggagt

SEQ ID NO: 3617052 - DNA, 16 bp, Homo sapiens
ctaagttattttatga

SEQ ID NO: 3617053 - DNA, 14 bp, Homo sapiens
ctaataaacactgt

SEQ ID NO: 3617054 - DNA, 16 bp, Homo sapiens
ctaataaacactgttt

SEQ ID NO: 3617055 - DNA, 16 bp, Homo sapiens
ctaatagtttttcact

SEQ ID NO: 3617056 - DNA, 13 bp, Homo sapiens
ctaatcaaaactt

SEQ ID NO: 3617057 - DNA, 20 bp, Homo sapiens
ctaatcaaaactttcgttgt

SEQ ID NO: 3617058 - DNA, 21 bp, Homo sapiens
ctaatcaaattctgtctgggg

SEQ ID NO: 3617059 - DNA, 17 bp, Homo sapiens
ctaatccaggcagatcc

SEQ ID NO: 3617060 - DNA, 22 bp, Homo sapiens
ctaatccttttccttatttgcc

SEQ ID NO: 3617061 - DNA, 19 bp, Homo sapiens
ctaatctgtgctgtttcaa

SEQ ID NO: 3617062 - DNA, 21 bp, Homo sapiens
ctaatctgtgctgtttcaaag

SEQ ID NO: 3617063 - DNA, 16 bp, Homo sapiens
ctaatgtaaaatgatt

SEQ ID NO: 3617064 - DNA, 17 bp, Homo sapiens
ctaatgtcacaattatg

SEQ ID NO: 3617065 - DNA, 16 bp, Homo sapiens
ctaatgtctgcagctc

SEQ ID NO: 3617066 - DNA, 22 bp, Homo sapiens
ctaatgtgagtgtgaagctttg

SEQ ID NO: 3617067 - DNA, 11 bp, Homo sapiens
ctaatgtgttt

SEQ ID NO: 3617068 - DNA, 14 bp, Homo sapiens
ctaattatttaatt

SEQ ID NO: 3617069 - DNA, 18 bp, Homo sapiens
ctaattatttaattgtcc

SEQ ID NO: 3617070 - DNA, 16 bp, Homo sapiens
ctaattcaaggaattt

SEQ ID NO: 3617071 - DNA, 18 bp, Homo sapiens
ctaattcaaggaatttct

SEQ ID NO: 3617072 - DNA, 15 bp, Homo sapiens
ctaattctatgcctg

SEQ ID NO: 3617073 - DNA, 19 bp, Homo sapiens
ctaattggaaggagagggg

SEQ ID NO: 3617074 - DNA, 22 bp, Homo sapiens
ctaatttatcttcatgtccagt

SEQ ID NO: 3617075 - DNA, 14 bp, Homo sapiens
ctacacatttttaa

SEQ ID NO: 3617076 - DNA, 19 bp, Homo sapiens
ctacacatttttaaattgt

SEQ ID NO: 3617077 - DNA, 20 bp, Homo sapiens
ctacacctttctcctttgta

SEQ ID NO: 3617078 - DNA, 20 bp, Homo sapiens
ctacagaaaccacagtcttc

SEQ ID NO: 3617079 - DNA, 15 bp, Homo sapiens
ctacagacagcttac

SEQ ID NO: 3617080 - DNA, 22 bp, Homo sapiens
ctacagacagcttacaggagcc

SEQ ID NO: 3617081 - DNA, 16 bp, Homo sapiens
ctacagactccatctc

SEQ ID NO: 3617082 - DNA, 19 bp, Homo sapiens
ctacagactccatctcttc

SEQ ID NO: 3617083 - DNA, 20 bp, Homo sapiens
ctacagactccatctcttct

SEQ ID NO: 3617084 - DNA, 23 bp, Homo sapiens
ctacagactccatctcttctgca

SEQ ID NO: 3617085 - DNA, 19 bp, Homo sapiens
ctacagctaatcagcattc

SEQ ID NO: 3617086 - DNA, 17 bp, Homo sapiens
ctacagtgactccctgg

SEQ ID NO: 3617087 - DNA, 18 bp, Homo sapiens
ctacagtgactccctggg

SEQ ID NO: 3617088 - DNA, 18 bp, Homo sapiens
ctacatactatggaattt

SEQ ID NO: 3617089 - DNA, 19 bp, Homo sapiens
ctacatgatgctaaaggct

SEQ ID NO: 3617090 - DNA, 21 bp, Homo sapiens
ctacatgtattgcacattgta

SEQ ID NO: 3617091 - DNA, 22 bp, Homo sapiens
ctacatgtattgcacattgtaa

SEQ ID NO: 3617092 - DNA, 17 bp, Homo sapiens
ctacatgttctttgtac

SEQ ID NO: 3617093 - DNA, 15 bp, Homo sapiens
ctaccaaaagacatt

SEQ ID NO: 3617094 - DNA, 22 bp, Homo sapiens
ctaccaaaagacattagagaaa

SEQ ID NO: 3617095 - DNA, 16 bp, Homo sapiens
ctaccaagctgtcaca

SEQ ID NO: 3617096 - DNA, 13 bp, Homo sapiens
ctaccagccagcc

SEQ ID NO: 3617097 - DNA, 17 bp, Homo sapiens
ctaccagccagcctcag

SEQ ID NO: 3617098 - DNA, 22 bp, Homo sapiens
ctaccagccagcctcagaaggc

SEQ ID NO: 3617099 - DNA, 22 bp, Homo sapiens
ctaccagggtctctcagggatg

SEQ ID NO: 3617100 - DNA, 20 bp, Homo sapiens
ctaccagtatttagaagcca

SEQ ID NO: 3617101 - DNA, 13 bp, Homo sapiens
ctaccatttcaga

SEQ ID NO: 3617102 - DNA, 14 bp, Homo sapiens
ctacccaaccctgc

SEQ ID NO: 3617103 - DNA, 20 bp, Homo sapiens
ctacccaaccctgccctgcc

SEQ ID NO: 3617104 - DNA, 12 bp, Homo sapiens
ctacccagctct

SEQ ID NO: 3617105 - DNA, 13 bp, Homo sapiens
ctacccagctctg

SEQ ID NO: 3617106 - DNA, 20 bp, Homo sapiens
ctacccagctctgtcctctt

SEQ ID NO: 3617107 - DNA, 19 bp, Homo sapiens
ctaccccagccaggctcct

SEQ ID NO: 3617108 - DNA, 18 bp, Homo sapiens
ctacccctcaaactgcac

SEQ ID NO: 3617109 - DNA, 19 bp, Homo sapiens
ctaccctggcagggacctg

SEQ ID NO: 3617110 - DNA, 20 bp, Homo sapiens
ctacccttggaaagaaatgt

SEQ ID NO: 3617111 - DNA, 15 bp, Homo sapiens
ctaccgctggccctg

SEQ ID NO: 3617112 - DNA, 16 bp, Homo sapiens
ctacctcagcctcctg

SEQ ID NO: 3617113 - DNA, 14 bp, Homo sapiens
ctacctctgtctga

SEQ ID NO: 3617114 - DNA, 12 bp, Homo sapiens
ctacctctgtgc

SEQ ID NO: 3617115 - DNA, 14 bp, Homo sapiens
ctacctctgtgcct

SEQ ID NO: 3617116 - DNA, 17 bp, Homo sapiens
ctacctctgtgccttgc

SEQ ID NO: 3617117 - DNA, 16 bp, Homo sapiens
ctacctgtcctccgtg

SEQ ID NO: 3617118 - DNA, 20 bp, Homo sapiens
ctacctgtctgctgccagca

SEQ ID NO: 3617119 - DNA, 23 bp, Homo sapiens
ctacctttatatttggggtcctt

SEQ ID NO: 3617120 - DNA, 17 bp, Homo sapiens
ctactacctgtaatgac

SEQ ID NO: 3617121 - DNA, 14 bp, Homo sapiens
ctactatgatcaga

SEQ ID NO: 3617122 - DNA, 23 bp, Homo sapiens
ctactcaggaggctgaggcagga

SEQ ID NO: 3617123 - DNA, 11 bp, Homo sapiens
ctactcctgcc

SEQ ID NO: 3617124 - DNA, 14 bp, Homo sapiens
ctactcctgcctca

SEQ ID NO: 3617125 - DNA, 13 bp, Homo sapiens
ctactctcttcct

SEQ ID NO: 3617126 - DNA, 16 bp, Homo sapiens
ctactctcttcctcca

SEQ ID NO: 3617127 - DNA, 22 bp, Homo sapiens
ctactctggaggtttgtttaga

SEQ ID NO: 3617128 - DNA, 12 bp, Homo sapiens
ctactctttgat

SEQ ID NO: 3617129 - DNA, 15 bp, Homo sapiens
ctactgcagtcttta

SEQ ID NO: 3617130 - DNA, 17 bp, Homo sapiens
ctactgcagtctttatt

SEQ ID NO: 3617131 - DNA, 18 bp, Homo sapiens
ctactgcagtctttattt

SEQ ID NO: 3617132 - DNA, 19 bp, Homo sapiens
ctactggttacctggagaa

SEQ ID NO: 3617133 - DNA, 15 bp, Homo sapiens
ctacttaaaaaaaat

SEQ ID NO: 3617134 - DNA, 17 bp, Homo sapiens
ctacttagcatgtccct

SEQ ID NO: 3617135 - DNA, 14 bp, Homo sapiens
ctactttataacta

SEQ ID NO: 3617136 - DNA, 13 bp, Homo sapiens
ctacttttctaaa

SEQ ID NO: 3617137 - DNA, 16 bp, Homo sapiens
ctagaaaacatttttt

SEQ ID NO: 3617138 - DNA, 22 bp, Homo sapiens
ctagaaaatgagaaaattgtct

SEQ ID NO: 3617139 - DNA, 21 bp, Homo sapiens
ctagaacacaggcaaaatcct

SEQ ID NO: 3617140 - DNA, 19 bp, Homo sapiens
ctagaacattccatttgct

SEQ ID NO: 3617141 - DNA, 23 bp, Homo sapiens
ctagaactcctgtcttctttctc

SEQ ID NO: 3617142 - DNA, 18 bp, Homo sapiens
ctagaagattagaaacta

SEQ ID NO: 3617143 - DNA, 12 bp, Homo sapiens
ctagaatggata

SEQ ID NO: 3617144 - DNA, 13 bp, Homo sapiens
ctagacactgcca

SEQ ID NO: 3617145 - DNA, 12 bp, Homo sapiens
ctagagagggag

SEQ ID NO: 3617146 - DNA, 21 bp, Homo sapiens
ctagagagggaggcaagccct

SEQ ID NO: 3617147 - DNA, 22 bp, Homo sapiens
ctagagagggaggcaagccctg

SEQ ID NO: 3617148 - DNA, 23 bp, Homo sapiens
ctagagagggaggcaagccctgt

SEQ ID NO: 3617149 - DNA, 17 bp, Homo sapiens
ctagagctccagttctt

SEQ ID NO: 3617150 - DNA, 15 bp, Homo sapiens
ctagaggagggggca

SEQ ID NO: 3617151 - DNA, 16 bp, Homo sapiens
ctagaggagggggcag

SEQ ID NO: 3617152 - DNA, 22 bp, Homo sapiens
ctagaggagggggcaggctgag

SEQ ID NO: 3617153 - DNA, 16 bp, Homo sapiens
ctagagggaggggcct

SEQ ID NO: 3617154 - DNA, 19 bp, Homo sapiens
ctagagggaggggcctagg

SEQ ID NO: 3617155 - DNA, 13 bp, Homo sapiens
ctagagtgtagcc

SEQ ID NO: 3617156 - DNA, 15 bp, Homo sapiens
ctagagtgtagccta

SEQ ID NO: 3617157 - DNA, 16 bp, Homo sapiens
ctagagtgtagcctaa

SEQ ID NO: 3617158 - DNA, 20 bp, Homo sapiens
ctagatccagcccaaacctg

SEQ ID NO: 3617159 - DNA, 23 bp, Homo sapiens
ctagatgtagtattttttgtata

SEQ ID NO: 3617160 - DNA, 21 bp, Homo sapiens
ctagcaaccgcctcaaaatgt

SEQ ID NO: 3617161 - DNA, 19 bp, Homo sapiens
ctagcatttcccaacacaa

SEQ ID NO: 3617162 - DNA, 16 bp, Homo sapiens
ctagccagcattccat

SEQ ID NO: 3617163 - DNA, 13 bp, Homo sapiens
ctagcccaaccta

SEQ ID NO: 3617164 - DNA, 13 bp, Homo sapiens
ctagccctgctcc

SEQ ID NO: 3617165 - DNA, 11 bp, Homo sapiens
ctagccctggt

SEQ ID NO: 3617166 - DNA, 21 bp, Homo sapiens
ctagcctctggactggaaagc

SEQ ID NO: 3617167 - DNA, 22 bp, Homo sapiens
ctagcctgtgcctctgggactg

SEQ ID NO: 3617168 - DNA, 22 bp, Homo sapiens
ctagccttaatcaggtcctcag

SEQ ID NO: 3617169 - DNA, 22 bp, Homo sapiens
ctagcggagcccagcctgggag

SEQ ID NO: 3617170 - DNA, 13 bp, Homo sapiens
ctagctgaccccg

SEQ ID NO: 3617171 - DNA, 22 bp, Homo sapiens
ctagctgaccccgagaagtgct

SEQ ID NO: 3617172 - DNA, 18 bp, Homo sapiens
ctagctgggggtgggcca

SEQ ID NO: 3617173 - DNA, 12 bp, Homo sapiens
ctagctgtgctg

SEQ ID NO: 3617174 - DNA, 15 bp, Homo sapiens
ctaggaaccctggag

SEQ ID NO: 3617175 - DNA, 19 bp, Homo sapiens
ctaggagatgttgggaaca

SEQ ID NO: 3617176 - DNA, 17 bp, Homo sapiens
ctaggagcaggcttgtg

SEQ ID NO: 3617177 - DNA, 21 bp, Homo sapiens
ctaggagcaggcttgtggcag

SEQ ID NO: 3617178 - DNA, 17 bp, Homo sapiens
ctaggataacttgcttt

SEQ ID NO: 3617179 - DNA, 16 bp, Homo sapiens
ctaggccccagaggcc

SEQ ID NO: 3617180 - DNA, 18 bp, Homo sapiens
ctaggccccagaggccct

SEQ ID NO: 3617181 - DNA, 20 bp, Homo sapiens
ctaggccccagaggccctgg

SEQ ID NO: 3617182 - DNA, 15 bp, Homo sapiens
ctaggccctgtgagc

SEQ ID NO: 3617183 - DNA, 16 bp, Homo sapiens
ctaggccctgtgagca

SEQ ID NO: 3617184 - DNA, 19 bp, Homo sapiens
ctaggcctccgttgtctgg

SEQ ID NO: 3617185 - DNA, 13 bp, Homo sapiens
ctaggctccaccc

SEQ ID NO: 3617186 - DNA, 22 bp, Homo sapiens
ctagggacatgaaatttacaaa

SEQ ID NO: 3617187 - DNA, 13 bp, Homo sapiens
ctaggtgcagctc

SEQ ID NO: 3617188 - DNA, 18 bp, Homo sapiens
ctaggtgcagctcctcag

SEQ ID NO: 3617189 - DNA, 16 bp, Homo sapiens
ctagtacctgtgactc

SEQ ID NO: 3617190 - DNA, 21 bp, Homo sapiens
ctagtagaagaagctttgccg

SEQ ID NO: 3617191 - DNA, 18 bp, Homo sapiens
ctagtaggaatgtacatg

SEQ ID NO: 3617192 - DNA, 21 bp, Homo sapiens
ctagtagtgtggcctgtgcca

SEQ ID NO: 3617193 - DNA, 15 bp, Homo sapiens
ctagtggaaagtcag

SEQ ID NO: 3617194 - DNA, 21 bp, Homo sapiens
ctagtggagttttataaatta

SEQ ID NO: 3617195 - DNA, 20 bp, Homo sapiens
ctagtgtccataaataaagt

SEQ ID NO: 3617196 - DNA, 12 bp, Homo sapiens
ctagtgtgactc

SEQ ID NO: 3617197 - DNA, 13 bp, Homo sapiens
ctagtgtgactcc

SEQ ID NO: 3617198 - DNA, 13 bp, Homo sapiens
ctagtgttgtatt

SEQ ID NO: 3617199 - DNA, 19 bp, Homo sapiens
ctagtgttgtatttctata

SEQ ID NO: 3617200 - DNA, 22 bp, Homo sapiens
ctagttccagaaaacctctcct

SEQ ID NO: 3617201 - DNA, 16 bp, Homo sapiens
ctagttctttcctccc

SEQ ID NO: 3617202 - DNA, 22 bp, Homo sapiens
ctagttctttcctccccctgca

SEQ ID NO: 3617203 - DNA, 20 bp, Homo sapiens
ctagttgcccccattcccag

SEQ ID NO: 3617204 - DNA, 21 bp, Homo sapiens
ctagttgcccccattcccagc

SEQ ID NO: 3617205 - DNA, 13 bp, Homo sapiens
ctagttgtcaata

SEQ ID NO: 3617206 - DNA, 20 bp, Homo sapiens
ctagttgtccagagataaaa

SEQ ID NO: 3617207 - DNA, 17 bp, Homo sapiens
ctagttgtttgggcttt

SEQ ID NO: 3617208 - DNA, 17 bp, Homo sapiens
ctagttttctcctccca

SEQ ID NO: 3617209 - DNA, 20 bp, Homo sapiens
ctagttttctcctcccagga

SEQ ID NO: 3617210 - DNA, 18 bp, Homo sapiens
ctataaatagtattccaa

SEQ ID NO: 3617211 - DNA, 23 bp, Homo sapiens
ctataaattcctctttgctttgc

SEQ ID NO: 3617212 - DNA, 16 bp, Homo sapiens
ctataaattttttgaa

SEQ ID NO: 3617213 - DNA, 17 bp, Homo sapiens
ctataaattttttgaaa

SEQ ID NO: 3617214 - DNA, 13 bp, Homo sapiens
ctatactgtggcc

SEQ ID NO: 3617215 - DNA, 10 bp, Homo sapiens
ctatagcacc

SEQ ID NO: 3617216 - DNA, 12 bp, Homo sapiens
ctatagcctggg

SEQ ID NO: 3617217 - DNA, 17 bp, Homo sapiens
ctatagctaagtacaca

SEQ ID NO: 3617218 - DNA, 15 bp, Homo sapiens
ctataggtgctacaa

SEQ ID NO: 3617219 - DNA, 20 bp, Homo sapiens
ctataggtgctacaaaaaca

SEQ ID NO: 3617220 - DNA, 13 bp, Homo sapiens
ctatataaaatgt

SEQ ID NO: 3617221 - DNA, 18 bp, Homo sapiens
ctatataaaatgtattca

SEQ ID NO: 3617222 - DNA, 16 bp, Homo sapiens
ctatatgcagtccttt

SEQ ID NO: 3617223 - DNA, 20 bp, Homo sapiens
ctatatgtgaaacatttttt

SEQ ID NO: 3617224 - DNA, 19 bp, Homo sapiens
ctatcacctagcagcctca

SEQ ID NO: 3617225 - DNA, 14 bp, Homo sapiens
ctatcagaaataca

SEQ ID NO: 3617226 - DNA, 18 bp, Homo sapiens
ctatcagaaatacaaaaa

SEQ ID NO: 3617227 - DNA, 20 bp, Homo sapiens
ctatcagaaatacaaaaaat

SEQ ID NO: 3617228 - DNA, 23 bp, Homo sapiens
ctatcagcaatgccccaaacttt

SEQ ID NO: 3617229 - DNA, 18 bp, Homo sapiens
ctatccttataggcctgt

SEQ ID NO: 3617230 - DNA, 22 bp, Homo sapiens
ctatccttataggcctgtccct

SEQ ID NO: 3617231 - DNA, 12 bp, Homo sapiens
ctatccttggct

SEQ ID NO: 3617232 - DNA, 22 bp, Homo sapiens
ctatcgaaatgacggtgttaat

SEQ ID NO: 3617233 - DNA, 15 bp, Homo sapiens
ctatctcagccatag

SEQ ID NO: 3617234 - DNA, 16 bp, Homo sapiens
ctatctcatctgtctc

SEQ ID NO: 3617235 - DNA, 12 bp, Homo sapiens
ctatctccctgg

SEQ ID NO: 3617236 - DNA, 17 bp, Homo sapiens
ctatctgacttcataca

SEQ ID NO: 3617237 - DNA, 14 bp, Homo sapiens
ctatctttgctgca

SEQ ID NO: 3617238 - DNA, 19 bp, Homo sapiens
ctatgaaacaatcttccaa

SEQ ID NO: 3617239 - DNA, 21 bp, Homo sapiens
ctatgaaacaatcttccaaag

SEQ ID NO: 3617240 - DNA, 22 bp, Homo sapiens
ctatgaacagaaactacatttc

SEQ ID NO: 3617241 - DNA, 18 bp, Homo sapiens
ctatgagatggccatgct

SEQ ID NO: 3617242 - DNA, 19 bp, Homo sapiens
ctatgagatggccatgctc

SEQ ID NO: 3617243 - DNA, 13 bp, Homo sapiens
ctatgatactgtc

SEQ ID NO: 3617244 - DNA, 14 bp, Homo sapiens
ctatgatactgtct

SEQ ID NO: 3617245 - DNA, 22 bp, Homo sapiens
ctatgatactgtctctccagtg

SEQ ID NO: 3617246 - DNA, 18 bp, Homo sapiens
ctatgatggatggcagac

SEQ ID NO: 3617247 - DNA, 21 bp, Homo sapiens
ctatgcatggtgccccaggac

SEQ ID NO: 3617248 - DNA, 22 bp, Homo sapiens
ctatgcatggtgccccaggacc

SEQ ID NO: 3617249 - DNA, 13 bp, Homo sapiens
ctatgctggtaga

SEQ ID NO: 3617250 - DNA, 13 bp, Homo sapiens
ctatgctgtttgt

SEQ ID NO: 3617251 - DNA, 19 bp, Homo sapiens
ctatggagggtcctcctcc

SEQ ID NO: 3617252 - DNA, 20 bp, Homo sapiens
ctatggggatagatgtgtgg

SEQ ID NO: 3617253 - DNA, 20 bp, Homo sapiens
ctatgtagtccgtgctgaca

SEQ ID NO: 3617254 - DNA, 15 bp, Homo sapiens
ctatgtattaattta

SEQ ID NO: 3617255 - DNA, 17 bp, Homo sapiens
ctatgtattaatttaga

SEQ ID NO: 3617256 - DNA, 21 bp, Homo sapiens
ctatgtgacatttctcttccc

SEQ ID NO: 3617257 - DNA, 14 bp, Homo sapiens
ctatgttaatattt

SEQ ID NO: 3617258 - DNA, 13 bp, Homo sapiens
ctattaatcaaga

SEQ ID NO: 3617259 - DNA, 14 bp, Homo sapiens
ctattaatcaagag

SEQ ID NO: 3617260 - DNA, 12 bp, Homo sapiens
ctattacagtgt

SEQ ID NO: 3617261 - DNA, 12 bp, Homo sapiens
ctattatttcct

SEQ ID NO: 3617262 - DNA, 12 bp, Homo sapiens
ctattctccaga

SEQ ID NO: 3617263 - DNA, 13 bp, Homo sapiens
ctattctccagac

SEQ ID NO: 3617264 - DNA, 15 bp, Homo sapiens
ctattctccagacat

SEQ ID NO: 3617265 - DNA, 16 bp, Homo sapiens
ctattctgaaaaagac

SEQ ID NO: 3617266 - DNA, 20 bp, Homo sapiens
ctattctgaaaaagacataa

SEQ ID NO: 3617267 - DNA, 16 bp, Homo sapiens
ctattctgggggcccg

SEQ ID NO: 3617268 - DNA, 12 bp, Homo sapiens
ctattctgtcag

SEQ ID NO: 3617269 - DNA, 19 bp, Homo sapiens
ctattctgtcagtgttaaa

SEQ ID NO: 3617270 - DNA, 15 bp, Homo sapiens
ctattgatacaatat

SEQ ID NO: 3617271 - DNA, 14 bp, Homo sapiens
ctattgatactctt

SEQ ID NO: 3617272 - DNA, 14 bp, Homo sapiens
ctattgcatttata

SEQ ID NO: 3617273 - DNA, 13 bp, Homo sapiens
ctatttaaaaaat

SEQ ID NO: 3617274 - DNA, 13 bp, Homo sapiens
ctatttaaagaaa

SEQ ID NO: 3617275 - DNA, 22 bp, Homo sapiens
ctatttacactattatttccta

SEQ ID NO: 3617276 - DNA, 20 bp, Homo sapiens
ctatttataatgaataaaca

SEQ ID NO: 3617277 - DNA, 13 bp, Homo sapiens
ctatttcagcctc

SEQ ID NO: 3617278 - DNA, 17 bp, Homo sapiens
ctatttcagcctcctgt

SEQ ID NO: 3617279 - DNA, 23 bp, Homo sapiens
ctatttgaccagaactttttcct

SEQ ID NO: 3617280 - DNA, 12 bp, Homo sapiens
ctattttgtaaa

SEQ ID NO: 3617281 - DNA, 13 bp, Homo sapiens
ctatttttataca

SEQ ID NO: 3617282 - DNA, 14 bp, Homo sapiens
ctatttttccttta

SEQ ID NO: 3617283 - DNA, 15 bp, Homo sapiens
ctatttttcctttaa

SEQ ID NO: 3617284 - DNA, 23 bp, Homo sapiens
ctcaaaataccatgccatttaaa

SEQ ID NO: 3617285 - DNA, 18 bp, Homo sapiens
ctcaaaattgcttctaaa

SEQ ID NO: 3617286 - DNA, 14 bp, Homo sapiens
ctcaaactcctgac

SEQ ID NO: 3617287 - DNA, 11 bp, Homo sapiens
ctcaaactgca

SEQ ID NO: 3617288 - DNA, 20 bp, Homo sapiens
ctcaaagagaattgtatgta

SEQ ID NO: 3617289 - DNA, 20 bp, Homo sapiens
ctcaaatctgcttcatccaa

SEQ ID NO: 3617290 - DNA, 20 bp, Homo sapiens
ctcaaatgctggcaaatcca

SEQ ID NO: 3617291 - DNA, 17 bp, Homo sapiens
ctcaacccccctcccag

SEQ ID NO: 3617292 - DNA, 21 bp, Homo sapiens
ctcaacccccctcccagacag

SEQ ID NO: 3617293 - DNA, 15 bp, Homo sapiens
ctcaacctcctgggt

SEQ ID NO: 3617294 - DNA, 19 bp, Homo sapiens
ctcaagagggcactggtgg

SEQ ID NO: 3617295 - DNA, 21 bp, Homo sapiens
ctcaagagggcactggtggcc

SEQ ID NO: 3617296 - DNA, 17 bp, Homo sapiens
ctcaagccccatttcct

SEQ ID NO: 3617297 - DNA, 14 bp, Homo sapiens
ctcaagtaaaagaa

SEQ ID NO: 3617298 - DNA, 15 bp, Homo sapiens
ctcaagtctggcaga

SEQ ID NO: 3617299 - DNA, 21 bp, Homo sapiens
ctcaataaacatttcatttcc

SEQ ID NO: 3617300 - DNA, 16 bp, Homo sapiens
ctcaattgctttgtaa

SEQ ID NO: 3617301 - DNA, 13 bp, Homo sapiens
ctcaatttcagca

SEQ ID NO: 3617302 - DNA, 17 bp, Homo sapiens
ctcacaaggcccaggag

SEQ ID NO: 3617303 - DNA, 17 bp, Homo sapiens
ctcacaatccttgccac

SEQ ID NO: 3617304 - DNA, 20 bp, Homo sapiens
ctcacacccctgtcccaccc

SEQ ID NO: 3617305 - DNA, 13 bp, Homo sapiens
ctcacactgcaag

SEQ ID NO: 3617306 - DNA, 14 bp, Homo sapiens
ctcacaggctgaga

SEQ ID NO: 3617307 - DNA, 21 bp, Homo sapiens
ctcacataagcccagttcatc

SEQ ID NO: 3617308 - DNA, 16 bp, Homo sapiens
ctcacatggtttacat

SEQ ID NO: 3617309 - DNA, 20 bp, Homo sapiens
ctcaccactaccagccagcc

SEQ ID NO: 3617310 - DNA, 19 bp, Homo sapiens
ctcaccatgatgtgaagag

SEQ ID NO: 3617311 - DNA, 16 bp, Homo sapiens
ctcacccacctctggg

SEQ ID NO: 3617312 - DNA, 17 bp, Homo sapiens
ctcacccatcctagagg

SEQ ID NO: 3617313 - DNA, 16 bp, Homo sapiens
ctcacccctagccctg

SEQ ID NO: 3617314 - DNA, 18 bp, Homo sapiens
ctcacccctagccctggt

SEQ ID NO: 3617315 - DNA, 23 bp, Homo sapiens
ctcaccctgggagccagtcctcc

SEQ ID NO: 3617316 - DNA, 20 bp, Homo sapiens
ctcacctggtcgccaatcca

SEQ ID NO: 3617317 - DNA, 16 bp, Homo sapiens
ctcaccttggcaccag

SEQ ID NO: 3617318 - DNA, 13 bp, Homo sapiens
ctcacgtaatgca

SEQ ID NO: 3617319 - DNA, 22 bp, Homo sapiens
ctcacgtaatgcattgcctgta

SEQ ID NO: 3617320 - DNA, 13 bp, Homo sapiens
ctcactccccagg

SEQ ID NO: 3617321 - DNA, 14 bp, Homo sapiens
ctcactccccaggg

SEQ ID NO: 3617322 - DNA, 15 bp, Homo sapiens
ctcactccccaggga

SEQ ID NO: 3617323 - DNA, 16 bp, Homo sapiens
ctcactccccagggag

SEQ ID NO: 3617324 - DNA, 19 bp, Homo sapiens
ctcactccccagggagctc

SEQ ID NO: 3617325 - DNA, 14 bp, Homo sapiens
ctcactctgtccct

SEQ ID NO: 3617326 - DNA, 13 bp, Homo sapiens
ctcactgaactcc

SEQ ID NO: 3617327 - DNA, 14 bp, Homo sapiens
ctcactgaactcca

SEQ ID NO: 3617328 - DNA, 10 bp, Homo sapiens
ctcactgcca

SEQ ID NO: 3617329 - DNA, 12 bp, Homo sapiens
ctcactggcagg

SEQ ID NO: 3617330 - DNA, 18 bp, Homo sapiens
ctcactgggaagctccca

SEQ ID NO: 3617331 - DNA, 20 bp, Homo sapiens
ctcactgggaagctcccacc

SEQ ID NO: 3617332 - DNA, 15 bp, Homo sapiens
ctcacttagtccttt

SEQ ID NO: 3617333 - DNA, 14 bp, Homo sapiens
ctcacttattatta

SEQ ID NO: 3617334 - DNA, 17 bp, Homo sapiens
ctcagaaaattccctgg

SEQ ID NO: 3617335 - DNA, 17 bp, Homo sapiens
ctcagaaccaaatcttt

SEQ ID NO: 3617336 - DNA, 16 bp, Homo sapiens
ctcagaagtctttcag

SEQ ID NO: 3617337 - DNA, 13 bp, Homo sapiens
ctcagacattggc

SEQ ID NO: 3617338 - DNA, 14 bp, Homo sapiens
ctcagaccagctct

SEQ ID NO: 3617339 - DNA, 18 bp, Homo sapiens
ctcagaccccctcagcct

SEQ ID NO: 3617340 - DNA, 19 bp, Homo sapiens
ctcagaccccctcagcctt

SEQ ID NO: 3617341 - DNA, 20 bp, Homo sapiens
ctcagaccccctcagccttg

SEQ ID NO: 3617342 - DNA, 22 bp, Homo sapiens
ctcagactgggcactggggcct

SEQ ID NO: 3617343 - DNA, 19 bp, Homo sapiens
ctcagagaggtagcactct

SEQ ID NO: 3617344 - DNA, 14 bp, Homo sapiens
ctcagaggcctgct

SEQ ID NO: 3617345 - DNA, 15 bp, Homo sapiens
ctcagaggcctgctg

SEQ ID NO: 3617346 - DNA, 14 bp, Homo sapiens
ctcagatccaggga

SEQ ID NO: 3617347 - DNA, 17 bp, Homo sapiens
ctcagatccagggacag

SEQ ID NO: 3617348 - DNA, 22 bp, Homo sapiens
ctcagatccagggacagaggcc

SEQ ID NO: 3617349 - DNA, 12 bp, Homo sapiens
ctcagattcttc

SEQ ID NO: 3617350 - DNA, 16 bp, Homo sapiens
ctcagattcttcattg

SEQ ID NO: 3617351 - DNA, 16 bp, Homo sapiens
ctcagcacccctccag

SEQ ID NO: 3617352 - DNA, 21 bp, Homo sapiens
ctcagcatttccttgtcccgt

SEQ ID NO: 3617353 - DNA, 19 bp, Homo sapiens
ctcagccataggtgcagtt

SEQ ID NO: 3617354 - DNA, 21 bp, Homo sapiens
ctcagcccacatagtgatggt

SEQ ID NO: 3617355 - DNA, 16 bp, Homo sapiens
ctcagccccaactctt

SEQ ID NO: 3617356 - DNA, 17 bp, Homo sapiens
ctcagccccaactcttt

SEQ ID NO: 3617357 - DNA, 20 bp, Homo sapiens
ctcagccccaactctttatc

SEQ ID NO: 3617358 - DNA, 14 bp, Homo sapiens
ctcagccctccctg

SEQ ID NO: 3617359 - DNA, 15 bp, Homo sapiens
ctcagccctggcctg

SEQ ID NO: 3617360 - DNA, 18 bp, Homo sapiens
ctcagcctcctcatctgg

SEQ ID NO: 3617361 - DNA, 16 bp, Homo sapiens
ctcagcctcctgggta

SEQ ID NO: 3617362 - DNA, 20 bp, Homo sapiens
ctcagcctgctttcctgcag

SEQ ID NO: 3617363 - DNA, 21 bp, Homo sapiens
ctcagccttgccagagatcca

SEQ ID NO: 3617364 - DNA, 22 bp, Homo sapiens
ctcagccttgccagagatccaa

SEQ ID NO: 3617365 - DNA, 19 bp, Homo sapiens
ctcagctcccaaggctctg

SEQ ID NO: 3617366 - DNA, 20 bp, Homo sapiens
ctcagctcttggctccactg

SEQ ID NO: 3617367 - DNA, 12 bp, Homo sapiens
ctcagctgcctc

SEQ ID NO: 3617368 - DNA, 13 bp, Homo sapiens
ctcagctgtgcct

SEQ ID NO: 3617369 - DNA, 18 bp, Homo sapiens
ctcaggaattcagtgcct

SEQ ID NO: 3617370 - DNA, 19 bp, Homo sapiens
ctcaggaattcagtgcctt

SEQ ID NO: 3617371 - DNA, 18 bp, Homo sapiens
ctcaggacagatgccaca

SEQ ID NO: 3617372 - DNA, 19 bp, Homo sapiens
ctcaggagatggagggctt

SEQ ID NO: 3617373 - DNA, 21 bp, Homo sapiens
ctcaggagccgaagcccaggg

SEQ ID NO: 3617374 - DNA, 16 bp, Homo sapiens
ctcaggagcctctgct

SEQ ID NO: 3617375 - DNA, 16 bp, Homo sapiens
ctcaggatccagtgac

SEQ ID NO: 3617376 - DNA, 13 bp, Homo sapiens
ctcaggcacacct

SEQ ID NO: 3617377 - DNA, 18 bp, Homo sapiens
ctcaggcacaccttgcag

SEQ ID NO: 3617378 - DNA, 19 bp, Homo sapiens
ctcaggcacaccttgcaga

SEQ ID NO: 3617379 - DNA, 16 bp, Homo sapiens
ctcaggccaagggacc

SEQ ID NO: 3617380 - DNA, 19 bp, Homo sapiens
ctcaggccaagggaccagg

SEQ ID NO: 3617381 - DNA, 14 bp, Homo sapiens
ctcaggccaccctc

SEQ ID NO: 3617382 - DNA, 18 bp, Homo sapiens
ctcaggccaccctccacg

SEQ ID NO: 3617383 - DNA, 10 bp, Homo sapiens
ctcaggctcc

SEQ ID NO: 3617384 - DNA, 22 bp, Homo sapiens
ctcaggctccgggcaccagggg

SEQ ID NO: 3617385 - DNA, 20 bp, Homo sapiens
ctcaggctcctaaagagaca

SEQ ID NO: 3617386 - DNA, 14 bp, Homo sapiens
ctcaggctctgcac

SEQ ID NO: 3617387 - DNA, 12 bp, Homo sapiens
ctcaggctcttg

SEQ ID NO: 3617388 - DNA, 14 bp, Homo sapiens
ctcaggctgggccc

SEQ ID NO: 3617389 - DNA, 17 bp, Homo sapiens
ctcagggaaaagcagct

SEQ ID NO: 3617390 - DNA, 21 bp, Homo sapiens
ctcagggaccggtgctgcagg

SEQ ID NO: 3617391 - DNA, 14 bp, Homo sapiens
ctcaggggacccca

SEQ ID NO: 3617392 - DNA, 20 bp, Homo sapiens
ctcaggggaccccactcccc

SEQ ID NO: 3617393 - DNA, 18 bp, Homo sapiens
ctcaggtccctgcagggc

SEQ ID NO: 3617394 - DNA, 22 bp, Homo sapiens
ctcaggttgtctgaagtcactg

SEQ ID NO: 3617395 - DNA, 21 bp, Homo sapiens
ctcagtactttggaggcccct

SEQ ID NO: 3617396 - DNA, 23 bp, Homo sapiens
ctcagtactttggaggcccctat

SEQ ID NO: 3617397 - DNA, 14 bp, Homo sapiens
ctcagtgatggaat

SEQ ID NO: 3617398 - DNA, 13 bp, Homo sapiens
ctcagtgcctcca

SEQ ID NO: 3617399 - DNA, 15 bp, Homo sapiens
ctcagtgcctccaca

SEQ ID NO: 3617400 - DNA, 15 bp, Homo sapiens
ctcagtggggctggc

SEQ ID NO: 3617401 - DNA, 17 bp, Homo sapiens
ctcagtggggctggcat

SEQ ID NO: 3617402 - DNA, 19 bp, Homo sapiens
ctcagtggggctggcatca

SEQ ID NO: 3617403 - DNA, 20 bp, Homo sapiens
ctcagtggggctggcatcaa

SEQ ID NO: 3617404 - DNA, 22 bp, Homo sapiens
ctcagttccatggcaattttgt

SEQ ID NO: 3617405 - DNA, 21 bp, Homo sapiens
ctcagttgaaaatgcaactct

SEQ ID NO: 3617406 - DNA, 14 bp, Homo sapiens
ctcataattttgca

SEQ ID NO: 3617407 - DNA, 15 bp, Homo sapiens
ctcataattttgcaa

SEQ ID NO: 3617408 - DNA, 13 bp, Homo sapiens
ctcatataagaca

SEQ ID NO: 3617409 - DNA, 15 bp, Homo sapiens
ctcatcagccttggg

SEQ ID NO: 3617410 - DNA, 17 bp, Homo sapiens
ctcatctctctgcccaa

SEQ ID NO: 3617411 - DNA, 15 bp, Homo sapiens
ctcatctgagaggct

SEQ ID NO: 3617412 - DNA, 18 bp, Homo sapiens
ctcatctgggggagtgga

SEQ ID NO: 3617413 - DNA, 12 bp, Homo sapiens
ctcatctgtctc

SEQ ID NO: 3617414 - DNA, 22 bp, Homo sapiens
ctcatctgtggagctgccacag

SEQ ID NO: 3617415 - DNA, 17 bp, Homo sapiens
ctcatgcacccctgagc

SEQ ID NO: 3617416 - DNA, 20 bp, Homo sapiens
ctcatgctgctcccctaaag

SEQ ID NO: 3617417 - DNA, 19 bp, Homo sapiens
ctcatgggtggcactcagt

SEQ ID NO: 3617418 - DNA, 23 bp, Homo sapiens
ctcatgggtggcactcagtctct

SEQ ID NO: 3617419 - DNA, 16 bp, Homo sapiens
ctcatgttctgctttc

SEQ ID NO: 3617420 - DNA, 17 bp, Homo sapiens
ctcatgttgaaacttta

SEQ ID NO: 3617421 - DNA, 18 bp, Homo sapiens
ctcatgttttcaactgcc

SEQ ID NO: 3617422 - DNA, 18 bp, Homo sapiens
ctcattccaccttcccat

SEQ ID NO: 3617423 - DNA, 15 bp, Homo sapiens
ctcatttccatacca

SEQ ID NO: 3617424 - DNA, 22 bp, Homo sapiens
ctccaaacctccagcctccctg

SEQ ID NO: 3617425 - DNA, 22 bp, Homo sapiens
ctccaaagtattgtacaaataa

SEQ ID NO: 3617426 - DNA, 20 bp, Homo sapiens
ctccaacgcccctgtggcca

SEQ ID NO: 3617427 - DNA, 21 bp, Homo sapiens
ctccaacgcccctgtggccaa

SEQ ID NO: 3617428 - DNA, 15 bp, Homo sapiens
ctccaagcatttcat

SEQ ID NO: 3617429 - DNA, 19 bp, Homo sapiens
ctccaagcatttcatgaaa

SEQ ID NO: 3617430 - DNA, 13 bp, Homo sapiens
ctccaagccagcg

SEQ ID NO: 3617431 - DNA, 18 bp, Homo sapiens
ctccaagctccatctcca

SEQ ID NO: 3617432 - DNA, 16 bp, Homo sapiens
ctccaaggcagggacc

SEQ ID NO: 3617433 - DNA, 20 bp, Homo sapiens
ctccaagggtttcgactggt

SEQ ID NO: 3617434 - DNA, 21 bp, Homo sapiens
ctccaagggtttcgactggtc

SEQ ID NO: 3617435 - DNA, 22 bp, Homo sapiens
ctccaagtgccccaccactccc

SEQ ID NO: 3617436 - DNA, 15 bp, Homo sapiens
ctccacatgctgcct

SEQ ID NO: 3617437 - DNA, 19 bp, Homo sapiens
ctccacatgctgcctggca

SEQ ID NO: 3617438 - DNA, 17 bp, Homo sapiens
ctccaccccacagaacc

SEQ ID NO: 3617439 - DNA, 22 bp, Homo sapiens
ctccaccccccactcagtgcct

SEQ ID NO: 3617440 - DNA, 23 bp, Homo sapiens
ctccaccccccactcagtgcctc

SEQ ID NO: 3617441 - DNA, 17 bp, Homo sapiens
ctccactactctcttcc

SEQ ID NO: 3617442 - DNA, 18 bp, Homo sapiens
ctccactactctcttcct

SEQ ID NO: 3617443 - DNA, 13 bp, Homo sapiens
ctccactccaagt

SEQ ID NO: 3617444 - DNA, 20 bp, Homo sapiens
ctccactcttgatctctctt

SEQ ID NO: 3617445 - DNA, 14 bp, Homo sapiens
ctccactggatgga

SEQ ID NO: 3617446 - DNA, 23 bp, Homo sapiens
ctccactggccggagtcagtgcc

SEQ ID NO: 3617447 - DNA, 19 bp, Homo sapiens
ctccagaaccgcagaagcc

SEQ ID NO: 3617448 - DNA, 20 bp, Homo sapiens
ctccagaaccgcagaagcct

SEQ ID NO: 3617449 - DNA, 18 bp, Homo sapiens
ctccagaagtcccttcaa

SEQ ID NO: 3617450 - DNA, 18 bp, Homo sapiens
ctccagacatggagggga

SEQ ID NO: 3617451 - DNA, 15 bp, Homo sapiens
ctccagacccctggc

SEQ ID NO: 3617452 - DNA, 19 bp, Homo sapiens
ctccagacctgatcctgga

SEQ ID NO: 3617453 - DNA, 13 bp, Homo sapiens
ctccagactcagc

SEQ ID NO: 3617454 - DNA, 17 bp, Homo sapiens
ctccagactcagcagag

SEQ ID NO: 3617455 - DNA, 18 bp, Homo sapiens
ctccagactcagcagagt

SEQ ID NO: 3617456 - DNA, 21 bp, Homo sapiens
ctccagactcagcagagtgag

SEQ ID NO: 3617457 - DNA, 22 bp, Homo sapiens
ctccagactcagcagagtgagg

SEQ ID NO: 3617458 - DNA, 14 bp, Homo sapiens
ctccagaggtcctc

SEQ ID NO: 3617459 - DNA, 22 bp, Homo sapiens
ctccagcaggaaggaccccaca

SEQ ID NO: 3617460 - DNA, 14 bp, Homo sapiens
ctccagcaggccca

SEQ ID NO: 3617461 - DNA, 14 bp, Homo sapiens
ctccagcctcccct

SEQ ID NO: 3617462 - DNA, 16 bp, Homo sapiens
ctccagcctccctgtc

SEQ ID NO: 3617463 - DNA, 24 bp, Homo sapiens
ctccagcctccctgtctccagctg

SEQ ID NO: 3617464 - DNA, 20 bp, Homo sapiens
ctccagctgactaaactttt

SEQ ID NO: 3617465 - DNA, 21 bp, Homo sapiens
ctccagctgcctgggcccgga

SEQ ID NO: 3617466 - DNA, 13 bp, Homo sapiens
ctccagctgggat

SEQ ID NO: 3617467 - DNA, 18 bp, Homo sapiens
ctccaggaaccacaccac

SEQ ID NO: 3617468 - DNA, 15 bp, Homo sapiens
ctccaggagggctcg

SEQ ID NO: 3617469 - DNA, 17 bp, Homo sapiens
ctccaggcctgtcaaga

SEQ ID NO: 3617470 - DNA, 14 bp, Homo sapiens
ctccagggcccagg

SEQ ID NO: 3617471 - DNA, 14 bp, Homo sapiens
ctccaggggcacct

SEQ ID NO: 3617472 - DNA, 19 bp, Homo sapiens
ctccaggggcctgcagaag

SEQ ID NO: 3617473 - DNA, 14 bp, Homo sapiens
ctccaggtcagcct

SEQ ID NO: 3617474 - DNA, 21 bp, Homo sapiens
ctccaggtcggagtgcctgga

SEQ ID NO: 3617475 - DNA, 12 bp, Homo sapiens
ctccaggttttt

SEQ ID NO: 3617476 - DNA, 20 bp, Homo sapiens
ctccaggtttttcaattaaa

SEQ ID NO: 3617477 - DNA, 16 bp, Homo sapiens
ctccagtgtcagggtc

SEQ ID NO: 3617478 - DNA, 15 bp, Homo sapiens
ctccagttctttata

SEQ ID NO: 3617479 - DNA, 16 bp, Homo sapiens
ctccagttttgcctga

SEQ ID NO: 3617480 - DNA, 19 bp, Homo sapiens
ctccatacacacgctgcct

SEQ ID NO: 3617481 - DNA, 16 bp, Homo sapiens
ctccataccttttctc

SEQ ID NO: 3617482 - DNA, 23 bp, Homo sapiens
ctccataccttttctcttttctt

SEQ ID NO: 3617483 - DNA, 16 bp, Homo sapiens
ctccatcccctccctg

SEQ ID NO: 3617484 - DNA, 20 bp, Homo sapiens
ctccatcccctccctgcctg

SEQ ID NO: 3617485 - DNA, 21 bp, Homo sapiens
ctccatcccctccctgcctgc

SEQ ID NO: 3617486 - DNA, 17 bp, Homo sapiens
ctccatctcaaaacaaa

SEQ ID NO: 3617487 - DNA, 20 bp, Homo sapiens
ctccatctcaaaacaaaaca

SEQ ID NO: 3617488 - DNA, 14 bp, Homo sapiens
ctccatctccactc

SEQ ID NO: 3617489 - DNA, 16 bp, Homo sapiens
ctccatctttctacag

SEQ ID NO: 3617490 - DNA, 13 bp, Homo sapiens
ctccatgctgcct

SEQ ID NO: 3617491 - DNA, 14 bp, Homo sapiens
ctccatggagccta

SEQ ID NO: 3617492 - DNA, 17 bp, Homo sapiens
ctccattctattttaga

SEQ ID NO: 3617493 - DNA, 20 bp, Homo sapiens
ctccatttttctcccaagaa

SEQ ID NO: 3617494 - DNA, 18 bp, Homo sapiens
ctcccaaactgacaattt

SEQ ID NO: 3617495 - DNA, 22 bp, Homo sapiens
ctcccaaagtgctgggattaca

SEQ ID NO: 3617496 - DNA, 14 bp, Homo sapiens
ctcccaacttcttc

SEQ ID NO: 3617497 - DNA, 19 bp, Homo sapiens
ctcccaatttcagactccc

SEQ ID NO: 3617498 - DNA, 15 bp, Homo sapiens
ctcccacagcagccc

SEQ ID NO: 3617499 - DNA, 18 bp, Homo sapiens
ctcccacagcagccccag

SEQ ID NO: 3617500 - DNA, 15 bp, Homo sapiens
ctcccacagcttcct

SEQ ID NO: 3617501 - DNA, 14 bp, Homo sapiens
ctcccacaggccct

SEQ ID NO: 3617502 - DNA, 16 bp, Homo sapiens
ctcccacaggcccttc

SEQ ID NO: 3617503 - DNA, 14 bp, Homo sapiens
ctcccaccagagcc

SEQ ID NO: 3617504 - DNA, 14 bp, Homo sapiens
ctcccacccaccgc

SEQ ID NO: 3617505 - DNA, 14 bp, Homo sapiens
ctcccaccccactc

SEQ ID NO: 3617506 - DNA, 23 bp, Homo sapiens
ctcccacctctccttttgaggct

SEQ ID NO: 3617507 - DNA, 21 bp, Homo sapiens
ctcccacgcctcaccagcccc

SEQ ID NO: 3617508 - DNA, 17 bp, Homo sapiens
ctcccactgcccactgg

SEQ ID NO: 3617509 - DNA, 12 bp, Homo sapiens
ctcccagaacct

SEQ ID NO: 3617510 - DNA, 17 bp, Homo sapiens
ctcccagaacctctaag

SEQ ID NO: 3617511 - DNA, 19 bp, Homo sapiens
ctcccagaactattctggg

SEQ ID NO: 3617512 - DNA, 23 bp, Homo sapiens
ctcccagacaggccctccctgtc

SEQ ID NO: 3617513 - DNA, 15 bp, Homo sapiens
ctcccagaggagcca

SEQ ID NO: 3617514 - DNA, 19 bp, Homo sapiens
ctcccagaggagccaccag

SEQ ID NO: 3617515 - DNA, 17 bp, Homo sapiens
ctcccagagtgctggga

SEQ ID NO: 3617516 - DNA, 17 bp, Homo sapiens
ctcccagctctagcctc

SEQ ID NO: 3617517 - DNA, 21 bp, Homo sapiens
ctcccagctctagcctctgga

SEQ ID NO: 3617518 - DNA, 22 bp, Homo sapiens
ctcccaggttcccccagcaagc

SEQ ID NO: 3617519 - DNA, 17 bp, Homo sapiens
ctcccagtcatttaata

SEQ ID NO: 3617520 - DNA, 18 bp, Homo sapiens
ctcccatcctggggcagc

SEQ ID NO: 3617521 - DNA, 12 bp, Homo sapiens
ctccccaaggct

SEQ ID NO: 3617522 - DNA, 22 bp, Homo sapiens
ctccccagagctgtgccagcag

SEQ ID NO: 3617523 - DNA, 11 bp, Homo sapiens
ctccccagcca

SEQ ID NO: 3617524 - DNA, 15 bp, Homo sapiens
ctccccagccagcct

SEQ ID NO: 3617525 - DNA, 17 bp, Homo sapiens
ctccccagccagcctgg

SEQ ID NO: 3617526 - DNA, 20 bp, Homo sapiens
ctccccagccagcctggctg

SEQ ID NO: 3617527 - DNA, 12 bp, Homo sapiens
ctccccagccca

SEQ ID NO: 3617528 - DNA, 13 bp, Homo sapiens
ctccccagcccag

SEQ ID NO: 3617529 - DNA, 15 bp, Homo sapiens
ctccccagcccagag

SEQ ID NO: 3617530 - DNA, 16 bp, Homo sapiens
ctccccagcccagaga

SEQ ID NO: 3617531 - DNA, 14 bp, Homo sapiens
ctccccagcccagc

SEQ ID NO: 3617532 - DNA, 16 bp, Homo sapiens
ctccccagcccagcac

SEQ ID NO: 3617533 - DNA, 18 bp, Homo sapiens
ctccccagcccagcaccc

SEQ ID NO: 3617534 - DNA, 15 bp, Homo sapiens
ctccccagccccagc

SEQ ID NO: 3617535 - DNA, 21 bp, Homo sapiens
ctccccagggagctctgggga

SEQ ID NO: 3617536 - DNA, 22 bp, Homo sapiens
ctccccagggagctctggggac

SEQ ID NO: 3617537 - DNA, 22 bp, Homo sapiens
ctccccagtagctgggattaca

SEQ ID NO: 3617538 - DNA, 19 bp, Homo sapiens
ctcccccaccactcaggcc

SEQ ID NO: 3617539 - DNA, 15 bp, Homo sapiens
ctcccccactccact

SEQ ID NO: 3617540 - DNA, 15 bp, Homo sapiens
ctcccccatgggctg

SEQ ID NO: 3617541 - DNA, 22 bp, Homo sapiens
ctcccccgtttctccttttcct

SEQ ID NO: 3617542 - DNA, 17 bp, Homo sapiens
ctccccctccttgtgcc

SEQ ID NO: 3617543 - DNA, 13 bp, Homo sapiens
ctccccgcccctg

SEQ ID NO: 3617544 - DNA, 22 bp, Homo sapiens
ctccccgcccctgtggccctgg

SEQ ID NO: 3617545 - DNA, 23 bp, Homo sapiens
ctccccgcccctgtggccctggc

SEQ ID NO: 3617546 - DNA, 19 bp, Homo sapiens
ctccccgctcaggggcctg

SEQ ID NO: 3617547 - DNA, 20 bp, Homo sapiens
ctccccgctcaggggcctgg

SEQ ID NO: 3617548 - DNA, 16 bp, Homo sapiens
ctcccctaaagcctca

SEQ ID NO: 3617549 - DNA, 23 bp, Homo sapiens
ctcccctaaagcctcaaaacaaa

SEQ ID NO: 3617550 - DNA, 18 bp, Homo sapiens
ctcccctatgctggtaga

SEQ ID NO: 3617551 - DNA, 13 bp, Homo sapiens
ctcccctcagagt

SEQ ID NO: 3617552 - DNA, 16 bp, Homo sapiens
ctcccctcagagtgca

SEQ ID NO: 3617553 - DNA, 16 bp, Homo sapiens
ctcccctcccctgggg

SEQ ID NO: 3617554 - DNA, 17 bp, Homo sapiens
ctcccctcctgcacaca

SEQ ID NO: 3617555 - DNA, 14 bp, Homo sapiens
ctcccctcggagaa

SEQ ID NO: 3617556 - DNA, 14 bp, Homo sapiens
ctcccctctcagca

SEQ ID NO: 3617557 - DNA, 19 bp, Homo sapiens
ctcccctctcgccccatcc

SEQ ID NO: 3617558 - DNA, 20 bp, Homo sapiens
ctcccctctcgccccatccc

SEQ ID NO: 3617559 - DNA, 12 bp, Homo sapiens
ctccccttctct

SEQ ID NO: 3617560 - DNA, 14 bp, Homo sapiens
ctcccgctcccagg

SEQ ID NO: 3617561 - DNA, 20 bp, Homo sapiens
ctcccgctgcccaggggagc

SEQ ID NO: 3617562 - DNA, 15 bp, Homo sapiens
ctcccgggggcccca

SEQ ID NO: 3617563 - DNA, 13 bp, Homo sapiens
ctccctacactga

SEQ ID NO: 3617564 - DNA, 14 bp, Homo sapiens
ctccctcagtgccc

SEQ ID NO: 3617565 - DNA, 13 bp, Homo sapiens
ctccctcattcca

SEQ ID NO: 3617566 - DNA, 13 bp, Homo sapiens
ctccctcctcagg

SEQ ID NO: 3617567 - DNA, 21 bp, Homo sapiens
ctccctctccagcaggcccat

SEQ ID NO: 3617568 - DNA, 22 bp, Homo sapiens
ctccctgactgggggcagacat

SEQ ID NO: 3617569 - DNA, 20 bp, Homo sapiens
ctccctgatcccaccccctc

SEQ ID NO: 3617570 - DNA, 20 bp, Homo sapiens
ctccctgcccctcccttcaa

SEQ ID NO: 3617571 - DNA, 14 bp, Homo sapiens
ctccctgcctccag

SEQ ID NO: 3617572 - DNA, 14 bp, Homo sapiens
ctccctgcctgctc

SEQ ID NO: 3617573 - DNA, 22 bp, Homo sapiens
ctccctgctgtgccatgctggg

SEQ ID NO: 3617574 - DNA, 15 bp, Homo sapiens
ctccctgggtctggg

SEQ ID NO: 3617575 - DNA, 17 bp, Homo sapiens
ctccctgtataagacac

SEQ ID NO: 3617576 - DNA, 14 bp, Homo sapiens
ctccctgtctccag

SEQ ID NO: 3617577 - DNA, 16 bp, Homo sapiens
ctccctgtctccagct

SEQ ID NO: 3617578 - DNA, 19 bp, Homo sapiens
ctccctgtctccagctgcc

SEQ ID NO: 3617579 - DNA, 20 bp, Homo sapiens
ctccctgtctccagctgcct

SEQ ID NO: 3617580 - DNA, 22 bp, Homo sapiens
ctccctgtctccagctgcctgg

SEQ ID NO: 3617581 - DNA, 22 bp, Homo sapiens
ctccctgtctccagggccccca

SEQ ID NO: 3617582 - DNA, 23 bp, Homo sapiens
ctccctgtctccagggcccccac

SEQ ID NO: 3617583 - DNA, 18 bp, Homo sapiens
ctccctgttccccagaga

SEQ ID NO: 3617584 - DNA, 14 bp, Homo sapiens
ctcccttaccctcc

SEQ ID NO: 3617585 - DNA, 20 bp, Homo sapiens
ctcccttaccctcctctgct

SEQ ID NO: 3617586 - DNA, 22 bp, Homo sapiens
ctcccttaccctcctctgctgg

SEQ ID NO: 3617587 - DNA, 20 bp, Homo sapiens
ctcccttcaaccattcccca

SEQ ID NO: 3617588 - DNA, 14 bp, Homo sapiens
ctcccttctgctac

SEQ ID NO: 3617589 - DNA, 15 bp, Homo sapiens
ctcccttctgctact

SEQ ID NO: 3617590 - DNA, 15 bp, Homo sapiens
ctccctttctctctc

SEQ ID NO: 3617591 - DNA, 17 bp, Homo sapiens
ctccgaaatgctgtctt

SEQ ID NO: 3617592 - DNA, 14 bp, Homo sapiens
ctccgagctctggt

SEQ ID NO: 3617593 - DNA, 19 bp, Homo sapiens
ctccgagctctggtgcttt

SEQ ID NO: 3617594 - DNA, 12 bp, Homo sapiens
ctccgcagggcg

SEQ ID NO: 3617595 - DNA, 17 bp, Homo sapiens
ctccgccttaccaggag

SEQ ID NO: 3617596 - DNA, 13 bp, Homo sapiens
ctccgccttccgg

SEQ ID NO: 3617597 - DNA, 16 bp, Homo sapiens
ctccggagcgccctgc

SEQ ID NO: 3617598 - DNA, 17 bp, Homo sapiens
ctccgggcaccaggggc

SEQ ID NO: 3617599 - DNA, 19 bp, Homo sapiens
ctccgggcaccaggggcca

SEQ ID NO: 3617600 - DNA, 15 bp, Homo sapiens
ctccgtagctctgct

SEQ ID NO: 3617601 - DNA, 17 bp, Homo sapiens
ctccgtagctctgctgc

SEQ ID NO: 3617602 - DNA, 21 bp, Homo sapiens
ctccgtagggtctttcttggg

SEQ ID NO: 3617603 - DNA, 18 bp, Homo sapiens
ctccgtccaggagcctgg

SEQ ID NO: 3617604 - DNA, 16 bp, Homo sapiens
ctccgtgtttctctaa

SEQ ID NO: 3617605 - DNA, 14 bp, Homo sapiens
ctccgttccatctg

SEQ ID NO: 3617606 - DNA, 14 bp, Homo sapiens
ctcctaaataaatt

SEQ ID NO: 3617607 - DNA, 13 bp, Homo sapiens
ctcctaccctccc

SEQ ID NO: 3617608 - DNA, 16 bp, Homo sapiens
ctcctaccctcccacc

SEQ ID NO: 3617609 - DNA, 18 bp, Homo sapiens
ctcctaccctcccaccag

SEQ ID NO: 3617610 - DNA, 11 bp, Homo sapiens
ctcctacctca

SEQ ID NO: 3617611 - DNA, 13 bp, Homo sapiens
ctcctacctggta

SEQ ID NO: 3617612 - DNA, 14 bp, Homo sapiens
ctcctacctgtctg

SEQ ID NO: 3617613 - DNA, 16 bp, Homo sapiens
ctcctacctgtctgct

SEQ ID NO: 3617614 - DNA, 17 bp, Homo sapiens
ctcctacctgtctgctg

SEQ ID NO: 3617615 - DNA, 13 bp, Homo sapiens
ctcctagagggag

SEQ ID NO: 3617616 - DNA, 18 bp, Homo sapiens
ctcctagagggaggggcc

SEQ ID NO: 3617617 - DNA, 19 bp, Homo sapiens
ctcctagagggaggggcct

SEQ ID NO: 3617618 - DNA, 19 bp, Homo sapiens
ctcctataaagtgcctcgg

SEQ ID NO: 3617619 - DNA, 22 bp, Homo sapiens
ctcctatcagaagtttctcagc

SEQ ID NO: 3617620 - DNA, 21 bp, Homo sapiens
ctcctcacccacctctgggtc

SEQ ID NO: 3617621 - DNA, 14 bp, Homo sapiens
ctcctcacccccag

SEQ ID NO: 3617622 - DNA, 13 bp, Homo sapiens
ctcctcagcaccc

SEQ ID NO: 3617623 - DNA, 15 bp, Homo sapiens
ctcctcagctccctg

SEQ ID NO: 3617624 - DNA, 19 bp, Homo sapiens
ctcctcagctccctgcctg

SEQ ID NO: 3617625 - DNA, 12 bp, Homo sapiens
ctcctcaggagc

SEQ ID NO: 3617626 - DNA, 14 bp, Homo sapiens
ctcctcccactgcc

SEQ ID NO: 3617627 - DNA, 18 bp, Homo sapiens
ctcctcccactgcccact

SEQ ID NO: 3617628 - DNA, 14 bp, Homo sapiens
ctcctcccccagtg

SEQ ID NO: 3617629 - DNA, 16 bp, Homo sapiens
ctcctcccgcccttcc

SEQ ID NO: 3617630 - DNA, 14 bp, Homo sapiens
ctcctcccggtgcc

SEQ ID NO: 3617631 - DNA, 14 bp, Homo sapiens
ctcctccctgcatc

SEQ ID NO: 3617632 - DNA, 18 bp, Homo sapiens
ctcctccctgcatctgac

SEQ ID NO: 3617633 - DNA, 13 bp, Homo sapiens
ctcctcctccctg

SEQ ID NO: 3617634 - DNA, 15 bp, Homo sapiens
ctcctcctccctgca

SEQ ID NO: 3617635 - DNA, 20 bp, Homo sapiens
ctcctcggagagcagcagca

SEQ ID NO: 3617636 - DNA, 21 bp, Homo sapiens
ctcctcggagagcagcagcac

SEQ ID NO: 3617637 - DNA, 15 bp, Homo sapiens
ctcctctaggccctg

SEQ ID NO: 3617638 - DNA, 9 bp, Homo sapiens
ctcctctct

SEQ ID NO: 3617639 - DNA, 13 bp, Homo sapiens
ctcctctgcactc

SEQ ID NO: 3617640 - DNA, 12 bp, Homo sapiens
ctcctctgctgg

SEQ ID NO: 3617641 - DNA, 12 bp, Homo sapiens
ctcctctgtcca

SEQ ID NO: 3617642 - DNA, 14 bp, Homo sapiens
ctcctcttagctca

SEQ ID NO: 3617643 - DNA, 18 bp, Homo sapiens
ctcctcttcaactgacca

SEQ ID NO: 3617644 - DNA, 23 bp, Homo sapiens
ctcctcttcaactgaccagcctc

SEQ ID NO: 3617645 - DNA, 12 bp, Homo sapiens
ctcctcttgcca

SEQ ID NO: 3617646 - DNA, 16 bp, Homo sapiens
ctcctcttgttcctga

SEQ ID NO: 3617647 - DNA, 14 bp, Homo sapiens
ctcctgaccttggg

SEQ ID NO: 3617648 - DNA, 20 bp, Homo sapiens
ctcctgagtgccccacttct

SEQ ID NO: 3617649 - DNA, 14 bp, Homo sapiens
ctcctgcacacagg

SEQ ID NO: 3617650 - DNA, 17 bp, Homo sapiens
ctcctgcacacagggca

SEQ ID NO: 3617651 - DNA, 14 bp, Homo sapiens
ctcctgccaccagc

SEQ ID NO: 3617652 - DNA, 19 bp, Homo sapiens
ctcctgccaccagcatcca

SEQ ID NO: 3617653 - DNA, 16 bp, Homo sapiens
ctcctgccccctgcca

SEQ ID NO: 3617654 - DNA, 15 bp, Homo sapiens
ctcctgccctgtgat

SEQ ID NO: 3617655 - DNA, 14 bp, Homo sapiens
ctcctgcttttctg

SEQ ID NO: 3617656 - DNA, 20 bp, Homo sapiens
ctcctgcttttctgtcctgg

SEQ ID NO: 3617657 - DNA, 22 bp, Homo sapiens
ctcctgcttttctgtcctgggc

SEQ ID NO: 3617658 - DNA, 18 bp, Homo sapiens
ctcctggcagggccacct

SEQ ID NO: 3617659 - DNA, 22 bp, Homo sapiens
ctcctggcagggccacctgcag

SEQ ID NO: 3617660 - DNA, 23 bp, Homo sapiens
ctcctggcagggccacctgcagg

SEQ ID NO: 3617661 - DNA, 24 bp, Homo sapiens
ctcctggcagggccacctgcagga

SEQ ID NO: 3617662 - DNA, 14 bp, Homo sapiens
ctcctggccttttg

SEQ ID NO: 3617663 - DNA, 23 bp, Homo sapiens
ctcctgggaacacatctggctgc

SEQ ID NO: 3617664 - DNA, 21 bp, Homo sapiens
ctcctgggcattagcaaggca

SEQ ID NO: 3617665 - DNA, 22 bp, Homo sapiens
ctcctgggcattagcaaggcag

SEQ ID NO: 3617666 - DNA, 23 bp, Homo sapiens
ctcctgggcattagcaaggcaga

SEQ ID NO: 3617667 - DNA, 22 bp, Homo sapiens
ctcctgggccggctgagtggca

SEQ ID NO: 3617668 - DNA, 20 bp, Homo sapiens
ctcctgggggttctttcttc

SEQ ID NO: 3617669 - DNA, 20 bp, Homo sapiens
ctcctgtcccttttccctta

SEQ ID NO: 3617670 - DNA, 15 bp, Homo sapiens
ctcctgtcttctttc

SEQ ID NO: 3617671 - DNA, 18 bp, Homo sapiens
ctccttaggtgcccagaa

SEQ ID NO: 3617672 - DNA, 20 bp, Homo sapiens
ctccttcccatttctctaca

SEQ ID NO: 3617673 - DNA, 13 bp, Homo sapiens
ctccttcctgtgt

SEQ ID NO: 3617674 - DNA, 12 bp, Homo sapiens
ctccttctcctt

SEQ ID NO: 3617675 - DNA, 18 bp, Homo sapiens
ctccttggcacccccatg

SEQ ID NO: 3617676 - DNA, 16 bp, Homo sapiens
ctccttggccacagac

SEQ ID NO: 3617677 - DNA, 20 bp, Homo sapiens
ctccttggctttatgcaaat

SEQ ID NO: 3617678 - DNA, 23 bp, Homo sapiens
ctccttggctttatgcaaataca

SEQ ID NO: 3617679 - DNA, 22 bp, Homo sapiens
ctccttgtgttgcactgaacag

SEQ ID NO: 3617680 - DNA, 23 bp, Homo sapiens
ctccttgtgttgcactgaacagg

SEQ ID NO: 3617681 - DNA, 20 bp, Homo sapiens
ctcctttcacaaccttctgt

SEQ ID NO: 3617682 - DNA, 20 bp, Homo sapiens
ctcctttgaagaaggcaagg

SEQ ID NO: 3617683 - DNA, 17 bp, Homo sapiens
ctcctttgtactttgtg

SEQ ID NO: 3617684 - DNA, 12 bp, Homo sapiens
ctccttttccta

SEQ ID NO: 3617685 - DNA, 14 bp, Homo sapiens
ctcgaactcctgac

SEQ ID NO: 3617686 - DNA, 13 bp, Homo sapiens
ctcgacccagaat

SEQ ID NO: 3617687 - DNA, 19 bp, Homo sapiens
ctcgacccagaatggagcc

SEQ ID NO: 3617688 - DNA, 12 bp, Homo sapiens
ctcgagagcctt

SEQ ID NO: 3617689 - DNA, 22 bp, Homo sapiens
ctcgagcctgggtgacagggca

SEQ ID NO: 3617690 - DNA, 20 bp, Homo sapiens
ctcgcagggaatgcagcagg

SEQ ID NO: 3617691 - DNA, 13 bp, Homo sapiens
ctcgcccagcagg

SEQ ID NO: 3617692 - DNA, 14 bp, Homo sapiens
ctcgctcccttcaa

SEQ ID NO: 3617693 - DNA, 14 bp, Homo sapiens
ctcggaatctattt

SEQ ID NO: 3617694 - DNA, 13 bp, Homo sapiens
ctcggagaagagc

SEQ ID NO: 3617695 - DNA, 20 bp, Homo sapiens
ctcggagagcagcagcacca

SEQ ID NO: 3617696 - DNA, 20 bp, Homo sapiens
ctcggatgacaccctggcct

SEQ ID NO: 3617697 - DNA, 14 bp, Homo sapiens
ctcggcacacactg

SEQ ID NO: 3617698 - DNA, 15 bp, Homo sapiens
ctcggctctgcatgt

SEQ ID NO: 3617699 - DNA, 23 bp, Homo sapiens
ctcgggccgtaggggctcctgag

SEQ ID NO: 3617700 - DNA, 20 bp, Homo sapiens
ctcggggtgtgtcatttcta

SEQ ID NO: 3617701 - DNA, 19 bp, Homo sapiens
ctcggtatctggcttccct

SEQ ID NO: 3617702 - DNA, 23 bp, Homo sapiens
ctcggtatctggcttccctggaa

SEQ ID NO: 3617703 - DNA, 15 bp, Homo sapiens
ctcggtgtccccacc

SEQ ID NO: 3617704 - DNA, 22 bp, Homo sapiens
ctcggtgtccccaccatctgct

SEQ ID NO: 3617705 - DNA, 23 bp, Homo sapiens
ctcggtgtccccaccatctgctg

SEQ ID NO: 3617706 - DNA, 18 bp, Homo sapiens
ctcgtcaagagcatgcac

SEQ ID NO: 3617707 - DNA, 17 bp, Homo sapiens
ctcgtcagccacctggg

SEQ ID NO: 3617708 - DNA, 18 bp, Homo sapiens
ctcgtcagccacctggga

SEQ ID NO: 3617709 - DNA, 14 bp, Homo sapiens
ctcgtgaggggcaa

SEQ ID NO: 3617710 - DNA, 21 bp, Homo sapiens
ctcgtgccaccccgagggctg

SEQ ID NO: 3617711 - DNA, 18 bp, Homo sapiens
ctcgtgctccgcagggcg

SEQ ID NO: 3617712 - DNA, 16 bp, Homo sapiens
ctcgttccagtggcgg

SEQ ID NO: 3617713 - DNA, 17 bp, Homo sapiens
ctcgttccagtggcggc

SEQ ID NO: 3617714 - DNA, 23 bp, Homo sapiens
ctcgttttgggtactttctatct

SEQ ID NO: 3617715 - DNA, 13 bp, Homo sapiens
ctctaaaatctgc

SEQ ID NO: 3617716 - DNA, 17 bp, Homo sapiens
ctctaaagccaagcact

SEQ ID NO: 3617717 - DNA, 23 bp, Homo sapiens
ctctaaatactgagaaaacctgt

SEQ ID NO: 3617718 - DNA, 19 bp, Homo sapiens
ctctaacagtggacaaagt

SEQ ID NO: 3617719 - DNA, 19 bp, Homo sapiens
ctctaactctgagagctgt

SEQ ID NO: 3617720 - DNA, 22 bp, Homo sapiens
ctctaaggaattatttcacaca

SEQ ID NO: 3617721 - DNA, 13 bp, Homo sapiens
ctctaagtgctgc

SEQ ID NO: 3617722 - DNA, 14 bp, Homo sapiens
ctctaataaacact

SEQ ID NO: 3617723 - DNA, 17 bp, Homo sapiens
ctctaattcacagtgct

SEQ ID NO: 3617724 - DNA, 20 bp, Homo sapiens
ctctaattcacagtgctctt

SEQ ID NO: 3617725 - DNA, 17 bp, Homo sapiens
ctctaatttaacttatt

SEQ ID NO: 3617726 - DNA, 21 bp, Homo sapiens
ctctacagctaatcagcattc

SEQ ID NO: 3617727 - DNA, 16 bp, Homo sapiens
ctctaccaaatagtga

SEQ ID NO: 3617728 - DNA, 16 bp, Homo sapiens
ctctagacactgccac

SEQ ID NO: 3617729 - DNA, 13 bp, Homo sapiens
ctctagcctctgg

SEQ ID NO: 3617730 - DNA, 22 bp, Homo sapiens
ctctagcctggcaacagagcga

SEQ ID NO: 3617731 - DNA, 23 bp, Homo sapiens
ctctagctgggggtgggccaggc

SEQ ID NO: 3617732 - DNA, 12 bp, Homo sapiens
ctctatactgtg

SEQ ID NO: 3617733 - DNA, 13 bp, Homo sapiens
ctctatactgtgg

SEQ ID NO: 3617734 - DNA, 23 bp, Homo sapiens
ctctatcatctgctaagtaattt

SEQ ID NO: 3617735 - DNA, 17 bp, Homo sapiens
ctctatgtatcaaatgt

SEQ ID NO: 3617736 - DNA, 20 bp, Homo sapiens
ctctattatgttatcatcct

SEQ ID NO: 3617737 - DNA, 21 bp, Homo sapiens
ctctattatgttatcatcctc

SEQ ID NO: 3617738 - DNA, 11 bp, Homo sapiens
ctctcacagac

SEQ ID NO: 3617739 - DNA, 18 bp, Homo sapiens
ctctcagtactttggagg

SEQ ID NO: 3617740 - DNA, 15 bp, Homo sapiens
ctctcataccctccc

SEQ ID NO: 3617741 - DNA, 18 bp, Homo sapiens
ctctcatcggaggcccat

SEQ ID NO: 3617742 - DNA, 22 bp, Homo sapiens
ctctcatcggaggcccatgccc

SEQ ID NO: 3617743 - DNA, 12 bp, Homo sapiens
ctctccagcagg

SEQ ID NO: 3617744 - DNA, 15 bp, Homo sapiens
ctctccagctgacta

SEQ ID NO: 3617745 - DNA, 20 bp, Homo sapiens
ctctccaggagggctcgggg

SEQ ID NO: 3617746 - DNA, 14 bp, Homo sapiens
ctctccaggcctgt

SEQ ID NO: 3617747 - DNA, 15 bp, Homo sapiens
ctctccagggtgctt

SEQ ID NO: 3617748 - DNA, 13 bp, Homo sapiens
ctctccagtgaaa

SEQ ID NO: 3617749 - DNA, 21 bp, Homo sapiens
ctctccatacctgcccctgcc

SEQ ID NO: 3617750 - DNA, 16 bp, Homo sapiens
ctctcccatcctgggg

SEQ ID NO: 3617751 - DNA, 16 bp, Homo sapiens
ctctcccattgtccct

SEQ ID NO: 3617752 - DNA, 15 bp, Homo sapiens
ctctccccagcccag

SEQ ID NO: 3617753 - DNA, 17 bp, Homo sapiens
ctctccccagcccagag

SEQ ID NO: 3617754 - DNA, 21 bp, Homo sapiens
ctctcccctcagagtgcaagc

SEQ ID NO: 3617755 - DNA, 20 bp, Homo sapiens
ctctccgactctgcacccgc

SEQ ID NO: 3617756 - DNA, 17 bp, Homo sapiens
ctctccgagctctggtg

SEQ ID NO: 3617757 - DNA, 18 bp, Homo sapiens
ctctccgagctctggtgc

SEQ ID NO: 3617758 - DNA, 16 bp, Homo sapiens
ctctccgaggggtgga

SEQ ID NO: 3617759 - DNA, 19 bp, Homo sapiens
ctctcctcatctccaaggc

SEQ ID NO: 3617760 - DNA, 13 bp, Homo sapiens
ctctcctctctgc

SEQ ID NO: 3617761 - DNA, 14 bp, Homo sapiens
ctctcctctctgct

SEQ ID NO: 3617762 - DNA, 14 bp, Homo sapiens
ctctcctcttgcca

SEQ ID NO: 3617763 - DNA, 21 bp, Homo sapiens
ctctcctgacttttaatgtca

SEQ ID NO: 3617764 - DNA, 14 bp, Homo sapiens
ctctcctgccctgt

SEQ ID NO: 3617765 - DNA, 17 bp, Homo sapiens
ctctcctgccctgtgat

SEQ ID NO: 3617766 - DNA, 15 bp, Homo sapiens
ctctcctgcctcagc

SEQ ID NO: 3617767 - DNA, 16 bp, Homo sapiens
ctctcctgcctcagcc

SEQ ID NO: 3617768 - DNA, 16 bp, Homo sapiens
ctctccttggccacag

SEQ ID NO: 3617769 - DNA, 18 bp, Homo sapiens
ctctccttggccacagac

SEQ ID NO: 3617770 - DNA, 16 bp, Homo sapiens
ctctccttttgaggct

SEQ ID NO: 3617771 - DNA, 22 bp, Homo sapiens
ctctcgactgtcagtggggcag

SEQ ID NO: 3617772 - DNA, 19 bp, Homo sapiens
ctctcggctgccaggggct

SEQ ID NO: 3617773 - DNA, 22 bp, Homo sapiens
ctctcggctgccaggggctctg

SEQ ID NO: 3617774 - DNA, 19 bp, Homo sapiens
ctctcgggttgtgtgtctg

SEQ ID NO: 3617775 - DNA, 14 bp, Homo sapiens
ctctcgtctctcgt

SEQ ID NO: 3617776 - DNA, 21 bp, Homo sapiens
ctctctcataccctccctccc

SEQ ID NO: 3617777 - DNA, 13 bp, Homo sapiens
ctctctccaggag

SEQ ID NO: 3617778 - DNA, 15 bp, Homo sapiens
ctctctccagggtgc

SEQ ID NO: 3617779 - DNA, 14 bp, Homo sapiens
ctctctccaggtca

SEQ ID NO: 3617780 - DNA, 21 bp, Homo sapiens
ctctctccaggtcagcctgga

SEQ ID NO: 3617781 - DNA, 17 bp, Homo sapiens
ctctctcctctctgctt

SEQ ID NO: 3617782 - DNA, 19 bp, Homo sapiens
ctctctgagtcaaatccag

SEQ ID NO: 3617783 - DNA, 21 bp, Homo sapiens
ctctctgagtcaaatccagtg

SEQ ID NO: 3617784 - DNA, 23 bp, Homo sapiens
ctctctgagtcaaatccagtggt

SEQ ID NO: 3617785 - DNA, 15 bp, Homo sapiens
ctctctggctgggga

SEQ ID NO: 3617786 - DNA, 16 bp, Homo sapiens
ctctctggctggtctt

SEQ ID NO: 3617787 - DNA, 16 bp, Homo sapiens
ctctcttctctccagc

SEQ ID NO: 3617788 - DNA, 18 bp, Homo sapiens
ctctcttgtcctcttctg

SEQ ID NO: 3617789 - DNA, 12 bp, Homo sapiens
ctctcttttgtt

SEQ ID NO: 3617790 - DNA, 14 bp, Homo sapiens
ctctcttttgttta

SEQ ID NO: 3617791 - DNA, 22 bp, Homo sapiens
ctctgaatgagcctttgtgctt

SEQ ID NO: 3617792 - DNA, 20 bp, Homo sapiens
ctctgacaactgtgaagcca

SEQ ID NO: 3617793 - DNA, 18 bp, Homo sapiens
ctctgacagtccacaggg

SEQ ID NO: 3617794 - DNA, 20 bp, Homo sapiens
ctctgacagtccacaggggc

SEQ ID NO: 3617795 - DNA, 22 bp, Homo sapiens
ctctgacagtccacaggggcca

SEQ ID NO: 3617796 - DNA, 16 bp, Homo sapiens
ctctgacatcccttcc

SEQ ID NO: 3617797 - DNA, 14 bp, Homo sapiens
ctctgagtcaaatc

SEQ ID NO: 3617798 - DNA, 21 bp, Homo sapiens
ctctgagtcaaatccagtggt

SEQ ID NO: 3617799 - DNA, 23 bp, Homo sapiens
ctctgagtcaaatccagtggtgg

SEQ ID NO: 3617800 - DNA, 22 bp, Homo sapiens
ctctgattagttgacagtatta

SEQ ID NO: 3617801 - DNA, 15 bp, Homo sapiens
ctctgattttcaaag

SEQ ID NO: 3617802 - DNA, 16 bp, Homo sapiens
ctctgcacagacaagc

SEQ ID NO: 3617803 - DNA, 18 bp, Homo sapiens
ctctgcacagacaagcag

SEQ ID NO: 3617804 - DNA, 15 bp, Homo sapiens
ctctgcacccagaac

SEQ ID NO: 3617805 - DNA, 20 bp, Homo sapiens
ctctgcactcccacctgaca

SEQ ID NO: 3617806 - DNA, 17 bp, Homo sapiens
ctctgcagtctcatttc

SEQ ID NO: 3617807 - DNA, 19 bp, Homo sapiens
ctctgcagtctcatttctc

SEQ ID NO: 3617808 - DNA, 20 bp, Homo sapiens
ctctgcccaacccttccctc

SEQ ID NO: 3617809 - DNA, 16 bp, Homo sapiens
ctctgccccagcctgt

SEQ ID NO: 3617810 - DNA, 17 bp, Homo sapiens
ctctgccccatcctcca

SEQ ID NO: 3617811 - DNA, 21 bp, Homo sapiens
ctctgccccatcctccagcag

SEQ ID NO: 3617812 - DNA, 11 bp, Homo sapiens
ctctgccctgg

SEQ ID NO: 3617813 - DNA, 14 bp, Homo sapiens
ctctgccctggatt

SEQ ID NO: 3617814 - DNA, 14 bp, Homo sapiens
ctctgccctgggct

SEQ ID NO: 3617815 - DNA, 15 bp, Homo sapiens
ctctgccctgggctc

SEQ ID NO: 3617816 - DNA, 18 bp, Homo sapiens
ctctgccggtcgggcagc

SEQ ID NO: 3617817 - DNA, 16 bp, Homo sapiens
ctctgcctcctcttca

SEQ ID NO: 3617818 - DNA, 18 bp, Homo sapiens
ctctgcctgggctctgga

SEQ ID NO: 3617819 - DNA, 22 bp, Homo sapiens
ctctgcgtcggtcctggtgccc

SEQ ID NO: 3617820 - DNA, 11 bp, Homo sapiens
ctctgctgccg

SEQ ID NO: 3617821 - DNA, 19 bp, Homo sapiens
ctctgctgccggctctggg

SEQ ID NO: 3617822 - DNA, 20 bp, Homo sapiens
ctctgctgccggctctgggc

SEQ ID NO: 3617823 - DNA, 12 bp, Homo sapiens
ctctgctgctga

SEQ ID NO: 3617824 - DNA, 13 bp, Homo sapiens
ctctgctgctgat

SEQ ID NO: 3617825 - DNA, 14 bp, Homo sapiens
ctctgctggccgga

SEQ ID NO: 3617826 - DNA, 20 bp, Homo sapiens
ctctgctgggaacctagcac

SEQ ID NO: 3617827 - DNA, 18 bp, Homo sapiens
ctctggacagccccaccc

SEQ ID NO: 3617828 - DNA, 15 bp, Homo sapiens
ctctggactggaaag

SEQ ID NO: 3617829 - DNA, 15 bp, Homo sapiens
ctctggagaaggcct

SEQ ID NO: 3617830 - DNA, 16 bp, Homo sapiens
ctctggagaaggcctg

SEQ ID NO: 3617831 - DNA, 18 bp, Homo sapiens
ctctggagaaggcctgga

SEQ ID NO: 3617832 - DNA, 14 bp, Homo sapiens
ctctggagtggcca

SEQ ID NO: 3617833 - DNA, 16 bp, Homo sapiens
ctctggagtggccact

SEQ ID NO: 3617834 - DNA, 19 bp, Homo sapiens
ctctggcaccatcagcctg

SEQ ID NO: 3617835 - DNA, 20 bp, Homo sapiens
ctctggcaccatcagcctgt

SEQ ID NO: 3617836 - DNA, 15 bp, Homo sapiens
ctctggctggggagc

SEQ ID NO: 3617837 - DNA, 13 bp, Homo sapiens
ctctggctggtct

SEQ ID NO: 3617838 - DNA, 15 bp, Homo sapiens
ctctggctggtcttc

SEQ ID NO: 3617839 - DNA, 21 bp, Homo sapiens
ctctggcttcaaaaagccaca

SEQ ID NO: 3617840 - DNA, 22 bp, Homo sapiens
ctctggcttcaaaaagccacag

SEQ ID NO: 3617841 - DNA, 22 bp, Homo sapiens
ctctggcttccctaaactgcag

SEQ ID NO: 3617842 - DNA, 12 bp, Homo sapiens
ctctgggaccca

SEQ ID NO: 3617843 - DNA, 19 bp, Homo sapiens
ctctgggacccacagaact

SEQ ID NO: 3617844 - DNA, 15 bp, Homo sapiens
ctctgggagcccaga

SEQ ID NO: 3617845 - DNA, 22 bp, Homo sapiens
ctctgggcctgagggtccacct

SEQ ID NO: 3617846 - DNA, 18 bp, Homo sapiens
ctctggggacagcttcct

SEQ ID NO: 3617847 - DNA, 19 bp, Homo sapiens
ctctggggacagcttcctc

SEQ ID NO: 3617848 - DNA, 21 bp, Homo sapiens
ctctgggggctgaggagcagc

SEQ ID NO: 3617849 - DNA, 13 bp, Homo sapiens
ctctgggggtcct

SEQ ID NO: 3617850 - DNA, 17 bp, Homo sapiens
ctctgggggtcctctct

SEQ ID NO: 3617851 - DNA, 15 bp, Homo sapiens
ctctgggtgctgccc

SEQ ID NO: 3617852 - DNA, 18 bp, Homo sapiens
ctctggtgtgtggtgagg

SEQ ID NO: 3617853 - DNA, 12 bp, Homo sapiens
ctctgtccaggc

SEQ ID NO: 3617854 - DNA, 16 bp, Homo sapiens
ctctgtccctgtcctt

SEQ ID NO: 3617855 - DNA, 21 bp, Homo sapiens
ctctgtcctcttggccatcct

SEQ ID NO: 3617856 - DNA, 13 bp, Homo sapiens
ctctgtgacccta

SEQ ID NO: 3617857 - DNA, 15 bp, Homo sapiens
ctctgtggcaaaaag

SEQ ID NO: 3617858 - DNA, 17 bp, Homo sapiens
ctctgtggtcacccatg

SEQ ID NO: 3617859 - DNA, 18 bp, Homo sapiens
ctctgtggtcacccatgc

SEQ ID NO: 3617860 - DNA, 14 bp, Homo sapiens
ctctgttacaaaag

SEQ ID NO: 3617861 - DNA, 22 bp, Homo sapiens
ctctgttcctttctctgggctt

SEQ ID NO: 3617862 - DNA, 22 bp, Homo sapiens
ctctgttgcccaggctggagtg

SEQ ID NO: 3617863 - DNA, 14 bp, Homo sapiens
ctctgttggtctgc

SEQ ID NO: 3617864 - DNA, 16 bp, Homo sapiens
ctctgttggtctgcct

SEQ ID NO: 3617865 - DNA, 21 bp, Homo sapiens
ctctgttggtctgccttctgc

SEQ ID NO: 3617866 - DNA, 22 bp, Homo sapiens
ctctgttggtctgccttctgct

SEQ ID NO: 3617867 - DNA, 20 bp, Homo sapiens
ctcttaaagaaaacccaccc

SEQ ID NO: 3617868 - DNA, 17 bp, Homo sapiens
ctcttaccagtatttaa

SEQ ID NO: 3617869 - DNA, 19 bp, Homo sapiens
ctcttaccagtatttaact

SEQ ID NO: 3617870 - DNA, 16 bp, Homo sapiens
ctcttactaatgtaaa

SEQ ID NO: 3617871 - DNA, 19 bp, Homo sapiens
ctcttagctcagctgagca

SEQ ID NO: 3617872 - DNA, 13 bp, Homo sapiens
ctcttagctgtct

SEQ ID NO: 3617873 - DNA, 21 bp, Homo sapiens
ctcttattttttaaaaaattt

SEQ ID NO: 3617874 - DNA, 14 bp, Homo sapiens
ctcttcaatctctt

SEQ ID NO: 3617875 - DNA, 18 bp, Homo sapiens
ctcttcagtgactcctgc

SEQ ID NO: 3617876 - DNA, 23 bp, Homo sapiens
ctcttcagtgactcctgctggta

SEQ ID NO: 3617877 - DNA, 20 bp, Homo sapiens
ctcttccagggcagcggctc

SEQ ID NO: 3617878 - DNA, 13 bp, Homo sapiens
ctcttccccttcc

SEQ ID NO: 3617879 - DNA, 19 bp, Homo sapiens
ctcttccccttcctgtttc

SEQ ID NO: 3617880 - DNA, 21 bp, Homo sapiens
ctcttccccttcctgtttcag

SEQ ID NO: 3617881 - DNA, 15 bp, Homo sapiens
ctcttccctgacctc

SEQ ID NO: 3617882 - DNA, 13 bp, Homo sapiens
ctcttcctccact

SEQ ID NO: 3617883 - DNA, 14 bp, Homo sapiens
ctcttcctccactt

SEQ ID NO: 3617884 - DNA, 15 bp, Homo sapiens
ctcttcctcctccca

SEQ ID NO: 3617885 - DNA, 17 bp, Homo sapiens
ctcttcctcctcccaag

SEQ ID NO: 3617886 - DNA, 18 bp, Homo sapiens
ctcttcctcctcccaagg

SEQ ID NO: 3617887 - DNA, 17 bp, Homo sapiens
ctcttctattttgtaaa

SEQ ID NO: 3617888 - DNA, 20 bp, Homo sapiens
ctcttctgaataaagcaatt

SEQ ID NO: 3617889 - DNA, 17 bp, Homo sapiens
ctcttctgagcagaaat

SEQ ID NO: 3617890 - DNA, 13 bp, Homo sapiens
ctcttctggtgtt

SEQ ID NO: 3617891 - DNA, 22 bp, Homo sapiens
ctcttgaaaagttcagggaccg

SEQ ID NO: 3617892 - DNA, 17 bp, Homo sapiens
ctcttgagttcctctgc

SEQ ID NO: 3617893 - DNA, 20 bp, Homo sapiens
ctcttgagttcctctgcagt

SEQ ID NO: 3617894 - DNA, 21 bp, Homo sapiens
ctcttgagttcctctgcagtt

SEQ ID NO: 3617895 - DNA, 20 bp, Homo sapiens
ctcttgccactgcctcttcc

SEQ ID NO: 3617896 - DNA, 21 bp, Homo sapiens
ctcttgccatttgtagctttg

SEQ ID NO: 3617897 - DNA, 21 bp, Homo sapiens
ctcttggccatccttctgtgt

SEQ ID NO: 3617898 - DNA, 22 bp, Homo sapiens
ctcttggccatccttctgtgta

SEQ ID NO: 3617899 - DNA, 14 bp, Homo sapiens
ctcttggctgaccc

SEQ ID NO: 3617900 - DNA, 16 bp, Homo sapiens
ctcttggctgacccct

SEQ ID NO: 3617901 - DNA, 22 bp, Homo sapiens
ctcttggctgacccctctggtg

SEQ ID NO: 3617902 - DNA, 17 bp, Homo sapiens
ctcttgggtagggtagt

SEQ ID NO: 3617903 - DNA, 19 bp, Homo sapiens
ctcttgggttcaagtgatt

SEQ ID NO: 3617904 - DNA, 20 bp, Homo sapiens
ctcttggttcgatacctgga

SEQ ID NO: 3617905 - DNA, 20 bp, Homo sapiens
ctcttgtccctttccctacc

SEQ ID NO: 3617906 - DNA, 17 bp, Homo sapiens
ctcttgtgttcagaaga

SEQ ID NO: 3617907 - DNA, 19 bp, Homo sapiens
ctcttgtgttcagaagaat

SEQ ID NO: 3617908 - DNA, 15 bp, Homo sapiens
ctctttaaccctccc

SEQ ID NO: 3617909 - DNA, 14 bp, Homo sapiens
ctctttaataaatt

SEQ ID NO: 3617910 - DNA, 13 bp, Homo sapiens
ctctttattttcc

SEQ ID NO: 3617911 - DNA, 22 bp, Homo sapiens
ctctttattttcccctatcatt

SEQ ID NO: 3617912 - DNA, 22 bp, Homo sapiens
ctctttccaccataccttagag

SEQ ID NO: 3617913 - DNA, 14 bp, Homo sapiens
ctctttccctgcga

SEQ ID NO: 3617914 - DNA, 20 bp, Homo sapiens
ctctttccctgcgagacgca

SEQ ID NO: 3617915 - DNA, 12 bp, Homo sapiens
ctctttgctttg

SEQ ID NO: 3617916 - DNA, 13 bp, Homo sapiens
ctctttgctttgc

SEQ ID NO: 3617917 - DNA, 18 bp, Homo sapiens
ctcttttcctggcagctg

SEQ ID NO: 3617918 - DNA, 22 bp, Homo sapiens
ctcttttcctggtgctcttttt

SEQ ID NO: 3617919 - DNA, 12 bp, Homo sapiens
ctcttttctttc

SEQ ID NO: 3617920 - DNA, 12 bp, Homo sapiens
ctgaaaaagaca

SEQ ID NO: 3617921 - DNA, 14 bp, Homo sapiens
ctgaaaaagacata

SEQ ID NO: 3617922 - DNA, 20 bp, Homo sapiens
ctgaaaaagacataaaacag

SEQ ID NO: 3617923 - DNA, 23 bp, Homo sapiens
ctgaaaaagacataaaacagaat

SEQ ID NO: 3617924 - DNA, 21 bp, Homo sapiens
ctgaaaaatggtaattgttgc

SEQ ID NO: 3617925 - DNA, 14 bp, Homo sapiens
ctgaaaacctctcc

SEQ ID NO: 3617926 - DNA, 20 bp, Homo sapiens
ctgaaaacctctcctcatgt

SEQ ID NO: 3617927 - DNA, 24 bp, Homo sapiens
ctgaaaatattgttttacaatagt

SEQ ID NO: 3617928 - DNA, 16 bp, Homo sapiens
ctgaaacaacttggaa

SEQ ID NO: 3617929 - DNA, 14 bp, Homo sapiens
ctgaaactggcttc

SEQ ID NO: 3617930 - DNA, 21 bp, Homo sapiens
ctgaaacttgctgagctgttt

SEQ ID NO: 3617931 - DNA, 18 bp, Homo sapiens
ctgaaaggccagcagctg

SEQ ID NO: 3617932 - DNA, 21 bp, Homo sapiens
ctgaaaggccagcagctgatg

SEQ ID NO: 3617933 - DNA, 14 bp, Homo sapiens
ctgaaatataaagt

SEQ ID NO: 3617934 - DNA, 13 bp, Homo sapiens
ctgaaatttacct

SEQ ID NO: 3617935 - DNA, 12 bp, Homo sapiens
ctgaaccaaatt

SEQ ID NO: 3617936 - DNA, 14 bp, Homo sapiens
ctgaaccctccaaa

SEQ ID NO: 3617937 - DNA, 15 bp, Homo sapiens
ctgaacgccctggta

SEQ ID NO: 3617938 - DNA, 22 bp, Homo sapiens
ctgaactccaccgaccaactgc

SEQ ID NO: 3617939 - DNA, 23 bp, Homo sapiens
ctgaactccaccgaccaactgcc

SEQ ID NO: 3617940 - DNA, 12 bp, Homo sapiens
ctgaactgagga

SEQ ID NO: 3617941 - DNA, 23 bp, Homo sapiens
ctgaagacaccgttcattcaggc

SEQ ID NO: 3617942 - DNA, 18 bp, Homo sapiens
ctgaagagtcctctgaat

SEQ ID NO: 3617943 - DNA, 15 bp, Homo sapiens
ctgaagatgccttga

SEQ ID NO: 3617944 - DNA, 22 bp, Homo sapiens
ctgaagattcttaaaaattgaa

SEQ ID NO: 3617945 - DNA, 23 bp, Homo sapiens
ctgaaggaaaagcaagaaacagt

SEQ ID NO: 3617946 - DNA, 15 bp, Homo sapiens
ctgaaggcagtggca

SEQ ID NO: 3617947 - DNA, 13 bp, Homo sapiens
ctgaagtcactgc

SEQ ID NO: 3617948 - DNA, 17 bp, Homo sapiens
ctgaagtcactgcacag

SEQ ID NO: 3617949 - DNA, 21 bp, Homo sapiens
ctgaagtctgagcccatttct

SEQ ID NO: 3617950 - DNA, 16 bp, Homo sapiens
ctgaagtgacctcact

SEQ ID NO: 3617951 - DNA, 17 bp, Homo sapiens
ctgaagtgacctcactg

SEQ ID NO: 3617952 - DNA, 11 bp, Homo sapiens
ctgaagttttt

SEQ ID NO: 3617953 - DNA, 14 bp, Homo sapiens
ctgaataaagcaat

SEQ ID NO: 3617954 - DNA, 14 bp, Homo sapiens
ctgaatcagctgga

SEQ ID NO: 3617955 - DNA, 16 bp, Homo sapiens
ctgaatcagctggaca

SEQ ID NO: 3617956 - DNA, 20 bp, Homo sapiens
ctgaatgaaaataactgaac

SEQ ID NO: 3617957 - DNA, 23 bp, Homo sapiens
ctgaatgactccactgtttttct

SEQ ID NO: 3617958 - DNA, 19 bp, Homo sapiens
ctgaatgagcctttgtgct

SEQ ID NO: 3617959 - DNA, 19 bp, Homo sapiens
ctgaatgcctcgctccctt

SEQ ID NO: 3617960 - DNA, 21 bp, Homo sapiens
ctgaatgcctcgctcccttca

SEQ ID NO: 3617961 - DNA, 20 bp, Homo sapiens
ctgaatgctgttaatatttc

SEQ ID NO: 3617962 - DNA, 16 bp, Homo sapiens
ctgaattcctttacaa

SEQ ID NO: 3617963 - DNA, 20 bp, Homo sapiens
ctgaattcctttacaactaa

SEQ ID NO: 3617964 - DNA, 19 bp, Homo sapiens
ctgacaaaaggctccagtt

SEQ ID NO: 3617965 - DNA, 23 bp, Homo sapiens
ctgacaattttacctattctgaa

SEQ ID NO: 3617966 - DNA, 15 bp, Homo sapiens
ctgacagactcactg

SEQ ID NO: 3617967 - DNA, 22 bp, Homo sapiens
ctgacagccacaccgtggcagc

SEQ ID NO: 3617968 - DNA, 14 bp, Homo sapiens
ctgacagccttccc

SEQ ID NO: 3617969 - DNA, 21 bp, Homo sapiens
ctgacagccttccccagctcc

SEQ ID NO: 3617970 - DNA, 12 bp, Homo sapiens
ctgacagctgct

SEQ ID NO: 3617971 - DNA, 14 bp, Homo sapiens
ctgacagctgctcc

SEQ ID NO: 3617972 - DNA, 16 bp, Homo sapiens
ctgacagctgctccta

SEQ ID NO: 3617973 - DNA, 23 bp, Homo sapiens
ctgacagctgctcctagagggag

SEQ ID NO: 3617974 - DNA, 16 bp, Homo sapiens
ctgacatattatgcct

SEQ ID NO: 3617975 - DNA, 20 bp, Homo sapiens
ctgacatattatgcctgaat

SEQ ID NO: 3617976 - DNA, 18 bp, Homo sapiens
ctgacatcccttcctgga

SEQ ID NO: 3617977 - DNA, 21 bp, Homo sapiens
ctgacatcccttcctggaaac

SEQ ID NO: 3617978 - DNA, 22 bp, Homo sapiens
ctgacatcccttcctggaaaca

SEQ ID NO: 3617979 - DNA, 19 bp, Homo sapiens
ctgacattgctccaagatg

SEQ ID NO: 3617980 - DNA, 15 bp, Homo sapiens
ctgacattggagcct

SEQ ID NO: 3617981 - DNA, 14 bp, Homo sapiens
ctgaccagcagcgc

SEQ ID NO: 3617982 - DNA, 15 bp, Homo sapiens
ctgaccatcatgccc

SEQ ID NO: 3617983 - DNA, 19 bp, Homo sapiens
ctgaccatgcgtcaggggc

SEQ ID NO: 3617984 - DNA, 14 bp, Homo sapiens
ctgacccagcatct

SEQ ID NO: 3617985 - DNA, 16 bp, Homo sapiens
ctgacccagcatctcc

SEQ ID NO: 3617986 - DNA, 10 bp, Homo sapiens
ctgacccagt

SEQ ID NO: 3617987 - DNA, 18 bp, Homo sapiens
ctgacccagtgcccccac

SEQ ID NO: 3617988 - DNA, 21 bp, Homo sapiens
ctgaccccaagggggctgctg

SEQ ID NO: 3617989 - DNA, 21 bp, Homo sapiens
ctgacccccatctgagctggg

SEQ ID NO: 3617990 - DNA, 19 bp, Homo sapiens
ctgaccccgagaagtgctc

SEQ ID NO: 3617991 - DNA, 20 bp, Homo sapiens
ctgaccccgagaagtgctct

SEQ ID NO: 3617992 - DNA, 15 bp, Homo sapiens
ctgaccccgccatgc

SEQ ID NO: 3617993 - DNA, 14 bp, Homo sapiens
ctgacccctctggt

SEQ ID NO: 3617994 - DNA, 15 bp, Homo sapiens
ctgacccctctggtg

SEQ ID NO: 3617995 - DNA, 13 bp, Homo sapiens
ctgacccctgcct

SEQ ID NO: 3617996 - DNA, 14 bp, Homo sapiens
ctgacccctgcctg

SEQ ID NO: 3617997 - DNA, 13 bp, Homo sapiens
ctgaccctcaggc

SEQ ID NO: 3617998 - DNA, 16 bp, Homo sapiens
ctgaccctcaggcaca

SEQ ID NO: 3617999 - DNA, 20 bp, Homo sapiens
ctgaccctcaggcacacctt

SEQ ID NO: 3618000 - DNA, 20 bp, Homo sapiens
ctgacccttacagcctctga

SEQ ID NO: 3618001 - DNA, 22 bp, Homo sapiens
ctgacccttacagcctctgact

SEQ ID NO: 3618002 - DNA, 18 bp, Homo sapiens
ctgacctaccccagccag

SEQ ID NO: 3618003 - DNA, 19 bp, Homo sapiens
ctgacctaccccagccagg

SEQ ID NO: 3618004 - DNA, 21 bp, Homo sapiens
ctgacctaccccagccaggct

SEQ ID NO: 3618005 - DNA, 24 bp, Homo sapiens
ctgacctaccccagccaggctcct

SEQ ID NO: 3618006 - DNA, 16 bp, Homo sapiens
ctgacctcccaactct

SEQ ID NO: 3618007 - DNA, 19 bp, Homo sapiens
ctgaccttaaatgcaacca

SEQ ID NO: 3618008 - DNA, 18 bp, Homo sapiens
ctgaccttgggtcctgaa

SEQ ID NO: 3618009 - DNA, 22 bp, Homo sapiens
ctgactaaactttttttctgta

SEQ ID NO: 3618010 - DNA, 13 bp, Homo sapiens
ctgactagaactc

SEQ ID NO: 3618011 - DNA, 20 bp, Homo sapiens
ctgactcaattatttgcata

SEQ ID NO: 3618012 - DNA, 21 bp, Homo sapiens
ctgactcaattatttgcatat

SEQ ID NO: 3618013 - DNA, 20 bp, Homo sapiens
ctgactcagtgaccagtgcc

SEQ ID NO: 3618014 - DNA, 12 bp, Homo sapiens
ctgactccaaag

SEQ ID NO: 3618015 - DNA, 13 bp, Homo sapiens
ctgactcttattt

SEQ ID NO: 3618016 - DNA, 15 bp, Homo sapiens
ctgactcttattttt

SEQ ID NO: 3618017 - DNA, 14 bp, Homo sapiens
ctgactgaaggaaa

SEQ ID NO: 3618018 - DNA, 15 bp, Homo sapiens
ctgactgaaggaaaa

SEQ ID NO: 3618019 - DNA, 14 bp, Homo sapiens
ctgactgccaagcc

SEQ ID NO: 3618020 - DNA, 18 bp, Homo sapiens
ctgactggaggaggcctg

SEQ ID NO: 3618021 - DNA, 23 bp, Homo sapiens
ctgactggaggaggcctgtccca

SEQ ID NO: 3618022 - DNA, 16 bp, Homo sapiens
ctgactggccaaaccc

SEQ ID NO: 3618023 - DNA, 14 bp, Homo sapiens
ctgactgggggcag

SEQ ID NO: 3618024 - DNA, 17 bp, Homo sapiens
ctgactgggggcagaca

SEQ ID NO: 3618025 - DNA, 17 bp, Homo sapiens
ctgactgtactcctccc

SEQ ID NO: 3618026 - DNA, 23 bp, Homo sapiens
ctgacttatggcatgactcttca

SEQ ID NO: 3618027 - DNA, 16 bp, Homo sapiens
ctgacttctaagtaaa

SEQ ID NO: 3618028 - DNA, 20 bp, Homo sapiens
ctgactttccgagcctccag

SEQ ID NO: 3618029 - DNA, 14 bp, Homo sapiens
ctgactttggtttt

SEQ ID NO: 3618030 - DNA, 18 bp, Homo sapiens
ctgactttggtttttcca

SEQ ID NO: 3618031 - DNA, 12 bp, Homo sapiens
ctgagaaagact

SEQ ID NO: 3618032 - DNA, 15 bp, Homo sapiens
ctgagaaagactatt

SEQ ID NO: 3618033 - DNA, 20 bp, Homo sapiens
ctgagaaagactattcaaac

SEQ ID NO: 3618034 - DNA, 12 bp, Homo sapiens
ctgagaaggggc

SEQ ID NO: 3618035 - DNA, 14 bp, Homo sapiens
ctgagaaggggcag

SEQ ID NO: 3618036 - DNA, 11 bp, Homo sapiens
ctgagacaggt

SEQ ID NO: 3618037 - DNA, 15 bp, Homo sapiens
ctgagacaggtgcct

SEQ ID NO: 3618038 - DNA, 22 bp, Homo sapiens
ctgagacgccacggagggctgg

SEQ ID NO: 3618039 - DNA, 17 bp, Homo sapiens
ctgagagaccctggcct

SEQ ID NO: 3618040 - DNA, 18 bp, Homo sapiens
ctgagagaccctggcctc

SEQ ID NO: 3618041 - DNA, 19 bp, Homo sapiens
ctgagagcatctcaggagg

SEQ ID NO: 3618042 - DNA, 13 bp, Homo sapiens
ctgagagctgttt

SEQ ID NO: 3618043 - DNA, 14 bp, Homo sapiens
ctgagaggctgtct

SEQ ID NO: 3618044 - DNA, 20 bp, Homo sapiens
ctgagatgtgaacacatcag

SEQ ID NO: 3618045 - DNA, 21 bp, Homo sapiens
ctgagcaaatattaaaattgt

SEQ ID NO: 3618046 - DNA, 15 bp, Homo sapiens
ctgagcaaatgtggc

SEQ ID NO: 3618047 - DNA, 17 bp, Homo sapiens
ctgagcaaatgtggctc

SEQ ID NO: 3618048 - DNA, 20 bp, Homo sapiens
ctgagcaaatgtggctcctg

SEQ ID NO: 3618049 - DNA, 20 bp, Homo sapiens
ctgagcacttagcaggcacc

SEQ ID NO: 3618050 - DNA, 13 bp, Homo sapiens
ctgagcagccgcc

SEQ ID NO: 3618051 - DNA, 15 bp, Homo sapiens
ctgagcagccgccag

SEQ ID NO: 3618052 - DNA, 19 bp, Homo sapiens
ctgagcagggtccacagct

SEQ ID NO: 3618053 - DNA, 23 bp, Homo sapiens
ctgagcagggtccacagctggaa

SEQ ID NO: 3618054 - DNA, 14 bp, Homo sapiens
ctgagcaggtacat

SEQ ID NO: 3618055 - DNA, 21 bp, Homo sapiens
ctgagcaggtacatttctgat

SEQ ID NO: 3618056 - DNA, 21 bp, Homo sapiens
ctgagcagttgttatattcat

SEQ ID NO: 3618057 - DNA, 19 bp, Homo sapiens
ctgagcatggagacagcag

SEQ ID NO: 3618058 - DNA, 19 bp, Homo sapiens
ctgagccaaatttcttttg

SEQ ID NO: 3618059 - DNA, 15 bp, Homo sapiens
ctgagccagcagggc

SEQ ID NO: 3618060 - DNA, 15 bp, Homo sapiens
ctgagcccctgggga

SEQ ID NO: 3618061 - DNA, 17 bp, Homo sapiens
ctgagccctcctgaggg

SEQ ID NO: 3618062 - DNA, 21 bp, Homo sapiens
ctgagcggcaccctggtctgt

SEQ ID NO: 3618063 - DNA, 23 bp, Homo sapiens
ctgagcgtgctttccaaaaccca

SEQ ID NO: 3618064 - DNA, 14 bp, Homo sapiens
ctgagctggaaggg

SEQ ID NO: 3618065 - DNA, 12 bp, Homo sapiens
ctgagctgggga

SEQ ID NO: 3618066 - DNA, 14 bp, Homo sapiens
ctgagctggggaag

SEQ ID NO: 3618067 - DNA, 13 bp, Homo sapiens
ctgagctgggggg

SEQ ID NO: 3618068 - DNA, 21 bp, Homo sapiens
ctgaggaagacaagtgatgct

SEQ ID NO: 3618069 - DNA, 14 bp, Homo sapiens
ctgaggaccagcca

SEQ ID NO: 3618070 - DNA, 20 bp, Homo sapiens
ctgaggagatgaccagggat

SEQ ID NO: 3618071 - DNA, 23 bp, Homo sapiens
ctgaggcaccgtccaggccccac

SEQ ID NO: 3618072 - DNA, 17 bp, Homo sapiens
ctgaggccagaaaggtg

SEQ ID NO: 3618073 - DNA, 22 bp, Homo sapiens
ctgaggccagaaaggtgtgagg

SEQ ID NO: 3618074 - DNA, 15 bp, Homo sapiens
ctgaggcccctaggt

SEQ ID NO: 3618075 - DNA, 14 bp, Homo sapiens
ctgaggctgaggca

SEQ ID NO: 3618076 - DNA, 18 bp, Homo sapiens
ctgagggggtgggggtgc

SEQ ID NO: 3618077 - DNA, 23 bp, Homo sapiens
ctgagggggtgggggtgccgctg

SEQ ID NO: 3618078 - DNA, 21 bp, Homo sapiens
ctgagggggtgggggtgctgc

SEQ ID NO: 3618079 - DNA, 19 bp, Homo sapiens
ctgaggggtgggggtgccg

SEQ ID NO: 3618080 - DNA, 22 bp, Homo sapiens
ctgaggggtgggggtgccgctg

SEQ ID NO: 3618081 - DNA, 17 bp, Homo sapiens
ctgagggtccacctgga

SEQ ID NO: 3618082 - DNA, 19 bp, Homo sapiens
ctgagggtccacctggaga

SEQ ID NO: 3618083 - DNA, 15 bp, Homo sapiens
ctgagggtcgtggga

SEQ ID NO: 3618084 - DNA, 16 bp, Homo sapiens
ctgagggtcgtgggaa

SEQ ID NO: 3618085 - DNA, 22 bp, Homo sapiens
ctgagggtcgtgggaaagggga

SEQ ID NO: 3618086 - DNA, 16 bp, Homo sapiens
ctgaggtcactgctag

SEQ ID NO: 3618087 - DNA, 20 bp, Homo sapiens
ctgaggtccttatgtcctgt

SEQ ID NO: 3618088 - DNA, 15 bp, Homo sapiens
ctgaggtctcattca

SEQ ID NO: 3618089 - DNA, 17 bp, Homo sapiens
ctgagtagctctcctga

SEQ ID NO: 3618090 - DNA, 21 bp, Homo sapiens
ctgagtcaaatccagtggtgg

SEQ ID NO: 3618091 - DNA, 23 bp, Homo sapiens
ctgagtcaaatccagtggtgggt

SEQ ID NO: 3618092 - DNA, 22 bp, Homo sapiens
ctgagtcaccctacctgtgcct

SEQ ID NO: 3618093 - DNA, 23 bp, Homo sapiens
ctgagtgccccacttctggccac

SEQ ID NO: 3618094 - DNA, 17 bp, Homo sapiens
ctgagtggcagcagccc

SEQ ID NO: 3618095 - DNA, 14 bp, Homo sapiens
ctgataaactgacg

SEQ ID NO: 3618096 - DNA, 21 bp, Homo sapiens
ctgataccattctattctcca

SEQ ID NO: 3618097 - DNA, 18 bp, Homo sapiens
ctgatatcaacagcttcc

SEQ ID NO: 3618098 - DNA, 18 bp, Homo sapiens
ctgatcccaccccctcct

SEQ ID NO: 3618099 - DNA, 20 bp, Homo sapiens
ctgatcccaccccctcctcc

SEQ ID NO: 3618100 - DNA, 13 bp, Homo sapiens
ctgatgagagaat

SEQ ID NO: 3618101 - DNA, 19 bp, Homo sapiens
ctgatgagagaatgtggaa

SEQ ID NO: 3618102 - DNA, 17 bp, Homo sapiens
ctgatgattttcctttt

SEQ ID NO: 3618103 - DNA, 22 bp, Homo sapiens
ctgatgattttcctttttcttc

SEQ ID NO: 3618104 - DNA, 15 bp, Homo sapiens
ctgatgcaaggatta

SEQ ID NO: 3618105 - DNA, 19 bp, Homo sapiens
ctgatgcttttgtctaatt

SEQ ID NO: 3618106 - DNA, 13 bp, Homo sapiens
ctgatgttcctag

SEQ ID NO: 3618107 - DNA, 21 bp, Homo sapiens
ctgatgttcctagtgaaagag

SEQ ID NO: 3618108 - DNA, 20 bp, Homo sapiens
ctgattaaaaataccttcta

SEQ ID NO: 3618109 - DNA, 16 bp, Homo sapiens
ctgattagttgacagt

SEQ ID NO: 3618110 - DNA, 20 bp, Homo sapiens
ctgattcatagtaaaatacc

SEQ ID NO: 3618111 - DNA, 18 bp, Homo sapiens
ctgattcggggctgacct

SEQ ID NO: 3618112 - DNA, 19 bp, Homo sapiens
ctgattcggggctgacctt

SEQ ID NO: 3618113 - DNA, 16 bp, Homo sapiens
ctgattctgattgcta

SEQ ID NO: 3618114 - DNA, 13 bp, Homo sapiens
ctgattggctgct

SEQ ID NO: 3618115 - DNA, 13 bp, Homo sapiens
ctgattgtattta

SEQ ID NO: 3618116 - DNA, 22 bp, Homo sapiens
ctgattgtcaacacaaactggc

SEQ ID NO: 3618117 - DNA, 17 bp, Homo sapiens
ctgatttaggagaagcc

SEQ ID NO: 3618118 - DNA, 18 bp, Homo sapiens
ctgatttaggagaagcca

SEQ ID NO: 3618119 - DNA, 17 bp, Homo sapiens
ctgcaaaaaaagcctcc

SEQ ID NO: 3618120 - DNA, 19 bp, Homo sapiens
ctgcaaaaaaagcctccaa

SEQ ID NO: 3618121 - DNA, 20 bp, Homo sapiens
ctgcaaaactccaggcagga

SEQ ID NO: 3618122 - DNA, 22 bp, Homo sapiens
ctgcaaacacaccttggagaag

SEQ ID NO: 3618123 - DNA, 12 bp, Homo sapiens
ctgcaaagaaag

SEQ ID NO: 3618124 - DNA, 23 bp, Homo sapiens
ctgcaaagatctgtcctcagcct

SEQ ID NO: 3618125 - DNA, 19 bp, Homo sapiens
ctgcaaagcaaaacagact

SEQ ID NO: 3618126 - DNA, 20 bp, Homo sapiens
ctgcaaagcaaaacagactg

SEQ ID NO: 3618127 - DNA, 14 bp, Homo sapiens
ctgcaacctccgcc

SEQ ID NO: 3618128 - DNA, 20 bp, Homo sapiens
ctgcaacctccgccttccgg

SEQ ID NO: 3618129 - DNA, 17 bp, Homo sapiens
ctgcaacttccgctgag

SEQ ID NO: 3618130 - DNA, 23 bp, Homo sapiens
ctgcaacttccgctgaggggtct

SEQ ID NO: 3618131 - DNA, 15 bp, Homo sapiens
ctgcaagagccaagt

SEQ ID NO: 3618132 - DNA, 18 bp, Homo sapiens
ctgcaaggtttaggctgg

SEQ ID NO: 3618133 - DNA, 19 bp, Homo sapiens
ctgcaagtcagtccaggat

SEQ ID NO: 3618134 - DNA, 18 bp, Homo sapiens
ctgcacaaagcccttcca

SEQ ID NO: 3618135 - DNA, 21 bp, Homo sapiens
ctgcacaacagccctgcctga

SEQ ID NO: 3618136 - DNA, 13 bp, Homo sapiens
ctgcacacagggc

SEQ ID NO: 3618137 - DNA, 19 bp, Homo sapiens
ctgcacagacaagcagccc

SEQ ID NO: 3618138 - DNA, 18 bp, Homo sapiens
ctgcacagtgcatctcag

SEQ ID NO: 3618139 - DNA, 17 bp, Homo sapiens
ctgcacatgagtggaaa

SEQ ID NO: 3618140 - DNA, 13 bp, Homo sapiens
ctgcaccaaacct

SEQ ID NO: 3618141 - DNA, 19 bp, Homo sapiens
ctgcaccaccatgcccagc

SEQ ID NO: 3618142 - DNA, 18 bp, Homo sapiens
ctgcacccagaacagtgg

SEQ ID NO: 3618143 - DNA, 15 bp, Homo sapiens
ctgcaccccttcctg

SEQ ID NO: 3618144 - DNA, 17 bp, Homo sapiens
ctgcaccctgcgcctcc

SEQ ID NO: 3618145 - DNA, 21 bp, Homo sapiens
ctgcacctcctaccctcccac

SEQ ID NO: 3618146 - DNA, 22 bp, Homo sapiens
ctgcactcccacctgacacacc

SEQ ID NO: 3618147 - DNA, 19 bp, Homo sapiens
ctgcactgatgctgcccct

SEQ ID NO: 3618148 - DNA, 13 bp, Homo sapiens
ctgcagaacccac

SEQ ID NO: 3618149 - DNA, 14 bp, Homo sapiens
ctgcagaaggaaag

SEQ ID NO: 3618150 - DNA, 15 bp, Homo sapiens
ctgcagaaggaaaga

SEQ ID NO: 3618151 - DNA, 23 bp, Homo sapiens
ctgcagattagttctttttgcca

SEQ ID NO: 3618152 - DNA, 24 bp, Homo sapiens
ctgcagattagttctttttgccag

SEQ ID NO: 3618153 - DNA, 21 bp, Homo sapiens
ctgcagcagtcgcccaagcag

SEQ ID NO: 3618154 - DNA, 14 bp, Homo sapiens
ctgcagcccaggcc

SEQ ID NO: 3618155 - DNA, 20 bp, Homo sapiens
ctgcagccttcatcagaact

SEQ ID NO: 3618156 - DNA, 22 bp, Homo sapiens
ctgcagccttcatcagaactct

SEQ ID NO: 3618157 - DNA, 20 bp, Homo sapiens
ctgcaggaccctgtcctgca

SEQ ID NO: 3618158 - DNA, 21 bp, Homo sapiens
ctgcaggaccctgtcctgcag

SEQ ID NO: 3618159 - DNA, 13 bp, Homo sapiens
ctgcaggcaggcg

SEQ ID NO: 3618160 - DNA, 15 bp, Homo sapiens
ctgcaggcaggcggc

SEQ ID NO: 3618161 - DNA, 19 bp, Homo sapiens
ctgcaggcaggcggctcct

SEQ ID NO: 3618162 - DNA, 22 bp, Homo sapiens
ctgcaggcctaggtgcagctcc

SEQ ID NO: 3618163 - DNA, 17 bp, Homo sapiens
ctgcagggactgccagt

SEQ ID NO: 3618164 - DNA, 18 bp, Homo sapiens
ctgcagggccgggcaggg

SEQ ID NO: 3618165 - DNA, 19 bp, Homo sapiens
ctgcagggccgggcagggg

SEQ ID NO: 3618166 - DNA, 14 bp, Homo sapiens
ctgcagggcttctc

SEQ ID NO: 3618167 - DNA, 16 bp, Homo sapiens
ctgcaggggcctctgt

SEQ ID NO: 3618168 - DNA, 19 bp, Homo sapiens
ctgcaggggcctctgttcc

SEQ ID NO: 3618169 - DNA, 20 bp, Homo sapiens
ctgcagggggtgtgtctgct

SEQ ID NO: 3618170 - DNA, 16 bp, Homo sapiens
ctgcagtaaaacacat

SEQ ID NO: 3618171 - DNA, 17 bp, Homo sapiens
ctgcagtctggctgagc

SEQ ID NO: 3618172 - DNA, 21 bp, Homo sapiens
ctgcagtctggctgagccctg

SEQ ID NO: 3618173 - DNA, 15 bp, Homo sapiens
ctgcagtctttattt

SEQ ID NO: 3618174 - DNA, 23 bp, Homo sapiens
ctgcagtctttatttttttccca

SEQ ID NO: 3618175 - DNA, 15 bp, Homo sapiens
ctgcataccaacctg

SEQ ID NO: 3618176 - DNA, 15 bp, Homo sapiens
ctgcatatgaaagga

SEQ ID NO: 3618177 - DNA, 13 bp, Homo sapiens
ctgcatccagcct

SEQ ID NO: 3618178 - DNA, 16 bp, Homo sapiens
ctgcatctgaccagca

SEQ ID NO: 3618179 - DNA, 17 bp, Homo sapiens
ctgcatctgaccagcag

SEQ ID NO: 3618180 - DNA, 20 bp, Homo sapiens
ctgcatctgaccagcagcgc

SEQ ID NO: 3618181 - DNA, 21 bp, Homo sapiens
ctgcatctgaccagcagcgcc

SEQ ID NO: 3618182 - DNA, 13 bp, Homo sapiens
ctgcattctctcc

SEQ ID NO: 3618183 - DNA, 22 bp, Homo sapiens
ctgcattctctcccatcctggg

SEQ ID NO: 3618184 - DNA, 19 bp, Homo sapiens
ctgcatttataaagaccgt

SEQ ID NO: 3618185 - DNA, 17 bp, Homo sapiens
ctgcatttgtgaaatga

SEQ ID NO: 3618186 - DNA, 16 bp, Homo sapiens
ctgccaaaatgctcta

SEQ ID NO: 3618187 - DNA, 19 bp, Homo sapiens
ctgccaaaggatgtgatat

SEQ ID NO: 3618188 - DNA, 13 bp, Homo sapiens
ctgccaagccaga

SEQ ID NO: 3618189 - DNA, 23 bp, Homo sapiens
ctgccaagccagattctcttgaa

SEQ ID NO: 3618190 - DNA, 17 bp, Homo sapiens
ctgccaaggagcatcct

SEQ ID NO: 3618191 - DNA, 23 bp, Homo sapiens
ctgccaaggagcatccttggcag

SEQ ID NO: 3618192 - DNA, 15 bp, Homo sapiens
ctgccaataaattct

SEQ ID NO: 3618193 - DNA, 22 bp, Homo sapiens
ctgccaataaattctaaattac

SEQ ID NO: 3618194 - DNA, 17 bp, Homo sapiens
ctgccacacttcaggct

SEQ ID NO: 3618195 - DNA, 22 bp, Homo sapiens
ctgccacacttcaggctcttct

SEQ ID NO: 3618196 - DNA, 13 bp, Homo sapiens
ctgccacagagaa

SEQ ID NO: 3618197 - DNA, 14 bp, Homo sapiens
ctgccacatggagc

SEQ ID NO: 3618198 - DNA, 16 bp, Homo sapiens
ctgccacatggagccc

SEQ ID NO: 3618199 - DNA, 14 bp, Homo sapiens
ctgccacccacctc

SEQ ID NO: 3618200 - DNA, 11 bp, Homo sapiens
ctgccagctgc

SEQ ID NO: 3618201 - DNA, 16 bp, Homo sapiens
ctgccaggctgcctcc

SEQ ID NO: 3618202 - DNA, 20 bp, Homo sapiens
ctgccaggctgcctcctgcc

SEQ ID NO: 3618203 - DNA, 11 bp, Homo sapiens
ctgccagggcc

SEQ ID NO: 3618204 - DNA, 12 bp, Homo sapiens
ctgccagggctt

SEQ ID NO: 3618205 - DNA, 17 bp, Homo sapiens
ctgccagtgaagtcctt

SEQ ID NO: 3618206 - DNA, 20 bp, Homo sapiens
ctgccagtgaagtccttcag

SEQ ID NO: 3618207 - DNA, 23 bp, Homo sapiens
ctgccatcatgtttacagaggac

SEQ ID NO: 3618208 - DNA, 21 bp, Homo sapiens
ctgccatttcccttctggaca

SEQ ID NO: 3618209 - DNA, 20 bp, Homo sapiens
ctgcccaaacccttaactga

SEQ ID NO: 3618210 - DNA, 20 bp, Homo sapiens
ctgcccaacccttccctcac

SEQ ID NO: 3618211 - DNA, 15 bp, Homo sapiens
ctgcccacctggctg

SEQ ID NO: 3618212 - DNA, 16 bp, Homo sapiens
ctgcccacctggctgc

SEQ ID NO: 3618213 - DNA, 13 bp, Homo sapiens
ctgcccaggagac

SEQ ID NO: 3618214 - DNA, 19 bp, Homo sapiens
ctgcccaggcctgcctgtt

SEQ ID NO: 3618215 - DNA, 18 bp, Homo sapiens
ctgcccaggggagccctc

SEQ ID NO: 3618216 - DNA, 21 bp, Homo sapiens
ctgccccaagtggtgagcaag

SEQ ID NO: 3618217 - DNA, 13 bp, Homo sapiens
ctgccccacccca

SEQ ID NO: 3618218 - DNA, 16 bp, Homo sapiens
ctgccccaccccacct

SEQ ID NO: 3618219 - DNA, 12 bp, Homo sapiens
ctgccccagcct

SEQ ID NO: 3618220 - DNA, 19 bp, Homo sapiens
ctgccccagggctcccggc

SEQ ID NO: 3618221 - DNA, 13 bp, Homo sapiens
ctgccccatcctc

SEQ ID NO: 3618222 - DNA, 17 bp, Homo sapiens
ctgccccatcctccagc

SEQ ID NO: 3618223 - DNA, 21 bp, Homo sapiens
ctgccccatcctccagcaggg

SEQ ID NO: 3618224 - DNA, 23 bp, Homo sapiens
ctgcccccagaaagcctcctgcc

SEQ ID NO: 3618225 - DNA, 18 bp, Homo sapiens
ctgccccccctaagagac

SEQ ID NO: 3618226 - DNA, 12 bp, Homo sapiens
ctgccccctccc

SEQ ID NO: 3618227 - DNA, 20 bp, Homo sapiens
ctgccccctcccccatgggc

SEQ ID NO: 3618228 - DNA, 14 bp, Homo sapiens
ctgccccggcctcc

SEQ ID NO: 3618229 - DNA, 13 bp, Homo sapiens
ctgcccctccctt

SEQ ID NO: 3618230 - DNA, 14 bp, Homo sapiens
ctgcccctcccttc

SEQ ID NO: 3618231 - DNA, 17 bp, Homo sapiens
ctgcccctcccttcaac

SEQ ID NO: 3618232 - DNA, 18 bp, Homo sapiens
ctgcccctgcctgacagc

SEQ ID NO: 3618233 - DNA, 23 bp, Homo sapiens
ctgccccttaaacacaggctgtc

SEQ ID NO: 3618234 - DNA, 19 bp, Homo sapiens
ctgcccgcgggagacagct

SEQ ID NO: 3618235 - DNA, 16 bp, Homo sapiens
ctgccctaagccccca

SEQ ID NO: 3618236 - DNA, 18 bp, Homo sapiens
ctgccctaagcccccagg

SEQ ID NO: 3618237 - DNA, 19 bp, Homo sapiens
ctgccctaagcccccaggg

SEQ ID NO: 3618238 - DNA, 21 bp, Homo sapiens
ctgccctaagcccccagggcc

SEQ ID NO: 3618239 - DNA, 15 bp, Homo sapiens
ctgccctagctgacc

SEQ ID NO: 3618240 - DNA, 16 bp, Homo sapiens
ctgccctagctgaccc

SEQ ID NO: 3618241 - DNA, 20 bp, Homo sapiens
ctgccctctatttattagcc

SEQ ID NO: 3618242 - DNA, 13 bp, Homo sapiens
ctgccctggtgct

SEQ ID NO: 3618243 - DNA, 16 bp, Homo sapiens
ctgccctggtgctgcc

SEQ ID NO: 3618244 - DNA, 23 bp, Homo sapiens
ctgccctggtgctgccacacttc

SEQ ID NO: 3618245 - DNA, 15 bp, Homo sapiens
ctgcccttgctgccc

SEQ ID NO: 3618246 - DNA, 17 bp, Homo sapiens
ctgcccttgctgcccgc

SEQ ID NO: 3618247 - DNA, 21 bp, Homo sapiens
ctgccgagtggtcactgtcag

SEQ ID NO: 3618248 - DNA, 18 bp, Homo sapiens
ctgccggctctgggcctg

SEQ ID NO: 3618249 - DNA, 20 bp, Homo sapiens
ctgccggctctgggcctgag

SEQ ID NO: 3618250 - DNA, 22 bp, Homo sapiens
ctgccggctctgggcctgaggg

SEQ ID NO: 3618251 - DNA, 23 bp, Homo sapiens
ctgccggttcttaaatccatcct

SEQ ID NO: 3618252 - DNA, 21 bp, Homo sapiens
ctgccgtcacccactctgcac

SEQ ID NO: 3618253 - DNA, 23 bp, Homo sapiens
ctgcctaattttgccaaaatcct

SEQ ID NO: 3618254 - DNA, 21 bp, Homo sapiens
ctgcctagagtgtagcctaaa

SEQ ID NO: 3618255 - DNA, 13 bp, Homo sapiens
ctgcctcacctgg

SEQ ID NO: 3618256 - DNA, 23 bp, Homo sapiens
ctgcctcagcctccccagtagct

SEQ ID NO: 3618257 - DNA, 15 bp, Homo sapiens
ctgcctcaggaccca

SEQ ID NO: 3618258 - DNA, 22 bp, Homo sapiens
ctgcctccagaatggtctttct

SEQ ID NO: 3618259 - DNA, 13 bp, Homo sapiens
ctgcctccaggaa

SEQ ID NO: 3618260 - DNA, 20 bp, Homo sapiens
ctgcctcccctctccttcct

SEQ ID NO: 3618261 - DNA, 12 bp, Homo sapiens
ctgcctcctgcg

SEQ ID NO: 3618262 - DNA, 20 bp, Homo sapiens
ctgcctcggatccccttcct

SEQ ID NO: 3618263 - DNA, 21 bp, Homo sapiens
ctgcctctccctgggtctggg

SEQ ID NO: 3618264 - DNA, 12 bp, Homo sapiens
ctgcctcttcct

SEQ ID NO: 3618265 - DNA, 15 bp, Homo sapiens
ctgcctgacagcctt

SEQ ID NO: 3618266 - DNA, 22 bp, Homo sapiens
ctgcctgacagccttccccagc

SEQ ID NO: 3618267 - DNA, 18 bp, Homo sapiens
ctgcctgcatgagctggc

SEQ ID NO: 3618268 - DNA, 20 bp, Homo sapiens
ctgcctgccagctgcactga

SEQ ID NO: 3618269 - DNA, 14 bp, Homo sapiens
ctgcctgctgtgct

SEQ ID NO: 3618270 - DNA, 20 bp, Homo sapiens
ctgcctggagacaaggtgct

SEQ ID NO: 3618271 - DNA, 11 bp, Homo sapiens
ctgcctggagg

SEQ ID NO: 3618272 - DNA, 22 bp, Homo sapiens
ctgcctggaggcaaaggcctgg

SEQ ID NO: 3618273 - DNA, 22 bp, Homo sapiens
ctgcctggcacagaccaggcct

SEQ ID NO: 3618274 - DNA, 11 bp, Homo sapiens
ctgcctgggcc

SEQ ID NO: 3618275 - DNA, 22 bp, Homo sapiens
ctgcctgggccgtggcacagct

SEQ ID NO: 3618276 - DNA, 13 bp, Homo sapiens
ctgcctgtgggct

SEQ ID NO: 3618277 - DNA, 18 bp, Homo sapiens
ctgcctgttggcaggccc

SEQ ID NO: 3618278 - DNA, 19 bp, Homo sapiens
ctgcctgttggcaggccca

SEQ ID NO: 3618279 - DNA, 21 bp, Homo sapiens
ctgccttaatgacattcccct

SEQ ID NO: 3618280 - DNA, 15 bp, Homo sapiens
ctgccttcagggaga

SEQ ID NO: 3618281 - DNA, 18 bp, Homo sapiens
ctgccttcggtacccacc

SEQ ID NO: 3618282 - DNA, 12 bp, Homo sapiens
ctgccttctgct

SEQ ID NO: 3618283 - DNA, 14 bp, Homo sapiens
ctgccttctgctga

SEQ ID NO: 3618284 - DNA, 14 bp, Homo sapiens
ctgccttctttcca

SEQ ID NO: 3618285 - DNA, 17 bp, Homo sapiens
ctgccttctttccatca

SEQ ID NO: 3618286 - DNA, 19 bp, Homo sapiens
ctgccttgtttaatgttaa

SEQ ID NO: 3618287 - DNA, 15 bp, Homo sapiens
ctgcctttaagccaa

SEQ ID NO: 3618288 - DNA, 18 bp, Homo sapiens
ctgcctttaagccaaaga

SEQ ID NO: 3618289 - DNA, 19 bp, Homo sapiens
ctgcctttaagccaaagaa

SEQ ID NO: 3618290 - DNA, 20 bp, Homo sapiens
ctgcctttaagccaaagaaa

SEQ ID NO: 3618291 - DNA, 23 bp, Homo sapiens
ctgcctttaagccaaagaaacaa

SEQ ID NO: 3618292 - DNA, 21 bp, Homo sapiens
ctgcgaatctagaggaggggg

SEQ ID NO: 3618293 - DNA, 13 bp, Homo sapiens
ctgcgatgcagcg

SEQ ID NO: 3618294 - DNA, 14 bp, Homo sapiens
ctgcgcctccagag

SEQ ID NO: 3618295 - DNA, 22 bp, Homo sapiens
ctgcgctcttgggaccccagag

SEQ ID NO: 3618296 - DNA, 15 bp, Homo sapiens
ctgcgctgtgtacaa

SEQ ID NO: 3618297 - DNA, 17 bp, Homo sapiens
ctgcgtcggtcctggtg

SEQ ID NO: 3618298 - DNA, 21 bp, Homo sapiens
ctgctaagtcattggcaaagt

SEQ ID NO: 3618299 - DNA, 13 bp, Homo sapiens
ctgctacctgttc

SEQ ID NO: 3618300 - DNA, 16 bp, Homo sapiens
ctgctagagacgctga

SEQ ID NO: 3618301 - DNA, 13 bp, Homo sapiens
ctgctcagacaga

SEQ ID NO: 3618302 - DNA, 14 bp, Homo sapiens
ctgctcagccctgc

SEQ ID NO: 3618303 - DNA, 22 bp, Homo sapiens
ctgctcagggaaaagcagctct

SEQ ID NO: 3618304 - DNA, 13 bp, Homo sapiens
ctgctccaactcc

SEQ ID NO: 3618305 - DNA, 14 bp, Homo sapiens
ctgctccaactcca

SEQ ID NO: 3618306 - DNA, 20 bp, Homo sapiens
ctgctccaatgactgagcag

SEQ ID NO: 3618307 - DNA, 18 bp, Homo sapiens
ctgctccaccagcagcat

SEQ ID NO: 3618308 - DNA, 20 bp, Homo sapiens
ctgctccataccttttctct

SEQ ID NO: 3618309 - DNA, 20 bp, Homo sapiens
ctgctcccctaaagccaggc

SEQ ID NO: 3618310 - DNA, 21 bp, Homo sapiens
ctgctcccctaaagccaggct

SEQ ID NO: 3618311 - DNA, 22 bp, Homo sapiens
ctgctcccctaaagccaggctc

SEQ ID NO: 3618312 - DNA, 19 bp, Homo sapiens
ctgctcccctaaagcctca

SEQ ID NO: 3618313 - DNA, 21 bp, Homo sapiens
ctgctcctagagggaggggcc

SEQ ID NO: 3618314 - DNA, 11 bp, Homo sapiens
ctgctcctctt

SEQ ID NO: 3618315 - DNA, 12 bp, Homo sapiens
ctgctcctcttg

SEQ ID NO: 3618316 - DNA, 13 bp, Homo sapiens
ctgctcctgggca

SEQ ID NO: 3618317 - DNA, 12 bp, Homo sapiens
ctgctccttggc

SEQ ID NO: 3618318 - DNA, 18 bp, Homo sapiens
ctgctccttggcaccccc

SEQ ID NO: 3618319 - DNA, 15 bp, Homo sapiens
ctgctcggctactgg

SEQ ID NO: 3618320 - DNA, 16 bp, Homo sapiens
ctgctcggctactggt

SEQ ID NO: 3618321 - DNA, 22 bp, Homo sapiens
ctgctcggctactggttacctg

SEQ ID NO: 3618322 - DNA, 19 bp, Homo sapiens
ctgctcgtggactgtgctg

SEQ ID NO: 3618323 - DNA, 17 bp, Homo sapiens
ctgctctaacagccctc

SEQ ID NO: 3618324 - DNA, 17 bp, Homo sapiens
ctgctctataaatagta

SEQ ID NO: 3618325 - DNA, 21 bp, Homo sapiens
ctgctctataaatagtattcc

SEQ ID NO: 3618326 - DNA, 15 bp, Homo sapiens
ctgctctatactgtg

SEQ ID NO: 3618327 - DNA, 16 bp, Homo sapiens
ctgctctatactgtgg

SEQ ID NO: 3618328 - DNA, 18 bp, Homo sapiens
ctgctctatactgtggcc

SEQ ID NO: 3618329 - DNA, 21 bp, Homo sapiens
ctgctctatactgtggcctgc

SEQ ID NO: 3618330 - DNA, 22 bp, Homo sapiens
ctgctctatactgtggcctgca

SEQ ID NO: 3618331 - DNA, 13 bp, Homo sapiens
ctgctcttttcct

SEQ ID NO: 3618332 - DNA, 13 bp, Homo sapiens
ctgctgaaacaac

SEQ ID NO: 3618333 - DNA, 22 bp, Homo sapiens
ctgctgaatgcctcgctccctt

SEQ ID NO: 3618334 - DNA, 15 bp, Homo sapiens
ctgctgagttggcct

SEQ ID NO: 3618335 - DNA, 17 bp, Homo sapiens
ctgctgagttggcctgg

SEQ ID NO: 3618336 - DNA, 14 bp, Homo sapiens
ctgctgcagctccc

SEQ ID NO: 3618337 - DNA, 21 bp, Homo sapiens
ctgctgcagggtctttttcta

SEQ ID NO: 3618338 - DNA, 11 bp, Homo sapiens
ctgctgcagtt

SEQ ID NO: 3618339 - DNA, 14 bp, Homo sapiens
ctgctgcagttacc

SEQ ID NO: 3618340 - DNA, 18 bp, Homo sapiens
ctgctgcagttaccacag

SEQ ID NO: 3618341 - DNA, 13 bp, Homo sapiens
ctgctgccagtgc

SEQ ID NO: 3618342 - DNA, 19 bp, Homo sapiens
ctgctgccagtgcagccac

SEQ ID NO: 3618343 - DNA, 14 bp, Homo sapiens
ctgctgccgccgcc

SEQ ID NO: 3618344 - DNA, 15 bp, Homo sapiens
ctgctgccggctctg

SEQ ID NO: 3618345 - DNA, 15 bp, Homo sapiens
ctgctgcgctgcttg

SEQ ID NO: 3618346 - DNA, 16 bp, Homo sapiens
ctgctgctactgctgc

SEQ ID NO: 3618347 - DNA, 14 bp, Homo sapiens
ctgctgctcctctc

SEQ ID NO: 3618348 - DNA, 16 bp, Homo sapiens
ctgctgctgagacgcc

SEQ ID NO: 3618349 - DNA, 16 bp, Homo sapiens
ctgctgctgctgccgc

SEQ ID NO: 3618350 - DNA, 18 bp, Homo sapiens
ctgctggagtccagtgct

SEQ ID NO: 3618351 - DNA, 15 bp, Homo sapiens
ctgctggggaagaca

SEQ ID NO: 3618352 - DNA, 18 bp, Homo sapiens
ctgctggggaagacagtg

SEQ ID NO: 3618353 - DNA, 15 bp, Homo sapiens
ctgctgggtggcagg

SEQ ID NO: 3618354 - DNA, 19 bp, Homo sapiens
ctgctgtgccatgctgggc

SEQ ID NO: 3618355 - DNA, 15 bp, Homo sapiens
ctgctgtggagtgag

SEQ ID NO: 3618356 - DNA, 21 bp, Homo sapiens
ctgcttcatccaatgtgaagt

SEQ ID NO: 3618357 - DNA, 24 bp, Homo sapiens
ctgcttccaattttctggaataca

SEQ ID NO: 3618358 - DNA, 23 bp, Homo sapiens
ctgcttcccacaactactagtgt

SEQ ID NO: 3618359 - DNA, 20 bp, Homo sapiens
ctgcttctaggagaactttt

SEQ ID NO: 3618360 - DNA, 16 bp, Homo sapiens
ctgcttgactttccag

SEQ ID NO: 3618361 - DNA, 18 bp, Homo sapiens
ctgcttgactttccagaa

SEQ ID NO: 3618362 - DNA, 22 bp, Homo sapiens
ctgcttgactttccagaatgac

SEQ ID NO: 3618363 - DNA, 18 bp, Homo sapiens
ctgcttgcccgctcccac

SEQ ID NO: 3618364 - DNA, 11 bp, Homo sapiens
ctgcttggccc

SEQ ID NO: 3618365 - DNA, 23 bp, Homo sapiens
ctgctttgagctacaggacaaag

SEQ ID NO: 3618366 - DNA, 20 bp, Homo sapiens
ctgctttgggctgccctggt

SEQ ID NO: 3618367 - DNA, 21 bp, Homo sapiens
ctgctttgggctgccctggtg

SEQ ID NO: 3618368 - DNA, 22 bp, Homo sapiens
ctgctttgggctgccctggtgc

SEQ ID NO: 3618369 - DNA, 16 bp, Homo sapiens
ctgcttttctgtcctg

SEQ ID NO: 3618370 - DNA, 16 bp, Homo sapiens
ctggaaagcacaagac

SEQ ID NO: 3618371 - DNA, 23 bp, Homo sapiens
ctggaaagcacaagactggccca

SEQ ID NO: 3618372 - DNA, 23 bp, Homo sapiens
ctggaaagttgggcccctgagga

SEQ ID NO: 3618373 - DNA, 22 bp, Homo sapiens
ctggaacccagactcagacatt

SEQ ID NO: 3618374 - DNA, 15 bp, Homo sapiens
ctggaacctcagcct

SEQ ID NO: 3618375 - DNA, 18 bp, Homo sapiens
ctggaacctcagcctggc

SEQ ID NO: 3618376 - DNA, 20 bp, Homo sapiens
ctggaacctcagcctggcca

SEQ ID NO: 3618377 - DNA, 14 bp, Homo sapiens
ctggaacttgggga

SEQ ID NO: 3618378 - DNA, 17 bp, Homo sapiens
ctggaagaggccttccc

SEQ ID NO: 3618379 - DNA, 22 bp, Homo sapiens
ctggaagctctccgagctctgg

SEQ ID NO: 3618380 - DNA, 19 bp, Homo sapiens
ctggaagctttgtagaaat

SEQ ID NO: 3618381 - DNA, 18 bp, Homo sapiens
ctggaatccagaaggaag

SEQ ID NO: 3618382 - DNA, 21 bp, Homo sapiens
ctggaatccagaaggaagctc

SEQ ID NO: 3618383 - DNA, 14 bp, Homo sapiens
ctggaattcttctg

SEQ ID NO: 3618384 - DNA, 19 bp, Homo sapiens
ctggacaatctcacacctt

SEQ ID NO: 3618385 - DNA, 23 bp, Homo sapiens
ctggacaatctcacaccttagct

SEQ ID NO: 3618386 - DNA, 19 bp, Homo sapiens
ctggacacaataggtcttt

SEQ ID NO: 3618387 - DNA, 10 bp, Homo sapiens
ctggacacag

SEQ ID NO: 3618388 - DNA, 13 bp, Homo sapiens
ctggacacagctc

SEQ ID NO: 3618389 - DNA, 18 bp, Homo sapiens
ctggacacagctcttcat

SEQ ID NO: 3618390 - DNA, 22 bp, Homo sapiens
ctggacacttcacgcccttggc

SEQ ID NO: 3618391 - DNA, 15 bp, Homo sapiens
ctggacagccccacc

SEQ ID NO: 3618392 - DNA, 19 bp, Homo sapiens
ctggacagccccaccctgg

SEQ ID NO: 3618393 - DNA, 18 bp, Homo sapiens
ctggacatactgctggag

SEQ ID NO: 3618394 - DNA, 22 bp, Homo sapiens
ctggacatactgctggagtcca

SEQ ID NO: 3618395 - DNA, 14 bp, Homo sapiens
ctggaccactgggc

SEQ ID NO: 3618396 - DNA, 13 bp, Homo sapiens
ctggacctgggga

SEQ ID NO: 3618397 - DNA, 17 bp, Homo sapiens
ctggacggaagtggtgg

SEQ ID NO: 3618398 - DNA, 23 bp, Homo sapiens
ctggactagagggacctctccca

SEQ ID NO: 3618399 - DNA, 16 bp, Homo sapiens
ctggactattgtgcca

SEQ ID NO: 3618400 - DNA, 19 bp, Homo sapiens
ctggactcctctgtccagg

SEQ ID NO: 3618401 - DNA, 22 bp, Homo sapiens
ctggactcctctgtccaggcac

SEQ ID NO: 3618402 - DNA, 23 bp, Homo sapiens
ctggactctaaagtctgttgatt

SEQ ID NO: 3618403 - DNA, 20 bp, Homo sapiens
ctggactggaaagcacaaga

SEQ ID NO: 3618404 - DNA, 18 bp, Homo sapiens
ctggactgtcatagaaat

SEQ ID NO: 3618405 - DNA, 20 bp, Homo sapiens
ctggactgtcatagaaatta

SEQ ID NO: 3618406 - DNA, 15 bp, Homo sapiens
ctggactgttctgta

SEQ ID NO: 3618407 - DNA, 18 bp, Homo sapiens
ctggacttaagcatctgg

SEQ ID NO: 3618408 - DNA, 12 bp, Homo sapiens
ctggagaaagag

SEQ ID NO: 3618409 - DNA, 16 bp, Homo sapiens
ctggagaaagagctgc

SEQ ID NO: 3618410 - DNA, 17 bp, Homo sapiens
ctggagaaagagctgcc

SEQ ID NO: 3618411 - DNA, 19 bp, Homo sapiens
ctggagaaagagctgcctg

SEQ ID NO: 3618412 - DNA, 21 bp, Homo sapiens
ctggagaaagagctgcctgga

SEQ ID NO: 3618413 - DNA, 12 bp, Homo sapiens
ctggagaaagat

SEQ ID NO: 3618414 - DNA, 17 bp, Homo sapiens
ctggagacttcctctgg

SEQ ID NO: 3618415 - DNA, 16 bp, Homo sapiens
ctggagagcccagagt

SEQ ID NO: 3618416 - DNA, 17 bp, Homo sapiens
ctggagagcccagagtc

SEQ ID NO: 3618417 - DNA, 16 bp, Homo sapiens
ctggagatactggtgg

SEQ ID NO: 3618418 - DNA, 15 bp, Homo sapiens
ctggagatggaagct

SEQ ID NO: 3618419 - DNA, 17 bp, Homo sapiens
ctggagcaggagccccg

SEQ ID NO: 3618420 - DNA, 12 bp, Homo sapiens
ctggagcaggcc

SEQ ID NO: 3618421 - DNA, 14 bp, Homo sapiens
ctggagcaggccca

SEQ ID NO: 3618422 - DNA, 13 bp, Homo sapiens
ctggagccccatc

SEQ ID NO: 3618423 - DNA, 14 bp, Homo sapiens
ctggagcttcagcc

SEQ ID NO: 3618424 - DNA, 21 bp, Homo sapiens
ctggagcttcagccaggtctg

SEQ ID NO: 3618425 - DNA, 19 bp, Homo sapiens
ctggaggaggcctgtccca

SEQ ID NO: 3618426 - DNA, 12 bp, Homo sapiens
ctggaggcccag

SEQ ID NO: 3618427 - DNA, 13 bp, Homo sapiens
ctggaggcccagt

SEQ ID NO: 3618428 - DNA, 15 bp, Homo sapiens
ctggaggcccagttc

SEQ ID NO: 3618429 - DNA, 17 bp, Homo sapiens
ctggaggctcctctagg

SEQ ID NO: 3618430 - DNA, 21 bp, Homo sapiens
ctggaggctcctctaggccct

SEQ ID NO: 3618431 - DNA, 19 bp, Homo sapiens
ctggaggctgcctgctgtg

SEQ ID NO: 3618432 - DNA, 18 bp, Homo sapiens
ctggaggtctccaggggc

SEQ ID NO: 3618433 - DNA, 14 bp, Homo sapiens
ctggaggtctggct

SEQ ID NO: 3618434 - DNA, 18 bp, Homo sapiens
ctggaggtctggctgagc

SEQ ID NO: 3618435 - DNA, 19 bp, Homo sapiens
ctggaggtctggctgagcc

SEQ ID NO: 3618436 - DNA, 20 bp, Homo sapiens
ctggaggtctggctgagccc

SEQ ID NO: 3618437 - DNA, 20 bp, Homo sapiens
ctggaggtggctgagcccct

SEQ ID NO: 3618438 - DNA, 19 bp, Homo sapiens
ctggagttccttatccctc

SEQ ID NO: 3618439 - DNA, 15 bp, Homo sapiens
ctggagttgatctgg

SEQ ID NO: 3618440 - DNA, 20 bp, Homo sapiens
ctggagttgatctggaaccc

SEQ ID NO: 3618441 - DNA, 16 bp, Homo sapiens
ctggagttggggcaga

SEQ ID NO: 3618442 - DNA, 16 bp, Homo sapiens
ctggatccagcactgg

SEQ ID NO: 3618443 - DNA, 17 bp, Homo sapiens
ctggatccatcaggcca

SEQ ID NO: 3618444 - DNA, 19 bp, Homo sapiens
ctggatctcctcccttacc

SEQ ID NO: 3618445 - DNA, 14 bp, Homo sapiens
ctggatgagaaaca

SEQ ID NO: 3618446 - DNA, 20 bp, Homo sapiens
ctggatgagaaacagctcag

SEQ ID NO: 3618447 - DNA, 15 bp, Homo sapiens
ctggatgcccaggaa

SEQ ID NO: 3618448 - DNA, 17 bp, Homo sapiens
ctggatgctgttgaggg

SEQ ID NO: 3618449 - DNA, 23 bp, Homo sapiens
ctggatgctgttgagggccaaga

SEQ ID NO: 3618450 - DNA, 15 bp, Homo sapiens
ctggatgtaccacca

SEQ ID NO: 3618451 - DNA, 23 bp, Homo sapiens
ctggattggttggcaaactaaag

SEQ ID NO: 3618452 - DNA, 19 bp, Homo sapiens
ctggcaaaaggatctttgt

SEQ ID NO: 3618453 - DNA, 17 bp, Homo sapiens
ctggcaaatccaggctg

SEQ ID NO: 3618454 - DNA, 18 bp, Homo sapiens
ctggcaaatccaggctgg

SEQ ID NO: 3618455 - DNA, 15 bp, Homo sapiens
ctggcaacagagcga

SEQ ID NO: 3618456 - DNA, 15 bp, Homo sapiens
ctggcaaccagccag

SEQ ID NO: 3618457 - DNA, 17 bp, Homo sapiens
ctggcacaaaagacagc

SEQ ID NO: 3618458 - DNA, 21 bp, Homo sapiens
ctggcacaatgttggagcagc

SEQ ID NO: 3618459 - DNA, 18 bp, Homo sapiens
ctggcacagttttctgag

SEQ ID NO: 3618460 - DNA, 21 bp, Homo sapiens
ctggcacagttttctgagaaa

SEQ ID NO: 3618461 - DNA, 15 bp, Homo sapiens
ctggcaccatcagcc

SEQ ID NO: 3618462 - DNA, 17 bp, Homo sapiens
ctggcacgtgacaggct

SEQ ID NO: 3618463 - DNA, 19 bp, Homo sapiens
ctggcacgtgacaggctcg

SEQ ID NO: 3618464 - DNA, 22 bp, Homo sapiens
ctggcactggtttgttccctgt

SEQ ID NO: 3618465 - DNA, 12 bp, Homo sapiens
ctggcacttttt

SEQ ID NO: 3618466 - DNA, 20 bp, Homo sapiens
ctggcacttttttaaatata

SEQ ID NO: 3618467 - DNA, 22 bp, Homo sapiens
ctggcacttttttaaatataaa

SEQ ID NO: 3618468 - DNA, 20 bp, Homo sapiens
ctggcagcaccgcctcttcc

SEQ ID NO: 3618469 - DNA, 19 bp, Homo sapiens
ctggcagccgtgccttcag

SEQ ID NO: 3618470 - DNA, 21 bp, Homo sapiens
ctggcagctctggacagcccc

SEQ ID NO: 3618471 - DNA, 15 bp, Homo sapiens
ctggcagctgctgtg

SEQ ID NO: 3618472 - DNA, 16 bp, Homo sapiens
ctggcagctgctgtgg

SEQ ID NO: 3618473 - DNA, 16 bp, Homo sapiens
ctggcagggacctgag

SEQ ID NO: 3618474 - DNA, 17 bp, Homo sapiens
ctggcagggacctgaga

SEQ ID NO: 3618475 - DNA, 14 bp, Homo sapiens
ctggcagggccacc

SEQ ID NO: 3618476 - DNA, 20 bp, Homo sapiens
ctggcagggccacctgcagg

SEQ ID NO: 3618477 - DNA, 19 bp, Homo sapiens
ctggcaggggagacaggag

SEQ ID NO: 3618478 - DNA, 22 bp, Homo sapiens
ctggcaggggagacaggagcct

SEQ ID NO: 3618479 - DNA, 16 bp, Homo sapiens
ctggcattacagctgg

SEQ ID NO: 3618480 - DNA, 21 bp, Homo sapiens
ctggccacatcagccccacag

SEQ ID NO: 3618481 - DNA, 14 bp, Homo sapiens
ctggccactaaagc

SEQ ID NO: 3618482 - DNA, 17 bp, Homo sapiens
ctggccagacacaggcc

SEQ ID NO: 3618483 - DNA, 18 bp, Homo sapiens
ctggccaggcagggagag

SEQ ID NO: 3618484 - DNA, 21 bp, Homo sapiens
ctggccatttccaagaggctg

SEQ ID NO: 3618485 - DNA, 23 bp, Homo sapiens
ctggccatttccaagaggctgta

SEQ ID NO: 3618486 - DNA, 13 bp, Homo sapiens
ctggcccaccagg

SEQ ID NO: 3618487 - DNA, 14 bp, Homo sapiens
ctggcccagggccc

SEQ ID NO: 3618488 - DNA, 19 bp, Homo sapiens
ctggcccagggcccagagc

SEQ ID NO: 3618489 - DNA, 14 bp, Homo sapiens
ctggcccagtgcca

SEQ ID NO: 3618490 - DNA, 22 bp, Homo sapiens
ctggccccagtgcggttcctca

SEQ ID NO: 3618491 - DNA, 13 bp, Homo sapiens
ctggccctgccgt

SEQ ID NO: 3618492 - DNA, 14 bp, Homo sapiens
ctggccctggggat

SEQ ID NO: 3618493 - DNA, 20 bp, Homo sapiens
ctggccctggggatcttccc

SEQ ID NO: 3618494 - DNA, 21 bp, Homo sapiens
ctggccggagcaaactctgct

SEQ ID NO: 3618495 - DNA, 18 bp, Homo sapiens
ctggccggagtcagtgcc

SEQ ID NO: 3618496 - DNA, 20 bp, Homo sapiens
ctggcctagaaagggcaagg

SEQ ID NO: 3618497 - DNA, 17 bp, Homo sapiens
ctggcctgaactgagga

SEQ ID NO: 3618498 - DNA, 21 bp, Homo sapiens
ctggccttaaagagggacagg

SEQ ID NO: 3618499 - DNA, 22 bp, Homo sapiens
ctggccttaaagagggacaggc

SEQ ID NO: 3618500 - DNA, 20 bp, Homo sapiens
ctggcctttttcatttatct

SEQ ID NO: 3618501 - DNA, 23 bp, Homo sapiens
ctggcgacacactccgtccatcc

SEQ ID NO: 3618502 - DNA, 13 bp, Homo sapiens
ctggcgtgctcag

SEQ ID NO: 3618503 - DNA, 16 bp, Homo sapiens
ctggcgtgctcagacc

SEQ ID NO: 3618504 - DNA, 17 bp, Homo sapiens
ctggctcactggcaggt

SEQ ID NO: 3618505 - DNA, 19 bp, Homo sapiens
ctggctcactggcaggtgt

SEQ ID NO: 3618506 - DNA, 22 bp, Homo sapiens
ctggctccccaaggctgcaaag

SEQ ID NO: 3618507 - DNA, 22 bp, Homo sapiens
ctggctctaattcacagtgctc

SEQ ID NO: 3618508 - DNA, 23 bp, Homo sapiens
ctggctctaattcacagtgctct

SEQ ID NO: 3618509 - DNA, 20 bp, Homo sapiens
ctggctctgccccctccccc

SEQ ID NO: 3618510 - DNA, 17 bp, Homo sapiens
ctggctgagcccctggg

SEQ ID NO: 3618511 - DNA, 14 bp, Homo sapiens
ctggctgcacaggc

SEQ ID NO: 3618512 - DNA, 16 bp, Homo sapiens
ctggctgcacaggctg

SEQ ID NO: 3618513 - DNA, 17 bp, Homo sapiens
ctggctgggactgggaa

SEQ ID NO: 3618514 - DNA, 21 bp, Homo sapiens
ctggctggtgggcccccaatg

SEQ ID NO: 3618515 - DNA, 20 bp, Homo sapiens
ctggcttcaaaaagccacag

SEQ ID NO: 3618516 - DNA, 15 bp, Homo sapiens
ctggcttccctggaa

SEQ ID NO: 3618517 - DNA, 13 bp, Homo sapiens
ctggctttgcctc

SEQ ID NO: 3618518 - DNA, 14 bp, Homo sapiens
ctggctttgcctct

SEQ ID NO: 3618519 - DNA, 14 bp, Homo sapiens
ctggctttggcttc

SEQ ID NO: 3618520 - DNA, 22 bp, Homo sapiens
ctggcttttcactgctggctgc

SEQ ID NO: 3618521 - DNA, 11 bp, Homo sapiens
ctgggaaacag

SEQ ID NO: 3618522 - DNA, 15 bp, Homo sapiens
ctgggaacacatctg

SEQ ID NO: 3618523 - DNA, 18 bp, Homo sapiens
ctgggaacctagcacacc

SEQ ID NO: 3618524 - DNA, 22 bp, Homo sapiens
ctgggaagagaagagggcccag

SEQ ID NO: 3618525 - DNA, 23 bp, Homo sapiens
ctgggaagagaagagggcccagc

SEQ ID NO: 3618526 - DNA, 13 bp, Homo sapiens
ctgggaagccctt

SEQ ID NO: 3618527 - DNA, 14 bp, Homo sapiens
ctgggaagggagag

SEQ ID NO: 3618528 - DNA, 15 bp, Homo sapiens
ctgggaatgggagag

SEQ ID NO: 3618529 - DNA, 18 bp, Homo sapiens
ctgggaatgggagagggg

SEQ ID NO: 3618530 - DNA, 14 bp, Homo sapiens
ctgggacagctggc

SEQ ID NO: 3618531 - DNA, 16 bp, Homo sapiens
ctgggacagctggctg

SEQ ID NO: 3618532 - DNA, 18 bp, Homo sapiens
ctgggacagctggctggg

SEQ ID NO: 3618533 - DNA, 19 bp, Homo sapiens
ctgggacagctggctgggc

SEQ ID NO: 3618534 - DNA, 22 bp, Homo sapiens
ctgggacagctggctgggcctt

SEQ ID NO: 3618535 - DNA, 13 bp, Homo sapiens
ctgggacccacag

SEQ ID NO: 3618536 - DNA, 15 bp, Homo sapiens
ctgggacccacagaa

SEQ ID NO: 3618537 - DNA, 15 bp, Homo sapiens
ctgggacctgtggtc

SEQ ID NO: 3618538 - DNA, 23 bp, Homo sapiens
ctgggagagctggtggtgcagcc

SEQ ID NO: 3618539 - DNA, 12 bp, Homo sapiens
ctgggagcccag

SEQ ID NO: 3618540 - DNA, 15 bp, Homo sapiens
ctgggagcccagagg

SEQ ID NO: 3618541 - DNA, 17 bp, Homo sapiens
ctgggagccgcctgctt

SEQ ID NO: 3618542 - DNA, 22 bp, Homo sapiens
ctgggagcctggttcagacaca

SEQ ID NO: 3618543 - DNA, 15 bp, Homo sapiens
ctgggagctctgcag

SEQ ID NO: 3618544 - DNA, 13 bp, Homo sapiens
ctgggaggcagag

SEQ ID NO: 3618545 - DNA, 15 bp, Homo sapiens
ctgggagggaggtgg

SEQ ID NO: 3618546 - DNA, 19 bp, Homo sapiens
ctgggagggaggtggtcct

SEQ ID NO: 3618547 - DNA, 14 bp, Homo sapiens
ctgggagttgctgt

SEQ ID NO: 3618548 - DNA, 15 bp, Homo sapiens
ctgggatatggctgc

SEQ ID NO: 3618549 - DNA, 20 bp, Homo sapiens
ctgggatgggaggagaggac

SEQ ID NO: 3618550 - DNA, 19 bp, Homo sapiens
ctgggattaagaaaccttg

SEQ ID NO: 3618551 - DNA, 20 bp, Homo sapiens
ctgggattaagaaaccttgc

SEQ ID NO: 3618552 - DNA, 23 bp, Homo sapiens
ctgggattaagaaaccttgctct

SEQ ID NO: 3618553 - DNA, 20 bp, Homo sapiens
ctgggattataggcatgagc

SEQ ID NO: 3618554 - DNA, 21 bp, Homo sapiens
ctgggattataggcatgagcc

SEQ ID NO: 3618555 - DNA, 16 bp, Homo sapiens
ctgggcaaagaggatc

SEQ ID NO: 3618556 - DNA, 18 bp, Homo sapiens
ctgggcaaagcccctcac

SEQ ID NO: 3618557 - DNA, 12 bp, Homo sapiens
ctgggcacaaac

SEQ ID NO: 3618558 - DNA, 15 bp, Homo sapiens
ctgggcacacgctgc

SEQ ID NO: 3618559 - DNA, 16 bp, Homo sapiens
ctgggcacacgctgct

SEQ ID NO: 3618560 - DNA, 18 bp, Homo sapiens
ctgggcacacgctgctct

SEQ ID NO: 3618561 - DNA, 13 bp, Homo sapiens
ctgggcagaggga

SEQ ID NO: 3618562 - DNA, 23 bp, Homo sapiens
ctgggcaggtctcctctgggagg

SEQ ID NO: 3618563 - DNA, 15 bp, Homo sapiens
ctgggcatcctcagg

SEQ ID NO: 3618564 - DNA, 16 bp, Homo sapiens
ctgggcattagcaagg

SEQ ID NO: 3618565 - DNA, 22 bp, Homo sapiens
ctgggcattagcaaggcagagc

SEQ ID NO: 3618566 - DNA, 12 bp, Homo sapiens
ctgggccactgg

SEQ ID NO: 3618567 - DNA, 16 bp, Homo sapiens
ctgggccactggggac

SEQ ID NO: 3618568 - DNA, 22 bp, Homo sapiens
ctgggcccggaagggctttggt

SEQ ID NO: 3618569 - DNA, 16 bp, Homo sapiens
ctgggccctctttccc

SEQ ID NO: 3618570 - DNA, 22 bp, Homo sapiens
ctgggccctctttccctgcgag

SEQ ID NO: 3618571 - DNA, 23 bp, Homo sapiens
ctgggccggctgagtggcagcag

SEQ ID NO: 3618572 - DNA, 13 bp, Homo sapiens
ctgggcctgaggg

SEQ ID NO: 3618573 - DNA, 21 bp, Homo sapiens
ctgggcctgagggtccacctg

SEQ ID NO: 3618574 - DNA, 16 bp, Homo sapiens
ctgggcctttgcaaga

SEQ ID NO: 3618575 - DNA, 23 bp, Homo sapiens
ctgggcctttgcaagatgcttgg

SEQ ID NO: 3618576 - DNA, 19 bp, Homo sapiens
ctgggcgtccagctcagcc

SEQ ID NO: 3618577 - DNA, 23 bp, Homo sapiens
ctgggcgtccagctcagccctgg

SEQ ID NO: 3618578 - DNA, 22 bp, Homo sapiens
ctgggctcactgtgctggggca

SEQ ID NO: 3618579 - DNA, 15 bp, Homo sapiens
ctgggctcctcttag

SEQ ID NO: 3618580 - DNA, 13 bp, Homo sapiens
ctgggctctggaa

SEQ ID NO: 3618581 - DNA, 14 bp, Homo sapiens
ctgggctgggccct

SEQ ID NO: 3618582 - DNA, 16 bp, Homo sapiens
ctgggctgggccctct

SEQ ID NO: 3618583 - DNA, 17 bp, Homo sapiens
ctgggctgggccctctt

SEQ ID NO: 3618584 - DNA, 18 bp, Homo sapiens
ctgggctggggcctcaga

SEQ ID NO: 3618585 - DNA, 19 bp, Homo sapiens
ctgggctggttggagaagg

SEQ ID NO: 3618586 - DNA, 15 bp, Homo sapiens
ctgggcttagggtcc

SEQ ID NO: 3618587 - DNA, 16 bp, Homo sapiens
cttcctgctgcaccct

SEQ ID NO: 3618588 - DNA, 17 bp, Homo sapiens
cttcctgctgcaccctg

SEQ ID NO: 3618589 - DNA, 20 bp, Homo sapiens
cttcctgctgcaccctgcgc

SEQ ID NO: 3618590 - DNA, 23 bp, Homo sapiens
cttcctgctgcaccctgcgcctc

SEQ ID NO: 3618591 - DNA, 12 bp, Homo sapiens
cttcctgctgta

SEQ ID NO: 3618592 - DNA, 20 bp, Homo sapiens
cttcctggaaacagcatgaa

SEQ ID NO: 3618593 - DNA, 23 bp, Homo sapiens
cttcctggcacaatgttggagca

SEQ ID NO: 3618594 - DNA, 23 bp, Homo sapiens
cttcctggggcatctggcgaatc

SEQ ID NO: 3618595 - DNA, 14 bp, Homo sapiens
cttcctgtgccttt

SEQ ID NO: 3618596 - DNA, 20 bp, Homo sapiens
cttcctgtggatgcaaatag

SEQ ID NO: 3618597 - DNA, 23 bp, Homo sapiens
cttcctgtgtgtccaaaactgcc

SEQ ID NO: 3618598 - DNA, 13 bp, Homo sapiens
cttcctttcttga

SEQ ID NO: 3618599 - DNA, 21 bp, Homo sapiens
cttcgctggactattgtgcca

SEQ ID NO: 3618600 - DNA, 15 bp, Homo sapiens
cttcgggctgtgccc

SEQ ID NO: 3618601 - DNA, 13 bp, Homo sapiens
cttctaaaacaat

SEQ ID NO: 3618602 - DNA, 16 bp, Homo sapiens
cttctaaaacaataaa

SEQ ID NO: 3618603 - DNA, 22 bp, Homo sapiens
cttctaaattcccaaatcctag

SEQ ID NO: 3618604 - DNA, 17 bp, Homo sapiens
cttctaacatgaaatat

SEQ ID NO: 3618605 - DNA, 18 bp, Homo sapiens
cttctaacatgaaatata

SEQ ID NO: 3618606 - DNA, 13 bp, Homo sapiens
cttctaagtaaaa

SEQ ID NO: 3618607 - DNA, 16 bp, Homo sapiens
cttctactcctgcctc

SEQ ID NO: 3618608 - DNA, 17 bp, Homo sapiens
cttctactcctgcctca

SEQ ID NO: 3618609 - DNA, 16 bp, Homo sapiens
cttctaggagaacttt

SEQ ID NO: 3618610 - DNA, 19 bp, Homo sapiens
cttctagggttattgcatt

SEQ ID NO: 3618611 - DNA, 16 bp, Homo sapiens
cttctattaatcaaga

SEQ ID NO: 3618612 - DNA, 21 bp, Homo sapiens
cttctattatccagagtcatg

SEQ ID NO: 3618613 - DNA, 16 bp, Homo sapiens
cttctattttgtaaac

SEQ ID NO: 3618614 - DNA, 15 bp, Homo sapiens
cttctcactcaccac

SEQ ID NO: 3618615 - DNA, 14 bp, Homo sapiens
cttctcactgccat

SEQ ID NO: 3618616 - DNA, 15 bp, Homo sapiens
cttctcactgccatg

SEQ ID NO: 3618617 - DNA, 17 bp, Homo sapiens
cttctcactgccatgga

SEQ ID NO: 3618618 - DNA, 19 bp, Homo sapiens
cttctcagatttctgagga

SEQ ID NO: 3618619 - DNA, 13 bp, Homo sapiens
cttctccactgga

SEQ ID NO: 3618620 - DNA, 16 bp, Homo sapiens
cttctcccacatgagg

SEQ ID NO: 3618621 - DNA, 17 bp, Homo sapiens
cttctcccacatgaggc

SEQ ID NO: 3618622 - DNA, 13 bp, Homo sapiens
cttctcccagtgt

SEQ ID NO: 3618623 - DNA, 14 bp, Homo sapiens
cttctcctttcaca

SEQ ID NO: 3618624 - DNA, 20 bp, Homo sapiens
cttctcctttcacaaccttc

SEQ ID NO: 3618625 - DNA, 22 bp, Homo sapiens
cttctcctttcacaaccttctg

SEQ ID NO: 3618626 - DNA, 15 bp, Homo sapiens
cttctctctccaggg

SEQ ID NO: 3618627 - DNA, 15 bp, Homo sapiens
cttctctgcagtaaa

SEQ ID NO: 3618628 - DNA, 16 bp, Homo sapiens
cttctctgcctcacct

SEQ ID NO: 3618629 - DNA, 13 bp, Homo sapiens
cttctcttgcttt

SEQ ID NO: 3618630 - DNA, 16 bp, Homo sapiens
cttctcttgctttcta

SEQ ID NO: 3618631 - DNA, 16 bp, Homo sapiens
cttctcttgttaggta

SEQ ID NO: 3618632 - DNA, 13 bp, Homo sapiens
cttctctttctta

SEQ ID NO: 3618633 - DNA, 14 bp, Homo sapiens
cttctgaagctgct

SEQ ID NO: 3618634 - DNA, 22 bp, Homo sapiens
cttctgaagtctgagcccattt

SEQ ID NO: 3618635 - DNA, 15 bp, Homo sapiens
cttctgaataaagca

SEQ ID NO: 3618636 - DNA, 14 bp, Homo sapiens
cttctgaatatttt

SEQ ID NO: 3618637 - DNA, 19 bp, Homo sapiens
cttctgactagattattat

SEQ ID NO: 3618638 - DNA, 18 bp, Homo sapiens
cttctgcaagcctcatgc

SEQ ID NO: 3618639 - DNA, 11 bp, Homo sapiens
cttctgctact

SEQ ID NO: 3618640 - DNA, 13 bp, Homo sapiens
cttctgctactgg

SEQ ID NO: 3618641 - DNA, 13 bp, Homo sapiens
cttctgctgaaag

SEQ ID NO: 3618642 - DNA, 22 bp, Homo sapiens
cttctgctgaaagactcgagaa

SEQ ID NO: 3618643 - DNA, 15 bp, Homo sapiens
cttctggacactgag

SEQ ID NO: 3618644 - DNA, 19 bp, Homo sapiens
cttctggacactgagaggg

SEQ ID NO: 3618645 - DNA, 16 bp, Homo sapiens
cttctggccacatcag

SEQ ID NO: 3618646 - DNA, 15 bp, Homo sapiens
cttctggcctcccac

SEQ ID NO: 3618647 - DNA, 16 bp, Homo sapiens
cttctggcctcccaca

SEQ ID NO: 3618648 - DNA, 19 bp, Homo sapiens
cttctggcctcccacagac

SEQ ID NO: 3618649 - DNA, 18 bp, Homo sapiens
cttctggtgttgactgga

SEQ ID NO: 3618650 - DNA, 21 bp, Homo sapiens
cttctggtgttgactggactg

SEQ ID NO: 3618651 - DNA, 22 bp, Homo sapiens
cttctgtcttcacaacagatta

SEQ ID NO: 3618652 - DNA, 15 bp, Homo sapiens
cttcttaaaagtttc

SEQ ID NO: 3618653 - DNA, 14 bp, Homo sapiens
cttcttctctccac

SEQ ID NO: 3618654 - DNA, 22 bp, Homo sapiens
cttcttctgaagatcagaacat

SEQ ID NO: 3618655 - DNA, 12 bp, Homo sapiens
cttcttgaaggt

SEQ ID NO: 3618656 - DNA, 21 bp, Homo sapiens
cttcttgcttctttctagaaa

SEQ ID NO: 3618657 - DNA, 13 bp, Homo sapiens
cttctttccatca

SEQ ID NO: 3618658 - DNA, 12 bp, Homo sapiens
cttctttcctct

SEQ ID NO: 3618659 - DNA, 14 bp, Homo sapiens
cttctttcctctta

SEQ ID NO: 3618660 - DNA, 20 bp, Homo sapiens
cttctttctaatacaagcat

SEQ ID NO: 3618661 - DNA, 19 bp, Homo sapiens
cttctttctccatggagcc

SEQ ID NO: 3618662 - DNA, 16 bp, Homo sapiens
cttctttctgtcttta

SEQ ID NO: 3618663 - DNA, 17 bp, Homo sapiens
cttctttctgtctttaa

SEQ ID NO: 3618664 - DNA, 10 bp, Homo sapiens
cttctttctt

SEQ ID NO: 3618665 - DNA, 14 bp, Homo sapiens
cttctttgtgcctt

SEQ ID NO: 3618666 - DNA, 20 bp, Homo sapiens
cttctttgtgcctttggcct

SEQ ID NO: 3618667 - DNA, 21 bp, Homo sapiens
cttctttgtgcctttggcctg

SEQ ID NO: 3618668 - DNA, 16 bp, Homo sapiens
cttcttttcctgcagg

SEQ ID NO: 3618669 - DNA, 17 bp, Homo sapiens
cttgaaaagttcaggga

SEQ ID NO: 3618670 - DNA, 22 bp, Homo sapiens
cttgaaacagattcaggccagc

SEQ ID NO: 3618671 - DNA, 16 bp, Homo sapiens
cttgaaagttttccag

SEQ ID NO: 3618672 - DNA, 23 bp, Homo sapiens
cttgaaagttttccagtattgaa

SEQ ID NO: 3618673 - DNA, 17 bp, Homo sapiens
cttgaaattgattaact

SEQ ID NO: 3618674 - DNA, 19 bp, Homo sapiens
cttgaaattgattaactta

SEQ ID NO: 3618675 - DNA, 21 bp, Homo sapiens
cttgaacgagcagcccagggc

SEQ ID NO: 3618676 - DNA, 22 bp, Homo sapiens
cttgaaggtgctgacggccagg

SEQ ID NO: 3618677 - DNA, 19 bp, Homo sapiens
cttgaatattatacttctt

SEQ ID NO: 3618678 - DNA, 15 bp, Homo sapiens
cttgaatctttttat

SEQ ID NO: 3618679 - DNA, 17 bp, Homo sapiens
cttgaattccttgggga

SEQ ID NO: 3618680 - DNA, 13 bp, Homo sapiens
cttgaatttctgc

SEQ ID NO: 3618681 - DNA, 13 bp, Homo sapiens
cttgagaaccttt

SEQ ID NO: 3618682 - DNA, 14 bp, Homo sapiens
cttgagattcaaga

SEQ ID NO: 3618683 - DNA, 20 bp, Homo sapiens
cttgagattcaagacaagag

SEQ ID NO: 3618684 - DNA, 18 bp, Homo sapiens
cttgaggaaacaacagct

SEQ ID NO: 3618685 - DNA, 15 bp, Homo sapiens
cttgagtaagtgaag

SEQ ID NO: 3618686 - DNA, 18 bp, Homo sapiens
cttgagtataagaaatgc

SEQ ID NO: 3618687 - DNA, 19 bp, Homo sapiens
cttgagttaacaggacagt

SEQ ID NO: 3618688 - DNA, 18 bp, Homo sapiens
cttgagttcctctgcagt

SEQ ID NO: 3618689 - DNA, 16 bp, Homo sapiens
cttgataattttcctt

SEQ ID NO: 3618690 - DNA, 22 bp, Homo sapiens
cttgataattttcctttaatat

SEQ ID NO: 3618691 - DNA, 19 bp, Homo sapiens
cttgatatttaagcagctt

SEQ ID NO: 3618692 - DNA, 14 bp, Homo sapiens
cttgatctctcttg

SEQ ID NO: 3618693 - DNA, 13 bp, Homo sapiens
cttgatgtacata

SEQ ID NO: 3618694 - DNA, 17 bp, Homo sapiens
cttgattacttccactg

SEQ ID NO: 3618695 - DNA, 16 bp, Homo sapiens
cttgatttgagatttt

SEQ ID NO: 3618696 - DNA, 13 bp, Homo sapiens
cttgcaatctaat

SEQ ID NO: 3618697 - DNA, 18 bp, Homo sapiens
cttgcaatctaatctgaa

SEQ ID NO: 3618698 - DNA, 17 bp, Homo sapiens
cttgcagcggctcctgc

SEQ ID NO: 3618699 - DNA, 23 bp, Homo sapiens
cttgcatcaatttttcttatttc

SEQ ID NO: 3618700 - DNA, 18 bp, Homo sapiens
cttgcatctaaccaaaaa

SEQ ID NO: 3618701 - DNA, 16 bp, Homo sapiens
cttgcatggagaatgg

SEQ ID NO: 3618702 - DNA, 13 bp, Homo sapiens
cttgccagttttc

SEQ ID NO: 3618703 - DNA, 14 bp, Homo sapiens
cttgcccacaccga

SEQ ID NO: 3618704 - DNA, 19 bp, Homo sapiens
cttgcccgctcccacagct

SEQ ID NO: 3618705 - DNA, 22 bp, Homo sapiens
cttgccctttccccccatgttg

SEQ ID NO: 3618706 - DNA, 21 bp, Homo sapiens
cttgccgcgtcgccctcccag

SEQ ID NO: 3618707 - DNA, 13 bp, Homo sapiens
cttgctaccagta

SEQ ID NO: 3618708 - DNA, 14 bp, Homo sapiens
cttgctcattaatt

SEQ ID NO: 3618709 - DNA, 16 bp, Homo sapiens
cttgctcattaatttt

SEQ ID NO: 3618710 - DNA, 23 bp, Homo sapiens
cttgctccttttgctctttttgt

SEQ ID NO: 3618711 - DNA, 17 bp, Homo sapiens
cttgctgccatgatgta

SEQ ID NO: 3618712 - DNA, 11 bp, Homo sapiens
cttgctgctgc

SEQ ID NO: 3618713 - DNA, 23 bp, Homo sapiens
cttgctgggtacctggtccccac

SEQ ID NO: 3618714 - DNA, 12 bp, Homo sapiens
cttgctttcctg

SEQ ID NO: 3618715 - DNA, 15 bp, Homo sapiens
cttgctttcctgggc

SEQ ID NO: 3618716 - DNA, 17 bp, Homo sapiens
cttgctttcctgggcct

SEQ ID NO: 3618717 - DNA, 24 bp, Homo sapiens
cttgctttcggagctcctgtccaa

SEQ ID NO: 3618718 - DNA, 21 bp, Homo sapiens
cttgctttctatgctgtttgt

SEQ ID NO: 3618719 - DNA, 18 bp, Homo sapiens
cttgctttcttttttaaa

SEQ ID NO: 3618720 - DNA, 20 bp, Homo sapiens
cttgctttgagactcctcag

SEQ ID NO: 3618721 - DNA, 23 bp, Homo sapiens
cttgctttgagactcctcagcac

SEQ ID NO: 3618722 - DNA, 12 bp, Homo sapiens
cttggaaaaaca

SEQ ID NO: 3618723 - DNA, 23 bp, Homo sapiens
cttggaaaggggaggagcttctc

SEQ ID NO: 3618724 - DNA, 20 bp, Homo sapiens
cttggaaatcaaatgtaaag

SEQ ID NO: 3618725 - DNA, 21 bp, Homo sapiens
cttggaaatcaaatgtaaagt

SEQ ID NO: 3618726 - DNA, 12 bp, Homo sapiens
cttggaagccag

SEQ ID NO: 3618727 - DNA, 14 bp, Homo sapiens
cttggaagccaggt

SEQ ID NO: 3618728 - DNA, 15 bp, Homo sapiens
cttggaagccaggta

SEQ ID NO: 3618729 - DNA, 18 bp, Homo sapiens
cttggacattttatgtct

SEQ ID NO: 3618730 - DNA, 23 bp, Homo sapiens
cttggagaatgtgagaagccagc

SEQ ID NO: 3618731 - DNA, 18 bp, Homo sapiens
cttggagagggcccaggt

SEQ ID NO: 3618732 - DNA, 22 bp, Homo sapiens
cttggagccaatggagactgtc

SEQ ID NO: 3618733 - DNA, 15 bp, Homo sapiens
cttggaggagagaga

SEQ ID NO: 3618734 - DNA, 16 bp, Homo sapiens
cttggaggagagagac

SEQ ID NO: 3618735 - DNA, 19 bp, Homo sapiens
cttggcaccagacacccag

SEQ ID NO: 3618736 - DNA, 20 bp, Homo sapiens
cttggcaccagacacccagg

SEQ ID NO: 3618737 - DNA, 17 bp, Homo sapiens
cttggcacccccatgct

SEQ ID NO: 3618738 - DNA, 18 bp, Homo sapiens
cttggcacttattgaata

SEQ ID NO: 3618739 - DNA, 20 bp, Homo sapiens
cttggcacttattgaatata

SEQ ID NO: 3618740 - DNA, 21 bp, Homo sapiens
cttggcaggagtgggctctga

SEQ ID NO: 3618741 - DNA, 22 bp, Homo sapiens
cttggcccccttcaggagcctg

SEQ ID NO: 3618742 - DNA, 17 bp, Homo sapiens
cttggccgactcaggga

SEQ ID NO: 3618743 - DNA, 19 bp, Homo sapiens
cttggccgactcagggacc

SEQ ID NO: 3618744 - DNA, 20 bp, Homo sapiens
cttggcctcccaaagtgctg

SEQ ID NO: 3618745 - DNA, 23 bp, Homo sapiens
cttggcctcccaaagtgctggga

SEQ ID NO: 3618746 - DNA, 13 bp, Homo sapiens
cttggctgacccc

SEQ ID NO: 3618747 - DNA, 23 bp, Homo sapiens
cttggctttcagagccagcctgg

SEQ ID NO: 3618748 - DNA, 20 bp, Homo sapiens
cttggcttttactgaagcct

SEQ ID NO: 3618749 - DNA, 16 bp, Homo sapiens
cttgggaccccagaga

SEQ ID NO: 3618750 - DNA, 17 bp, Homo sapiens
cttgggatagtgttctg

SEQ ID NO: 3618751 - DNA, 23 bp, Homo sapiens
cttgggatagtgttctgctcctg

SEQ ID NO: 3618752 - DNA, 23 bp, Homo sapiens
cttggggagttaagacctggcag

SEQ ID NO: 3618753 - DNA, 22 bp, Homo sapiens
cttggggccactttcagagccc

SEQ ID NO: 3618754 - DNA, 18 bp, Homo sapiens
cttggggtccctccaccc

SEQ ID NO: 3618755 - DNA, 16 bp, Homo sapiens
cttgggtcacatgact

SEQ ID NO: 3618756 - DNA, 16 bp, Homo sapiens
cttggtaaaacattac

SEQ ID NO: 3618757 - DNA, 20 bp, Homo sapiens
cttggtgaatttttttttcc

SEQ ID NO: 3618758 - DNA, 21 bp, Homo sapiens
cttggtgacaaaattcatttg

SEQ ID NO: 3618759 - DNA, 18 bp, Homo sapiens
cttggttgtctccacaca

SEQ ID NO: 3618760 - DNA, 19 bp, Homo sapiens
cttggtttagaggaaccca

SEQ ID NO: 3618761 - DNA, 14 bp, Homo sapiens
cttgtaactaaaat

SEQ ID NO: 3618762 - DNA, 22 bp, Homo sapiens
cttgtaactaaaataattttgt

SEQ ID NO: 3618763 - DNA, 17 bp, Homo sapiens
cttgtaagatggataat

SEQ ID NO: 3618764 - DNA, 17 bp, Homo sapiens
cttgtaataaatactgc

SEQ ID NO: 3618765 - DNA, 14 bp, Homo sapiens
cttgtacagtctgc

SEQ ID NO: 3618766 - DNA, 21 bp, Homo sapiens
cttgtacagtctgctcctctt

SEQ ID NO: 3618767 - DNA, 21 bp, Homo sapiens
cttgtatagcatgaaataaaa

SEQ ID NO: 3618768 - DNA, 22 bp, Homo sapiens
cttgtataggttttaaagacct

SEQ ID NO: 3618769 - DNA, 15 bp, Homo sapiens
cttgtatattctatt

SEQ ID NO: 3618770 - DNA, 21 bp, Homo sapiens
cttgtatgaaagatggctgtg

SEQ ID NO: 3618771 - DNA, 17 bp, Homo sapiens
cttgtattatctccttt

SEQ ID NO: 3618772 - DNA, 20 bp, Homo sapiens
cttgtattccaagcatataa

SEQ ID NO: 3618773 - DNA, 20 bp, Homo sapiens
cttgtcacgatcacaggcct

SEQ ID NO: 3618774 - DNA, 22 bp, Homo sapiens
cttgtcactggtagaccaaaat

SEQ ID NO: 3618775 - DNA, 13 bp, Homo sapiens
cttgtcagtgtgt

SEQ ID NO: 3618776 - DNA, 14 bp, Homo sapiens
cttgtcagtgtgtc

SEQ ID NO: 3618777 - DNA, 21 bp, Homo sapiens
cttgtccctttccctaccttt

SEQ ID NO: 3618778 - DNA, 20 bp, Homo sapiens
cttgtcctttctctctaatt

SEQ ID NO: 3618779 - DNA, 16 bp, Homo sapiens
cttgtcgggggcccaa

SEQ ID NO: 3618780 - DNA, 12 bp, Homo sapiens
cttgtgattggc

SEQ ID NO: 3618781 - DNA, 18 bp, Homo sapiens
cttgtgattggctgcagg

SEQ ID NO: 3618782 - DNA, 14 bp, Homo sapiens
cttgtgatttccat

SEQ ID NO: 3618783 - DNA, 16 bp, Homo sapiens
cttgtggcagcctgat

SEQ ID NO: 3618784 - DNA, 15 bp, Homo sapiens
cttgtgttctgagta

SEQ ID NO: 3618785 - DNA, 13 bp, Homo sapiens
cttgttcctgaaa

SEQ ID NO: 3618786 - DNA, 21 bp, Homo sapiens
cttgttgaaaacccagactgt

SEQ ID NO: 3618787 - DNA, 21 bp, Homo sapiens
cttgttgatagtgatgtattt

SEQ ID NO: 3618788 - DNA, 14 bp, Homo sapiens
cttgtttgaatatt

SEQ ID NO: 3618789 - DNA, 15 bp, Homo sapiens
ctttaaaaaaataat

SEQ ID NO: 3618790 - DNA, 19 bp, Homo sapiens
ctttaaaaaacacagtcac

SEQ ID NO: 3618791 - DNA, 16 bp, Homo sapiens
ctttaaaaatgtctta

SEQ ID NO: 3618792 - DNA, 12 bp, Homo sapiens
ctttaaaacaaa

SEQ ID NO: 3618793 - DNA, 22 bp, Homo sapiens
ctttaaaacaaagggaaaaaag

SEQ ID NO: 3618794 - DNA, 22 bp, Homo sapiens
ctttaaagctgagagaccctgg

SEQ ID NO: 3618795 - DNA, 18 bp, Homo sapiens
ctttaaagggatggcaag

SEQ ID NO: 3618796 - DNA, 10 bp, Homo sapiens
ctttaaatta

SEQ ID NO: 3618797 - DNA, 13 bp, Homo sapiens
ctttaaattatat

SEQ ID NO: 3618798 - DNA, 21 bp, Homo sapiens
ctttaaattatatgatatgca

SEQ ID NO: 3618799 - DNA, 13 bp, Homo sapiens
ctttaacatcctt

SEQ ID NO: 3618800 - DNA, 19 bp, Homo sapiens
ctttaacttttttttctct

SEQ ID NO: 3618801 - DNA, 18 bp, Homo sapiens
ctttaagaaccttaatga

SEQ ID NO: 3618802 - DNA, 14 bp, Homo sapiens
ctttaagccaaaga

SEQ ID NO: 3618803 - DNA, 21 bp, Homo sapiens
ctttaagccaaagaaacaagc

SEQ ID NO: 3618804 - DNA, 23 bp, Homo sapiens
ctttaatgagtgcacctgcctcc

SEQ ID NO: 3618805 - DNA, 15 bp, Homo sapiens
ctttacaactaaata

SEQ ID NO: 3618806 - DNA, 15 bp, Homo sapiens
ctttacacctcgctg

SEQ ID NO: 3618807 - DNA, 23 bp, Homo sapiens
ctttactcctggctcaagccctg

SEQ ID NO: 3618808 - DNA, 22 bp, Homo sapiens
ctttagagaagtatacataagt

SEQ ID NO: 3618809 - DNA, 15 bp, Homo sapiens
ctttagatatttgcc

SEQ ID NO: 3618810 - DNA, 13 bp, Homo sapiens
ctttagcctgggc

SEQ ID NO: 3618811 - DNA, 15 bp, Homo sapiens
ctttagcttacctgg

SEQ ID NO: 3618812 - DNA, 16 bp, Homo sapiens
ctttagcttacctggg

SEQ ID NO: 3618813 - DNA, 21 bp, Homo sapiens
ctttagcttacctgggcacaa

SEQ ID NO: 3618814 - DNA, 19 bp, Homo sapiens
ctttagtgttctgtttgaa

SEQ ID NO: 3618815 - DNA, 23 bp, Homo sapiens
ctttagtgttctgtttgaaacta

SEQ ID NO: 3618816 - DNA, 19 bp, Homo sapiens
ctttataattctactttga

SEQ ID NO: 3618817 - DNA, 13 bp, Homo sapiens
ctttatctgtaat

SEQ ID NO: 3618818 - DNA, 16 bp, Homo sapiens
ctttatgcaaatacaa

SEQ ID NO: 3618819 - DNA, 22 bp, Homo sapiens
ctttatgcaaatacaatcagcc

SEQ ID NO: 3618820 - DNA, 22 bp, Homo sapiens
ctttattgccaaaacccagctg

SEQ ID NO: 3618821 - DNA, 23 bp, Homo sapiens
ctttattgccaaaacccagctgc

SEQ ID NO: 3618822 - DNA, 18 bp, Homo sapiens
ctttatttattaaacttc

SEQ ID NO: 3618823 - DNA, 15 bp, Homo sapiens
ctttatttttttccc

SEQ ID NO: 3618824 - DNA, 17 bp, Homo sapiens
ctttatttttttcccat

SEQ ID NO: 3618825 - DNA, 14 bp, Homo sapiens
ctttcacatttaaa

SEQ ID NO: 3618826 - DNA, 17 bp, Homo sapiens
ctttcagaatcttttca

SEQ ID NO: 3618827 - DNA, 19 bp, Homo sapiens
ctttcagagccagcctggc

SEQ ID NO: 3618828 - DNA, 21 bp, Homo sapiens
ctttcagagccagcctggctc

SEQ ID NO: 3618829 - DNA, 22 bp, Homo sapiens
ctttcagagccagcctggctct

SEQ ID NO: 3618830 - DNA, 18 bp, Homo sapiens
ctttcatgagtttttccc

SEQ ID NO: 3618831 - DNA, 22 bp, Homo sapiens
ctttcatgtcttgtcatacaaa

SEQ ID NO: 3618832 - DNA, 14 bp, Homo sapiens
ctttcatttgcttt

SEQ ID NO: 3618833 - DNA, 17 bp, Homo sapiens
ctttccaaaacatttct

SEQ ID NO: 3618834 - DNA, 17 bp, Homo sapiens
ctttccagaatgacctt

SEQ ID NO: 3618835 - DNA, 21 bp, Homo sapiens
ctttccagaatgaccttgagt

SEQ ID NO: 3618836 - DNA, 16 bp, Homo sapiens
ctttcccaactctagc

SEQ ID NO: 3618837 - DNA, 13 bp, Homo sapiens
ctttcccaccatt

SEQ ID NO: 3618838 - DNA, 21 bp, Homo sapiens
ctttccctaatttatcttcat

SEQ ID NO: 3618839 - DNA, 16 bp, Homo sapiens
ctttcctaaggctgca

SEQ ID NO: 3618840 - DNA, 17 bp, Homo sapiens
ctttcctaaggctgcaa

SEQ ID NO: 3618841 - DNA, 13 bp, Homo sapiens
ctttcctatcacc

SEQ ID NO: 3618842 - DNA, 15 bp, Homo sapiens
ctttcctcacatttg

SEQ ID NO: 3618843 - DNA, 15 bp, Homo sapiens
ctttcctctgcacgc

SEQ ID NO: 3618844 - DNA, 23 bp, Homo sapiens
ctttcctctgcacgctcaatgcc

SEQ ID NO: 3618845 - DNA, 13 bp, Homo sapiens
ctttcctgcatct

SEQ ID NO: 3618846 - DNA, 18 bp, Homo sapiens
ctttcctgggcctttgca

SEQ ID NO: 3618847 - DNA, 14 bp, Homo sapiens
ctttcggagctcct

SEQ ID NO: 3618848 - DNA, 17 bp, Homo sapiens
ctttctaatgtgtgaat

SEQ ID NO: 3618849 - DNA, 14 bp, Homo sapiens
ctttctagaaagaa

SEQ ID NO: 3618850 - DNA, 18 bp, Homo sapiens
ctttctagaaagaataaa

SEQ ID NO: 3618851 - DNA, 20 bp, Homo sapiens
ctttctagttcaatgcctca

SEQ ID NO: 3618852 - DNA, 17 bp, Homo sapiens
ctttctatataaaatgt

SEQ ID NO: 3618853 - DNA, 15 bp, Homo sapiens
ctttctatctcatct

SEQ ID NO: 3618854 - DNA, 23 bp, Homo sapiens
ctttctcctttgtactttgtgct

SEQ ID NO: 3618855 - DNA, 13 bp, Homo sapiens
ctttctcggggct

SEQ ID NO: 3618856 - DNA, 13 bp, Homo sapiens
ctttctctcagtg

SEQ ID NO: 3618857 - DNA, 15 bp, Homo sapiens
ctttctctcagtgaa

SEQ ID NO: 3618858 - DNA, 15 bp, Homo sapiens
ctttctctctcctct

SEQ ID NO: 3618859 - DNA, 19 bp, Homo sapiens
ctttctctctcctctctgc

SEQ ID NO: 3618860 - DNA, 12 bp, Homo sapiens
ctttctctgagg

SEQ ID NO: 3618861 - DNA, 19 bp, Homo sapiens
ctttctctgggcttagggt

SEQ ID NO: 3618862 - DNA, 9 bp, Homo sapiens
ctttctctt

SEQ ID NO: 3618863 - DNA, 21 bp, Homo sapiens
ctttctgagcaagaggatttt

SEQ ID NO: 3618864 - DNA, 17 bp, Homo sapiens
ctttctgctcagcttct

SEQ ID NO: 3618865 - DNA, 16 bp, Homo sapiens
ctttctgtaaccataa

SEQ ID NO: 3618866 - DNA, 16 bp, Homo sapiens
ctttcttattttgtaa

SEQ ID NO: 3618867 - DNA, 18 bp, Homo sapiens
ctttcttccacccacaaa

SEQ ID NO: 3618868 - DNA, 14 bp, Homo sapiens
ctttcttcctctgc

SEQ ID NO: 3618869 - DNA, 13 bp, Homo sapiens
ctttcttctttcc

SEQ ID NO: 3618870 - DNA, 13 bp, Homo sapiens
ctttcttgctccc

SEQ ID NO: 3618871 - DNA, 15 bp, Homo sapiens
ctttcttgctccctg

SEQ ID NO: 3618872 - DNA, 13 bp, Homo sapiens
ctttcttgggata

SEQ ID NO: 3618873 - DNA, 20 bp, Homo sapiens
ctttctttccgtcaccctgg

SEQ ID NO: 3618874 - DNA, 14 bp, Homo sapiens
ctttctttgcctct

SEQ ID NO: 3618875 - DNA, 15 bp, Homo sapiens
ctttctttgcctctg

SEQ ID NO: 3618876 - DNA, 17 bp, Homo sapiens
ctttctttgcctctgca

SEQ ID NO: 3618877 - DNA, 18 bp, Homo sapiens
ctttctttgcctctgcag

SEQ ID NO: 3618878 - DNA, 18 bp, Homo sapiens
ctttctttgtcattcagt

SEQ ID NO: 3618879 - DNA, 22 bp, Homo sapiens
ctttgaagtgcagctcatgttt

SEQ ID NO: 3618880 - DNA, 23 bp, Homo sapiens
ctttgaatatgtagtatctatat

SEQ ID NO: 3618881 - DNA, 18 bp, Homo sapiens
ctttgagactcctcagca

SEQ ID NO: 3618882 - DNA, 17 bp, Homo sapiens
ctttgatactaccaggg

SEQ ID NO: 3618883 - DNA, 21 bp, Homo sapiens
ctttgatactaccagggtctc

SEQ ID NO: 3618884 - DNA, 21 bp, Homo sapiens
ctttgatcgcctctttgacat

SEQ ID NO: 3618885 - DNA, 15 bp, Homo sapiens
ctttgcaagatgctt

SEQ ID NO: 3618886 - DNA, 18 bp, Homo sapiens
ctttgcaccaaagacatc

SEQ ID NO: 3618887 - DNA, 15 bp, Homo sapiens
ctttgcatattataa

SEQ ID NO: 3618888 - DNA, 17 bp, Homo sapiens
ctttgccaaggctctcc

SEQ ID NO: 3618889 - DNA, 23 bp, Homo sapiens
ctttgccaaggctctcccctctc

SEQ ID NO: 3618890 - DNA, 12 bp, Homo sapiens
ctttgcccaccc

SEQ ID NO: 3618891 - DNA, 14 bp, Homo sapiens
ctttgcccacccct

SEQ ID NO: 3618892 - DNA, 18 bp, Homo sapiens
ctttgcccacccctcact

SEQ ID NO: 3618893 - DNA, 22 bp, Homo sapiens
ctttgcccacccctcactcccc

SEQ ID NO: 3618894 - DNA, 19 bp, Homo sapiens
ctttgccgcttttgtgcct

SEQ ID NO: 3618895 - DNA, 18 bp, Homo sapiens
ctttgcctctgcagtctc

SEQ ID NO: 3618896 - DNA, 13 bp, Homo sapiens
ctttgcctcttct

SEQ ID NO: 3618897 - DNA, 15 bp, Homo sapiens
ctttgcctcttcttt

SEQ ID NO: 3618898 - DNA, 22 bp, Homo sapiens
ctttgcctttatctctgaggct

SEQ ID NO: 3618899 - DNA, 21 bp, Homo sapiens
ctttgctgccagctctcagga

SEQ ID NO: 3618900 - DNA, 11 bp, Homo sapiens
ctttgctgccc

SEQ ID NO: 3618901 - DNA, 17 bp, Homo sapiens
ctttgctgcccctgtct

SEQ ID NO: 3618902 - DNA, 18 bp, Homo sapiens
ctttgctgcccctgtctg

SEQ ID NO: 3618903 - DNA, 12 bp, Homo sapiens
ctttgctttctg

SEQ ID NO: 3618904 - DNA, 21 bp, Homo sapiens
ctttgctttctgctcagcttc

SEQ ID NO: 3618905 - DNA, 17 bp, Homo sapiens
ctttgctttgctttctg

SEQ ID NO: 3618906 - DNA, 20 bp, Homo sapiens
ctttggacacagtgttttat

SEQ ID NO: 3618907 - DNA, 22 bp, Homo sapiens
ctttggagagggaaaatcttca

SEQ ID NO: 3618908 - DNA, 14 bp, Homo sapiens
ctttggaggcccct

SEQ ID NO: 3618909 - DNA, 24 bp, Homo sapiens
ctttggcctggggtgcatctcctc

SEQ ID NO: 3618910 - DNA, 18 bp, Homo sapiens
ctttggctgcaggtgttc

SEQ ID NO: 3618911 - DNA, 18 bp, Homo sapiens
ctttggctggtagcagca

SEQ ID NO: 3618912 - DNA, 20 bp, Homo sapiens
ctttggctggtagcagcagg

SEQ ID NO: 3618913 - DNA, 12 bp, Homo sapiens
ctttgggagtcc

SEQ ID NO: 3618914 - DNA, 21 bp, Homo sapiens
ctttgggccagacatgccaca

SEQ ID NO: 3618915 - DNA, 15 bp, Homo sapiens
ctttgggctgccctg

SEQ ID NO: 3618916 - DNA, 20 bp, Homo sapiens
ctttgggctgccctggtgct

SEQ ID NO: 3618917 - DNA, 14 bp, Homo sapiens
ctttggtagaaaag

SEQ ID NO: 3618918 - DNA, 14 bp, Homo sapiens
ctttggtccttcaa

SEQ ID NO: 3618919 - DNA, 16 bp, Homo sapiens
ctttggttccttctct

SEQ ID NO: 3618920 - DNA, 20 bp, Homo sapiens
ctttggttccttctctgggt

SEQ ID NO: 3618921 - DNA, 16 bp, Homo sapiens
ctttgtaatactttct

SEQ ID NO: 3618922 - DNA, 22 bp, Homo sapiens
ctttgtacacccatgaaagaaa

SEQ ID NO: 3618923 - DNA, 19 bp, Homo sapiens
ctttgtaccttttgtagtt

SEQ ID NO: 3618924 - DNA, 18 bp, Homo sapiens
ctttgtagttactcaagc

SEQ ID NO: 3618925 - DNA, 18 bp, Homo sapiens
ctttgtatataggcttct

SEQ ID NO: 3618926 - DNA, 12 bp, Homo sapiens
ctttgtatgcac

SEQ ID NO: 3618927 - DNA, 14 bp, Homo sapiens
ctttgtcattcagt

SEQ ID NO: 3618928 - DNA, 12 bp, Homo sapiens
ctttgtctccaa

SEQ ID NO: 3618929 - DNA, 18 bp, Homo sapiens
ctttgtctccaaagaaga

SEQ ID NO: 3618930 - DNA, 14 bp, Homo sapiens
ctttgtctttcttt

SEQ ID NO: 3618931 - DNA, 13 bp, Homo sapiens
ctttgtgaccaga

SEQ ID NO: 3618932 - DNA, 14 bp, Homo sapiens
ctttgtgataattc

SEQ ID NO: 3618933 - DNA, 14 bp, Homo sapiens
ctttgtgcctttgg

SEQ ID NO: 3618934 - DNA, 20 bp, Homo sapiens
ctttgtgctttttgtcatgt

SEQ ID NO: 3618935 - DNA, 12 bp, Homo sapiens
ctttgtggccaa

SEQ ID NO: 3618936 - DNA, 13 bp, Homo sapiens
ctttgtggccaag

SEQ ID NO: 3618937 - DNA, 14 bp, Homo sapiens
ctttgtggccaagg

SEQ ID NO: 3618938 - DNA, 15 bp, Homo sapiens
ctttgtggccaagga

SEQ ID NO: 3618939 - DNA, 16 bp, Homo sapiens
ctttgtggccaaggag

SEQ ID NO: 3618940 - DNA, 20 bp, Homo sapiens
ctttgtggccaaggagctgc

SEQ ID NO: 3618941 - DNA, 23 bp, Homo sapiens
ctttgtgggaaacagagtccaat

SEQ ID NO: 3618942 - DNA, 18 bp, Homo sapiens
ctttgttctaaagatgga

SEQ ID NO: 3618943 - DNA, 18 bp, Homo sapiens
ctttgttcttcctgtctc

SEQ ID NO: 3618944 - DNA, 14 bp, Homo sapiens
ctttgttgtgagaa

SEQ ID NO: 3618945 - DNA, 23 bp, Homo sapiens
ctttgttgtgagaatggcctgga

SEQ ID NO: 3618946 - DNA, 19 bp, Homo sapiens
ctttgtttagtctttatac

SEQ ID NO: 3618947 - DNA, 15 bp, Homo sapiens
cttttaaattataca

SEQ ID NO: 3618948 - DNA, 19 bp, Homo sapiens
cttttaatccatttcagga

SEQ ID NO: 3618949 - DNA, 21 bp, Homo sapiens
cttttaatccatttcaggact

SEQ ID NO: 3618950 - DNA, 13 bp, Homo sapiens
cttttaatttaaa

SEQ ID NO: 3618951 - DNA, 19 bp, Homo sapiens
cttttatagagcatatttg

SEQ ID NO: 3618952 - DNA, 15 bp, Homo sapiens
cttttatattctaat

SEQ ID NO: 3618953 - DNA, 20 bp, Homo sapiens
cttttatattctaatagttt

SEQ ID NO: 3618954 - DNA, 22 bp, Homo sapiens
cttttatattctaatagttttt

SEQ ID NO: 3618955 - DNA, 20 bp, Homo sapiens
cttttatctccttgtggcct

SEQ ID NO: 3618956 - DNA, 22 bp, Homo sapiens
cttttatctgtttaaagcatat

SEQ ID NO: 3618957 - DNA, 14 bp, Homo sapiens
cttttatgtaaatt

SEQ ID NO: 3618958 - DNA, 23 bp, Homo sapiens
cttttatgtaaattttttacgta

SEQ ID NO: 3618959 - DNA, 22 bp, Homo sapiens
cttttatttttatttctgactc

SEQ ID NO: 3618960 - DNA, 12 bp, Homo sapiens
cttttcactgct

SEQ ID NO: 3618961 - DNA, 18 bp, Homo sapiens
cttttcactgctggctgc

SEQ ID NO: 3618962 - DNA, 20 bp, Homo sapiens
cttttcactgctggctgcct

SEQ ID NO: 3618963 - DNA, 18 bp, Homo sapiens
cttttcactgctgttata

SEQ ID NO: 3618964 - DNA, 20 bp, Homo sapiens
cttttcactgctgttatatt

SEQ ID NO: 3618965 - DNA, 14 bp, Homo sapiens
cttttcccttcttt

SEQ ID NO: 3618966 - DNA, 16 bp, Homo sapiens
cttttcctggcagctg

SEQ ID NO: 3618967 - DNA, 21 bp, Homo sapiens
cttttcctggcagctgctgtg

SEQ ID NO: 3618968 - DNA, 15 bp, Homo sapiens
cttttcctggtgctc

SEQ ID NO: 3618969 - DNA, 16 bp, Homo sapiens
cttttcctggtgctct

SEQ ID NO: 3618970 - DNA, 11 bp, Homo sapiens
cttttcctttg

SEQ ID NO: 3618971 - DNA, 22 bp, Homo sapiens
cttttctcaatattaagtcatt

SEQ ID NO: 3618972 - DNA, 17 bp, Homo sapiens
cttttctgccactccat

SEQ ID NO: 3618973 - DNA, 13 bp, Homo sapiens
cttttctgtcctg

SEQ ID NO: 3618974 - DNA, 22 bp, Homo sapiens
cttttctttgccatctctgctc

SEQ ID NO: 3618975 - DNA, 13 bp, Homo sapiens
cttttgaacccag

SEQ ID NO: 3618976 - DNA, 18 bp, Homo sapiens
cttttgaacccaggagtt

SEQ ID NO: 3618977 - DNA, 14 bp, Homo sapiens
cttttgaattgttt

SEQ ID NO: 3618978 - DNA, 12 bp, Homo sapiens
cttttgacactg

SEQ ID NO: 3618979 - DNA, 18 bp, Homo sapiens
cttttgacactgctctaa

SEQ ID NO: 3618980 - DNA, 14 bp, Homo sapiens
cttttgataagaaa

SEQ ID NO: 3618981 - DNA, 23 bp, Homo sapiens
cttttgatggtggccctgaacct

SEQ ID NO: 3618982 - DNA, 13 bp, Homo sapiens
cttttgccactcc

SEQ ID NO: 3618983 - DNA, 14 bp, Homo sapiens
cttttgctctctgt

SEQ ID NO: 3618984 - DNA, 23 bp, Homo sapiens
cttttggcaatgactcaaagtct

SEQ ID NO: 3618985 - DNA, 11 bp, Homo sapiens
cttttgggaag

SEQ ID NO: 3618986 - DNA, 21 bp, Homo sapiens
cttttgggaagaatccagtat

SEQ ID NO: 3618987 - DNA, 17 bp, Homo sapiens
cttttgggggtcagcat

SEQ ID NO: 3618988 - DNA, 10 bp, Homo sapiens
cttttgtaag

SEQ ID NO: 3618989 - DNA, 21 bp, Homo sapiens
cttttgtagttttatttgtat

SEQ ID NO: 3618990 - DNA, 14 bp, Homo sapiens
cttttgtcccagaa

SEQ ID NO: 3618991 - DNA, 18 bp, Homo sapiens
ctttttaaaaattgttat

SEQ ID NO: 3618992 - DNA, 22 bp, Homo sapiens
ctttttaatattgatatgctta

SEQ ID NO: 3618993 - DNA, 21 bp, Homo sapiens
ctttttacctggcctagaaag

SEQ ID NO: 3618994 - DNA, 16 bp, Homo sapiens
ctttttattaaaatat

SEQ ID NO: 3618995 - DNA, 15 bp, Homo sapiens
ctttttcatttatct

SEQ ID NO: 3618996 - DNA, 23 bp, Homo sapiens
ctttttcatttatctataattta

SEQ ID NO: 3618997 - DNA, 14 bp, Homo sapiens
ctttttgaggcaaa

SEQ ID NO: 3618998 - DNA, 22 bp, Homo sapiens
ctttttgccagttttccctgga

SEQ ID NO: 3618999 - DNA, 20 bp, Homo sapiens
ctttttggtttgccttttat

SEQ ID NO: 3619000 - DNA, 13 bp, Homo sapiens
ctttttgtcatgt

SEQ ID NO: 3619001 - DNA, 18 bp, Homo sapiens
cttttttaaaatcaactt

SEQ ID NO: 3619002 - DNA, 12 bp, Homo sapiens
cttttttatctg

SEQ ID NO: 3619003 - DNA, 16 bp, Homo sapiens
cttttttcaatatgca

SEQ ID NO: 3619004 - DNA, 22 bp, Homo sapiens
ctttttttctctgcatttaaaa

SEQ ID NO: 3619005 - DNA, 14 bp, Homo sapiens
ctttttttctgtac

SEQ ID NO: 3619006 - DNA, 16 bp, Homo sapiens
ctttttttctgtacca

SEQ ID NO: 3619007 - DNA, 20 bp, Homo sapiens
ctttttttctgtaccagtta

SEQ ID NO: 3619008 - DNA, 20 bp, Homo sapiens
ctttttttgctttaaaacaa

SEQ ID NO: 3619009 - DNA, 17 bp, Homo sapiens
cttttttttctctcttt

SEQ ID NO: 3619010 - DNA, 17 bp, Homo sapiens
gaaaaaaaaaaagaaag

SEQ ID NO: 3619011 - DNA, 20 bp, Homo sapiens
gaaaaaagagtttaaacaaa

SEQ ID NO: 3619012 - DNA, 15 bp, Homo sapiens
gaaaaacacgagaaa

SEQ ID NO: 3619013 - DNA, 14 bp, Homo sapiens
gaaaaagaagaaaa

SEQ ID NO: 3619014 - DNA, 13 bp, Homo sapiens
gaaaaagacataa

SEQ ID NO: 3619015 - DNA, 21 bp, Homo sapiens
gaaaaagacataaaacagaat

SEQ ID NO: 3619016 - DNA, 21 bp, Homo sapiens
gaaaaataataaagtcagaag

SEQ ID NO: 3619017 - DNA, 16 bp, Homo sapiens
gaaaaatctaagtgat

SEQ ID NO: 3619018 - DNA, 16 bp, Homo sapiens
gaaaaatggttgatgg

SEQ ID NO: 3619019 - DNA, 18 bp, Homo sapiens
gaaaaatggttgatggaa

SEQ ID NO: 3619020 - DNA, 21 bp, Homo sapiens
gaaaaatggttgatggaaaat

SEQ ID NO: 3619021 - DNA, 18 bp, Homo sapiens
gaaaacaaggtttccata

SEQ ID NO: 3619022 - DNA, 18 bp, Homo sapiens
gaaaaccaagccgtggct

SEQ ID NO: 3619023 - DNA, 19 bp, Homo sapiens
gaaaaccaagccgtggctt

SEQ ID NO: 3619024 - DNA, 21 bp, Homo sapiens
gaaaaccaagccgtggcttcc

SEQ ID NO: 3619025 - DNA, 22 bp, Homo sapiens
gaaaaccttaaaagtaataaag

SEQ ID NO: 3619026 - DNA, 16 bp, Homo sapiens
gaaaacgaagctcatt

SEQ ID NO: 3619027 - DNA, 18 bp, Homo sapiens
gaaaactaaggatttttc

SEQ ID NO: 3619028 - DNA, 13 bp, Homo sapiens
gaaaacttcaaag

SEQ ID NO: 3619029 - DNA, 14 bp, Homo sapiens
gaaaacttcaaagc

SEQ ID NO: 3619030 - DNA, 12 bp, Homo sapiens
gaaaagaaagaa

SEQ ID NO: 3619031 - DNA, 16 bp, Homo sapiens
gaaaagaacaaacaaa

SEQ ID NO: 3619032 - DNA, 21 bp, Homo sapiens
gaaaagactccaaagaaatgt

SEQ ID NO: 3619033 - DNA, 16 bp, Homo sapiens
gaaaagcagacatttt

SEQ ID NO: 3619034 - DNA, 15 bp, Homo sapiens
gaaaagccgaaaggg

SEQ ID NO: 3619035 - DNA, 21 bp, Homo sapiens
gaaaagctgccatttcccttc

SEQ ID NO: 3619036 - DNA, 14 bp, Homo sapiens
gaaaagtgcctgag

SEQ ID NO: 3619037 - DNA, 19 bp, Homo sapiens
gaaaagtgcctgagctggg

SEQ ID NO: 3619038 - DNA, 21 bp, Homo sapiens
gaaaagttatttatgctataa

SEQ ID NO: 3619039 - DNA, 20 bp, Homo sapiens
gaaaataaacatcagtttct

SEQ ID NO: 3619040 - DNA, 22 bp, Homo sapiens
gaaaataaatcttagtgttcaa

SEQ ID NO: 3619041 - DNA, 23 bp, Homo sapiens
gaaaataaatcttagtgttcaaa

SEQ ID NO: 3619042 - DNA, 14 bp, Homo sapiens
gaaaataactgaac

SEQ ID NO: 3619043 - DNA, 19 bp, Homo sapiens
gaaaataactgaaccaaat

SEQ ID NO: 3619044 - DNA, 14 bp, Homo sapiens
gaaaataatgtttg

SEQ ID NO: 3619045 - DNA, 15 bp, Homo sapiens
gaaaataatgtttga

SEQ ID NO: 3619046 - DNA, 15 bp, Homo sapiens
gaaaatattgtttta

SEQ ID NO: 3619047 - DNA, 16 bp, Homo sapiens
gaaaatcttcactttc

SEQ ID NO: 3619048 - DNA, 14 bp, Homo sapiens
gaaaatgaaatgca

SEQ ID NO: 3619049 - DNA, 17 bp, Homo sapiens
gaaaatgaagaaggaag

SEQ ID NO: 3619050 - DNA, 17 bp, Homo sapiens
gaaaatgacttatttct

SEQ ID NO: 3619051 - DNA, 14 bp, Homo sapiens
gaaaatgcagcagg

SEQ ID NO: 3619052 - DNA, 17 bp, Homo sapiens
gaaaatgtctgtaataa

SEQ ID NO: 3619053 - DNA, 22 bp, Homo sapiens
gaaaatgtctgtaataatagac

SEQ ID NO: 3619054 - DNA, 13 bp, Homo sapiens
gaaaatttaacag

SEQ ID NO: 3619055 - DNA, 17 bp, Homo sapiens
gaaacaacgttgctatt

SEQ ID NO: 3619056 - DNA, 14 bp, Homo sapiens
gaaacaacttggaa

SEQ ID NO: 3619057 - DNA, 15 bp, Homo sapiens
gaaacacaataccta

SEQ ID NO: 3619058 - DNA, 23 bp, Homo sapiens
gaaacactgaaatgaaatcttcc

SEQ ID NO: 3619059 - DNA, 16 bp, Homo sapiens
gaaacagaaaaataag

SEQ ID NO: 3619060 - DNA, 22 bp, Homo sapiens
gaaacagacttgtatattctat

SEQ ID NO: 3619061 - DNA, 20 bp, Homo sapiens
gaaacagagtggcctccctg

SEQ ID NO: 3619062 - DNA, 19 bp, Homo sapiens
gaaacagattcaggccagc

SEQ ID NO: 3619063 - DNA, 20 bp, Homo sapiens
gaaacagattcaggccagcc

SEQ ID NO: 3619064 - DNA, 21 bp, Homo sapiens
gaaacagattcaggccagccc

SEQ ID NO: 3619065 - DNA, 20 bp, Homo sapiens
gaaacagcatgaataaaaca

SEQ ID NO: 3619066 - DNA, 16 bp, Homo sapiens
gaaacagctcagccag

SEQ ID NO: 3619067 - DNA, 18 bp, Homo sapiens
gaaacagttggtaacttt

SEQ ID NO: 3619068 - DNA, 19 bp, Homo sapiens
gaaacagttggtaactttt

SEQ ID NO: 3619069 - DNA, 18 bp, Homo sapiens
gaaacagtttcttgcttg

SEQ ID NO: 3619070 - DNA, 13 bp, Homo sapiens
gaaaccagaaaag

SEQ ID NO: 3619071 - DNA, 16 bp, Homo sapiens
gaaaccagaaaagcaa

SEQ ID NO: 3619072 - DNA, 13 bp, Homo sapiens
gaaacccagagat

SEQ ID NO: 3619073 - DNA, 23 bp, Homo sapiens
gaaacccagagatgcctgatttc

SEQ ID NO: 3619074 - DNA, 18 bp, Homo sapiens
gaaacctgccaaggagca

SEQ ID NO: 3619075 - DNA, 22 bp, Homo sapiens
gaaacctgccaaggagcatcct

SEQ ID NO: 3619076 - DNA, 18 bp, Homo sapiens
gaaacctggggtgaatac

SEQ ID NO: 3619077 - DNA, 17 bp, Homo sapiens
gaaaccttccacccagt

SEQ ID NO: 3619078 - DNA, 15 bp, Homo sapiens
gaaaccttgctctcc

SEQ ID NO: 3619079 - DNA, 13 bp, Homo sapiens
gaaactacaaata

SEQ ID NO: 3619080 - DNA, 18 bp, Homo sapiens
gaaactgaggaattttct

SEQ ID NO: 3619081 - DNA, 14 bp, Homo sapiens
gaaactgaggccca

SEQ ID NO: 3619082 - DNA, 16 bp, Homo sapiens
gaaactgaggcccaga

SEQ ID NO: 3619083 - DNA, 17 bp, Homo sapiens
gaaactgaggcccagag

SEQ ID NO: 3619084 - DNA, 17 bp, Homo sapiens
gaaactgatgccaaggg

SEQ ID NO: 3619085 - DNA, 15 bp, Homo sapiens
gaaactgctgcagat

SEQ ID NO: 3619086 - DNA, 12 bp, Homo sapiens
gaaactggttta

SEQ ID NO: 3619087 - DNA, 14 bp, Homo sapiens
gaaactggtttata

SEQ ID NO: 3619088 - DNA, 19 bp, Homo sapiens
gaaactggtttataataaa

SEQ ID NO: 3619089 - DNA, 21 bp, Homo sapiens
gaaactgttcccacctgctgg

SEQ ID NO: 3619090 - DNA, 19 bp, Homo sapiens
gaaacttttaactgagaaa

SEQ ID NO: 3619091 - DNA, 14 bp, Homo sapiens
gaaagaaaatattt

SEQ ID NO: 3619092 - DNA, 15 bp, Homo sapiens
gaaagaaagaggaaa

SEQ ID NO: 3619093 - DNA, 20 bp, Homo sapiens
gaaagaacgctgatttaaag

SEQ ID NO: 3619094 - DNA, 15 bp, Homo sapiens
gaaagaagagaaaag

SEQ ID NO: 3619095 - DNA, 15 bp, Homo sapiens
gaaagaagcaagaca

SEQ ID NO: 3619096 - DNA, 14 bp, Homo sapiens
gaaagaagggggcc

SEQ ID NO: 3619097 - DNA, 20 bp, Homo sapiens
gaaagaagggggccctgcta

SEQ ID NO: 3619098 - DNA, 19 bp, Homo sapiens
gaaagactattcaaacagt

SEQ ID NO: 3619099 - DNA, 23 bp, Homo sapiens
gaaagactattcaaacagtctca

SEQ ID NO: 3619100 - DNA, 15 bp, Homo sapiens
gaaagacttctcaaa

SEQ ID NO: 3619101 - DNA, 14 bp, Homo sapiens
gaaagagagaagcc

SEQ ID NO: 3619102 - DNA, 15 bp, Homo sapiens
gaaagagagaagcca

SEQ ID NO: 3619103 - DNA, 17 bp, Homo sapiens
gaaagagagaagccagc

SEQ ID NO: 3619104 - DNA, 20 bp, Homo sapiens
gaaagagagaagccagccac

SEQ ID NO: 3619105 - DNA, 16 bp, Homo sapiens
gaaagagatacagagg

SEQ ID NO: 3619106 - DNA, 15 bp, Homo sapiens
gaaagagctgcctgg

SEQ ID NO: 3619107 - DNA, 16 bp, Homo sapiens
gaaagagctgcctgga

SEQ ID NO: 3619108 - DNA, 16 bp, Homo sapiens
gaaagaggaaaagaaa

SEQ ID NO: 3619109 - DNA, 18 bp, Homo sapiens
gaaagaggtgaaaatgaa

SEQ ID NO: 3619110 - DNA, 21 bp, Homo sapiens
gaaagaggtgaaaatgaagaa

SEQ ID NO: 3619111 - DNA, 22 bp, Homo sapiens
gaaagatgtgtttttgggaaga

SEQ ID NO: 3619112 - DNA, 16 bp, Homo sapiens
gaaagcaaaatacatc

SEQ ID NO: 3619113 - DNA, 20 bp, Homo sapiens
gaaagcaaaggtgcactcca

SEQ ID NO: 3619114 - DNA, 23 bp, Homo sapiens
gaaagcaaaggtgcactccagac

SEQ ID NO: 3619115 - DNA, 19 bp, Homo sapiens
gaaagcacaagactggccc

SEQ ID NO: 3619116 - DNA, 16 bp, Homo sapiens
gaaagcagagcctcct

SEQ ID NO: 3619117 - DNA, 21 bp, Homo sapiens
gaaagcagagcctcctgggaa

SEQ ID NO: 3619118 - DNA, 22 bp, Homo sapiens
gaaagcagagcctcctgggaac

SEQ ID NO: 3619119 - DNA, 13 bp, Homo sapiens
gaaagccacatct

SEQ ID NO: 3619120 - DNA, 21 bp, Homo sapiens
gaaagcctcctgccccctgcc

SEQ ID NO: 3619121 - DNA, 17 bp, Homo sapiens
gaaagcgggcagccccg

SEQ ID NO: 3619122 - DNA, 21 bp, Homo sapiens
gaaaggatggagtgttttagt

SEQ ID NO: 3619123 - DNA, 12 bp, Homo sapiens
gaaaggatttta

SEQ ID NO: 3619124 - DNA, 19 bp, Homo sapiens
gaaaggattttaccaaagc

SEQ ID NO: 3619125 - DNA, 20 bp, Homo sapiens
gaaaggattttaccaaagca

SEQ ID NO: 3619126 - DNA, 14 bp, Homo sapiens
gaaaggccagcagc

SEQ ID NO: 3619127 - DNA, 18 bp, Homo sapiens
gaaagggattgctgaggc

SEQ ID NO: 3619128 - DNA, 13 bp, Homo sapiens
gaaaggggagccc

SEQ ID NO: 3619129 - DNA, 15 bp, Homo sapiens
gaaaggggagtaggt

SEQ ID NO: 3619130 - DNA, 20 bp, Homo sapiens
gaaaggggagtaggtggggg

SEQ ID NO: 3619131 - DNA, 21 bp, Homo sapiens
gaaaggggagtaggtggggga

SEQ ID NO: 3619132 - DNA, 23 bp, Homo sapiens
gaaagggttaatcatatttgaaa

SEQ ID NO: 3619133 - DNA, 17 bp, Homo sapiens
gaaaggtgtgaggagag

SEQ ID NO: 3619134 - DNA, 20 bp, Homo sapiens
gaaagtaagcatttccagcc

SEQ ID NO: 3619135 - DNA, 21 bp, Homo sapiens
gaaagtcaggctagctgtgct

SEQ ID NO: 3619136 - DNA, 22 bp, Homo sapiens
gaaagtcaggctagctgtgctg

SEQ ID NO: 3619137 - DNA, 21 bp, Homo sapiens
gaaagtgggaggtcaggaaac

SEQ ID NO: 3619138 - DNA, 11 bp, Homo sapiens
gaaagtgtatt

SEQ ID NO: 3619139 - DNA, 23 bp, Homo sapiens
gaaagtgtatttggaaataaagt

SEQ ID NO: 3619140 - DNA, 15 bp, Homo sapiens
gaaagtgtgagctct

SEQ ID NO: 3619141 - DNA, 13 bp, Homo sapiens
gaaagttctggaa

SEQ ID NO: 3619142 - DNA, 22 bp, Homo sapiens
gaaagttgtaaaatagaaaaag

SEQ ID NO: 3619143 - DNA, 19 bp, Homo sapiens
gaaataaaccaaaggaaaa

SEQ ID NO: 3619144 - DNA, 19 bp, Homo sapiens
gaaataaagtcagatggaa

SEQ ID NO: 3619145 - DNA, 12 bp, Homo sapiens
gaaataaatgaa

SEQ ID NO: 3619146 - DNA, 13 bp, Homo sapiens
gaaataaatgaaa

SEQ ID NO: 3619147 - DNA, 15 bp, Homo sapiens
gaaataacaaaatgg

SEQ ID NO: 3619148 - DNA, 16 bp, Homo sapiens
gaaataacaaaatgga

SEQ ID NO: 3619149 - DNA, 18 bp, Homo sapiens
gaaataacaaaatggaca

SEQ ID NO: 3619150 - DNA, 19 bp, Homo sapiens
gaaataacaaaatggacat

SEQ ID NO: 3619151 - DNA, 15 bp, Homo sapiens
gaaataataatattt

SEQ ID NO: 3619152 - DNA, 11 bp, Homo sapiens
gaaatacaaaa

SEQ ID NO: 3619153 - DNA, 21 bp, Homo sapiens
gaaatactgtatggttttgtt

SEQ ID NO: 3619154 - DNA, 18 bp, Homo sapiens
gaaatatatttgtcactt

SEQ ID NO: 3619155 - DNA, 23 bp, Homo sapiens
gaaatatcaaagtcattaaagac

SEQ ID NO: 3619156 - DNA, 13 bp, Homo sapiens
gaaatatccagga

SEQ ID NO: 3619157 - DNA, 16 bp, Homo sapiens
gaaatcaaatatgcaa

SEQ ID NO: 3619158 - DNA, 17 bp, Homo sapiens
gaaatccagaagtttta

SEQ ID NO: 3619159 - DNA, 19 bp, Homo sapiens
gaaatgacggtgttaattt

SEQ ID NO: 3619160 - DNA, 23 bp, Homo sapiens
gaaatgaggtctgtttaaagtgg

SEQ ID NO: 3619161 - DNA, 24 bp, Homo sapiens
gaaatgctgttggtaaagcacatg

SEQ ID NO: 3619162 - DNA, 19 bp, Homo sapiens
gaaatgcttttatattcta

SEQ ID NO: 3619163 - DNA, 18 bp, Homo sapiens
gaaatggctatgaacaga

SEQ ID NO: 3619164 - DNA, 21 bp, Homo sapiens
gaaatggtttcacttgctctt

SEQ ID NO: 3619165 - DNA, 18 bp, Homo sapiens
gaaatgtagatgatatgt

SEQ ID NO: 3619166 - DNA, 14 bp, Homo sapiens
gaaatgtatgtgtg

SEQ ID NO: 3619167 - DNA, 15 bp, Homo sapiens
gaaattaaacatatt

SEQ ID NO: 3619168 - DNA, 20 bp, Homo sapiens
gaaattataactattacagt

SEQ ID NO: 3619169 - DNA, 16 bp, Homo sapiens
gaaattggaagagcac

SEQ ID NO: 3619170 - DNA, 23 bp, Homo sapiens
gaaatttgggagagccatacata

SEQ ID NO: 3619171 - DNA, 20 bp, Homo sapiens
gaaatttgttatacttcaaa

SEQ ID NO: 3619172 - DNA, 18 bp, Homo sapiens
gaaatttttattaaatta

SEQ ID NO: 3619173 - DNA, 20 bp, Homo sapiens
gaacaatattgactttgtct

SEQ ID NO: 3619174 - DNA, 21 bp, Homo sapiens
gaacaattttttttaattggc

SEQ ID NO: 3619175 - DNA, 11 bp, Homo sapiens
gaacactgaca

SEQ ID NO: 3619176 - DNA, 14 bp, Homo sapiens
gaacactgagaaag

SEQ ID NO: 3619177 - DNA, 23 bp, Homo sapiens
gaacaggaaaataaaatatttaa

SEQ ID NO: 3619178 - DNA, 12 bp, Homo sapiens
gaacaggaaaga

SEQ ID NO: 3619179 - DNA, 14 bp, Homo sapiens
gaacataaaaagga

SEQ ID NO: 3619180 - DNA, 16 bp, Homo sapiens
gaacatcccgcttctg

SEQ ID NO: 3619181 - DNA, 16 bp, Homo sapiens
gaacatgaaatgccct

SEQ ID NO: 3619182 - DNA, 23 bp, Homo sapiens
gaacatgttttatactgctctat

SEQ ID NO: 3619183 - DNA, 18 bp, Homo sapiens
gaacattcagctctggag

SEQ ID NO: 3619184 - DNA, 19 bp, Homo sapiens
gaacattcagctctggaga

SEQ ID NO: 3619185 - DNA, 15 bp, Homo sapiens
gaacattggttcttt

SEQ ID NO: 3619186 - DNA, 13 bp, Homo sapiens
gaaccaaagctca

SEQ ID NO: 3619187 - DNA, 14 bp, Homo sapiens
gaaccaaattgcac

SEQ ID NO: 3619188 - DNA, 17 bp, Homo sapiens
gaaccaaattgcactga

SEQ ID NO: 3619189 - DNA, 19 bp, Homo sapiens
gaaccaaattgcactgaag

SEQ ID NO: 3619190 - DNA, 21 bp, Homo sapiens
gaaccacatttcctctgttct

SEQ ID NO: 3619191 - DNA, 22 bp, Homo sapiens
gaaccatgcaggaaggaaaact

SEQ ID NO: 3619192 - DNA, 19 bp, Homo sapiens
gaacccacataaaagcccc

SEQ ID NO: 3619193 - DNA, 20 bp, Homo sapiens
gaacccacataaaagcccca

SEQ ID NO: 3619194 - DNA, 22 bp, Homo sapiens
gaacccacataaaagccccagc

SEQ ID NO: 3619195 - DNA, 16 bp, Homo sapiens
gaacccagactcagac

SEQ ID NO: 3619196 - DNA, 17 bp, Homo sapiens
gaacccagactcagaca

SEQ ID NO: 3619197 - DNA, 14 bp, Homo sapiens
gaacccccctccca

SEQ ID NO: 3619198 - DNA, 17 bp, Homo sapiens
gaacccccctcccaccc

SEQ ID NO: 3619199 - DNA, 15 bp, Homo sapiens
gaaccctcaggccac

SEQ ID NO: 3619200 - DNA, 20 bp, Homo sapiens
gaaccctcaggccaccctcc

SEQ ID NO: 3619201 - DNA, 22 bp, Homo sapiens
gaacctacctgccttggagagg

SEQ ID NO: 3619202 - DNA, 12 bp, Homo sapiens
gaacctcagcct

SEQ ID NO: 3619203 - DNA, 15 bp, Homo sapiens
gaacctcagcctggc

SEQ ID NO: 3619204 - DNA, 16 bp, Homo sapiens
gaacctcattctggtt

SEQ ID NO: 3619205 - DNA, 16 bp, Homo sapiens
gaacctggaacttggg

SEQ ID NO: 3619206 - DNA, 18 bp, Homo sapiens
gaacctggatccagcact

SEQ ID NO: 3619207 - DNA, 12 bp, Homo sapiens
gaaccttctttg

SEQ ID NO: 3619208 - DNA, 12 bp, Homo sapiens
gaacgagcagcc

SEQ ID NO: 3619209 - DNA, 19 bp, Homo sapiens
gaacgcccccccccacccc

SEQ ID NO: 3619210 - DNA, 23 bp, Homo sapiens
gaacgtggattgtatttaagaca

SEQ ID NO: 3619211 - DNA, 17 bp, Homo sapiens
gaacgtggctctgctgg

SEQ ID NO: 3619212 - DNA, 20 bp, Homo sapiens
gaactaaggactccaatgtc

SEQ ID NO: 3619213 - DNA, 16 bp, Homo sapiens
gaactagggaagctca

SEQ ID NO: 3619214 - DNA, 13 bp, Homo sapiens
gaactattagagc

SEQ ID NO: 3619215 - DNA, 19 bp, Homo sapiens
gaactattctgggggcccg

SEQ ID NO: 3619216 - DNA, 14 bp, Homo sapiens
gaactatttttaag

SEQ ID NO: 3619217 - DNA, 14 bp, Homo sapiens
gaactcagatccag

SEQ ID NO: 3619218 - DNA, 23 bp, Homo sapiens
gaactccaccgaccaactgccct

SEQ ID NO: 3619219 - DNA, 14 bp, Homo sapiens
gaactccaggcatg

SEQ ID NO: 3619220 - DNA, 16 bp, Homo sapiens
gaactccaggcatgtg

SEQ ID NO: 3619221 - DNA, 19 bp, Homo sapiens
gaactccaggcatgtgtct

SEQ ID NO: 3619222 - DNA, 24 bp, Homo sapiens
gaactcctgtcttctttctccatg

SEQ ID NO: 3619223 - DNA, 21 bp, Homo sapiens
gaactctcagaaataaatcac

SEQ ID NO: 3619224 - DNA, 16 bp, Homo sapiens
gaactcttcctcctcc

SEQ ID NO: 3619225 - DNA, 11 bp, Homo sapiens
gaactgaaatc

SEQ ID NO: 3619226 - DNA, 23 bp, Homo sapiens
gaactgaccctcaggcacacctt

SEQ ID NO: 3619227 - DNA, 11 bp, Homo sapiens
gaactgaggag

SEQ ID NO: 3619228 - DNA, 21 bp, Homo sapiens
gaactgaggagatgaccaggg

SEQ ID NO: 3619229 - DNA, 19 bp, Homo sapiens
gaactgcccttgctgcccg

SEQ ID NO: 3619230 - DNA, 15 bp, Homo sapiens
gaacttgactgggtg

SEQ ID NO: 3619231 - DNA, 15 bp, Homo sapiens
gaacttgctgctgcc

SEQ ID NO: 3619232 - DNA, 18 bp, Homo sapiens
gaactttctccctcatcg

SEQ ID NO: 3619233 - DNA, 15 bp, Homo sapiens
gaagaaaagattctt

SEQ ID NO: 3619234 - DNA, 16 bp, Homo sapiens
gaagaaataaatgaaa

SEQ ID NO: 3619235 - DNA, 21 bp, Homo sapiens
gaagaaatggctatgaacaga

SEQ ID NO: 3619236 - DNA, 22 bp, Homo sapiens
gaagaaccagtccccccaccct

SEQ ID NO: 3619237 - DNA, 14 bp, Homo sapiens
gaagaagaaaggac

SEQ ID NO: 3619238 - DNA, 14 bp, Homo sapiens
gaagaagagaggca

SEQ ID NO: 3619239 - DNA, 15 bp, Homo sapiens
gaagaagctttgccg

SEQ ID NO: 3619240 - DNA, 19 bp, Homo sapiens
gaagaaggacttgtttccc

SEQ ID NO: 3619241 - DNA, 10 bp, Homo sapiens
gaagaaggca

SEQ ID NO: 3619242 - DNA, 14 bp, Homo sapiens
gaagaaggcaaggc

SEQ ID NO: 3619243 - DNA, 15 bp, Homo sapiens
gaagaaggcaaggct

SEQ ID NO: 3619244 - DNA, 23 bp, Homo sapiens
gaagaataagtcatggagcctga

SEQ ID NO: 3619245 - DNA, 13 bp, Homo sapiens
gaagaatcttcct

SEQ ID NO: 3619246 - DNA, 20 bp, Homo sapiens
gaagaatcttcctggcacaa

SEQ ID NO: 3619247 - DNA, 15 bp, Homo sapiens
gaagacagtggcccc

SEQ ID NO: 3619248 - DNA, 11 bp, Homo sapiens
gaagaccaatc

SEQ ID NO: 3619249 - DNA, 20 bp, Homo sapiens
gaagacccaaaacagctttg

SEQ ID NO: 3619250 - DNA, 15 bp, Homo sapiens
gaagaccctttcaga

SEQ ID NO: 3619251 - DNA, 15 bp, Homo sapiens
gaagacctgaaagag

SEQ ID NO: 3619252 - DNA, 23 bp, Homo sapiens
gaagacgatttggggggggaggg

SEQ ID NO: 3619253 - DNA, 19 bp, Homo sapiens
gaagagaagagggcccagc

SEQ ID NO: 3619254 - DNA, 17 bp, Homo sapiens
gaagagaagggcagggc

SEQ ID NO: 3619255 - DNA, 15 bp, Homo sapiens
gaagagagggacagg

SEQ ID NO: 3619256 - DNA, 15 bp, Homo sapiens
gaagaggagaaaaag

SEQ ID NO: 3619257 - DNA, 17 bp, Homo sapiens
gaagaggagaaaaagaa

SEQ ID NO: 3619258 - DNA, 22 bp, Homo sapiens
gaagaggagaaaaagaagaaaa

SEQ ID NO: 3619259 - DNA, 16 bp, Homo sapiens
gaagagggcccagccc

SEQ ID NO: 3619260 - DNA, 17 bp, Homo sapiens
gaagagggcccagccca

SEQ ID NO: 3619261 - DNA, 22 bp, Homo sapiens
gaagagggcccagcccagagcc

SEQ ID NO: 3619262 - DNA, 20 bp, Homo sapiens
gaagaggtctgattggctgc

SEQ ID NO: 3619263 - DNA, 21 bp, Homo sapiens
gaagaggtctgattggctgct

SEQ ID NO: 3619264 - DNA, 16 bp, Homo sapiens
gaagagtcctctgaat

SEQ ID NO: 3619265 - DNA, 12 bp, Homo sapiens
gaagatgacctg

SEQ ID NO: 3619266 - DNA, 18 bp, Homo sapiens
gaagatgcagttcaaaaa

SEQ ID NO: 3619267 - DNA, 17 bp, Homo sapiens
gaagatgccagcttctc

SEQ ID NO: 3619268 - DNA, 17 bp, Homo sapiens
gaagatgcctgttaatt

SEQ ID NO: 3619269 - DNA, 22 bp, Homo sapiens
gaagatggagacaccctctggg

SEQ ID NO: 3619270 - DNA, 18 bp, Homo sapiens
gaagattattttttaaaa

SEQ ID NO: 3619271 - DNA, 23 bp, Homo sapiens
gaagattctatgttaatatttta

SEQ ID NO: 3619272 - DNA, 19 bp, Homo sapiens
gaagattggggacactcat

SEQ ID NO: 3619273 - DNA, 24 bp, Homo sapiens
gaagattggggacactcatattgc

SEQ ID NO: 3619274 - DNA, 23 bp, Homo sapiens
gaagattttgaaatttttattaa

SEQ ID NO: 3619275 - DNA, 18 bp, Homo sapiens
gaagcaagacacgtggcc

SEQ ID NO: 3619276 - DNA, 16 bp, Homo sapiens
gaagcaataggtagct

SEQ ID NO: 3619277 - DNA, 13 bp, Homo sapiens
gaagcagaacctt

SEQ ID NO: 3619278 - DNA, 10 bp, Homo sapiens
gaagcatgta

SEQ ID NO: 3619279 - DNA, 13 bp, Homo sapiens
gaagccaccctgg

SEQ ID NO: 3619280 - DNA, 13 bp, Homo sapiens
gaagccagccaca

SEQ ID NO: 3619281 - DNA, 16 bp, Homo sapiens
gaagccagccacagac

SEQ ID NO: 3619282 - DNA, 18 bp, Homo sapiens
gaagccagccacagaccc

SEQ ID NO: 3619283 - DNA, 22 bp, Homo sapiens
gaagccagccacagacccctgg

SEQ ID NO: 3619284 - DNA, 21 bp, Homo sapiens
gaagccaggaatttcccagga

SEQ ID NO: 3619285 - DNA, 14 bp, Homo sapiens
gaagccaggtacag

SEQ ID NO: 3619286 - DNA, 18 bp, Homo sapiens
gaagccaggtacaggaga

SEQ ID NO: 3619287 - DNA, 22 bp, Homo sapiens
gaagccatccctttttttacat

SEQ ID NO: 3619288 - DNA, 22 bp, Homo sapiens
gaagcccccagctaagaacctg

SEQ ID NO: 3619289 - DNA, 21 bp, Homo sapiens
gaagccggggtgtaacttcct

SEQ ID NO: 3619290 - DNA, 16 bp, Homo sapiens
gaagcctaccagaaga

SEQ ID NO: 3619291 - DNA, 22 bp, Homo sapiens
gaagcctctctccttggccaca

SEQ ID NO: 3619292 - DNA, 21 bp, Homo sapiens
gaagctacccctcaaactgca

SEQ ID NO: 3619293 - DNA, 19 bp, Homo sapiens
gaagctataaattcctctt

SEQ ID NO: 3619294 - DNA, 15 bp, Homo sapiens
gaagctcattcccaa

SEQ ID NO: 3619295 - DNA, 18 bp, Homo sapiens
gaagctcattcccaacgt

SEQ ID NO: 3619296 - DNA, 21 bp, Homo sapiens
gaagctcctctccccagccca

SEQ ID NO: 3619297 - DNA, 22 bp, Homo sapiens
gaagctcctctccccagcccag

SEQ ID NO: 3619298 - DNA, 10 bp, Homo sapiens
gaagctgctg

SEQ ID NO: 3619299 - DNA, 16 bp, Homo sapiens
gaagctgctgcagctc

SEQ ID NO: 3619300 - DNA, 11 bp, Homo sapiens
gaagctgctgt

SEQ ID NO: 3619301 - DNA, 16 bp, Homo sapiens
gaagctgtcctggagg

SEQ ID NO: 3619302 - DNA, 21 bp, Homo sapiens
gaagctgtggggtcggagagg

SEQ ID NO: 3619303 - DNA, 18 bp, Homo sapiens
gaagctgtgttgaaacag

SEQ ID NO: 3619304 - DNA, 22 bp, Homo sapiens
gaaggaaagaagggggccctgc

SEQ ID NO: 3619305 - DNA, 14 bp, Homo sapiens
gaaggaacaaagac

SEQ ID NO: 3619306 - DNA, 21 bp, Homo sapiens
gaaggaagctgtgttgaaaca

SEQ ID NO: 3619307 - DNA, 14 bp, Homo sapiens
gaaggagcagaaag

SEQ ID NO: 3619308 - DNA, 21 bp, Homo sapiens
gaaggatgatgtctttttatt

SEQ ID NO: 3619309 - DNA, 15 bp, Homo sapiens
gaaggcaaggccctg

SEQ ID NO: 3619310 - DNA, 18 bp, Homo sapiens
gaaggccccagagagacc

SEQ ID NO: 3619311 - DNA, 15 bp, Homo sapiens
gaagggacttttatt

SEQ ID NO: 3619312 - DNA, 16 bp, Homo sapiens
gaagggagcattgcag

SEQ ID NO: 3619313 - DNA, 19 bp, Homo sapiens
gaagggagcattgcagcct

SEQ ID NO: 3619314 - DNA, 14 bp, Homo sapiens
gaagggagccaagg

SEQ ID NO: 3619315 - DNA, 13 bp, Homo sapiens
gaagggccagagc

SEQ ID NO: 3619316 - DNA, 15 bp, Homo sapiens
gaagggccagagcca

SEQ ID NO: 3619317 - DNA, 14 bp, Homo sapiens
gaagggggccctgc

SEQ ID NO: 3619318 - DNA, 15 bp, Homo sapiens
gaaggtagaatgttt

SEQ ID NO: 3619319 - DNA, 23 bp, Homo sapiens
gaaggtgcctctggatgctgtga

SEQ ID NO: 3619320 - DNA, 15 bp, Homo sapiens
gaagtaacagacaca

SEQ ID NO: 3619321 - DNA, 21 bp, Homo sapiens
gaagtacttggcccccttcag

SEQ ID NO: 3619322 - DNA, 17 bp, Homo sapiens
gaagtagacctcttttt

SEQ ID NO: 3619323 - DNA, 18 bp, Homo sapiens
gaagtaggggtggcccga

SEQ ID NO: 3619324 - DNA, 19 bp, Homo sapiens
gaagtatatttttgcaggt

SEQ ID NO: 3619325 - DNA, 15 bp, Homo sapiens
gaagtcactgcacag

SEQ ID NO: 3619326 - DNA, 23 bp, Homo sapiens
gaagtctctgattagttgacagt

SEQ ID NO: 3619327 - DNA, 13 bp, Homo sapiens
gaagtcttctatt

SEQ ID NO: 3619328 - DNA, 18 bp, Homo sapiens
gaagtgcagtcagcagat

SEQ ID NO: 3619329 - DNA, 16 bp, Homo sapiens
gaagtggctgtccctg

SEQ ID NO: 3619330 - DNA, 19 bp, Homo sapiens
gaagtgtgggtctgtgtgt

SEQ ID NO: 3619331 - DNA, 18 bp, Homo sapiens
gaagtgtgtgccaagagc

SEQ ID NO: 3619332 - DNA, 16 bp, Homo sapiens
gaagtgtttatgttgt

SEQ ID NO: 3619333 - DNA, 21 bp, Homo sapiens
gaagtgtttcacgagagcccg

SEQ ID NO: 3619334 - DNA, 22 bp, Homo sapiens
gaagtgtttcacgagagcccgg

SEQ ID NO: 3619335 - DNA, 21 bp, Homo sapiens
gaagttactgttacttgataa

SEQ ID NO: 3619336 - DNA, 23 bp, Homo sapiens
gaagttgacttatagtacatgat

SEQ ID NO: 3619337 - DNA, 14 bp, Homo sapiens
gaagtttgctgtgc

SEQ ID NO: 3619338 - DNA, 16 bp, Homo sapiens
gaagtttttgaaatac

SEQ ID NO: 3619339 - DNA, 13 bp, Homo sapiens
gaataaagcaatt

SEQ ID NO: 3619340 - DNA, 15 bp, Homo sapiens
gaataaaggcagttt

SEQ ID NO: 3619341 - DNA, 20 bp, Homo sapiens
gaataaaggcagttttctaa

SEQ ID NO: 3619342 - DNA, 15 bp, Homo sapiens
gaataaatgtcactt

SEQ ID NO: 3619343 - DNA, 18 bp, Homo sapiens
gaataaatgtcacttttt

SEQ ID NO: 3619344 - DNA, 23 bp, Homo sapiens
gaataaatgtcactttttgaggc

SEQ ID NO: 3619345 - DNA, 20 bp, Homo sapiens
gaataaattcccaacttctc

SEQ ID NO: 3619346 - DNA, 15 bp, Homo sapiens
gaataaattgctcct

SEQ ID NO: 3619347 - DNA, 20 bp, Homo sapiens
gaataagtgccaggatggaa

SEQ ID NO: 3619348 - DNA, 22 bp, Homo sapiens
gaataatgttttgggaaacact

SEQ ID NO: 3619349 - DNA, 17 bp, Homo sapiens
gaatacatttgtattta

SEQ ID NO: 3619350 - DNA, 13 bp, Homo sapiens
gaatacttatttt

SEQ ID NO: 3619351 - DNA, 24 bp, Homo sapiens
gaatactttgcagcacagctgaga

SEQ ID NO: 3619352 - DNA, 22 bp, Homo sapiens
gaatagctttaatgatatgctt

SEQ ID NO: 3619353 - DNA, 17 bp, Homo sapiens
gaatagtatcctccagg

SEQ ID NO: 3619354 - DNA, 18 bp, Homo sapiens
gaatagtatcctccaggt

SEQ ID NO: 3619355 - DNA, 16 bp, Homo sapiens
gaatataatagattga

SEQ ID NO: 3619356 - DNA, 14 bp, Homo sapiens
gaatatctttcgat

SEQ ID NO: 3619357 - DNA, 23 bp, Homo sapiens
gaatattccactatttgcagagg

SEQ ID NO: 3619358 - DNA, 23 bp, Homo sapiens
gaatattttgttttgtgcagaga

SEQ ID NO: 3619359 - DNA, 21 bp, Homo sapiens
gaatattttttatttctaagt

SEQ ID NO: 3619360 - DNA, 19 bp, Homo sapiens
gaatcagaacagatgctga

SEQ ID NO: 3619361 - DNA, 18 bp, Homo sapiens
gaatcagctggacatact

SEQ ID NO: 3619362 - DNA, 20 bp, Homo sapiens
gaatcctaggctccacccca

SEQ ID NO: 3619363 - DNA, 13 bp, Homo sapiens
gaatctagcccaa

SEQ ID NO: 3619364 - DNA, 23 bp, Homo sapiens
gaatgaaaataactgaaccaaat

SEQ ID NO: 3619365 - DNA, 16 bp, Homo sapiens
gaatgaattaaataaa

SEQ ID NO: 3619366 - DNA, 13 bp, Homo sapiens
gaatgagcctcgg

SEQ ID NO: 3619367 - DNA, 14 bp, Homo sapiens
gaatgcagaaaaca

SEQ ID NO: 3619368 - DNA, 17 bp, Homo sapiens
gaatgccgctgtctctg

SEQ ID NO: 3619369 - DNA, 18 bp, Homo sapiens
gaatgccgctgtctctga

SEQ ID NO: 3619370 - DNA, 12 bp, Homo sapiens
gaatgcctcgct

SEQ ID NO: 3619371 - DNA, 21 bp, Homo sapiens
gaatgcctcgctcccttcaag

SEQ ID NO: 3619372 - DNA, 14 bp, Homo sapiens
gaatggagcctgct

SEQ ID NO: 3619373 - DNA, 22 bp, Homo sapiens
gaatggataaaataatgctgca

SEQ ID NO: 3619374 - DNA, 14 bp, Homo sapiens
gaatggcagtcctg

SEQ ID NO: 3619375 - DNA, 18 bp, Homo sapiens
gaatggcagtcctggagg

SEQ ID NO: 3619376 - DNA, 17 bp, Homo sapiens
gaatggcatggcaggag

SEQ ID NO: 3619377 - DNA, 19 bp, Homo sapiens
gaatggcatggcaggagtc

SEQ ID NO: 3619378 - DNA, 15 bp, Homo sapiens
gaatggcctggagca

SEQ ID NO: 3619379 - DNA, 19 bp, Homo sapiens
gaatggcctggagcaggcc

SEQ ID NO: 3619380 - DNA, 15 bp, Homo sapiens
gaatgggcatttcta

SEQ ID NO: 3619381 - DNA, 16 bp, Homo sapiens
gaatgggcatttctaa

SEQ ID NO: 3619382 - DNA, 13 bp, Homo sapiens
gaatgtcaataaa

SEQ ID NO: 3619383 - DNA, 23 bp, Homo sapiens
gaatgtcagggccaggtgcagac

SEQ ID NO: 3619384 - DNA, 19 bp, Homo sapiens
gaatgtcagtatgtggaag

SEQ ID NO: 3619385 - DNA, 17 bp, Homo sapiens
gaatgtcagttgttatt

SEQ ID NO: 3619386 - DNA, 13 bp, Homo sapiens
gaatgttctttct

SEQ ID NO: 3619387 - DNA, 18 bp, Homo sapiens
gaatgttctttctgctct

SEQ ID NO: 3619388 - DNA, 12 bp, Homo sapiens
gaattaaataaa

SEQ ID NO: 3619389 - DNA, 20 bp, Homo sapiens
gaattaaataaacccttcct

SEQ ID NO: 3619390 - DNA, 23 bp, Homo sapiens
gaattaaatcatcccttaataaa

SEQ ID NO: 3619391 - DNA, 19 bp, Homo sapiens
gaattaggctgtaactact

SEQ ID NO: 3619392 - DNA, 14 bp, Homo sapiens
gaattatctcaagt

SEQ ID NO: 3619393 - DNA, 20 bp, Homo sapiens
gaattatctcaagtaaaaca

SEQ ID NO: 3619394 - DNA, 17 bp, Homo sapiens
gaattcaccagtgttcc

SEQ ID NO: 3619395 - DNA, 17 bp, Homo sapiens
gaattcagtgccttcaa

SEQ ID NO: 3619396 - DNA, 19 bp, Homo sapiens
gaattctgtttaattttca

SEQ ID NO: 3619397 - DNA, 21 bp, Homo sapiens
gaattggaaagacttctcaaa

SEQ ID NO: 3619398 - DNA, 21 bp, Homo sapiens
gaattggaagttacatgctgt

SEQ ID NO: 3619399 - DNA, 17 bp, Homo sapiens
gaattgggagcttggga

SEQ ID NO: 3619400 - DNA, 14 bp, Homo sapiens
gaatttaaaactgt

SEQ ID NO: 3619401 - DNA, 20 bp, Homo sapiens
gaatttatgtgaaatgcttt

SEQ ID NO: 3619402 - DNA, 16 bp, Homo sapiens
gaatttcccaggaccc

SEQ ID NO: 3619403 - DNA, 22 bp, Homo sapiens
gaatttcccaggaccctgaagg

SEQ ID NO: 3619404 - DNA, 14 bp, Homo sapiens
gaatttcttaactt

SEQ ID NO: 3619405 - DNA, 20 bp, Homo sapiens
gaatttcttcttttcctgca

SEQ ID NO: 3619406 - DNA, 13 bp, Homo sapiens
gaatttgccagag

SEQ ID NO: 3619407 - DNA, 23 bp, Homo sapiens
gaattttctttgtgtagctttgc

SEQ ID NO: 3619408 - DNA, 15 bp, Homo sapiens
gaattttgttgctgt

SEQ ID NO: 3619409 - DNA, 17 bp, Homo sapiens
gacaaacacctcccagg

SEQ ID NO: 3619410 - DNA, 19 bp, Homo sapiens
gacaaacacctcccaggag

SEQ ID NO: 3619411 - DNA, 20 bp, Homo sapiens
gacaaagccttaagcaaatt

SEQ ID NO: 3619412 - DNA, 22 bp, Homo sapiens
gacaaagccttaagcaaatttt

SEQ ID NO: 3619413 - DNA, 17 bp, Homo sapiens
gacaaatctttaagaat

SEQ ID NO: 3619414 - DNA, 19 bp, Homo sapiens
gacaacactgggaaacaga

SEQ ID NO: 3619415 - DNA, 17 bp, Homo sapiens
gacaacacttaatagca

SEQ ID NO: 3619416 - DNA, 20 bp, Homo sapiens
gacaacatgtttaataaata

SEQ ID NO: 3619417 - DNA, 17 bp, Homo sapiens
gacaactgtgaagccac

SEQ ID NO: 3619418 - DNA, 20 bp, Homo sapiens
gacaagagctgttatgctgt

SEQ ID NO: 3619419 - DNA, 22 bp, Homo sapiens
gacaagtgatgctaaaacctga

SEQ ID NO: 3619420 - DNA, 12 bp, Homo sapiens
gacaatcactgc

SEQ ID NO: 3619421 - DNA, 14 bp, Homo sapiens
gacaatcactgcca

SEQ ID NO: 3619422 - DNA, 23 bp, Homo sapiens
gacaattttacctattctgaaaa

SEQ ID NO: 3619423 - DNA, 22 bp, Homo sapiens
gacacaacagcagtctccttca

SEQ ID NO: 3619424 - DNA, 15 bp, Homo sapiens
gacacaataggtctt

SEQ ID NO: 3619425 - DNA, 22 bp, Homo sapiens
gacacaataggtctttctctca

SEQ ID NO: 3619426 - DNA, 13 bp, Homo sapiens
gacacacatacat

SEQ ID NO: 3619427 - DNA, 18 bp, Homo sapiens
gacacacggggctcgggc

SEQ ID NO: 3619428 - DNA, 12 bp, Homo sapiens
gacacagctctt

SEQ ID NO: 3619429 - DNA, 14 bp, Homo sapiens
gacacagctcttca

SEQ ID NO: 3619430 - DNA, 23 bp, Homo sapiens
gacacagctcttcattccattga

SEQ ID NO: 3619431 - DNA, 17 bp, Homo sapiens
gacaccaagctcaccct

SEQ ID NO: 3619432 - DNA, 13 bp, Homo sapiens
gacacccaggact

SEQ ID NO: 3619433 - DNA, 13 bp, Homo sapiens
gacacccatgcca

SEQ ID NO: 3619434 - DNA, 20 bp, Homo sapiens
gacacccatgccagagaggt

SEQ ID NO: 3619435 - DNA, 10 bp, Homo sapiens
gacacccggc

SEQ ID NO: 3619436 - DNA, 13 bp, Homo sapiens
gacaccctctggg

SEQ ID NO: 3619437 - DNA, 23 bp, Homo sapiens
gacaccctctgggggtcctctct

SEQ ID NO: 3619438 - DNA, 23 bp, Homo sapiens
gacaccctggcctgaactgagga

SEQ ID NO: 3619439 - DNA, 17 bp, Homo sapiens
gacacctactgagtggc

SEQ ID NO: 3619440 - DNA, 12 bp, Homo sapiens
gacacctccccc

SEQ ID NO: 3619441 - DNA, 23 bp, Homo sapiens
gacacctccccctttcacactgg

SEQ ID NO: 3619442 - DNA, 23 bp, Homo sapiens
gacacgtggcctcgtgaggggca

SEQ ID NO: 3619443 - DNA, 14 bp, Homo sapiens
gacactcatattgc

SEQ ID NO: 3619444 - DNA, 17 bp, Homo sapiens
gacactgttgataaaaa

SEQ ID NO: 3619445 - DNA, 17 bp, Homo sapiens
gacagactcactgggaa

SEQ ID NO: 3619446 - DNA, 20 bp, Homo sapiens
gacagactttggacagtggc

SEQ ID NO: 3619447 - DNA, 21 bp, Homo sapiens
gacagactttggacagtggcc

SEQ ID NO: 3619448 - DNA, 22 bp, Homo sapiens
gacagactttggacagtggcct

SEQ ID NO: 3619449 - DNA, 23 bp, Homo sapiens
gacagactttggacagtggcctc

SEQ ID NO: 3619450 - DNA, 15 bp, Homo sapiens
gacagaggcagagat

SEQ ID NO: 3619451 - DNA, 13 bp, Homo sapiens
gacagaggcccca

SEQ ID NO: 3619452 - DNA, 19 bp, Homo sapiens
gacagaggccccagcctcc

SEQ ID NO: 3619453 - DNA, 21 bp, Homo sapiens
gacagaggtttgaaggagaat

SEQ ID NO: 3619454 - DNA, 14 bp, Homo sapiens
gacagatattttat

SEQ ID NO: 3619455 - DNA, 14 bp, Homo sapiens
gacagcagaactgc

SEQ ID NO: 3619456 - DNA, 18 bp, Homo sapiens
gacagcagggaccgggcg

SEQ ID NO: 3619457 - DNA, 16 bp, Homo sapiens
gacagccattttccaa

SEQ ID NO: 3619458 - DNA, 18 bp, Homo sapiens
gacagcctccccctgtcc

SEQ ID NO: 3619459 - DNA, 20 bp, Homo sapiens
gacagccttccccagctcca

SEQ ID NO: 3619460 - DNA, 13 bp, Homo sapiens
gacagccttgcaa

SEQ ID NO: 3619461 - DNA, 18 bp, Homo sapiens
gacagctgataaatttaa

SEQ ID NO: 3619462 - DNA, 20 bp, Homo sapiens
gacagctgctcctagaggga

SEQ ID NO: 3619463 - DNA, 22 bp, Homo sapiens
gacagctggcggaggctgctcg

SEQ ID NO: 3619464 - DNA, 16 bp, Homo sapiens
gacagcttacaggagc

SEQ ID NO: 3619465 - DNA, 17 bp, Homo sapiens
gacagcttacaggagcc

SEQ ID NO: 3619466 - DNA, 18 bp, Homo sapiens
gacagcttacaggagcca

SEQ ID NO: 3619467 - DNA, 14 bp, Homo sapiens
gacagcttcctcac

SEQ ID NO: 3619468 - DNA, 17 bp, Homo sapiens
gacagcttcctcacacc

SEQ ID NO: 3619469 - DNA, 22 bp, Homo sapiens
gacagcttcctcacacccctgt

SEQ ID NO: 3619470 - DNA, 13 bp, Homo sapiens
gacagcttctctg

SEQ ID NO: 3619471 - DNA, 11 bp, Homo sapiens
gacaggaccct

SEQ ID NO: 3619472 - DNA, 15 bp, Homo sapiens
gacaggaccctcagg

SEQ ID NO: 3619473 - DNA, 18 bp, Homo sapiens
gacaggaccctcaggaat

SEQ ID NO: 3619474 - DNA, 14 bp, Homo sapiens
gacaggagcctagc

SEQ ID NO: 3619475 - DNA, 18 bp, Homo sapiens
gacaggcagggagggctt

SEQ ID NO: 3619476 - DNA, 16 bp, Homo sapiens
gacaggcccgcttgct

SEQ ID NO: 3619477 - DNA, 17 bp, Homo sapiens
gacaggccctccctgtc

SEQ ID NO: 3619478 - DNA, 23 bp, Homo sapiens
gacaggctgaagagagggacagg

SEQ ID NO: 3619479 - DNA, 17 bp, Homo sapiens
gacagggagcagccccc

SEQ ID NO: 3619480 - DNA, 14 bp, Homo sapiens
gacagggcatggcc

SEQ ID NO: 3619481 - DNA, 15 bp, Homo sapiens
gacagggcatggcca

SEQ ID NO: 3619482 - DNA, 20 bp, Homo sapiens
gacagggcatggccaggtgg

SEQ ID NO: 3619483 - DNA, 18 bp, Homo sapiens
gacagggccagtgcagtt

SEQ ID NO: 3619484 - DNA, 15 bp, Homo sapiens
gacagggcctggagc

SEQ ID NO: 3619485 - DNA, 14 bp, Homo sapiens
gacaggtgggcctg

SEQ ID NO: 3619486 - DNA, 18 bp, Homo sapiens
gacaggtgggcctgggag

SEQ ID NO: 3619487 - DNA, 17 bp, Homo sapiens
gacagtacctgattgta

SEQ ID NO: 3619488 - DNA, 13 bp, Homo sapiens
gacagtccacagg

SEQ ID NO: 3619489 - DNA, 19 bp, Homo sapiens
gacagtccacaggggccac

SEQ ID NO: 3619490 - DNA, 12 bp, Homo sapiens
gacagtgccatc

SEQ ID NO: 3619491 - DNA, 15 bp, Homo sapiens
gacagtgccatcccc

SEQ ID NO: 3619492 - DNA, 21 bp, Homo sapiens
gacagttgatggagccccagg

SEQ ID NO: 3619493 - DNA, 22 bp, Homo sapiens
gacagttgatggagccccaggg

SEQ ID NO: 3619494 - DNA, 22 bp, Homo sapiens
gacataaacaaagacattgaca

SEQ ID NO: 3619495 - DNA, 22 bp, Homo sapiens
gacataatggggtcctggccat

SEQ ID NO: 3619496 - DNA, 20 bp, Homo sapiens
gacatacatattatctcatt

SEQ ID NO: 3619497 - DNA, 14 bp, Homo sapiens
gacatacttgaagg

SEQ ID NO: 3619498 - DNA, 20 bp, Homo sapiens
gacatacttgaagggccaga

SEQ ID NO: 3619499 - DNA, 16 bp, Homo sapiens
gacatattatgcctga

SEQ ID NO: 3619500 - DNA, 15 bp, Homo sapiens
gacatcacttgtaca

SEQ ID NO: 3619501 - DNA, 14 bp, Homo sapiens
gacatcagcaaaca

SEQ ID NO: 3619502 - DNA, 13 bp, Homo sapiens
gacatcagctggt

SEQ ID NO: 3619503 - DNA, 12 bp, Homo sapiens
gacatcccttcc

SEQ ID NO: 3619504 - DNA, 23 bp, Homo sapiens
gacatcccttcctggaaacagca

SEQ ID NO: 3619505 - DNA, 15 bp, Homo sapiens
gacatctgaccccaa

SEQ ID NO: 3619506 - DNA, 17 bp, Homo sapiens
gacatctgaccccaagg

SEQ ID NO: 3619507 - DNA, 14 bp, Homo sapiens
gacatgatcttctt

SEQ ID NO: 3619508 - DNA, 19 bp, Homo sapiens
gacatgcataaaaattaaa

SEQ ID NO: 3619509 - DNA, 21 bp, Homo sapiens
gacatgcttttctgccactcc

SEQ ID NO: 3619510 - DNA, 13 bp, Homo sapiens
gacattagagaaa

SEQ ID NO: 3619511 - DNA, 14 bp, Homo sapiens
gacattagagaaaa

SEQ ID NO: 3619512 - DNA, 20 bp, Homo sapiens
gacattagagaaaaccttaa

SEQ ID NO: 3619513 - DNA, 20 bp, Homo sapiens
gacattcagactaaaaatac

SEQ ID NO: 3619514 - DNA, 12 bp, Homo sapiens
gacattccctgc

SEQ ID NO: 3619515 - DNA, 13 bp, Homo sapiens
gacattctcacat

SEQ ID NO: 3619516 - DNA, 14 bp, Homo sapiens
gacattgacagcaa

SEQ ID NO: 3619517 - DNA, 16 bp, Homo sapiens
gacattgacagcaatt

SEQ ID NO: 3619518 - DNA, 14 bp, Homo sapiens
gacatttctttgga

SEQ ID NO: 3619519 - DNA, 22 bp, Homo sapiens
gacatttgggagacatgtgaca

SEQ ID NO: 3619520 - DNA, 19 bp, Homo sapiens
gaccaaatgtagttttgta

SEQ ID NO: 3619521 - DNA, 17 bp, Homo sapiens
gaccaacagaaaccttt

SEQ ID NO: 3619522 - DNA, 16 bp, Homo sapiens
gaccaatcaaatatat

SEQ ID NO: 3619523 - DNA, 14 bp, Homo sapiens
gaccacggagggag

SEQ ID NO: 3619524 - DNA, 14 bp, Homo sapiens
gaccagcagcgcct

SEQ ID NO: 3619525 - DNA, 20 bp, Homo sapiens
gaccagcagcgcctttccca

SEQ ID NO: 3619526 - DNA, 12 bp, Homo sapiens
gaccagcctggc

SEQ ID NO: 3619527 - DNA, 21 bp, Homo sapiens
gaccataagagaaacctgcca

SEQ ID NO: 3619528 - DNA, 22 bp, Homo sapiens
gaccataagagaaacctgccaa

SEQ ID NO: 3619529 - DNA, 16 bp, Homo sapiens
gaccatcatgccctct

SEQ ID NO: 3619530 - DNA, 14 bp, Homo sapiens
gaccatctgctgca

SEQ ID NO: 3619531 - DNA, 16 bp, Homo sapiens
gaccatctgctgcagt

SEQ ID NO: 3619532 - DNA, 16 bp, Homo sapiens
gaccattgagtccctg

SEQ ID NO: 3619533 - DNA, 18 bp, Homo sapiens
gaccattgagtccctgct

SEQ ID NO: 3619534 - DNA, 15 bp, Homo sapiens
gacccaaaacagctt

SEQ ID NO: 3619535 - DNA, 19 bp, Homo sapiens
gacccaaaacagctttgtc

SEQ ID NO: 3619536 - DNA, 19 bp, Homo sapiens
gacccagaatggagcctgc

SEQ ID NO: 3619537 - DNA, 18 bp, Homo sapiens
gacccagcatctcccagc

SEQ ID NO: 3619538 - DNA, 19 bp, Homo sapiens
gacccagcatctcccagca

SEQ ID NO: 3619539 - DNA, 22 bp, Homo sapiens
gacccagcatctcccagcaaga

SEQ ID NO: 3619540 - DNA, 16 bp, Homo sapiens
gacccagtcccacact

SEQ ID NO: 3619541 - DNA, 20 bp, Homo sapiens
gacccagtcccacactgtgg

SEQ ID NO: 3619542 - DNA, 15 bp, Homo sapiens
gacccagtgccccca

SEQ ID NO: 3619543 - DNA, 16 bp, Homo sapiens
gacccatccctgcctg

SEQ ID NO: 3619544 - DNA, 18 bp, Homo sapiens
gacccatccctgcctgga

SEQ ID NO: 3619545 - DNA, 20 bp, Homo sapiens
gacccatccctgcctggagg

SEQ ID NO: 3619546 - DNA, 21 bp, Homo sapiens
gacccatccctgcctggaggc

SEQ ID NO: 3619547 - DNA, 19 bp, Homo sapiens
gaccccaaagactctggag

SEQ ID NO: 3619548 - DNA, 22 bp, Homo sapiens
gaccccacatccttctcactgc

SEQ ID NO: 3619549 - DNA, 12 bp, Homo sapiens
gaccccagagaa

SEQ ID NO: 3619550 - DNA, 15 bp, Homo sapiens
gaccccagccatcca

SEQ ID NO: 3619551 - DNA, 12 bp, Homo sapiens
gacccccaacca

SEQ ID NO: 3619552 - DNA, 17 bp, Homo sapiens
gacccccaggcagaggg

SEQ ID NO: 3619553 - DNA, 14 bp, Homo sapiens
gaccccctcagcct

SEQ ID NO: 3619554 - DNA, 19 bp, Homo sapiens
gaccccgagaaccctgagc

SEQ ID NO: 3619555 - DNA, 20 bp, Homo sapiens
gaccccgcacccggctcgtg

SEQ ID NO: 3619556 - DNA, 11 bp, Homo sapiens
gacccctgcct

SEQ ID NO: 3619557 - DNA, 13 bp, Homo sapiens
gacccctggcttt

SEQ ID NO: 3619558 - DNA, 19 bp, Homo sapiens
gacccggaggggcctggca

SEQ ID NO: 3619559 - DNA, 22 bp, Homo sapiens
gaccctcaggcacaccttgcag

SEQ ID NO: 3619560 - DNA, 17 bp, Homo sapiens
gaccctccccgcacccc

SEQ ID NO: 3619561 - DNA, 20 bp, Homo sapiens
gaccctcgggccccatcctc

SEQ ID NO: 3619562 - DNA, 23 bp, Homo sapiens
gaccctgaatccgtacttgggtc

SEQ ID NO: 3619563 - DNA, 16 bp, Homo sapiens
gaccctgacctccgcc

SEQ ID NO: 3619564 - DNA, 15 bp, Homo sapiens
gaccctggcctcaag

SEQ ID NO: 3619565 - DNA, 23 bp, Homo sapiens
gaccctgggtaggggaagagaag

SEQ ID NO: 3619566 - DNA, 24 bp, Homo sapiens
gaccctgtcctgcagtcccacact

SEQ ID NO: 3619567 - DNA, 20 bp, Homo sapiens
gaccctgtgtcctccaccat

SEQ ID NO: 3619568 - DNA, 21 bp, Homo sapiens
gaccctgtgtcctccaccatg

SEQ ID NO: 3619569 - DNA, 22 bp, Homo sapiens
gaccctgtgtcctccaccatgc

SEQ ID NO: 3619570 - DNA, 21 bp, Homo sapiens
gacccttctgggtccagggag

SEQ ID NO: 3619571 - DNA, 21 bp, Homo sapiens
gacccttgacacctgctgaga

SEQ ID NO: 3619572 - DNA, 19 bp, Homo sapiens
gacccttgattcattctga

SEQ ID NO: 3619573 - DNA, 20 bp, Homo sapiens
gaccctttcagaatcttttc

SEQ ID NO: 3619574 - DNA, 14 bp, Homo sapiens
gaccgagccctgga

SEQ ID NO: 3619575 - DNA, 17 bp, Homo sapiens
gaccgagccctggagag

SEQ ID NO: 3619576 - DNA, 22 bp, Homo sapiens
gaccgatgtgtctcccagaact

SEQ ID NO: 3619577 - DNA, 13 bp, Homo sapiens
gaccgggccaggc

SEQ ID NO: 3619578 - DNA, 17 bp, Homo sapiens
gaccgggcgcagccctc

SEQ ID NO: 3619579 - DNA, 17 bp, Homo sapiens
gaccggtgctgcaggag

SEQ ID NO: 3619580 - DNA, 18 bp, Homo sapiens
gaccgtacaaactcagat

SEQ ID NO: 3619581 - DNA, 13 bp, Homo sapiens
gaccgtccagggg

SEQ ID NO: 3619582 - DNA, 23 bp, Homo sapiens
gaccgtgcccacgagggtctccc

SEQ ID NO: 3619583 - DNA, 18 bp, Homo sapiens
gacctaaagggactacct

SEQ ID NO: 3619584 - DNA, 14 bp, Homo sapiens
gacctcatcagcct

SEQ ID NO: 3619585 - DNA, 20 bp, Homo sapiens
gacctcatctgtggagctgc

SEQ ID NO: 3619586 - DNA, 14 bp, Homo sapiens
gacctccccacccg

SEQ ID NO: 3619587 - DNA, 19 bp, Homo sapiens
gacctccccacccgctccc

SEQ ID NO: 3619588 - DNA, 16 bp, Homo sapiens
gacctccgcccctgcc

SEQ ID NO: 3619589 - DNA, 18 bp, Homo sapiens
gacctccgcccctgcccc

SEQ ID NO: 3619590 - DNA, 17 bp, Homo sapiens
gacctcctaaataaatt

SEQ ID NO: 3619591 - DNA, 14 bp, Homo sapiens
gacctctaggagga

SEQ ID NO: 3619592 - DNA, 14 bp, Homo sapiens
gacctctcccaggg

SEQ ID NO: 3619593 - DNA, 12 bp, Homo sapiens
gacctcttctgg

SEQ ID NO: 3619594 - DNA, 17 bp, Homo sapiens
gacctgagagcatctca

SEQ ID NO: 3619595 - DNA, 20 bp, Homo sapiens
gacctgagcggcaccctggt

SEQ ID NO: 3619596 - DNA, 15 bp, Homo sapiens
gacctgatcctggag

SEQ ID NO: 3619597 - DNA, 21 bp, Homo sapiens
gacctgatcctggaggcccag

SEQ ID NO: 3619598 - DNA, 11 bp, Homo sapiens
gacctggacaa

SEQ ID NO: 3619599 - DNA, 18 bp, Homo sapiens
gacctgtcctctttgtga

SEQ ID NO: 3619600 - DNA, 11 bp, Homo sapiens
gacctgtcctg

SEQ ID NO: 3619601 - DNA, 15 bp, Homo sapiens
gacctgtcctgtctt

SEQ ID NO: 3619602 - DNA, 16 bp, Homo sapiens
gacctgtggtcatgtg

SEQ ID NO: 3619603 - DNA, 12 bp, Homo sapiens
gaccttcccagg

SEQ ID NO: 3619604 - DNA, 23 bp, Homo sapiens
gaccttccctccgccttctccca

SEQ ID NO: 3619605 - DNA, 20 bp, Homo sapiens
gaccttgagttaacaggaca

SEQ ID NO: 3619606 - DNA, 21 bp, Homo sapiens
gaccttgagttaacaggacag

SEQ ID NO: 3619607 - DNA, 22 bp, Homo sapiens
gaccttgagttaacaggacagt

SEQ ID NO: 3619608 - DNA, 20 bp, Homo sapiens
gaccttgctttgagactcct

SEQ ID NO: 3619609 - DNA, 14 bp, Homo sapiens
gaccttgggtcctg

SEQ ID NO: 3619610 - DNA, 23 bp, Homo sapiens
gacctttatttattaaacttcag

SEQ ID NO: 3619611 - DNA, 12 bp, Homo sapiens
gacgaggggcag

SEQ ID NO: 3619612 - DNA, 21 bp, Homo sapiens
gacgaggggcagggaaggaca

SEQ ID NO: 3619613 - DNA, 17 bp, Homo sapiens
gacgccacggagggctg

SEQ ID NO: 3619614 - DNA, 14 bp, Homo sapiens
gacgggatgacctc

SEQ ID NO: 3619615 - DNA, 16 bp, Homo sapiens
gacggtctgtgtgctg

SEQ ID NO: 3619616 - DNA, 15 bp, Homo sapiens
gacgtctccccttct

SEQ ID NO: 3619617 - DNA, 22 bp, Homo sapiens
gacgtgctccgtagctctgctg

SEQ ID NO: 3619618 - DNA, 18 bp, Homo sapiens
gacgttaggccaggcctt

SEQ ID NO: 3619619 - DNA, 19 bp, Homo sapiens
gacgttaggccaggcctta

SEQ ID NO: 3619620 - DNA, 16 bp, Homo sapiens
gactaactatgcaata

SEQ ID NO: 3619621 - DNA, 22 bp, Homo sapiens
gactacctctgtgccttgccac

SEQ ID NO: 3619622 - DNA, 19 bp, Homo sapiens
gactacttggaactaggct

SEQ ID NO: 3619623 - DNA, 16 bp, Homo sapiens
gactatctttgctgca

SEQ ID NO: 3619624 - DNA, 17 bp, Homo sapiens
gactcaatgtgctctgt

SEQ ID NO: 3619625 - DNA, 20 bp, Homo sapiens
gactcagggaccggtgctgc

SEQ ID NO: 3619626 - DNA, 22 bp, Homo sapiens
gactcagggaccggtgctgcag

SEQ ID NO: 3619627 - DNA, 12 bp, Homo sapiens
gactccaaagaa

SEQ ID NO: 3619628 - DNA, 16 bp, Homo sapiens
gactccaaagaaatgt

SEQ ID NO: 3619629 - DNA, 18 bp, Homo sapiens
gactccaaagaaatgtaa

SEQ ID NO: 3619630 - DNA, 13 bp, Homo sapiens
gactccaaagctg

SEQ ID NO: 3619631 - DNA, 12 bp, Homo sapiens
gactccagggtg

SEQ ID NO: 3619632 - DNA, 12 bp, Homo sapiens
gactccatctct

SEQ ID NO: 3619633 - DNA, 14 bp, Homo sapiens
gactccatctcttc

SEQ ID NO: 3619634 - DNA, 15 bp, Homo sapiens
gactccatttctttc

SEQ ID NO: 3619635 - DNA, 19 bp, Homo sapiens
gactccatttctttcttcc

SEQ ID NO: 3619636 - DNA, 13 bp, Homo sapiens
gactcccagaacc

SEQ ID NO: 3619637 - DNA, 13 bp, Homo sapiens
gactcccattcct

SEQ ID NO: 3619638 - DNA, 16 bp, Homo sapiens
gactccccagcccagc

SEQ ID NO: 3619639 - DNA, 15 bp, Homo sapiens
gactcctcagcaccc

SEQ ID NO: 3619640 - DNA, 21 bp, Homo sapiens
gactcctcagcacccctccag

SEQ ID NO: 3619641 - DNA, 14 bp, Homo sapiens
gactcctctgtcca

SEQ ID NO: 3619642 - DNA, 12 bp, Homo sapiens
gactcctgctgg

SEQ ID NO: 3619643 - DNA, 13 bp, Homo sapiens
gactcctgctggt

SEQ ID NO: 3619644 - DNA, 13 bp, Homo sapiens
gactcctggcagg

SEQ ID NO: 3619645 - DNA, 22 bp, Homo sapiens
gactcctgttgccatggattca

SEQ ID NO: 3619646 - DNA, 13 bp, Homo sapiens
gactctctccagg

SEQ ID NO: 3619647 - DNA, 17 bp, Homo sapiens
gactctgacctcttggc

SEQ ID NO: 3619648 - DNA, 21 bp, Homo sapiens
gactctgcacccgcctcgacc

SEQ ID NO: 3619649 - DNA, 21 bp, Homo sapiens
gactctggaggtcatctggcg

SEQ ID NO: 3619650 - DNA, 15 bp, Homo sapiens
gactgaaaatattgt

SEQ ID NO: 3619651 - DNA, 22 bp, Homo sapiens
gactgaatgctgttaatatttc

SEQ ID NO: 3619652 - DNA, 22 bp, Homo sapiens
gactgaccatcatgccctctct

SEQ ID NO: 3619653 - DNA, 23 bp, Homo sapiens
gactgacccccatctgagctggg

SEQ ID NO: 3619654 - DNA, 23 bp, Homo sapiens
gactgacttatggcatgactctt

SEQ ID NO: 3619655 - DNA, 16 bp, Homo sapiens
gactgagcagccgcca

SEQ ID NO: 3619656 - DNA, 21 bp, Homo sapiens
gactgagcagccgccagctgg

SEQ ID NO: 3619657 - DNA, 17 bp, Homo sapiens
gactgatgattttcctt

SEQ ID NO: 3619658 - DNA, 13 bp, Homo sapiens
gactgccaagcca

SEQ ID NO: 3619659 - DNA, 14 bp, Homo sapiens
gactgcccccagaa

SEQ ID NO: 3619660 - DNA, 15 bp, Homo sapiens
gactgctcctgggca

SEQ ID NO: 3619661 - DNA, 15 bp, Homo sapiens
gactggaaagcacaa

SEQ ID NO: 3619662 - DNA, 16 bp, Homo sapiens
gactggaaagcacaag

SEQ ID NO: 3619663 - DNA, 13 bp, Homo sapiens
gactggaggaggc

SEQ ID NO: 3619664 - DNA, 16 bp, Homo sapiens
gactggaggaggcctg

SEQ ID NO: 3619665 - DNA, 14 bp, Homo sapiens
gactggcacagttt

SEQ ID NO: 3619666 - DNA, 17 bp, Homo sapiens
gactggcccagtgccag

SEQ ID NO: 3619667 - DNA, 17 bp, Homo sapiens
gactgggcactggggcc

SEQ ID NO: 3619668 - DNA, 18 bp, Homo sapiens
gactgggcactggggcct

SEQ ID NO: 3619669 - DNA, 16 bp, Homo sapiens
gactgggggcagacat

SEQ ID NO: 3619670 - DNA, 16 bp, Homo sapiens
gactggtccagctctg

SEQ ID NO: 3619671 - DNA, 20 bp, Homo sapiens
gactggtccagctctgacat

SEQ ID NO: 3619672 - DNA, 18 bp, Homo sapiens
gactggtgctaatgtcaa

SEQ ID NO: 3619673 - DNA, 21 bp, Homo sapiens
gactgtgaacttgactgggtg

SEQ ID NO: 3619674 - DNA, 23 bp, Homo sapiens
gactgtgacagactttggacagt

SEQ ID NO: 3619675 - DNA, 20 bp, Homo sapiens
gactgtgtttaactgctgca

SEQ ID NO: 3619676 - DNA, 22 bp, Homo sapiens
gactgttgggacagccattttc

SEQ ID NO: 3619677 - DNA, 13 bp, Homo sapiens
gactgtttcaaac

SEQ ID NO: 3619678 - DNA, 20 bp, Homo sapiens
gacttagaggcaacaggatt

SEQ ID NO: 3619679 - DNA, 19 bp, Homo sapiens
gacttatttctgctctgga

SEQ ID NO: 3619680 - DNA, 20 bp, Homo sapiens
gacttcaggtcaggtggctg

SEQ ID NO: 3619681 - DNA, 18 bp, Homo sapiens
gacttcagtgaatatttt

SEQ ID NO: 3619682 - DNA, 12 bp, Homo sapiens
gacttcctctgg

SEQ ID NO: 3619683 - DNA, 14 bp, Homo sapiens
gacttcctctggct

SEQ ID NO: 3619684 - DNA, 22 bp, Homo sapiens
gacttcctctggctccccaagg

SEQ ID NO: 3619685 - DNA, 18 bp, Homo sapiens
gacttctaagtaaaacca

SEQ ID NO: 3619686 - DNA, 14 bp, Homo sapiens
gacttctctttctt

SEQ ID NO: 3619687 - DNA, 15 bp, Homo sapiens
gacttctctttctta

SEQ ID NO: 3619688 - DNA, 23 bp, Homo sapiens
gacttctctttcttattttgtaa

SEQ ID NO: 3619689 - DNA, 17 bp, Homo sapiens
gacttgaaaagaaagaa

SEQ ID NO: 3619690 - DNA, 16 bp, Homo sapiens
gacttgtgtctctgtg

SEQ ID NO: 3619691 - DNA, 15 bp, Homo sapiens
gactttagctttctg

SEQ ID NO: 3619692 - DNA, 19 bp, Homo sapiens
gactttatcctgagtccct

SEQ ID NO: 3619693 - DNA, 15 bp, Homo sapiens
gactttccagaatga

SEQ ID NO: 3619694 - DNA, 21 bp, Homo sapiens
gactttgatactaccagggtc

SEQ ID NO: 3619695 - DNA, 12 bp, Homo sapiens
gactttgatcca

SEQ ID NO: 3619696 - DNA, 16 bp, Homo sapiens
gactttggacagtggc

SEQ ID NO: 3619697 - DNA, 20 bp, Homo sapiens
gactttgtgttcatttcatt

SEQ ID NO: 3619698 - DNA, 19 bp, Homo sapiens
gagaaaaccttaaaagtaa

SEQ ID NO: 3619699 - DNA, 23 bp, Homo sapiens
gagaaaaccttaaaagtaataaa

SEQ ID NO: 3619700 - DNA, 14 bp, Homo sapiens
gagaaacagctcag

SEQ ID NO: 3619701 - DNA, 21 bp, Homo sapiens
gagaaacagttggtaactttt

SEQ ID NO: 3619702 - DNA, 22 bp, Homo sapiens
gagaaacagttggtaacttttg

SEQ ID NO: 3619703 - DNA, 15 bp, Homo sapiens
gagaaacccagagat

SEQ ID NO: 3619704 - DNA, 14 bp, Homo sapiens
gagaaacttcaaag

SEQ ID NO: 3619705 - DNA, 15 bp, Homo sapiens
gagaaagactattca

SEQ ID NO: 3619706 - DNA, 13 bp, Homo sapiens
gagaaagagagaa

SEQ ID NO: 3619707 - DNA, 23 bp, Homo sapiens
gagaaagagagaagccagccaca

SEQ ID NO: 3619708 - DNA, 15 bp, Homo sapiens
gagaaagagctgcct

SEQ ID NO: 3619709 - DNA, 16 bp, Homo sapiens
gagaaagatgcagtcc

SEQ ID NO: 3619710 - DNA, 14 bp, Homo sapiens
gagaaagcaaaata

SEQ ID NO: 3619711 - DNA, 19 bp, Homo sapiens
gagaaagggattgctgagg

SEQ ID NO: 3619712 - DNA, 20 bp, Homo sapiens
gagaaagggattgctgaggc

SEQ ID NO: 3619713 - DNA, 17 bp, Homo sapiens
gagaaaggggagcccac

SEQ ID NO: 3619714 - DNA, 12 bp, Homo sapiens
gagaacagtggt

SEQ ID NO: 3619715 - DNA, 13 bp, Homo sapiens
gagaacagtggtt

SEQ ID NO: 3619716 - DNA, 17 bp, Homo sapiens
gagaacagtggttgcct

SEQ ID NO: 3619717 - DNA, 23 bp, Homo sapiens
gagaacagtggttgcctgggggc

SEQ ID NO: 3619718 - DNA, 19 bp, Homo sapiens
gagaaccaaccagggaagc

SEQ ID NO: 3619719 - DNA, 15 bp, Homo sapiens
gagaagataaggtct

SEQ ID NO: 3619720 - DNA, 11 bp, Homo sapiens
gagaagccagc

SEQ ID NO: 3619721 - DNA, 14 bp, Homo sapiens
gagaagccagccac

SEQ ID NO: 3619722 - DNA, 22 bp, Homo sapiens
gagaagccagctttcctcatca

SEQ ID NO: 3619723 - DNA, 22 bp, Homo sapiens
gagaagccaggaatttcccagg

SEQ ID NO: 3619724 - DNA, 23 bp, Homo sapiens
gagaagccagtgtctaggcactg

SEQ ID NO: 3619725 - DNA, 24 bp, Homo sapiens
gagaagccagtgtctaggcactga

SEQ ID NO: 3619726 - DNA, 22 bp, Homo sapiens
gagaagctcctctccccagccc

SEQ ID NO: 3619727 - DNA, 20 bp, Homo sapiens
gagaaggacccggaggggcc

SEQ ID NO: 3619728 - DNA, 16 bp, Homo sapiens
gagaaggcctggaaga

SEQ ID NO: 3619729 - DNA, 16 bp, Homo sapiens
gagaagtatacataag

SEQ ID NO: 3619730 - DNA, 18 bp, Homo sapiens
gagaagtcttctatttat

SEQ ID NO: 3619731 - DNA, 19 bp, Homo sapiens
gagaagtttgtagccaggt

SEQ ID NO: 3619732 - DNA, 15 bp, Homo sapiens
gagaatctatattta

SEQ ID NO: 3619733 - DNA, 18 bp, Homo sapiens
gagaatggcatggcagga

SEQ ID NO: 3619734 - DNA, 20 bp, Homo sapiens
gagaatggcctggagcaggc

SEQ ID NO: 3619735 - DNA, 21 bp, Homo sapiens
gagaatggcctggagcaggcc

SEQ ID NO: 3619736 - DNA, 22 bp, Homo sapiens
gagaatggcctggagcaggccc

SEQ ID NO: 3619737 - DNA, 19 bp, Homo sapiens
gagaatgggacgaggacat

SEQ ID NO: 3619738 - DNA, 20 bp, Homo sapiens
gagaatgggacgaggacatt

SEQ ID NO: 3619739 - DNA, 17 bp, Homo sapiens
gagaatgtcagtatgtg

SEQ ID NO: 3619740 - DNA, 23 bp, Homo sapiens
gagaatgtgtgtgtgtggcaggg

SEQ ID NO: 3619741 - DNA, 22 bp, Homo sapiens
gagacaaacacctcccaggaga

SEQ ID NO: 3619742 - DNA, 15 bp, Homo sapiens
gagacaaatctttaa

SEQ ID NO: 3619743 - DNA, 15 bp, Homo sapiens
gagacaccctctggg

SEQ ID NO: 3619744 - DNA, 16 bp, Homo sapiens
gagacaccctctgggg

SEQ ID NO: 3619745 - DNA, 20 bp, Homo sapiens
gagacagcagtttccagaga

SEQ ID NO: 3619746 - DNA, 22 bp, Homo sapiens
gagacagcagtttccagagagt

SEQ ID NO: 3619747 - DNA, 21 bp, Homo sapiens
gagacagcttctctgcagtaa

SEQ ID NO: 3619748 - DNA, 22 bp, Homo sapiens
gagacaggtgcctaacctggga

SEQ ID NO: 3619749 - DNA, 17 bp, Homo sapiens
gagacagtcctttccca

SEQ ID NO: 3619750 - DNA, 15 bp, Homo sapiens
gagacatacttgaag

SEQ ID NO: 3619751 - DNA, 12 bp, Homo sapiens
gagacatccagc

SEQ ID NO: 3619752 - DNA, 14 bp, Homo sapiens
gagacatgtgacat

SEQ ID NO: 3619753 - DNA, 21 bp, Homo sapiens
gagacattttccgcccactcc

SEQ ID NO: 3619754 - DNA, 23 bp, Homo sapiens
gagaccataagagaaacctgcca

SEQ ID NO: 3619755 - DNA, 20 bp, Homo sapiens
gagaccccaaagactctgga

SEQ ID NO: 3619756 - DNA, 19 bp, Homo sapiens
gagaccccgcacccggctc

SEQ ID NO: 3619757 - DNA, 14 bp, Homo sapiens
gagaccctgcaaga

SEQ ID NO: 3619758 - DNA, 13 bp, Homo sapiens
gagaccctggcct

SEQ ID NO: 3619759 - DNA, 17 bp, Homo sapiens
gagacctcatcagcctt

SEQ ID NO: 3619760 - DNA, 20 bp, Homo sapiens
gagacctcatcagccttggg

SEQ ID NO: 3619761 - DNA, 21 bp, Homo sapiens
gagacgcacacagctgagcac

SEQ ID NO: 3619762 - DNA, 17 bp, Homo sapiens
gagactcctcagcaccc

SEQ ID NO: 3619763 - DNA, 22 bp, Homo sapiens
gagactcctcagcacccctcca

SEQ ID NO: 3619764 - DNA, 18 bp, Homo sapiens
gagagaaagagagaagcc

SEQ ID NO: 3619765 - DNA, 11 bp, Homo sapiens
gagagaagcca

SEQ ID NO: 3619766 - DNA, 14 bp, Homo sapiens
gagagaagccagcc

SEQ ID NO: 3619767 - DNA, 16 bp, Homo sapiens
gagagaagccagccac

SEQ ID NO: 3619768 - DNA, 15 bp, Homo sapiens
gagagaccctggcct

SEQ ID NO: 3619769 - DNA, 16 bp, Homo sapiens
gagagaccctggcctc

SEQ ID NO: 3619770 - DNA, 14 bp, Homo sapiens
gagagagcagggct

SEQ ID NO: 3619771 - DNA, 13 bp, Homo sapiens
gagagagccagga

SEQ ID NO: 3619772 - DNA, 18 bp, Homo sapiens
gagagagtagctgcagcc

SEQ ID NO: 3619773 - DNA, 12 bp, Homo sapiens
gagagcagcagc

SEQ ID NO: 3619774 - DNA, 17 bp, Homo sapiens
gagagcagcagcaccaa

SEQ ID NO: 3619775 - DNA, 23 bp, Homo sapiens
gagagcatctcaggaggggcagc

SEQ ID NO: 3619776 - DNA, 20 bp, Homo sapiens
gagagcccagagtcccccca

SEQ ID NO: 3619777 - DNA, 14 bp, Homo sapiens
gagagccccatggt

SEQ ID NO: 3619778 - DNA, 16 bp, Homo sapiens
gagagcccttcatttg

SEQ ID NO: 3619779 - DNA, 13 bp, Homo sapiens
gagagcctggggg

SEQ ID NO: 3619780 - DNA, 23 bp, Homo sapiens
gagagccttacttcaaagtgcct

SEQ ID NO: 3619781 - DNA, 13 bp, Homo sapiens
gagagcggctgga

SEQ ID NO: 3619782 - DNA, 21 bp, Homo sapiens
gagaggactggttctgaggcc

SEQ ID NO: 3619783 - DNA, 23 bp, Homo sapiens
gagaggccctctggagtggccac

SEQ ID NO: 3619784 - DNA, 15 bp, Homo sapiens
gagaggccttttgga

SEQ ID NO: 3619785 - DNA, 18 bp, Homo sapiens
gagagggacaggcactcc

SEQ ID NO: 3619786 - DNA, 20 bp, Homo sapiens
gagaggtagcactctcagag

SEQ ID NO: 3619787 - DNA, 21 bp, Homo sapiens
gagaggtgattctcagggctg

SEQ ID NO: 3619788 - DNA, 21 bp, Homo sapiens
gagaggtttcgatatttattg

SEQ ID NO: 3619789 - DNA, 14 bp, Homo sapiens
gagagtcaaagctg

SEQ ID NO: 3619790 - DNA, 18 bp, Homo sapiens
gagagttctttgctgccc

SEQ ID NO: 3619791 - DNA, 14 bp, Homo sapiens
gagataaaaatcat

SEQ ID NO: 3619792 - DNA, 18 bp, Homo sapiens
gagataaggtggcttctc

SEQ ID NO: 3619793 - DNA, 13 bp, Homo sapiens
gagatactgtgta

SEQ ID NO: 3619794 - DNA, 17 bp, Homo sapiens
gagatattaaattctca

SEQ ID NO: 3619795 - DNA, 21 bp, Homo sapiens
gagatccaaaagaagccccca

SEQ ID NO: 3619796 - DNA, 22 bp, Homo sapiens
gagatccaaaagaagcccccag

SEQ ID NO: 3619797 - DNA, 20 bp, Homo sapiens
gagatctgtgtggctcctgg

SEQ ID NO: 3619798 - DNA, 22 bp, Homo sapiens
gagatctgtgtggctcctgggc

SEQ ID NO: 3619799 - DNA, 21 bp, Homo sapiens
gagatctttctttccaaaaca

SEQ ID NO: 3619800 - DNA, 16 bp, Homo sapiens
gagatgaccagggatg

SEQ ID NO: 3619801 - DNA, 18 bp, Homo sapiens
gagatgaccagggatgct

SEQ ID NO: 3619802 - DNA, 15 bp, Homo sapiens
gagatgctgtgcccc

SEQ ID NO: 3619803 - DNA, 17 bp, Homo sapiens
gagatggagggcttggc

SEQ ID NO: 3619804 - DNA, 21 bp, Homo sapiens
gagatggggaataatttcctt

SEQ ID NO: 3619805 - DNA, 23 bp, Homo sapiens
gagatggggaataatttccttca

SEQ ID NO: 3619806 - DNA, 14 bp, Homo sapiens
gagatgttgggaac

SEQ ID NO: 3619807 - DNA, 15 bp, Homo sapiens
gagattatgttcttt

SEQ ID NO: 3619808 - DNA, 21 bp, Homo sapiens
gagattgcgccattgcactcc

SEQ ID NO: 3619809 - DNA, 15 bp, Homo sapiens
gagcaaactctgctg

SEQ ID NO: 3619810 - DNA, 13 bp, Homo sapiens
gagcaacatttta

SEQ ID NO: 3619811 - DNA, 21 bp, Homo sapiens
gagcaagcaccaacctccaga

SEQ ID NO: 3619812 - DNA, 20 bp, Homo sapiens
gagcacaaagaagaaagctg

SEQ ID NO: 3619813 - DNA, 22 bp, Homo sapiens
gagcacaagaggagatccaggg

SEQ ID NO: 3619814 - DNA, 14 bp, Homo sapiens
gagcacagacacag

SEQ ID NO: 3619815 - DNA, 14 bp, Homo sapiens
gagcacccagagca

SEQ ID NO: 3619816 - DNA, 17 bp, Homo sapiens
gagcacccagagcaccc

SEQ ID NO: 3619817 - DNA, 14 bp, Homo sapiens
gagcaccccctgct

SEQ ID NO: 3619818 - DNA, 22 bp, Homo sapiens
gagcaccgcctgtgaaatacca

SEQ ID NO: 3619819 - DNA, 19 bp, Homo sapiens
gagcagaggaggggaaagt

SEQ ID NO: 3619820 - DNA, 21 bp, Homo sapiens
gagcagcaggaggggggaggg

SEQ ID NO: 3619821 - DNA, 13 bp, Homo sapiens
gagcagcaggcct

SEQ ID NO: 3619822 - DNA, 14 bp, Homo sapiens
gagcagcaggcctc

SEQ ID NO: 3619823 - DNA, 12 bp, Homo sapiens
gagcagcccagg

SEQ ID NO: 3619824 - DNA, 14 bp, Homo sapiens
gagcagcccagggc

SEQ ID NO: 3619825 - DNA, 16 bp, Homo sapiens
gagcagcccagggcct

SEQ ID NO: 3619826 - DNA, 17 bp, Homo sapiens
gagcaggcccaatgctg

SEQ ID NO: 3619827 - DNA, 22 bp, Homo sapiens
gagcaggcccaatgctgctttt

SEQ ID NO: 3619828 - DNA, 21 bp, Homo sapiens
gagcaggcttgtggcagcctg

SEQ ID NO: 3619829 - DNA, 21 bp, Homo sapiens
gagcaggttccccaagggccc

SEQ ID NO: 3619830 - DNA, 22 bp, Homo sapiens
gagcagtgttgcgtttttcctt

SEQ ID NO: 3619831 - DNA, 20 bp, Homo sapiens
gagcagttgttatattcatt

SEQ ID NO: 3619832 - DNA, 11 bp, Homo sapiens
gagcatcctga

SEQ ID NO: 3619833 - DNA, 13 bp, Homo sapiens
gagcatctcagga

SEQ ID NO: 3619834 - DNA, 16 bp, Homo sapiens
gagcatctcaggaggg

SEQ ID NO: 3619835 - DNA, 20 bp, Homo sapiens
gagcatctcaggaggggcag

SEQ ID NO: 3619836 - DNA, 14 bp, Homo sapiens
gagcatgcacatgc

SEQ ID NO: 3619837 - DNA, 16 bp, Homo sapiens
gagcatggagacagca

SEQ ID NO: 3619838 - DNA, 24 bp, Homo sapiens
gagcattgcagcctaagaagaagg

SEQ ID NO: 3619839 - DNA, 22 bp, Homo sapiens
gagcatttaatggcagctagtg

SEQ ID NO: 3619840 - DNA, 16 bp, Homo sapiens
gagcatttttaaggga

SEQ ID NO: 3619841 - DNA, 14 bp, Homo sapiens
gagccaagggatgg

SEQ ID NO: 3619842 - DNA, 15 bp, Homo sapiens
gagccaagggatgga

SEQ ID NO: 3619843 - DNA, 16 bp, Homo sapiens
gagccaagggatggac

SEQ ID NO: 3619844 - DNA, 19 bp, Homo sapiens
gagccaagggatggacatc

SEQ ID NO: 3619845 - DNA, 17 bp, Homo sapiens
gagccacagtcactgga

SEQ ID NO: 3619846 - DNA, 23 bp, Homo sapiens
gagccaccatgcttgcctgaagc

SEQ ID NO: 3619847 - DNA, 15 bp, Homo sapiens
gagccacctggatct

SEQ ID NO: 3619848 - DNA, 12 bp, Homo sapiens
gagccagcctgc

SEQ ID NO: 3619849 - DNA, 17 bp, Homo sapiens
gagccagcctgcttccc

SEQ ID NO: 3619850 - DNA, 14 bp, Homo sapiens
gagccatacataaa

SEQ ID NO: 3619851 - DNA, 21 bp, Homo sapiens
gagcccagcctgggagcccag

SEQ ID NO: 3619852 - DNA, 23 bp, Homo sapiens
gagcccaggcagctatttcagcc

SEQ ID NO: 3619853 - DNA, 20 bp, Homo sapiens
gagcccagtgaagcctctga

SEQ ID NO: 3619854 - DNA, 16 bp, Homo sapiens
gagcccatttctgggg

SEQ ID NO: 3619855 - DNA, 20 bp, Homo sapiens
gagcccccagccctgggaac

SEQ ID NO: 3619856 - DNA, 22 bp, Homo sapiens
gagcccccctagtggtatgggg

SEQ ID NO: 3619857 - DNA, 22 bp, Homo sapiens
gagcccctactgtgggcaaagt

SEQ ID NO: 3619858 - DNA, 18 bp, Homo sapiens
gagcccctccccagccag

SEQ ID NO: 3619859 - DNA, 21 bp, Homo sapiens
gagcccctgtctagagaggga

SEQ ID NO: 3619860 - DNA, 14 bp, Homo sapiens
gagcccgggagctg

SEQ ID NO: 3619861 - DNA, 13 bp, Homo sapiens
gagccctggagag

SEQ ID NO: 3619862 - DNA, 16 bp, Homo sapiens
gagccctggagagccc

SEQ ID NO: 3619863 - DNA, 22 bp, Homo sapiens
gagcccttctatacccacccag

SEQ ID NO: 3619864 - DNA, 15 bp, Homo sapiens
gagccgaagcccagg

SEQ ID NO: 3619865 - DNA, 20 bp, Homo sapiens
gagccgggcaaactggccgc

SEQ ID NO: 3619866 - DNA, 22 bp, Homo sapiens
gagcctacctctgtctgagaca

SEQ ID NO: 3619867 - DNA, 17 bp, Homo sapiens
gagcctagcggagccca

SEQ ID NO: 3619868 - DNA, 19 bp, Homo sapiens
gagcctagcggagcccagc

SEQ ID NO: 3619869 - DNA, 20 bp, Homo sapiens
gagcctagcggagcccagcc

SEQ ID NO: 3619870 - DNA, 23 bp, Homo sapiens
gagcctcctgggaacacatctgg

SEQ ID NO: 3619871 - DNA, 12 bp, Homo sapiens
gagcctctggct

SEQ ID NO: 3619872 - DNA, 14 bp, Homo sapiens
gagcctctggcttc

SEQ ID NO: 3619873 - DNA, 18 bp, Homo sapiens
gagcctgctctccgcgcc

SEQ ID NO: 3619874 - DNA, 19 bp, Homo sapiens
gagcctggccaggcaggga

SEQ ID NO: 3619875 - DNA, 22 bp, Homo sapiens
gagcctggttcagacacagctc

SEQ ID NO: 3619876 - DNA, 19 bp, Homo sapiens
gagcctgtgcgtcccagct

SEQ ID NO: 3619877 - DNA, 17 bp, Homo sapiens
gagccttcccgggcggg

SEQ ID NO: 3619878 - DNA, 12 bp, Homo sapiens
gagccttttgct

SEQ ID NO: 3619879 - DNA, 20 bp, Homo sapiens
gagcctttttacctggccta

SEQ ID NO: 3619880 - DNA, 17 bp, Homo sapiens
gagcgagcaagccggca

SEQ ID NO: 3619881 - DNA, 15 bp, Homo sapiens
gagcgcaggcagcgc

SEQ ID NO: 3619882 - DNA, 20 bp, Homo sapiens
gagcgcaggcagcgcagggc

SEQ ID NO: 3619883 - DNA, 17 bp, Homo sapiens
gagcgccatcatgtctt

SEQ ID NO: 3619884 - DNA, 13 bp, Homo sapiens
gagcgccctgcag

SEQ ID NO: 3619885 - DNA, 13 bp, Homo sapiens
gagcggctggaga

SEQ ID NO: 3619886 - DNA, 20 bp, Homo sapiens
gagctccatacacacgctgc

SEQ ID NO: 3619887 - DNA, 21 bp, Homo sapiens
gagctccatacacacgctgcc

SEQ ID NO: 3619888 - DNA, 19 bp, Homo sapiens
gagctctggggacagcttc

SEQ ID NO: 3619889 - DNA, 13 bp, Homo sapiens
gagctctggtgct

SEQ ID NO: 3619890 - DNA, 15 bp, Homo sapiens
gagctcttggcagga

SEQ ID NO: 3619891 - DNA, 11 bp, Homo sapiens
gagctgcctgg

SEQ ID NO: 3619892 - DNA, 12 bp, Homo sapiens
gagctgcctgga

SEQ ID NO: 3619893 - DNA, 21 bp, Homo sapiens
gagctgcctggatgagaaaca

SEQ ID NO: 3619894 - DNA, 19 bp, Homo sapiens
gagctgctgggtggcaggg

SEQ ID NO: 3619895 - DNA, 21 bp, Homo sapiens
gagctgctgggtggcaggggg

SEQ ID NO: 3619896 - DNA, 13 bp, Homo sapiens
gagctggaagggg

SEQ ID NO: 3619897 - DNA, 15 bp, Homo sapiens
gagctggaaggggcc

SEQ ID NO: 3619898 - DNA, 17 bp, Homo sapiens
gagctggcaaccagcca

SEQ ID NO: 3619899 - DNA, 21 bp, Homo sapiens
gagctggcaaccagccagcgt

SEQ ID NO: 3619900 - DNA, 17 bp, Homo sapiens
gagctggcccttgggga

SEQ ID NO: 3619901 - DNA, 12 bp, Homo sapiens
gagctggcctgt

SEQ ID NO: 3619902 - DNA, 16 bp, Homo sapiens
gagctgggcaggaagg

SEQ ID NO: 3619903 - DNA, 16 bp, Homo sapiens
gagctggggactcagg

SEQ ID NO: 3619904 - DNA, 11 bp, Homo sapiens
gagctgtgcca

SEQ ID NO: 3619905 - DNA, 12 bp, Homo sapiens
gagctgtgccag

SEQ ID NO: 3619906 - DNA, 18 bp, Homo sapiens
gagctgtgccagcagggg

SEQ ID NO: 3619907 - DNA, 17 bp, Homo sapiens
gagctgttcacagccag

SEQ ID NO: 3619908 - DNA, 20 bp, Homo sapiens
gagctgttcacagccagact

SEQ ID NO: 3619909 - DNA, 22 bp, Homo sapiens
gagctgttcacagccagactgg

SEQ ID NO: 3619910 - DNA, 15 bp, Homo sapiens
gagcttcagccaggt

SEQ ID NO: 3619911 - DNA, 20 bp, Homo sapiens
gagcttccaattttccttca

SEQ ID NO: 3619912 - DNA, 23 bp, Homo sapiens
gagcttccgctttgaaagaagca

SEQ ID NO: 3619913 - DNA, 14 bp, Homo sapiens
gagcttctggcact

SEQ ID NO: 3619914 - DNA, 17 bp, Homo sapiens
gaggaaaaactgacaga

SEQ ID NO: 3619915 - DNA, 23 bp, Homo sapiens
gaggaaaaccaagccgtggcttc

SEQ ID NO: 3619916 - DNA, 18 bp, Homo sapiens
gaggaaaaggcccctgca

SEQ ID NO: 3619917 - DNA, 14 bp, Homo sapiens
gaggaactccagag

SEQ ID NO: 3619918 - DNA, 20 bp, Homo sapiens
gaggaaggggccccatggca

SEQ ID NO: 3619919 - DNA, 16 bp, Homo sapiens
gaggaagtgagcagtc

SEQ ID NO: 3619920 - DNA, 18 bp, Homo sapiens
gaggacaagagaaaaaag

SEQ ID NO: 3619921 - DNA, 20 bp, Homo sapiens
gaggacataatggggtcctg

SEQ ID NO: 3619922 - DNA, 20 bp, Homo sapiens
gaggacatttgtgggcaagc

SEQ ID NO: 3619923 - DNA, 23 bp, Homo sapiens
gaggacatttgtgggcaagcaga

SEQ ID NO: 3619924 - DNA, 16 bp, Homo sapiens
gaggaccaatgcttgc

SEQ ID NO: 3619925 - DNA, 19 bp, Homo sapiens
gaggactggttctgaggcc

SEQ ID NO: 3619926 - DNA, 16 bp, Homo sapiens
gaggagaaaaagaaga

SEQ ID NO: 3619927 - DNA, 17 bp, Homo sapiens
gaggagaaaaagaagaa

SEQ ID NO: 3619928 - DNA, 16 bp, Homo sapiens
gaggagaacttgctgc

SEQ ID NO: 3619929 - DNA, 18 bp, Homo sapiens
gaggagaacttgctgcct

SEQ ID NO: 3619930 - DNA, 15 bp, Homo sapiens
gaggagagagacccc

SEQ ID NO: 3619931 - DNA, 17 bp, Homo sapiens
gaggagagagaccccgc

SEQ ID NO: 3619932 - DNA, 16 bp, Homo sapiens
gaggagagaggaggaa

SEQ ID NO: 3619933 - DNA, 17 bp, Homo sapiens
gaggagagaggaggaaa

SEQ ID NO: 3619934 - DNA, 18 bp, Homo sapiens
gaggagatgaccagggat

SEQ ID NO: 3619935 - DNA, 16 bp, Homo sapiens
gaggagcagcaggagg

SEQ ID NO: 3619936 - DNA, 20 bp, Homo sapiens
gaggagcagcaggagggggg

SEQ ID NO: 3619937 - DNA, 16 bp, Homo sapiens
gaggagccaccagttc

SEQ ID NO: 3619938 - DNA, 18 bp, Homo sapiens
gaggagccaccagttctc

SEQ ID NO: 3619939 - DNA, 23 bp, Homo sapiens
gaggagcctgtgcgtcccagctg

SEQ ID NO: 3619940 - DNA, 16 bp, Homo sapiens
gaggaggggccgctgc

SEQ ID NO: 3619941 - DNA, 18 bp, Homo sapiens
gaggaggggccgctgcca

SEQ ID NO: 3619942 - DNA, 14 bp, Homo sapiens
gaggagggggcagg

SEQ ID NO: 3619943 - DNA, 14 bp, Homo sapiens
gaggataggacaga

SEQ ID NO: 3619944 - DNA, 21 bp, Homo sapiens
gaggatccactcccaggatga

SEQ ID NO: 3619945 - DNA, 15 bp, Homo sapiens
gaggatccagggcag

SEQ ID NO: 3619946 - DNA, 21 bp, Homo sapiens
gaggatccagggcagcaggcc

SEQ ID NO: 3619947 - DNA, 15 bp, Homo sapiens
gaggatgtctgggcc

SEQ ID NO: 3619948 - DNA, 16 bp, Homo sapiens
gaggcacactttctgg

SEQ ID NO: 3619949 - DNA, 18 bp, Homo sapiens
gaggcaccgtccaggccc

SEQ ID NO: 3619950 - DNA, 18 bp, Homo sapiens
gaggcagggacctaaagg

SEQ ID NO: 3619951 - DNA, 16 bp, Homo sapiens
gaggcatgggtgagca

SEQ ID NO: 3619952 - DNA, 22 bp, Homo sapiens
gaggccacattgctggctgccc

SEQ ID NO: 3619953 - DNA, 23 bp, Homo sapiens
gaggccaccccaaaccccagccc

SEQ ID NO: 3619954 - DNA, 14 bp, Homo sapiens
gaggccagaaaggt

SEQ ID NO: 3619955 - DNA, 12 bp, Homo sapiens
gaggccatctgg

SEQ ID NO: 3619956 - DNA, 16 bp, Homo sapiens
gaggccatctggagag

SEQ ID NO: 3619957 - DNA, 12 bp, Homo sapiens
gaggcccagaga

SEQ ID NO: 3619958 - DNA, 16 bp, Homo sapiens
gaggcccagagaggga

SEQ ID NO: 3619959 - DNA, 23 bp, Homo sapiens
gaggccccagcctccctgaagcc

SEQ ID NO: 3619960 - DNA, 19 bp, Homo sapiens
gaggcccctaggtgcccag

SEQ ID NO: 3619961 - DNA, 17 bp, Homo sapiens
gaggccctctggagtgg

SEQ ID NO: 3619962 - DNA, 14 bp, Homo sapiens
gaggccctggaggt

SEQ ID NO: 3619963 - DNA, 21 bp, Homo sapiens
gaggccctggaggtctccagg

SEQ ID NO: 3619964 - DNA, 16 bp, Homo sapiens
gaggcctgccccctgg

SEQ ID NO: 3619965 - DNA, 19 bp, Homo sapiens
gaggcctgccccctgggct

SEQ ID NO: 3619966 - DNA, 14 bp, Homo sapiens
gaggcctgtcccaa

SEQ ID NO: 3619967 - DNA, 21 bp, Homo sapiens
gaggcgcacagtgtgagcccg

SEQ ID NO: 3619968 - DNA, 16 bp, Homo sapiens
gaggcgtactacccag

SEQ ID NO: 3619969 - DNA, 18 bp, Homo sapiens
gaggcgtactacccagct

SEQ ID NO: 3619970 - DNA, 20 bp, Homo sapiens
gaggcgtactacccagctct

SEQ ID NO: 3619971 - DNA, 21 bp, Homo sapiens
gaggcgtactacccagctctg

SEQ ID NO: 3619972 - DNA, 22 bp, Homo sapiens
gaggctacctcacctgggcagg

SEQ ID NO: 3619973 - DNA, 14 bp, Homo sapiens
gaggctcagagagg

SEQ ID NO: 3619974 - DNA, 14 bp, Homo sapiens
gaggctcctctagg

SEQ ID NO: 3619975 - DNA, 15 bp, Homo sapiens
gaggctcctctaggc

SEQ ID NO: 3619976 - DNA, 20 bp, Homo sapiens
gagggaagacctgaaagaga

SEQ ID NO: 3619977 - DNA, 16 bp, Homo sapiens
gagggaagggagccaa

SEQ ID NO: 3619978 - DNA, 18 bp, Homo sapiens
gagggacaggctgaagag

SEQ ID NO: 3619979 - DNA, 12 bp, Homo sapiens
gagggaggaagg

SEQ ID NO: 3619980 - DNA, 20 bp, Homo sapiens
gagggatggagaaagaagtg

SEQ ID NO: 3619981 - DNA, 18 bp, Homo sapiens
gagggccaagagatctgt

SEQ ID NO: 3619982 - DNA, 12 bp, Homo sapiens
gagggcccagcc

SEQ ID NO: 3619983 - DNA, 20 bp, Homo sapiens
gagggcccagcccagagcca

SEQ ID NO: 3619984 - DNA, 16 bp, Homo sapiens
gagggcttggcccagc

SEQ ID NO: 3619985 - DNA, 17 bp, Homo sapiens
gagggcttggcccagcg

SEQ ID NO: 3619986 - DNA, 16 bp, Homo sapiens
gaggggcaagctaggc

SEQ ID NO: 3619987 - DNA, 17 bp, Homo sapiens
gaggggcaagctaggcc

SEQ ID NO: 3619988 - DNA, 23 bp, Homo sapiens
gaggggcaagctaggccccagag

SEQ ID NO: 3619989 - DNA, 13 bp, Homo sapiens
gaggggcagcgca

SEQ ID NO: 3619990 - DNA, 21 bp, Homo sapiens
gaggggcagcgcatgtgtgca

SEQ ID NO: 3619991 - DNA, 23 bp, Homo sapiens
gaggggcagcgcatgtgtgcatg

SEQ ID NO: 3619992 - DNA, 17 bp, Homo sapiens
gaggggcctaggcctca

SEQ ID NO: 3619993 - DNA, 22 bp, Homo sapiens
gaggggcctaggcctcagccag

SEQ ID NO: 3619994 - DNA, 23 bp, Homo sapiens
gaggggcctaggcctcagccaga

SEQ ID NO: 3619995 - DNA, 18 bp, Homo sapiens
gaggggcctggcagccgt

SEQ ID NO: 3619996 - DNA, 20 bp, Homo sapiens
gaggggcctggcagccgtgc

SEQ ID NO: 3619997 - DNA, 21 bp, Homo sapiens
gaggggcgttctcccaaagat

SEQ ID NO: 3619998 - DNA, 15 bp, Homo sapiens
gagggggagtagcca

SEQ ID NO: 3619999 - DNA, 22 bp, Homo sapiens
gaggggtgcggcggtcccagct

SEQ ID NO: 3620000 - DNA, 15 bp, Homo sapiens
gagggtccacctgga

SEQ ID NO: 3620001 - DNA, 18 bp, Homo sapiens
gagggtccacctggagag

SEQ ID NO: 3620002 - DNA, 22 bp, Homo sapiens
gagggtcccggtgtatcctggc

SEQ ID NO: 3620003 - DNA, 23 bp, Homo sapiens
gagggtcccggtgtatcctggcc

SEQ ID NO: 3620004 - DNA, 17 bp, Homo sapiens
gagggtcctgcagcctg

SEQ ID NO: 3620005 - DNA, 18 bp, Homo sapiens
gagggtcctgcagcctgc

SEQ ID NO: 3620006 - DNA, 19 bp, Homo sapiens
gagggtcgtgggaaagggg

SEQ ID NO: 3620007 - DNA, 18 bp, Homo sapiens
gagggtctcccctcctgc

SEQ ID NO: 3620008 - DNA, 22 bp, Homo sapiens
gagggtgccgtgcgggcgaggc

SEQ ID NO: 3620009 - DNA, 12 bp, Homo sapiens
gagggttgctgg

SEQ ID NO: 3620010 - DNA, 19 bp, Homo sapiens
gaggtatttatctttactt

SEQ ID NO: 3620011 - DNA, 16 bp, Homo sapiens
gaggtcaccaggggag

SEQ ID NO: 3620012 - DNA, 21 bp, Homo sapiens
gaggtcaccaggggaggagcc

SEQ ID NO: 3620013 - DNA, 11 bp, Homo sapiens
gaggtcactgc

SEQ ID NO: 3620014 - DNA, 22 bp, Homo sapiens
gaggtcaggaaacttttaactg

SEQ ID NO: 3620015 - DNA, 16 bp, Homo sapiens
gaggtcatctggcgga

SEQ ID NO: 3620016 - DNA, 22 bp, Homo sapiens
gaggtccatggagaaggcatat

SEQ ID NO: 3620017 - DNA, 13 bp, Homo sapiens
gaggtctccaggg

SEQ ID NO: 3620018 - DNA, 17 bp, Homo sapiens
gaggtctccaggggcct

SEQ ID NO: 3620019 - DNA, 22 bp, Homo sapiens
gaggtctccaggggcctgcaga

SEQ ID NO: 3620020 - DNA, 15 bp, Homo sapiens
gaggtctctgggagc

SEQ ID NO: 3620021 - DNA, 18 bp, Homo sapiens
gaggtctctgggagccca

SEQ ID NO: 3620022 - DNA, 15 bp, Homo sapiens
gaggtctgattggct

SEQ ID NO: 3620023 - DNA, 18 bp, Homo sapiens
gaggtgaaaatgaagaag

SEQ ID NO: 3620024 - DNA, 17 bp, Homo sapiens
gaggtgaaagcataaca

SEQ ID NO: 3620025 - DNA, 17 bp, Homo sapiens
gaggtgaactccaggca

SEQ ID NO: 3620026 - DNA, 19 bp, Homo sapiens
gaggtgaactccaggcatg

SEQ ID NO: 3620027 - DNA, 20 bp, Homo sapiens
gaggtgattctcagggctgg

SEQ ID NO: 3620028 - DNA, 15 bp, Homo sapiens
gaggtgcaaggagtg

SEQ ID NO: 3620029 - DNA, 23 bp, Homo sapiens
gaggtgggccacacccaggaagg

SEQ ID NO: 3620030 - DNA, 23 bp, Homo sapiens
gaggtgtattggtgttgcagccg

SEQ ID NO: 3620031 - DNA, 18 bp, Homo sapiens
gaggttgtggggcctcag

SEQ ID NO: 3620032 - DNA, 21 bp, Homo sapiens
gagtaactatcgaaatgacgg

SEQ ID NO: 3620033 - DNA, 21 bp, Homo sapiens
gagtatatttttgtctgcagc

SEQ ID NO: 3620034 - DNA, 22 bp, Homo sapiens
gagtatatttttgtctgcagct

SEQ ID NO: 3620035 - DNA, 11 bp, Homo sapiens
gagtcaaatcc

SEQ ID NO: 3620036 - DNA, 17 bp, Homo sapiens
gagtcaaatccagtggt

SEQ ID NO: 3620037 - DNA, 18 bp, Homo sapiens
gagtcaaatccagtggtg

SEQ ID NO: 3620038 - DNA, 11 bp, Homo sapiens
gagtcacctgc

SEQ ID NO: 3620039 - DNA, 14 bp, Homo sapiens
gagtcacctgctcc

SEQ ID NO: 3620040 - DNA, 15 bp, Homo sapiens
gagtcacctgctcca

SEQ ID NO: 3620041 - DNA, 16 bp, Homo sapiens
gagtcacctgctccag

SEQ ID NO: 3620042 - DNA, 18 bp, Homo sapiens
gagtcagggagagctgaa

SEQ ID NO: 3620043 - DNA, 20 bp, Homo sapiens
gagtcatttaaatgtgtaca

SEQ ID NO: 3620044 - DNA, 21 bp, Homo sapiens
gagtcccttaatcttatgggg

SEQ ID NO: 3620045 - DNA, 13 bp, Homo sapiens
gagtcctctgaat

SEQ ID NO: 3620046 - DNA, 13 bp, Homo sapiens
gagtcgctgtgcc

SEQ ID NO: 3620047 - DNA, 16 bp, Homo sapiens
gagtctcttctccact

SEQ ID NO: 3620048 - DNA, 14 bp, Homo sapiens
gagtgaataaatgt

SEQ ID NO: 3620049 - DNA, 15 bp, Homo sapiens
gagtgaataaatgtc

SEQ ID NO: 3620050 - DNA, 15 bp, Homo sapiens
gagtgagtcacctgc

SEQ ID NO: 3620051 - DNA, 18 bp, Homo sapiens
gagtgagtcacctgctcc

SEQ ID NO: 3620052 - DNA, 22 bp, Homo sapiens
gagtgagtcacctgctccagaa

SEQ ID NO: 3620053 - DNA, 18 bp, Homo sapiens
gagtgagttcaactacat

SEQ ID NO: 3620054 - DNA, 21 bp, Homo sapiens
gagtgcaagcccctgctccag

SEQ ID NO: 3620055 - DNA, 16 bp, Homo sapiens
gagtgcacctgcctcc

SEQ ID NO: 3620056 - DNA, 12 bp, Homo sapiens
gagtgcctggag

SEQ ID NO: 3620057 - DNA, 13 bp, Homo sapiens
gagtgcctggagt

SEQ ID NO: 3620058 - DNA, 14 bp, Homo sapiens
gagtgcctggagtc

SEQ ID NO: 3620059 - DNA, 14 bp, Homo sapiens
gagtgctcttccca

SEQ ID NO: 3620060 - DNA, 15 bp, Homo sapiens
gagtggagagagcag

SEQ ID NO: 3620061 - DNA, 11 bp, Homo sapiens
gagtggccact

SEQ ID NO: 3620062 - DNA, 19 bp, Homo sapiens
gagtgggccccgggctgga

SEQ ID NO: 3620063 - DNA, 22 bp, Homo sapiens
gagtgggccccgggctggagaa

SEQ ID NO: 3620064 - DNA, 16 bp, Homo sapiens
gagtggttaggcagca

SEQ ID NO: 3620065 - DNA, 18 bp, Homo sapiens
gagtgtagcctaaagggc

SEQ ID NO: 3620066 - DNA, 19 bp, Homo sapiens
gagtgtagcctaaagggca

SEQ ID NO: 3620067 - DNA, 16 bp, Homo sapiens
gagtgtcatgaagtgc

SEQ ID NO: 3620068 - DNA, 20 bp, Homo sapiens
gagtgtcatgaagtgcacag

SEQ ID NO: 3620069 - DNA, 16 bp, Homo sapiens
gagtgtcctgcccatg

SEQ ID NO: 3620070 - DNA, 19 bp, Homo sapiens
gagtgtcctgcccatgccc

SEQ ID NO: 3620071 - DNA, 21 bp, Homo sapiens
gagtgtgtaatttaaaattgt

SEQ ID NO: 3620072 - DNA, 22 bp, Homo sapiens
gagtgtgtaatttaaaattgtg

SEQ ID NO: 3620073 - DNA, 14 bp, Homo sapiens
gagttaagacctgg

SEQ ID NO: 3620074 - DNA, 15 bp, Homo sapiens
gagttacagttctgt

SEQ ID NO: 3620075 - DNA, 17 bp, Homo sapiens
gagttacagttctgtgg

SEQ ID NO: 3620076 - DNA, 14 bp, Homo sapiens
gagttcaactacat

SEQ ID NO: 3620077 - DNA, 13 bp, Homo sapiens
gagttcctctgca

SEQ ID NO: 3620078 - DNA, 17 bp, Homo sapiens
gagttccttatccctct

SEQ ID NO: 3620079 - DNA, 15 bp, Homo sapiens
gagtttatccatcct

SEQ ID NO: 3620080 - DNA, 12 bp, Homo sapiens
gagtttctgttt

SEQ ID NO: 3620081 - DNA, 20 bp, Homo sapiens
gagtttgagaccagcctggc

SEQ ID NO: 3620082 - DNA, 16 bp, Homo sapiens
gagttttataaattaa

SEQ ID NO: 3620083 - DNA, 22 bp, Homo sapiens
gagtttttcccagctacacctt

SEQ ID NO: 3620084 - DNA, 21 bp, Homo sapiens
gataaaataatgctgcaaact

SEQ ID NO: 3620085 - DNA, 16 bp, Homo sapiens
gataaacaacaaggtg

SEQ ID NO: 3620086 - DNA, 18 bp, Homo sapiens
gataaacaacaaggtggt

SEQ ID NO: 3620087 - DNA, 19 bp, Homo sapiens
gataacaatgttttaacaa

SEQ ID NO: 3620088 - DNA, 13 bp, Homo sapiens
gataacactgact

SEQ ID NO: 3620089 - DNA, 15 bp, Homo sapiens
gataaggtggcttct

SEQ ID NO: 3620090 - DNA, 17 bp, Homo sapiens
gataatagggttttcag

SEQ ID NO: 3620091 - DNA, 14 bp, Homo sapiens
gataataggtcata

SEQ ID NO: 3620092 - DNA, 17 bp, Homo sapiens
gatacaggtgacagtga

SEQ ID NO: 3620093 - DNA, 16 bp, Homo sapiens
gataccattctattct

SEQ ID NO: 3620094 - DNA, 22 bp, Homo sapiens
gataccattctattctccagac

SEQ ID NO: 3620095 - DNA, 16 bp, Homo sapiens
gatactaccagggtct

SEQ ID NO: 3620096 - DNA, 22 bp, Homo sapiens
gatactaccagggtctctcagg

SEQ ID NO: 3620097 - DNA, 16 bp, Homo sapiens
gatacttatttttctg

SEQ ID NO: 3620098 - DNA, 19 bp, Homo sapiens
gatacttcccacaccacaa

SEQ ID NO: 3620099 - DNA, 18 bp, Homo sapiens
gatactttgatattttca

SEQ ID NO: 3620100 - DNA, 17 bp, Homo sapiens
gatagatgactttgcag

SEQ ID NO: 3620101 - DNA, 18 bp, Homo sapiens
gatagatgactttgcaga

SEQ ID NO: 3620102 - DNA, 12 bp, Homo sapiens
gatagatgctgg

SEQ ID NO: 3620103 - DNA, 16 bp, Homo sapiens
gatagatgctggccca

SEQ ID NO: 3620104 - DNA, 20 bp, Homo sapiens
gatagatgctggcccagggc

SEQ ID NO: 3620105 - DNA, 23 bp, Homo sapiens
gatagcttcaccccaatcccagc

SEQ ID NO: 3620106 - DNA, 14 bp, Homo sapiens
gataggaaactgaa

SEQ ID NO: 3620107 - DNA, 22 bp, Homo sapiens
gataggactccatttctttctt

SEQ ID NO: 3620108 - DNA, 15 bp, Homo sapiens
gataggtaaattttt

SEQ ID NO: 3620109 - DNA, 19 bp, Homo sapiens
gatagtccttcctggcatc

SEQ ID NO: 3620110 - DNA, 16 bp, Homo sapiens
gatagtgatgtatttt

SEQ ID NO: 3620111 - DNA, 20 bp, Homo sapiens
gatagtgtgaagatctttgg

SEQ ID NO: 3620112 - DNA, 21 bp, Homo sapiens
gatagtgttctgctcctgctt

SEQ ID NO: 3620113 - DNA, 19 bp, Homo sapiens
gatatataggctattttct

SEQ ID NO: 3620114 - DNA, 15 bp, Homo sapiens
gatatatttaagcct

SEQ ID NO: 3620115 - DNA, 20 bp, Homo sapiens
gatatattttatttttagaa

SEQ ID NO: 3620116 - DNA, 20 bp, Homo sapiens
gatatctagctagtaatata

SEQ ID NO: 3620117 - DNA, 14 bp, Homo sapiens
gatatgattggcaa

SEQ ID NO: 3620118 - DNA, 22 bp, Homo sapiens
gatatgcatgtagcatataaat

SEQ ID NO: 3620119 - DNA, 23 bp, Homo sapiens
gatatgcatgtagcatataaatg

SEQ ID NO: 3620120 - DNA, 12 bp, Homo sapiens
gatatggcagga

SEQ ID NO: 3620121 - DNA, 15 bp, Homo sapiens
gatatggcaggactc

SEQ ID NO: 3620122 - DNA, 19 bp, Homo sapiens
gatatggcaggactcctgg

SEQ ID NO: 3620123 - DNA, 16 bp, Homo sapiens
gatatggctgcccagg

SEQ ID NO: 3620124 - DNA, 18 bp, Homo sapiens
gatatggctgcccaggag

SEQ ID NO: 3620125 - DNA, 13 bp, Homo sapiens
gatattaatgtat

SEQ ID NO: 3620126 - DNA, 15 bp, Homo sapiens
gatattgaaggaatt

SEQ ID NO: 3620127 - DNA, 14 bp, Homo sapiens
gatattgatattga

SEQ ID NO: 3620128 - DNA, 21 bp, Homo sapiens
gatattgttataaataaaatt

SEQ ID NO: 3620129 - DNA, 17 bp, Homo sapiens
gatatttattgatgttt

SEQ ID NO: 3620130 - DNA, 18 bp, Homo sapiens
gatatttattgatgtttt

SEQ ID NO: 3620131 - DNA, 19 bp, Homo sapiens
gatatttgcctgtctgttt

SEQ ID NO: 3620132 - DNA, 14 bp, Homo sapiens
gatcagaacatgaa

SEQ ID NO: 3620133 - DNA, 16 bp, Homo sapiens
gatcagaacattcagc

SEQ ID NO: 3620134 - DNA, 22 bp, Homo sapiens
gatcagaacattcagctctgga

SEQ ID NO: 3620135 - DNA, 14 bp, Homo sapiens
gatcaggaggaagt

SEQ ID NO: 3620136 - DNA, 16 bp, Homo sapiens
gatcatatggtaggac

SEQ ID NO: 3620137 - DNA, 19 bp, Homo sapiens
gatcatatggtaggaccct

SEQ ID NO: 3620138 - DNA, 19 bp, Homo sapiens
gatccaaaagaagccccca

SEQ ID NO: 3620139 - DNA, 15 bp, Homo sapiens
gatccaagcaaaact

SEQ ID NO: 3620140 - DNA, 14 bp, Homo sapiens
gatccactcccagg

SEQ ID NO: 3620141 - DNA, 13 bp, Homo sapiens
gatccagcactgg

SEQ ID NO: 3620142 - DNA, 17 bp, Homo sapiens
gatccagcccaaacctg

SEQ ID NO: 3620143 - DNA, 19 bp, Homo sapiens
gatccagcccaaacctggg

SEQ ID NO: 3620144 - DNA, 20 bp, Homo sapiens
gatccagcccaaacctggga

SEQ ID NO: 3620145 - DNA, 12 bp, Homo sapiens
gatccaggacta

SEQ ID NO: 3620146 - DNA, 12 bp, Homo sapiens
gatccagggaca

SEQ ID NO: 3620147 - DNA, 18 bp, Homo sapiens
gatccagggacagaggcc

SEQ ID NO: 3620148 - DNA, 17 bp, Homo sapiens
gatccagggcagcaggc

SEQ ID NO: 3620149 - DNA, 22 bp, Homo sapiens
gatccagtgacatgattctgaa

SEQ ID NO: 3620150 - DNA, 23 bp, Homo sapiens
gatccataaagacaatcactgcc

SEQ ID NO: 3620151 - DNA, 19 bp, Homo sapiens
gatccatcttgagccacag

SEQ ID NO: 3620152 - DNA, 13 bp, Homo sapiens
gatcccaccccct

SEQ ID NO: 3620153 - DNA, 17 bp, Homo sapiens
gatcccaccccctcctc

SEQ ID NO: 3620154 - DNA, 21 bp, Homo sapiens
gatccccaggaggcctgggcc

SEQ ID NO: 3620155 - DNA, 17 bp, Homo sapiens
gatcctggaggctgcct

SEQ ID NO: 3620156 - DNA, 17 bp, Homo sapiens
gatcgcctctttgacat

SEQ ID NO: 3620157 - DNA, 15 bp, Homo sapiens
gatcggtctcctagg

SEQ ID NO: 3620158 - DNA, 21 bp, Homo sapiens
gatctatccctgcggcctcca

SEQ ID NO: 3620159 - DNA, 12 bp, Homo sapiens
gatctcccctca

SEQ ID NO: 3620160 - DNA, 16 bp, Homo sapiens
gatctctcttgtcctc

SEQ ID NO: 3620161 - DNA, 21 bp, Homo sapiens
gatctctcttgtcctcttctg

SEQ ID NO: 3620162 - DNA, 13 bp, Homo sapiens
gatctgagggaga

SEQ ID NO: 3620163 - DNA, 18 bp, Homo sapiens
gatctgcaccaccatgcc

SEQ ID NO: 3620164 - DNA, 14 bp, Homo sapiens
gatctggaacccag

SEQ ID NO: 3620165 - DNA, 20 bp, Homo sapiens
gatctggaacccagactcag

SEQ ID NO: 3620166 - DNA, 23 bp, Homo sapiens
gatctggaacctcagcctggcca

SEQ ID NO: 3620167 - DNA, 21 bp, Homo sapiens
gatctggggagagcggctgga

SEQ ID NO: 3620168 - DNA, 16 bp, Homo sapiens
gatctggtcctaccca

SEQ ID NO: 3620169 - DNA, 17 bp, Homo sapiens
gatctgtcctcagcctt

SEQ ID NO: 3620170 - DNA, 18 bp, Homo sapiens
gatctgtcctcagccttg

SEQ ID NO: 3620171 - DNA, 21 bp, Homo sapiens
gatctgttttggatgttgcta

SEQ ID NO: 3620172 - DNA, 20 bp, Homo sapiens
gatcttcagaactgcccttg

SEQ ID NO: 3620173 - DNA, 20 bp, Homo sapiens
gatctttctttccaaaacat

SEQ ID NO: 3620174 - DNA, 14 bp, Homo sapiens
gatctttgtggcca

SEQ ID NO: 3620175 - DNA, 21 bp, Homo sapiens
gatgaaaaagaataaaaactt

SEQ ID NO: 3620176 - DNA, 14 bp, Homo sapiens
gatgaaaatatttg

SEQ ID NO: 3620177 - DNA, 14 bp, Homo sapiens
gatgaatgtcagtt

SEQ ID NO: 3620178 - DNA, 18 bp, Homo sapiens
gatgacaccctggcctga

SEQ ID NO: 3620179 - DNA, 20 bp, Homo sapiens
gatgacatgcactcagctct

SEQ ID NO: 3620180 - DNA, 15 bp, Homo sapiens
gatgacattccctgc

SEQ ID NO: 3620181 - DNA, 17 bp, Homo sapiens
gatgacattccctgcta

SEQ ID NO: 3620182 - DNA, 13 bp, Homo sapiens
gatgacctccaga

SEQ ID NO: 3620183 - DNA, 13 bp, Homo sapiens
gatgaccttccca

SEQ ID NO: 3620184 - DNA, 15 bp, Homo sapiens
gatgaccttcccagg

SEQ ID NO: 3620185 - DNA, 18 bp, Homo sapiens
gatgacttagtacaaagt

SEQ ID NO: 3620186 - DNA, 14 bp, Homo sapiens
gatgactttgcaga

SEQ ID NO: 3620187 - DNA, 18 bp, Homo sapiens
gatgactttgcagatgga

SEQ ID NO: 3620188 - DNA, 20 bp, Homo sapiens
gatgactttgcagatggaaa

SEQ ID NO: 3620189 - DNA, 17 bp, Homo sapiens
gatgagaaacagctcag

SEQ ID NO: 3620190 - DNA, 13 bp, Homo sapiens
gatgaggcaaccc

SEQ ID NO: 3620191 - DNA, 18 bp, Homo sapiens
gatgaggtcaccagggga

SEQ ID NO: 3620192 - DNA, 15 bp, Homo sapiens
gatgataaaggaaat

SEQ ID NO: 3620193 - DNA, 16 bp, Homo sapiens
gatgatctttaaaata

SEQ ID NO: 3620194 - DNA, 14 bp, Homo sapiens
gatgatgagggaag

SEQ ID NO: 3620195 - DNA, 17 bp, Homo sapiens
gatgatgatgatgatga

SEQ ID NO: 3620196 - DNA, 18 bp, Homo sapiens
gatgcaaggattacagaa

SEQ ID NO: 3620197 - DNA, 18 bp, Homo sapiens
gatgcacagtatctgctg

SEQ ID NO: 3620198 - DNA, 19 bp, Homo sapiens
gatgcacagtatctgctgt

SEQ ID NO: 3620199 - DNA, 19 bp, Homo sapiens
gatgcacgtggggcccact

SEQ ID NO: 3620200 - DNA, 23 bp, Homo sapiens
gatgcagcggcgtgaggcctggg

SEQ ID NO: 3620201 - DNA, 16 bp, Homo sapiens
gatgcatatagacaca

SEQ ID NO: 3620202 - DNA, 19 bp, Homo sapiens
gatgcatatagacacacat

SEQ ID NO: 3620203 - DNA, 18 bp, Homo sapiens
gatgccacttctcactca

SEQ ID NO: 3620204 - DNA, 20 bp, Homo sapiens
gatgccagcttctctctcca

SEQ ID NO: 3620205 - DNA, 21 bp, Homo sapiens
gatgccagcttctctctccag

SEQ ID NO: 3620206 - DNA, 23 bp, Homo sapiens
gatgccccctccaggagagagcc

SEQ ID NO: 3620207 - DNA, 23 bp, Homo sapiens
gatgcccgcccggggagtttccg

SEQ ID NO: 3620208 - DNA, 12 bp, Homo sapiens
gatgccctggag

SEQ ID NO: 3620209 - DNA, 23 bp, Homo sapiens
gatgcctgttaatttataatgta

SEQ ID NO: 3620210 - DNA, 17 bp, Homo sapiens
gatgcggatcctgctgg

SEQ ID NO: 3620211 - DNA, 18 bp, Homo sapiens
gatgcggatcctgctggg

SEQ ID NO: 3620212 - DNA, 17 bp, Homo sapiens
gatgctgactgtactcc

SEQ ID NO: 3620213 - DNA, 20 bp, Homo sapiens
gatgctgactgtactcctcc

SEQ ID NO: 3620214 - DNA, 15 bp, Homo sapiens
gatgctggcccaggg

SEQ ID NO: 3620215 - DNA, 13 bp, Homo sapiens
gatgctgggctgg

SEQ ID NO: 3620216 - DNA, 22 bp, Homo sapiens
gatggaaaaaccacccccaaat

SEQ ID NO: 3620217 - DNA, 12 bp, Homo sapiens
gatggaaaataa

SEQ ID NO: 3620218 - DNA, 17 bp, Homo sapiens
gatggaaaataaacatc

SEQ ID NO: 3620219 - DNA, 18 bp, Homo sapiens
gatggaaaataaacatca

SEQ ID NO: 3620220 - DNA, 20 bp, Homo sapiens
gatggaatatcatgaatgtg

SEQ ID NO: 3620221 - DNA, 13 bp, Homo sapiens
gatggaatgatgg

SEQ ID NO: 3620222 - DNA, 13 bp, Homo sapiens
gatggacatcttg

SEQ ID NO: 3620223 - DNA, 21 bp, Homo sapiens
gatggacttgtgattggctgc

SEQ ID NO: 3620224 - DNA, 23 bp, Homo sapiens
gatggacttgtgattggctgcag

SEQ ID NO: 3620225 - DNA, 22 bp, Homo sapiens
gatggagacaccctctgggggt

SEQ ID NO: 3620226 - DNA, 12 bp, Homo sapiens
gatggagggaag

SEQ ID NO: 3620227 - DNA, 13 bp, Homo sapiens
gatggagggaaga

SEQ ID NO: 3620228 - DNA, 17 bp, Homo sapiens
gatggagtttctctctt

SEQ ID NO: 3620229 - DNA, 14 bp, Homo sapiens
gatggatggcagac

SEQ ID NO: 3620230 - DNA, 20 bp, Homo sapiens
gatggcaaagaaggagagca

SEQ ID NO: 3620231 - DNA, 15 bp, Homo sapiens
gatggcaacagatct

SEQ ID NO: 3620232 - DNA, 22 bp, Homo sapiens
gatggcaacagatctggaacct

SEQ ID NO: 3620233 - DNA, 13 bp, Homo sapiens
gatggcagactct

SEQ ID NO: 3620234 - DNA, 16 bp, Homo sapiens
gatggcagagccaggc

SEQ ID NO: 3620235 - DNA, 13 bp, Homo sapiens
gatggccatgctc

SEQ ID NO: 3620236 - DNA, 20 bp, Homo sapiens
gatggctgtgcctctgcctg

SEQ ID NO: 3620237 - DNA, 16 bp, Homo sapiens
gatggggcaagacaga

SEQ ID NO: 3620238 - DNA, 18 bp, Homo sapiens
gatggtcggatctcacag

SEQ ID NO: 3620239 - DNA, 14 bp, Homo sapiens
gatggtgcagacgc

SEQ ID NO: 3620240 - DNA, 14 bp, Homo sapiens
gatgtaaagatgtt

SEQ ID NO: 3620241 - DNA, 19 bp, Homo sapiens
gatgtacatttaataatat

SEQ ID NO: 3620242 - DNA, 15 bp, Homo sapiens
gatgtacttaagagt

SEQ ID NO: 3620243 - DNA, 16 bp, Homo sapiens
gatgtataatgtaatg

SEQ ID NO: 3620244 - DNA, 19 bp, Homo sapiens
gatgtctttttattaaaat

SEQ ID NO: 3620245 - DNA, 18 bp, Homo sapiens
gatgtgatatataagtgt

SEQ ID NO: 3620246 - DNA, 16 bp, Homo sapiens
gatgtgcaaaatcact

SEQ ID NO: 3620247 - DNA, 19 bp, Homo sapiens
gatgtgcagcatttcactt

SEQ ID NO: 3620248 - DNA, 21 bp, Homo sapiens
gatgtgtcctgataagctgag

SEQ ID NO: 3620249 - DNA, 17 bp, Homo sapiens
gatgtgtctcccagaac

SEQ ID NO: 3620250 - DNA, 17 bp, Homo sapiens
gatgttagttttcctta

SEQ ID NO: 3620251 - DNA, 12 bp, Homo sapiens
gatgttcctttt

SEQ ID NO: 3620252 - DNA, 21 bp, Homo sapiens
gatgttctgcctctccctggg

SEQ ID NO: 3620253 - DNA, 18 bp, Homo sapiens
gatgttctggataccatt

SEQ ID NO: 3620254 - DNA, 22 bp, Homo sapiens
gatgttctgggctaatatactt

SEQ ID NO: 3620255 - DNA, 16 bp, Homo sapiens
gatgttgctatagtga

SEQ ID NO: 3620256 - DNA, 14 bp, Homo sapiens
gatgtttacatttt

SEQ ID NO: 3620257 - DNA, 16 bp, Homo sapiens
gattaaccttttcaaa

SEQ ID NO: 3620258 - DNA, 17 bp, Homo sapiens
gattaaccttttcaaat

SEQ ID NO: 3620259 - DNA, 17 bp, Homo sapiens
gattacaaatcagaagt

SEQ ID NO: 3620260 - DNA, 19 bp, Homo sapiens
gattacaaatcagaagtca

SEQ ID NO: 3620261 - DNA, 17 bp, Homo sapiens
gattacagaaactgatg

SEQ ID NO: 3620262 - DNA, 14 bp, Homo sapiens
gattactcctccat

SEQ ID NO: 3620263 - DNA, 20 bp, Homo sapiens
gattataaaattaatcacaa

SEQ ID NO: 3620264 - DNA, 22 bp, Homo sapiens
gattataaacaacctagacagt

SEQ ID NO: 3620265 - DNA, 17 bp, Homo sapiens
gattatatgaagtttaa

SEQ ID NO: 3620266 - DNA, 15 bp, Homo sapiens
gattattttttcaga

SEQ ID NO: 3620267 - DNA, 18 bp, Homo sapiens
gattattttttcagaccg

SEQ ID NO: 3620268 - DNA, 13 bp, Homo sapiens
gattcaagacaag

SEQ ID NO: 3620269 - DNA, 22 bp, Homo sapiens
gattcacccccctctgctgccg

SEQ ID NO: 3620270 - DNA, 12 bp, Homo sapiens
gattcagagaaa

SEQ ID NO: 3620271 - DNA, 14 bp, Homo sapiens
gattcagagaaatt

SEQ ID NO: 3620272 - DNA, 12 bp, Homo sapiens
gattcagcaaaa

SEQ ID NO: 3620273 - DNA, 20 bp, Homo sapiens
gattccaagttctcacctct

SEQ ID NO: 3620274 - DNA, 23 bp, Homo sapiens
gattctgaccttaaatgcaacca

SEQ ID NO: 3620275 - DNA, 18 bp, Homo sapiens
gattctgattgctatcag

SEQ ID NO: 3620276 - DNA, 10 bp, Homo sapiens
gattcttctt

SEQ ID NO: 3620277 - DNA, 23 bp, Homo sapiens
gattgagttattaactgtatttt

SEQ ID NO: 3620278 - DNA, 14 bp, Homo sapiens
gattgcccctggct

SEQ ID NO: 3620279 - DNA, 21 bp, Homo sapiens
gattgcccctggctttgcctc

SEQ ID NO: 3620280 - DNA, 23 bp, Homo sapiens
gattgcccctggctttgcctctt

SEQ ID NO: 3620281 - DNA, 18 bp, Homo sapiens
gattggcacccctttcta

SEQ ID NO: 3620282 - DNA, 17 bp, Homo sapiens
gattggctgcaggaaga

SEQ ID NO: 3620283 - DNA, 22 bp, Homo sapiens
gattggctgcttaaactggaaa

SEQ ID NO: 3620284 - DNA, 19 bp, Homo sapiens
gattggggggtgggctttg

SEQ ID NO: 3620285 - DNA, 18 bp, Homo sapiens
gattgtatttaagacata

SEQ ID NO: 3620286 - DNA, 13 bp, Homo sapiens
gatttcacagtgt

SEQ ID NO: 3620287 - DNA, 15 bp, Homo sapiens
gatttccatttgcaa

SEQ ID NO: 3620288 - DNA, 23 bp, Homo sapiens
gatttctttctttgcaccaaaga

SEQ ID NO: 3620289 - DNA, 18 bp, Homo sapiens
gatttgaaccatgaagtc

SEQ ID NO: 3620290 - DNA, 14 bp, Homo sapiens
gatttgtactgaaa

SEQ ID NO: 3620291 - DNA, 15 bp, Homo sapiens
gattttaccaaagca

SEQ ID NO: 3620292 - DNA, 16 bp, Homo sapiens
gattttaccaaagcat

SEQ ID NO: 3620293 - DNA, 19 bp, Homo sapiens
gattttaccaaagcatcaa

SEQ ID NO: 3620294 - DNA, 21 bp, Homo sapiens
gattttcaaccagataacata

SEQ ID NO: 3620295 - DNA, 20 bp, Homo sapiens
gattttctcactgaactcca

SEQ ID NO: 3620296 - DNA, 23 bp, Homo sapiens
gattttctcactgaactccaccg

SEQ ID NO: 3620297 - DNA, 13 bp, Homo sapiens
gatttttatcaca

SEQ ID NO: 3620298 - DNA, 20 bp, Homo sapiens
gattttttactgccctttca

SEQ ID NO: 3620299 - DNA, 20 bp, Homo sapiens
gattttttttttttggtcct

SEQ ID NO: 3620300 - DNA, 17 bp, Homo sapiens
gcaaaaaaagcctccaa

SEQ ID NO: 3620301 - DNA, 23 bp, Homo sapiens
gcaaaagatgtgcaaaatcactg

SEQ ID NO: 3620302 - DNA, 21 bp, Homo sapiens
gcaaaaggatctttgtggcca

SEQ ID NO: 3620303 - DNA, 20 bp, Homo sapiens
gcaaaataattttaaacaaa

SEQ ID NO: 3620304 - DNA, 15 bp, Homo sapiens
gcaaacaatcccaat

SEQ ID NO: 3620305 - DNA, 22 bp, Homo sapiens
gcaaacaatcccaatctttcta

SEQ ID NO: 3620306 - DNA, 16 bp, Homo sapiens
gcaaacacaccttgga

SEQ ID NO: 3620307 - DNA, 13 bp, Homo sapiens
gcaaacatcaaat

SEQ ID NO: 3620308 - DNA, 18 bp, Homo sapiens
gcaaactccaggttcctg

SEQ ID NO: 3620309 - DNA, 22 bp, Homo sapiens
gcaaagaaagtgggaggtcagg

SEQ ID NO: 3620310 - DNA, 18 bp, Homo sapiens
gcaaagaagtaagtttat

SEQ ID NO: 3620311 - DNA, 20 bp, Homo sapiens
gcaaagatctgtcctcagcc

SEQ ID NO: 3620312 - DNA, 19 bp, Homo sapiens
gcaaagcatttgagctgtg

SEQ ID NO: 3620313 - DNA, 18 bp, Homo sapiens
gcaaagccaaggcagcga

SEQ ID NO: 3620314 - DNA, 15 bp, Homo sapiens
gcaaagcccctcaca

SEQ ID NO: 3620315 - DNA, 23 bp, Homo sapiens
gcaaagcccctcacactgcaagg

SEQ ID NO: 3620316 - DNA, 11 bp, Homo sapiens
gcaaagcttgt

SEQ ID NO: 3620317 - DNA, 15 bp, Homo sapiens
gcaaagtgacaaagc

SEQ ID NO: 3620318 - DNA, 21 bp, Homo sapiens
gcaaatagattcagagaaatt

SEQ ID NO: 3620319 - DNA, 17 bp, Homo sapiens
gcaaatcagaaaaccca

SEQ ID NO: 3620320 - DNA, 17 bp, Homo sapiens
gcaaattttgtattatt

SEQ ID NO: 3620321 - DNA, 15 bp, Homo sapiens
gcaacacagaggaat

SEQ ID NO: 3620322 - DNA, 16 bp, Homo sapiens
gcaacacagaggaatt

SEQ ID NO: 3620323 - DNA, 13 bp, Homo sapiens
gcaacagatctgg

SEQ ID NO: 3620324 - DNA, 13 bp, Homo sapiens
gcaacatcttttt

SEQ ID NO: 3620325 - DNA, 22 bp, Homo sapiens
gcaacatgaagaatgcattcaa

SEQ ID NO: 3620326 - DNA, 14 bp, Homo sapiens
gcaacattcattgc

SEQ ID NO: 3620327 - DNA, 14 bp, Homo sapiens
gcaacattggcaca

SEQ ID NO: 3620328 - DNA, 12 bp, Homo sapiens
gcaaccagccag

SEQ ID NO: 3620329 - DNA, 13 bp, Homo sapiens
gcaaccagccagc

SEQ ID NO: 3620330 - DNA, 14 bp, Homo sapiens
gcaaccagccagcg

SEQ ID NO: 3620331 - DNA, 16 bp, Homo sapiens
gcaaccagccagcgtc

SEQ ID NO: 3620332 - DNA, 17 bp, Homo sapiens
gcaacgcccctccaaac

SEQ ID NO: 3620333 - DNA, 13 bp, Homo sapiens
gcaactattcaca

SEQ ID NO: 3620334 - DNA, 15 bp, Homo sapiens
gcaagaaatgaactt

SEQ ID NO: 3620335 - DNA, 14 bp, Homo sapiens
gcaagacctcatct

SEQ ID NO: 3620336 - DNA, 18 bp, Homo sapiens
gcaagacctcatctgtgg

SEQ ID NO: 3620337 - DNA, 21 bp, Homo sapiens
gcaagacctcatctgtggagc

SEQ ID NO: 3620338 - DNA, 15 bp, Homo sapiens
gcaagataaacatta

SEQ ID NO: 3620339 - DNA, 12 bp, Homo sapiens
gcaagatgtggg

SEQ ID NO: 3620340 - DNA, 16 bp, Homo sapiens
gcaagatgtgggcagt

SEQ ID NO: 3620341 - DNA, 19 bp, Homo sapiens
gcaagcaacacagaggaat

SEQ ID NO: 3620342 - DNA, 18 bp, Homo sapiens
gcaagcaccaacctccag

SEQ ID NO: 3620343 - DNA, 19 bp, Homo sapiens
gcaagcaccaacctccaga

SEQ ID NO: 3620344 - DNA, 16 bp, Homo sapiens
gcaagcaggagtgtgc

SEQ ID NO: 3620345 - DNA, 18 bp, Homo sapiens
gcaagctaggccccagag

SEQ ID NO: 3620346 - DNA, 17 bp, Homo sapiens
gcaaggagtgtaaaatg

SEQ ID NO: 3620347 - DNA, 15 bp, Homo sapiens
gcaaggattacagaa

SEQ ID NO: 3620348 - DNA, 19 bp, Homo sapiens
gcaaggattacagaaactg

SEQ ID NO: 3620349 - DNA, 21 bp, Homo sapiens
gcaaggattacagaaactgat

SEQ ID NO: 3620350 - DNA, 22 bp, Homo sapiens
gcaaggattacagaaactgatg

SEQ ID NO: 3620351 - DNA, 13 bp, Homo sapiens
gcaaggcagagcc

SEQ ID NO: 3620352 - DNA, 16 bp, Homo sapiens
gcaaggccctgccctg

SEQ ID NO: 3620353 - DNA, 15 bp, Homo sapiens
gcaaggggtgaggat

SEQ ID NO: 3620354 - DNA, 17 bp, Homo sapiens
gcaaggggtgaggatag

SEQ ID NO: 3620355 - DNA, 14 bp, Homo sapiens
gcaagggtgatggg

SEQ ID NO: 3620356 - DNA, 22 bp, Homo sapiens
gcaaggtttaggctggtggccc

SEQ ID NO: 3620357 - DNA, 20 bp, Homo sapiens
gcaataaataaagcttggga

SEQ ID NO: 3620358 - DNA, 18 bp, Homo sapiens
gcaataaatctgacccag

SEQ ID NO: 3620359 - DNA, 19 bp, Homo sapiens
gcaataaatctgacccagt

SEQ ID NO: 3620360 - DNA, 21 bp, Homo sapiens
gcaataaatctgacccagtgc

SEQ ID NO: 3620361 - DNA, 14 bp, Homo sapiens
gcaataagaacaaa

SEQ ID NO: 3620362 - DNA, 20 bp, Homo sapiens
gcaatcctcctacctcagcc

SEQ ID NO: 3620363 - DNA, 14 bp, Homo sapiens
gcaatgccccaaac

SEQ ID NO: 3620364 - DNA, 15 bp, Homo sapiens
gcaatgccccaaact

SEQ ID NO: 3620365 - DNA, 16 bp, Homo sapiens
gcaatgccccaaactt

SEQ ID NO: 3620366 - DNA, 19 bp, Homo sapiens
gcaatgtggtgacacctcc

SEQ ID NO: 3620367 - DNA, 22 bp, Homo sapiens
gcaatgtggtgacacctccccc

SEQ ID NO: 3620368 - DNA, 17 bp, Homo sapiens
gcaattagtctgaaact

SEQ ID NO: 3620369 - DNA, 22 bp, Homo sapiens
gcaattagtctgaaactggctt

SEQ ID NO: 3620370 - DNA, 15 bp, Homo sapiens
gcaattcatggttca

SEQ ID NO: 3620371 - DNA, 13 bp, Homo sapiens
gcaatttaaatgt

SEQ ID NO: 3620372 - DNA, 18 bp, Homo sapiens
gcaatttaaatgttatga

SEQ ID NO: 3620373 - DNA, 23 bp, Homo sapiens
gcaatttactgatgagagaatgt

SEQ ID NO: 3620374 - DNA, 18 bp, Homo sapiens
gcaatttccttttttgtt

SEQ ID NO: 3620375 - DNA, 13 bp, Homo sapiens
gcacaaagaagaa

SEQ ID NO: 3620376 - DNA, 13 bp, Homo sapiens
gcacaaatattta

SEQ ID NO: 3620377 - DNA, 14 bp, Homo sapiens
gcacaaatatttat

SEQ ID NO: 3620378 - DNA, 19 bp, Homo sapiens
gcacaacagagtaactatc

SEQ ID NO: 3620379 - DNA, 19 bp, Homo sapiens
gcacaacagccctgcctga

SEQ ID NO: 3620380 - DNA, 21 bp, Homo sapiens
gcacaacagccctgcctgaga

SEQ ID NO: 3620381 - DNA, 16 bp, Homo sapiens
gcacaagactggccca

SEQ ID NO: 3620382 - DNA, 20 bp, Homo sapiens
gcacaagactggcccagtgc

SEQ ID NO: 3620383 - DNA, 21 bp, Homo sapiens
gcacaatgttggagcagcagg

SEQ ID NO: 3620384 - DNA, 22 bp, Homo sapiens
gcacaatgttggagcagcaggc

SEQ ID NO: 3620385 - DNA, 23 bp, Homo sapiens
gcacaatgttggagcagcaggcc

SEQ ID NO: 3620386 - DNA, 13 bp, Homo sapiens
gcacacagggcag

SEQ ID NO: 3620387 - DNA, 15 bp, Homo sapiens
gcacacccgtgtgca

SEQ ID NO: 3620388 - DNA, 14 bp, Homo sapiens
gcacaccttgcaga

SEQ ID NO: 3620389 - DNA, 15 bp, Homo sapiens
gcacacgctgctctg

SEQ ID NO: 3620390 - DNA, 17 bp, Homo sapiens
gcacacgctgctctgcc

SEQ ID NO: 3620391 - DNA, 22 bp, Homo sapiens
gcacactctcccattatattta

SEQ ID NO: 3620392 - DNA, 15 bp, Homo sapiens
gcacagacaagcagc

SEQ ID NO: 3620393 - DNA, 16 bp, Homo sapiens
gcacagacaagcagcc

SEQ ID NO: 3620394 - DNA, 15 bp, Homo sapiens
gcacagaccaggcct

SEQ ID NO: 3620395 - DNA, 16 bp, Homo sapiens
gcacagaccaggcctt

SEQ ID NO: 3620396 - DNA, 14 bp, Homo sapiens
gcacagccttctcc

SEQ ID NO: 3620397 - DNA, 18 bp, Homo sapiens
gcacagctgggagcctgg

SEQ ID NO: 3620398 - DNA, 16 bp, Homo sapiens
gcacagggcagtggga

SEQ ID NO: 3620399 - DNA, 19 bp, Homo sapiens
gcacagtatctgctgttct

SEQ ID NO: 3620400 - DNA, 20 bp, Homo sapiens
gcacagtatctgctgttctt

SEQ ID NO: 3620401 - DNA, 18 bp, Homo sapiens
gcacagtgcatctcagcc

SEQ ID NO: 3620402 - DNA, 19 bp, Homo sapiens
gcacagtgcatctcagccc

SEQ ID NO: 3620403 - DNA, 20 bp, Homo sapiens
gcacagtgcatctcagccca

SEQ ID NO: 3620404 - DNA, 16 bp, Homo sapiens
gcacagtgggagctga

SEQ ID NO: 3620405 - DNA, 18 bp, Homo sapiens
gcacagtgggagctgagc

SEQ ID NO: 3620406 - DNA, 19 bp, Homo sapiens
gcacagtgggagctgagct

SEQ ID NO: 3620407 - DNA, 20 bp, Homo sapiens
gcacagtgggagctgagctg

SEQ ID NO: 3620408 - DNA, 21 bp, Homo sapiens
gcacagtgggagctgagctgg

SEQ ID NO: 3620409 - DNA, 14 bp, Homo sapiens
gcacagttttctga

SEQ ID NO: 3620410 - DNA, 22 bp, Homo sapiens
gcacatacacctcgtcaagagc

SEQ ID NO: 3620411 - DNA, 23 bp, Homo sapiens
gcacatacacctcgtcaagagca

SEQ ID NO: 3620412 - DNA, 17 bp, Homo sapiens
gcacatgccacctggca

SEQ ID NO: 3620413 - DNA, 22 bp, Homo sapiens
gcaccaaacctaagtccttcca

SEQ ID NO: 3620414 - DNA, 12 bp, Homo sapiens
gcaccaaagaca

SEQ ID NO: 3620415 - DNA, 22 bp, Homo sapiens
gcaccaaagacatcagtctcca

SEQ ID NO: 3620416 - DNA, 15 bp, Homo sapiens
gcaccaaccacagca

SEQ ID NO: 3620417 - DNA, 15 bp, Homo sapiens
gcaccacagcctcca

SEQ ID NO: 3620418 - DNA, 15 bp, Homo sapiens
gcaccaccatgccca

SEQ ID NO: 3620419 - DNA, 16 bp, Homo sapiens
gcaccacctctgtggg

SEQ ID NO: 3620420 - DNA, 17 bp, Homo sapiens
gcaccacctctgtgggc

SEQ ID NO: 3620421 - DNA, 15 bp, Homo sapiens
gcaccagacacccag

SEQ ID NO: 3620422 - DNA, 17 bp, Homo sapiens
gcaccagacacccagga

SEQ ID NO: 3620423 - DNA, 14 bp, Homo sapiens
gcaccaggggccaa

SEQ ID NO: 3620424 - DNA, 15 bp, Homo sapiens
gcaccatcagcctgt

SEQ ID NO: 3620425 - DNA, 16 bp, Homo sapiens
gcaccatgctgctggg

SEQ ID NO: 3620426 - DNA, 18 bp, Homo sapiens
gcaccatgctgctgggga

SEQ ID NO: 3620427 - DNA, 20 bp, Homo sapiens
gcaccatgctgctggggaag

SEQ ID NO: 3620428 - DNA, 23 bp, Homo sapiens
gcaccatgctgctggggaagaca

SEQ ID NO: 3620429 - DNA, 23 bp, Homo sapiens
gcaccattgcactctagcctggc

SEQ ID NO: 3620430 - DNA, 14 bp, Homo sapiens
gcaccattttgtca

SEQ ID NO: 3620431 - DNA, 14 bp, Homo sapiens
gcacccagaacagt

SEQ ID NO: 3620432 - DNA, 15 bp, Homo sapiens
gcacccagagcaccc

SEQ ID NO: 3620433 - DNA, 12 bp, Homo sapiens
gcacccccacaa

SEQ ID NO: 3620434 - DNA, 22 bp, Homo sapiens
gcacccccacaagctgtccctg

SEQ ID NO: 3620435 - DNA, 20 bp, Homo sapiens
gcacccccaccccctgccca

SEQ ID NO: 3620436 - DNA, 13 bp, Homo sapiens
gcacccccatgct

SEQ ID NO: 3620437 - DNA, 14 bp, Homo sapiens
gcaccccccaagct

SEQ ID NO: 3620438 - DNA, 23 bp, Homo sapiens
gcaccccctgctccaccagcagc

SEQ ID NO: 3620439 - DNA, 22 bp, Homo sapiens
gcacccctccagttttgcctga

SEQ ID NO: 3620440 - DNA, 15 bp, Homo sapiens
gcaccccttcctggg

SEQ ID NO: 3620441 - DNA, 12 bp, Homo sapiens
gcaccgccacgt

SEQ ID NO: 3620442 - DNA, 18 bp, Homo sapiens
gcacctaaaacccaaagg

SEQ ID NO: 3620443 - DNA, 20 bp, Homo sapiens
gcacctaaaacccaaaggtg

SEQ ID NO: 3620444 - DNA, 23 bp, Homo sapiens
gcacctaatccaggcagatccag

SEQ ID NO: 3620445 - DNA, 17 bp, Homo sapiens
gcacctatctcagccat

SEQ ID NO: 3620446 - DNA, 21 bp, Homo sapiens
gcacctatgagatggccatgc

SEQ ID NO: 3620447 - DNA, 24 bp, Homo sapiens
gcacctatgagatggccatgctca

SEQ ID NO: 3620448 - DNA, 14 bp, Homo sapiens
gcacctccccgctg

SEQ ID NO: 3620449 - DNA, 16 bp, Homo sapiens
gcacctccccgctggg

SEQ ID NO: 3620450 - DNA, 18 bp, Homo sapiens
gcacctcctaccctccca

SEQ ID NO: 3620451 - DNA, 17 bp, Homo sapiens
gcacctgcctccaccag

SEQ ID NO: 3620452 - DNA, 18 bp, Homo sapiens
gcacctgcctccaccagc

SEQ ID NO: 3620453 - DNA, 17 bp, Homo sapiens
gcacgctcaatgcccag

SEQ ID NO: 3620454 - DNA, 19 bp, Homo sapiens
gcactcacccctagccctg

SEQ ID NO: 3620455 - DNA, 20 bp, Homo sapiens
gcactcacccctagccctgg

SEQ ID NO: 3620456 - DNA, 17 bp, Homo sapiens
gcactccagactctggg

SEQ ID NO: 3620457 - DNA, 18 bp, Homo sapiens
gcactccagactctgggg

SEQ ID NO: 3620458 - DNA, 19 bp, Homo sapiens
gcactccagactctggggg

SEQ ID NO: 3620459 - DNA, 18 bp, Homo sapiens
gcactccccagagctgtg

SEQ ID NO: 3620460 - DNA, 19 bp, Homo sapiens
gcactccccagagctgtgc

SEQ ID NO: 3620461 - DNA, 15 bp, Homo sapiens
gcactctagcctggc

SEQ ID NO: 3620462 - DNA, 17 bp, Homo sapiens
gcactctccccgctcag

SEQ ID NO: 3620463 - DNA, 24 bp, Homo sapiens
gcactctccccgctcaggggcctg

SEQ ID NO: 3620464 - DNA, 17 bp, Homo sapiens
gcactgaagtttttgaa

SEQ ID NO: 3620465 - DNA, 17 bp, Homo sapiens
gcactgagcagggatct

SEQ ID NO: 3620466 - DNA, 21 bp, Homo sapiens
gcactgagcagggatctgccc

SEQ ID NO: 3620467 - DNA, 16 bp, Homo sapiens
gcactgaggacacaga

SEQ ID NO: 3620468 - DNA, 17 bp, Homo sapiens
gcactgaggaccagcca

SEQ ID NO: 3620469 - DNA, 18 bp, Homo sapiens
gcactgaggatttctttt

SEQ ID NO: 3620470 - DNA, 18 bp, Homo sapiens
gcactgatgctgcccctc

SEQ ID NO: 3620471 - DNA, 22 bp, Homo sapiens
gcactgcattcctgtgccctag

SEQ ID NO: 3620472 - DNA, 18 bp, Homo sapiens
gcactgcctgcatgagct

SEQ ID NO: 3620473 - DNA, 14 bp, Homo sapiens
gcactgctgcccag

SEQ ID NO: 3620474 - DNA, 18 bp, Homo sapiens
gcactgctgcccagcctc

SEQ ID NO: 3620475 - DNA, 15 bp, Homo sapiens
gcactggcgaggaga

SEQ ID NO: 3620476 - DNA, 19 bp, Homo sapiens
gcactggggcgtttcctac

SEQ ID NO: 3620477 - DNA, 23 bp, Homo sapiens
gcactggtgaactgagctgggca

SEQ ID NO: 3620478 - DNA, 22 bp, Homo sapiens
gcactggtggcccgacagcctg

SEQ ID NO: 3620479 - DNA, 11 bp, Homo sapiens
gcactggtggg

SEQ ID NO: 3620480 - DNA, 20 bp, Homo sapiens
gcactggtgtgaactcaccc

SEQ ID NO: 3620481 - DNA, 17 bp, Homo sapiens
gcacttattgaatatat

SEQ ID NO: 3620482 - DNA, 20 bp, Homo sapiens
gcacttcccagagcatcttg

SEQ ID NO: 3620483 - DNA, 22 bp, Homo sapiens
gcacttcctgttttataatgaa

SEQ ID NO: 3620484 - DNA, 18 bp, Homo sapiens
gcacttggagacttgtat

SEQ ID NO: 3620485 - DNA, 15 bp, Homo sapiens
gcacttgttatatta

SEQ ID NO: 3620486 - DNA, 17 bp, Homo sapiens
gcacttgttatattata

SEQ ID NO: 3620487 - DNA, 18 bp, Homo sapiens
gcactttatgtggagact

SEQ ID NO: 3620488 - DNA, 22 bp, Homo sapiens
gcagaaaaaccaacatctacaa

SEQ ID NO: 3620489 - DNA, 16 bp, Homo sapiens
gcagaaaacagggtct

SEQ ID NO: 3620490 - DNA, 20 bp, Homo sapiens
gcagaaagtaagcatttcca

SEQ ID NO: 3620491 - DNA, 16 bp, Homo sapiens
gcagaaccttctttgg

SEQ ID NO: 3620492 - DNA, 15 bp, Homo sapiens
gcagaaggaaagaag

SEQ ID NO: 3620493 - DNA, 21 bp, Homo sapiens
gcagaaggcaaggccctgccc

SEQ ID NO: 3620494 - DNA, 18 bp, Homo sapiens
gcagaccagctggcgggt

SEQ ID NO: 3620495 - DNA, 16 bp, Homo sapiens
gcagacccagtcccac

SEQ ID NO: 3620496 - DNA, 16 bp, Homo sapiens
gcagacctggagcttc

SEQ ID NO: 3620497 - DNA, 13 bp, Homo sapiens
gcagacggtctgt

SEQ ID NO: 3620498 - DNA, 17 bp, Homo sapiens
gcagactgtgaacttga

SEQ ID NO: 3620499 - DNA, 22 bp, Homo sapiens
gcagactgtgaacttgactggg

SEQ ID NO: 3620500 - DNA, 17 bp, Homo sapiens
gcagagaagatgaaatt

SEQ ID NO: 3620501 - DNA, 18 bp, Homo sapiens
gcagagaagatgaaattt

SEQ ID NO: 3620502 - DNA, 21 bp, Homo sapiens
gcagagaattctcttatccaa

SEQ ID NO: 3620503 - DNA, 19 bp, Homo sapiens
gcagagccaggctgttgga

SEQ ID NO: 3620504 - DNA, 16 bp, Homo sapiens
gcagagcctcctggga

SEQ ID NO: 3620505 - DNA, 19 bp, Homo sapiens
gcagaggagaacttgctgc

SEQ ID NO: 3620506 - DNA, 15 bp, Homo sapiens
gcagaggaggggccg

SEQ ID NO: 3620507 - DNA, 23 bp, Homo sapiens
gcagaggcgtactacccagctct

SEQ ID NO: 3620508 - DNA, 22 bp, Homo sapiens
gcagagtgagggggtaaagcag

SEQ ID NO: 3620509 - DNA, 21 bp, Homo sapiens
gcagagtggcgtggcctcccc

SEQ ID NO: 3620510 - DNA, 20 bp, Homo sapiens
gcagagttacagttctgtgg

SEQ ID NO: 3620511 - DNA, 15 bp, Homo sapiens
gcagatccaggacta

SEQ ID NO: 3620512 - DNA, 22 bp, Homo sapiens
gcagatctcccacatgccaggg

SEQ ID NO: 3620513 - DNA, 15 bp, Homo sapiens
gcagatgacagaggt

SEQ ID NO: 3620514 - DNA, 15 bp, Homo sapiens
gcagatggaaagagg

SEQ ID NO: 3620515 - DNA, 12 bp, Homo sapiens
gcagcaatttaa

SEQ ID NO: 3620516 - DNA, 15 bp, Homo sapiens
gcagcaatttaaatg

SEQ ID NO: 3620517 - DNA, 16 bp, Homo sapiens
gcagcaatttaaatgt

SEQ ID NO: 3620518 - DNA, 12 bp, Homo sapiens
gcagcactcccc

SEQ ID NO: 3620519 - DNA, 21 bp, Homo sapiens
gcagcactccccagagctgtg

SEQ ID NO: 3620520 - DNA, 22 bp, Homo sapiens
gcagcactccccagagctgtgc

SEQ ID NO: 3620521 - DNA, 15 bp, Homo sapiens
gcagcagcaccaacc

SEQ ID NO: 3620522 - DNA, 23 bp, Homo sapiens
agggcccagcccagagccacctg

SEQ ID NO: 3620523 - DNA, 14 bp, Homo sapiens
agggcccctggatc

SEQ ID NO: 3620524 - DNA, 15 bp, Homo sapiens
agggcccctggatct

SEQ ID NO: 3620525 - DNA, 13 bp, Homo sapiens
agggcctggagcc

SEQ ID NO: 3620526 - DNA, 14 bp, Homo sapiens
agggcctggagccc

SEQ ID NO: 3620527 - DNA, 20 bp, Homo sapiens
agggctaattctgggaaggg

SEQ ID NO: 3620528 - DNA, 21 bp, Homo sapiens
agggctaattctgggaaggga

SEQ ID NO: 3620529 - DNA, 22 bp, Homo sapiens
agggctgaaaacggagagggaa

SEQ ID NO: 3620530 - DNA, 16 bp, Homo sapiens
agggctggagcctggg

SEQ ID NO: 3620531 - DNA, 17 bp, Homo sapiens
agggctggagcctgggg

SEQ ID NO: 3620532 - DNA, 18 bp, Homo sapiens
agggctggagcctggggt

SEQ ID NO: 3620533 - DNA, 10 bp, Homo sapiens
agggctgggg

SEQ ID NO: 3620534 - DNA, 11 bp, Homo sapiens
agggctgggga

SEQ ID NO: 3620535 - DNA, 15 bp, Homo sapiens
agggctggggacaga

SEQ ID NO: 3620536 - DNA, 18 bp, Homo sapiens
agggctggggatgcgcct

SEQ ID NO: 3620537 - DNA, 21 bp, Homo sapiens
agggcttggcccagcgccaag

SEQ ID NO: 3620538 - DNA, 13 bp, Homo sapiens
agggcttggggct

SEQ ID NO: 3620539 - DNA, 16 bp, Homo sapiens
agggcttggggctgca

SEQ ID NO: 3620540 - DNA, 20 bp, Homo sapiens
agggcttggggctgcacctc

SEQ ID NO: 3620541 - DNA, 15 bp, Homo sapiens
agggctttggttcct

SEQ ID NO: 3620542 - DNA, 14 bp, Homo sapiens
aggggaaagtccag

SEQ ID NO: 3620543 - DNA, 15 bp, Homo sapiens
aggggaatcagaact

SEQ ID NO: 3620544 - DNA, 22 bp, Homo sapiens
aggggaattccctccccctcct

SEQ ID NO: 3620545 - DNA, 11 bp, Homo sapiens
aggggacccca

SEQ ID NO: 3620546 - DNA, 13 bp, Homo sapiens
aggggaccccact

SEQ ID NO: 3620547 - DNA, 16 bp, Homo sapiens
aggggagacaggagcc

SEQ ID NO: 3620548 - DNA, 13 bp, Homo sapiens
aggggagcccact

SEQ ID NO: 3620549 - DNA, 21 bp, Homo sapiens
aggggagcccactgtcctggg

SEQ ID NO: 3620550 - DNA, 24 bp, Homo sapiens
aggggagcccactgtcctgggcct

SEQ ID NO: 3620551 - DNA, 13 bp, Homo sapiens
aggggaggcacac

SEQ ID NO: 3620552 - DNA, 14 bp, Homo sapiens
aggggaggcacact

SEQ ID NO: 3620553 - DNA, 15 bp, Homo sapiens
aggggaggccatctg

SEQ ID NO: 3620554 - DNA, 21 bp, Homo sapiens
aggggagtaggtgggggaaca

SEQ ID NO: 3620555 - DNA, 16 bp, Homo sapiens
aggggatgataaagga

SEQ ID NO: 3620556 - DNA, 19 bp, Homo sapiens
aggggcaagctaggcccca

SEQ ID NO: 3620557 - DNA, 22 bp, Homo sapiens
aggggcaagctaggccccagag

SEQ ID NO: 3620558 - DNA, 20 bp, Homo sapiens
aggggcagatgttcccggag

SEQ ID NO: 3620559 - DNA, 13 bp, Homo sapiens
aggggcagggaag

SEQ ID NO: 3620560 - DNA, 16 bp, Homo sapiens
aggggcagggaaggac

SEQ ID NO: 3620561 - DNA, 23 bp, Homo sapiens
aggggcagggaaggacaggaccc

SEQ ID NO: 3620562 - DNA, 19 bp, Homo sapiens
aggggccaacctcaggctc

SEQ ID NO: 3620563 - DNA, 22 bp, Homo sapiens
aggggccccatggcagctcctg

SEQ ID NO: 3620564 - DNA, 17 bp, Homo sapiens
aggggccccgtgtcctg

SEQ ID NO: 3620565 - DNA, 15 bp, Homo sapiens
aggggcccggccagc

SEQ ID NO: 3620566 - DNA, 17 bp, Homo sapiens
aggggccgctgccaccc

SEQ ID NO: 3620567 - DNA, 16 bp, Homo sapiens
aggggcctaggcctca

SEQ ID NO: 3620568 - DNA, 12 bp, Homo sapiens
aggggcctgcag

SEQ ID NO: 3620569 - DNA, 11 bp, Homo sapiens
aggggcctgga

SEQ ID NO: 3620570 - DNA, 13 bp, Homo sapiens
aggggcctggagg

SEQ ID NO: 3620571 - DNA, 17 bp, Homo sapiens
aggggcctggaggtctg

SEQ ID NO: 3620572 - DNA, 12 bp, Homo sapiens
aggggcctggca

SEQ ID NO: 3620573 - DNA, 13 bp, Homo sapiens
aggggcctggcag

SEQ ID NO: 3620574 - DNA, 15 bp, Homo sapiens
aggggcctggcagcc

SEQ ID NO: 3620575 - DNA, 18 bp, Homo sapiens
aggggcctggcagccgtg

SEQ ID NO: 3620576 - DNA, 21 bp, Homo sapiens
aggggcgtctgttcccccttc

SEQ ID NO: 3620577 - DNA, 18 bp, Homo sapiens
aggggctagctaagccaa

SEQ ID NO: 3620578 - DNA, 15 bp, Homo sapiens
aggggctcctgagtg

SEQ ID NO: 3620579 - DNA, 21 bp, Homo sapiens
aggggcttataataaaggact

SEQ ID NO: 3620580 - DNA, 19 bp, Homo sapiens
aggggctttctcttcccct

SEQ ID NO: 3620581 - DNA, 19 bp, Homo sapiens
agggggacagcagggaccg

SEQ ID NO: 3620582 - DNA, 16 bp, Homo sapiens
agggggcaagaggaat

SEQ ID NO: 3620583 - DNA, 20 bp, Homo sapiens
agggggccccgccagggctg

SEQ ID NO: 3620584 - DNA, 23 bp, Homo sapiens
agggggccccgccagggctgggg

SEQ ID NO: 3620585 - DNA, 12 bp, Homo sapiens
agggggccctgc

SEQ ID NO: 3620586 - DNA, 15 bp, Homo sapiens
agggggccctgcccc

SEQ ID NO: 3620587 - DNA, 17 bp, Homo sapiens
agggggccctgccccac

SEQ ID NO: 3620588 - DNA, 19 bp, Homo sapiens
agggggccctgccccaccc

SEQ ID NO: 3620589 - DNA, 20 bp, Homo sapiens
agggggccctgccccacccc

SEQ ID NO: 3620590 - DNA, 14 bp, Homo sapiens
agggggctgctgct

SEQ ID NO: 3620591 - DNA, 12 bp, Homo sapiens
aggggggctgtg

SEQ ID NO: 3620592 - DNA, 13 bp, Homo sapiens
aggggggctgtgc

SEQ ID NO: 3620593 - DNA, 23 bp, Homo sapiens
aggggtatgttccctcttgtccc

SEQ ID NO: 3620594 - DNA, 22 bp, Homo sapiens
aggggtgcggcggtcccagctc

SEQ ID NO: 3620595 - DNA, 15 bp, Homo sapiens
aggggtggaatgccg

SEQ ID NO: 3620596 - DNA, 13 bp, Homo sapiens
aggggtgtttggg

SEQ ID NO: 3620597 - DNA, 18 bp, Homo sapiens
agggtagtggctggggtg

SEQ ID NO: 3620598 - DNA, 15 bp, Homo sapiens
agggtccacagctgg

SEQ ID NO: 3620599 - DNA, 16 bp, Homo sapiens
agggtccacctggaga

SEQ ID NO: 3620600 - DNA, 17 bp, Homo sapiens
agggtccacctggagag

SEQ ID NO: 3620601 - DNA, 21 bp, Homo sapiens
agggtccaggagagcctgggg

SEQ ID NO: 3620602 - DNA, 24 bp, Homo sapiens
agggtcccggtgtatcctggccct

SEQ ID NO: 3620603 - DNA, 22 bp, Homo sapiens
agggtccctgaacgccctggta

SEQ ID NO: 3620604 - DNA, 23 bp, Homo sapiens
agggtcctgtcgaaggggaggca

SEQ ID NO: 3620605 - DNA, 13 bp, Homo sapiens
agggtctctcagg

SEQ ID NO: 3620606 - DNA, 15 bp, Homo sapiens
agggtctctcaggga

SEQ ID NO: 3620607 - DNA, 13 bp, Homo sapiens
agggtctgggaca

SEQ ID NO: 3620608 - DNA, 17 bp, Homo sapiens
agggtctttgcagatgt

SEQ ID NO: 3620609 - DNA, 16 bp, Homo sapiens
agggtctttttctagg

SEQ ID NO: 3620610 - DNA, 18 bp, Homo sapiens
agggtgacaaggcctgct

SEQ ID NO: 3620611 - DNA, 22 bp, Homo sapiens
agggtgggctctaaatccatta

SEQ ID NO: 3620612 - DNA, 18 bp, Homo sapiens
agggtgggggtgctctct

SEQ ID NO: 3620613 - DNA, 23 bp, Homo sapiens
agggtgtggggccatgcctcctc

SEQ ID NO: 3620614 - DNA, 19 bp, Homo sapiens
agggttaatcatatttgaa

SEQ ID NO: 3620615 - DNA, 21 bp, Homo sapiens
agggttgctggtcctgcacat

SEQ ID NO: 3620616 - DNA, 15 bp, Homo sapiens
agggtttcgactggt

SEQ ID NO: 3620617 - DNA, 19 bp, Homo sapiens
agggttttttcttctttct

SEQ ID NO: 3620618 - DNA, 18 bp, Homo sapiens
aggtaaatggttaaattt

SEQ ID NO: 3620619 - DNA, 22 bp, Homo sapiens
aggtaaatttttaggcaaagat

SEQ ID NO: 3620620 - DNA, 22 bp, Homo sapiens
aggtacactggtatttatattt

SEQ ID NO: 3620621 - DNA, 14 bp, Homo sapiens
aggtacaggagagg

SEQ ID NO: 3620622 - DNA, 18 bp, Homo sapiens
aggtacaggagaggcagc

SEQ ID NO: 3620623 - DNA, 16 bp, Homo sapiens
aggtacatttctgatt

SEQ ID NO: 3620624 - DNA, 14 bp, Homo sapiens
aggtactagaatgc

SEQ ID NO: 3620625 - DNA, 17 bp, Homo sapiens
aggtactagaatgctta

SEQ ID NO: 3620626 - DNA, 21 bp, Homo sapiens
aggtactgcattctctcccat

SEQ ID NO: 3620627 - DNA, 18 bp, Homo sapiens
aggtagagccacaaaaga

SEQ ID NO: 3620628 - DNA, 16 bp, Homo sapiens
aggtagccttgtgttc

SEQ ID NO: 3620629 - DNA, 18 bp, Homo sapiens
aggtagctggggagccct

SEQ ID NO: 3620630 - DNA, 19 bp, Homo sapiens
aggtattttgtttctttta

SEQ ID NO: 3620631 - DNA, 18 bp, Homo sapiens
aggtcaaaactgaagctt

SEQ ID NO: 3620632 - DNA, 15 bp, Homo sapiens
aggtcaggagttcga

SEQ ID NO: 3620633 - DNA, 15 bp, Homo sapiens
aggtcatctggcgga

SEQ ID NO: 3620634 - DNA, 19 bp, Homo sapiens
aggtccaaattcaccttcc

SEQ ID NO: 3620635 - DNA, 14 bp, Homo sapiens
aggtcccggccagc

SEQ ID NO: 3620636 - DNA, 16 bp, Homo sapiens
aggtcccggccagctc

SEQ ID NO: 3620637 - DNA, 17 bp, Homo sapiens
aggtcccggccagctct

SEQ ID NO: 3620638 - DNA, 15 bp, Homo sapiens
aggtcctcagagaat

SEQ ID NO: 3620639 - DNA, 15 bp, Homo sapiens
aggtcctggtgccta

SEQ ID NO: 3620640 - DNA, 20 bp, Homo sapiens
aggtcgcttgggaattttat

SEQ ID NO: 3620641 - DNA, 18 bp, Homo sapiens
aggtcggagtgcctggag

SEQ ID NO: 3620642 - DNA, 15 bp, Homo sapiens
aggtctagagagaac

SEQ ID NO: 3620643 - DNA, 12 bp, Homo sapiens
aggtctcattca

SEQ ID NO: 3620644 - DNA, 22 bp, Homo sapiens
aggtctccaggggcctgcagaa

SEQ ID NO: 3620645 - DNA, 13 bp, Homo sapiens
aggtctctgggag

SEQ ID NO: 3620646 - DNA, 14 bp, Homo sapiens
aggtctctgggagc

SEQ ID NO: 3620647 - DNA, 19 bp, Homo sapiens
aggtctggctgagcccctg

SEQ ID NO: 3620648 - DNA, 13 bp, Homo sapiens
aggtctgtatgtc

SEQ ID NO: 3620649 - DNA, 20 bp, Homo sapiens
aggtctgtggtgcagtgtgt

SEQ ID NO: 3620650 - DNA, 20 bp, Homo sapiens
aggtctgtttaaagtggcaa

SEQ ID NO: 3620651 - DNA, 23 bp, Homo sapiens
aggtcttggccgactcagggacc

SEQ ID NO: 3620652 - DNA, 11 bp, Homo sapiens
aggtctttcct

SEQ ID NO: 3620653 - DNA, 12 bp, Homo sapiens
aggtctttctct

SEQ ID NO: 3620654 - DNA, 15 bp, Homo sapiens
aggtctttctctcag

SEQ ID NO: 3620655 - DNA, 17 bp, Homo sapiens
aggtgaaaatgaagaag

SEQ ID NO: 3620656 - DNA, 22 bp, Homo sapiens
aggtgaaactccagatgccaca

SEQ ID NO: 3620657 - DNA, 21 bp, Homo sapiens
aggtgaacattggttctttca

SEQ ID NO: 3620658 - DNA, 14 bp, Homo sapiens
aggtgaactccagg

SEQ ID NO: 3620659 - DNA, 15 bp, Homo sapiens
aggtgaactccaggc

SEQ ID NO: 3620660 - DNA, 23 bp, Homo sapiens
aggtgaattaattaaacattgtg

SEQ ID NO: 3620661 - DNA, 14 bp, Homo sapiens
aggtgacagtgaag

SEQ ID NO: 3620662 - DNA, 22 bp, Homo sapiens
aggtgagcaagcccaggagaat

SEQ ID NO: 3620663 - DNA, 19 bp, Homo sapiens
aggtgattctcagggctgg

SEQ ID NO: 3620664 - DNA, 14 bp, Homo sapiens
aggtgcactccaga

SEQ ID NO: 3620665 - DNA, 16 bp, Homo sapiens
aggtgcactccagact

SEQ ID NO: 3620666 - DNA, 18 bp, Homo sapiens
aggtgcagccccagggcc

SEQ ID NO: 3620667 - DNA, 13 bp, Homo sapiens
aggtgcagctcct

SEQ ID NO: 3620668 - DNA, 12 bp, Homo sapiens
aggtgccaccac

SEQ ID NO: 3620669 - DNA, 13 bp, Homo sapiens
aggtgccaccacc

SEQ ID NO: 3620670 - DNA, 22 bp, Homo sapiens
aggtgccaccaccctgcccccc

SEQ ID NO: 3620671 - DNA, 15 bp, Homo sapiens
aggtgcccagggcca

SEQ ID NO: 3620672 - DNA, 18 bp, Homo sapiens
aggtgcccgcgccaggcc

SEQ ID NO: 3620673 - DNA, 15 bp, Homo sapiens
aggtgctaacataga

SEQ ID NO: 3620674 - DNA, 14 bp, Homo sapiens
aggtgctcatgctg

SEQ ID NO: 3620675 - DNA, 15 bp, Homo sapiens
aggtgctcatgctgc

SEQ ID NO: 3620676 - DNA, 16 bp, Homo sapiens
aggtgctcatgctgct

SEQ ID NO: 3620677 - DNA, 18 bp, Homo sapiens
aggtgctcatgctgctcc

SEQ ID NO: 3620678 - DNA, 16 bp, Homo sapiens
aggtgctgacggccag

SEQ ID NO: 3620679 - DNA, 17 bp, Homo sapiens
aggtgctgacggccagg

SEQ ID NO: 3620680 - DNA, 20 bp, Homo sapiens
aggtgctgacggccagggag

SEQ ID NO: 3620681 - DNA, 21 bp, Homo sapiens
aggtgctttagagataattgc

SEQ ID NO: 3620682 - DNA, 19 bp, Homo sapiens
aggtgcttttggcagagac

SEQ ID NO: 3620683 - DNA, 21 bp, Homo sapiens
aggtgcttttggcagagacca

SEQ ID NO: 3620684 - DNA, 15 bp, Homo sapiens
aggtggctgagcccc

SEQ ID NO: 3620685 - DNA, 11 bp, Homo sapiens
aggtgggagat

SEQ ID NO: 3620686 - DNA, 22 bp, Homo sapiens
aggtgggccacacccaggaagg

SEQ ID NO: 3620687 - DNA, 23 bp, Homo sapiens
aggtgggggaacactgagaaaga

SEQ ID NO: 3620688 - DNA, 15 bp, Homo sapiens
aggtgtcctgagcac

SEQ ID NO: 3620689 - DNA, 14 bp, Homo sapiens
aggtgtcgaggcca

SEQ ID NO: 3620690 - DNA, 21 bp, Homo sapiens
aggtgtgaacctacctgcctt

SEQ ID NO: 3620691 - DNA, 22 bp, Homo sapiens
aggtgtgaacctacctgccttg

SEQ ID NO: 3620692 - DNA, 15 bp, Homo sapiens
aggtgtgaggagaga

SEQ ID NO: 3620693 - DNA, 18 bp, Homo sapiens
aggtgtgaggagagagga

SEQ ID NO: 3620694 - DNA, 23 bp, Homo sapiens
aggtgtgaggagagaggaggaaa

SEQ ID NO: 3620695 - DNA, 19 bp, Homo sapiens
aggttatctacttttactc

SEQ ID NO: 3620696 - DNA, 19 bp, Homo sapiens
aggttccccaagggccctg

SEQ ID NO: 3620697 - DNA, 20 bp, Homo sapiens
aggttccccaagggccctgg

SEQ ID NO: 3620698 - DNA, 21 bp, Homo sapiens
aggttccccaagggccctggc

SEQ ID NO: 3620699 - DNA, 22 bp, Homo sapiens
aggttccccaagggccctggca

SEQ ID NO: 3620700 - DNA, 17 bp, Homo sapiens
aggttcccccagcaagc

SEQ ID NO: 3620701 - DNA, 14 bp, Homo sapiens
aggttccctcccag

SEQ ID NO: 3620702 - DNA, 21 bp, Homo sapiens
aggttcgagacccaaaccccc

SEQ ID NO: 3620703 - DNA, 16 bp, Homo sapiens
aggttcttctatagtg

SEQ ID NO: 3620704 - DNA, 18 bp, Homo sapiens
aggttgggctagagaaat

SEQ ID NO: 3620705 - DNA, 20 bp, Homo sapiens
aggttgtctgaagtcactgc

SEQ ID NO: 3620706 - DNA, 14 bp, Homo sapiens
aggttgtggggcct

SEQ ID NO: 3620707 - DNA, 13 bp, Homo sapiens
aggtttcgatatt

SEQ ID NO: 3620708 - DNA, 22 bp, Homo sapiens
aggtttcgatatttattgatgt

SEQ ID NO: 3620709 - DNA, 18 bp, Homo sapiens
aggtttgaaggagaatgg

SEQ ID NO: 3620710 - DNA, 22 bp, Homo sapiens
aggttttcaaccggaaggaggc

SEQ ID NO: 3620711 - DNA, 22 bp, Homo sapiens
aggttttcagagaattatctca

SEQ ID NO: 3620712 - DNA, 12 bp, Homo sapiens
aggtttttcaat

SEQ ID NO: 3620713 - DNA, 16 bp, Homo sapiens
aggtttttttccttct

SEQ ID NO: 3620714 - DNA, 18 bp, Homo sapiens
aggtttttttccttctga

SEQ ID NO: 3620715 - DNA, 12 bp, Homo sapiens
agtaaaaataca

SEQ ID NO: 3620716 - DNA, 14 bp, Homo sapiens
agtaaaacaaatga

SEQ ID NO: 3620717 - DNA, 15 bp, Homo sapiens
agtaaaacaaatgaa

SEQ ID NO: 3620718 - DNA, 15 bp, Homo sapiens
agtaaaatttcagga

SEQ ID NO: 3620719 - DNA, 16 bp, Homo sapiens
agtaaaggttaaaaat

SEQ ID NO: 3620720 - DNA, 22 bp, Homo sapiens
agtaaatgtccacttaaaatac

SEQ ID NO: 3620721 - DNA, 15 bp, Homo sapiens
agtaaattatagctc

SEQ ID NO: 3620722 - DNA, 12 bp, Homo sapiens
agtaactgtgct

SEQ ID NO: 3620723 - DNA, 13 bp, Homo sapiens
agtaacttttaaa

SEQ ID NO: 3620724 - DNA, 15 bp, Homo sapiens
agtaagttctgtggt

SEQ ID NO: 3620725 - DNA, 22 bp, Homo sapiens
agtaagttctgtggttccagta

SEQ ID NO: 3620726 - DNA, 13 bp, Homo sapiens
agtaataaagaga

SEQ ID NO: 3620727 - DNA, 19 bp, Homo sapiens
agtaataaagagaaatata

SEQ ID NO: 3620728 - DNA, 22 bp, Homo sapiens
agtaatatattctgaagcaaca

SEQ ID NO: 3620729 - DNA, 14 bp, Homo sapiens
agtaatattattac

SEQ ID NO: 3620730 - DNA, 16 bp, Homo sapiens
agtaatgacttagaaa

SEQ ID NO: 3620731 - DNA, 19 bp, Homo sapiens
agtaatgacttagaaactg

SEQ ID NO: 3620732 - DNA, 22 bp, Homo sapiens
agtaatttaatttgtaaaactt

SEQ ID NO: 3620733 - DNA, 22 bp, Homo sapiens
agtacaaatgccttaaaatgga

SEQ ID NO: 3620734 - DNA, 17 bp, Homo sapiens
agtacacaataagcaaa

SEQ ID NO: 3620735 - DNA, 18 bp, Homo sapiens
agtacacaataagcaaaa

SEQ ID NO: 3620736 - DNA, 17 bp, Homo sapiens
agtacatatttattttc

SEQ ID NO: 3620737 - DNA, 21 bp, Homo sapiens
agtacatatttattttctttt

SEQ ID NO: 3620738 - DNA, 22 bp, Homo sapiens
agtacatatttattttcttttg

SEQ ID NO: 3620739 - DNA, 22 bp, Homo sapiens
agtacattactaaatatataaa

SEQ ID NO: 3620740 - DNA, 16 bp, Homo sapiens
agtacatttgctttaa

SEQ ID NO: 3620741 - DNA, 23 bp, Homo sapiens
agtaccatttaatggggaggaca

SEQ ID NO: 3620742 - DNA, 19 bp, Homo sapiens
agtacccttggcctttaca

SEQ ID NO: 3620743 - DNA, 16 bp, Homo sapiens
agtacttccctcaggc

SEQ ID NO: 3620744 - DNA, 19 bp, Homo sapiens
agtactttggaggccccta

SEQ ID NO: 3620745 - DNA, 22 bp, Homo sapiens
agtagagcttgtaataaatact

SEQ ID NO: 3620746 - DNA, 17 bp, Homo sapiens
agtagctgcagccttca

SEQ ID NO: 3620747 - DNA, 17 bp, Homo sapiens
agtagctggattacagg

SEQ ID NO: 3620748 - DNA, 18 bp, Homo sapiens
agtaggaatgtacatgaa

SEQ ID NO: 3620749 - DNA, 21 bp, Homo sapiens
agtaggaatgtacatgaagca

SEQ ID NO: 3620750 - DNA, 14 bp, Homo sapiens
agtataacatgtcg

SEQ ID NO: 3620751 - DNA, 13 bp, Homo sapiens
agtataagaaatg

SEQ ID NO: 3620752 - DNA, 21 bp, Homo sapiens
agtatatcatgtaaagaaatg

SEQ ID NO: 3620753 - DNA, 23 bp, Homo sapiens
agtatatttttgtctgcagctgt

SEQ ID NO: 3620754 - DNA, 14 bp, Homo sapiens
agtatcctccaggt

SEQ ID NO: 3620755 - DNA, 20 bp, Homo sapiens
agtatcctccaggtttttca

SEQ ID NO: 3620756 - DNA, 16 bp, Homo sapiens
agtatgaataaagaca

SEQ ID NO: 3620757 - DNA, 23 bp, Homo sapiens
agtatgtatattaaaaaagagac

SEQ ID NO: 3620758 - DNA, 17 bp, Homo sapiens
agtatgtgtaacaggat

SEQ ID NO: 3620759 - DNA, 23 bp, Homo sapiens
agtattatttctccatcccctcc

SEQ ID NO: 3620760 - DNA, 11 bp, Homo sapiens
agtattgtaca

SEQ ID NO: 3620761 - DNA, 22 bp, Homo sapiens
agtatttctacattacagccat

SEQ ID NO: 3620762 - DNA, 21 bp, Homo sapiens
agtcaaagtgttgctgtggct

SEQ ID NO: 3620763 - DNA, 22 bp, Homo sapiens
agtcaaagtgttgctgtggctc

SEQ ID NO: 3620764 - DNA, 16 bp, Homo sapiens
agtcaaatccagtggt

SEQ ID NO: 3620765 - DNA, 17 bp, Homo sapiens
agtcaaatccagtggtg

SEQ ID NO: 3620766 - DNA, 19 bp, Homo sapiens
agtcaaatccagtggtggg

SEQ ID NO: 3620767 - DNA, 20 bp, Homo sapiens
agtcaaatccagtggtgggt

SEQ ID NO: 3620768 - DNA, 22 bp, Homo sapiens
agtcaaatccagtggtgggtaa

SEQ ID NO: 3620769 - DNA, 19 bp, Homo sapiens
agtcaacagagaggggcag

SEQ ID NO: 3620770 - DNA, 13 bp, Homo sapiens
agtcaatgtactt

SEQ ID NO: 3620771 - DNA, 18 bp, Homo sapiens
agtcacacattacaaagt

SEQ ID NO: 3620772 - DNA, 14 bp, Homo sapiens
agtcaccagagact

SEQ ID NO: 3620773 - DNA, 14 bp, Homo sapiens
agtcacctgctcca

SEQ ID NO: 3620774 - DNA, 15 bp, Homo sapiens
agtcacctgctccag

SEQ ID NO: 3620775 - DNA, 16 bp, Homo sapiens
agtcacttactattgt

SEQ ID NO: 3620776 - DNA, 21 bp, Homo sapiens
agtcagacatttctttggaaa

SEQ ID NO: 3620777 - DNA, 21 bp, Homo sapiens
agtcagactgatagacaccat

SEQ ID NO: 3620778 - DNA, 16 bp, Homo sapiens
agtcataggttaatat

SEQ ID NO: 3620779 - DNA, 11 bp, Homo sapiens
agtcatcttgc

SEQ ID NO: 3620780 - DNA, 23 bp, Homo sapiens
agtcatcttgctaccagtattta

SEQ ID NO: 3620781 - DNA, 15 bp, Homo sapiens
agtcatgggagagta

SEQ ID NO: 3620782 - DNA, 12 bp, Homo sapiens
agtcatgtgacc

SEQ ID NO: 3620783 - DNA, 14 bp, Homo sapiens
agtcattaaagaca

SEQ ID NO: 3620784 - DNA, 14 bp, Homo sapiens
agtcattcttccct

SEQ ID NO: 3620785 - DNA, 15 bp, Homo sapiens
agtcattggcaaagt

SEQ ID NO: 3620786 - DNA, 21 bp, Homo sapiens
agtcatttgttaatatttctt

SEQ ID NO: 3620787 - DNA, 15 bp, Homo sapiens
agtcatttgtttaaa

SEQ ID NO: 3620788 - DNA, 11 bp, Homo sapiens
agtccaagcat

SEQ ID NO: 3620789 - DNA, 20 bp, Homo sapiens
agtccactcccagtgcttgc

SEQ ID NO: 3620790 - DNA, 16 bp, Homo sapiens
agtccagctctttaga

SEQ ID NO: 3620791 - DNA, 23 bp, Homo sapiens
agtccaggacaggagatgctgtg

SEQ ID NO: 3620792 - DNA, 20 bp, Homo sapiens
agtccagtgctttctttccg

SEQ ID NO: 3620793 - DNA, 14 bp, Homo sapiens
agtccatttcctaa

SEQ ID NO: 3620794 - DNA, 19 bp, Homo sapiens
agtccatttcctaatgtat

SEQ ID NO: 3620795 - DNA, 18 bp, Homo sapiens
agtcccacactgtgcaga

SEQ ID NO: 3620796 - DNA, 18 bp, Homo sapiens
agtcccacactgtggcca

SEQ ID NO: 3620797 - DNA, 18 bp, Homo sapiens
agtcccatttttctcttg

SEQ ID NO: 3620798 - DNA, 16 bp, Homo sapiens
agtccccctgccccag

SEQ ID NO: 3620799 - DNA, 18 bp, Homo sapiens
agtccgcagttgtagcag

SEQ ID NO: 3620800 - DNA, 23 bp, Homo sapiens
agtccgcagttgtagcagaaacc

SEQ ID NO: 3620801 - DNA, 16 bp, Homo sapiens
agtcctccactcgacc

SEQ ID NO: 3620802 - DNA, 12 bp, Homo sapiens
agtcctctgaat

SEQ ID NO: 3620803 - DNA, 15 bp, Homo sapiens
agtccttaggctact

SEQ ID NO: 3620804 - DNA, 13 bp, Homo sapiens
agtccttcagtga

SEQ ID NO: 3620805 - DNA, 15 bp, Homo sapiens
agtccttcctggcat

SEQ ID NO: 3620806 - DNA, 16 bp, Homo sapiens
agtccttcctggcatc

SEQ ID NO: 3620807 - DNA, 14 bp, Homo sapiens
agtcgcctgcctgc

SEQ ID NO: 3620808 - DNA, 17 bp, Homo sapiens
agtcgcctgcctgcagc

SEQ ID NO: 3620809 - DNA, 22 bp, Homo sapiens
agtcgcctgcctgcagcaggca

SEQ ID NO: 3620810 - DNA, 19 bp, Homo sapiens
agtctagatggctcctctc

SEQ ID NO: 3620811 - DNA, 13 bp, Homo sapiens
agtctcaggaaat

SEQ ID NO: 3620812 - DNA, 16 bp, Homo sapiens
agtctcaggaaatcaa

SEQ ID NO: 3620813 - DNA, 22 bp, Homo sapiens
agtctcaggaaatcaaatatgc

SEQ ID NO: 3620814 - DNA, 15 bp, Homo sapiens
agtctcatttctcat

SEQ ID NO: 3620815 - DNA, 21 bp, Homo sapiens
agtctccactttctcaatgct

SEQ ID NO: 3620816 - DNA, 13 bp, Homo sapiens
agtctcctcactc

SEQ ID NO: 3620817 - DNA, 20 bp, Homo sapiens
agtctcctcactctgtccct

SEQ ID NO: 3620818 - DNA, 20 bp, Homo sapiens
agtctcctcccctactctgc

SEQ ID NO: 3620819 - DNA, 15 bp, Homo sapiens
agtctccttcagcac

SEQ ID NO: 3620820 - DNA, 16 bp, Homo sapiens
agtctccttcagcacg

SEQ ID NO: 3620821 - DNA, 16 bp, Homo sapiens
agtctctcttctctcc

SEQ ID NO: 3620822 - DNA, 21 bp, Homo sapiens
agtctctcttctctccagctg

SEQ ID NO: 3620823 - DNA, 19 bp, Homo sapiens
agtctcttctccactggat

SEQ ID NO: 3620824 - DNA, 11 bp, Homo sapiens
agtctgagccc

SEQ ID NO: 3620825 - DNA, 15 bp, Homo sapiens
agtctgagcccattt

SEQ ID NO: 3620826 - DNA, 18 bp, Homo sapiens
agtctgggatattcttta

SEQ ID NO: 3620827 - DNA, 16 bp, Homo sapiens
agtcttcaaatttttt

SEQ ID NO: 3620828 - DNA, 17 bp, Homo sapiens
agtcttcactaaccttt

SEQ ID NO: 3620829 - DNA, 17 bp, Homo sapiens
agtctttatttttttcc

SEQ ID NO: 3620830 - DNA, 16 bp, Homo sapiens
agtctttcttcactct

SEQ ID NO: 3620831 - DNA, 14 bp, Homo sapiens
agtgaaaatatagc

SEQ ID NO: 3620832 - DNA, 14 bp, Homo sapiens
agtgaaataacaaa

SEQ ID NO: 3620833 - DNA, 14 bp, Homo sapiens
agtgaataaatgtc

SEQ ID NO: 3620834 - DNA, 23 bp, Homo sapiens
agtgaatatttttgtattttaca

SEQ ID NO: 3620835 - DNA, 20 bp, Homo sapiens
agtgaattagttttaaaatg

SEQ ID NO: 3620836 - DNA, 15 bp, Homo sapiens
agtgacaaagcaatt

SEQ ID NO: 3620837 - DNA, 19 bp, Homo sapiens
agtgacatgattctgaact

SEQ ID NO: 3620838 - DNA, 15 bp, Homo sapiens
agtgaccagtgcctg

SEQ ID NO: 3620839 - DNA, 15 bp, Homo sapiens
agtgaccgagagaac

SEQ ID NO: 3620840 - DNA, 10 bp, Homo sapiens
agtgactcca

SEQ ID NO: 3620841 - DNA, 11 bp, Homo sapiens
agtgactccag

SEQ ID NO: 3620842 - DNA, 12 bp, Homo sapiens
agtgactccagg

SEQ ID NO: 3620843 - DNA, 13 bp, Homo sapiens
agtgactccaggg

SEQ ID NO: 3620844 - DNA, 23 bp, Homo sapiens
agtgactccccagcccagcaccc

SEQ ID NO: 3620845 - DNA, 14 bp, Homo sapiens
agtgactccctggg

SEQ ID NO: 3620846 - DNA, 22 bp, Homo sapiens
agtgactcctgctggtacctgc

SEQ ID NO: 3620847 - DNA, 13 bp, Homo sapiens
agtgactctcctg

SEQ ID NO: 3620848 - DNA, 22 bp, Homo sapiens
agtgactctcctgcctcagcct

SEQ ID NO: 3620849 - DNA, 15 bp, Homo sapiens
agtgagatcaatgtg

SEQ ID NO: 3620850 - DNA, 20 bp, Homo sapiens
agtgagcacacccgtgtgca

SEQ ID NO: 3620851 - DNA, 21 bp, Homo sapiens
agtgagcagtcgcctgcctgc

SEQ ID NO: 3620852 - DNA, 13 bp, Homo sapiens
agtgagcagtgtt

SEQ ID NO: 3620853 - DNA, 13 bp, Homo sapiens
agtgagcccctcc

SEQ ID NO: 3620854 - DNA, 20 bp, Homo sapiens
agtgagcccctccccagcca

SEQ ID NO: 3620855 - DNA, 14 bp, Homo sapiens
agtgaggatgtctg

SEQ ID NO: 3620856 - DNA, 14 bp, Homo sapiens
agtgagtcacctgc

SEQ ID NO: 3620857 - DNA, 17 bp, Homo sapiens
agtgagtcacctgctcc

SEQ ID NO: 3620858 - DNA, 21 bp, Homo sapiens
agtgagtcacctgctccagaa

SEQ ID NO: 3620859 - DNA, 15 bp, Homo sapiens
agtgatcctcacgcc

SEQ ID NO: 3620860 - DNA, 13 bp, Homo sapiens
agtgatctgtcca

SEQ ID NO: 3620861 - DNA, 21 bp, Homo sapiens
agtgatctgtccacctcggcc

SEQ ID NO: 3620862 - DNA, 17 bp, Homo sapiens
agtgatgctaaaacctg

SEQ ID NO: 3620863 - DNA, 13 bp, Homo sapiens
agtgatggaatat

SEQ ID NO: 3620864 - DNA, 21 bp, Homo sapiens
agtgattctgtttgccttttg

SEQ ID NO: 3620865 - DNA, 15 bp, Homo sapiens
agtgcaagcccctgc

SEQ ID NO: 3620866 - DNA, 21 bp, Homo sapiens
agtgcaataaatctgacccag

SEQ ID NO: 3620867 - DNA, 18 bp, Homo sapiens
agtgcaatgacacagtct

SEQ ID NO: 3620868 - DNA, 23 bp, Homo sapiens
agtgcaatggtgcaatcacagct

SEQ ID NO: 3620869 - DNA, 14 bp, Homo sapiens
agtgcacaggagcc

SEQ ID NO: 3620870 - DNA, 20 bp, Homo sapiens
agtgcactgcattcctgtgc

SEQ ID NO: 3620871 - DNA, 14 bp, Homo sapiens
agtgcatctcagcc

SEQ ID NO: 3620872 - DNA, 16 bp, Homo sapiens
agtgcatctcagccca

SEQ ID NO: 3620873 - DNA, 20 bp, Homo sapiens
agtgccccaccactccccaa

SEQ ID NO: 3620874 - DNA, 21 bp, Homo sapiens
agtgccccaccactccccaac

SEQ ID NO: 3620875 - DNA, 20 bp, Homo sapiens
agtgccccacttctggccac

SEQ ID NO: 3620876 - DNA, 14 bp, Homo sapiens
agtgcccccactga

SEQ ID NO: 3620877 - DNA, 18 bp, Homo sapiens
agtgcccccactgaccag

SEQ ID NO: 3620878 - DNA, 14 bp, Homo sapiens
agtgcctattgata

SEQ ID NO: 3620879 - DNA, 14 bp, Homo sapiens
agtgcctccacatg

SEQ ID NO: 3620880 - DNA, 22 bp, Homo sapiens
agtgcctccacatgctgcctgg

SEQ ID NO: 3620881 - DNA, 18 bp, Homo sapiens
agtgcctgggctcagcct

SEQ ID NO: 3620882 - DNA, 19 bp, Homo sapiens
agtgcctgggctcagcctg

SEQ ID NO: 3620883 - DNA, 22 bp, Homo sapiens
agtgcctgtgagcatggggcca

SEQ ID NO: 3620884 - DNA, 17 bp, Homo sapiens
agtgctcttggctgacc

SEQ ID NO: 3620885 - DNA, 18 bp, Homo sapiens
agtgctcttggctgaccc

SEQ ID NO: 3620886 - DNA, 23 bp, Homo sapiens
agtgctcttggctgacccctctg

SEQ ID NO: 3620887 - DNA, 12 bp, Homo sapiens
agtgctgctgtg

SEQ ID NO: 3620888 - DNA, 15 bp, Homo sapiens
agtgctgctgtggag

SEQ ID NO: 3620889 - DNA, 17 bp, Homo sapiens
agtgctgggattacagg

SEQ ID NO: 3620890 - DNA, 22 bp, Homo sapiens
agtgctgtttattaatcttagt

SEQ ID NO: 3620891 - DNA, 16 bp, Homo sapiens
agtggaaacatttata

SEQ ID NO: 3620892 - DNA, 16 bp, Homo sapiens
agtggaaagtcaggct

SEQ ID NO: 3620893 - DNA, 21 bp, Homo sapiens
agtggaatagtatcctccagg

SEQ ID NO: 3620894 - DNA, 22 bp, Homo sapiens
agtggaatagtatcctccaggt

SEQ ID NO: 3620895 - DNA, 20 bp, Homo sapiens
agtggacgttaggccaggcc

SEQ ID NO: 3620896 - DNA, 17 bp, Homo sapiens
agtggagagagcagggc

SEQ ID NO: 3620897 - DNA, 19 bp, Homo sapiens
agtggagctgtctgtctct

SEQ ID NO: 3620898 - DNA, 22 bp, Homo sapiens
agtggagctgtctgtctctaat

SEQ ID NO: 3620899 - DNA, 18 bp, Homo sapiens
agtggagttttataaatt

SEQ ID NO: 3620900 - DNA, 14 bp, Homo sapiens
agtggcaggggagc

SEQ ID NO: 3620901 - DNA, 14 bp, Homo sapiens
agtggccactaagc

SEQ ID NO: 3620902 - DNA, 20 bp, Homo sapiens
agtggccactaagcagagga

SEQ ID NO: 3620903 - DNA, 18 bp, Homo sapiens
agtggcctccctgctgtg

SEQ ID NO: 3620904 - DNA, 22 bp, Homo sapiens
agtggcctccgtcactacctgg

SEQ ID NO: 3620905 - DNA, 23 bp, Homo sapiens
agtggcctcttgagttcctctgc

SEQ ID NO: 3620906 - DNA, 18 bp, Homo sapiens
agtggccttccccagcat

SEQ ID NO: 3620907 - DNA, 21 bp, Homo sapiens
agtggcggcacgtccttgggc

SEQ ID NO: 3620908 - DNA, 14 bp, Homo sapiens
agtggcgtggcctc

SEQ ID NO: 3620909 - DNA, 16 bp, Homo sapiens
agtggctggatctgtg

SEQ ID NO: 3620910 - DNA, 20 bp, Homo sapiens
agtgggaatgttctttctgc

SEQ ID NO: 3620911 - DNA, 18 bp, Homo sapiens
agtgggccccgggctgga

SEQ ID NO: 3620912 - DNA, 15 bp, Homo sapiens
agtgggctctgagca

SEQ ID NO: 3620913 - DNA, 18 bp, Homo sapiens
agtggggctgcaggcagg

SEQ ID NO: 3620914 - DNA, 23 bp, Homo sapiens
agtgggtctgggatatggctgcc

SEQ ID NO: 3620915 - DNA, 15 bp, Homo sapiens
agtggtaattgggaa

SEQ ID NO: 3620916 - DNA, 23 bp, Homo sapiens
agtggtgcgtttataattggctt

SEQ ID NO: 3620917 - DNA, 22 bp, Homo sapiens
agtggtgggtaattgtacaata

SEQ ID NO: 3620918 - DNA, 14 bp, Homo sapiens
agtggtgtgactct

SEQ ID NO: 3620919 - DNA, 19 bp, Homo sapiens
agtgtaaaatgtatatttt

SEQ ID NO: 3620920 - DNA, 16 bp, Homo sapiens
agtgtaaaattgttaa

SEQ ID NO: 3620921 - DNA, 22 bp, Homo sapiens
agtgtagcctaaagggcagggc

SEQ ID NO: 3620922 - DNA, 23 bp, Homo sapiens
agtgtagcctaaagggcagggcc

SEQ ID NO: 3620923 - DNA, 19 bp, Homo sapiens
agtgtagctgtaagggcag

SEQ ID NO: 3620924 - DNA, 20 bp, Homo sapiens
agtgtagctgtaagggcagt

SEQ ID NO: 3620925 - DNA, 23 bp, Homo sapiens
agtgtagctgtaagggcagtgcc

SEQ ID NO: 3620926 - DNA, 19 bp, Homo sapiens
agtgtatgattactggcct

SEQ ID NO: 3620927 - DNA, 16 bp, Homo sapiens
agtgtatggaaataaa

SEQ ID NO: 3620928 - DNA, 20 bp, Homo sapiens
agtgtatggaaataaatgta

SEQ ID NO: 3620929 - DNA, 23 bp, Homo sapiens
agtgtatttggaaataaagtcag

SEQ ID NO: 3620930 - DNA, 19 bp, Homo sapiens
agtgtctaggcactgagca

SEQ ID NO: 3620931 - DNA, 20 bp, Homo sapiens
agtgtctaggcactgagcag

SEQ ID NO: 3620932 - DNA, 21 bp, Homo sapiens
agtgtctaggcactgagcagg

SEQ ID NO: 3620933 - DNA, 19 bp, Homo sapiens
agtgtctggagcgcttcag

SEQ ID NO: 3620934 - DNA, 15 bp, Homo sapiens
agtgtcttaattaaa

SEQ ID NO: 3620935 - DNA, 17 bp, Homo sapiens
agtgtgaatattccttt

SEQ ID NO: 3620936 - DNA, 13 bp, Homo sapiens
agtgtgagctctt

SEQ ID NO: 3620937 - DNA, 16 bp, Homo sapiens
agtgtgagctcttccc

SEQ ID NO: 3620938 - DNA, 17 bp, Homo sapiens
agtgtgcagtatctgtg

SEQ ID NO: 3620939 - DNA, 20 bp, Homo sapiens
agtgtgccagtttaaaaaga

SEQ ID NO: 3620940 - DNA, 23 bp, Homo sapiens
agtgtgggtctgtgtgtgtgtat

SEQ ID NO: 3620941 - DNA, 15 bp, Homo sapiens
agtgttcctgaagct

SEQ ID NO: 3620942 - DNA, 15 bp, Homo sapiens
agtgttcctgcacca

SEQ ID NO: 3620943 - DNA, 17 bp, Homo sapiens
agtgttccttgtgcccg

SEQ ID NO: 3620944 - DNA, 17 bp, Homo sapiens
agtgttctgctcctgct

SEQ ID NO: 3620945 - DNA, 19 bp, Homo sapiens
agtgttctgctcctgcttt

SEQ ID NO: 3620946 - DNA, 23 bp, Homo sapiens
agtgttctgctcctgcttttctg

SEQ ID NO: 3620947 - DNA, 16 bp, Homo sapiens
agtgttgaaaatgttc

SEQ ID NO: 3620948 - DNA, 12 bp, Homo sapiens
agtgttgctgat

SEQ ID NO: 3620949 - DNA, 15 bp, Homo sapiens
agtgttgctgtggct

SEQ ID NO: 3620950 - DNA, 14 bp, Homo sapiens
agtgttgtatttct

SEQ ID NO: 3620951 - DNA, 12 bp, Homo sapiens
agtgtttaaatg

SEQ ID NO: 3620952 - DNA, 18 bp, Homo sapiens
agtgtttatgttgtttat

SEQ ID NO: 3620953 - DNA, 22 bp, Homo sapiens
agttaaaattgttatcaaaata

SEQ ID NO: 3620954 - DNA, 12 bp, Homo sapiens
agttaaataaat

SEQ ID NO: 3620955 - DNA, 13 bp, Homo sapiens
agttaacaggaca

SEQ ID NO: 3620956 - DNA, 14 bp, Homo sapiens
agttaacaggacag

SEQ ID NO: 3620957 - DNA, 17 bp, Homo sapiens
agttaactattgcattt

SEQ ID NO: 3620958 - DNA, 13 bp, Homo sapiens
agttaagaactat

SEQ ID NO: 3620959 - DNA, 14 bp, Homo sapiens
agttacagttctgt

SEQ ID NO: 3620960 - DNA, 16 bp, Homo sapiens
agttacagttctgtgg

SEQ ID NO: 3620961 - DNA, 16 bp, Homo sapiens
agttacattaaaataa

SEQ ID NO: 3620962 - DNA, 23 bp, Homo sapiens
agttacattaaaataaaccaaat

SEQ ID NO: 3620963 - DNA, 21 bp, Homo sapiens
agttaccacagcaactgacct

SEQ ID NO: 3620964 - DNA, 15 bp, Homo sapiens
agttaccagtgcctt

SEQ ID NO: 3620965 - DNA, 17 bp, Homo sapiens
agttaccttatagttac

SEQ ID NO: 3620966 - DNA, 13 bp, Homo sapiens
agttactcaagca

SEQ ID NO: 3620967 - DNA, 18 bp, Homo sapiens
agttactccctacactga

SEQ ID NO: 3620968 - DNA, 22 bp, Homo sapiens
agttactccctacactgatgca

SEQ ID NO: 3620969 - DNA, 14 bp, Homo sapiens
agttactgtgtaat

SEQ ID NO: 3620970 - DNA, 23 bp, Homo sapiens
agttacttaattgccagcaaata

SEQ ID NO: 3620971 - DNA, 15 bp, Homo sapiens
agttacttgggcttc

SEQ ID NO: 3620972 - DNA, 18 bp, Homo sapiens
agttagtgagactagaca

SEQ ID NO: 3620973 - DNA, 19 bp, Homo sapiens
agttatattggaattataa

SEQ ID NO: 3620974 - DNA, 19 bp, Homo sapiens
agttatggctataggtgct

SEQ ID NO: 3620975 - DNA, 11 bp, Homo sapiens
agttattttat

SEQ ID NO: 3620976 - DNA, 24 bp, Homo sapiens
agttattttatgacatgaaaagtt

SEQ ID NO: 3620977 - DNA, 21 bp, Homo sapiens
agttatttttatttatttaaa

SEQ ID NO: 3620978 - DNA, 14 bp, Homo sapiens
agttcagaatggca

SEQ ID NO: 3620979 - DNA, 21 bp, Homo sapiens
agttcagaatggcagtcctgg

SEQ ID NO: 3620980 - DNA, 22 bp, Homo sapiens
agttcagaatggcagtcctgga

SEQ ID NO: 3620981 - DNA, 16 bp, Homo sapiens
agttcagggaccgtcc

SEQ ID NO: 3620982 - DNA, 14 bp, Homo sapiens
agttcatcttgcag

SEQ ID NO: 3620983 - DNA, 14 bp, Homo sapiens
agttcattctacca

SEQ ID NO: 3620984 - DNA, 15 bp, Homo sapiens
agttcattctaccaa

SEQ ID NO: 3620985 - DNA, 18 bp, Homo sapiens
agttcattctaccaagct

SEQ ID NO: 3620986 - DNA, 22 bp, Homo sapiens
agttcattctaccaagctgtca

SEQ ID NO: 3620987 - DNA, 15 bp, Homo sapiens
agttccggggagaaa

SEQ ID NO: 3620988 - DNA, 23 bp, Homo sapiens
agttccggggagaaacccagaga

SEQ ID NO: 3620989 - DNA, 12 bp, Homo sapiens
agttcctctgca

SEQ ID NO: 3620990 - DNA, 19 bp, Homo sapiens
agttccttatccctctctt

SEQ ID NO: 3620991 - DNA, 21 bp, Homo sapiens
agttccttatccctctcttcc

SEQ ID NO: 3620992 - DNA, 19 bp, Homo sapiens
agttcgagaccagcctggc

SEQ ID NO: 3620993 - DNA, 22 bp, Homo sapiens
agttctaggcatacttttcaaa

SEQ ID NO: 3620994 - DNA, 19 bp, Homo sapiens
agttctaggcctttcctct

SEQ ID NO: 3620995 - DNA, 14 bp, Homo sapiens
agttctatttaaaa

SEQ ID NO: 3620996 - DNA, 18 bp, Homo sapiens
agttctattttactgtct

SEQ ID NO: 3620997 - DNA, 18 bp, Homo sapiens
agttctctcatcggaggc

SEQ ID NO: 3620998 - DNA, 21 bp, Homo sapiens
agttctctcatcggaggccca

SEQ ID NO: 3620999 - DNA, 23 bp, Homo sapiens
agttctctcatcggaggcccatg

SEQ ID NO: 3621000 - DNA, 10 bp, Homo sapiens
agttctggaa

SEQ ID NO: 3621001 - DNA, 14 bp, Homo sapiens
agttctgtggttcc

SEQ ID NO: 3621002 - DNA, 22 bp, Homo sapiens
agttcttagctatccttggctt

SEQ ID NO: 3621003 - DNA, 12 bp, Homo sapiens
agttctttcctc

SEQ ID NO: 3621004 - DNA, 15 bp, Homo sapiens
agttctttcctcccc

SEQ ID NO: 3621005 - DNA, 21 bp, Homo sapiens
agttctttcctccccctgcaa

SEQ ID NO: 3621006 - DNA, 15 bp, Homo sapiens
agttctttgctgccc

SEQ ID NO: 3621007 - DNA, 18 bp, Homo sapiens
agttctttgctgcccctg

SEQ ID NO: 3621008 - DNA, 20 bp, Homo sapiens
agttgaaaagactccaaaga

SEQ ID NO: 3621009 - DNA, 23 bp, Homo sapiens
agttgacctttatttattaaact

SEQ ID NO: 3621010 - DNA, 12 bp, Homo sapiens
agttgacttact

SEQ ID NO: 3621011 - DNA, 18 bp, Homo sapiens
agttgacttatagtacat

SEQ ID NO: 3621012 - DNA, 22 bp, Homo sapiens
agttgatataaaactctgggtc

SEQ ID NO: 3621013 - DNA, 20 bp, Homo sapiens
agttgatctggaacccagac

SEQ ID NO: 3621014 - DNA, 21 bp, Homo sapiens
agttgatctggaacccagact

SEQ ID NO: 3621015 - DNA, 18 bp, Homo sapiens
agttgatggagccccagg

SEQ ID NO: 3621016 - DNA, 14 bp, Homo sapiens
agttgcattttaac

SEQ ID NO: 3621017 - DNA, 23 bp, Homo sapiens
agttgcattttaaccctatttta

SEQ ID NO: 3621018 - DNA, 15 bp, Homo sapiens
agttgccacatttag

SEQ ID NO: 3621019 - DNA, 21 bp, Homo sapiens
agttgcccccattcccagcct

SEQ ID NO: 3621020 - DNA, 19 bp, Homo sapiens
agttgctgttaatctgatg

SEQ ID NO: 3621021 - DNA, 19 bp, Homo sapiens
agttggctttgcccacccc

SEQ ID NO: 3621022 - DNA, 23 bp, Homo sapiens
agttggctttgcccacccctcac

SEQ ID NO: 3621023 - DNA, 24 bp, Homo sapiens
agttggctttgcccacccctcact

SEQ ID NO: 3621024 - DNA, 15 bp, Homo sapiens
agttgggcccctgag

SEQ ID NO: 3621025 - DNA, 17 bp, Homo sapiens
agttgggcccctgagga

SEQ ID NO: 3621026 - DNA, 13 bp, Homo sapiens
agttggtaacttt

SEQ ID NO: 3621027 - DNA, 16 bp, Homo sapiens
agttggtaacttttgt

SEQ ID NO: 3621028 - DNA, 20 bp, Homo sapiens
agttggtaacttttgtgaat

SEQ ID NO: 3621029 - DNA, 16 bp, Homo sapiens
agttggtttggatttt

SEQ ID NO: 3621030 - DNA, 16 bp, Homo sapiens
agttgtcaataaatgg

SEQ ID NO: 3621031 - DNA, 15 bp, Homo sapiens
agttgttagattaag

SEQ ID NO: 3621032 - DNA, 23 bp, Homo sapiens
agttgttgctatacatgttggaa

SEQ ID NO: 3621033 - DNA, 16 bp, Homo sapiens
agtttaaacaaaaaac

SEQ ID NO: 3621034 - DNA, 14 bp, Homo sapiens
agtttaaattctag

SEQ ID NO: 3621035 - DNA, 18 bp, Homo sapiens
agtttaagggggacttaa

SEQ ID NO: 3621036 - DNA, 13 bp, Homo sapiens
agtttaattgtct

SEQ ID NO: 3621037 - DNA, 12 bp, Homo sapiens
agtttacagtat

SEQ ID NO: 3621038 - DNA, 16 bp, Homo sapiens
agtttaggataaaata

SEQ ID NO: 3621039 - DNA, 17 bp, Homo sapiens
agtttatccaaatcttg

SEQ ID NO: 3621040 - DNA, 16 bp, Homo sapiens
agtttccagagagtgg

SEQ ID NO: 3621041 - DNA, 16 bp, Homo sapiens
agtttccgcggcggct

SEQ ID NO: 3621042 - DNA, 14 bp, Homo sapiens
agtttcctcagtga

SEQ ID NO: 3621043 - DNA, 12 bp, Homo sapiens
agtttcctgaaa

SEQ ID NO: 3621044 - DNA, 22 bp, Homo sapiens
agtttctacattcagattatat

SEQ ID NO: 3621045 - DNA, 23 bp, Homo sapiens
agtttctgtcgttaaaaacagat

SEQ ID NO: 3621046 - DNA, 14 bp, Homo sapiens
agtttctgtttgat

SEQ ID NO: 3621047 - DNA, 17 bp, Homo sapiens
agtttctgtttgattct

SEQ ID NO: 3621048 - DNA, 19 bp, Homo sapiens
agtttctgtttgattcttt

SEQ ID NO: 3621049 - DNA, 18 bp, Homo sapiens
agtttcttgcttggaagc

SEQ ID NO: 3621050 - DNA, 21 bp, Homo sapiens
agtttcttgcttggaagccag

SEQ ID NO: 3621051 - DNA, 19 bp, Homo sapiens
agtttgaatgctgcaagtt

SEQ ID NO: 3621052 - DNA, 14 bp, Homo sapiens
agtttgacacctta

SEQ ID NO: 3621053 - DNA, 22 bp, Homo sapiens
agtttgctctaccaaatagtga

SEQ ID NO: 3621054 - DNA, 14 bp, Homo sapiens
agtttgggtatttt

SEQ ID NO: 3621055 - DNA, 18 bp, Homo sapiens
agtttgtggtaacttgag

SEQ ID NO: 3621056 - DNA, 15 bp, Homo sapiens
agttttacagtgttt

SEQ ID NO: 3621057 - DNA, 12 bp, Homo sapiens
agttttataaat

SEQ ID NO: 3621058 - DNA, 15 bp, Homo sapiens
agttttataaattaa

SEQ ID NO: 3621059 - DNA, 20 bp, Homo sapiens
agttttataaattaaaaggt

SEQ ID NO: 3621060 - DNA, 15 bp, Homo sapiens
agttttatttgtatt

SEQ ID NO: 3621061 - DNA, 21 bp, Homo sapiens
agttttcatttagaaaataga

SEQ ID NO: 3621062 - DNA, 20 bp, Homo sapiens
agttttcccttgaggaaaca

SEQ ID NO: 3621063 - DNA, 12 bp, Homo sapiens
agttttctgaga

SEQ ID NO: 3621064 - DNA, 14 bp, Homo sapiens
agttttctgagaaa

SEQ ID NO: 3621065 - DNA, 18 bp, Homo sapiens
agttttctgagaaagact

SEQ ID NO: 3621066 - DNA, 18 bp, Homo sapiens
agttttgagtaattcaag

SEQ ID NO: 3621067 - DNA, 16 bp, Homo sapiens
agttttggcagccatg

SEQ ID NO: 3621068 - DNA, 19 bp, Homo sapiens
agtttttagaatgttgaaa

SEQ ID NO: 3621069 - DNA, 22 bp, Homo sapiens
agtttttcccagctacaccttt

SEQ ID NO: 3621070 - DNA, 23 bp, Homo sapiens
agtttttcccagctacacctttc

SEQ ID NO: 3621071 - DNA, 23 bp, Homo sapiens
agtttttgaaatacctttgtagt

SEQ ID NO: 3621072 - DNA, 18 bp, Homo sapiens
agttttttacttctctta

SEQ ID NO: 3621073 - DNA, 19 bp, Homo sapiens
ataaaaaagaacttttgta

SEQ ID NO: 3621074 - DNA, 21 bp, Homo sapiens
ataaaaactcaggcaaagaaa

SEQ ID NO: 3621075 - DNA, 19 bp, Homo sapiens
ataaaaaggacatcagcaa

SEQ ID NO: 3621076 - DNA, 17 bp, Homo sapiens
ataaaaagtcacaatga

SEQ ID NO: 3621077 - DNA, 16 bp, Homo sapiens
ataaaaattaaatgga

SEQ ID NO: 3621078 - DNA, 13 bp, Homo sapiens
ataaaagaaataa

SEQ ID NO: 3621079 - DNA, 20 bp, Homo sapiens
ataaaagacaaatgcaacat

SEQ ID NO: 3621080 - DNA, 20 bp, Homo sapiens
ataaaagcacaagtactttt

SEQ ID NO: 3621081 - DNA, 13 bp, Homo sapiens
ataaaataaataa

SEQ ID NO: 3621082 - DNA, 17 bp, Homo sapiens
ataaaatatatcttata

SEQ ID NO: 3621083 - DNA, 18 bp, Homo sapiens
ataaaatgtaaactgttt

SEQ ID NO: 3621084 - DNA, 13 bp, Homo sapiens
ataaaatgtattc

SEQ ID NO: 3621085 - DNA, 14 bp, Homo sapiens
ataaacaaagacat

SEQ ID NO: 3621086 - DNA, 22 bp, Homo sapiens
ataaacaaagacattgacagca

SEQ ID NO: 3621087 - DNA, 15 bp, Homo sapiens
ataaacacatttcca

SEQ ID NO: 3621088 - DNA, 16 bp, Homo sapiens
ataaacacatttccat

SEQ ID NO: 3621089 - DNA, 16 bp, Homo sapiens
ataaacatcagtttct

SEQ ID NO: 3621090 - DNA, 19 bp, Homo sapiens
ataaaccaaatatgttaaa

SEQ ID NO: 3621091 - DNA, 23 bp, Homo sapiens
ataaaccgtgtatttattacatt

SEQ ID NO: 3621092 - DNA, 16 bp, Homo sapiens
ataaacggttcctggt

SEQ ID NO: 3621093 - DNA, 17 bp, Homo sapiens
ataaactcttaagagaa

SEQ ID NO: 3621094 - DNA, 17 bp, Homo sapiens
ataaactggtatgaata

SEQ ID NO: 3621095 - DNA, 18 bp, Homo sapiens
ataaagaattaatgactt

SEQ ID NO: 3621096 - DNA, 11 bp, Homo sapiens
ataaagacagg

SEQ ID NO: 3621097 - DNA, 20 bp, Homo sapiens
ataaagaccgtacaaactca

SEQ ID NO: 3621098 - DNA, 11 bp, Homo sapiens
ataaagagaaa

SEQ ID NO: 3621099 - DNA, 20 bp, Homo sapiens
ataaagataaatgcaaccat

SEQ ID NO: 3621100 - DNA, 20 bp, Homo sapiens
ataaagcagttaatttatat

SEQ ID NO: 3621101 - DNA, 14 bp, Homo sapiens
ataaaggataaaga

SEQ ID NO: 3621102 - DNA, 22 bp, Homo sapiens
ataaagggcccacacctggtgg

SEQ ID NO: 3621103 - DNA, 22 bp, Homo sapiens
ataaagtggaagtatgtatatt

SEQ ID NO: 3621104 - DNA, 12 bp, Homo sapiens
ataaataatttt

SEQ ID NO: 3621105 - DNA, 12 bp, Homo sapiens
ataaatcatgtt

SEQ ID NO: 3621106 - DNA, 20 bp, Homo sapiens
ataaatcattcttactaaaa

SEQ ID NO: 3621107 - DNA, 18 bp, Homo sapiens
ataaatctgacccagtgc

SEQ ID NO: 3621108 - DNA, 21 bp, Homo sapiens
ataaatgaaacttggccagtt

SEQ ID NO: 3621109 - DNA, 17 bp, Homo sapiens
ataaatgtaaaaatgaa

SEQ ID NO: 3621110 - DNA, 22 bp, Homo sapiens
ataaatgtaatagccaaaccca

SEQ ID NO: 3621111 - DNA, 14 bp, Homo sapiens
ataaatgtgactca

SEQ ID NO: 3621112 - DNA, 12 bp, Homo sapiens
ataaattattac

SEQ ID NO: 3621113 - DNA, 13 bp, Homo sapiens
ataaattatttgt

SEQ ID NO: 3621114 - DNA, 15 bp, Homo sapiens
ataaattatttgtta

SEQ ID NO: 3621115 - DNA, 20 bp, Homo sapiens
ataaattcctctttgctttg

SEQ ID NO: 3621116 - DNA, 16 bp, Homo sapiens
ataaattctaaattac

SEQ ID NO: 3621117 - DNA, 23 bp, Homo sapiens
ataaattctacctccttgtgttg

SEQ ID NO: 3621118 - DNA, 17 bp, Homo sapiens
ataaattctactaagtt

SEQ ID NO: 3621119 - DNA, 19 bp, Homo sapiens
ataaattctactaagttat

SEQ ID NO: 3621120 - DNA, 16 bp, Homo sapiens
ataaattgctccttga

SEQ ID NO: 3621121 - DNA, 17 bp, Homo sapiens
ataaattgcttactgat

SEQ ID NO: 3621122 - DNA, 16 bp, Homo sapiens
ataaatttaactttaa

SEQ ID NO: 3621123 - DNA, 20 bp, Homo sapiens
ataaatttctgggatattta

SEQ ID NO: 3621124 - DNA, 22 bp, Homo sapiens
ataaattttttttggtcaaatt

SEQ ID NO: 3621125 - DNA, 14 bp, Homo sapiens
ataacaaaatggac

SEQ ID NO: 3621126 - DNA, 16 bp, Homo sapiens
ataacacagatattgt

SEQ ID NO: 3621127 - DNA, 16 bp, Homo sapiens
ataacagatcctttca

SEQ ID NO: 3621128 - DNA, 15 bp, Homo sapiens
ataacagatttctca

SEQ ID NO: 3621129 - DNA, 18 bp, Homo sapiens
ataactcctgtccctttt

SEQ ID NO: 3621130 - DNA, 19 bp, Homo sapiens
ataactcctgtcccttttc

SEQ ID NO: 3621131 - DNA, 22 bp, Homo sapiens
ataactcctgtcccttttccct

SEQ ID NO: 3621132 - DNA, 18 bp, Homo sapiens
ataactgaaccaaattgc

SEQ ID NO: 3621133 - DNA, 23 bp, Homo sapiens
ataactgaaccaaattgcactga

SEQ ID NO: 3621134 - DNA, 21 bp, Homo sapiens
ataacttgctttcttctttcc

SEQ ID NO: 3621135 - DNA, 17 bp, Homo sapiens
ataactttaacttctgt

SEQ ID NO: 3621136 - DNA, 12 bp, Homo sapiens
ataagaaatgaa

SEQ ID NO: 3621137 - DNA, 17 bp, Homo sapiens
ataagaaatgcatatgt

SEQ ID NO: 3621138 - DNA, 19 bp, Homo sapiens
ataagaacaagttttggca

SEQ ID NO: 3621139 - DNA, 14 bp, Homo sapiens
ataagaagaagaga

SEQ ID NO: 3621140 - DNA, 16 bp, Homo sapiens
ataagagaaacctgcc

SEQ ID NO: 3621141 - DNA, 17 bp, Homo sapiens
ataagagaaacctgcca

SEQ ID NO: 3621142 - DNA, 22 bp, Homo sapiens
ataagagaaacctgccaaggag

SEQ ID NO: 3621143 - DNA, 22 bp, Homo sapiens
ataagagcatgaaatttttaaa

SEQ ID NO: 3621144 - DNA, 19 bp, Homo sapiens
ataagatgatttaatgttg

SEQ ID NO: 3621145 - DNA, 12 bp, Homo sapiens
ataaggaaattt

SEQ ID NO: 3621146 - DNA, 21 bp, Homo sapiens
ataagtgctattgcagagccg

SEQ ID NO: 3621147 - DNA, 15 bp, Homo sapiens
ataagttgaccttta

SEQ ID NO: 3621148 - DNA, 11 bp, Homo sapiens
ataataaaaat

SEQ ID NO: 3621149 - DNA, 13 bp, Homo sapiens
ataataaaggact

SEQ ID NO: 3621150 - DNA, 18 bp, Homo sapiens
ataataaatcacacattc

SEQ ID NO: 3621151 - DNA, 15 bp, Homo sapiens
ataataagtttcata

SEQ ID NO: 3621152 - DNA, 14 bp, Homo sapiens
ataataataataaa

SEQ ID NO: 3621153 - DNA, 16 bp, Homo sapiens
ataatagggttttcag

SEQ ID NO: 3621154 - DNA, 13 bp, Homo sapiens
ataataggtcata

SEQ ID NO: 3621155 - DNA, 20 bp, Homo sapiens
ataatatttaggcatgagct

SEQ ID NO: 3621156 - DNA, 15 bp, Homo sapiens
ataatccacccccag

SEQ ID NO: 3621157 - DNA, 15 bp, Homo sapiens
ataatctagaacaca

SEQ ID NO: 3621158 - DNA, 11 bp, Homo sapiens
ataatctcatc

SEQ ID NO: 3621159 - DNA, 19 bp, Homo sapiens
ataatctggactcctctgt

SEQ ID NO: 3621160 - DNA, 13 bp, Homo sapiens
ataatgaacccat

SEQ ID NO: 3621161 - DNA, 13 bp, Homo sapiens
ataatgaataaat

SEQ ID NO: 3621162 - DNA, 21 bp, Homo sapiens
ataatgggattttcttttctt

SEQ ID NO: 3621163 - DNA, 17 bp, Homo sapiens
ataatgggtttctttca

SEQ ID NO: 3621164 - DNA, 20 bp, Homo sapiens
ataatggtactcccaaactg

SEQ ID NO: 3621165 - DNA, 22 bp, Homo sapiens
ataatggtactcccaaactgac

SEQ ID NO: 3621166 - DNA, 22 bp, Homo sapiens
ataatgtaatgtttttatttca

SEQ ID NO: 3621167 - DNA, 13 bp, Homo sapiens
ataatgtgtataa

SEQ ID NO: 3621168 - DNA, 20 bp, Homo sapiens
ataatgttttgggaaacact

SEQ ID NO: 3621169 - DNA, 13 bp, Homo sapiens
ataattaaagact

SEQ ID NO: 3621170 - DNA, 14 bp, Homo sapiens
ataattaattgtca

SEQ ID NO: 3621171 - DNA, 15 bp, Homo sapiens
ataattctgaaacaa

SEQ ID NO: 3621172 - DNA, 21 bp, Homo sapiens
ataatttaaaaatatatttat

SEQ ID NO: 3621173 - DNA, 13 bp, Homo sapiens
ataatttacctaa

SEQ ID NO: 3621174 - DNA, 23 bp, Homo sapiens
ataatttacctaagattacaaat

SEQ ID NO: 3621175 - DNA, 14 bp, Homo sapiens
ataatttagatggt

SEQ ID NO: 3621176 - DNA, 19 bp, Homo sapiens
ataatttccttcaggcagc

SEQ ID NO: 3621177 - DNA, 12 bp, Homo sapiens
ataattttcctt

SEQ ID NO: 3621178 - DNA, 19 bp, Homo sapiens
ataatttttgctgaattcc

SEQ ID NO: 3621179 - DNA, 17 bp, Homo sapiens
atacaaaagctttttaa

SEQ ID NO: 3621180 - DNA, 15 bp, Homo sapiens
atacaaactctcacc

SEQ ID NO: 3621181 - DNA, 16 bp, Homo sapiens
atacaaactctcacca

SEQ ID NO: 3621182 - DNA, 13 bp, Homo sapiens
atacaaatttata

SEQ ID NO: 3621183 - DNA, 16 bp, Homo sapiens
atacaaatttataaag

SEQ ID NO: 3621184 - DNA, 15 bp, Homo sapiens
atacaagcatatgtt

SEQ ID NO: 3621185 - DNA, 16 bp, Homo sapiens
atacaatcagcccagt

SEQ ID NO: 3621186 - DNA, 22 bp, Homo sapiens
atacacacacacagacatatat

SEQ ID NO: 3621187 - DNA, 11 bp, Homo sapiens
atacacacgct

SEQ ID NO: 3621188 - DNA, 15 bp, Homo sapiens
atacacacgctgcct

SEQ ID NO: 3621189 - DNA, 17 bp, Homo sapiens
atacacactcaaatcaa

SEQ ID NO: 3621190 - DNA, 18 bp, Homo sapiens
atacacactcaaatcaag

SEQ ID NO: 3621191 - DNA, 19 bp, Homo sapiens
atacacactcgaatcattg

SEQ ID NO: 3621192 - DNA, 17 bp, Homo sapiens
atacaccagcaatttag

SEQ ID NO: 3621193 - DNA, 19 bp, Homo sapiens
atacacccagttctgaata

SEQ ID NO: 3621194 - DNA, 18 bp, Homo sapiens
atacaccgggcctggaga

SEQ ID NO: 3621195 - DNA, 19 bp, Homo sapiens
atacactgtaagctttgtt

SEQ ID NO: 3621196 - DNA, 13 bp, Homo sapiens
atacacttacact

SEQ ID NO: 3621197 - DNA, 16 bp, Homo sapiens
atacataaaagaaata

SEQ ID NO: 3621198 - DNA, 18 bp, Homo sapiens
atacataaaagaaataaa

SEQ ID NO: 3621199 - DNA, 21 bp, Homo sapiens
atacatttaaaacattaaaat

SEQ ID NO: 3621200 - DNA, 16 bp, Homo sapiens
atacatttgataaagt

SEQ ID NO: 3621201 - DNA, 15 bp, Homo sapiens
ataccaaaattgagc

SEQ ID NO: 3621202 - DNA, 14 bp, Homo sapiens
ataccacgaggaaa

SEQ ID NO: 3621203 - DNA, 20 bp, Homo sapiens
ataccattctattctccaga

SEQ ID NO: 3621204 - DNA, 22 bp, Homo sapiens
ataccattctattctccagaca

SEQ ID NO: 3621205 - DNA, 19 bp, Homo sapiens
atacctacaataaactggt

SEQ ID NO: 3621206 - DNA, 11 bp, Homo sapiens
atacctgcccc

SEQ ID NO: 3621207 - DNA, 15 bp, Homo sapiens
ataccttagagactt

SEQ ID NO: 3621208 - DNA, 15 bp, Homo sapiens
ataccttctatgtat

SEQ ID NO: 3621209 - DNA, 21 bp, Homo sapiens
atactaagaccctaattcttt

SEQ ID NO: 3621210 - DNA, 12 bp, Homo sapiens
atactacttatg

SEQ ID NO: 3621211 - DNA, 17 bp, Homo sapiens
atactatggaatttctc

SEQ ID NO: 3621212 - DNA, 17 bp, Homo sapiens
atactgagaaaacctgt

SEQ ID NO: 3621213 - DNA, 16 bp, Homo sapiens
atactgccttgtttaa

SEQ ID NO: 3621214 - DNA, 18 bp, Homo sapiens
atactgctctataaatag

SEQ ID NO: 3621215 - DNA, 18 bp, Homo sapiens
atactgtctctccagtga

SEQ ID NO: 3621216 - DNA, 17 bp, Homo sapiens
atactgtctctttcatg

SEQ ID NO: 3621217 - DNA, 20 bp, Homo sapiens
atactgtggcctgcaggagg

SEQ ID NO: 3621218 - DNA, 21 bp, Homo sapiens
atactgtggcctgcaggaggg

SEQ ID NO: 3621219 - DNA, 16 bp, Homo sapiens
atacttacatatctga

SEQ ID NO: 3621220 - DNA, 17 bp, Homo sapiens
atacttgaagaaacaga

SEQ ID NO: 3621221 - DNA, 16 bp, Homo sapiens
atactttctatgtgac

SEQ ID NO: 3621222 - DNA, 13 bp, Homo sapiens
atactttgaagtg

SEQ ID NO: 3621223 - DNA, 19 bp, Homo sapiens
atagaataaaggcagtttt

SEQ ID NO: 3621224 - DNA, 22 bp, Homo sapiens
atagaataaaggcagttttcta

SEQ ID NO: 3621225 - DNA, 18 bp, Homo sapiens
atagacacacatacataa

SEQ ID NO: 3621226 - DNA, 15 bp, Homo sapiens
atagacagcatgaga

SEQ ID NO: 3621227 - DNA, 15 bp, Homo sapiens
atagaccaaagcaaa

SEQ ID NO: 3621228 - DNA, 10 bp, Homo sapiens
atagagaaaa

SEQ ID NO: 3621229 - DNA, 16 bp, Homo sapiens
atagagcttttaaaaa

SEQ ID NO: 3621230 - DNA, 17 bp, Homo sapiens
atagatgctggcccagg

SEQ ID NO: 3621231 - DNA, 13 bp, Homo sapiens
atagatgtaattt

SEQ ID NO: 3621232 - DNA, 20 bp, Homo sapiens
atagatgtgcagtttggaat

SEQ ID NO: 3621233 - DNA, 14 bp, Homo sapiens
atagatgtgtggac

SEQ ID NO: 3621234 - DNA, 14 bp, Homo sapiens
atagattcagagaa

SEQ ID NO: 3621235 - DNA, 18 bp, Homo sapiens
atagattgagttattaac

SEQ ID NO: 3621236 - DNA, 19 bp, Homo sapiens
atagcacatggcagatttg

SEQ ID NO: 3621237 - DNA, 12 bp, Homo sapiens
atagcagaaaga

SEQ ID NO: 3621238 - DNA, 16 bp, Homo sapiens
atagcagtagtctttt

SEQ ID NO: 3621239 - DNA, 18 bp, Homo sapiens
atagcccaggatatattt

SEQ ID NO: 3621240 - DNA, 21 bp, Homo sapiens
atagcccaggatatattttat

SEQ ID NO: 3621241 - DNA, 13 bp, Homo sapiens
atagctaagtaca

SEQ ID NO: 3621242 - DNA, 15 bp, Homo sapiens
atagctaagtacaca

SEQ ID NO: 3621243 - DNA, 18 bp, Homo sapiens
atagctaagtacacaata

SEQ ID NO: 3621244 - DNA, 17 bp, Homo sapiens
atagctacatgttcttt

SEQ ID NO: 3621245 - DNA, 19 bp, Homo sapiens
atagctctctgactgcttt

SEQ ID NO: 3621246 - DNA, 12 bp, Homo sapiens
atagctctgggg

SEQ ID NO: 3621247 - DNA, 22 bp, Homo sapiens
atagcttcaccccaatcccagc

SEQ ID NO: 3621248 - DNA, 15 bp, Homo sapiens
ataggaaactgaagc

SEQ ID NO: 3621249 - DNA, 15 bp, Homo sapiens
ataggacagagggat

SEQ ID NO: 3621250 - DNA, 23 bp, Homo sapiens
ataggactccatttctttcttcc

SEQ ID NO: 3621251 - DNA, 20 bp, Homo sapiens
ataggagaaagcaaaataca

SEQ ID NO: 3621252 - DNA, 23 bp, Homo sapiens
ataggatcatttgttggaatgaa

SEQ ID NO: 3621253 - DNA, 14 bp, Homo sapiens
ataggcagggggcc

SEQ ID NO: 3621254 - DNA, 20 bp, Homo sapiens
ataggcagggggccctgccc

SEQ ID NO: 3621255 - DNA, 15 bp, Homo sapiens
ataggcatgagccac

SEQ ID NO: 3621256 - DNA, 22 bp, Homo sapiens
ataggcatgagccactgtgctt

SEQ ID NO: 3621257 - DNA, 14 bp, Homo sapiens
ataggcattttaag

SEQ ID NO: 3621258 - DNA, 15 bp, Homo sapiens
ataggcctgtccctt

SEQ ID NO: 3621259 - DNA, 20 bp, Homo sapiens
ataggcctgtcccttgcctc

SEQ ID NO: 3621260 - DNA, 21 bp, Homo sapiens
ataggctattttctaaagact

SEQ ID NO: 3621261 - DNA, 15 bp, Homo sapiens
atagggatggcagtg

SEQ ID NO: 3621262 - DNA, 15 bp, Homo sapiens
atagggttttcagat

SEQ ID NO: 3621263 - DNA, 19 bp, Homo sapiens
ataggtcatatgttgtgtt

SEQ ID NO: 3621264 - DNA, 22 bp, Homo sapiens
ataggtctaaataggatcctgg

SEQ ID NO: 3621265 - DNA, 15 bp, Homo sapiens
ataggtctttctctc

SEQ ID NO: 3621266 - DNA, 22 bp, Homo sapiens
ataggtttatattattgattca

SEQ ID NO: 3621267 - DNA, 14 bp, Homo sapiens
atagtaaaatacct

SEQ ID NO: 3621268 - DNA, 20 bp, Homo sapiens
atagtatcctccaggttttt

SEQ ID NO: 3621269 - DNA, 15 bp, Homo sapiens
atagtatctgtatat

SEQ ID NO: 3621270 - DNA, 22 bp, Homo sapiens
atagtatctgtatataagttgc

SEQ ID NO: 3621271 - DNA, 14 bp, Homo sapiens
atagtcaagacgaa

SEQ ID NO: 3621272 - DNA, 17 bp, Homo sapiens
atagtccttcctggcat

SEQ ID NO: 3621273 - DNA, 11 bp, Homo sapiens
atagtcctttt

SEQ ID NO: 3621274 - DNA, 16 bp, Homo sapiens
atagtgttctgctcct

SEQ ID NO: 3621275 - DNA, 19 bp, Homo sapiens
atagtgttctgctcctgct

SEQ ID NO: 3621276 - DNA, 13 bp, Homo sapiens
atagttactgtgt

SEQ ID NO: 3621277 - DNA, 20 bp, Homo sapiens
atagttactgtgtaattagt

SEQ ID NO: 3621278 - DNA, 22 bp, Homo sapiens
atagttgccaatctaaaatggc

SEQ ID NO: 3621279 - DNA, 19 bp, Homo sapiens
atagttttttacttctctt

SEQ ID NO: 3621280 - DNA, 14 bp, Homo sapiens
atataaaatgtatt

SEQ ID NO: 3621281 - DNA, 21 bp, Homo sapiens
atataaaggaaaggccctgca

SEQ ID NO: 3621282 - DNA, 16 bp, Homo sapiens
atataaagtatatgtt

SEQ ID NO: 3621283 - DNA, 12 bp, Homo sapiens
atataaagtcag

SEQ ID NO: 3621284 - DNA, 14 bp, Homo sapiens
atataaatgtttat

SEQ ID NO: 3621285 - DNA, 16 bp, Homo sapiens
atataaatgtttatat

SEQ ID NO: 3621286 - DNA, 13 bp, Homo sapiens
atataagacaaat

SEQ ID NO: 3621287 - DNA, 21 bp, Homo sapiens
atataatagattgagttatta

SEQ ID NO: 3621288 - DNA, 18 bp, Homo sapiens
atatagacacacatacat

SEQ ID NO: 3621289 - DNA, 17 bp, Homo sapiens
atatagaccaattgaag

SEQ ID NO: 3621290 - DNA, 20 bp, Homo sapiens
atatagaccaattgaagcat

SEQ ID NO: 3621291 - DNA, 23 bp, Homo sapiens
atatagccattgatcataaactg

SEQ ID NO: 3621292 - DNA, 18 bp, Homo sapiens
atatataaattattactt

SEQ ID NO: 3621293 - DNA, 15 bp, Homo sapiens
atatataagtgtaca

SEQ ID NO: 3621294 - DNA, 14 bp, Homo sapiens
atatattcttataa

SEQ ID NO: 3621295 - DNA, 15 bp, Homo sapiens
atatattgaatattt

SEQ ID NO: 3621296 - DNA, 14 bp, Homo sapiens
atatatttgtcact

SEQ ID NO: 3621297 - DNA, 22 bp, Homo sapiens
atatatttttaaaaaatgaaat

SEQ ID NO: 3621298 - DNA, 24 bp, Homo sapiens
atatcaaagagaagatgcctgtta

SEQ ID NO: 3621299 - DNA, 13 bp, Homo sapiens
atatcaaagtcat

SEQ ID NO: 3621300 - DNA, 17 bp, Homo sapiens
atatcaacagcttccct

SEQ ID NO: 3621301 - DNA, 11 bp, Homo sapiens
atatcacttcc

SEQ ID NO: 3621302 - DNA, 22 bp, Homo sapiens
atatcaggtgtataaatgtaca

SEQ ID NO: 3621303 - DNA, 23 bp, Homo sapiens
atatcaggtgtataaatgtacat

SEQ ID NO: 3621304 - DNA, 21 bp, Homo sapiens
atatcatgagtgaataaatgt

SEQ ID NO: 3621305 - DNA, 19 bp, Homo sapiens
atatcatgtaaagaaatgt

SEQ ID NO: 3621306 - DNA, 18 bp, Homo sapiens
atatccacccagcaggca

SEQ ID NO: 3621307 - DNA, 15 bp, Homo sapiens
atatccctacatgta

SEQ ID NO: 3621308 - DNA, 17 bp, Homo sapiens
atatccctacatgtatt

SEQ ID NO: 3621309 - DNA, 18 bp, Homo sapiens
atatcccttggacatttt

SEQ ID NO: 3621310 - DNA, 19 bp, Homo sapiens
atatcccttggacatttta

SEQ ID NO: 3621311 - DNA, 14 bp, Homo sapiens
atatctaaaatatt

SEQ ID NO: 3621312 - DNA, 21 bp, Homo sapiens
atatctaaaatattattttat

SEQ ID NO: 3621313 - DNA, 18 bp, Homo sapiens
atatctgacttctaggat

SEQ ID NO: 3621314 - DNA, 23 bp, Homo sapiens
atatgatatgcatgtagcatata

SEQ ID NO: 3621315 - DNA, 15 bp, Homo sapiens
atatgcaaagcactg

SEQ ID NO: 3621316 - DNA, 16 bp, Homo sapiens
atatgcaaagcactga

SEQ ID NO: 3621317 - DNA, 16 bp, Homo sapiens
atatgcagttttcctt

SEQ ID NO: 3621318 - DNA, 11 bp, Homo sapiens
atatgcatgta

SEQ ID NO: 3621319 - DNA, 20 bp, Homo sapiens
atatgcatgtagcatataaa

SEQ ID NO: 3621320 - DNA, 19 bp, Homo sapiens
atatgcttatacacttaca

SEQ ID NO: 3621321 - DNA, 21 bp, Homo sapiens
atatggagtgagtcacctgct

SEQ ID NO: 3621322 - DNA, 23 bp, Homo sapiens
atatggataatctgagcaggtac

SEQ ID NO: 3621323 - DNA, 13 bp, Homo sapiens
atatggcaggact

SEQ ID NO: 3621324 - DNA, 19 bp, Homo sapiens
atatggcaggactcctggc

SEQ ID NO: 3621325 - DNA, 20 bp, Homo sapiens
atatggcaggactcctggca

SEQ ID NO: 3621326 - DNA, 22 bp, Homo sapiens
atatggcaggactcctggcagg

SEQ ID NO: 3621327 - DNA, 22 bp, Homo sapiens
atatgtaaatggtatgtcattc

SEQ ID NO: 3621328 - DNA, 20 bp, Homo sapiens
atatgtaacatcaagccatc

SEQ ID NO: 3621329 - DNA, 20 bp, Homo sapiens
atatgtacagtttattgata

SEQ ID NO: 3621330 - DNA, 15 bp, Homo sapiens
atatgtataacttta

SEQ ID NO: 3621331 - DNA, 21 bp, Homo sapiens
atatgtattctgtaaaagaaa

SEQ ID NO: 3621332 - DNA, 15 bp, Homo sapiens
atatgtgaaacattt

SEQ ID NO: 3621333 - DNA, 18 bp, Homo sapiens
atatgtgctggaattcta

SEQ ID NO: 3621334 - DNA, 19 bp, Homo sapiens
atatgtgctggaattctaa

SEQ ID NO: 3621335 - DNA, 23 bp, Homo sapiens
atatgttaagcagctaaattttc

SEQ ID NO: 3621336 - DNA, 21 bp, Homo sapiens
atatgttgttcttacaaacca

SEQ ID NO: 3621337 - DNA, 17 bp, Homo sapiens
atattaaaaaagagaca

SEQ ID NO: 3621338 - DNA, 19 bp, Homo sapiens
atattaaattctcaaagtt

SEQ ID NO: 3621339 - DNA, 20 bp, Homo sapiens
atattaaattctcaaagttt

SEQ ID NO: 3621340 - DNA, 13 bp, Homo sapiens
atattacaatgat

SEQ ID NO: 3621341 - DNA, 15 bp, Homo sapiens
atattacctggatta

SEQ ID NO: 3621342 - DNA, 18 bp, Homo sapiens
atattatgcctgaatgac

SEQ ID NO: 3621343 - DNA, 19 bp, Homo sapiens
atattatgcctgaatgact

SEQ ID NO: 3621344 - DNA, 15 bp, Homo sapiens
atattatttgtctta

SEQ ID NO: 3621345 - DNA, 17 bp, Homo sapiens
atattcattctttttga

SEQ ID NO: 3621346 - DNA, 19 bp, Homo sapiens
atattccactatttgcaga

SEQ ID NO: 3621347 - DNA, 15 bp, Homo sapiens
atattcctccagctg

SEQ ID NO: 3621348 - DNA, 21 bp, Homo sapiens
atattcctgcatttgtgaaat

SEQ ID NO: 3621349 - DNA, 12 bp, Homo sapiens
atattcctttgc

SEQ ID NO: 3621350 - DNA, 19 bp, Homo sapiens
atattctaatagtttttca

SEQ ID NO: 3621351 - DNA, 14 bp, Homo sapiens
atattctattttac

SEQ ID NO: 3621352 - DNA, 24 bp, Homo sapiens
atattctgaagcaacattttagct

SEQ ID NO: 3621353 - DNA, 13 bp, Homo sapiens
atattcttataaa

SEQ ID NO: 3621354 - DNA, 23 bp, Homo sapiens
atattctttagcttacctgggca

SEQ ID NO: 3621355 - DNA, 14 bp, Homo sapiens
atattgacttgtat

SEQ ID NO: 3621356 - DNA, 17 bp, Homo sapiens
atattgccctaattaaa

SEQ ID NO: 3621357 - DNA, 18 bp, Homo sapiens
atattggaattataaata

SEQ ID NO: 3621358 - DNA, 15 bp, Homo sapiens
atattgttataaata

SEQ ID NO: 3621359 - DNA, 19 bp, Homo sapiens
atattgttttacaatagtt

SEQ ID NO: 3621360 - DNA, 14 bp, Homo sapiens
atatttaatttgaa

SEQ ID NO: 3621361 - DNA, 15 bp, Homo sapiens
atatttaatttgaag

SEQ ID NO: 3621362 - DNA, 13 bp, Homo sapiens
atatttaccaaag

SEQ ID NO: 3621363 - DNA, 16 bp, Homo sapiens
atatttaccaaagtag

SEQ ID NO: 3621364 - DNA, 15 bp, Homo sapiens
atatttactatttca

SEQ ID NO: 3621365 - DNA, 21 bp, Homo sapiens
atatttatatcatccagaaaa

SEQ ID NO: 3621366 - DNA, 15 bp, Homo sapiens
atatttattacacaa

SEQ ID NO: 3621367 - DNA, 21 bp, Homo sapiens
atatttattttctttctgtaa

SEQ ID NO: 3621368 - DNA, 13 bp, Homo sapiens
atatttattttta

SEQ ID NO: 3621369 - DNA, 19 bp, Homo sapiens
atatttattttttttaagt

SEQ ID NO: 3621370 - DNA, 12 bp, Homo sapiens
atatttcaatct

SEQ ID NO: 3621371 - DNA, 14 bp, Homo sapiens
atatttcaatcttt

SEQ ID NO: 3621372 - DNA, 16 bp, Homo sapiens
atatttcaatctttta

SEQ ID NO: 3621373 - DNA, 19 bp, Homo sapiens
atatttcttcgtgatgaca

SEQ ID NO: 3621374 - DNA, 18 bp, Homo sapiens
atatttgaaaaccatatt

SEQ ID NO: 3621375 - DNA, 21 bp, Homo sapiens
atatttgtcaacagatttaaa

SEQ ID NO: 3621376 - DNA, 23 bp, Homo sapiens
atattttaattaaaattggtaaa

SEQ ID NO: 3621377 - DNA, 20 bp, Homo sapiens
atattttatttttagaattt

SEQ ID NO: 3621378 - DNA, 12 bp, Homo sapiens
atattttgctaa

SEQ ID NO: 3621379 - DNA, 20 bp, Homo sapiens
atattttgctaactggttaa

SEQ ID NO: 3621380 - DNA, 13 bp, Homo sapiens
atattttgtaaat

SEQ ID NO: 3621381 - DNA, 14 bp, Homo sapiens
atatttttaaagaa

SEQ ID NO: 3621382 - DNA, 23 bp, Homo sapiens
atatttttgtggacatgcataaa

SEQ ID NO: 3621383 - DNA, 19 bp, Homo sapiens
atattttttatttctaagt

SEQ ID NO: 3621384 - DNA, 16 bp, Homo sapiens
atcaaaaaaacaagtt

SEQ ID NO: 3621385 - DNA, 14 bp, Homo sapiens
atcaaaatagtcta

SEQ ID NO: 3621386 - DNA, 19 bp, Homo sapiens
atcaaagtcattaaagaca

SEQ ID NO: 3621387 - DNA, 15 bp, Homo sapiens
atcaaataaatttct

SEQ ID NO: 3621388 - DNA, 18 bp, Homo sapiens
atcaaatgtaacttactg

SEQ ID NO: 3621389 - DNA, 19 bp, Homo sapiens
atcaaatgtggctgtatcc

SEQ ID NO: 3621390 - DNA, 18 bp, Homo sapiens
atcaactcccaacttctt

SEQ ID NO: 3621391 - DNA, 16 bp, Homo sapiens
atcaagcaacattctt

SEQ ID NO: 3621392 - DNA, 16 bp, Homo sapiens
atcaagggaagaacta

SEQ ID NO: 3621393 - DNA, 22 bp, Homo sapiens
atcaagggagacaccagtggtg

SEQ ID NO: 3621394 - DNA, 11 bp, Homo sapiens
atcaatacaca

SEQ ID NO: 3621395 - DNA, 19 bp, Homo sapiens
atcacaaatttcacttata

SEQ ID NO: 3621396 - DNA, 16 bp, Homo sapiens
atcacacccatttaaa

SEQ ID NO: 3621397 - DNA, 23 bp, Homo sapiens
atcacagatgcatatagacacac

SEQ ID NO: 3621398 - DNA, 12 bp, Homo sapiens
atcacagggaat

SEQ ID NO: 3621399 - DNA, 21 bp, Homo sapiens
atcacatgtcagccactgtga

SEQ ID NO: 3621400 - DNA, 16 bp, Homo sapiens
atcactcctggaggct

SEQ ID NO: 3621401 - DNA, 12 bp, Homo sapiens
atcactgtatcc

SEQ ID NO: 3621402 - DNA, 20 bp, Homo sapiens
atcagaacattcagctctgg

SEQ ID NO: 3621403 - DNA, 22 bp, Homo sapiens
atcagaactcaaatggggccag

SEQ ID NO: 3621404 - DNA, 23 bp, Homo sapiens
atcagaactcaaatggggccaga

SEQ ID NO: 3621405 - DNA, 16 bp, Homo sapiens
atcagcattttagaaa

SEQ ID NO: 3621406 - DNA, 22 bp, Homo sapiens
atcagcattttagaaactacaa

SEQ ID NO: 3621407 - DNA, 13 bp, Homo sapiens
atcagccttggga

SEQ ID NO: 3621408 - DNA, 22 bp, Homo sapiens
atcagccttgggatagcaaact

SEQ ID NO: 3621409 - DNA, 13 bp, Homo sapiens
atcagctagattt

SEQ ID NO: 3621410 - DNA, 21 bp, Homo sapiens
atcagctgctgaaacaacaaa

SEQ ID NO: 3621411 - DNA, 23 bp, Homo sapiens
atcagctgctgaaacaacaaata

SEQ ID NO: 3621412 - DNA, 13 bp, Homo sapiens
atcagctggacat

SEQ ID NO: 3621413 - DNA, 22 bp, Homo sapiens
atcagctggacatactgctgga

SEQ ID NO: 3621414 - DNA, 22 bp, Homo sapiens
atcagctggtcaaacaaactct

SEQ ID NO: 3621415 - DNA, 22 bp, Homo sapiens
atcagcttgccctgttaaaaga

SEQ ID NO: 3621416 - DNA, 21 bp, Homo sapiens
atcaggcatgtgtcccttcca

SEQ ID NO: 3621417 - DNA, 16 bp, Homo sapiens
atcaggccattgtccc

SEQ ID NO: 3621418 - DNA, 18 bp, Homo sapiens
atcaggctaagaccctgt

SEQ ID NO: 3621419 - DNA, 20 bp, Homo sapiens
atcaggtcctcagagaattt

SEQ ID NO: 3621420 - DNA, 18 bp, Homo sapiens
atcagtgattatttttcc

SEQ ID NO: 3621421 - DNA, 19 bp, Homo sapiens
atcagtgattatttttcca

SEQ ID NO: 3621422 - DNA, 13 bp, Homo sapiens
atcagtgtccttt

SEQ ID NO: 3621423 - DNA, 20 bp, Homo sapiens
atcataaggagttggtgtaa

SEQ ID NO: 3621424 - DNA, 24 bp, Homo sapiens
atcataaggagttggtgtaatcat

SEQ ID NO: 3621425 - DNA, 23 bp, Homo sapiens
atcatatagaccaattgaagcat

SEQ ID NO: 3621426 - DNA, 13 bp, Homo sapiens
atcatatttgaaa

SEQ ID NO: 3621427 - DNA, 15 bp, Homo sapiens
atcatatttgaaaac

SEQ ID NO: 3621428 - DNA, 20 bp, Homo sapiens
atcatcctcccttttttgta

SEQ ID NO: 3621429 - DNA, 17 bp, Homo sapiens
atcatcctgcagacaga

SEQ ID NO: 3621430 - DNA, 14 bp, Homo sapiens
atcatgtaaagaaa

SEQ ID NO: 3621431 - DNA, 17 bp, Homo sapiens
atcatgtaaagaaatgt

SEQ ID NO: 3621432 - DNA, 18 bp, Homo sapiens
atcattgttcttttcaat

SEQ ID NO: 3621433 - DNA, 23 bp, Homo sapiens
atcattgtttagatgaggctcag

SEQ ID NO: 3621434 - DNA, 13 bp, Homo sapiens
atcatttttaatt

SEQ ID NO: 3621435 - DNA, 19 bp, Homo sapiens
atccaaaaagctctgaaaa

SEQ ID NO: 3621436 - DNA, 21 bp, Homo sapiens
atccaaatcttgaatttctgc

SEQ ID NO: 3621437 - DNA, 13 bp, Homo sapiens
atccaaggcaaac

SEQ ID NO: 3621438 - DNA, 16 bp, Homo sapiens
atccaaggcaaacaat

SEQ ID NO: 3621439 - DNA, 15 bp, Homo sapiens
atccacccagcaggc

SEQ ID NO: 3621440 - DNA, 16 bp, Homo sapiens
atccacccagcaggca

SEQ ID NO: 3621441 - DNA, 17 bp, Homo sapiens
atccacccccaggtgca

SEQ ID NO: 3621442 - DNA, 22 bp, Homo sapiens
atccacccccaggtgcagcccc

SEQ ID NO: 3621443 - DNA, 22 bp, Homo sapiens
atccacccgggggagcccagtg

SEQ ID NO: 3621444 - DNA, 12 bp, Homo sapiens
atccactttgca

SEQ ID NO: 3621445 - DNA, 22 bp, Homo sapiens
atccagaagttttaacttccag

SEQ ID NO: 3621446 - DNA, 14 bp, Homo sapiens
atccagccagaccc

SEQ ID NO: 3621447 - DNA, 19 bp, Homo sapiens
atccagcccaaacctggga

SEQ ID NO: 3621448 - DNA, 12 bp, Homo sapiens
atccagcctggg

SEQ ID NO: 3621449 - DNA, 19 bp, Homo sapiens
atccagcctggggctgagg

SEQ ID NO: 3621450 - DNA, 22 bp, Homo sapiens
atccaggactatatttgggcct

SEQ ID NO: 3621451 - DNA, 22 bp, Homo sapiens
atccaggcagatccaggactat

SEQ ID NO: 3621452 - DNA, 12 bp, Homo sapiens
atccagggacag

SEQ ID NO: 3621453 - DNA, 14 bp, Homo sapiens
atccagggcagcag

SEQ ID NO: 3621454 - DNA, 17 bp, Homo sapiens
atccagggcagcaggcc

SEQ ID NO: 3621455 - DNA, 15 bp, Homo sapiens
atccagtggtgggta

SEQ ID NO: 3621456 - DNA, 15 bp, Homo sapiens
atccagtgtgagata

SEQ ID NO: 3621457 - DNA, 16 bp, Homo sapiens
atccagttcatgagaa

SEQ ID NO: 3621458 - DNA, 10 bp, Homo sapiens
atccatcctg

SEQ ID NO: 3621459 - DNA, 15 bp, Homo sapiens
atccatcctgagcca

SEQ ID NO: 3621460 - DNA, 20 bp, Homo sapiens
atccatggggctgattgtat

SEQ ID NO: 3621461 - DNA, 22 bp, Homo sapiens
atccattcacaagcctcctgta

SEQ ID NO: 3621462 - DNA, 13 bp, Homo sapiens
atccatttcagga

SEQ ID NO: 3621463 - DNA, 14 bp, Homo sapiens
atccatttcaggac

SEQ ID NO: 3621464 - DNA, 15 bp, Homo sapiens
atcccaccccctcct

SEQ ID NO: 3621465 - DNA, 21 bp, Homo sapiens
atcccaccccctcctccccca

SEQ ID NO: 3621466 - DNA, 18 bp, Homo sapiens
atcccagaaaaagtaact

SEQ ID NO: 3621467 - DNA, 19 bp, Homo sapiens
atccccaccttcacctcgg

SEQ ID NO: 3621468 - DNA, 18 bp, Homo sapiens
atccccgcagtgtgcact

SEQ ID NO: 3621469 - DNA, 16 bp, Homo sapiens
atccccgtctctgccc

SEQ ID NO: 3621470 - DNA, 19 bp, Homo sapiens
atccccgtctctgccctgg

SEQ ID NO: 3621471 - DNA, 22 bp, Homo sapiens
atccccgtctctgccctgggct

SEQ ID NO: 3621472 - DNA, 21 bp, Homo sapiens
atcccctccctgcctgctcct

SEQ ID NO: 3621473 - DNA, 14 bp, Homo sapiens
atccctacatgtat

SEQ ID NO: 3621474 - DNA, 15 bp, Homo sapiens
atccctacatgtatt

SEQ ID NO: 3621475 - DNA, 14 bp, Homo sapiens
atccctcacctgta

SEQ ID NO: 3621476 - DNA, 19 bp, Homo sapiens
atccctcccccccatgcac

SEQ ID NO: 3621477 - DNA, 13 bp, Homo sapiens
atccctctcttcc

SEQ ID NO: 3621478 - DNA, 16 bp, Homo sapiens
atccctctcttcccct

SEQ ID NO: 3621479 - DNA, 18 bp, Homo sapiens
atccctctcttccccttc

SEQ ID NO: 3621480 - DNA, 19 bp, Homo sapiens
atccctctcttccccttcc

SEQ ID NO: 3621481 - DNA, 23 bp, Homo sapiens
atccctctcttccccttccctta

SEQ ID NO: 3621482 - DNA, 18 bp, Homo sapiens
atccctgactggccaaac

SEQ ID NO: 3621483 - DNA, 11 bp, Homo sapiens
atccctgcaga

SEQ ID NO: 3621484 - DNA, 15 bp, Homo sapiens
atccctgcctggagg

SEQ ID NO: 3621485 - DNA, 19 bp, Homo sapiens
atccctgcggcctccacac

SEQ ID NO: 3621486 - DNA, 17 bp, Homo sapiens
atccctgcttgcccgct

SEQ ID NO: 3621487 - DNA, 23 bp, Homo sapiens
atccctgcttgcccgctcccaca

SEQ ID NO: 3621488 - DNA, 22 bp, Homo sapiens
atcccttcctggaaacagcatg

SEQ ID NO: 3621489 - DNA, 22 bp, Homo sapiens
atccctttttcataaattattt

SEQ ID NO: 3621490 - DNA, 19 bp, Homo sapiens
atccctttttttacatttc

SEQ ID NO: 3621491 - DNA, 22 bp, Homo sapiens
atccgagtgtgatttgaattct

SEQ ID NO: 3621492 - DNA, 20 bp, Homo sapiens
atccgtgcctctttttaaag

SEQ ID NO: 3621493 - DNA, 13 bp, Homo sapiens
atcctaaagaaca

SEQ ID NO: 3621494 - DNA, 18 bp, Homo sapiens
atcctaaagaacaaagta

SEQ ID NO: 3621495 - DNA, 20 bp, Homo sapiens
atcctagactgctcctgggc

SEQ ID NO: 3621496 - DNA, 15 bp, Homo sapiens
atcctcatccctgac

SEQ ID NO: 3621497 - DNA, 16 bp, Homo sapiens
atcctccacagagagg

SEQ ID NO: 3621498 - DNA, 11 bp, Homo sapiens
atcctccaggt

SEQ ID NO: 3621499 - DNA, 14 bp, Homo sapiens
atcctccaggtttt

SEQ ID NO: 3621500 - DNA, 15 bp, Homo sapiens
atcctccaggttttt

SEQ ID NO: 3621501 - DNA, 21 bp, Homo sapiens
atcctccaggtttttcaatta

SEQ ID NO: 3621502 - DNA, 16 bp, Homo sapiens
atcctcttgagagaaa

SEQ ID NO: 3621503 - DNA, 14 bp, Homo sapiens
atcctgaaatttca

SEQ ID NO: 3621504 - DNA, 23 bp, Homo sapiens
atcctgacaagattataatattt

SEQ ID NO: 3621505 - DNA, 11 bp, Homo sapiens
atcctgagcca

SEQ ID NO: 3621506 - DNA, 18 bp, Homo sapiens
atcctgattcatatttaa

SEQ ID NO: 3621507 - DNA, 22 bp, Homo sapiens
atcctgcagatactttgaagtg

SEQ ID NO: 3621508 - DNA, 15 bp, Homo sapiens
atcctgcagggcttc

SEQ ID NO: 3621509 - DNA, 11 bp, Homo sapiens
atcctgctggg

SEQ ID NO: 3621510 - DNA, 23 bp, Homo sapiens
atcctgctggggccgccacggcc

SEQ ID NO: 3621511 - DNA, 14 bp, Homo sapiens
atcctgcttcagtg

SEQ ID NO: 3621512 - DNA, 15 bp, Homo sapiens
atcctggaggcccag

SEQ ID NO: 3621513 - DNA, 17 bp, Homo sapiens
atcctggaggcccagtt

SEQ ID NO: 3621514 - DNA, 20 bp, Homo sapiens
atcctggaggcccagttcac

SEQ ID NO: 3621515 - DNA, 12 bp, Homo sapiens
atcctggccaac

SEQ ID NO: 3621516 - DNA, 13 bp, Homo sapiens
atcctggccctgg

SEQ ID NO: 3621517 - DNA, 16 bp, Homo sapiens
atcctggccctggggg

SEQ ID NO: 3621518 - DNA, 16 bp, Homo sapiens
atccttacatttcacc

SEQ ID NO: 3621519 - DNA, 17 bp, Homo sapiens
atccttacatttcacct

SEQ ID NO: 3621520 - DNA, 21 bp, Homo sapiens
atccttataggcctgtccctt

SEQ ID NO: 3621521 - DNA, 20 bp, Homo sapiens
atccttcaaaataaaaagta

SEQ ID NO: 3621522 - DNA, 16 bp, Homo sapiens
atccttgattacttcc

SEQ ID NO: 3621523 - DNA, 21 bp, Homo sapiens
atccttttccttatttgcctt

SEQ ID NO: 3621524 - DNA, 20 bp, Homo sapiens
atcgaaatgacggtgttaat

SEQ ID NO: 3621525 - DNA, 17 bp, Homo sapiens
atcgagaccatcctggc

SEQ ID NO: 3621526 - DNA, 17 bp, Homo sapiens
atcgcactctggcagca

SEQ ID NO: 3621527 - DNA, 20 bp, Homo sapiens
atcgcactctggcagcaccg

SEQ ID NO: 3621528 - DNA, 20 bp, Homo sapiens
atcgctaaagggaccatctg

SEQ ID NO: 3621529 - DNA, 23 bp, Homo sapiens
atcgctaaagggaccatctgctg

SEQ ID NO: 3621530 - DNA, 15 bp, Homo sapiens
atcggcatttgtttc

SEQ ID NO: 3621531 - DNA, 14 bp, Homo sapiens
atcgttctctgcct

SEQ ID NO: 3621532 - DNA, 22 bp, Homo sapiens
atctaaaatttcataattctga

SEQ ID NO: 3621533 - DNA, 20 bp, Homo sapiens
atctaacgtgttccagtgtc

SEQ ID NO: 3621534 - DNA, 13 bp, Homo sapiens
atctaagtgatat

SEQ ID NO: 3621535 - DNA, 14 bp, Homo sapiens
atctaagtgatata

SEQ ID NO: 3621536 - DNA, 17 bp, Homo sapiens
atctaagtgatataaat

SEQ ID NO: 3621537 - DNA, 23 bp, Homo sapiens
atctaatctgaactgaccttgaa

SEQ ID NO: 3621538 - DNA, 14 bp, Homo sapiens
atctaattttacac

SEQ ID NO: 3621539 - DNA, 20 bp, Homo sapiens
atctaccccagactagatgt

SEQ ID NO: 3621540 - DNA, 14 bp, Homo sapiens
atctaccttttctg

SEQ ID NO: 3621541 - DNA, 13 bp, Homo sapiens
atctacttgcaca

SEQ ID NO: 3621542 - DNA, 21 bp, Homo sapiens
atctagaacacaggcaaaatc

SEQ ID NO: 3621543 - DNA, 18 bp, Homo sapiens
atctagcccaacctacat

SEQ ID NO: 3621544 - DNA, 17 bp, Homo sapiens
atctagttgtcaataaa

SEQ ID NO: 3621545 - DNA, 11 bp, Homo sapiens
atctataattt

SEQ ID NO: 3621546 - DNA, 16 bp, Homo sapiens
atctataatttaccta

SEQ ID NO: 3621547 - DNA, 23 bp, Homo sapiens
atctataatttacctaagattac

SEQ ID NO: 3621548 - DNA, 15 bp, Homo sapiens
atctatatttaacaa

SEQ ID NO: 3621549 - DNA, 17 bp, Homo sapiens
atctatttcacttattt

SEQ ID NO: 3621550 - DNA, 14 bp, Homo sapiens
atctcaaaacaaaa

SEQ ID NO: 3621551 - DNA, 15 bp, Homo sapiens
atctcaaaacaaaac

SEQ ID NO: 3621552 - DNA, 20 bp, Homo sapiens
atctcaaaactgcactgtca

SEQ ID NO: 3621553 - DNA, 17 bp, Homo sapiens
atctcaagtaaaacaaa

SEQ ID NO: 3621554 - DNA, 19 bp, Homo sapiens
atctcaagtaaaacaaatg

SEQ ID NO: 3621555 - DNA, 14 bp, Homo sapiens
atctcacaggctga

SEQ ID NO: 3621556 - DNA, 16 bp, Homo sapiens
atctcacaggctgaga

SEQ ID NO: 3621557 - DNA, 16 bp, Homo sapiens
atctcacttagtcctt

SEQ ID NO: 3621558 - DNA, 18 bp, Homo sapiens
atctcagggaactgaccc

SEQ ID NO: 3621559 - DNA, 18 bp, Homo sapiens
atctcatctgtctcggct

SEQ ID NO: 3621560 - DNA, 17 bp, Homo sapiens
atctcattgcttacaag

SEQ ID NO: 3621561 - DNA, 18 bp, Homo sapiens
atctccaagaccagagat

SEQ ID NO: 3621562 - DNA, 13 bp, Homo sapiens
atctcccacatgc

SEQ ID NO: 3621563 - DNA, 17 bp, Homo sapiens
atctccctcctccaggt

SEQ ID NO: 3621564 - DNA, 14 bp, Homo sapiens
atctccctggctca

SEQ ID NO: 3621565 - DNA, 21 bp, Homo sapiens
atctccctggctcactggcag

SEQ ID NO: 3621566 - DNA, 15 bp, Homo sapiens
atctccttgtggcct

SEQ ID NO: 3621567 - DNA, 17 bp, Homo sapiens
atctccttgtggcctat

SEQ ID NO: 3621568 - DNA, 18 bp, Homo sapiens
atctcctttgaagaaggc

SEQ ID NO: 3621569 - DNA, 17 bp, Homo sapiens
atctctataacagatcc

SEQ ID NO: 3621570 - DNA, 22 bp, Homo sapiens
atctctatcagaaatacaaaaa

SEQ ID NO: 3621571 - DNA, 17 bp, Homo sapiens
atctctcaaatctgtta

SEQ ID NO: 3621572 - DNA, 20 bp, Homo sapiens
atctctccccatatataaat

SEQ ID NO: 3621573 - DNA, 15 bp, Homo sapiens
atctctcttgtcctc

SEQ ID NO: 3621574 - DNA, 18 bp, Homo sapiens
atctctcttgtcctcttc

SEQ ID NO: 3621575 - DNA, 17 bp, Homo sapiens
atctctgttacaaaaga

SEQ ID NO: 3621576 - DNA, 12 bp, Homo sapiens
atctcttctgca

SEQ ID NO: 3621577 - DNA, 15 bp, Homo sapiens
atctcttctgcaagc

SEQ ID NO: 3621578 - DNA, 23 bp, Homo sapiens
atctcttctgcaagcctcatgcc

SEQ ID NO: 3621579 - DNA, 14 bp, Homo sapiens
atctcttctggtgt

SEQ ID NO: 3621580 - DNA, 16 bp, Homo sapiens
atctcttctggtgttg

SEQ ID NO: 3621581 - DNA, 14 bp, Homo sapiens
atctgaaaggccag

SEQ ID NO: 3621582 - DNA, 15 bp, Homo sapiens
atctgaaaggccagc

SEQ ID NO: 3621583 - DNA, 16 bp, Homo sapiens
atctgaaaggccagca

SEQ ID NO: 3621584 - DNA, 19 bp, Homo sapiens
atctgaatgaaaataactg

SEQ ID NO: 3621585 - DNA, 20 bp, Homo sapiens
atctgaatgaaaataactga

SEQ ID NO: 3621586 - DNA, 17 bp, Homo sapiens
atctgacatattatgcc

SEQ ID NO: 3621587 - DNA, 16 bp, Homo sapiens
atctgaccagcagcgc

SEQ ID NO: 3621588 - DNA, 20 bp, Homo sapiens
atctgaccagcagcgccttt

SEQ ID NO: 3621589 - DNA, 20 bp, Homo sapiens
atctgacccagtgcccccac

SEQ ID NO: 3621590 - DNA, 17 bp, Homo sapiens
atctgactgccaagcca

SEQ ID NO: 3621591 - DNA, 22 bp, Homo sapiens
atctgagcaggtacatttctga

SEQ ID NO: 3621592 - DNA, 18 bp, Homo sapiens
atctgcaccaccatgccc

SEQ ID NO: 3621593 - DNA, 17 bp, Homo sapiens
atctgcagtacagtctt

SEQ ID NO: 3621594 - DNA, 20 bp, Homo sapiens
atctgcgtgcacttcccaga

SEQ ID NO: 3621595 - DNA, 13 bp, Homo sapiens
atctgctcctccc

SEQ ID NO: 3621596 - DNA, 22 bp, Homo sapiens
atctgctgtcttttctttgcca

SEQ ID NO: 3621597 - DNA, 14 bp, Homo sapiens
atctggaacccaga

SEQ ID NO: 3621598 - DNA, 19 bp, Homo sapiens
atctggaacccagactcag

SEQ ID NO: 3621599 - DNA, 11 bp, Homo sapiens
atctggaacct

SEQ ID NO: 3621600 - DNA, 20 bp, Homo sapiens
atctggaacctcagcctggc

SEQ ID NO: 3621601 - DNA, 21 bp, Homo sapiens
atctggaacctcagcctggcc

SEQ ID NO: 3621602 - DNA, 17 bp, Homo sapiens
atctggactcctctgtc

SEQ ID NO: 3621603 - DNA, 19 bp, Homo sapiens
atctggagagcccagagtc

SEQ ID NO: 3621604 - DNA, 21 bp, Homo sapiens
atctggcggaggtctctggga

SEQ ID NO: 3621605 - DNA, 23 bp, Homo sapiens
atctggcggaggtctctgggagc

SEQ ID NO: 3621606 - DNA, 17 bp, Homo sapiens
atctggctgcacaggct

SEQ ID NO: 3621607 - DNA, 21 bp, Homo sapiens
atctggctggaaagcagagcc

SEQ ID NO: 3621608 - DNA, 18 bp, Homo sapiens
atctggcttccctggaag

SEQ ID NO: 3621609 - DNA, 19 bp, Homo sapiens
atctggcttccctggaagc

SEQ ID NO: 3621610 - DNA, 21 bp, Homo sapiens
atctgggcttatatgtacttt

SEQ ID NO: 3621611 - DNA, 16 bp, Homo sapiens
atctgggggagtggaa

SEQ ID NO: 3621612 - DNA, 17 bp, Homo sapiens
atctggttctatatgaa

SEQ ID NO: 3621613 - DNA, 18 bp, Homo sapiens
atctgtataccctctgtt

SEQ ID NO: 3621614 - DNA, 17 bp, Homo sapiens
atctgtcctcagccttg

SEQ ID NO: 3621615 - DNA, 21 bp, Homo sapiens
atctgtgaggggctctctcat

SEQ ID NO: 3621616 - DNA, 22 bp, Homo sapiens
atctgtgaggggctctctcatg

SEQ ID NO: 3621617 - DNA, 17 bp, Homo sapiens
atctgtgattggctggt

SEQ ID NO: 3621618 - DNA, 15 bp, Homo sapiens
atctgtgcaaacagt

SEQ ID NO: 3621619 - DNA, 16 bp, Homo sapiens
atctgtgctgtttcaa

SEQ ID NO: 3621620 - DNA, 13 bp, Homo sapiens
atctgtggagctg

SEQ ID NO: 3621621 - DNA, 17 bp, Homo sapiens
atctgtggagctgccac

SEQ ID NO: 3621622 - DNA, 21 bp, Homo sapiens
atctgtgtggctcctgggccg

SEQ ID NO: 3621623 - DNA, 24 bp, Homo sapiens
atctgtttaaagcatatagagatg

SEQ ID NO: 3621624 - DNA, 17 bp, Homo sapiens
atctgttttggatgttg

SEQ ID NO: 3621625 - DNA, 22 bp, Homo sapiens
atcttaaacataataaatcaca

SEQ ID NO: 3621626 - DNA, 18 bp, Homo sapiens
atcttaatccattaaaaa

SEQ ID NO: 3621627 - DNA, 20 bp, Homo sapiens
atcttaatgtatcaaactgt

SEQ ID NO: 3621628 - DNA, 17 bp, Homo sapiens
atcttaatgtctggtgt

SEQ ID NO: 3621629 - DNA, 18 bp, Homo sapiens
atcttaatgtctggtgtt

SEQ ID NO: 3621630 - DNA, 22 bp, Homo sapiens
atcttacaacaggcttatgaat

SEQ ID NO: 3621631 - DNA, 13 bp, Homo sapiens
atcttagtgtatg

SEQ ID NO: 3621632 - DNA, 14 bp, Homo sapiens
atcttagtgtatga

SEQ ID NO: 3621633 - DNA, 13 bp, Homo sapiens
atcttagtgttca

SEQ ID NO: 3621634 - DNA, 16 bp, Homo sapiens
atcttattgtttaatc

SEQ ID NO: 3621635 - DNA, 19 bp, Homo sapiens
atcttattgtttaatcttt

SEQ ID NO: 3621636 - DNA, 14 bp, Homo sapiens
atcttcactagaag

SEQ ID NO: 3621637 - DNA, 15 bp, Homo sapiens
atcttcactttctta

SEQ ID NO: 3621638 - DNA, 12 bp, Homo sapiens
atcttcatgtcc

SEQ ID NO: 3621639 - DNA, 15 bp, Homo sapiens
atcttccactggaac

SEQ ID NO: 3621640 - DNA, 14 bp, Homo sapiens
atcttcccacagga

SEQ ID NO: 3621641 - DNA, 17 bp, Homo sapiens
atcttctttataattct

SEQ ID NO: 3621642 - DNA, 21 bp, Homo sapiens
atcttgaatatgggcggaagt

SEQ ID NO: 3621643 - DNA, 22 bp, Homo sapiens
atcttgagccacagtcactgga

SEQ ID NO: 3621644 - DNA, 22 bp, Homo sapiens
atcttgagtataagaaatgcat

SEQ ID NO: 3621645 - DNA, 18 bp, Homo sapiens
atcttgcagcatttacta

SEQ ID NO: 3621646 - DNA, 23 bp, Homo sapiens
atcttgctaccagtatttagaag

SEQ ID NO: 3621647 - DNA, 15 bp, Homo sapiens
atcttgtaggtcatt

SEQ ID NO: 3621648 - DNA, 16 bp, Homo sapiens
atctttagatatttgc

SEQ ID NO: 3621649 - DNA, 12 bp, Homo sapiens
atctttagcagt

SEQ ID NO: 3621650 - DNA, 13 bp, Homo sapiens
atctttagcagtt

SEQ ID NO: 3621651 - DNA, 15 bp, Homo sapiens
atctttcacctttct

SEQ ID NO: 3621652 - DNA, 14 bp, Homo sapiens
atctttcatgtctt

SEQ ID NO: 3621653 - DNA, 18 bp, Homo sapiens
atctttctatataaaatg

SEQ ID NO: 3621654 - DNA, 22 bp, Homo sapiens
atctttctatataaaatgtatt

SEQ ID NO: 3621655 - DNA, 13 bp, Homo sapiens
atctttctgcaga

SEQ ID NO: 3621656 - DNA, 22 bp, Homo sapiens
atctttctttccaaaacatttc

SEQ ID NO: 3621657 - DNA, 16 bp, Homo sapiens
atctttgtggccaagg

SEQ ID NO: 3621658 - DNA, 16 bp, Homo sapiens
atctttgttacttcct

SEQ ID NO: 3621659 - DNA, 19 bp, Homo sapiens
atctttgttacttccttat

SEQ ID NO: 3621660 - DNA, 11 bp, Homo sapiens
atcttttgaac

SEQ ID NO: 3621661 - DNA, 23 bp, Homo sapiens
atctttttatcccatttagtgtg

SEQ ID NO: 3621662 - DNA, 13 bp, Homo sapiens
atctttttctaac

SEQ ID NO: 3621663 - DNA, 12 bp, Homo sapiens
atgaaaagttat

SEQ ID NO: 3621664 - DNA, 19 bp, Homo sapiens
atgaaaagttatttatgct

SEQ ID NO: 3621665 - DNA, 13 bp, Homo sapiens
atgaaacagaaac

SEQ ID NO: 3621666 - DNA, 22 bp, Homo sapiens
atgaaacagaaacaaaaacact

SEQ ID NO: 3621667 - DNA, 22 bp, Homo sapiens
atgaaacatcctatgaaatact

SEQ ID NO: 3621668 - DNA, 11 bp, Homo sapiens
atgaaactggt

SEQ ID NO: 3621669 - DNA, 22 bp, Homo sapiens
atgaaactggtttataataaac

SEQ ID NO: 3621670 - DNA, 19 bp, Homo sapiens
atgaaagcgacttcaggtc

SEQ ID NO: 3621671 - DNA, 16 bp, Homo sapiens
atgaaagtattaaaat

SEQ ID NO: 3621672 - DNA, 16 bp, Homo sapiens
atgaaataaaatatat

SEQ ID NO: 3621673 - DNA, 18 bp, Homo sapiens
atgaaatgcatatttgca

SEQ ID NO: 3621674 - DNA, 21 bp, Homo sapiens
atgaaatttaattacaaacaa

SEQ ID NO: 3621675 - DNA, 22 bp, Homo sapiens
atgaaatttaattacaaacaat

SEQ ID NO: 3621676 - DNA, 17 bp, Homo sapiens
atgaacatcatggactg

SEQ ID NO: 3621677 - DNA, 21 bp, Homo sapiens
atgaaccttctggcctcccac

SEQ ID NO: 3621678 - DNA, 24 bp, Homo sapiens
atgaaccttctggcctcccacaga

SEQ ID NO: 3621679 - DNA, 19 bp, Homo sapiens
atgaacgtggattgtattt

SEQ ID NO: 3621680 - DNA, 15 bp, Homo sapiens
atgaacttattaata

SEQ ID NO: 3621681 - DNA, 23 bp, Homo sapiens
atgaagaaggaagctgtgttgaa

SEQ ID NO: 3621682 - DNA, 22 bp, Homo sapiens
atgaagaatgcattcaaaatat

SEQ ID NO: 3621683 - DNA, 15 bp, Homo sapiens
atgaagacagaggca

SEQ ID NO: 3621684 - DNA, 14 bp, Homo sapiens
atgaagcagaacct

SEQ ID NO: 3621685 - DNA, 13 bp, Homo sapiens
atgaaggaattac

SEQ ID NO: 3621686 - DNA, 18 bp, Homo sapiens
atgaaggtcactcgtggt

SEQ ID NO: 3621687 - DNA, 17 bp, Homo sapiens
atgaataaaacactcat

SEQ ID NO: 3621688 - DNA, 17 bp, Homo sapiens
atgaatagtacatgcag

SEQ ID NO: 3621689 - DNA, 14 bp, Homo sapiens
atgaatcagaacag

SEQ ID NO: 3621690 - DNA, 13 bp, Homo sapiens
atgaatgctattt

SEQ ID NO: 3621691 - DNA, 23 bp, Homo sapiens
atgaatgggcatttctaaaatgt

SEQ ID NO: 3621692 - DNA, 23 bp, Homo sapiens
atgacaacctgtgtgagagaatt

SEQ ID NO: 3621693 - DNA, 15 bp, Homo sapiens
atgacacccatgcca

SEQ ID NO: 3621694 - DNA, 17 bp, Homo sapiens
atgacacccatgccaga

SEQ ID NO: 3621695 - DNA, 20 bp, Homo sapiens
atgacacccatgccagagag

SEQ ID NO: 3621696 - DNA, 17 bp, Homo sapiens
atgacaccctggcctga

SEQ ID NO: 3621697 - DNA, 21 bp, Homo sapiens
atgacagatatatttaagcct

SEQ ID NO: 3621698 - DNA, 22 bp, Homo sapiens
atgacagatatatttaagcctt

SEQ ID NO: 3621699 - DNA, 23 bp, Homo sapiens
atgacagatatatttaagcctta

SEQ ID NO: 3621700 - DNA, 16 bp, Homo sapiens
atgacagatattttat

SEQ ID NO: 3621701 - DNA, 14 bp, Homo sapiens
atgaccgagccctg

SEQ ID NO: 3621702 - DNA, 16 bp, Homo sapiens
atgaccgagccctgga

SEQ ID NO: 3621703 - DNA, 17 bp, Homo sapiens
atgaccgagccctggag

SEQ ID NO: 3621704 - DNA, 18 bp, Homo sapiens
atgaccgagccctggaga

SEQ ID NO: 3621705 - DNA, 13 bp, Homo sapiens
atgacctcaagga

SEQ ID NO: 3621706 - DNA, 11 bp, Homo sapiens
atgacctccag

SEQ ID NO: 3621707 - DNA, 12 bp, Homo sapiens
atgacctccaga

SEQ ID NO: 3621708 - DNA, 16 bp, Homo sapiens
atgacctccagaagtc

SEQ ID NO: 3621709 - DNA, 13 bp, Homo sapiens
atgacctgcccca

SEQ ID NO: 3621710 - DNA, 13 bp, Homo sapiens
atgaccttcccag

SEQ ID NO: 3621711 - DNA, 15 bp, Homo sapiens
atgaccttcccaggg

SEQ ID NO: 3621712 - DNA, 20 bp, Homo sapiens
atgacggtgttaattttgct

SEQ ID NO: 3621713 - DNA, 20 bp, Homo sapiens
atgacgtgctccgtagctct

SEQ ID NO: 3621714 - DNA, 18 bp, Homo sapiens
atgactgttgttcttata

SEQ ID NO: 3621715 - DNA, 17 bp, Homo sapiens
atgacttagtacaaagt

SEQ ID NO: 3621716 - DNA, 14 bp, Homo sapiens
atgacttatttctg

SEQ ID NO: 3621717 - DNA, 18 bp, Homo sapiens
atgacttatttctgctct

SEQ ID NO: 3621718 - DNA, 22 bp, Homo sapiens
atgacttatttctgctctggaa

SEQ ID NO: 3621719 - DNA, 13 bp, Homo sapiens
atgactttcctta

SEQ ID NO: 3621720 - DNA, 12 bp, Homo sapiens
atgagagaatgt

SEQ ID NO: 3621721 - DNA, 16 bp, Homo sapiens
atgagccccttcatcc

SEQ ID NO: 3621722 - DNA, 16 bp, Homo sapiens
atgagcctttgtgctt

SEQ ID NO: 3621723 - DNA, 18 bp, Homo sapiens
atgagcctttgtgctttt

SEQ ID NO: 3621724 - DNA, 23 bp, Homo sapiens
atgagcctttgtgctttttgtca

SEQ ID NO: 3621725 - DNA, 19 bp, Homo sapiens
atgagctggcaaccagcca

SEQ ID NO: 3621726 - DNA, 22 bp, Homo sapiens
atgaggatccagggcagcaggc

SEQ ID NO: 3621727 - DNA, 22 bp, Homo sapiens
atgaggccatctcaggagatgg

SEQ ID NO: 3621728 - DNA, 15 bp, Homo sapiens
atgagggaagcaata

SEQ ID NO: 3621729 - DNA, 14 bp, Homo sapiens
atgagtacaaatgc

SEQ ID NO: 3621730 - DNA, 16 bp, Homo sapiens
atgagtacaaatgcct

SEQ ID NO: 3621731 - DNA, 14 bp, Homo sapiens
atgagtcaaaacaa

SEQ ID NO: 3621732 - DNA, 15 bp, Homo sapiens
atgagtcaaaacaaa

SEQ ID NO: 3621733 - DNA, 16 bp, Homo sapiens
atgagtcatttgttta

SEQ ID NO: 3621734 - DNA, 16 bp, Homo sapiens
atgagtgaataaatgt

SEQ ID NO: 3621735 - DNA, 17 bp, Homo sapiens
atgagtgaataaatgtc

SEQ ID NO: 3621736 - DNA, 15 bp, Homo sapiens
atgagtggaaataca

SEQ ID NO: 3621737 - DNA, 15 bp, Homo sapiens
atgataataggtcat

SEQ ID NO: 3621738 - DNA, 16 bp, Homo sapiens
atgataataggtcata

SEQ ID NO: 3621739 - DNA, 15 bp, Homo sapiens
atgatactgtctctc

SEQ ID NO: 3621740 - DNA, 11 bp, Homo sapiens
atgatatgcat

SEQ ID NO: 3621741 - DNA, 23 bp, Homo sapiens
atgatatgcttgtaactaaaata

SEQ ID NO: 3621742 - DNA, 21 bp, Homo sapiens
atgatccccgtctctgccctg

SEQ ID NO: 3621743 - DNA, 14 bp, Homo sapiens
atgatctcttctgg

SEQ ID NO: 3621744 - DNA, 21 bp, Homo sapiens
atgatcttgagtataagaaat

SEQ ID NO: 3621745 - DNA, 14 bp, Homo sapiens
atgatgatgaaaac

SEQ ID NO: 3621746 - DNA, 17 bp, Homo sapiens
atgatgcacagtatctg

SEQ ID NO: 3621747 - DNA, 14 bp, Homo sapiens
atgatggatggcag

SEQ ID NO: 3621748 - DNA, 18 bp, Homo sapiens
atgatggcagagccaggc

SEQ ID NO: 3621749 - DNA, 17 bp, Homo sapiens
atgatgttagttttcct

SEQ ID NO: 3621750 - DNA, 19 bp, Homo sapiens
atgatgttagttttcctta

SEQ ID NO: 3621751 - DNA, 19 bp, Homo sapiens
atgattactggcctttttc

SEQ ID NO: 3621752 - DNA, 16 bp, Homo sapiens
atgattcaaatgtttt

SEQ ID NO: 3621753 - DNA, 13 bp, Homo sapiens
atgattctgaact

SEQ ID NO: 3621754 - DNA, 21 bp, Homo sapiens
atgattctgaacttttgtgga

SEQ ID NO: 3621755 - DNA, 22 bp, Homo sapiens
atgattctgatgtactctaaat

SEQ ID NO: 3621756 - DNA, 16 bp, Homo sapiens
atgattgaatctactt

SEQ ID NO: 3621757 - DNA, 22 bp, Homo sapiens
atgattttacaagtataacagt

SEQ ID NO: 3621758 - DNA, 14 bp, Homo sapiens
atgattttcctttt

SEQ ID NO: 3621759 - DNA, 11 bp, Homo sapiens
atgcaaataca

SEQ ID NO: 3621760 - DNA, 15 bp, Homo sapiens
atgcaaccatttgaa

SEQ ID NO: 3621761 - DNA, 20 bp, Homo sapiens
atgcaactctaactctgaga

SEQ ID NO: 3621762 - DNA, 21 bp, Homo sapiens
atgcaactctaactctgagag

SEQ ID NO: 3621763 - DNA, 22 bp, Homo sapiens
atgcaaggattacagaaactga

SEQ ID NO: 3621764 - DNA, 17 bp, Homo sapiens
atgcaatttcctttttt

SEQ ID NO: 3621765 - DNA, 19 bp, Homo sapiens
atgcacacatatataggca

SEQ ID NO: 3621766 - DNA, 16 bp, Homo sapiens
atgcacagtatctgct

SEQ ID NO: 3621767 - DNA, 17 bp, Homo sapiens
atgcacagtatctgctg

SEQ ID NO: 3621768 - DNA, 19 bp, Homo sapiens
atgcacagttgccacattt

SEQ ID NO: 3621769 - DNA, 19 bp, Homo sapiens
atgcacatgctgtctggcc

SEQ ID NO: 3621770 - DNA, 23 bp, Homo sapiens
atgcacatgctgtctggccctgg

SEQ ID NO: 3621771 - DNA, 20 bp, Homo sapiens
atgcaccctcatacacagaa

SEQ ID NO: 3621772 - DNA, 18 bp, Homo sapiens
atgcacgtggggcccact

SEQ ID NO: 3621773 - DNA, 19 bp, Homo sapiens
atgcacgtggggcccactg

SEQ ID NO: 3621774 - DNA, 13 bp, Homo sapiens
atgcactcacccc

SEQ ID NO: 3621775 - DNA, 23 bp, Homo sapiens
atgcactcacccctagccctggt

SEQ ID NO: 3621776 - DNA, 14 bp, Homo sapiens
atgcactcagctct

SEQ ID NO: 3621777 - DNA, 18 bp, Homo sapiens
atgcactgtgaaggaccc

SEQ ID NO: 3621778 - DNA, 20 bp, Homo sapiens
atgcactgtgaaggaccctt

SEQ ID NO: 3621779 - DNA, 19 bp, Homo sapiens
atgcagaaaacagggtctg

SEQ ID NO: 3621780 - DNA, 15 bp, Homo sapiens
atgcagctgtggcag

SEQ ID NO: 3621781 - DNA, 17 bp, Homo sapiens
atgcaggaaggaaaact

SEQ ID NO: 3621782 - DNA, 18 bp, Homo sapiens
atgcaggaaggaaaacta

SEQ ID NO: 3621783 - DNA, 17 bp, Homo sapiens
atgcaggtgtcctgagc

SEQ ID NO: 3621784 - DNA, 15 bp, Homo sapiens
atgcatataatgaat

SEQ ID NO: 3621785 - DNA, 18 bp, Homo sapiens
atgcatataatgaataaa

SEQ ID NO: 3621786 - DNA, 14 bp, Homo sapiens
atgcatatagacac

SEQ ID NO: 3621787 - DNA, 21 bp, Homo sapiens
atgcatatagacacacataca

SEQ ID NO: 3621788 - DNA, 18 bp, Homo sapiens
atgcatatgtcactagaa

SEQ ID NO: 3621789 - DNA, 17 bp, Homo sapiens
atgcatatttgcaaagt

SEQ ID NO: 3621790 - DNA, 17 bp, Homo sapiens
atgcatggtgccccagg

SEQ ID NO: 3621791 - DNA, 21 bp, Homo sapiens
atgcatggtgccccaggacca

SEQ ID NO: 3621792 - DNA, 23 bp, Homo sapiens
atgcattgcctgtaacaatgtaa

SEQ ID NO: 3621793 - DNA, 19 bp, Homo sapiens
atgccaaggggctgagtga

SEQ ID NO: 3621794 - DNA, 14 bp, Homo sapiens
atgccacctggcaa

SEQ ID NO: 3621795 - DNA, 21 bp, Homo sapiens
atgccacctggcaaaggaccc

SEQ ID NO: 3621796 - DNA, 12 bp, Homo sapiens
atgccacttcct

SEQ ID NO: 3621797 - DNA, 16 bp, Homo sapiens
atgccagcttctctct

SEQ ID NO: 3621798 - DNA, 16 bp, Homo sapiens
atgccagtaactgtgc

SEQ ID NO: 3621799 - DNA, 21 bp, Homo sapiens
atgcccagtaaaatttcagga

SEQ ID NO: 3621800 - DNA, 13 bp, Homo sapiens
atgccccaaactt

SEQ ID NO: 3621801 - DNA, 13 bp, Homo sapiens
atgccctcctctc

SEQ ID NO: 3621802 - DNA, 14 bp, Homo sapiens
atgccctggaggtg

SEQ ID NO: 3621803 - DNA, 15 bp, Homo sapiens
atgccctggaggtgg

SEQ ID NO: 3621804 - DNA, 14 bp, Homo sapiens
atgccctggatcca

SEQ ID NO: 3621805 - DNA, 18 bp, Homo sapiens
atgcctcctcaggagccg

SEQ ID NO: 3621806 - DNA, 16 bp, Homo sapiens
atgcctcgctcccttc

SEQ ID NO: 3621807 - DNA, 22 bp, Homo sapiens
atgcctctgccaaaggatgtga

SEQ ID NO: 3621808 - DNA, 22 bp, Homo sapiens
atgcctgaccaacaggcccagc

SEQ ID NO: 3621809 - DNA, 22 bp, Homo sapiens
atgcctgttaatttataatgta

SEQ ID NO: 3621810 - DNA, 16 bp, Homo sapiens
atgccttaaaatggaa

SEQ ID NO: 3621811 - DNA, 19 bp, Homo sapiens
atgccttaaaatggaattg

SEQ ID NO: 3621812 - DNA, 18 bp, Homo sapiens
atgccttacctaagagaa

SEQ ID NO: 3621813 - DNA, 16 bp, Homo sapiens
atgcgccaccatgccc

SEQ ID NO: 3621814 - DNA, 15 bp, Homo sapiens
atgcggatcctgctg

SEQ ID NO: 3621815 - DNA, 17 bp, Homo sapiens
atgcggatcctgctggg

SEQ ID NO: 3621816 - DNA, 19 bp, Homo sapiens
atgcggttaattttgaagt

SEQ ID NO: 3621817 - DNA, 18 bp, Homo sapiens
atgctactactgcagtct

SEQ ID NO: 3621818 - DNA, 15 bp, Homo sapiens
atgctagcaggctgt

SEQ ID NO: 3621819 - DNA, 13 bp, Homo sapiens
atgctagtgttgt

SEQ ID NO: 3621820 - DNA, 19 bp, Homo sapiens
atgctagtgttgtatttct

SEQ ID NO: 3621821 - DNA, 19 bp, Homo sapiens
atgctataaattttttgaa

SEQ ID NO: 3621822 - DNA, 20 bp, Homo sapiens
atgctataaattttttgaaa

SEQ ID NO: 3621823 - DNA, 21 bp, Homo sapiens
atgctcaacccccctcccaga

SEQ ID NO: 3621824 - DNA, 22 bp, Homo sapiens
atgctcaacccccctcccagac

SEQ ID NO: 3621825 - DNA, 21 bp, Homo sapiens
atgctgactgtactcctccca

SEQ ID NO: 3621826 - DNA, 23 bp, Homo sapiens
atgctgcaagttatgaaatattt

SEQ ID NO: 3621827 - DNA, 13 bp, Homo sapiens
atgctgcctggca

SEQ ID NO: 3621828 - DNA, 18 bp, Homo sapiens
atgctgccttttctttaa

SEQ ID NO: 3621829 - DNA, 20 bp, Homo sapiens
atgctgctcccctaaagcca

SEQ ID NO: 3621830 - DNA, 22 bp, Homo sapiens
atgctgctcccctaaagccagg

SEQ ID NO: 3621831 - DNA, 14 bp, Homo sapiens
atgctgctggggaa

SEQ ID NO: 3621832 - DNA, 18 bp, Homo sapiens
atgctgctggggaagaca

SEQ ID NO: 3621833 - DNA, 18 bp, Homo sapiens
atgctggcaaatccaggc

SEQ ID NO: 3621834 - DNA, 20 bp, Homo sapiens
atgctggcaaatccaggctg

SEQ ID NO: 3621835 - DNA, 12 bp, Homo sapiens
atgctggcccag

SEQ ID NO: 3621836 - DNA, 17 bp, Homo sapiens
atgctgggctgggccct

SEQ ID NO: 3621837 - DNA, 18 bp, Homo sapiens
atgctgggctgggccctc

SEQ ID NO: 3621838 - DNA, 23 bp, Homo sapiens
atgctggtgaaatgctgttggta

SEQ ID NO: 3621839 - DNA, 13 bp, Homo sapiens
atgctgtgcccct

SEQ ID NO: 3621840 - DNA, 17 bp, Homo sapiens
atgctgtgcccctggcc

SEQ ID NO: 3621841 - DNA, 20 bp, Homo sapiens
atgctgttagtaaatttctg

SEQ ID NO: 3621842 - DNA, 21 bp, Homo sapiens
atgctgttagtaaatttctgt

SEQ ID NO: 3621843 - DNA, 14 bp, Homo sapiens
atgctgtttcctag

SEQ ID NO: 3621844 - DNA, 16 bp, Homo sapiens
atgctgtttcctagct

SEQ ID NO: 3621845 - DNA, 22 bp, Homo sapiens
atgcttccactaccaaaagaca

SEQ ID NO: 3621846 - DNA, 24 bp, Homo sapiens
atgcttccactaccaaaagacatt

SEQ ID NO: 3621847 - DNA, 13 bp, Homo sapiens
atgcttgcatgga

SEQ ID NO: 3621848 - DNA, 19 bp, Homo sapiens
atgcttgcatggagaatgg

SEQ ID NO: 3621849 - DNA, 22 bp, Homo sapiens
atgcttgggctgacccagcatc

SEQ ID NO: 3621850 - DNA, 19 bp, Homo sapiens
atgcttttatattctaata

SEQ ID NO: 3621851 - DNA, 21 bp, Homo sapiens
atgcttttgctaataccaaaa

SEQ ID NO: 3621852 - DNA, 16 bp, Homo sapiens
atggaaaaatggttga

SEQ ID NO: 3621853 - DNA, 21 bp, Homo sapiens
atggaaaaatggttgatggaa

SEQ ID NO: 3621854 - DNA, 20 bp, Homo sapiens
atggaaacactgattttgta

SEQ ID NO: 3621855 - DNA, 20 bp, Homo sapiens
atggaaagaggtgaaaatga

SEQ ID NO: 3621856 - DNA, 15 bp, Homo sapiens
atggaacacagaact

SEQ ID NO: 3621857 - DNA, 14 bp, Homo sapiens
atggaacagtgtaa

SEQ ID NO: 3621858 - DNA, 16 bp, Homo sapiens
atggaacataaaatac

SEQ ID NO: 3621859 - DNA, 19 bp, Homo sapiens
atggaatatcatgaatgtg

SEQ ID NO: 3621860 - DNA, 21 bp, Homo sapiens
atggaatgatgggtcagttgt

SEQ ID NO: 3621861 - DNA, 20 bp, Homo sapiens
atggacatcttgtcattttt

SEQ ID NO: 3621862 - DNA, 14 bp, Homo sapiens
atggacatgatctt

SEQ ID NO: 3621863 - DNA, 13 bp, Homo sapiens
atggacatggtgg

SEQ ID NO: 3621864 - DNA, 20 bp, Homo sapiens
atggactaaatgatctctga

SEQ ID NO: 3621865 - DNA, 15 bp, Homo sapiens
atggagaaagaagtg

SEQ ID NO: 3621866 - DNA, 22 bp, Homo sapiens
atggagaaagaagtggagacag

SEQ ID NO: 3621867 - DNA, 12 bp, Homo sapiens
atggagaatggg

SEQ ID NO: 3621868 - DNA, 17 bp, Homo sapiens
atggagacaccctctgg

SEQ ID NO: 3621869 - DNA, 18 bp, Homo sapiens
atggagacaccctctggg

SEQ ID NO: 3621870 - DNA, 10 bp, Homo sapiens
atggagccta

SEQ ID NO: 3621871 - DNA, 20 bp, Homo sapiens
atggagcctacctctgtctg

SEQ ID NO: 3621872 - DNA, 14 bp, Homo sapiens
atggagctgggcta

SEQ ID NO: 3621873 - DNA, 16 bp, Homo sapiens
atggaggaaaaccaag

SEQ ID NO: 3621874 - DNA, 14 bp, Homo sapiens
atggagggcttggc

SEQ ID NO: 3621875 - DNA, 18 bp, Homo sapiens
atggagggcttggcccag

SEQ ID NO: 3621876 - DNA, 13 bp, Homo sapiens
atggagtagaggt

SEQ ID NO: 3621877 - DNA, 22 bp, Homo sapiens
atggagtagaggtactagaatg

SEQ ID NO: 3621878 - DNA, 20 bp, Homo sapiens
atggataaaataatgctgca

SEQ ID NO: 3621879 - DNA, 20 bp, Homo sapiens
atggattaaatttaattctt

SEQ ID NO: 3621880 - DNA, 17 bp, Homo sapiens
atggatttgttacagcc

SEQ ID NO: 3621881 - DNA, 16 bp, Homo sapiens
atggcaattttgtaac

SEQ ID NO: 3621882 - DNA, 13 bp, Homo sapiens
atggcagactctt

SEQ ID NO: 3621883 - DNA, 14 bp, Homo sapiens
atggcagctcctga

SEQ ID NO: 3621884 - DNA, 14 bp, Homo sapiens
atggcagtcctgga

SEQ ID NO: 3621885 - DNA, 15 bp, Homo sapiens
atggcagtcctggag

SEQ ID NO: 3621886 - DNA, 15 bp, Homo sapiens
atggcatggcaggag

SEQ ID NO: 3621887 - DNA, 14 bp, Homo sapiens
atggccacaaacct

SEQ ID NO: 3621888 - DNA, 17 bp, Homo sapiens
atggccacaaacctgcc

SEQ ID NO: 3621889 - DNA, 16 bp, Homo sapiens
atggccaggtggccac

SEQ ID NO: 3621890 - DNA, 17 bp, Homo sapiens
atggccatcttctttct

SEQ ID NO: 3621891 - DNA, 22 bp, Homo sapiens
atggcctcttactaatgtaaaa

SEQ ID NO: 3621892 - DNA, 17 bp, Homo sapiens
atggcctggagcaggcc

SEQ ID NO: 3621893 - DNA, 19 bp, Homo sapiens
atggcctggagcaggccca

SEQ ID NO: 3621894 - DNA, 20 bp, Homo sapiens
atggcctggagcaggcccaa

SEQ ID NO: 3621895 - DNA, 14 bp, Homo sapiens
atggctgcccagga

SEQ ID NO: 3621896 - DNA, 17 bp, Homo sapiens
atggctgcccaggagac

SEQ ID NO: 3621897 - DNA, 16 bp, Homo sapiens
atggctgtgcctctgc

SEQ ID NO: 3621898 - DNA, 15 bp, Homo sapiens
atgggacgaggacat

SEQ ID NO: 3621899 - DNA, 14 bp, Homo sapiens
atgggaggaagacg

SEQ ID NO: 3621900 - DNA, 17 bp, Homo sapiens
atgggaggaagacgatt

SEQ ID NO: 3621901 - DNA, 14 bp, Homo sapiens
atgggaggaattca

SEQ ID NO: 3621902 - DNA, 21 bp, Homo sapiens
atgggatggtcggatctcaca

SEQ ID NO: 3621903 - DNA, 15 bp, Homo sapiens
atgggctaggcctcc

SEQ ID NO: 3621904 - DNA, 21 bp, Homo sapiens
atgggctcgccgtgtctcagc

SEQ ID NO: 3621905 - DNA, 14 bp, Homo sapiens
atgggctcttcact

SEQ ID NO: 3621906 - DNA, 20 bp, Homo sapiens
atggggatagatgtgtggac

SEQ ID NO: 3621907 - DNA, 13 bp, Homo sapiens
atggggccagatc

SEQ ID NO: 3621908 - DNA, 14 bp, Homo sapiens
atggggccagatcc

SEQ ID NO: 3621909 - DNA, 13 bp, Homo sapiens
atggggccaggaa

SEQ ID NO: 3621910 - DNA, 15 bp, Homo sapiens
atggggccaggaaag

SEQ ID NO: 3621911 - DNA, 18 bp, Homo sapiens
atgggggaactcagatcc

SEQ ID NO: 3621912 - DNA, 21 bp, Homo sapiens
atgggggaactcagatccagg

SEQ ID NO: 3621913 - DNA, 22 bp, Homo sapiens
atgggggatttcaaacttaaac

SEQ ID NO: 3621914 - DNA, 23 bp, Homo sapiens
atgggggcaggaaagccacatct

SEQ ID NO: 3621915 - DNA, 19 bp, Homo sapiens
atgggtatttttataacaa

SEQ ID NO: 3621916 - DNA, 16 bp, Homo sapiens
atgggtggacacggat

SEQ ID NO: 3621917 - DNA, 18 bp, Homo sapiens
atggtactcccaaactga

SEQ ID NO: 3621918 - DNA, 21 bp, Homo sapiens
atggtactcccaaactgacaa

SEQ ID NO: 3621919 - DNA, 19 bp, Homo sapiens
atggtaggaccctcgagag

SEQ ID NO: 3621920 - DNA, 15 bp, Homo sapiens
atggtagttttacag

SEQ ID NO: 3621921 - DNA, 21 bp, Homo sapiens
atggtcacgtttggtgcttct

SEQ ID NO: 3621922 - DNA, 15 bp, Homo sapiens
atggtcggatctcac

SEQ ID NO: 3621923 - DNA, 20 bp, Homo sapiens
atggtcggatctcacaggct

SEQ ID NO: 3621924 - DNA, 16 bp, Homo sapiens
atggtgccccaggacc

SEQ ID NO: 3621925 - DNA, 17 bp, Homo sapiens
atggtgccccaggacca

SEQ ID NO: 3621926 - DNA, 19 bp, Homo sapiens
atggtgccccaggaccagc

SEQ ID NO: 3621927 - DNA, 22 bp, Homo sapiens
atggtgccccaggaccagctca

SEQ ID NO: 3621928 - DNA, 17 bp, Homo sapiens
atggtgctgcagatttg

SEQ ID NO: 3621929 - DNA, 19 bp, Homo sapiens
atggtggaaaacgaagctc

SEQ ID NO: 3621930 - DNA, 21 bp, Homo sapiens
atggtggcacacgcctgtagt

SEQ ID NO: 3621931 - DNA, 16 bp, Homo sapiens
atggtggccacagact

SEQ ID NO: 3621932 - DNA, 20 bp, Homo sapiens
atggtgtggggggctggggg

SEQ ID NO: 3621933 - DNA, 16 bp, Homo sapiens
atggttacatatcaaa

SEQ ID NO: 3621934 - DNA, 19 bp, Homo sapiens
atggttcaagtattaagca

SEQ ID NO: 3621935 - DNA, 20 bp, Homo sapiens
atggttcccctgttcactct

SEQ ID NO: 3621936 - DNA, 15 bp, Homo sapiens
atggttgagttacat

SEQ ID NO: 3621937 - DNA, 14 bp, Homo sapiens
atggttgatggaaa

SEQ ID NO: 3621938 - DNA, 22 bp, Homo sapiens
atggttgatggaaaataaacat

SEQ ID NO: 3621939 - DNA, 22 bp, Homo sapiens
atggtttgttgttctgcctgga

SEQ ID NO: 3621940 - DNA, 21 bp, Homo sapiens
atggttttcattcattggtga

SEQ ID NO: 3621941 - DNA, 19 bp, Homo sapiens
atggtttttcttttcttta

SEQ ID NO: 3621942 - DNA, 11 bp, Homo sapiens
atgtaaaaaag

SEQ ID NO: 3621943 - DNA, 13 bp, Homo sapiens
atgtaaaaaagaa

SEQ ID NO: 3621944 - DNA, 14 bp, Homo sapiens
atgtaaaaatgaag

SEQ ID NO: 3621945 - DNA, 20 bp, Homo sapiens
atgtaaactgtttctttaaa

SEQ ID NO: 3621946 - DNA, 14 bp, Homo sapiens
atgtaaagaaatgt

SEQ ID NO: 3621947 - DNA, 16 bp, Homo sapiens
atgtaaagaaatgtct

SEQ ID NO: 3621948 - DNA, 23 bp, Homo sapiens
atgtaaattttttacgtagctat

SEQ ID NO: 3621949 - DNA, 18 bp, Homo sapiens
atgtaacttcctgtggat

SEQ ID NO: 3621950 - DNA, 18 bp, Homo sapiens
atgtaacttttgtaagac

SEQ ID NO: 3621951 - DNA, 20 bp, Homo sapiens
atgtaagggaaactgccagc

SEQ ID NO: 3621952 - DNA, 21 bp, Homo sapiens
atgtaatgtttttatttcaat

SEQ ID NO: 3621953 - DNA, 24 bp, Homo sapiens
atgtaatgtttttatttcaattgt

SEQ ID NO: 3621954 - DNA, 17 bp, Homo sapiens
atgtacagtttattgat

SEQ ID NO: 3621955 - DNA, 20 bp, Homo sapiens
atgtacagtttattgatatt

SEQ ID NO: 3621956 - DNA, 20 bp, Homo sapiens
atgtacatttccaaatgaac

SEQ ID NO: 3621957 - DNA, 22 bp, Homo sapiens
atgtacttgtttgaatatttgt

SEQ ID NO: 3621958 - DNA, 20 bp, Homo sapiens
atgtagctgtcgtacattga

SEQ ID NO: 3621959 - DNA, 14 bp, Homo sapiens
atgtagtatctata

SEQ ID NO: 3621960 - DNA, 12 bp, Homo sapiens
atgtagtatttt

SEQ ID NO: 3621961 - DNA, 15 bp, Homo sapiens
atgtagttttgtata

SEQ ID NO: 3621962 - DNA, 19 bp, Homo sapiens
atgtatactatagtaccag

SEQ ID NO: 3621963 - DNA, 18 bp, Homo sapiens
atgtatataaactgggat

SEQ ID NO: 3621964 - DNA, 15 bp, Homo sapiens
atgtatataagtact

SEQ ID NO: 3621965 - DNA, 14 bp, Homo sapiens
atgtatatcttcta

SEQ ID NO: 3621966 - DNA, 14 bp, Homo sapiens
atgtatattaaaaa

SEQ ID NO: 3621967 - DNA, 16 bp, Homo sapiens
atgtatattaaaaaag

SEQ ID NO: 3621968 - DNA, 20 bp, Homo sapiens
atgtatattaaaaaagagac

SEQ ID NO: 3621969 - DNA, 21 bp, Homo sapiens
atgtatattaaaaaagagaca

SEQ ID NO: 3621970 - DNA, 14 bp, Homo sapiens
atgtatcaaactgt

SEQ ID NO: 3621971 - DNA, 20 bp, Homo sapiens
atgtatcagtgtcctttcca

SEQ ID NO: 3621972 - DNA, 16 bp, Homo sapiens
atgtatcatagaaatg

SEQ ID NO: 3621973 - DNA, 17 bp, Homo sapiens
atgtatcatagaaatgt

SEQ ID NO: 3621974 - DNA, 16 bp, Homo sapiens
atgtatgagtgtatgt

SEQ ID NO: 3621975 - DNA, 18 bp, Homo sapiens
atgtatgtgtgtctattt

SEQ ID NO: 3621976 - DNA, 17 bp, Homo sapiens
atgtattcctatgacaa

SEQ ID NO: 3621977 - DNA, 19 bp, Homo sapiens
atgtattcctatgacaaaa

SEQ ID NO: 3621978 - DNA, 22 bp, Homo sapiens
atgtattgcacattgtaaaaag

SEQ ID NO: 3621979 - DNA, 22 bp, Homo sapiens
atgtatttctccatcctgcaga

SEQ ID NO: 3621980 - DNA, 21 bp, Homo sapiens
atgtatttgaaaattacatgt

SEQ ID NO: 3621981 - DNA, 22 bp, Homo sapiens
atgtcaaggaagacttttggta

SEQ ID NO: 3621982 - DNA, 13 bp, Homo sapiens
atgtcagtatgtg

SEQ ID NO: 3621983 - DNA, 17 bp, Homo sapiens
atgtcagttgttattta

SEQ ID NO: 3621984 - DNA, 16 bp, Homo sapiens
atgtccaacccgtctg

SEQ ID NO: 3621985 - DNA, 20 bp, Homo sapiens
atgtcctatgtatatcttct

SEQ ID NO: 3621986 - DNA, 23 bp, Homo sapiens
atgtcctatgtatatcttctaca

SEQ ID NO: 3621987 - DNA, 20 bp, Homo sapiens
atgtcctgcctattatctgt

SEQ ID NO: 3621988 - DNA, 22 bp, Homo sapiens
atgtcctgcctattatctgtca

SEQ ID NO: 3621989 - DNA, 18 bp, Homo sapiens
atgtccttggactccatc

SEQ ID NO: 3621990 - DNA, 14 bp, Homo sapiens
atgtcgccaaaaat

SEQ ID NO: 3621991 - DNA, 23 bp, Homo sapiens
atgtctagaccaggacctccctc

SEQ ID NO: 3621992 - DNA, 13 bp, Homo sapiens
atgtctccagatt

SEQ ID NO: 3621993 - DNA, 22 bp, Homo sapiens
atgtctccagattggcacccct

SEQ ID NO: 3621994 - DNA, 16 bp, Homo sapiens
atgtctcttctaacat

SEQ ID NO: 3621995 - DNA, 14 bp, Homo sapiens
atgtctgcagctca

SEQ ID NO: 3621996 - DNA, 13 bp, Homo sapiens
atgtctgctgagt

SEQ ID NO: 3621997 - DNA, 15 bp, Homo sapiens
atgtctggtgtttgt

SEQ ID NO: 3621998 - DNA, 16 bp, Homo sapiens
atgtctggtgtttgtc

SEQ ID NO: 3621999 - DNA, 17 bp, Homo sapiens
atgtctggtgtttgtca

SEQ ID NO: 3622000 - DNA, 15 bp, Homo sapiens
atgtgaagaggtctg

SEQ ID NO: 3622001 - DNA, 21 bp, Homo sapiens
atgtgaagaggtctgattggc

SEQ ID NO: 3622002 - DNA, 14 bp, Homo sapiens
atgtgacatttata

SEQ ID NO: 3622003 - DNA, 19 bp, Homo sapiens
atgtgaccactctgtcttg

SEQ ID NO: 3622004 - DNA, 18 bp, Homo sapiens
atgtgagtcattatgtag

SEQ ID NO: 3622005 - DNA, 15 bp, Homo sapiens
atgtgagtctgggat

SEQ ID NO: 3622006 - DNA, 13 bp, Homo sapiens
atgtgatatataa

SEQ ID NO: 3622007 - DNA, 15 bp, Homo sapiens
atgtgatatataagt

SEQ ID NO: 3622008 - DNA, 19 bp, Homo sapiens
atgtgatatataagtgtac

SEQ ID NO: 3622009 - DNA, 22 bp, Homo sapiens
atgtgatatataagtgtacata

SEQ ID NO: 3622010 - DNA, 23 bp, Homo sapiens
atgtgatatataagtgtacatat

SEQ ID NO: 3622011 - DNA, 18 bp, Homo sapiens
atgtgcaaaggtgtgctt

SEQ ID NO: 3622012 - DNA, 16 bp, Homo sapiens
atgtgcactgcctgca

SEQ ID NO: 3622013 - DNA, 22 bp, Homo sapiens
atgtgcactgcctgcatgagct

SEQ ID NO: 3622014 - DNA, 17 bp, Homo sapiens
atgtgcagcatttcact

SEQ ID NO: 3622015 - DNA, 15 bp, Homo sapiens
atgtgcagtttggaa

SEQ ID NO: 3622016 - DNA, 10 bp, Homo sapiens
atgtgccttt

SEQ ID NO: 3622017 - DNA, 13 bp, Homo sapiens
atgtgcctttctt

SEQ ID NO: 3622018 - DNA, 16 bp, Homo sapiens
atgtggaactgtagga

SEQ ID NO: 3622019 - DNA, 15 bp, Homo sapiens
atgtggaagtgtggg

SEQ ID NO: 3622020 - DNA, 18 bp, Homo sapiens
atgtggcccctgaacaag

SEQ ID NO: 3622021 - DNA, 20 bp, Homo sapiens
atgtggcccctgaacaagaa

SEQ ID NO: 3622022 - DNA, 20 bp, Homo sapiens
atgtggcctttgaattctgt

SEQ ID NO: 3622023 - DNA, 13 bp, Homo sapiens
atgtggctgtatc

SEQ ID NO: 3622024 - DNA, 23 bp, Homo sapiens
atgtggggttgctgaagatgcct

SEQ ID NO: 3622025 - DNA, 20 bp, Homo sapiens
atgtgtacaatgtacacact

SEQ ID NO: 3622026 - DNA, 20 bp, Homo sapiens
atgtgtagagcccctactgt

SEQ ID NO: 3622027 - DNA, 16 bp, Homo sapiens
atgtgtctcccagaac

SEQ ID NO: 3622028 - DNA, 18 bp, Homo sapiens
atgtgtgtgtgtggcagg

SEQ ID NO: 3622029 - DNA, 21 bp, Homo sapiens
atgtgtgtgtgtgtgtgtaat

SEQ ID NO: 3622030 - DNA, 22 bp, Homo sapiens
atgtgtgtgtgttgtgtgtggg

SEQ ID NO: 3622031 - DNA, 20 bp, Homo sapiens
atgtgtttccttttcaggag

SEQ ID NO: 3622032 - DNA, 22 bp, Homo sapiens
atgtgtttccttttcaggagat

SEQ ID NO: 3622033 - DNA, 17 bp, Homo sapiens
atgtgttttcatcattt

SEQ ID NO: 3622034 - DNA, 22 bp, Homo sapiens
atgttaaagtttaagtgtgcag

SEQ ID NO: 3622035 - DNA, 23 bp, Homo sapiens
atgttaagcagctaaattttctg

SEQ ID NO: 3622036 - DNA, 13 bp, Homo sapiens
atgttaatatttc

SEQ ID NO: 3622037 - DNA, 18 bp, Homo sapiens
atgttaatattttatgtg

SEQ ID NO: 3622038 - DNA, 22 bp, Homo sapiens
atgttaattatgcagtgtttcc

SEQ ID NO: 3622039 - DNA, 17 bp, Homo sapiens
atgttacgtgaagaaat

SEQ ID NO: 3622040 - DNA, 14 bp, Homo sapiens
atgttagagtaatg

SEQ ID NO: 3622041 - DNA, 15 bp, Homo sapiens
atgttagcattaaag

SEQ ID NO: 3622042 - DNA, 18 bp, Homo sapiens
atgttagcattaaagttc

SEQ ID NO: 3622043 - DNA, 20 bp, Homo sapiens
atgttagcattaaagttcta

SEQ ID NO: 3622044 - DNA, 20 bp, Homo sapiens
atgttagttaccttatagtt

SEQ ID NO: 3622045 - DNA, 21 bp, Homo sapiens
atgttagttaccttatagtta

SEQ ID NO: 3622046 - DNA, 23 bp, Homo sapiens
atgttagttaccttatagttact

SEQ ID NO: 3622047 - DNA, 15 bp, Homo sapiens
atgttatgcagtgaa

SEQ ID NO: 3622048 - DNA, 16 bp, Homo sapiens
atgttatgcagtgaac

SEQ ID NO: 3622049 - DNA, 20 bp, Homo sapiens
atgttatgcagtgaactatt

SEQ ID NO: 3622050 - DNA, 11 bp, Homo sapiens
atgttccctct

SEQ ID NO: 3622051 - DNA, 12 bp, Homo sapiens
atgttcctcctt

SEQ ID NO: 3622052 - DNA, 12 bp, Homo sapiens
atgttctgcctc

SEQ ID NO: 3622053 - DNA, 21 bp, Homo sapiens
atgttctgcctctccctgggt

SEQ ID NO: 3622054 - DNA, 21 bp, Homo sapiens
atgttcttatgcaaaatggaa

SEQ ID NO: 3622055 - DNA, 11 bp, Homo sapiens
atgttctttca

SEQ ID NO: 3622056 - DNA, 19 bp, Homo sapiens
atgttctttcacccatcct

SEQ ID NO: 3622057 - DNA, 16 bp, Homo sapiens
atgttgaaaagtaatt

SEQ ID NO: 3622058 - DNA, 15 bp, Homo sapiens
atgttgctatagtga

SEQ ID NO: 3622059 - DNA, 21 bp, Homo sapiens
atgttggagcagcaggcctct

SEQ ID NO: 3622060 - DNA, 23 bp, Homo sapiens
atgttggagcagcaggcctctgg

SEQ ID NO: 3622061 - DNA, 12 bp, Homo sapiens
atgttggtcagg

SEQ ID NO: 3622062 - DNA, 16 bp, Homo sapiens
atgttgtaatgctgca

SEQ ID NO: 3622063 - DNA, 11 bp, Homo sapiens
atgttgtacaa

SEQ ID NO: 3622064 - DNA, 23 bp, Homo sapiens
atgttgtattgatttttaagaaa

SEQ ID NO: 3622065 - DNA, 14 bp, Homo sapiens
atgttgtcaaggat

SEQ ID NO: 3622066 - DNA, 23 bp, Homo sapiens
atgttgttctaaaggctgttaaa

SEQ ID NO: 3622067 - DNA, 17 bp, Homo sapiens
atgtttacagaggacag

SEQ ID NO: 3622068 - DNA, 19 bp, Homo sapiens
atgtttacagaggacagta

SEQ ID NO: 3622069 - DNA, 13 bp, Homo sapiens
atgtttatattgt

SEQ ID NO: 3622070 - DNA, 18 bp, Homo sapiens
atgtttccatcatttctg

SEQ ID NO: 3622071 - DNA, 14 bp, Homo sapiens
atgtttggaaaata

SEQ ID NO: 3622072 - DNA, 17 bp, Homo sapiens
atgttttagcatttgta

SEQ ID NO: 3622073 - DNA, 15 bp, Homo sapiens
atgttttcaaatgtt

SEQ ID NO: 3622074 - DNA, 18 bp, Homo sapiens
atgttttgggaaacactg

SEQ ID NO: 3622075 - DNA, 22 bp, Homo sapiens
atgtttttatttcaattgttta

SEQ ID NO: 3622076 - DNA, 20 bp, Homo sapiens
atgttttttcttcaaatgtt

SEQ ID NO: 3622077 - DNA, 16 bp, Homo sapiens
attaaacggattattt

SEQ ID NO: 3622078 - DNA, 22 bp, Homo sapiens
attaaacggattattttttcag

SEQ ID NO: 3622079 - DNA, 12 bp, Homo sapiens
attaaacttcag

SEQ ID NO: 3622080 - DNA, 16 bp, Homo sapiens
attaaacttcagcaac

SEQ ID NO: 3622081 - DNA, 17 bp, Homo sapiens
attaaagaaaattaatt

SEQ ID NO: 3622082 - DNA, 17 bp, Homo sapiens
attaaattctcaaagtt

SEQ ID NO: 3622083 - DNA, 18 bp, Homo sapiens
attaaatttaattcttca

SEQ ID NO: 3622084 - DNA, 14 bp, Homo sapiens
attaacatattatt

SEQ ID NO: 3622085 - DNA, 15 bp, Homo sapiens
attaaccttttcaaa

SEQ ID NO: 3622086 - DNA, 16 bp, Homo sapiens
attaaccttttcaaat

SEQ ID NO: 3622087 - DNA, 18 bp, Homo sapiens
attaaccttttcaaatta

SEQ ID NO: 3622088 - DNA, 16 bp, Homo sapiens
attaactaaagaagag

SEQ ID NO: 3622089 - DNA, 16 bp, Homo sapiens
attaactgtattttct

SEQ ID NO: 3622090 - DNA, 12 bp, Homo sapiens
attaagaaacct

SEQ ID NO: 3622091 - DNA, 12 bp, Homo sapiens
attaagcagttc

SEQ ID NO: 3622092 - DNA, 16 bp, Homo sapiens
attaagttattaacat

SEQ ID NO: 3622093 - DNA, 13 bp, Homo sapiens
attaatcaagaga

SEQ ID NO: 3622094 - DNA, 18 bp, Homo sapiens
attaatcaagagaaactt

SEQ ID NO: 3622095 - DNA, 20 bp, Homo sapiens
attaatcaagagaaacttca

SEQ ID NO: 3622096 - DNA, 14 bp, Homo sapiens
attaatcatacaaa

SEQ ID NO: 3622097 - DNA, 18 bp, Homo sapiens
attaatcatacaaactct

SEQ ID NO: 3622098 - DNA, 20 bp, Homo sapiens
attaatcttagtgtatgatt

SEQ ID NO: 3622099 - DNA, 21 bp, Homo sapiens
attaatcttagtgtatgatta

SEQ ID NO: 3622100 - DNA, 15 bp, Homo sapiens
attaatgacttactt

SEQ ID NO: 3622101 - DNA, 16 bp, Homo sapiens
attaattaaacattgt

SEQ ID NO: 3622102 - DNA, 20 bp, Homo sapiens
attaattatgtgtagttata

SEQ ID NO: 3622103 - DNA, 13 bp, Homo sapiens
attaattgctttg

SEQ ID NO: 3622104 - DNA, 21 bp, Homo sapiens
attaatttgaaaccaggacat

SEQ ID NO: 3622105 - DNA, 16 bp, Homo sapiens
attacaaaacctattt

SEQ ID NO: 3622106 - DNA, 23 bp, Homo sapiens
attacaaacaataagaacaagtt

SEQ ID NO: 3622107 - DNA, 21 bp, Homo sapiens
attacaaagaaccatgcagga

SEQ ID NO: 3622108 - DNA, 13 bp, Homo sapiens
attacaaagttaa

SEQ ID NO: 3622109 - DNA, 23 bp, Homo sapiens
attacaaagttaaaattgttatc

SEQ ID NO: 3622110 - DNA, 21 bp, Homo sapiens
attacaaatcagaagtcatct

SEQ ID NO: 3622111 - DNA, 22 bp, Homo sapiens
attacaaatcagaagtcatctt

SEQ ID NO: 3622112 - DNA, 23 bp, Homo sapiens
attacaacagtagagagggaaca

SEQ ID NO: 3622113 - DNA, 17 bp, Homo sapiens
attacaactctatttaa

SEQ ID NO: 3622114 - DNA, 13 bp, Homo sapiens
attacagaaactg

SEQ ID NO: 3622115 - DNA, 23 bp, Homo sapiens
attacagtctcactcagaactgt

SEQ ID NO: 3622116 - DNA, 20 bp, Homo sapiens
attacatgttttttcatttg

SEQ ID NO: 3622117 - DNA, 23 bp, Homo sapiens
attacatgttttttcatttgtaa

SEQ ID NO: 3622118 - DNA, 21 bp, Homo sapiens
attaccagggactatctttgc

SEQ ID NO: 3622119 - DNA, 21 bp, Homo sapiens
attaccagtggcgttgttgca

SEQ ID NO: 3622120 - DNA, 16 bp, Homo sapiens
attaccgtcacactct

SEQ ID NO: 3622121 - DNA, 15 bp, Homo sapiens
attaccttctttcta

SEQ ID NO: 3622122 - DNA, 15 bp, Homo sapiens
attactctattgata

SEQ ID NO: 3622123 - DNA, 17 bp, Homo sapiens
attactggcctttttca

SEQ ID NO: 3622124 - DNA, 22 bp, Homo sapiens
attactggcctttttcatttat

SEQ ID NO: 3622125 - DNA, 19 bp, Homo sapiens
attactgttccagattcct

SEQ ID NO: 3622126 - DNA, 13 bp, Homo sapiens
attacttatttaa

SEQ ID NO: 3622127 - DNA, 18 bp, Homo sapiens
attactttaaattatatg

SEQ ID NO: 3622128 - DNA, 23 bp, Homo sapiens
attactttaaattatatgatatg

SEQ ID NO: 3622129 - DNA, 14 bp, Homo sapiens
attactttatgaac

SEQ ID NO: 3622130 - DNA, 15 bp, Homo sapiens
attagagaaaacctt

SEQ ID NO: 3622131 - DNA, 16 bp, Homo sapiens
attagagaaaacctta

SEQ ID NO: 3622132 - DNA, 17 bp, Homo sapiens
attagagaaaaccttaa

SEQ ID NO: 3622133 - DNA, 20 bp, Homo sapiens
attagagaaaaccttaaaag

SEQ ID NO: 3622134 - DNA, 15 bp, Homo sapiens
attagcaaggcagag

SEQ ID NO: 3622135 - DNA, 16 bp, Homo sapiens
attagcaaggcagagc

SEQ ID NO: 3622136 - DNA, 17 bp, Homo sapiens
attagcagtttgctttg

SEQ ID NO: 3622137 - DNA, 22 bp, Homo sapiens
attagccaactgtttccctgct

SEQ ID NO: 3622138 - DNA, 23 bp, Homo sapiens
attagccaactgtttccctgctg

SEQ ID NO: 3622139 - DNA, 21 bp, Homo sapiens
attagtcgttatatttgactt

SEQ ID NO: 3622140 - DNA, 13 bp, Homo sapiens
attagttgacagt

SEQ ID NO: 3622141 - DNA, 18 bp, Homo sapiens
attataaaggataaagaa

SEQ ID NO: 3622142 - DNA, 22 bp, Homo sapiens
attataaaggataaagaaggat

SEQ ID NO: 3622143 - DNA, 16 bp, Homo sapiens
attataaattctacta

SEQ ID NO: 3622144 - DNA, 12 bp, Homo sapiens
attataactatt

SEQ ID NO: 3622145 - DNA, 20 bp, Homo sapiens
attataagttctattttact

SEQ ID NO: 3622146 - DNA, 17 bp, Homo sapiens
attatatgcctgattca

SEQ ID NO: 3622147 - DNA, 20 bp, Homo sapiens
attatctcaagtaaaacaaa

SEQ ID NO: 3622148 - DNA, 23 bp, Homo sapiens
attatctcaagtaaaacaaatga

SEQ ID NO: 3622149 - DNA, 24 bp, Homo sapiens
attatctcaagtaaaacaaatgaa

SEQ ID NO: 3622150 - DNA, 18 bp, Homo sapiens
attatctcctttgaagaa

SEQ ID NO: 3622151 - DNA, 17 bp, Homo sapiens
attatcttatcatttat

SEQ ID NO: 3622152 - DNA, 17 bp, Homo sapiens
attatgcctgaatgact

SEQ ID NO: 3622153 - DNA, 20 bp, Homo sapiens
attatgtgacattttacatt

SEQ ID NO: 3622154 - DNA, 14 bp, Homo sapiens
attatgttaatatt

SEQ ID NO: 3622155 - DNA, 16 bp, Homo sapiens
attatgttaatatttc

SEQ ID NO: 3622156 - DNA, 19 bp, Homo sapiens
attatgttcttagcaataa

SEQ ID NO: 3622157 - DNA, 19 bp, Homo sapiens
attattaagtaacttattt

SEQ ID NO: 3622158 - DNA, 20 bp, Homo sapiens
attattacttatttttgaca

SEQ ID NO: 3622159 - DNA, 17 bp, Homo sapiens
attattactttaaatta

SEQ ID NO: 3622160 - DNA, 14 bp, Homo sapiens
attattatgttctt

SEQ ID NO: 3622161 - DNA, 17 bp, Homo sapiens
attattattttaaaaat

SEQ ID NO: 3622162 - DNA, 14 bp, Homo sapiens
attattctctttta

SEQ ID NO: 3622163 - DNA, 14 bp, Homo sapiens
attatttaactaat

SEQ ID NO: 3622164 - DNA, 19 bp, Homo sapiens
attatttaagactaaaagt

SEQ ID NO: 3622165 - DNA, 20 bp, Homo sapiens
attatttatttctggtaact

SEQ ID NO: 3622166 - DNA, 21 bp, Homo sapiens
attatttctccatcccctccc

SEQ ID NO: 3622167 - DNA, 22 bp, Homo sapiens
attatttctccatcccctccct

SEQ ID NO: 3622168 - DNA, 15 bp, Homo sapiens
attatttgattattt

SEQ ID NO: 3622169 - DNA, 19 bp, Homo sapiens
attatttgattatttaaga

SEQ ID NO: 3622170 - DNA, 22 bp, Homo sapiens
attatttgattatttaagacta

SEQ ID NO: 3622171 - DNA, 13 bp, Homo sapiens
attattttttaat

SEQ ID NO: 3622172 - DNA, 16 bp, Homo sapiens
attattttttcagacc

SEQ ID NO: 3622173 - DNA, 17 bp, Homo sapiens
attattttttcagaccg

SEQ ID NO: 3622174 - DNA, 19 bp, Homo sapiens
attattttttcagaccgaa

SEQ ID NO: 3622175 - DNA, 22 bp, Homo sapiens
attattttttttatatttattg

SEQ ID NO: 3622176 - DNA, 21 bp, Homo sapiens
attcaaaaagacagcagacaa

SEQ ID NO: 3622177 - DNA, 16 bp, Homo sapiens
attcaaaaattatcta

SEQ ID NO: 3622178 - DNA, 17 bp, Homo sapiens
attcaagacaagagctg

SEQ ID NO: 3622179 - DNA, 18 bp, Homo sapiens
attcaagacaagagctgt

SEQ ID NO: 3622180 - DNA, 19 bp, Homo sapiens
attcaagacaagagctgtt

SEQ ID NO: 3622181 - DNA, 22 bp, Homo sapiens
attcaagcaaacatcaaataaa

SEQ ID NO: 3622182 - DNA, 19 bp, Homo sapiens
attcaaggaatttcttaac

SEQ ID NO: 3622183 - DNA, 15 bp, Homo sapiens
attcacaagcctcct

SEQ ID NO: 3622184 - DNA, 21 bp, Homo sapiens
attcacaagcctcctgtacct

SEQ ID NO: 3622185 - DNA, 20 bp, Homo sapiens
attcacagtgctcttttctc

SEQ ID NO: 3622186 - DNA, 21 bp, Homo sapiens
attcacagtgctcttttctcc

SEQ ID NO: 3622187 - DNA, 15 bp, Homo sapiens
attcaccagtgttcc

SEQ ID NO: 3622188 - DNA, 21 bp, Homo sapiens
attcacccccctctgctgccg

SEQ ID NO: 3622189 - DNA, 13 bp, Homo sapiens
attcacctgtgga

SEQ ID NO: 3622190 - DNA, 15 bp, Homo sapiens
attcacctgtggatg

SEQ ID NO: 3622191 - DNA, 23 bp, Homo sapiens
attcacgtgctttgtgttcagtt

SEQ ID NO: 3622192 - DNA, 12 bp, Homo sapiens
attcagagaaat

SEQ ID NO: 3622193 - DNA, 14 bp, Homo sapiens
attcaggccagccc

SEQ ID NO: 3622194 - DNA, 15 bp, Homo sapiens
attcaggccagccca

SEQ ID NO: 3622195 - DNA, 18 bp, Homo sapiens
attcaggccagcccagcc

SEQ ID NO: 3622196 - DNA, 21 bp, Homo sapiens
attcaggccagcccagccagg

SEQ ID NO: 3622197 - DNA, 21 bp, Homo sapiens
attcaggtctgtatgtcatgg

SEQ ID NO: 3622198 - DNA, 16 bp, Homo sapiens
attcaggttttttagt

SEQ ID NO: 3622199 - DNA, 15 bp, Homo sapiens
attcagtaagttctg

SEQ ID NO: 3622200 - DNA, 13 bp, Homo sapiens
attcagttctagg

SEQ ID NO: 3622201 - DNA, 19 bp, Homo sapiens
attcagttctaggcctttc

SEQ ID NO: 3622202 - DNA, 21 bp, Homo sapiens
attcagttctaggcctttcct

SEQ ID NO: 3622203 - DNA, 14 bp, Homo sapiens
attcatatttactt

SEQ ID NO: 3622204 - DNA, 19 bp, Homo sapiens
attcatatttacttcttat

SEQ ID NO: 3622205 - DNA, 12 bp, Homo sapiens
attcatggttca

SEQ ID NO: 3622206 - DNA, 15 bp, Homo sapiens
attcatggttcaagt

SEQ ID NO: 3622207 - DNA, 16 bp, Homo sapiens
attcattctttttgaa

SEQ ID NO: 3622208 - DNA, 21 bp, Homo sapiens
attcattctttttgaaatgtc

SEQ ID NO: 3622209 - DNA, 13 bp, Homo sapiens
attcatttcactg

SEQ ID NO: 3622210 - DNA, 19 bp, Homo sapiens
attcatttcactgtagctc

SEQ ID NO: 3622211 - DNA, 21 bp, Homo sapiens
attccaaagctttattaccag

SEQ ID NO: 3622212 - DNA, 23 bp, Homo sapiens
attccaactgggcatttcaatcc

SEQ ID NO: 3622213 - DNA, 21 bp, Homo sapiens
attccaaggctttaaagctga

SEQ ID NO: 3622214 - DNA, 13 bp, Homo sapiens
attccactgaaaa

SEQ ID NO: 3622215 - DNA, 18 bp, Homo sapiens
attcccaaatcctagact

SEQ ID NO: 3622216 - DNA, 19 bp, Homo sapiens
attcccagagcaaaataat

SEQ ID NO: 3622217 - DNA, 17 bp, Homo sapiens
attccccagtgactcca

SEQ ID NO: 3622218 - DNA, 21 bp, Homo sapiens
attccccccattttgcctctg

SEQ ID NO: 3622219 - DNA, 18 bp, Homo sapiens
attcccgttttgtcactt

SEQ ID NO: 3622220 - DNA, 21 bp, Homo sapiens
attcccgttttgtcacttttt

SEQ ID NO: 3622221 - DNA, 12 bp, Homo sapiens
attccctccccc

SEQ ID NO: 3622222 - DNA, 22 bp, Homo sapiens
attccctccccctccttgtgcc

SEQ ID NO: 3622223 - DNA, 24 bp, Homo sapiens
attcctatgatggatggcagactc

SEQ ID NO: 3622224 - DNA, 15 bp, Homo sapiens
attcctccagcctcc

SEQ ID NO: 3622225 - DNA, 18 bp, Homo sapiens
attcctccagcctcccct

SEQ ID NO: 3622226 - DNA, 14 bp, Homo sapiens
attcctccagctgg

SEQ ID NO: 3622227 - DNA, 13 bp, Homo sapiens
attcctctttgct

SEQ ID NO: 3622228 - DNA, 16 bp, Homo sapiens
attcctctttgctttg

SEQ ID NO: 3622229 - DNA, 17 bp, Homo sapiens
attcctctttgctttgc

SEQ ID NO: 3622230 - DNA, 17 bp, Homo sapiens
attcctgagctggcctg

SEQ ID NO: 3622231 - DNA, 20 bp, Homo sapiens
attcctgcctttaagccaaa

SEQ ID NO: 3622232 - DNA, 21 bp, Homo sapiens
attcctgcctttaagccaaag

SEQ ID NO: 3622233 - DNA, 22 bp, Homo sapiens
attcctggtttaattcagcaga

SEQ ID NO: 3622234 - DNA, 16 bp, Homo sapiens
attcctttacaactaa

SEQ ID NO: 3622235 - DNA, 22 bp, Homo sapiens
attcctttacaactaaataaca

SEQ ID NO: 3622236 - DNA, 18 bp, Homo sapiens
attcctttttcttcactt

SEQ ID NO: 3622237 - DNA, 21 bp, Homo sapiens
attcgctactatgatttaatt

SEQ ID NO: 3622238 - DNA, 22 bp, Homo sapiens
attcggggctgacctttcaaac

SEQ ID NO: 3622239 - DNA, 14 bp, Homo sapiens
attcgtgagctggg

SEQ ID NO: 3622240 - DNA, 16 bp, Homo sapiens
attctaaattacaaag

SEQ ID NO: 3622241 - DNA, 14 bp, Homo sapiens
attctaccaagctg

SEQ ID NO: 3622242 - DNA, 15 bp, Homo sapiens
attctaccaagctgt

SEQ ID NO: 3622243 - DNA, 19 bp, Homo sapiens
attctaccaagctgtcaca

SEQ ID NO: 3622244 - DNA, 14 bp, Homo sapiens
attctactaagtta

SEQ ID NO: 3622245 - DNA, 15 bp, Homo sapiens
attctactaagttat

SEQ ID NO: 3622246 - DNA, 16 bp, Homo sapiens
attctactaagttatt

SEQ ID NO: 3622247 - DNA, 23 bp, Homo sapiens
attctactaagttattttatgac

SEQ ID NO: 3622248 - DNA, 13 bp, Homo sapiens
attctactttgag

SEQ ID NO: 3622249 - DNA, 16 bp, Homo sapiens
attctactttgagtgc

SEQ ID NO: 3622250 - DNA, 15 bp, Homo sapiens
attctagtgtccata

SEQ ID NO: 3622251 - DNA, 23 bp, Homo sapiens
attctagtgtccataaataaagt

SEQ ID NO: 3622252 - DNA, 16 bp, Homo sapiens
attctattctccagac

SEQ ID NO: 3622253 - DNA, 17 bp, Homo sapiens
attctattctccagaca

SEQ ID NO: 3622254 - DNA, 13 bp, Homo sapiens
attctattttaca

SEQ ID NO: 3622255 - DNA, 11 bp, Homo sapiens
attctcagggc

SEQ ID NO: 3622256 - DNA, 13 bp, Homo sapiens
attctcagggctg

SEQ ID NO: 3622257 - DNA, 14 bp, Homo sapiens
attctcagggctgg

SEQ ID NO: 3622258 - DNA, 18 bp, Homo sapiens
attctcagggctggagcc

SEQ ID NO: 3622259 - DNA, 22 bp, Homo sapiens
attctcagggctggagcctggg

SEQ ID NO: 3622260 - DNA, 11 bp, Homo sapiens
attctccagac

SEQ ID NO: 3622261 - DNA, 12 bp, Homo sapiens
attctccagaca

SEQ ID NO: 3622262 - DNA, 16 bp, Homo sapiens
attctccagacatgga

SEQ ID NO: 3622263 - DNA, 16 bp, Homo sapiens
attctcccagctctag

SEQ ID NO: 3622264 - DNA, 20 bp, Homo sapiens
attctcccagctctagcctc

SEQ ID NO: 3622265 - DNA, 14 bp, Homo sapiens
attctcccctccct

SEQ ID NO: 3622266 - DNA, 12 bp, Homo sapiens
attctcttatcc

SEQ ID NO: 3622267 - DNA, 15 bp, Homo sapiens
attctcttatccaac

SEQ ID NO: 3622268 - DNA, 14 bp, Homo sapiens
attctcttgaataa

SEQ ID NO: 3622269 - DNA, 17 bp, Homo sapiens
attctgaaaaagacata

SEQ ID NO: 3622270 - DNA, 18 bp, Homo sapiens
attctgaaaaagacataa

SEQ ID NO: 3622271 - DNA, 22 bp, Homo sapiens
attctgaaaaagacataaaaca

SEQ ID NO: 3622272 - DNA, 17 bp, Homo sapiens
attctgaaccctccaaa

SEQ ID NO: 3622273 - DNA, 20 bp, Homo sapiens
attctgaaccctccaaagga

SEQ ID NO: 3622274 - DNA, 16 bp, Homo sapiens
attctgatgtactcta

SEQ ID NO: 3622275 - DNA, 18 bp, Homo sapiens
attctgatgtactctaaa

SEQ ID NO: 3622276 - DNA, 23 bp, Homo sapiens
attctgatgtactctaaatactg

SEQ ID NO: 3622277 - DNA, 14 bp, Homo sapiens
attctgattgctat

SEQ ID NO: 3622278 - DNA, 15 bp, Homo sapiens
attctgggaagggag

SEQ ID NO: 3622279 - DNA, 23 bp, Homo sapiens
attctgggggcccgacaggtggg

SEQ ID NO: 3622280 - DNA, 19 bp, Homo sapiens
attctgttttcccccagca

SEQ ID NO: 3622281 - DNA, 13 bp, Homo sapiens
attcttactaaaa

SEQ ID NO: 3622282 - DNA, 17 bp, Homo sapiens
attcttactaaaaagta

SEQ ID NO: 3622283 - DNA, 20 bp, Homo sapiens
attcttcagcgtaaaatggt

SEQ ID NO: 3622284 - DNA, 12 bp, Homo sapiens
attcttcctagt

SEQ ID NO: 3622285 - DNA, 12 bp, Homo sapiens
attcttcctttg

SEQ ID NO: 3622286 - DNA, 13 bp, Homo sapiens
attcttctgcaac

SEQ ID NO: 3622287 - DNA, 11 bp, Homo sapiens
attcttcttaa

SEQ ID NO: 3622288 - DNA, 21 bp, Homo sapiens
attcttgttgctgtacaaaag

SEQ ID NO: 3622289 - DNA, 17 bp, Homo sapiens
attctttactgcactca

SEQ ID NO: 3622290 - DNA, 19 bp, Homo sapiens
attctttagcttacctggg

SEQ ID NO: 3622291 - DNA, 20 bp, Homo sapiens
attctttagcttacctgggc

SEQ ID NO: 3622292 - DNA, 20 bp, Homo sapiens
attgaaagaatgtaaagcaa

SEQ ID NO: 3622293 - DNA, 20 bp, Homo sapiens
attgaaatgatttcacagtg

SEQ ID NO: 3622294 - DNA, 22 bp, Homo sapiens
attgaacttccaggaaagtgtg

SEQ ID NO: 3622295 - DNA, 12 bp, Homo sapiens
attgaaggaatt

SEQ ID NO: 3622296 - DNA, 13 bp, Homo sapiens
attgaattggaaa

SEQ ID NO: 3622297 - DNA, 18 bp, Homo sapiens
attgacacagtaccattt

SEQ ID NO: 3622298 - DNA, 15 bp, Homo sapiens
attgacagcaattca

SEQ ID NO: 3622299 - DNA, 19 bp, Homo sapiens
attgacagctttgctgctg

SEQ ID NO: 3622300 - DNA, 21 bp, Homo sapiens
attgaccctagccagagaata

SEQ ID NO: 3622301 - DNA, 14 bp, Homo sapiens
attgacttgtatat

SEQ ID NO: 3622302 - DNA, 20 bp, Homo sapiens
attgagcaaataaacttaca

SEQ ID NO: 3622303 - DNA, 23 bp, Homo sapiens
attgagcaaataaacttacagat

SEQ ID NO: 3622304 - DNA, 22 bp, Homo sapiens
attgagttattaactgtatttt

SEQ ID NO: 3622305 - DNA, 14 bp, Homo sapiens
attgatacaatatt

SEQ ID NO: 3622306 - DNA, 15 bp, Homo sapiens
attgatactctttct

SEQ ID NO: 3622307 - DNA, 13 bp, Homo sapiens
attgatctgtttt

SEQ ID NO: 3622308 - DNA, 14 bp, Homo sapiens
attgatctgttttg

SEQ ID NO: 3622309 - DNA, 16 bp, Homo sapiens
attgatgttttcatag

SEQ ID NO: 3622310 - DNA, 18 bp, Homo sapiens
attgatttttaagaaagt

SEQ ID NO: 3622311 - DNA, 19 bp, Homo sapiens
attgcacctatctcagcca

SEQ ID NO: 3622312 - DNA, 14 bp, Homo sapiens
attgcactgaagtt

SEQ ID NO: 3622313 - DNA, 17 bp, Homo sapiens
attgcactgaagttttt

SEQ ID NO: 3622314 - DNA, 19 bp, Homo sapiens
attgcactgaagtttttga

SEQ ID NO: 3622315 - DNA, 20 bp, Homo sapiens
attgcagataactttgactt

SEQ ID NO: 3622316 - DNA, 15 bp, Homo sapiens
attgcagcctaagaa

SEQ ID NO: 3622317 - DNA, 19 bp, Homo sapiens
attgcagcctaagaagaag

SEQ ID NO: 3622318 - DNA, 17 bp, Homo sapiens
attgcagtttacagtat

SEQ ID NO: 3622319 - DNA, 18 bp, Homo sapiens
attgcagtttacagtatt

SEQ ID NO: 3622320 - DNA, 16 bp, Homo sapiens
attgccaaaacccagc

SEQ ID NO: 3622321 - DNA, 20 bp, Homo sapiens
attgccaaaacccagctgca

SEQ ID NO: 3622322 - DNA, 12 bp, Homo sapiens
attgccccctct

SEQ ID NO: 3622323 - DNA, 16 bp, Homo sapiens
attgcccctggctttg

SEQ ID NO: 3622324 - DNA, 22 bp, Homo sapiens
attgcccctggctttgcctctt

SEQ ID NO: 3622325 - DNA, 21 bp, Homo sapiens
attgccctaattaaaaactgt

SEQ ID NO: 3622326 - DNA, 20 bp, Homo sapiens
attgcctgtaacaatgtaat

SEQ ID NO: 3622327 - DNA, 17 bp, Homo sapiens
attgcgccattgcactc

SEQ ID NO: 3622328 - DNA, 16 bp, Homo sapiens
attgcgcctaatgtgt

SEQ ID NO: 3622329 - DNA, 18 bp, Homo sapiens
attgcgcctaatgtgttt

SEQ ID NO: 3622330 - DNA, 16 bp, Homo sapiens
attgctaatttagaga

SEQ ID NO: 3622331 - DNA, 19 bp, Homo sapiens
attgctacaacatcactaa

SEQ ID NO: 3622332 - DNA, 15 bp, Homo sapiens
attgctatcagcaat

SEQ ID NO: 3622333 - DNA, 16 bp, Homo sapiens
attgctatcagcaatg

SEQ ID NO: 3622334 - DNA, 12 bp, Homo sapiens
attgctccttga

SEQ ID NO: 3622335 - DNA, 12 bp, Homo sapiens
attgctgaggca

SEQ ID NO: 3622336 - DNA, 16 bp, Homo sapiens
attgctgcatatttga

SEQ ID NO: 3622337 - DNA, 22 bp, Homo sapiens
attgctgctaagtcattggcaa

SEQ ID NO: 3622338 - DNA, 13 bp, Homo sapiens
attgcttactgat

SEQ ID NO: 3622339 - DNA, 16 bp, Homo sapiens
attgcttactgatatt

SEQ ID NO: 3622340 - DNA, 13 bp, Homo sapiens
attgcttctgact

SEQ ID NO: 3622341 - DNA, 17 bp, Homo sapiens
attgcttttttaaatat

SEQ ID NO: 3622342 - DNA, 16 bp, Homo sapiens
attggaaagacttctc

SEQ ID NO: 3622343 - DNA, 18 bp, Homo sapiens
attggcacccctttctag

SEQ ID NO: 3622344 - DNA, 19 bp, Homo sapiens
attggctgcaggaagaaac

SEQ ID NO: 3622345 - DNA, 22 bp, Homo sapiens
attggctgcaggaagaaacttt

SEQ ID NO: 3622346 - DNA, 14 bp, Homo sapiens
attggcttgtctca

SEQ ID NO: 3622347 - DNA, 21 bp, Homo sapiens
attgggagcttgggaatggat

SEQ ID NO: 3622348 - DNA, 23 bp, Homo sapiens
attggtactgccttaaagataca

SEQ ID NO: 3622349 - DNA, 16 bp, Homo sapiens
attggtggctgttcct

SEQ ID NO: 3622350 - DNA, 19 bp, Homo sapiens
attggtgtaaggtactttc

SEQ ID NO: 3622351 - DNA, 16 bp, Homo sapiens
attggtgttgcagccg

SEQ ID NO: 3622352 - DNA, 20 bp, Homo sapiens
attggtgttgcagccgcaga

SEQ ID NO: 3622353 - DNA, 15 bp, Homo sapiens
attggtttttttgta

SEQ ID NO: 3622354 - DNA, 17 bp, Homo sapiens
attgtaaatgtgctttt

SEQ ID NO: 3622355 - DNA, 13 bp, Homo sapiens
attgtaattccaa

SEQ ID NO: 3622356 - DNA, 12 bp, Homo sapiens
attgtacaataa

SEQ ID NO: 3622357 - DNA, 13 bp, Homo sapiens
attgtacaataaa

SEQ ID NO: 3622358 - DNA, 15 bp, Homo sapiens
attgtacaataaatt

SEQ ID NO: 3622359 - DNA, 19 bp, Homo sapiens
attgtagataacactgact

SEQ ID NO: 3622360 - DNA, 17 bp, Homo sapiens
attgtatgaagtttgaa

SEQ ID NO: 3622361 - DNA, 16 bp, Homo sapiens
attgtatttaagacat

SEQ ID NO: 3622362 - DNA, 23 bp, Homo sapiens
attgtccagtttgtcttggatat

SEQ ID NO: 3622363 - DNA, 12 bp, Homo sapiens
attgtccctctg

SEQ ID NO: 3622364 - DNA, 14 bp, Homo sapiens
attgtctcaacgcc

SEQ ID NO: 3622365 - DNA, 17 bp, Homo sapiens
attgtctgttttccttc

SEQ ID NO: 3622366 - DNA, 18 bp, Homo sapiens
attgtctgttttccttct

SEQ ID NO: 3622367 - DNA, 19 bp, Homo sapiens
attgtgcatgctagtgttg

SEQ ID NO: 3622368 - DNA, 14 bp, Homo sapiens
attgtgtatctgtg

SEQ ID NO: 3622369 - DNA, 12 bp, Homo sapiens
attgtgtattta

SEQ ID NO: 3622370 - DNA, 18 bp, Homo sapiens
attgttagcttccttaag

SEQ ID NO: 3622371 - DNA, 17 bp, Homo sapiens
attgttataaataaaat

SEQ ID NO: 3622372 - DNA, 18 bp, Homo sapiens
attgttataaataaaatt

SEQ ID NO: 3622373 - DNA, 20 bp, Homo sapiens
attgttataaataaaattgt

SEQ ID NO: 3622374 - DNA, 17 bp, Homo sapiens
attgttgaatctatttc

SEQ ID NO: 3622375 - DNA, 15 bp, Homo sapiens
attgtttaaaatcat

SEQ ID NO: 3622376 - DNA, 19 bp, Homo sapiens
attgtttaaaatcatttct

SEQ ID NO: 3622377 - DNA, 23 bp, Homo sapiens
attgtttatatggataatctgag

SEQ ID NO: 3622378 - DNA, 15 bp, Homo sapiens
attgtttgttgcact

SEQ ID NO: 3622379 - DNA, 14 bp, Homo sapiens
attgttttacaata

SEQ ID NO: 3622380 - DNA, 18 bp, Homo sapiens
attgttttctatttatgc

SEQ ID NO: 3622381 - DNA, 16 bp, Homo sapiens
attgtttttatatatt

SEQ ID NO: 3622382 - DNA, 23 bp, Homo sapiens
attgtttttatatattataagtt

SEQ ID NO: 3622383 - DNA, 20 bp, Homo sapiens
atttaaaaaaaagaaacttt

SEQ ID NO: 3622384 - DNA, 20 bp, Homo sapiens
atttaaaacattaaaatata

SEQ ID NO: 3622385 - DNA, 20 bp, Homo sapiens
atttaaaatgctcaatttca

SEQ ID NO: 3622386 - DNA, 15 bp, Homo sapiens
atttaaaattgtgat

SEQ ID NO: 3622387 - DNA, 18 bp, Homo sapiens
atttaaagaaatatgtat

SEQ ID NO: 3622388 - DNA, 19 bp, Homo sapiens
atttaaagcttattaaaac

SEQ ID NO: 3622389 - DNA, 20 bp, Homo sapiens
atttaaatcctgaagagcat

SEQ ID NO: 3622390 - DNA, 24 bp, Homo sapiens
atttaaatgtgtacaatgtacaca

SEQ ID NO: 3622391 - DNA, 23 bp, Homo sapiens
atttaaatgttatgactatgtaa

SEQ ID NO: 3622392 - DNA, 14 bp, Homo sapiens
atttaagacataaa

SEQ ID NO: 3622393 - DNA, 18 bp, Homo sapiens
atttaagacataaacaaa

SEQ ID NO: 3622394 - DNA, 17 bp, Homo sapiens
atttaagatgtacattt

SEQ ID NO: 3622395 - DNA, 22 bp, Homo sapiens
atttaagatgtacatttaataa

SEQ ID NO: 3622396 - DNA, 19 bp, Homo sapiens
atttaagcagcttgaatgg

SEQ ID NO: 3622397 - DNA, 18 bp, Homo sapiens
atttaagccttacaaagg

SEQ ID NO: 3622398 - DNA, 20 bp, Homo sapiens
atttaagccttacaaaggga

SEQ ID NO: 3622399 - DNA, 15 bp, Homo sapiens
atttaaggatagtgt

SEQ ID NO: 3622400 - DNA, 16 bp, Homo sapiens
atttaataaatgtgcc

SEQ ID NO: 3622401 - DNA, 13 bp, Homo sapiens
atttaatattaca

SEQ ID NO: 3622402 - DNA, 22 bp, Homo sapiens
atttaatccttctttgtaatac

SEQ ID NO: 3622403 - DNA, 12 bp, Homo sapiens
atttaatgctgc

SEQ ID NO: 3622404 - DNA, 13 bp, Homo sapiens
atttaatgctgcc

SEQ ID NO: 3622405 - DNA, 14 bp, Homo sapiens
atttaatgctgcct

SEQ ID NO: 3622406 - DNA, 15 bp, Homo sapiens
atttaatggcagcta

SEQ ID NO: 3622407 - DNA, 21 bp, Homo sapiens
atttaatggcagctagtgcct

SEQ ID NO: 3622408 - DNA, 22 bp, Homo sapiens
atttaatggcagctagtgcctt

SEQ ID NO: 3622409 - DNA, 15 bp, Homo sapiens
atttaattacaaaca

SEQ ID NO: 3622410 - DNA, 18 bp, Homo sapiens
atttaattacaaacaata

SEQ ID NO: 3622411 - DNA, 15 bp, Homo sapiens
atttaatttgaaggt

SEQ ID NO: 3622412 - DNA, 22 bp, Homo sapiens
atttaatttgaaggtagaatgt

SEQ ID NO: 3622413 - DNA, 11 bp, Homo sapiens
atttaatttgt

SEQ ID NO: 3622414 - DNA, 23 bp, Homo sapiens
atttaatttgtaaaacttctgct

SEQ ID NO: 3622415 - DNA, 16 bp, Homo sapiens
atttacagctgtgctc

SEQ ID NO: 3622416 - DNA, 18 bp, Homo sapiens
atttacctaagattacaa

SEQ ID NO: 3622417 - DNA, 15 bp, Homo sapiens
atttactatgcacaa

SEQ ID NO: 3622418 - DNA, 22 bp, Homo sapiens
atttactatgcacaacagagta

SEQ ID NO: 3622419 - DNA, 15 bp, Homo sapiens
atttactatttcaat

SEQ ID NO: 3622420 - DNA, 14 bp, Homo sapiens
atttactgatgaga

SEQ ID NO: 3622421 - DNA, 17 bp, Homo sapiens
atttactgatgagagaa

SEQ ID NO: 3622422 - DNA, 14 bp, Homo sapiens
atttacttcttata

SEQ ID NO: 3622423 - DNA, 20 bp, Homo sapiens
atttacttcttatacatttg

SEQ ID NO: 3622424 - DNA, 22 bp, Homo sapiens
atttagaaaatagagcttttaa

SEQ ID NO: 3622425 - DNA, 15 bp, Homo sapiens
atttagaaatataat

SEQ ID NO: 3622426 - DNA, 19 bp, Homo sapiens
atttagaatggttgagtta

SEQ ID NO: 3622427 - DNA, 20 bp, Homo sapiens
atttagaatggttgagttac

SEQ ID NO: 3622428 - DNA, 17 bp, Homo sapiens
atttagagataggaaac

SEQ ID NO: 3622429 - DNA, 17 bp, Homo sapiens
atttagagctaaaaagg

SEQ ID NO: 3622430 - DNA, 23 bp, Homo sapiens
atttaggaagttgacttatagta

SEQ ID NO: 3622431 - DNA, 18 bp, Homo sapiens
atttaggcatgagctctt

SEQ ID NO: 3622432 - DNA, 23 bp, Homo sapiens
atttaggtttttgtttgtttcct

SEQ ID NO: 3622433 - DNA, 14 bp, Homo sapiens
atttagtcatgtga

SEQ ID NO: 3622434 - DNA, 16 bp, Homo sapiens
atttagtcatgtgacc

SEQ ID NO: 3622435 - DNA, 15 bp, Homo sapiens
atttagtgtgaatat

SEQ ID NO: 3622436 - DNA, 16 bp, Homo sapiens
atttataaggaaattt

SEQ ID NO: 3622437 - DNA, 14 bp, Homo sapiens
atttataatgtatt

SEQ ID NO: 3622438 - DNA, 15 bp, Homo sapiens
atttataatgtattt

SEQ ID NO: 3622439 - DNA, 15 bp, Homo sapiens
atttattaaacttca

SEQ ID NO: 3622440 - DNA, 18 bp, Homo sapiens
atttattaaacttcagca

SEQ ID NO: 3622441 - DNA, 11 bp, Homo sapiens
atttattaatt

SEQ ID NO: 3622442 - DNA, 16 bp, Homo sapiens
atttattaattgcttt

SEQ ID NO: 3622443 - DNA, 21 bp, Homo sapiens
atttattattttttttatatt

SEQ ID NO: 3622444 - DNA, 17 bp, Homo sapiens
atttattccccagtgac

SEQ ID NO: 3622445 - DNA, 18 bp, Homo sapiens
atttattccccagtgact

SEQ ID NO: 3622446 - DNA, 13 bp, Homo sapiens
atttattgaaatg

SEQ ID NO: 3622447 - DNA, 18 bp, Homo sapiens
atttattgatgttttcac

SEQ ID NO: 3622448 - DNA, 19 bp, Homo sapiens
atttattgatgttttcaca

SEQ ID NO: 3622449 - DNA, 18 bp, Homo sapiens
atttattgttagaaaatg

SEQ ID NO: 3622450 - DNA, 19 bp, Homo sapiens
atttatttttaagaaagaa

SEQ ID NO: 3622451 - DNA, 18 bp, Homo sapiens
atttcaaacttaaacaaa

SEQ ID NO: 3622452 - DNA, 16 bp, Homo sapiens
atttcaataaatcttt

SEQ ID NO: 3622453 - DNA, 14 bp, Homo sapiens
atttcaatccattt

SEQ ID NO: 3622454 - DNA, 16 bp, Homo sapiens
atttcaatcttttaaa

SEQ ID NO: 3622455 - DNA, 22 bp, Homo sapiens
atttcaatcttttaaattgcaa

SEQ ID NO: 3622456 - DNA, 21 bp, Homo sapiens
atttcaattgtttatatggat

SEQ ID NO: 3622457 - DNA, 21 bp, Homo sapiens
atttcacatgagtcaaaacaa

SEQ ID NO: 3622458 - DNA, 21 bp, Homo sapiens
atttcactagagacaaatctt

SEQ ID NO: 3622459 - DNA, 24 bp, Homo sapiens
atttcactgtagctctaaaatctg

SEQ ID NO: 3622460 - DNA, 23 bp, Homo sapiens
atttcagactcccattcctgaag

SEQ ID NO: 3622461 - DNA, 12 bp, Homo sapiens
atttcagccaaa

SEQ ID NO: 3622462 - DNA, 16 bp, Homo sapiens
atttcagccaaagtcc

SEQ ID NO: 3622463 - DNA, 14 bp, Homo sapiens
atttcagcctcctg

SEQ ID NO: 3622464 - DNA, 17 bp, Homo sapiens
atttcaggactctctcc

SEQ ID NO: 3622465 - DNA, 19 bp, Homo sapiens
atttcaggactctctccag

SEQ ID NO: 3622466 - DNA, 21 bp, Homo sapiens
atttcaggactctctccagga

SEQ ID NO: 3622467 - DNA, 18 bp, Homo sapiens
atttcatgctatctctgt

SEQ ID NO: 3622468 - DNA, 22 bp, Homo sapiens
atttccattcatggatatttgt

SEQ ID NO: 3622469 - DNA, 14 bp, Homo sapiens
atttcccccaggga

SEQ ID NO: 3622470 - DNA, 18 bp, Homo sapiens
atttcctctgttcttttc

SEQ ID NO: 3622471 - DNA, 13 bp, Homo sapiens
atttccttcaggc

SEQ ID NO: 3622472 - DNA, 19 bp, Homo sapiens
atttccttttttgttatta

SEQ ID NO: 3622473 - DNA, 20 bp, Homo sapiens
atttcgggtgaatctgtcta

SEQ ID NO: 3622474 - DNA, 15 bp, Homo sapiens
atttctaagtattta

SEQ ID NO: 3622475 - DNA, 18 bp, Homo sapiens
atttctaatccttttcct

SEQ ID NO: 3622476 - DNA, 21 bp, Homo sapiens
atttctaatccttttccttat

SEQ ID NO: 3622477 - DNA, 17 bp, Homo sapiens
atttctaccatttcaga

SEQ ID NO: 3622478 - DNA, 19 bp, Homo sapiens
atttctactatgatcagaa

SEQ ID NO: 3622479 - DNA, 15 bp, Homo sapiens
atttctatacagtag

SEQ ID NO: 3622480 - DNA, 18 bp, Homo sapiens
atttctatattcctccag

SEQ ID NO: 3622481 - DNA, 19 bp, Homo sapiens
atttctcataattttgcaa

SEQ ID NO: 3622482 - DNA, 23 bp, Homo sapiens
atttctccatcccctccctgcct

SEQ ID NO: 3622483 - DNA, 16 bp, Homo sapiens
atttctgactcttatt

SEQ ID NO: 3622484 - DNA, 16 bp, Homo sapiens
atttctgattctgatt

SEQ ID NO: 3622485 - DNA, 20 bp, Homo sapiens
atttctgccaataaattcta

SEQ ID NO: 3622486 - DNA, 13 bp, Homo sapiens
atttctgctctgg

SEQ ID NO: 3622487 - DNA, 18 bp, Homo sapiens
atttctgctctggaataa

SEQ ID NO: 3622488 - DNA, 15 bp, Homo sapiens
atttctgggatattt

SEQ ID NO: 3622489 - DNA, 17 bp, Homo sapiens
atttctgtctttaagaa

SEQ ID NO: 3622490 - DNA, 14 bp, Homo sapiens
atttcttaacttct

SEQ ID NO: 3622491 - DNA, 19 bp, Homo sapiens
atttcttaacttcttgctt

SEQ ID NO: 3622492 - DNA, 17 bp, Homo sapiens
atttcttcacttcaagc

SEQ ID NO: 3622493 - DNA, 11 bp, Homo sapiens
atttcttccca

SEQ ID NO: 3622494 - DNA, 22 bp, Homo sapiens
atttcttccctgctttgcatct

SEQ ID NO: 3622495 - DNA, 17 bp, Homo sapiens
atttcttcgtgatgaca

SEQ ID NO: 3622496 - DNA, 20 bp, Homo sapiens
atttcttcgtgatgacatat

SEQ ID NO: 3622497 - DNA, 21 bp, Homo sapiens
atttcttcgtgatgacatatc

SEQ ID NO: 3622498 - DNA, 13 bp, Homo sapiens
atttctttcttcc

SEQ ID NO: 3622499 - DNA, 22 bp, Homo sapiens
atttctttctttgcaccaaaga

SEQ ID NO: 3622500 - DNA, 23 bp, Homo sapiens
atttctttctttgcaccaaagac

SEQ ID NO: 3622501 - DNA, 13 bp, Homo sapiens
atttctttggaaa

SEQ ID NO: 3622502 - DNA, 14 bp, Homo sapiens
atttgaaaaaaact

SEQ ID NO: 3622503 - DNA, 16 bp, Homo sapiens
atttgaacctggatcc

SEQ ID NO: 3622504 - DNA, 19 bp, Homo sapiens
atttgaagatagaaggttt

SEQ ID NO: 3622505 - DNA, 23 bp, Homo sapiens
atttgaaggtagaatgttttcaa

SEQ ID NO: 3622506 - DNA, 17 bp, Homo sapiens
atttgaccagaactttt

SEQ ID NO: 3622507 - DNA, 12 bp, Homo sapiens
atttgagatttt

SEQ ID NO: 3622508 - DNA, 22 bp, Homo sapiens
atttgaggacaaccattccaga

SEQ ID NO: 3622509 - DNA, 17 bp, Homo sapiens
atttgaggtcagtgttt

SEQ ID NO: 3622510 - DNA, 13 bp, Homo sapiens
atttgataaactg

SEQ ID NO: 3622511 - DNA, 15 bp, Homo sapiens
atttgatatttgcat

SEQ ID NO: 3622512 - DNA, 16 bp, Homo sapiens
atttgattatttaaga

SEQ ID NO: 3622513 - DNA, 22 bp, Homo sapiens
atttgcaacaggaagacactgg

SEQ ID NO: 3622514 - DNA, 20 bp, Homo sapiens
atttgccaggggcatccaag

SEQ ID NO: 3622515 - DNA, 13 bp, Homo sapiens
atttgcctatttc

SEQ ID NO: 3622516 - DNA, 19 bp, Homo sapiens
atttgccttctactcccct

SEQ ID NO: 3622517 - DNA, 22 bp, Homo sapiens
atttgcgcctcggtatctggct

SEQ ID NO: 3622518 - DNA, 17 bp, Homo sapiens
atttggaaataaagtca

SEQ ID NO: 3622519 - DNA, 19 bp, Homo sapiens
atttgggagacatgtgaca

SEQ ID NO: 3622520 - DNA, 17 bp, Homo sapiens
atttgggaggaggaaaa

SEQ ID NO: 3622521 - DNA, 23 bp, Homo sapiens
atttgggcctgctccagacctga

SEQ ID NO: 3622522 - DNA, 22 bp, Homo sapiens
atttggggtttgtgtttgattg

SEQ ID NO: 3622523 - DNA, 15 bp, Homo sapiens
atttgtaaaacttct

SEQ ID NO: 3622524 - DNA, 10 bp, Homo sapiens
atttgtaaag

SEQ ID NO: 3622525 - DNA, 19 bp, Homo sapiens
atttgtagtggaaacattt

SEQ ID NO: 3622526 - DNA, 22 bp, Homo sapiens
atttgtcttaaaaaatgtgaaa

SEQ ID NO: 3622527 - DNA, 23 bp, Homo sapiens
atttgtcttaaaaaatgtgaaat

SEQ ID NO: 3622528 - DNA, 15 bp, Homo sapiens
atttgttaatatttc

SEQ ID NO: 3622529 - DNA, 17 bp, Homo sapiens
atttgttaatatttctt

SEQ ID NO: 3622530 - DNA, 13 bp, Homo sapiens
atttgttctttgt

SEQ ID NO: 3622531 - DNA, 14 bp, Homo sapiens
atttgtttaaacaa

SEQ ID NO: 3622532 - DNA, 18 bp, Homo sapiens
atttgtttgctgaaattt

SEQ ID NO: 3622533 - DNA, 17 bp, Homo sapiens
attttaaaaaatggtca

SEQ ID NO: 3622534 - DNA, 15 bp, Homo sapiens
attttaaacagagga

SEQ ID NO: 3622535 - DNA, 14 bp, Homo sapiens
attttaaatgaaag

SEQ ID NO: 3622536 - DNA, 15 bp, Homo sapiens
attttaaatgaaagt

SEQ ID NO: 3622537 - DNA, 21 bp, Homo sapiens
attttaaattccactgaaaat

SEQ ID NO: 3622538 - DNA, 16 bp, Homo sapiens
attttaaggatatgat

SEQ ID NO: 3622539 - DNA, 22 bp, Homo sapiens
attttaatcctgtaccaaatct

SEQ ID NO: 3622540 - DNA, 20 bp, Homo sapiens
attttaattactgctataaa

SEQ ID NO: 3622541 - DNA, 15 bp, Homo sapiens
attttacataacgga

SEQ ID NO: 3622542 - DNA, 12 bp, Homo sapiens
attttacatgac

SEQ ID NO: 3622543 - DNA, 15 bp, Homo sapiens
attttaccaaagcat

SEQ ID NO: 3622544 - DNA, 22 bp, Homo sapiens
attttaccctgaggtcactgct

SEQ ID NO: 3622545 - DNA, 17 bp, Homo sapiens
attttacctagctaatt

SEQ ID NO: 3622546 - DNA, 16 bp, Homo sapiens
attttacctattctga

SEQ ID NO: 3622547 - DNA, 20 bp, Homo sapiens
attttagaaactacaaatat

SEQ ID NO: 3622548 - DNA, 24 bp, Homo sapiens
attttagaaactacaaatataggt

SEQ ID NO: 3622549 - DNA, 23 bp, Homo sapiens
attttagctctattgatactctt

SEQ ID NO: 3622550 - DNA, 15 bp, Homo sapiens
attttataaatgtat

SEQ ID NO: 3622551 - DNA, 20 bp, Homo sapiens
attttatgacatgaaaagtt

SEQ ID NO: 3622552 - DNA, 23 bp, Homo sapiens
attttatgacatgaaaagttatt

SEQ ID NO: 3622553 - DNA, 18 bp, Homo sapiens
attttattgtattttgat

SEQ ID NO: 3622554 - DNA, 23 bp, Homo sapiens
attttatttacagctgtgctcca

SEQ ID NO: 3622555 - DNA, 23 bp, Homo sapiens
attttattttgaaatggaaatta

SEQ ID NO: 3622556 - DNA, 22 bp, Homo sapiens
attttcaaagctttttccagag

SEQ ID NO: 3622557 - DNA, 13 bp, Homo sapiens
attttcaagaaac

SEQ ID NO: 3622558 - DNA, 16 bp, Homo sapiens
attttcaagaaactga

SEQ ID NO: 3622559 - DNA, 15 bp, Homo sapiens
attttcagtgcatca

SEQ ID NO: 3622560 - DNA, 18 bp, Homo sapiens
attttcagttctatttaa

SEQ ID NO: 3622561 - DNA, 17 bp, Homo sapiens
attttccaagtaaaata

SEQ ID NO: 3622562 - DNA, 20 bp, Homo sapiens
attttccaagtaaaatatta

SEQ ID NO: 3622563 - DNA, 16 bp, Homo sapiens
attttccgtcacttaa

SEQ ID NO: 3622564 - DNA, 19 bp, Homo sapiens
attttcctgttgtcaagaa

SEQ ID NO: 3622565 - DNA, 14 bp, Homo sapiens
attttctaaagact

SEQ ID NO: 3622566 - DNA, 19 bp, Homo sapiens
attttctggaatacatgaa

SEQ ID NO: 3622567 - DNA, 17 bp, Homo sapiens
attttcttcatctttgc

SEQ ID NO: 3622568 - DNA, 13 bp, Homo sapiens
attttgagaaact

SEQ ID NO: 3622569 - DNA, 23 bp, Homo sapiens
attttgcctctgtccgtgcccct

SEQ ID NO: 3622570 - DNA, 17 bp, Homo sapiens
attttgcgtcagagaaa

SEQ ID NO: 3622571 - DNA, 15 bp, Homo sapiens
attttgctaactggt

SEQ ID NO: 3622572 - DNA, 17 bp, Homo sapiens
attttgctaactggtta

SEQ ID NO: 3622573 - DNA, 18 bp, Homo sapiens
attttgctaactggttaa

SEQ ID NO: 3622574 - DNA, 19 bp, Homo sapiens
attttgctaactggttaaa

SEQ ID NO: 3622575 - DNA, 18 bp, Homo sapiens
attttgctgcttgatgat

SEQ ID NO: 3622576 - DNA, 19 bp, Homo sapiens
attttggaaaataaattat

SEQ ID NO: 3622577 - DNA, 16 bp, Homo sapiens
attttgtaataaactc

SEQ ID NO: 3622578 - DNA, 18 bp, Homo sapiens
attttgtaataaactctc

SEQ ID NO: 3622579 - DNA, 20 bp, Homo sapiens
attttgtaataaactctcta

SEQ ID NO: 3622580 - DNA, 22 bp, Homo sapiens
attttgtaataataaagaatag

SEQ ID NO: 3622581 - DNA, 20 bp, Homo sapiens
attttgtaatgtatcaaata

SEQ ID NO: 3622582 - DNA, 18 bp, Homo sapiens
attttgtgtaagaaatac

SEQ ID NO: 3622583 - DNA, 21 bp, Homo sapiens
attttgttcaagtttgctgca

SEQ ID NO: 3622584 - DNA, 19 bp, Homo sapiens
atttttaaaggtacactgg

SEQ ID NO: 3622585 - DNA, 14 bp, Homo sapiens
atttttacagcaaa

SEQ ID NO: 3622586 - DNA, 16 bp, Homo sapiens
atttttacagcaaaag

SEQ ID NO: 3622587 - DNA, 17 bp, Homo sapiens
atttttacatctaaact

SEQ ID NO: 3622588 - DNA, 17 bp, Homo sapiens
atttttacctgtttaaa

SEQ ID NO: 3622589 - DNA, 13 bp, Homo sapiens
atttttatacact

SEQ ID NO: 3622590 - DNA, 16 bp, Homo sapiens
atttttattaaattat

SEQ ID NO: 3622591 - DNA, 13 bp, Homo sapiens
atttttccaacta

SEQ ID NO: 3622592 - DNA, 12 bp, Homo sapiens
atttttccttta

SEQ ID NO: 3622593 - DNA, 19 bp, Homo sapiens
atttttctcccaagaaacc

SEQ ID NO: 3622594 - DNA, 15 bp, Homo sapiens
atttttcttatttca

SEQ ID NO: 3622595 - DNA, 20 bp, Homo sapiens
atttttcttatttcatttct

SEQ ID NO: 3622596 - DNA, 14 bp, Homo sapiens
atttttgaaaaaga

SEQ ID NO: 3622597 - DNA, 13 bp, Homo sapiens
atttttgccaaaa

SEQ ID NO: 3622598 - DNA, 21 bp, Homo sapiens
atttttgctgaattcctttac

SEQ ID NO: 3622599 - DNA, 15 bp, Homo sapiens
atttttgcttttgat

SEQ ID NO: 3622600 - DNA, 15 bp, Homo sapiens
atttttgtctgcagc

SEQ ID NO: 3622601 - DNA, 16 bp, Homo sapiens
atttttgttagcaaag

SEQ ID NO: 3622602 - DNA, 15 bp, Homo sapiens
attttttaaatcttg

SEQ ID NO: 3622603 - DNA, 18 bp, Homo sapiens
attttttaaatcttgacc

SEQ ID NO: 3622604 - DNA, 19 bp, Homo sapiens
attttttacagctgcctgc

SEQ ID NO: 3622605 - DNA, 14 bp, Homo sapiens
attttttatttcta

SEQ ID NO: 3622606 - DNA, 12 bp, Homo sapiens
attttttcagac

SEQ ID NO: 3622607 - DNA, 18 bp, Homo sapiens
attttttcccttctcttc

SEQ ID NO: 3622608 - DNA, 16 bp, Homo sapiens
attttttgaaaagcag

SEQ ID NO: 3622609 - DNA, 19 bp, Homo sapiens
attttttgaaaagcagaca

SEQ ID NO: 3622610 - DNA, 13 bp, Homo sapiens
attttttgaaaca

SEQ ID NO: 3622611 - DNA, 16 bp, Homo sapiens
attttttgtataattg

SEQ ID NO: 3622612 - DNA, 19 bp, Homo sapiens
atttttttcccaattgaga

SEQ ID NO: 3622613 - DNA, 14 bp, Homo sapiens
atttttttcccatg

SEQ ID NO: 3622614 - DNA, 15 bp, Homo sapiens
atttttttcccatga

SEQ ID NO: 3622615 - DNA, 15 bp, Homo sapiens
atttttttgtaattg

SEQ ID NO: 3622616 - DNA, 14 bp, Homo sapiens
attttttttacatt

SEQ ID NO: 3622617 - DNA, 16 bp, Homo sapiens
attttttttatattta

SEQ ID NO: 3622618 - DNA, 22 bp, Homo sapiens
attttttttcatgctttatcaa

SEQ ID NO: 3622619 - DNA, 17 bp, Homo sapiens
attttttttggtcaaat

SEQ ID NO: 3622620 - DNA, 18 bp, Homo sapiens
attttttttggtcaaatt

SEQ ID NO: 3622621 - DNA, 23 bp, Homo sapiens
attttttttttttggtccttctt

SEQ ID NO: 3622622 - DNA, 15 bp, Homo sapiens
caaaaacaagacaga

SEQ ID NO: 3622623 - DNA, 17 bp, Homo sapiens
caaaaacacagcaaggg

SEQ ID NO: 3622624 - DNA, 23 bp, Homo sapiens
caaaaacgaaactccatctcaaa

SEQ ID NO: 3622625 - DNA, 20 bp, Homo sapiens
caaaaagaaaagaaaatttt

SEQ ID NO: 3622626 - DNA, 13 bp, Homo sapiens
caaaaagccacag

SEQ ID NO: 3622627 - DNA, 16 bp, Homo sapiens
caaaaagccacagcag

SEQ ID NO: 3622628 - DNA, 15 bp, Homo sapiens
caaaaagctctgaaa

SEQ ID NO: 3622629 - DNA, 17 bp, Homo sapiens
caaaaattatctatagc

SEQ ID NO: 3622630 - DNA, 19 bp, Homo sapiens
caaaaattatctatagcta

SEQ ID NO: 3622631 - DNA, 19 bp, Homo sapiens
caaaacaaaacaaaacaaa

SEQ ID NO: 3622632 - DNA, 10 bp, Homo sapiens
caaaacaaac

SEQ ID NO: 3622633 - DNA, 13 bp, Homo sapiens
caaaacccagctg

SEQ ID NO: 3622634 - DNA, 15 bp, Homo sapiens
caaaacccagctgca

SEQ ID NO: 3622635 - DNA, 18 bp, Homo sapiens
caaaacccagctgcaccc

SEQ ID NO: 3622636 - DNA, 21 bp, Homo sapiens
caaaacccagctgcacccctt

SEQ ID NO: 3622637 - DNA, 19 bp, Homo sapiens
caaaacctatttttccttt

SEQ ID NO: 3622638 - DNA, 17 bp, Homo sapiens
caaaactacttttctaa

SEQ ID NO: 3622639 - DNA, 19 bp, Homo sapiens
caaaactacttttctaaaa

SEQ ID NO: 3622640 - DNA, 20 bp, Homo sapiens
caaaagaaacaccagtgtta

SEQ ID NO: 3622641 - DNA, 17 bp, Homo sapiens
caaaagaagcccccagc

SEQ ID NO: 3622642 - DNA, 12 bp, Homo sapiens
caaaagacatta

SEQ ID NO: 3622643 - DNA, 20 bp, Homo sapiens
caaaatccaaaacttctctt

SEQ ID NO: 3622644 - DNA, 15 bp, Homo sapiens
caaaatcctcaggaa

SEQ ID NO: 3622645 - DNA, 18 bp, Homo sapiens
caaaatgctctagtgcct

SEQ ID NO: 3622646 - DNA, 20 bp, Homo sapiens
caaaattgcttctaaaacaa

SEQ ID NO: 3622647 - DNA, 11 bp, Homo sapiens
caaacaaaact

SEQ ID NO: 3622648 - DNA, 14 bp, Homo sapiens
caaacaaaacttaa

SEQ ID NO: 3622649 - DNA, 14 bp, Homo sapiens
caaacaaaacttgc

SEQ ID NO: 3622650 - DNA, 16 bp, Homo sapiens
caaacaaacaaacaaa

SEQ ID NO: 3622651 - DNA, 15 bp, Homo sapiens
caaacaataagaaca

SEQ ID NO: 3622652 - DNA, 18 bp, Homo sapiens
caaacaatcccaatcttt

SEQ ID NO: 3622653 - DNA, 16 bp, Homo sapiens
caaacactgaactcct

SEQ ID NO: 3622654 - DNA, 16 bp, Homo sapiens
caaacagtctcaggaa

SEQ ID NO: 3622655 - DNA, 17 bp, Homo sapiens
caaacagtctcccttcc

SEQ ID NO: 3622656 - DNA, 16 bp, Homo sapiens
caaacatcaaataaat

SEQ ID NO: 3622657 - DNA, 15 bp, Homo sapiens
caaacatcattgttt

SEQ ID NO: 3622658 - DNA, 12 bp, Homo sapiens
caaacccactca

SEQ ID NO: 3622659 - DNA, 12 bp, Homo sapiens
caaaccccagcc

SEQ ID NO: 3622660 - DNA, 15 bp, Homo sapiens
caaaccccctgcagc

SEQ ID NO: 3622661 - DNA, 19 bp, Homo sapiens
caaaccccctgcagcccag

SEQ ID NO: 3622662 - DNA, 15 bp, Homo sapiens
caaacccttaactga

SEQ ID NO: 3622663 - DNA, 16 bp, Homo sapiens
caaacccttaactgac

SEQ ID NO: 3622664 - DNA, 22 bp, Homo sapiens
caaacccttgctttcctgggcc

SEQ ID NO: 3622665 - DNA, 18 bp, Homo sapiens
caaacctatggaagttgt

SEQ ID NO: 3622666 - DNA, 19 bp, Homo sapiens
caaacctccagcctccctg

SEQ ID NO: 3622667 - DNA, 19 bp, Homo sapiens
caaacctgggaaggccagc

SEQ ID NO: 3622668 - DNA, 19 bp, Homo sapiens
caaacctgtcttggggcca

SEQ ID NO: 3622669 - DNA, 14 bp, Homo sapiens
caaactcagatcct

SEQ ID NO: 3622670 - DNA, 15 bp, Homo sapiens
caaactcagatcctt

SEQ ID NO: 3622671 - DNA, 11 bp, Homo sapiens
caaactccagg

SEQ ID NO: 3622672 - DNA, 14 bp, Homo sapiens
caaactccaggctg

SEQ ID NO: 3622673 - DNA, 12 bp, Homo sapiens
caaactccaggt

SEQ ID NO: 3622674 - DNA, 12 bp, Homo sapiens
caaactctgctg

SEQ ID NO: 3622675 - DNA, 18 bp, Homo sapiens
caaactctgctgtctaac

SEQ ID NO: 3622676 - DNA, 21 bp, Homo sapiens
caaactgtagtaattgttaca

SEQ ID NO: 3622677 - DNA, 17 bp, Homo sapiens
caaacttaaacaaaaaa

SEQ ID NO: 3622678 - DNA, 18 bp, Homo sapiens
caaagaaccatgcaggaa

SEQ ID NO: 3622679 - DNA, 14 bp, Homo sapiens
caaagaagaaagct

SEQ ID NO: 3622680 - DNA, 15 bp, Homo sapiens
caaagaagaaagctg

SEQ ID NO: 3622681 - DNA, 16 bp, Homo sapiens
caaagaagatagctct

SEQ ID NO: 3622682 - DNA, 19 bp, Homo sapiens
caaagaagatagctctctg

SEQ ID NO: 3622683 - DNA, 20 bp, Homo sapiens
caaagaagatagctctctga

SEQ ID NO: 3622684 - DNA, 18 bp, Homo sapiens
caaagacattgacagcaa

SEQ ID NO: 3622685 - DNA, 21 bp, Homo sapiens
caaagacattgacagcaattc

SEQ ID NO: 3622686 - DNA, 23 bp, Homo sapiens
caaagacattgacagcaattcat

SEQ ID NO: 3622687 - DNA, 13 bp, Homo sapiens
caaagagaagatg

SEQ ID NO: 3622688 - DNA, 14 bp, Homo sapiens
caaagagaagatgc

SEQ ID NO: 3622689 - DNA, 18 bp, Homo sapiens
caaagagaagatgcctgt

SEQ ID NO: 3622690 - DNA, 20 bp, Homo sapiens
caaagatctgtcctcagcct

SEQ ID NO: 3622691 - DNA, 21 bp, Homo sapiens
caaagatctgtcctcagcctt

SEQ ID NO: 3622692 - DNA, 15 bp, Homo sapiens
caaagattaaatgtg

SEQ ID NO: 3622693 - DNA, 16 bp, Homo sapiens
caaagattaaatgtgt

SEQ ID NO: 3622694 - DNA, 18 bp, Homo sapiens
caaagattaggtcgtttt

SEQ ID NO: 3622695 - DNA, 13 bp, Homo sapiens
caaagcaaagaaa

SEQ ID NO: 3622696 - DNA, 21 bp, Homo sapiens
caaagcaatttactgatgaga

SEQ ID NO: 3622697 - DNA, 16 bp, Homo sapiens
caaagcagctttaaaa

SEQ ID NO: 3622698 - DNA, 19 bp, Homo sapiens
caaagcccctcacactgca

SEQ ID NO: 3622699 - DNA, 18 bp, Homo sapiens
caaagcccttccatgtcg

SEQ ID NO: 3622700 - DNA, 16 bp, Homo sapiens
caaagccttaagcaaa

SEQ ID NO: 3622701 - DNA, 17 bp, Homo sapiens
caaagcggtccctgtcc

SEQ ID NO: 3622702 - DNA, 16 bp, Homo sapiens
caaagcttgttaagat

SEQ ID NO: 3622703 - DNA, 16 bp, Homo sapiens
caaaggaactctagag

SEQ ID NO: 3622704 - DNA, 14 bp, Homo sapiens
caaaggatgtgata

SEQ ID NO: 3622705 - DNA, 17 bp, Homo sapiens
caaaggatgtgatatat

SEQ ID NO: 3622706 - DNA, 21 bp, Homo sapiens
caaaggatgtgatatataagt

SEQ ID NO: 3622707 - DNA, 11 bp, Homo sapiens
caaaggcctgg

SEQ ID NO: 3622708 - DNA, 16 bp, Homo sapiens
caaaggtgcactccag

SEQ ID NO: 3622709 - DNA, 22 bp, Homo sapiens
caaaggtgtgcttcctgctgta

SEQ ID NO: 3622710 - DNA, 17 bp, Homo sapiens
caaagtcattaaagaca

SEQ ID NO: 3622711 - DNA, 14 bp, Homo sapiens
caaagtgcctgggc

SEQ ID NO: 3622712 - DNA, 18 bp, Homo sapiens
caaagtgttgctgtggct

SEQ ID NO: 3622713 - DNA, 16 bp, Homo sapiens
caaataaaacgctttc

SEQ ID NO: 3622714 - DNA, 14 bp, Homo sapiens
caaataaatttctg

SEQ ID NO: 3622715 - DNA, 19 bp, Homo sapiens
caaatacatttaaaacatt

SEQ ID NO: 3622716 - DNA, 22 bp, Homo sapiens
caaatatgagtacaaatgcctt

SEQ ID NO: 3622717 - DNA, 13 bp, Homo sapiens
caaatatgcaaag

SEQ ID NO: 3622718 - DNA, 19 bp, Homo sapiens
caaatatgcaaagcactga

SEQ ID NO: 3622719 - DNA, 18 bp, Homo sapiens
caaatatgttaaagttta

SEQ ID NO: 3622720 - DNA, 15 bp, Homo sapiens
caaatattaaaattg

SEQ ID NO: 3622721 - DNA, 18 bp, Homo sapiens
caaatattaaaattgtta

SEQ ID NO: 3622722 - DNA, 22 bp, Homo sapiens
caaatatttagatgtaattttg

SEQ ID NO: 3622723 - DNA, 23 bp, Homo sapiens
caaatatttagatgtaattttgt

SEQ ID NO: 3622724 - DNA, 16 bp, Homo sapiens
caaatatttattttct

SEQ ID NO: 3622725 - DNA, 14 bp, Homo sapiens
caaatcagaagtca

SEQ ID NO: 3622726 - DNA, 15 bp, Homo sapiens
caaatccagtggtgg

SEQ ID NO: 3622727 - DNA, 17 bp, Homo sapiens
caaatccagtggtgggt

SEQ ID NO: 3622728 - DNA, 22 bp, Homo sapiens
caaatcctagactgctcctggg

SEQ ID NO: 3622729 - DNA, 14 bp, Homo sapiens
caaatctgacatat

SEQ ID NO: 3622730 - DNA, 21 bp, Homo sapiens
caaatcttaacttgaaggagt

SEQ ID NO: 3622731 - DNA, 21 bp, Homo sapiens
caaatcttggcaatattcctt

SEQ ID NO: 3622732 - DNA, 22 bp, Homo sapiens
caaatcttggcaatattcctta

SEQ ID NO: 3622733 - DNA, 20 bp, Homo sapiens
caaatgaaatatatttaaaa

SEQ ID NO: 3622734 - DNA, 18 bp, Homo sapiens
caaatgccttaaaatgga

SEQ ID NO: 3622735 - DNA, 20 bp, Homo sapiens
caaatggccattttaaaatg

SEQ ID NO: 3622736 - DNA, 14 bp, Homo sapiens
caaatggggccaga

SEQ ID NO: 3622737 - DNA, 19 bp, Homo sapiens
caaatggggccagatccag

SEQ ID NO: 3622738 - DNA, 20 bp, Homo sapiens
caaatggggccagatccagc

SEQ ID NO: 3622739 - DNA, 23 bp, Homo sapiens
caaatggggccagatccagcctg

SEQ ID NO: 3622740 - DNA, 17 bp, Homo sapiens
caaatgtagttttgtat

SEQ ID NO: 3622741 - DNA, 14 bp, Homo sapiens
caaatgtggctcct

SEQ ID NO: 3622742 - DNA, 13 bp, Homo sapiens
caaatgtttttca

SEQ ID NO: 3622743 - DNA, 13 bp, Homo sapiens
caaattctgtctg

SEQ ID NO: 3622744 - DNA, 17 bp, Homo sapiens
caaatttcttttgctga

SEQ ID NO: 3622745 - DNA, 23 bp, Homo sapiens
caacaacgtgagagaaagagaga

SEQ ID NO: 3622746 - DNA, 13 bp, Homo sapiens
caacacaaactgg

SEQ ID NO: 3622747 - DNA, 14 bp, Homo sapiens
caacacagaggaat

SEQ ID NO: 3622748 - DNA, 17 bp, Homo sapiens
caacacttaagtctcag

SEQ ID NO: 3622749 - DNA, 13 bp, Homo sapiens
caacagaaacctt

SEQ ID NO: 3622750 - DNA, 19 bp, Homo sapiens
caacagaaaccttttattt

SEQ ID NO: 3622751 - DNA, 16 bp, Homo sapiens
caacagagaggggcag

SEQ ID NO: 3622752 - DNA, 14 bp, Homo sapiens
caacagatctggaa

SEQ ID NO: 3622753 - DNA, 16 bp, Homo sapiens
caacagcaaaggaact

SEQ ID NO: 3622754 - DNA, 13 bp, Homo sapiens
caacagcagtctc

SEQ ID NO: 3622755 - DNA, 21 bp, Homo sapiens
caacagcagtctccttcagca

SEQ ID NO: 3622756 - DNA, 16 bp, Homo sapiens
caacagccctgcctga

SEQ ID NO: 3622757 - DNA, 20 bp, Homo sapiens
caacaggcttatgaatatat

SEQ ID NO: 3622758 - DNA, 17 bp, Homo sapiens
caacataactcaagtct

SEQ ID NO: 3622759 - DNA, 22 bp, Homo sapiens
caacatcttggtcagatttgaa

SEQ ID NO: 3622760 - DNA, 23 bp, Homo sapiens
caacatgccagccactgtgatag

SEQ ID NO: 3622761 - DNA, 16 bp, Homo sapiens
caacattgtagcctca

SEQ ID NO: 3622762 - DNA, 14 bp, Homo sapiens
caacatttctcatg

SEQ ID NO: 3622763 - DNA, 22 bp, Homo sapiens
caacattttagctctattgata

SEQ ID NO: 3622764 - DNA, 14 bp, Homo sapiens
caaccattccagac

SEQ ID NO: 3622765 - DNA, 15 bp, Homo sapiens
caacccccctcccag

SEQ ID NO: 3622766 - DNA, 23 bp, Homo sapiens
caaccccgaggtccctgttgtca

SEQ ID NO: 3622767 - DNA, 20 bp, Homo sapiens
caacccctctccaggcctgt

SEQ ID NO: 3622768 - DNA, 21 bp, Homo sapiens
caacccctgacctaccccagc

SEQ ID NO: 3622769 - DNA, 22 bp, Homo sapiens
caacccctgacctaccccagcc

SEQ ID NO: 3622770 - DNA, 20 bp, Homo sapiens
caacccgtctggcccaccag

SEQ ID NO: 3622771 - DNA, 21 bp, Homo sapiens
caacccgtctggcccaccagg

SEQ ID NO: 3622772 - DNA, 12 bp, Homo sapiens
caaccctaccct

SEQ ID NO: 3622773 - DNA, 18 bp, Homo sapiens
caaccctaccctggcagg

SEQ ID NO: 3622774 - DNA, 13 bp, Homo sapiens
caaccctcagagc

SEQ ID NO: 3622775 - DNA, 18 bp, Homo sapiens
caacccttccctcacctt

SEQ ID NO: 3622776 - DNA, 20 bp, Homo sapiens
caacctaacacattaaatgt

SEQ ID NO: 3622777 - DNA, 12 bp, Homo sapiens
caacctccagac

SEQ ID NO: 3622778 - DNA, 17 bp, Homo sapiens
caacctccagactcagc

SEQ ID NO: 3622779 - DNA, 19 bp, Homo sapiens
caacctccagactcagcag

SEQ ID NO: 3622780 - DNA, 20 bp, Homo sapiens
caacctccagtgtcagggtc

SEQ ID NO: 3622781 - DNA, 18 bp, Homo sapiens
caacctgctctcctcttg

SEQ ID NO: 3622782 - DNA, 18 bp, Homo sapiens
caacctgtgtgagagaat

SEQ ID NO: 3622783 - DNA, 22 bp, Homo sapiens
caacctgttcttagagtgtagc

SEQ ID NO: 3622784 - DNA, 17 bp, Homo sapiens
caaccttctgtggctca

SEQ ID NO: 3622785 - DNA, 14 bp, Homo sapiens
caacgcccctccaa

SEQ ID NO: 3622786 - DNA, 22 bp, Homo sapiens
caacgcccctccaaacctccag

SEQ ID NO: 3622787 - DNA, 12 bp, Homo sapiens
caacgcccctgt

SEQ ID NO: 3622788 - DNA, 15 bp, Homo sapiens
caacgcccctgtggc

SEQ ID NO: 3622789 - DNA, 16 bp, Homo sapiens
caacgcccctgtggcc

SEQ ID NO: 3622790 - DNA, 18 bp, Homo sapiens
caacgcccctgtggccaa

SEQ ID NO: 3622791 - DNA, 18 bp, Homo sapiens
caacgccgagtgcactgc

SEQ ID NO: 3622792 - DNA, 22 bp, Homo sapiens
caacgtgagagaaagagagaag

SEQ ID NO: 3622793 - DNA, 16 bp, Homo sapiens
caacgtgcaaagccaa

SEQ ID NO: 3622794 - DNA, 17 bp, Homo sapiens
caacgttgctatttcca

SEQ ID NO: 3622795 - DNA, 17 bp, Homo sapiens
caactaaataacacaga

SEQ ID NO: 3622796 - DNA, 19 bp, Homo sapiens
caactactacctgtaatga

SEQ ID NO: 3622797 - DNA, 13 bp, Homo sapiens
caactccatactc

SEQ ID NO: 3622798 - DNA, 15 bp, Homo sapiens
caactcccaacttct

SEQ ID NO: 3622799 - DNA, 13 bp, Homo sapiens
caactctagctgg

SEQ ID NO: 3622800 - DNA, 20 bp, Homo sapiens
caactgcaaaaaaagcctcc

SEQ ID NO: 3622801 - DNA, 21 bp, Homo sapiens
caactgcaaaaaaagcctcca

SEQ ID NO: 3622802 - DNA, 12 bp, Homo sapiens
caactgccctaa

SEQ ID NO: 3622803 - DNA, 22 bp, Homo sapiens
caactggggttgcgtctgaggc

SEQ ID NO: 3622804 - DNA, 21 bp, Homo sapiens
caactggttgtatatttttat

SEQ ID NO: 3622805 - DNA, 15 bp, Homo sapiens
caactgtttccctgc

SEQ ID NO: 3622806 - DNA, 18 bp, Homo sapiens
caactgtttccctgctga

SEQ ID NO: 3622807 - DNA, 15 bp, Homo sapiens
caacttccgctgagg

SEQ ID NO: 3622808 - DNA, 18 bp, Homo sapiens
caagaaactgaggaattt

SEQ ID NO: 3622809 - DNA, 19 bp, Homo sapiens
caagaaactgaggaatttt

SEQ ID NO: 3622810 - DNA, 13 bp, Homo sapiens
caagaacagaagt

SEQ ID NO: 3622811 - DNA, 21 bp, Homo sapiens
caagaagcaatgttataaagt

SEQ ID NO: 3622812 - DNA, 15 bp, Homo sapiens
caagaatactactta

SEQ ID NO: 3622813 - DNA, 13 bp, Homo sapiens
caagaatacttga

SEQ ID NO: 3622814 - DNA, 15 bp, Homo sapiens
caagacaagagctgt

SEQ ID NO: 3622815 - DNA, 23 bp, Homo sapiens
caagacaagagctgttatgctgt

SEQ ID NO: 3622816 - DNA, 20 bp, Homo sapiens
caagacagaaaagtgcctga

SEQ ID NO: 3622817 - DNA, 14 bp, Homo sapiens
caagacgaggggca

SEQ ID NO: 3622818 - DNA, 22 bp, Homo sapiens
caagacgaggggcagggaagga

SEQ ID NO: 3622819 - DNA, 22 bp, Homo sapiens
caagactgaagatggcttttcc

SEQ ID NO: 3622820 - DNA, 23 bp, Homo sapiens
caagactgaagatggcttttcct

SEQ ID NO: 3622821 - DNA, 14 bp, Homo sapiens
caagactggcccag

SEQ ID NO: 3622822 - DNA, 17 bp, Homo sapiens
caagactggcccagtgc

SEQ ID NO: 3622823 - DNA, 21 bp, Homo sapiens
caagagcatgcacatgctgtc

SEQ ID NO: 3622824 - DNA, 21 bp, Homo sapiens
caagagcgcaccattgcactc

SEQ ID NO: 3622825 - DNA, 19 bp, Homo sapiens
caagagctactcccacagc

SEQ ID NO: 3622826 - DNA, 19 bp, Homo sapiens
caagagctgttatgctgtt

SEQ ID NO: 3622827 - DNA, 13 bp, Homo sapiens
caagagggcactg

SEQ ID NO: 3622828 - DNA, 14 bp, Homo sapiens
caagagggcactgg

SEQ ID NO: 3622829 - DNA, 15 bp, Homo sapiens
caagagggcactggt

SEQ ID NO: 3622830 - DNA, 17 bp, Homo sapiens
caagattataatatttt

SEQ ID NO: 3622831 - DNA, 18 bp, Homo sapiens
caagcaaacatcaaataa

SEQ ID NO: 3622832 - DNA, 18 bp, Homo sapiens
caagcaagtcccttcaga

SEQ ID NO: 3622833 - DNA, 15 bp, Homo sapiens
caagcaatcctccta

SEQ ID NO: 3622834 - DNA, 14 bp, Homo sapiens
caagcacagccctt

SEQ ID NO: 3622835 - DNA, 14 bp, Homo sapiens
caagcaccaacctc

SEQ ID NO: 3622836 - DNA, 17 bp, Homo sapiens
caagcaccaacctccag

SEQ ID NO: 3622837 - DNA, 18 bp, Homo sapiens
caagcaccaacctccaga

SEQ ID NO: 3622838 - DNA, 22 bp, Homo sapiens
caagcagctttttattccctgc

SEQ ID NO: 3622839 - DNA, 21 bp, Homo sapiens
caagcataccaacacgagcag

SEQ ID NO: 3622840 - DNA, 17 bp, Homo sapiens
caagcatataaaatttt

SEQ ID NO: 3622841 - DNA, 16 bp, Homo sapiens
caagcatttcatgaaa

SEQ ID NO: 3622842 - DNA, 16 bp, Homo sapiens
caagccaaagagcctc

SEQ ID NO: 3622843 - DNA, 22 bp, Homo sapiens
caagccagcgggaatggcagct

SEQ ID NO: 3622844 - DNA, 14 bp, Homo sapiens
caagccagctggag

SEQ ID NO: 3622845 - DNA, 21 bp, Homo sapiens
caagccatgtataaatgtgat

SEQ ID NO: 3622846 - DNA, 17 bp, Homo sapiens
caagccccatttcctca

SEQ ID NO: 3622847 - DNA, 21 bp, Homo sapiens
caagcccctgctccagaagat

SEQ ID NO: 3622848 - DNA, 17 bp, Homo sapiens
caagccgtggcttcccg

SEQ ID NO: 3622849 - DNA, 21 bp, Homo sapiens
caagctaggccccagaggccc

SEQ ID NO: 3622850 - DNA, 22 bp, Homo sapiens
caagctaggccccagaggccct

SEQ ID NO: 3622851 - DNA, 23 bp, Homo sapiens
caagctaggccccagaggccctg

SEQ ID NO: 3622852 - DNA, 17 bp, Homo sapiens
caagctccatctccact

SEQ ID NO: 3622853 - DNA, 14 bp, Homo sapiens
caagctcctcctcc

SEQ ID NO: 3622854 - DNA, 23 bp, Homo sapiens
caagctcctcctccctgcatctg

SEQ ID NO: 3622855 - DNA, 12 bp, Homo sapiens
caagctggcaca

SEQ ID NO: 3622856 - DNA, 20 bp, Homo sapiens
caagctgtccctgcagggcc

SEQ ID NO: 3622857 - DNA, 22 bp, Homo sapiens
caagctgtccctgcagggccat

SEQ ID NO: 3622858 - DNA, 20 bp, Homo sapiens
caagctgttatttcttccct

SEQ ID NO: 3622859 - DNA, 21 bp, Homo sapiens
caagctgttatttcttccctg

SEQ ID NO: 3622860 - DNA, 22 bp, Homo sapiens
caagctgttatttcttccctgc

SEQ ID NO: 3622861 - DNA, 12 bp, Homo sapiens
caagcttcccaa

SEQ ID NO: 3622862 - DNA, 12 bp, Homo sapiens
caagctttggtt

SEQ ID NO: 3622863 - DNA, 14 bp, Homo sapiens
caagcttttgctca

SEQ ID NO: 3622864 - DNA, 15 bp, Homo sapiens
caaggaaccctcagg

SEQ ID NO: 3622865 - DNA, 19 bp, Homo sapiens
caaggaaccctcaggccac

SEQ ID NO: 3622866 - DNA, 24 bp, Homo sapiens
caaggaaccctcaggccaccctcc

SEQ ID NO: 3622867 - DNA, 23 bp, Homo sapiens
caaggaatttcttaacttcttgc

SEQ ID NO: 3622868 - DNA, 22 bp, Homo sapiens
caaggacttcctgtccagctcc

SEQ ID NO: 3622869 - DNA, 13 bp, Homo sapiens
caaggagcatcct

SEQ ID NO: 3622870 - DNA, 11 bp, Homo sapiens
caaggagctgc

SEQ ID NO: 3622871 - DNA, 20 bp, Homo sapiens
caaggagggtgagtgcaagg

SEQ ID NO: 3622872 - DNA, 16 bp, Homo sapiens
caaggatagatgctgg

SEQ ID NO: 3622873 - DNA, 13 bp, Homo sapiens
caaggattacaga

SEQ ID NO: 3622874 - DNA, 20 bp, Homo sapiens
caaggattacagaaactgat

SEQ ID NO: 3622875 - DNA, 23 bp, Homo sapiens
caaggcaaacaatcccaatcttt

SEQ ID NO: 3622876 - DNA, 13 bp, Homo sapiens
caaggcagagcct

SEQ ID NO: 3622877 - DNA, 20 bp, Homo sapiens
caaggcattctcccagctct

SEQ ID NO: 3622878 - DNA, 16 bp, Homo sapiens
caaggcccaggagacc

SEQ ID NO: 3622879 - DNA, 23 bp, Homo sapiens
caaggcccaggagacctccagct

SEQ ID NO: 3622880 - DNA, 12 bp, Homo sapiens
caaggccctgcc

SEQ ID NO: 3622881 - DNA, 14 bp, Homo sapiens
caaggcctgcttga

SEQ ID NO: 3622882 - DNA, 16 bp, Homo sapiens
caaggcctgcttgact

SEQ ID NO: 3622883 - DNA, 14 bp, Homo sapiens
caaggctctcccct

SEQ ID NO: 3622884 - DNA, 16 bp, Homo sapiens
caaggctttaaagctg

SEQ ID NO: 3622885 - DNA, 21 bp, Homo sapiens
caagggatctggtcctaccca

SEQ ID NO: 3622886 - DNA, 16 bp, Homo sapiens
caagggcataaagtaa

SEQ ID NO: 3622887 - DNA, 13 bp, Homo sapiens
caagggccctggc

SEQ ID NO: 3622888 - DNA, 14 bp, Homo sapiens
caagggctggcact

SEQ ID NO: 3622889 - DNA, 15 bp, Homo sapiens
caagggctggcactt

SEQ ID NO: 3622890 - DNA, 18 bp, Homo sapiens
caaggggaatcagaactc

SEQ ID NO: 3622891 - DNA, 11 bp, Homo sapiens
caagggtcagg

SEQ ID NO: 3622892 - DNA, 23 bp, Homo sapiens
caagggtgatgggaaagcattgt

SEQ ID NO: 3622893 - DNA, 20 bp, Homo sapiens
caaggtatacacccagttct

SEQ ID NO: 3622894 - DNA, 18 bp, Homo sapiens
caaggtggtgtgatctta

SEQ ID NO: 3622895 - DNA, 20 bp, Homo sapiens
caaggttacttaattcaact

SEQ ID NO: 3622896 - DNA, 21 bp, Homo sapiens
caaggttacttaattcaactt

SEQ ID NO: 3622897 - DNA, 20 bp, Homo sapiens
caaggtttaggctggtggcc

SEQ ID NO: 3622898 - DNA, 17 bp, Homo sapiens
caagtaaaacaaatgaa

SEQ ID NO: 3622899 - DNA, 19 bp, Homo sapiens
caagtaaaacaaatgaaat

SEQ ID NO: 3622900 - DNA, 13 bp, Homo sapiens
caagtaaaatatt

SEQ ID NO: 3622901 - DNA, 19 bp, Homo sapiens
caagtatgaataaagacac

SEQ ID NO: 3622902 - DNA, 14 bp, Homo sapiens
caagtattaagcag

SEQ ID NO: 3622903 - DNA, 17 bp, Homo sapiens
caagtattaagcagttc

SEQ ID NO: 3622904 - DNA, 15 bp, Homo sapiens
caagtccaataagac

SEQ ID NO: 3622905 - DNA, 23 bp, Homo sapiens
caagtgactctcctgcctcagcc

SEQ ID NO: 3622906 - DNA, 14 bp, Homo sapiens
caagtgattctcct

SEQ ID NO: 3622907 - DNA, 16 bp, Homo sapiens
caagtgattctcctgc

SEQ ID NO: 3622908 - DNA, 21 bp, Homo sapiens
caagtgattctcctgcctcag

SEQ ID NO: 3622909 - DNA, 21 bp, Homo sapiens
caagtggacgttaggccaggc

SEQ ID NO: 3622910 - DNA, 22 bp, Homo sapiens
caagtggacgttaggccaggcc

SEQ ID NO: 3622911 - DNA, 17 bp, Homo sapiens
caagttcatgcagctgt

SEQ ID NO: 3622912 - DNA, 18 bp, Homo sapiens
caagttctatttcttgaa

SEQ ID NO: 3622913 - DNA, 17 bp, Homo sapiens
caagttgaagactttgt

SEQ ID NO: 3622914 - DNA, 19 bp, Homo sapiens
caagttgaagactttgttt

SEQ ID NO: 3622915 - DNA, 15 bp, Homo sapiens
caagtttctagctct

SEQ ID NO: 3622916 - DNA, 12 bp, Homo sapiens
caagtttgctgc

SEQ ID NO: 3622917 - DNA, 17 bp, Homo sapiens
caagttttccatatttt

SEQ ID NO: 3622918 - DNA, 18 bp, Homo sapiens
caagttttggcagccatg

SEQ ID NO: 3622919 - DNA, 14 bp, Homo sapiens
caataaacagctcc

SEQ ID NO: 3622920 - DNA, 11 bp, Homo sapiens
caataaagcaa

SEQ ID NO: 3622921 - DNA, 14 bp, Homo sapiens
caataaatctttca

SEQ ID NO: 3622922 - DNA, 15 bp, Homo sapiens
caataaatctttcaa

SEQ ID NO: 3622923 - DNA, 11 bp, Homo sapiens
caataaattct

SEQ ID NO: 3622924 - DNA, 23 bp, Homo sapiens
caataaattttttttggtcaaat

SEQ ID NO: 3622925 - DNA, 12 bp, Homo sapiens
caataagaacaa

SEQ ID NO: 3622926 - DNA, 12 bp, Homo sapiens
caataagcaaaa

SEQ ID NO: 3622927 - DNA, 19 bp, Homo sapiens
caatagatatttacctttt

SEQ ID NO: 3622928 - DNA, 19 bp, Homo sapiens
caataggtctttctctcag

SEQ ID NO: 3622929 - DNA, 16 bp, Homo sapiens
caatagttttttactt

SEQ ID NO: 3622930 - DNA, 14 bp, Homo sapiens
caatataagagctt

SEQ ID NO: 3622931 - DNA, 13 bp, Homo sapiens
caatatagcaaga

SEQ ID NO: 3622932 - DNA, 11 bp, Homo sapiens
caatatgcaag

SEQ ID NO: 3622933 - DNA, 13 bp, Homo sapiens
caatatgcaagca

SEQ ID NO: 3622934 - DNA, 17 bp, Homo sapiens
caatatgcaagcagctt

SEQ ID NO: 3622935 - DNA, 18 bp, Homo sapiens
caatatgtgtttacttta

SEQ ID NO: 3622936 - DNA, 14 bp, Homo sapiens
caatattccttagt

SEQ ID NO: 3622937 - DNA, 17 bp, Homo sapiens
caatatttattacacaa

SEQ ID NO: 3622938 - DNA, 21 bp, Homo sapiens
caatcacagggaatggccaca

SEQ ID NO: 3622939 - DNA, 23 bp, Homo sapiens
caatccattttttaggtgcttta

SEQ ID NO: 3622940 - DNA, 17 bp, Homo sapiens
caatcccaatctttcta

SEQ ID NO: 3622941 - DNA, 15 bp, Homo sapiens
caatcgcaaatcaaa

SEQ ID NO: 3622942 - DNA, 15 bp, Homo sapiens
caatctaaaatggca

SEQ ID NO: 3622943 - DNA, 14 bp, Homo sapiens
caatctaatctgaa

SEQ ID NO: 3622944 - DNA, 23 bp, Homo sapiens
caatctgtgatgacattccctgc

SEQ ID NO: 3622945 - DNA, 14 bp, Homo sapiens
caatcttccaaaga

SEQ ID NO: 3622946 - DNA, 14 bp, Homo sapiens
caatctttctatat

SEQ ID NO: 3622947 - DNA, 14 bp, Homo sapiens
caatctttgccttt

SEQ ID NO: 3622948 - DNA, 15 bp, Homo sapiens
caatgactcaaagtc

SEQ ID NO: 3622949 - DNA, 19 bp, Homo sapiens
caatgagatcattgtgaag

SEQ ID NO: 3622950 - DNA, 13 bp, Homo sapiens
caatgatggcaat

SEQ ID NO: 3622951 - DNA, 11 bp, Homo sapiens
caatgctgctt

SEQ ID NO: 3622952 - DNA, 14 bp, Homo sapiens
caatgcttgcatgg

SEQ ID NO: 3622953 - DNA, 20 bp, Homo sapiens
caatggagactgtctcaaga

SEQ ID NO: 3622954 - DNA, 19 bp, Homo sapiens
caatgggttttaattttca

SEQ ID NO: 3622955 - DNA, 21 bp, Homo sapiens
caatgtaataaaaagcctctt

SEQ ID NO: 3622956 - DNA, 18 bp, Homo sapiens
caatgtggtgacacctcc

SEQ ID NO: 3622957 - DNA, 13 bp, Homo sapiens
caatgttggagca

SEQ ID NO: 3622958 - DNA, 20 bp, Homo sapiens
caatgttggagcagcaggcc

SEQ ID NO: 3622959 - DNA, 13 bp, Homo sapiens
caattaaacggat

SEQ ID NO: 3622960 - DNA, 14 bp, Homo sapiens
caattaaacggatt

SEQ ID NO: 3622961 - DNA, 17 bp, Homo sapiens
caattaaacggattatt

SEQ ID NO: 3622962 - DNA, 21 bp, Homo sapiens
caattagcaattgactgtcac

SEQ ID NO: 3622963 - DNA, 23 bp, Homo sapiens
caattatatctcccccactccac

SEQ ID NO: 3622964 - DNA, 14 bp, Homo sapiens
caattattggcaaa

SEQ ID NO: 3622965 - DNA, 16 bp, Homo sapiens
caattattggcaaagt

SEQ ID NO: 3622966 - DNA, 16 bp, Homo sapiens
caattatttgcatatt

SEQ ID NO: 3622967 - DNA, 20 bp, Homo sapiens
caattatttgcatattttga

SEQ ID NO: 3622968 - DNA, 17 bp, Homo sapiens
caattcatggttcaagt

SEQ ID NO: 3622969 - DNA, 22 bp, Homo sapiens
caattctgcccgctccatggaa

SEQ ID NO: 3622970 - DNA, 13 bp, Homo sapiens
caattctttcaag

SEQ ID NO: 3622971 - DNA, 14 bp, Homo sapiens
caattgaagcatga

SEQ ID NO: 3622972 - DNA, 22 bp, Homo sapiens
caattgaagcatgaacgtggat

SEQ ID NO: 3622973 - DNA, 19 bp, Homo sapiens
caattgactgtcactgttc

SEQ ID NO: 3622974 - DNA, 23 bp, Homo sapiens
caattgagaaaaatatatactaa

SEQ ID NO: 3622975 - DNA, 13 bp, Homo sapiens
caatttaaatgtt

SEQ ID NO: 3622976 - DNA, 11 bp, Homo sapiens
caatttcagca

SEQ ID NO: 3622977 - DNA, 21 bp, Homo sapiens
caatttctagtacctgtgact

SEQ ID NO: 3622978 - DNA, 18 bp, Homo sapiens
caattttacctattctga

SEQ ID NO: 3622979 - DNA, 20 bp, Homo sapiens
caattttctatttaaaaaat

SEQ ID NO: 3622980 - DNA, 19 bp, Homo sapiens
caattttctggaatacatg

SEQ ID NO: 3622981 - DNA, 12 bp, Homo sapiens
caattttgtaac

SEQ ID NO: 3622982 - DNA, 18 bp, Homo sapiens
caattttttttccgtaaa

SEQ ID NO: 3622983 - DNA, 20 bp, Homo sapiens
cacaaaactacttttctaaa

SEQ ID NO: 3622984 - DNA, 15 bp, Homo sapiens
cacaaagcagatcct

SEQ ID NO: 3622985 - DNA, 11 bp, Homo sapiens
cacaaagccca

SEQ ID NO: 3622986 - DNA, 12 bp, Homo sapiens
cacaaatacatt

SEQ ID NO: 3622987 - DNA, 19 bp, Homo sapiens
cacaacccttctctgttgg

SEQ ID NO: 3622988 - DNA, 18 bp, Homo sapiens
cacaaccttctgtggctc

SEQ ID NO: 3622989 - DNA, 15 bp, Homo sapiens
cacaactggaagctt

SEQ ID NO: 3622990 - DNA, 14 bp, Homo sapiens
cacaagactggccc

SEQ ID NO: 3622991 - DNA, 14 bp, Homo sapiens
cacaagcctcctgt

SEQ ID NO: 3622992 - DNA, 15 bp, Homo sapiens
cacaagctgtccctg

SEQ ID NO: 3622993 - DNA, 18 bp, Homo sapiens
cacaagctgtccctgcag

SEQ ID NO: 3622994 - DNA, 20 bp, Homo sapiens
cacaagctgtccctgcaggg

SEQ ID NO: 3622995 - DNA, 20 bp, Homo sapiens
cacaaggaaccctcaggcca

SEQ ID NO: 3622996 - DNA, 21 bp, Homo sapiens
cacaaggatagatgctggccc

SEQ ID NO: 3622997 - DNA, 11 bp, Homo sapiens
cacaataccta

SEQ ID NO: 3622998 - DNA, 21 bp, Homo sapiens
cacaatacctacaataaactg

SEQ ID NO: 3622999 - DNA, 22 bp, Homo sapiens
cacaatacctacaataaactgg

SEQ ID NO: 3623000 - DNA, 14 bp, Homo sapiens
cacaataggtcttt

SEQ ID NO: 3623001 - DNA, 21 bp, Homo sapiens
cacaatgttggagcagcaggc

SEQ ID NO: 3623002 - DNA, 23 bp, Homo sapiens
cacaattgaacttccaggaaagt

SEQ ID NO: 3623003 - DNA, 15 bp, Homo sapiens
cacacagacatatat

SEQ ID NO: 3623004 - DNA, 14 bp, Homo sapiens
cacacagctgccct

SEQ ID NO: 3623005 - DNA, 15 bp, Homo sapiens
cacacagctgcccta

SEQ ID NO: 3623006 - DNA, 13 bp, Homo sapiens
cacacagggcagt

SEQ ID NO: 3623007 - DNA, 23 bp, Homo sapiens
cacacagggtctgcaaggtcttt

SEQ ID NO: 3623008 - DNA, 12 bp, Homo sapiens
cacacatatata

SEQ ID NO: 3623009 - DNA, 18 bp, Homo sapiens
cacacatatataggcagt

SEQ ID NO: 3623010 - DNA, 21 bp, Homo sapiens
cacacccaccccctctggaga

SEQ ID NO: 3623011 - DNA, 22 bp, Homo sapiens
cacacccaccccctctggagaa

SEQ ID NO: 3623012 - DNA, 14 bp, Homo sapiens
cacacccatttaaa

SEQ ID NO: 3623013 - DNA, 15 bp, Homo sapiens
cacacccgcctgaca

SEQ ID NO: 3623014 - DNA, 20 bp, Homo sapiens
cacaccgagggcgaccccgt

SEQ ID NO: 3623015 - DNA, 22 bp, Homo sapiens
cacacctactagtcaccagaga

SEQ ID NO: 3623016 - DNA, 19 bp, Homo sapiens
cacacctcctcccactgcc

SEQ ID NO: 3623017 - DNA, 21 bp, Homo sapiens
cacacctcctcccactgccca

SEQ ID NO: 3623018 - DNA, 23 bp, Homo sapiens
cacacctcctcccactgcccact

SEQ ID NO: 3623019 - DNA, 16 bp, Homo sapiens
cacacctgaacttgcc

SEQ ID NO: 3623020 - DNA, 17 bp, Homo sapiens
cacacctgaatcagctg

SEQ ID NO: 3623021 - DNA, 18 bp, Homo sapiens
cacacctgaatcagctgg

SEQ ID NO: 3623022 - DNA, 15 bp, Homo sapiens
cacacctgggcattt

SEQ ID NO: 3623023 - DNA, 12 bp, Homo sapiens
cacacctggtgg

SEQ ID NO: 3623024 - DNA, 22 bp, Homo sapiens
cacacctgtaatcccagcactt

SEQ ID NO: 3623025 - DNA, 15 bp, Homo sapiens
cacacgtggctggcg

SEQ ID NO: 3623026 - DNA, 23 bp, Homo sapiens
cacactcagaaaattccctgggg

SEQ ID NO: 3623027 - DNA, 17 bp, Homo sapiens
cacactgtgcagaccca

SEQ ID NO: 3623028 - DNA, 16 bp, Homo sapiens
cacactgtgccccaca

SEQ ID NO: 3623029 - DNA, 17 bp, Homo sapiens
cacactgtggccaggcc

SEQ ID NO: 3623030 - DNA, 17 bp, Homo sapiens
cacacttcaggctcttc

SEQ ID NO: 3623031 - DNA, 13 bp, Homo sapiens
cacagaacccttg

SEQ ID NO: 3623032 - DNA, 21 bp, Homo sapiens
cacagacaagcagcccttgct

SEQ ID NO: 3623033 - DNA, 13 bp, Homo sapiens
cacagacatatat

SEQ ID NO: 3623034 - DNA, 20 bp, Homo sapiens
cacagactcaatgtgctctg

SEQ ID NO: 3623035 - DNA, 13 bp, Homo sapiens
cacagagaggagg

SEQ ID NO: 3623036 - DNA, 19 bp, Homo sapiens
cacagaggacacagagaag

SEQ ID NO: 3623037 - DNA, 20 bp, Homo sapiens
cacagatattgttataaata

SEQ ID NO: 3623038 - DNA, 21 bp, Homo sapiens
cacagatattgttataaataa

SEQ ID NO: 3623039 - DNA, 22 bp, Homo sapiens
cacagatcccggggagctgtga

SEQ ID NO: 3623040 - DNA, 18 bp, Homo sapiens
cacagcaactgacctgag

SEQ ID NO: 3623041 - DNA, 18 bp, Homo sapiens
cacagcagccccaggaga

SEQ ID NO: 3623042 - DNA, 21 bp, Homo sapiens
cacagcagttgaaaagactcc

SEQ ID NO: 3623043 - DNA, 22 bp, Homo sapiens
cacagcagttgaaaagactcca

SEQ ID NO: 3623044 - DNA, 17 bp, Homo sapiens
cacagccagactggcac

SEQ ID NO: 3623045 - DNA, 23 bp, Homo sapiens
cacagccttcggacagacatatg

SEQ ID NO: 3623046 - DNA, 18 bp, Homo sapiens
cacagccttctaaattcc

SEQ ID NO: 3623047 - DNA, 19 bp, Homo sapiens
cacagccttctaaattccc

SEQ ID NO: 3623048 - DNA, 18 bp, Homo sapiens
cacagccttctccactgg

SEQ ID NO: 3623049 - DNA, 23 bp, Homo sapiens
cacagctactcagtggggctggc

SEQ ID NO: 3623050 - DNA, 11 bp, Homo sapiens
cacagctcttc

SEQ ID NO: 3623051 - DNA, 14 bp, Homo sapiens
cacagctcttcatt

SEQ ID NO: 3623052 - DNA, 12 bp, Homo sapiens
cacagctgccct

SEQ ID NO: 3623053 - DNA, 13 bp, Homo sapiens
cacagctgcccta

SEQ ID NO: 3623054 - DNA, 18 bp, Homo sapiens
cacagctgccctagctga

SEQ ID NO: 3623055 - DNA, 21 bp, Homo sapiens
cacagctgccctagctgaccc

SEQ ID NO: 3623056 - DNA, 23 bp, Homo sapiens
cacagctggaaagttgggcccct

SEQ ID NO: 3623057 - DNA, 15 bp, Homo sapiens
cacagctgggagcct

SEQ ID NO: 3623058 - DNA, 17 bp, Homo sapiens
cacagcttcctgagggc

SEQ ID NO: 3623059 - DNA, 15 bp, Homo sapiens
cacaggactctgcct

SEQ ID NO: 3623060 - DNA, 20 bp, Homo sapiens
cacaggcacacaggtctcat

SEQ ID NO: 3623061 - DNA, 16 bp, Homo sapiens
cacaggcccttcctct

SEQ ID NO: 3623062 - DNA, 19 bp, Homo sapiens
cacaggcccttcctctcca

SEQ ID NO: 3623063 - DNA, 22 bp, Homo sapiens
cacaggcccttcctctccactg

SEQ ID NO: 3623064 - DNA, 17 bp, Homo sapiens
cacaggctgagaactcg

SEQ ID NO: 3623065 - DNA, 18 bp, Homo sapiens
cacaggcttagggacagg

SEQ ID NO: 3623066 - DNA, 17 bp, Homo sapiens
cacagggaatggccaca

SEQ ID NO: 3623067 - DNA, 22 bp, Homo sapiens
cacagggaatggccacaaacct

SEQ ID NO: 3623068 - DNA, 16 bp, Homo sapiens
cacaggggccaccacc

SEQ ID NO: 3623069 - DNA, 16 bp, Homo sapiens
cacaggttttcagaga

SEQ ID NO: 3623070 - DNA, 21 bp, Homo sapiens
cacagtaggtcccggccagct

SEQ ID NO: 3623071 - DNA, 23 bp, Homo sapiens
cacagtaggtcccggccagctct

SEQ ID NO: 3623072 - DNA, 15 bp, Homo sapiens
cacagtatctgctgt

SEQ ID NO: 3623073 - DNA, 18 bp, Homo sapiens
cacagtatctgctgttct

SEQ ID NO: 3623074 - DNA, 22 bp, Homo sapiens
cacagtatctgctgttcttcag

SEQ ID NO: 3623075 - DNA, 23 bp, Homo sapiens
cacagtattatttctccatcccc

SEQ ID NO: 3623076 - DNA, 16 bp, Homo sapiens
cacagtcttcccagca

SEQ ID NO: 3623077 - DNA, 17 bp, Homo sapiens
cacagtgcatctcagcc

SEQ ID NO: 3623078 - DNA, 14 bp, Homo sapiens
cacagtgggagctg

SEQ ID NO: 3623079 - DNA, 17 bp, Homo sapiens
cacagtgggagctgagc

SEQ ID NO: 3623080 - DNA, 19 bp, Homo sapiens
cacagtgggagctgagctg

SEQ ID NO: 3623081 - DNA, 22 bp, Homo sapiens
cacagtggggctgcaggcaggc

SEQ ID NO: 3623082 - DNA, 18 bp, Homo sapiens
cacagtggtgaccccctt

SEQ ID NO: 3623083 - DNA, 14 bp, Homo sapiens
cacagtgtgagccc

SEQ ID NO: 3623084 - DNA, 21 bp, Homo sapiens
cacagtgtgtggtcaacattt

SEQ ID NO: 3623085 - DNA, 18 bp, Homo sapiens
cacagttctttgggccag

SEQ ID NO: 3623086 - DNA, 15 bp, Homo sapiens
cacagttttctgaga

SEQ ID NO: 3623087 - DNA, 16 bp, Homo sapiens
cacagttttctgagaa

SEQ ID NO: 3623088 - DNA, 17 bp, Homo sapiens
cacagttttctgagaaa

SEQ ID NO: 3623089 - DNA, 20 bp, Homo sapiens
cacataaaagccccagcttg

SEQ ID NO: 3623090 - DNA, 23 bp, Homo sapiens
cacatcagcttgccctgttaaaa

SEQ ID NO: 3623091 - DNA, 19 bp, Homo sapiens
cacatccatcagcacccca

SEQ ID NO: 3623092 - DNA, 16 bp, Homo sapiens
cacatccttctcactg

SEQ ID NO: 3623093 - DNA, 17 bp, Homo sapiens
cacatccttctcactgc

SEQ ID NO: 3623094 - DNA, 13 bp, Homo sapiens
cacatctaagcct

SEQ ID NO: 3623095 - DNA, 17 bp, Homo sapiens
cacatcttgctctgcat

SEQ ID NO: 3623096 - DNA, 17 bp, Homo sapiens
cacatgagaatgctagc

SEQ ID NO: 3623097 - DNA, 17 bp, Homo sapiens
cacatgctgcctggcac

SEQ ID NO: 3623098 - DNA, 19 bp, Homo sapiens
cacatgctgcctggcacag

SEQ ID NO: 3623099 - DNA, 21 bp, Homo sapiens
cacatgctgcctggcacagac

SEQ ID NO: 3623100 - DNA, 17 bp, Homo sapiens
cacatgctgtctggccc

SEQ ID NO: 3623101 - DNA, 21 bp, Homo sapiens
cacatgctgtctggccctggg

SEQ ID NO: 3623102 - DNA, 22 bp, Homo sapiens
cacatggagccccctctgccgg

SEQ ID NO: 3623103 - DNA, 15 bp, Homo sapiens
cacatggcagatttg

SEQ ID NO: 3623104 - DNA, 17 bp, Homo sapiens
cacatggccatcttctt

SEQ ID NO: 3623105 - DNA, 19 bp, Homo sapiens
cacatggccatcttctttc

SEQ ID NO: 3623106 - DNA, 20 bp, Homo sapiens
cacatggccatcttctttct

SEQ ID NO: 3623107 - DNA, 19 bp, Homo sapiens
cacatggttacatatcaaa

SEQ ID NO: 3623108 - DNA, 21 bp, Homo sapiens
cacatgtattgctgtttttct

SEQ ID NO: 3623109 - DNA, 14 bp, Homo sapiens
cacatttatttggt

SEQ ID NO: 3623110 - DNA, 20 bp, Homo sapiens
cacatttgggatgttccttt

SEQ ID NO: 3623111 - DNA, 17 bp, Homo sapiens
cacatttgtcttctttc

SEQ ID NO: 3623112 - DNA, 14 bp, Homo sapiens
caccaaaaacctat

SEQ ID NO: 3623113 - DNA, 14 bp, Homo sapiens
caccaaagacatca

SEQ ID NO: 3623114 - DNA, 18 bp, Homo sapiens
caccaacctccagactca

SEQ ID NO: 3623115 - DNA, 19 bp, Homo sapiens
caccaacctccagactcag

SEQ ID NO: 3623116 - DNA, 18 bp, Homo sapiens
caccaactactacctgta

SEQ ID NO: 3623117 - DNA, 23 bp, Homo sapiens
caccaagttggaacatccttgga

SEQ ID NO: 3623118 - DNA, 20 bp, Homo sapiens
caccaataaatcagaccatg

SEQ ID NO: 3623119 - DNA, 16 bp, Homo sapiens
caccacagcattgtgt

SEQ ID NO: 3623120 - DNA, 22 bp, Homo sapiens
caccaccctgccccccctaaga

SEQ ID NO: 3623121 - DNA, 12 bp, Homo sapiens
caccactcaggc

SEQ ID NO: 3623122 - DNA, 13 bp, Homo sapiens
caccactcaggcc

SEQ ID NO: 3623123 - DNA, 20 bp, Homo sapiens
caccagaacgcaccccactg

SEQ ID NO: 3623124 - DNA, 18 bp, Homo sapiens
caccagacacccaggact

SEQ ID NO: 3623125 - DNA, 16 bp, Homo sapiens
caccagccccccgcgc

SEQ ID NO: 3623126 - DNA, 18 bp, Homo sapiens
caccagcctagcctggct

SEQ ID NO: 3623127 - DNA, 22 bp, Homo sapiens
caccagcctagcctggctctgc

SEQ ID NO: 3623128 - DNA, 18 bp, Homo sapiens
caccaggggaggagcctg

SEQ ID NO: 3623129 - DNA, 11 bp, Homo sapiens
caccagtgtta

SEQ ID NO: 3623130 - DNA, 15 bp, Homo sapiens
caccagtgttcctga

SEQ ID NO: 3623131 - DNA, 14 bp, Homo sapiens
caccataccttaga

SEQ ID NO: 3623132 - DNA, 14 bp, Homo sapiens
caccatagtcaatc

SEQ ID NO: 3623133 - DNA, 12 bp, Homo sapiens
caccatcagcct

SEQ ID NO: 3623134 - DNA, 10 bp, Homo sapiens
caccatctgc

SEQ ID NO: 3623135 - DNA, 19 bp, Homo sapiens
caccatctgctgtcttttc

SEQ ID NO: 3623136 - DNA, 16 bp, Homo sapiens
caccatctttgtcaaa

SEQ ID NO: 3623137 - DNA, 14 bp, Homo sapiens
caccatgcactcac

SEQ ID NO: 3623138 - DNA, 21 bp, Homo sapiens
caccatgcactcacccctagc

SEQ ID NO: 3623139 - DNA, 15 bp, Homo sapiens
caccatgcttgcctg

SEQ ID NO: 3623140 - DNA, 18 bp, Homo sapiens
caccatgcttgcctgaag

SEQ ID NO: 3623141 - DNA, 23 bp, Homo sapiens
caccatggcatgcgccaccatgc

SEQ ID NO: 3623142 - DNA, 19 bp, Homo sapiens
caccatgttggccaggctg

SEQ ID NO: 3623143 - DNA, 14 bp, Homo sapiens
caccattcctgcct

SEQ ID NO: 3623144 - DNA, 22 bp, Homo sapiens
caccattcctgcctttaagcca

SEQ ID NO: 3623145 - DNA, 19 bp, Homo sapiens
cacccacaaactccaggct

SEQ ID NO: 3623146 - DNA, 18 bp, Homo sapiens
cacccacacagctgccct

SEQ ID NO: 3623147 - DNA, 14 bp, Homo sapiens
cacccacagaccgc

SEQ ID NO: 3623148 - DNA, 19 bp, Homo sapiens
cacccaccccctctggaga

SEQ ID NO: 3623149 - DNA, 13 bp, Homo sapiens
cacccacctccct

SEQ ID NO: 3623150 - DNA, 14 bp, Homo sapiens
cacccacctccctg

SEQ ID NO: 3623151 - DNA, 13 bp, Homo sapiens
cacccacctctgg

SEQ ID NO: 3623152 - DNA, 15 bp, Homo sapiens
cacccagagcacccc

SEQ ID NO: 3623153 - DNA, 11 bp, Homo sapiens
cacccaggaag

SEQ ID NO: 3623154 - DNA, 11 bp, Homo sapiens
cacccatccta

SEQ ID NO: 3623155 - DNA, 18 bp, Homo sapiens
cacccatcctaggaacca

SEQ ID NO: 3623156 - DNA, 19 bp, Homo sapiens
cacccatcctaggaaccag

SEQ ID NO: 3623157 - DNA, 13 bp, Homo sapiens
caccccaaacccc

SEQ ID NO: 3623158 - DNA, 17 bp, Homo sapiens
caccccactgggagagc

SEQ ID NO: 3623159 - DNA, 19 bp, Homo sapiens
cacccccacaagctgtccc

SEQ ID NO: 3623160 - DNA, 18 bp, Homo sapiens
cacccccatgctgccttc

SEQ ID NO: 3623161 - DNA, 13 bp, Homo sapiens
caccccccactca

SEQ ID NO: 3623162 - DNA, 15 bp, Homo sapiens
cacccccctctgctg

SEQ ID NO: 3623163 - DNA, 15 bp, Homo sapiens
caccccctccccgcc

SEQ ID NO: 3623164 - DNA, 18 bp, Homo sapiens
caccccctgctccaccag

SEQ ID NO: 3623165 - DNA, 14 bp, Homo sapiens
cacccccttccctg

SEQ ID NO: 3623166 - DNA, 15 bp, Homo sapiens
caccccgagggctga

SEQ ID NO: 3623167 - DNA, 15 bp, Homo sapiens
caccccgtagattcc

SEQ ID NO: 3623168 - DNA, 15 bp, Homo sapiens
cacccctagccctgg

SEQ ID NO: 3623169 - DNA, 16 bp, Homo sapiens
cacccctagccctggt

SEQ ID NO: 3623170 - DNA, 17 bp, Homo sapiens
cacccctcactccccag

SEQ ID NO: 3623171 - DNA, 15 bp, Homo sapiens
cacccctgagccagc

SEQ ID NO: 3623172 - DNA, 18 bp, Homo sapiens
cacccctgggggctctca

SEQ ID NO: 3623173 - DNA, 16 bp, Homo sapiens
caccccttcctgggca

SEQ ID NO: 3623174 - DNA, 16 bp, Homo sapiens
cacccctttctgtccc

SEQ ID NO: 3623175 - DNA, 17 bp, Homo sapiens
cacccgggggagcccag

SEQ ID NO: 3623176 - DNA, 19 bp, Homo sapiens
cacccgggggagcccagtg

SEQ ID NO: 3623177 - DNA, 21 bp, Homo sapiens
cacccgttcccactgccctgg

SEQ ID NO: 3623178 - DNA, 17 bp, Homo sapiens
caccctcattctactga

SEQ ID NO: 3623179 - DNA, 14 bp, Homo sapiens
caccctctgggggt

SEQ ID NO: 3623180 - DNA, 19 bp, Homo sapiens
caccctctgggggtcctct

SEQ ID NO: 3623181 - DNA, 22 bp, Homo sapiens
caccctgatttaggagaagcca

SEQ ID NO: 3623182 - DNA, 22 bp, Homo sapiens
caccctgccccccctaagagac

SEQ ID NO: 3623183 - DNA, 14 bp, Homo sapiens
caccctgcgcctcc

SEQ ID NO: 3623184 - DNA, 12 bp, Homo sapiens
caccctggcctg

SEQ ID NO: 3623185 - DNA, 15 bp, Homo sapiens
caccctgggagccag

SEQ ID NO: 3623186 - DNA, 14 bp, Homo sapiens
caccgaccaactgc

SEQ ID NO: 3623187 - DNA, 23 bp, Homo sapiens
caccgaccaactgccctaagccc

SEQ ID NO: 3623188 - DNA, 12 bp, Homo sapiens
caccgcaggtgc

SEQ ID NO: 3623189 - DNA, 13 bp, Homo sapiens
caccgcaggtgct

SEQ ID NO: 3623190 - DNA, 19 bp, Homo sapiens
caccgccacgtcccagcat

SEQ ID NO: 3623191 - DNA, 13 bp, Homo sapiens
caccgcctcttcc

SEQ ID NO: 3623192 - DNA, 18 bp, Homo sapiens
caccgcttctgccttttc

SEQ ID NO: 3623193 - DNA, 23 bp, Homo sapiens
caccggccaggccgcgcccagca

SEQ ID NO: 3623194 - DNA, 13 bp, Homo sapiens
caccggtgggcag

SEQ ID NO: 3623195 - DNA, 14 bp, Homo sapiens
caccggtgggcagt

SEQ ID NO: 3623196 - DNA, 16 bp, Homo sapiens
caccggtgggcagtgg

SEQ ID NO: 3623197 - DNA, 17 bp, Homo sapiens
caccggtgggcagtggg

SEQ ID NO: 3623198 - DNA, 17 bp, Homo sapiens
caccgtacaaccccctc

SEQ ID NO: 3623199 - DNA, 19 bp, Homo sapiens
caccgtacaaccccctcca

SEQ ID NO: 3623200 - DNA, 15 bp, Homo sapiens
caccgtccaggcccc

SEQ ID NO: 3623201 - DNA, 20 bp, Homo sapiens
cacctaatccaggcagatcc

SEQ ID NO: 3623202 - DNA, 21 bp, Homo sapiens
cacctaatccaggcagatcca

SEQ ID NO: 3623203 - DNA, 22 bp, Homo sapiens
cacctaatccaggcagatccag

SEQ ID NO: 3623204 - DNA, 12 bp, Homo sapiens
cacctactgagt

SEQ ID NO: 3623205 - DNA, 15 bp, Homo sapiens
cacctagcagcctca

SEQ ID NO: 3623206 - DNA, 16 bp, Homo sapiens
cacctagcagcctcaa

SEQ ID NO: 3623207 - DNA, 19 bp, Homo sapiens
cacctatctcagccatagg

SEQ ID NO: 3623208 - DNA, 23 bp, Homo sapiens
cacctatgagatggccatgctca

SEQ ID NO: 3623209 - DNA, 12 bp, Homo sapiens
cacctcacctct

SEQ ID NO: 3623210 - DNA, 14 bp, Homo sapiens
cacctccacaccca

SEQ ID NO: 3623211 - DNA, 20 bp, Homo sapiens
cacctccacacccaccccct

SEQ ID NO: 3623212 - DNA, 12 bp, Homo sapiens
cacctcccagga

SEQ ID NO: 3623213 - DNA, 20 bp, Homo sapiens
cacctccccctttcacactg

SEQ ID NO: 3623214 - DNA, 21 bp, Homo sapiens
cacctccccctttcacactgg

SEQ ID NO: 3623215 - DNA, 12 bp, Homo sapiens
cacctccctgcc

SEQ ID NO: 3623216 - DNA, 14 bp, Homo sapiens
cacctccctgcctc

SEQ ID NO: 3623217 - DNA, 15 bp, Homo sapiens
cacctccctgcctcc

SEQ ID NO: 3623218 - DNA, 17 bp, Homo sapiens
cacctccctgcctccag

SEQ ID NO: 3623219 - DNA, 17 bp, Homo sapiens
cacctcctctgtgattt

SEQ ID NO: 3623220 - DNA, 22 bp, Homo sapiens
cacctcgctgttgtcacatctc

SEQ ID NO: 3623221 - DNA, 16 bp, Homo sapiens
cacctcggcacacact

SEQ ID NO: 3623222 - DNA, 19 bp, Homo sapiens
cacctcggcacacactgtg

SEQ ID NO: 3623223 - DNA, 12 bp, Homo sapiens
cacctctcctgc

SEQ ID NO: 3623224 - DNA, 17 bp, Homo sapiens
cacctctcctgccctgt

SEQ ID NO: 3623225 - DNA, 21 bp, Homo sapiens
cacctctgggtccttggctcc

SEQ ID NO: 3623226 - DNA, 12 bp, Homo sapiens
cacctctgtggg

SEQ ID NO: 3623227 - DNA, 11 bp, Homo sapiens
cacctgcagga

SEQ ID NO: 3623228 - DNA, 15 bp, Homo sapiens
cacctgccaccccct

SEQ ID NO: 3623229 - DNA, 22 bp, Homo sapiens
cacctgccacccccttccctgg

SEQ ID NO: 3623230 - DNA, 18 bp, Homo sapiens
cacctgcccaacctgctc

SEQ ID NO: 3623231 - DNA, 15 bp, Homo sapiens
cacctgcctccacca

SEQ ID NO: 3623232 - DNA, 18 bp, Homo sapiens
cacctgcctccaccagca

SEQ ID NO: 3623233 - DNA, 20 bp, Homo sapiens
cacctgcctccaccagcaag

SEQ ID NO: 3623234 - DNA, 14 bp, Homo sapiens
cacctgggaacaca

SEQ ID NO: 3623235 - DNA, 15 bp, Homo sapiens
cacctgggaacacag

SEQ ID NO: 3623236 - DNA, 16 bp, Homo sapiens
cacctgggaacacagt

SEQ ID NO: 3623237 - DNA, 23 bp, Homo sapiens
cacctggtcgccaatccatgctc

SEQ ID NO: 3623238 - DNA, 18 bp, Homo sapiens
cacctggtggatacctgg

SEQ ID NO: 3623239 - DNA, 16 bp, Homo sapiens
cacctgtaatcccagc

SEQ ID NO: 3623240 - DNA, 13 bp, Homo sapiens
caccttagagaag

SEQ ID NO: 3623241 - DNA, 21 bp, Homo sapiens
caccttagagaagctacccct

SEQ ID NO: 3623242 - DNA, 13 bp, Homo sapiens
caccttagctggc

SEQ ID NO: 3623243 - DNA, 13 bp, Homo sapiens
caccttcccatgc

SEQ ID NO: 3623244 - DNA, 14 bp, Homo sapiens
caccttcccatgcc

SEQ ID NO: 3623245 - DNA, 24 bp, Homo sapiens
caccttgcagaaggcaaggccctg

SEQ ID NO: 3623246 - DNA, 17 bp, Homo sapiens
caccttggcaccagaca

SEQ ID NO: 3623247 - DNA, 21 bp, Homo sapiens
caccttggggtccctccaccc

SEQ ID NO: 3623248 - DNA, 16 bp, Homo sapiens
cacctttctcctttgt

SEQ ID NO: 3623249 - DNA, 23 bp, Homo sapiens
cacctttggctggtagcagcagg

SEQ ID NO: 3623250 - DNA, 22 bp, Homo sapiens
cacgagcaggctactgtcagct

SEQ ID NO: 3623251 - DNA, 14 bp, Homo sapiens
cacgagggtctccc

SEQ ID NO: 3623252 - DNA, 23 bp, Homo sapiens
cacgagggtctcccctcctgcac

SEQ ID NO: 3623253 - DNA, 17 bp, Homo sapiens
cacgatcacaggccttg

SEQ ID NO: 3623254 - DNA, 21 bp, Homo sapiens
cacgcactctccccgctcagg

SEQ ID NO: 3623255 - DNA, 16 bp, Homo sapiens
cacgcaggcacagcag

SEQ ID NO: 3623256 - DNA, 17 bp, Homo sapiens
cacgctcaatgcccagt

SEQ ID NO: 3623257 - DNA, 16 bp, Homo sapiens
cacgctgctctgcccc

SEQ ID NO: 3623258 - DNA, 17 bp, Homo sapiens
cacgctgctctgcccca

SEQ ID NO: 3623259 - DNA, 20 bp, Homo sapiens
cacggaccatctttagcagt

SEQ ID NO: 3623260 - DNA, 16 bp, Homo sapiens
cacggatggtgcatgg

SEQ ID NO: 3623261 - DNA, 20 bp, Homo sapiens
cacggatggtgcatgggctc

SEQ ID NO: 3623262 - DNA, 13 bp, Homo sapiens
cacggcctggctg

SEQ ID NO: 3623263 - DNA, 16 bp, Homo sapiens
cacggcctggctggtg

SEQ ID NO: 3623264 - DNA, 22 bp, Homo sapiens
cacggcgggatcctccacagag

SEQ ID NO: 3623265 - DNA, 22 bp, Homo sapiens
cacggcgtggtgtgtccctgga

SEQ ID NO: 3623266 - DNA, 13 bp, Homo sapiens
cacgtgacaggct

SEQ ID NO: 3623267 - DNA, 14 bp, Homo sapiens
cacgtgacaggctc

SEQ ID NO: 3623268 - DNA, 22 bp, Homo sapiens
cacgtgacaggctcgtcagcca

SEQ ID NO: 3623269 - DNA, 15 bp, Homo sapiens
cacgtgggaaccccc

SEQ ID NO: 3623270 - DNA, 21 bp, Homo sapiens
cacgtgggaacccccctccca

SEQ ID NO: 3623271 - DNA, 15 bp, Homo sapiens
cacgtggggcccact

SEQ ID NO: 3623272 - DNA, 23 bp, Homo sapiens
cactaaaatgaggatccagggca

SEQ ID NO: 3623273 - DNA, 15 bp, Homo sapiens
cactaaagcttcaga

SEQ ID NO: 3623274 - DNA, 15 bp, Homo sapiens
cactaagagggcaga

SEQ ID NO: 3623275 - DNA, 19 bp, Homo sapiens
cactaagagggcagactgt

SEQ ID NO: 3623276 - DNA, 15 bp, Homo sapiens
cactaagcagaggag

SEQ ID NO: 3623277 - DNA, 20 bp, Homo sapiens
cactaagcagaggaggggcc

SEQ ID NO: 3623278 - DNA, 23 bp, Homo sapiens
cactaagtagaataaagaaaaac

SEQ ID NO: 3623279 - DNA, 22 bp, Homo sapiens
cactaccaaaagacattagaga

SEQ ID NO: 3623280 - DNA, 18 bp, Homo sapiens
cactactctcttcctcca

SEQ ID NO: 3623281 - DNA, 18 bp, Homo sapiens
cactagaatggataaaat

SEQ ID NO: 3623282 - DNA, 18 bp, Homo sapiens
cactagagacaaatcttt

SEQ ID NO: 3623283 - DNA, 20 bp, Homo sapiens
cactagagacaaatctttaa

SEQ ID NO: 3623284 - DNA, 20 bp, Homo sapiens
cactagggcagggacaggat

SEQ ID NO: 3623285 - DNA, 21 bp, Homo sapiens
cactagggcagggacaggata

SEQ ID NO: 3623286 - DNA, 14 bp, Homo sapiens
cactagtggaaagt

SEQ ID NO: 3623287 - DNA, 19 bp, Homo sapiens
cactatctccgttccatct

SEQ ID NO: 3623288 - DNA, 15 bp, Homo sapiens
cactattatttccta

SEQ ID NO: 3623289 - DNA, 17 bp, Homo sapiens
cactatttgcagaggct

SEQ ID NO: 3623290 - DNA, 19 bp, Homo sapiens
cactcacccctagccctgg

SEQ ID NO: 3623291 - DNA, 13 bp, Homo sapiens
cactcaggccaca

SEQ ID NO: 3623292 - DNA, 17 bp, Homo sapiens
cactcaggccacagtgg

SEQ ID NO: 3623293 - DNA, 14 bp, Homo sapiens
cactcagtgcctcc

SEQ ID NO: 3623294 - DNA, 21 bp, Homo sapiens
cactcagtgcctccacatgct

SEQ ID NO: 3623295 - DNA, 14 bp, Homo sapiens
cactcatgactgca

SEQ ID NO: 3623296 - DNA, 23 bp, Homo sapiens
cactccaagtgccccaccactcc

SEQ ID NO: 3623297 - DNA, 14 bp, Homo sapiens
cactccagacccct

SEQ ID NO: 3623298 - DNA, 23 bp, Homo sapiens
cactccagctgacagccacaccg

SEQ ID NO: 3623299 - DNA, 12 bp, Homo sapiens
cactcccaagcc

SEQ ID NO: 3623300 - DNA, 18 bp, Homo sapiens
cactccccaacccctctc

SEQ ID NO: 3623301 - DNA, 15 bp, Homo sapiens
cactccccagagctg

SEQ ID NO: 3623302 - DNA, 22 bp, Homo sapiens
cactcccctcacacacaccccc

SEQ ID NO: 3623303 - DNA, 14 bp, Homo sapiens
cactccgtctgctc

SEQ ID NO: 3623304 - DNA, 13 bp, Homo sapiens
cactcctacctgg

SEQ ID NO: 3623305 - DNA, 14 bp, Homo sapiens
cactccttgtcccc

SEQ ID NO: 3623306 - DNA, 22 bp, Homo sapiens
cactcgacccagaatggagcct

SEQ ID NO: 3623307 - DNA, 14 bp, Homo sapiens
cactctagcctggc

SEQ ID NO: 3623308 - DNA, 18 bp, Homo sapiens
cactctaggttttacaga

SEQ ID NO: 3623309 - DNA, 21 bp, Homo sapiens
cactctgggcaaagcccctca

SEQ ID NO: 3623310 - DNA, 15 bp, Homo sapiens
cactctgggctccag

SEQ ID NO: 3623311 - DNA, 22 bp, Homo sapiens
cactctgtattgaaaatggctt

SEQ ID NO: 3623312 - DNA, 12 bp, Homo sapiens
cactctgtccct

SEQ ID NO: 3623313 - DNA, 18 bp, Homo sapiens
cactctgtccctgtcctt

SEQ ID NO: 3623314 - DNA, 18 bp, Homo sapiens
cactctgttgcccaggct

SEQ ID NO: 3623315 - DNA, 17 bp, Homo sapiens
cactcttcagtgactcc

SEQ ID NO: 3623316 - DNA, 20 bp, Homo sapiens
cactcttcagtgactcctgc

SEQ ID NO: 3623317 - DNA, 21 bp, Homo sapiens
cactcttcagtgactcctgct

SEQ ID NO: 3623318 - DNA, 23 bp, Homo sapiens
cactcttcagtgactcctgctgg

SEQ ID NO: 3623319 - DNA, 23 bp, Homo sapiens
cactgaaatgaaatcttcccagt

SEQ ID NO: 3623320 - DNA, 11 bp, Homo sapiens
cactgaacagg

SEQ ID NO: 3623321 - DNA, 15 bp, Homo sapiens
cactgaactccaccg

SEQ ID NO: 3623322 - DNA, 21 bp, Homo sapiens
cactgaagtttttgaaatacc

SEQ ID NO: 3623323 - DNA, 13 bp, Homo sapiens
cactgaccagaac

SEQ ID NO: 3623324 - DNA, 15 bp, Homo sapiens
cactgaccagaacta

SEQ ID NO: 3623325 - DNA, 15 bp, Homo sapiens
cactgacttctaagt

SEQ ID NO: 3623326 - DNA, 21 bp, Homo sapiens
cactgacttctaagtaaaacc

SEQ ID NO: 3623327 - DNA, 19 bp, Homo sapiens
cactgagaaagaggcaggg

SEQ ID NO: 3623328 - DNA, 14 bp, Homo sapiens
cactgagcagggat

SEQ ID NO: 3623329 - DNA, 14 bp, Homo sapiens
cactgaggacacag

SEQ ID NO: 3623330 - DNA, 14 bp, Homo sapiens
cactgatgcaagga

SEQ ID NO: 3623331 - DNA, 16 bp, Homo sapiens
cactgattttgtaaag

SEQ ID NO: 3623332 - DNA, 22 bp, Homo sapiens
cactgcacagtgcatctcagcc

SEQ ID NO: 3623333 - DNA, 19 bp, Homo sapiens
cactgctcgtggactgtgc

SEQ ID NO: 3623334 - DNA, 19 bp, Homo sapiens
cactgctctaacagccctc

SEQ ID NO: 3623335 - DNA, 12 bp, Homo sapiens
cactgctgagct

SEQ ID NO: 3623336 - DNA, 15 bp, Homo sapiens
cactgctgagctggc

SEQ ID NO: 3623337 - DNA, 12 bp, Homo sapiens
cactgctggctg

SEQ ID NO: 3623338 - DNA, 15 bp, Homo sapiens
cactgctggctgcct

SEQ ID NO: 3623339 - DNA, 22 bp, Homo sapiens
cactggaaattgaaataaagat

SEQ ID NO: 3623340 - DNA, 23 bp, Homo sapiens
cactggattataagttctatttt

SEQ ID NO: 3623341 - DNA, 20 bp, Homo sapiens
cactggccggagtcagtgcc

SEQ ID NO: 3623342 - DNA, 22 bp, Homo sapiens
cactggcttggaacaccttggg

SEQ ID NO: 3623343 - DNA, 14 bp, Homo sapiens
cactggctttacat

SEQ ID NO: 3623344 - DNA, 15 bp, Homo sapiens
cactgggacagctgg

SEQ ID NO: 3623345 - DNA, 14 bp, Homo sapiens
cactgggagagctg

SEQ ID NO: 3623346 - DNA, 23 bp, Homo sapiens
cactggggactttatttatttct

SEQ ID NO: 3623347 - DNA, 17 bp, Homo sapiens
cactggggcgtttccta

SEQ ID NO: 3623348 - DNA, 13 bp, Homo sapiens
cactgggtgagag

SEQ ID NO: 3623349 - DNA, 14 bp, Homo sapiens
cactggtaaatgtt

SEQ ID NO: 3623350 - DNA, 22 bp, Homo sapiens
cactggtacttagagtttctgt

SEQ ID NO: 3623351 - DNA, 16 bp, Homo sapiens
cactggtatttatatt

SEQ ID NO: 3623352 - DNA, 19 bp, Homo sapiens
cactggtatttatatttca

SEQ ID NO: 3623353 - DNA, 15 bp, Homo sapiens
cactggtgaactgag

SEQ ID NO: 3623354 - DNA, 17 bp, Homo sapiens
cactggtgaactgagct

SEQ ID NO: 3623355 - DNA, 21 bp, Homo sapiens
cactggtggcccgacagcctg

SEQ ID NO: 3623356 - DNA, 19 bp, Homo sapiens
cactggtgtgaactcaccc

SEQ ID NO: 3623357 - DNA, 18 bp, Homo sapiens
cactggtgtttaggtgaa

SEQ ID NO: 3623358 - DNA, 20 bp, Homo sapiens
cactgtaagctttgttctgg

SEQ ID NO: 3623359 - DNA, 22 bp, Homo sapiens
cactgtaagctttgttctggga

SEQ ID NO: 3623360 - DNA, 17 bp, Homo sapiens
cactgtagctctaaaat

SEQ ID NO: 3623361 - DNA, 14 bp, Homo sapiens
cactgtcctccaag

SEQ ID NO: 3623362 - DNA, 18 bp, Homo sapiens
cactgtcctgggcctgca

SEQ ID NO: 3623363 - DNA, 13 bp, Homo sapiens
cactgtgaaggac

SEQ ID NO: 3623364 - DNA, 17 bp, Homo sapiens
cactgtgaaggaccctt

SEQ ID NO: 3623365 - DNA, 12 bp, Homo sapiens
cactgtggccag

SEQ ID NO: 3623366 - DNA, 14 bp, Homo sapiens
cacttaaaatacat

SEQ ID NO: 3623367 - DNA, 22 bp, Homo sapiens
cacttaaatttgttctttgttt

SEQ ID NO: 3623368 - DNA, 16 bp, Homo sapiens
cacttacactttatgc

SEQ ID NO: 3623369 - DNA, 20 bp, Homo sapiens
cacttagaaattgcatttcc

SEQ ID NO: 3623370 - DNA, 20 bp, Homo sapiens
cacttatttatgaacctgcc

SEQ ID NO: 3623371 - DNA, 15 bp, Homo sapiens
cacttcaatgcacat

SEQ ID NO: 3623372 - DNA, 21 bp, Homo sapiens
cacttcacgcccttggccatg

SEQ ID NO: 3623373 - DNA, 14 bp, Homo sapiens
cacttcaggctctt

SEQ ID NO: 3623374 - DNA, 23 bp, Homo sapiens
cacttcaggctcttctcctttca

SEQ ID NO: 3623375 - DNA, 18 bp, Homo sapiens
cacttgaggccaggagtt

SEQ ID NO: 3623376 - DNA, 16 bp, Homo sapiens
cacttgccaaaatcca

SEQ ID NO: 3623377 - DNA, 22 bp, Homo sapiens
cacttgccgcgtcgccctccca

SEQ ID NO: 3623378 - DNA, 19 bp, Homo sapiens
cacttgtgattataaaatt

SEQ ID NO: 3623379 - DNA, 12 bp, Homo sapiens
cacttgttttct

SEQ ID NO: 3623380 - DNA, 12 bp, Homo sapiens
cactttcaaaac

SEQ ID NO: 3623381 - DNA, 23 bp, Homo sapiens
cactttcagagcccccagccctg

SEQ ID NO: 3623382 - DNA, 12 bp, Homo sapiens
cactttcctcag

SEQ ID NO: 3623383 - DNA, 13 bp, Homo sapiens
cactttctggcaa

SEQ ID NO: 3623384 - DNA, 14 bp, Homo sapiens
cactttctggcaaa

SEQ ID NO: 3623385 - DNA, 14 bp, Homo sapiens
cactttgcacagct

SEQ ID NO: 3623386 - DNA, 23 bp, Homo sapiens
cactttgggaggccaaggagggc

SEQ ID NO: 3623387 - DNA, 14 bp, Homo sapiens
cactttttgaggca

SEQ ID NO: 3623388 - DNA, 15 bp, Homo sapiens
cacttttttaaatat

SEQ ID NO: 3623389 - DNA, 13 bp, Homo sapiens
cagaaaaataagt

SEQ ID NO: 3623390 - DNA, 17 bp, Homo sapiens
cagaaaaataagtcaaa

SEQ ID NO: 3623391 - DNA, 15 bp, Homo sapiens
cagaaaacagggtct

SEQ ID NO: 3623392 - DNA, 16 bp, Homo sapiens
cagaaaacagggtctg

SEQ ID NO: 3623393 - DNA, 13 bp, Homo sapiens
cagaaaagtgcct

SEQ ID NO: 3623394 - DNA, 15 bp, Homo sapiens
cagaaaagtgcctga

SEQ ID NO: 3623395 - DNA, 18 bp, Homo sapiens
cagaaacaaaaacactaa

SEQ ID NO: 3623396 - DNA, 11 bp, Homo sapiens
cagaaaccttt

SEQ ID NO: 3623397 - DNA, 13 bp, Homo sapiens
cagaaactgatgc

SEQ ID NO: 3623398 - DNA, 19 bp, Homo sapiens
cagaaactgttcccacctg

SEQ ID NO: 3623399 - DNA, 23 bp, Homo sapiens
cagaaagcctcctgccccctgcc

SEQ ID NO: 3623400 - DNA, 21 bp, Homo sapiens
cagaaagcttcatccacagcc

SEQ ID NO: 3623401 - DNA, 18 bp, Homo sapiens
cagaaaggtgtgaggaga

SEQ ID NO: 3623402 - DNA, 18 bp, Homo sapiens
cagaaagtaagcatttcc

SEQ ID NO: 3623403 - DNA, 15 bp, Homo sapiens
cagaaataaatcaca

SEQ ID NO: 3623404 - DNA, 22 bp, Homo sapiens
cagaaataaatcacagatgcat

SEQ ID NO: 3623405 - DNA, 13 bp, Homo sapiens
cagaacaaaactt

SEQ ID NO: 3623406 - DNA, 15 bp, Homo sapiens
cagaacaaaacttct

SEQ ID NO: 3623407 - DNA, 16 bp, Homo sapiens
cagaacattcagctct

SEQ ID NO: 3623408 - DNA, 19 bp, Homo sapiens
cagaacattcagctctgga

SEQ ID NO: 3623409 - DNA, 23 bp, Homo sapiens
cagaacattcagctctggagaac

SEQ ID NO: 3623410 - DNA, 16 bp, Homo sapiens
cagaaccaaagctcaa

SEQ ID NO: 3623411 - DNA, 23 bp, Homo sapiens
cagaacctctaagtgctgctgtg

SEQ ID NO: 3623412 - DNA, 17 bp, Homo sapiens
cagaaccttcaacccag

SEQ ID NO: 3623413 - DNA, 16 bp, Homo sapiens
cagaacgcaccccact

SEQ ID NO: 3623414 - DNA, 22 bp, Homo sapiens
cagaacgtggtttgcctgaggc

SEQ ID NO: 3623415 - DNA, 21 bp, Homo sapiens
cagaactcaaatggggccaga

SEQ ID NO: 3623416 - DNA, 19 bp, Homo sapiens
cagaactcggtgtccccac

SEQ ID NO: 3623417 - DNA, 13 bp, Homo sapiens
cagaactgccctt

SEQ ID NO: 3623418 - DNA, 14 bp, Homo sapiens
cagaactgcccttg

SEQ ID NO: 3623419 - DNA, 17 bp, Homo sapiens
cagaactgcccttgctg

SEQ ID NO: 3623420 - DNA, 18 bp, Homo sapiens
cagaactgcccttgctgc

SEQ ID NO: 3623421 - DNA, 22 bp, Homo sapiens
cagaactgcccttgctgcccgc

SEQ ID NO: 3623422 - DNA, 17 bp, Homo sapiens
cagaagatgccagcttc

SEQ ID NO: 3623423 - DNA, 21 bp, Homo sapiens
cagaagatgccagcttctctc

SEQ ID NO: 3623424 - DNA, 12 bp, Homo sapiens
cagaagctgtgg

SEQ ID NO: 3623425 - DNA, 17 bp, Homo sapiens
cagaaggaaagaagggg

SEQ ID NO: 3623426 - DNA, 17 bp, Homo sapiens
cagaaggcaaggccctg

SEQ ID NO: 3623427 - DNA, 18 bp, Homo sapiens
cagaaggccccagagaga

SEQ ID NO: 3623428 - DNA, 20 bp, Homo sapiens
cagaagtcacacattacaaa

SEQ ID NO: 3623429 - DNA, 19 bp, Homo sapiens
cagaagtttctcagctccc

SEQ ID NO: 3623430 - DNA, 15 bp, Homo sapiens
cagaatgaccttgag

SEQ ID NO: 3623431 - DNA, 16 bp, Homo sapiens
cagaatgaccttgagt

SEQ ID NO: 3623432 - DNA, 19 bp, Homo sapiens
cagaatttgggttctgcct

SEQ ID NO: 3623433 - DNA, 17 bp, Homo sapiens
cagacaagcagcccttg

SEQ ID NO: 3623434 - DNA, 12 bp, Homo sapiens
cagacacagctc

SEQ ID NO: 3623435 - DNA, 15 bp, Homo sapiens
cagacacaggccctc

SEQ ID NO: 3623436 - DNA, 12 bp, Homo sapiens
cagacacccagg

SEQ ID NO: 3623437 - DNA, 13 bp, Homo sapiens
cagacacccagga

SEQ ID NO: 3623438 - DNA, 17 bp, Homo sapiens
cagacagcttacaggag

SEQ ID NO: 3623439 - DNA, 19 bp, Homo sapiens
cagacagcttacaggagcc

SEQ ID NO: 3623440 - DNA, 20 bp, Homo sapiens
cagacagcttacaggagcca

SEQ ID NO: 3623441 - DNA, 20 bp, Homo sapiens
cagacatggaggggatgata

SEQ ID NO: 3623442 - DNA, 23 bp, Homo sapiens
cagacatggtggggtctcctcag

SEQ ID NO: 3623443 - DNA, 14 bp, Homo sapiens
cagaccacttgcca

SEQ ID NO: 3623444 - DNA, 17 bp, Homo sapiens
cagaccagctggcgggt

SEQ ID NO: 3623445 - DNA, 15 bp, Homo sapiens
cagacccagtcccac

SEQ ID NO: 3623446 - DNA, 18 bp, Homo sapiens
cagaccccacgctgacca

SEQ ID NO: 3623447 - DNA, 15 bp, Homo sapiens
cagacccctggcttt

SEQ ID NO: 3623448 - DNA, 23 bp, Homo sapiens
cagacccctggcttttcactgct

SEQ ID NO: 3623449 - DNA, 13 bp, Homo sapiens
cagacccctggga

SEQ ID NO: 3623450 - DNA, 13 bp, Homo sapiens
cagaccgccgtct

SEQ ID NO: 3623451 - DNA, 22 bp, Homo sapiens
cagacctgatcctggaggccca

SEQ ID NO: 3623452 - DNA, 13 bp, Homo sapiens
cagacctggagct

SEQ ID NO: 3623453 - DNA, 16 bp, Homo sapiens
cagacctggagcttca

SEQ ID NO: 3623454 - DNA, 22 bp, Homo sapiens
cagacctggagcttcagccagg

SEQ ID NO: 3623455 - DNA, 20 bp, Homo sapiens
cagacgccaggcaccacagc

SEQ ID NO: 3623456 - DNA, 22 bp, Homo sapiens
cagacgccaggcaccacagcct

SEQ ID NO: 3623457 - DNA, 16 bp, Homo sapiens
cagacggtctgtgtgc

SEQ ID NO: 3623458 - DNA, 16 bp, Homo sapiens
cagactaaaaatacac

SEQ ID NO: 3623459 - DNA, 17 bp, Homo sapiens
cagactcaatgtgctct

SEQ ID NO: 3623460 - DNA, 23 bp, Homo sapiens
cagactcactgggaagctcccac

SEQ ID NO: 3623461 - DNA, 15 bp, Homo sapiens
cagactcagcagagt

SEQ ID NO: 3623462 - DNA, 14 bp, Homo sapiens
cagactccatctct

SEQ ID NO: 3623463 - DNA, 15 bp, Homo sapiens
cagactccatctctt

SEQ ID NO: 3623464 - DNA, 19 bp, Homo sapiens
cagactccatctcttctgc

SEQ ID NO: 3623465 - DNA, 18 bp, Homo sapiens
cagactcccattcctgaa

SEQ ID NO: 3623466 - DNA, 19 bp, Homo sapiens
cagactctttaataaattg

SEQ ID NO: 3623467 - DNA, 17 bp, Homo sapiens
cagactgaactcgcagg

SEQ ID NO: 3623468 - DNA, 19 bp, Homo sapiens
cagactgaactcgcaggga

SEQ ID NO: 3623469 - DNA, 22 bp, Homo sapiens
cagactgacccccatctgagct

SEQ ID NO: 3623470 - DNA, 17 bp, Homo sapiens
cagactgatagacacca

SEQ ID NO: 3623471 - DNA, 19 bp, Homo sapiens
cagactgatagacaccata

SEQ ID NO: 3623472 - DNA, 18 bp, Homo sapiens
cagactgcgatttgtccc

SEQ ID NO: 3623473 - DNA, 17 bp, Homo sapiens
cagactggcacagtttt

SEQ ID NO: 3623474 - DNA, 18 bp, Homo sapiens
cagactggcacagttttc

SEQ ID NO: 3623475 - DNA, 23 bp, Homo sapiens
cagactggcacagttttctgaga

SEQ ID NO: 3623476 - DNA, 16 bp, Homo sapiens
cagactgggcactggg

SEQ ID NO: 3623477 - DNA, 19 bp, Homo sapiens
cagactggtttgggcaagc

SEQ ID NO: 3623478 - DNA, 22 bp, Homo sapiens
cagactgtgtttaactgctgca

SEQ ID NO: 3623479 - DNA, 17 bp, Homo sapiens
cagacttgtatattcta

SEQ ID NO: 3623480 - DNA, 21 bp, Homo sapiens
cagagaaaacccggagcaagc

SEQ ID NO: 3623481 - DNA, 16 bp, Homo sapiens
cagagaaagcaaaggt

SEQ ID NO: 3623482 - DNA, 11 bp, Homo sapiens
cagagaacatc

SEQ ID NO: 3623483 - DNA, 14 bp, Homo sapiens
cagagaacctgctc

SEQ ID NO: 3623484 - DNA, 17 bp, Homo sapiens
cagagaagtttgtagcc

SEQ ID NO: 3623485 - DNA, 20 bp, Homo sapiens
cagagaagtttgtagccagg

SEQ ID NO: 3623486 - DNA, 15 bp, Homo sapiens
cagagaatttctacc

SEQ ID NO: 3623487 - DNA, 16 bp, Homo sapiens
cagagaatttctacca

SEQ ID NO: 3623488 - DNA, 23 bp, Homo sapiens
cagagaatttctaccatttcaga

SEQ ID NO: 3623489 - DNA, 23 bp, Homo sapiens
cagagacactgttgataaaaact

SEQ ID NO: 3623490 - DNA, 19 bp, Homo sapiens
cagagacatacttgaaggg

SEQ ID NO: 3623491 - DNA, 17 bp, Homo sapiens
cagagaccataagagaa

SEQ ID NO: 3623492 - DNA, 18 bp, Homo sapiens
cagagaccataagagaaa

SEQ ID NO: 3623493 - DNA, 16 bp, Homo sapiens
cagagagaccctgcaa

SEQ ID NO: 3623494 - DNA, 17 bp, Homo sapiens
cagagagaccctgcaag

SEQ ID NO: 3623495 - DNA, 12 bp, Homo sapiens
cagagagggaag

SEQ ID NO: 3623496 - DNA, 20 bp, Homo sapiens
cagagaggtagcactctcag

SEQ ID NO: 3623497 - DNA, 20 bp, Homo sapiens
cagagagtggagagagcagg

SEQ ID NO: 3623498 - DNA, 14 bp, Homo sapiens
cagagagtggctcc

SEQ ID NO: 3623499 - DNA, 22 bp, Homo sapiens
cagagatagtggggagacttct

SEQ ID NO: 3623500 - DNA, 19 bp, Homo sapiens
cagagatccaaaagaagcc

SEQ ID NO: 3623501 - DNA, 20 bp, Homo sapiens
cagagatccaaaagaagccc

SEQ ID NO: 3623502 - DNA, 21 bp, Homo sapiens
cagagatccaaaagaagcccc

SEQ ID NO: 3623503 - DNA, 14 bp, Homo sapiens
cagagcaaaataat

SEQ ID NO: 3623504 - DNA, 13 bp, Homo sapiens
cagagccagcctg

SEQ ID NO: 3623505 - DNA, 22 bp, Homo sapiens
cagagccagcctggctctgccc

SEQ ID NO: 3623506 - DNA, 23 bp, Homo sapiens
cagagccagcctggctctgcccc

SEQ ID NO: 3623507 - DNA, 14 bp, Homo sapiens
cagagcccagctcc

SEQ ID NO: 3623508 - DNA, 17 bp, Homo sapiens
cagagcccccagccctg

SEQ ID NO: 3623509 - DNA, 14 bp, Homo sapiens
cagagccgggagga

SEQ ID NO: 3623510 - DNA, 15 bp, Homo sapiens
cagagcctcctggga

SEQ ID NO: 3623511 - DNA, 16 bp, Homo sapiens
cagagcctcctgggaa

SEQ ID NO: 3623512 - DNA, 23 bp, Homo sapiens
cagagcctttttacctggcctag

SEQ ID NO: 3623513 - DNA, 20 bp, Homo sapiens
cagagcgaggaaaggatttt

SEQ ID NO: 3623514 - DNA, 11 bp, Homo sapiens
cagagctgtgc

SEQ ID NO: 3623515 - DNA, 14 bp, Homo sapiens
cagaggaaatctgt

SEQ ID NO: 3623516 - DNA, 17 bp, Homo sapiens
cagaggaatttatacct

SEQ ID NO: 3623517 - DNA, 18 bp, Homo sapiens
cagaggaatttatacctc

SEQ ID NO: 3623518 - DNA, 20 bp, Homo sapiens
cagaggagaaagtggaaaat

SEQ ID NO: 3623519 - DNA, 20 bp, Homo sapiens
cagaggagaacttgctgcct

SEQ ID NO: 3623520 - DNA, 18 bp, Homo sapiens
cagaggagccaccagttc

SEQ ID NO: 3623521 - DNA, 17 bp, Homo sapiens
cagaggagcgcaggcag

SEQ ID NO: 3623522 - DNA, 18 bp, Homo sapiens
cagaggagcgcaggcagc

SEQ ID NO: 3623523 - DNA, 13 bp, Homo sapiens
cagaggaggggcc

SEQ ID NO: 3623524 - DNA, 14 bp, Homo sapiens
cagaggaggggccg

SEQ ID NO: 3623525 - DNA, 14 bp, Homo sapiens
cagaggccagaccc

SEQ ID NO: 3623526 - DNA, 13 bp, Homo sapiens
cagaggccccagc

SEQ ID NO: 3623527 - DNA, 14 bp, Homo sapiens
cagaggccccagcc

SEQ ID NO: 3623528 - DNA, 16 bp, Homo sapiens
cagaggccccagcctc

SEQ ID NO: 3623529 - DNA, 12 bp, Homo sapiens
cagaggccctgg

SEQ ID NO: 3623530 - DNA, 13 bp, Homo sapiens
cagaggccctgga

SEQ ID NO: 3623531 - DNA, 16 bp, Homo sapiens
cagaggccctggaggt

SEQ ID NO: 3623532 - DNA, 21 bp, Homo sapiens
cagaggcctgctgccagtgca

SEQ ID NO: 3623533 - DNA, 23 bp, Homo sapiens
cagaggcctgctgccagtgcagc

SEQ ID NO: 3623534 - DNA, 19 bp, Homo sapiens
cagaggcgtactacccagc

SEQ ID NO: 3623535 - DNA, 21 bp, Homo sapiens
cagaggctcagattgtaatat

SEQ ID NO: 3623536 - DNA, 21 bp, Homo sapiens
cagaggctcctctcaggctgg

SEQ ID NO: 3623537 - DNA, 22 bp, Homo sapiens
cagagggggagtagccaagctg

SEQ ID NO: 3623538 - DNA, 16 bp, Homo sapiens
cagagggtgtcaaaca

SEQ ID NO: 3623539 - DNA, 18 bp, Homo sapiens
cagagggttgctggtcct

SEQ ID NO: 3623540 - DNA, 16 bp, Homo sapiens
cagaggtttgaaggag

SEQ ID NO: 3623541 - DNA, 18 bp, Homo sapiens
cagaggtttgaaggagaa

SEQ ID NO: 3623542 - DNA, 22 bp, Homo sapiens
cagaggtttgaaggagaatggc

SEQ ID NO: 3623543 - DNA, 18 bp, Homo sapiens
cagagtccaatttaagga

SEQ ID NO: 3623544 - DNA, 13 bp, Homo sapiens
cagagtcccccca

SEQ ID NO: 3623545 - DNA, 22 bp, Homo sapiens
cagagtccccccactcccagca

SEQ ID NO: 3623546 - DNA, 20 bp, Homo sapiens
cagagtcttcactaaccttt

SEQ ID NO: 3623547 - DNA, 23 bp, Homo sapiens
cagagtgcaagcccctgctccag

SEQ ID NO: 3623548 - DNA, 13 bp, Homo sapiens
cagagtgctggga

SEQ ID NO: 3623549 - DNA, 18 bp, Homo sapiens
cagagtggcctccctgct

SEQ ID NO: 3623550 - DNA, 19 bp, Homo sapiens
cagagtggcctccctgctg

SEQ ID NO: 3623551 - DNA, 17 bp, Homo sapiens
cagagtggcgtggcctc

SEQ ID NO: 3623552 - DNA, 18 bp, Homo sapiens
cagagtggcgtggcctcc

SEQ ID NO: 3623553 - DNA, 23 bp, Homo sapiens
cagagtgggccccgggctggaga

SEQ ID NO: 3623554 - DNA, 17 bp, Homo sapiens
cagagtgttttgaccag

SEQ ID NO: 3623555 - DNA, 22 bp, Homo sapiens
cagagtgttttgaccagtttaa

SEQ ID NO: 3623556 - DNA, 13 bp, Homo sapiens
cagagttacagtt

SEQ ID NO: 3623557 - DNA, 15 bp, Homo sapiens
cagagttacagttct

SEQ ID NO: 3623558 - DNA, 16 bp, Homo sapiens
cagagttacagttctg

SEQ ID NO: 3623559 - DNA, 17 bp, Homo sapiens
cagagttacagttctgt

SEQ ID NO: 3623560 - DNA, 16 bp, Homo sapiens
cagataacttagctta

SEQ ID NO: 3623561 - DNA, 17 bp, Homo sapiens
cagatatatttaagcct

SEQ ID NO: 3623562 - DNA, 12 bp, Homo sapiens
cagatattttat

SEQ ID NO: 3623563 - DNA, 23 bp, Homo sapiens
cagatcagaacatgaaatgccct

SEQ ID NO: 3623564 - DNA, 23 bp, Homo sapiens
cagatcattatcagcctgtgcca

SEQ ID NO: 3623565 - DNA, 12 bp, Homo sapiens
cagatccagcct

SEQ ID NO: 3623566 - DNA, 15 bp, Homo sapiens
cagatccagcctggg

SEQ ID NO: 3623567 - DNA, 17 bp, Homo sapiens
cagatccagcctggggt

SEQ ID NO: 3623568 - DNA, 15 bp, Homo sapiens
cagatccagggacag

SEQ ID NO: 3623569 - DNA, 12 bp, Homo sapiens
cagatcctttca

SEQ ID NO: 3623570 - DNA, 13 bp, Homo sapiens
cagatctcccaca

SEQ ID NO: 3623571 - DNA, 19 bp, Homo sapiens
cagatctggaacctcagcc

SEQ ID NO: 3623572 - DNA, 21 bp, Homo sapiens
cagatctggaacctcagcctg

SEQ ID NO: 3623573 - DNA, 14 bp, Homo sapiens
cagatgcaatgact

SEQ ID NO: 3623574 - DNA, 16 bp, Homo sapiens
cagatgctgagccata

SEQ ID NO: 3623575 - DNA, 19 bp, Homo sapiens
cagatggaaaattcatttt

SEQ ID NO: 3623576 - DNA, 15 bp, Homo sapiens
cagattcaggccagc

SEQ ID NO: 3623577 - DNA, 16 bp, Homo sapiens
cagattcaggccagcc

SEQ ID NO: 3623578 - DNA, 17 bp, Homo sapiens
cagattcaggccagccc

SEQ ID NO: 3623579 - DNA, 22 bp, Homo sapiens
cagattcaggccagcccagcca

SEQ ID NO: 3623580 - DNA, 13 bp, Homo sapiens
cagattcccttcc

SEQ ID NO: 3623581 - DNA, 13 bp, Homo sapiens
cagattctcttga

SEQ ID NO: 3623582 - DNA, 21 bp, Homo sapiens
cagattggcacccctttctag

SEQ ID NO: 3623583 - DNA, 22 bp, Homo sapiens
cagattggcacccctttctagt

SEQ ID NO: 3623584 - DNA, 19 bp, Homo sapiens
cagattttttacagctgcc

SEQ ID NO: 3623585 - DNA, 22 bp, Homo sapiens
cagattttttacagctgcctgc

SEQ ID NO: 3623586 - DNA, 22 bp, Homo sapiens
cagcaaaagatgtgcaaaatca

SEQ ID NO: 3623587 - DNA, 10 bp, Homo sapiens
cagcaaccct

SEQ ID NO: 3623588 - DNA, 20 bp, Homo sapiens
cagcaaccctacagtatata

SEQ ID NO: 3623589 - DNA, 18 bp, Homo sapiens
cagcaacccttcctgctg

SEQ ID NO: 3623590 - DNA, 23 bp, Homo sapiens
cagcaacgcaggcccccaggtgc

SEQ ID NO: 3623591 - DNA, 13 bp, Homo sapiens
cagcaacgcccct

SEQ ID NO: 3623592 - DNA, 18 bp, Homo sapiens
cagcaacgcccctccaaa

SEQ ID NO: 3623593 - DNA, 13 bp, Homo sapiens
cagcaactgacct

SEQ ID NO: 3623594 - DNA, 14 bp, Homo sapiens
cagcaactgacctg

SEQ ID NO: 3623595 - DNA, 14 bp, Homo sapiens
cagcaagcgggagc

SEQ ID NO: 3623596 - DNA, 20 bp, Homo sapiens
cagcaagcgggagcccgtgg

SEQ ID NO: 3623597 - DNA, 19 bp, Homo sapiens
cagcaagggtgatgggaaa

SEQ ID NO: 3623598 - DNA, 17 bp, Homo sapiens
cagcaattcatggttca

SEQ ID NO: 3623599 - DNA, 15 bp, Homo sapiens
cagcaatttaaatgt

SEQ ID NO: 3623600 - DNA, 16 bp, Homo sapiens
cagcaatttaaatgtt

SEQ ID NO: 3623601 - DNA, 12 bp, Homo sapiens
cagcaatttaga

SEQ ID NO: 3623602 - DNA, 23 bp, Homo sapiens
cagcacagtaggtcccggccagc

SEQ ID NO: 3623603 - DNA, 12 bp, Homo sapiens
cagcaccccagt

SEQ ID NO: 3623604 - DNA, 23 bp, Homo sapiens
cagcacggcgtggtgtgtccctg

SEQ ID NO: 3623605 - DNA, 22 bp, Homo sapiens
cagcactccccagagctgtgcc

SEQ ID NO: 3623606 - DNA, 17 bp, Homo sapiens
cagcactttgggaggct

SEQ ID NO: 3623607 - DNA, 22 bp, Homo sapiens
cagcactttgggaggctgaggc

SEQ ID NO: 3623608 - DNA, 12 bp, Homo sapiens
cagcagagcatt

SEQ ID NO: 3623609 - DNA, 23 bp, Homo sapiens
cagcagagggggagtagccaagc

SEQ ID NO: 3623610 - DNA, 18 bp, Homo sapiens
cagcagcaccaaccacag

SEQ ID NO: 3623611 - DNA, 17 bp, Homo sapiens
cagcagccccaggagaa

SEQ ID NO: 3623612 - DNA, 23 bp, Homo sapiens
cagcagccccccttgccccacct

SEQ ID NO: 3623613 - DNA, 13 bp, Homo sapiens
cagcagcccctgc

SEQ ID NO: 3623614 - DNA, 15 bp, Homo sapiens
cagcagctgatgctg

SEQ ID NO: 3623615 - DNA, 13 bp, Homo sapiens
cagcagctgcagg

SEQ ID NO: 3623616 - DNA, 15 bp, Homo sapiens
cagcaggaaggaccc

SEQ ID NO: 3623617 - DNA, 21 bp, Homo sapiens
cagcaggagagactgagcagc

SEQ ID NO: 3623618 - DNA, 11 bp, Homo sapiens
cagcaggcaga

SEQ ID NO: 3623619 - DNA, 11 bp, Homo sapiens
cagcaggccca

SEQ ID NO: 3623620 - DNA, 12 bp, Homo sapiens
cagcaggcctct

SEQ ID NO: 3623621 - DNA, 23 bp, Homo sapiens
cagcagggaaaatgcagcaggga

SEQ ID NO: 3623622 - DNA, 22 bp, Homo sapiens
cagcagggatgccctggaggtg

SEQ ID NO: 3623623 - DNA, 17 bp, Homo sapiens
cagcagtctaaattttc

SEQ ID NO: 3623624 - DNA, 15 bp, Homo sapiens
cagcagtctccttca

SEQ ID NO: 3623625 - DNA, 20 bp, Homo sapiens
cagcagtctccttcagcacg

SEQ ID NO: 3623626 - DNA, 17 bp, Homo sapiens
cagcagttgaaaagact

SEQ ID NO: 3623627 - DNA, 18 bp, Homo sapiens
cagcagtttccagagagt

SEQ ID NO: 3623628 - DNA, 19 bp, Homo sapiens
cagcagtttccagagagtg

SEQ ID NO: 3623629 - DNA, 21 bp, Homo sapiens
cagcagtttccagagagtgga

SEQ ID NO: 3623630 - DNA, 17 bp, Homo sapiens
cagcatccagtgtgaga

SEQ ID NO: 3623631 - DNA, 13 bp, Homo sapiens
cagcatccctgga

SEQ ID NO: 3623632 - DNA, 22 bp, Homo sapiens
cagcatcgggagcacccagagc

SEQ ID NO: 3623633 - DNA, 15 bp, Homo sapiens
cagcatctcccagca

SEQ ID NO: 3623634 - DNA, 14 bp, Homo sapiens
cagcatgcttgggc

SEQ ID NO: 3623635 - DNA, 13 bp, Homo sapiens
cagcatggaaaaa

SEQ ID NO: 3623636 - DNA, 14 bp, Homo sapiens
cagcattgtgtgga

SEQ ID NO: 3623637 - DNA, 15 bp, Homo sapiens
cagcattgtgtggaa

SEQ ID NO: 3623638 - DNA, 18 bp, Homo sapiens
cagcattttagaaactac

SEQ ID NO: 3623639 - DNA, 21 bp, Homo sapiens
cagcattttagaaactacaaa

SEQ ID NO: 3623640 - DNA, 13 bp, Homo sapiens
cagccacagaccc

SEQ ID NO: 3623641 - DNA, 17 bp, Homo sapiens
cagccacagacccctgg

SEQ ID NO: 3623642 - DNA, 14 bp, Homo sapiens
cagccactccccag

SEQ ID NO: 3623643 - DNA, 22 bp, Homo sapiens
cagccagaccccacgctgacca

SEQ ID NO: 3623644 - DNA, 14 bp, Homo sapiens
cagccagactggca

SEQ ID NO: 3623645 - DNA, 20 bp, Homo sapiens
cagccagactggcacagttt

SEQ ID NO: 3623646 - DNA, 20 bp, Homo sapiens
cagccagaggaggccggtga

SEQ ID NO: 3623647 - DNA, 12 bp, Homo sapiens
cagccagcagag

SEQ ID NO: 3623648 - DNA, 15 bp, Homo sapiens
cagccagcagagggg

SEQ ID NO: 3623649 - DNA, 15 bp, Homo sapiens
cagccagcccttccc

SEQ ID NO: 3623650 - DNA, 22 bp, Homo sapiens
cagccagcctcagaaggcccca

SEQ ID NO: 3623651 - DNA, 14 bp, Homo sapiens
cagccagcctggct

SEQ ID NO: 3623652 - DNA, 16 bp, Homo sapiens
cagccagcctggctgg

SEQ ID NO: 3623653 - DNA, 16 bp, Homo sapiens
cagccaggccaacagc

SEQ ID NO: 3623654 - DNA, 12 bp, Homo sapiens
cagccaggctcc

SEQ ID NO: 3623655 - DNA, 12 bp, Homo sapiens
cagccaggtctg

SEQ ID NO: 3623656 - DNA, 22 bp, Homo sapiens
cagccatagtttgggtattttt

SEQ ID NO: 3623657 - DNA, 18 bp, Homo sapiens
cagcccaaacctgggaag

SEQ ID NO: 3623658 - DNA, 21 bp, Homo sapiens
cagcccagagacatacttgaa

SEQ ID NO: 3623659 - DNA, 13 bp, Homo sapiens
cagcccagcaccc

SEQ ID NO: 3623660 - DNA, 14 bp, Homo sapiens
cagcccagggccta

SEQ ID NO: 3623661 - DNA, 13 bp, Homo sapiens
cagccccaggaga

SEQ ID NO: 3623662 - DNA, 22 bp, Homo sapiens
cagccccccttgccccacctcc

SEQ ID NO: 3623663 - DNA, 16 bp, Homo sapiens
cagcccgacagtgcca

SEQ ID NO: 3623664 - DNA, 18 bp, Homo sapiens
cagcccgacagtgccatc

SEQ ID NO: 3623665 - DNA, 21 bp, Homo sapiens
cagcccgacagtgccatcccc

SEQ ID NO: 3623666 - DNA, 18 bp, Homo sapiens
cagccctccctgcccctc

SEQ ID NO: 3623667 - DNA, 15 bp, Homo sapiens
cagccctgcaccatg

SEQ ID NO: 3623668 - DNA, 11 bp, Homo sapiens
cagccctgctt

SEQ ID NO: 3623669 - DNA, 21 bp, Homo sapiens
cagccctgctttgggctgccc

SEQ ID NO: 3623670 - DNA, 12 bp, Homo sapiens
cagccctggcaa

SEQ ID NO: 3623671 - DNA, 21 bp, Homo sapiens
cagccctggcaaatgcctgac

SEQ ID NO: 3623672 - DNA, 20 bp, Homo sapiens
cagccctgggaaccactccc

SEQ ID NO: 3623673 - DNA, 16 bp, Homo sapiens
cagccgtgccttcagc

SEQ ID NO: 3623674 - DNA, 21 bp, Homo sapiens
cagcctaccgctggccctgcc

SEQ ID NO: 3623675 - DNA, 21 bp, Homo sapiens
cagcctcagaaggccccagag

SEQ ID NO: 3623676 - DNA, 23 bp, Homo sapiens
cagcctcagaaggccccagagag

SEQ ID NO: 3623677 - DNA, 22 bp, Homo sapiens
cagcctcagggacgactctgac

SEQ ID NO: 3623678 - DNA, 14 bp, Homo sapiens
cagcctccatgctg

SEQ ID NO: 3623679 - DNA, 15 bp, Homo sapiens
cagcctccatgctgc

SEQ ID NO: 3623680 - DNA, 23 bp, Homo sapiens
cagcctccccctgtcccctctat

SEQ ID NO: 3623681 - DNA, 18 bp, Homo sapiens
cagcctcccctcccctgg

SEQ ID NO: 3623682 - DNA, 16 bp, Homo sapiens
cagcctccctgaagcc

SEQ ID NO: 3623683 - DNA, 15 bp, Homo sapiens
cagcctccctgtctc

SEQ ID NO: 3623684 - DNA, 16 bp, Homo sapiens
cagcctccctgtctcc

SEQ ID NO: 3623685 - DNA, 17 bp, Homo sapiens
cagcctccctgtctcca

SEQ ID NO: 3623686 - DNA, 13 bp, Homo sapiens
cagcctcctgggt

SEQ ID NO: 3623687 - DNA, 15 bp, Homo sapiens
cagcctctctggctg

SEQ ID NO: 3623688 - DNA, 20 bp, Homo sapiens
cagcctctctggctggtctt

SEQ ID NO: 3623689 - DNA, 17 bp, Homo sapiens
cagcctgactagaactc

SEQ ID NO: 3623690 - DNA, 21 bp, Homo sapiens
cagcctgactagaactcctgt

SEQ ID NO: 3623691 - DNA, 12 bp, Homo sapiens
cagcctgcttcc

SEQ ID NO: 3623692 - DNA, 13 bp, Homo sapiens
cagcctgcttccc

SEQ ID NO: 3623693 - DNA, 15 bp, Homo sapiens
cagcctgcttcccac

SEQ ID NO: 3623694 - DNA, 16 bp, Homo sapiens
cagcctgcttcccaca

SEQ ID NO: 3623695 - DNA, 18 bp, Homo sapiens
cagcctgcttcccacaac

SEQ ID NO: 3623696 - DNA, 14 bp, Homo sapiens
cagcctggccagac

SEQ ID NO: 3623697 - DNA, 17 bp, Homo sapiens
cagcctggccagacaca

SEQ ID NO: 3623698 - DNA, 14 bp, Homo sapiens
cagcctggctggga

SEQ ID NO: 3623699 - DNA, 18 bp, Homo sapiens
cagcctgggagcccagag

SEQ ID NO: 3623700 - DNA, 17 bp, Homo sapiens
cagcctgttccagaagg

SEQ ID NO: 3623701 - DNA, 19 bp, Homo sapiens
cagccttaaggccctcatt

SEQ ID NO: 3623702 - DNA, 17 bp, Homo sapiens
cagccttagagctcttg

SEQ ID NO: 3623703 - DNA, 21 bp, Homo sapiens
cagccttccccagctccagca

SEQ ID NO: 3623704 - DNA, 15 bp, Homo sapiens
cagccttcccctccc

SEQ ID NO: 3623705 - DNA, 19 bp, Homo sapiens
cagccttcccctccctgta

SEQ ID NO: 3623706 - DNA, 19 bp, Homo sapiens
cagccttcggacagacata

SEQ ID NO: 3623707 - DNA, 19 bp, Homo sapiens
cagccttctaaattcccaa

SEQ ID NO: 3623708 - DNA, 20 bp, Homo sapiens
cagccttgcaacccaaggtg

SEQ ID NO: 3623709 - DNA, 21 bp, Homo sapiens
cagccttgcagcggctcctgc

SEQ ID NO: 3623710 - DNA, 15 bp, Homo sapiens
cagccttgccagaga

SEQ ID NO: 3623711 - DNA, 14 bp, Homo sapiens
cagccttgggaccg

SEQ ID NO: 3623712 - DNA, 18 bp, Homo sapiens
cagccttgtacagtctgc

SEQ ID NO: 3623713 - DNA, 22 bp, Homo sapiens
cagccttgtacagtctgctcct

SEQ ID NO: 3623714 - DNA, 24 bp, Homo sapiens
cagcctttgcccaaaactgtcatc

SEQ ID NO: 3623715 - DNA, 16 bp, Homo sapiens
cagcgaactctcagaa

SEQ ID NO: 3623716 - DNA, 21 bp, Homo sapiens
cagcgaactctcagaaataaa

SEQ ID NO: 3623717 - DNA, 14 bp, Homo sapiens
cagcgaccccagga

SEQ ID NO: 3623718 - DNA, 14 bp, Homo sapiens
cagcgcagggctgg

SEQ ID NO: 3623719 - DNA, 22 bp, Homo sapiens
cagcgcatgtgtgcatgtgctg

SEQ ID NO: 3623720 - DNA, 21 bp, Homo sapiens
cagcgccaagtaaacagggta

SEQ ID NO: 3623721 - DNA, 12 bp, Homo sapiens
cagcgcctttcc

SEQ ID NO: 3623722 - DNA, 13 bp, Homo sapiens
cagcgcctttccc

SEQ ID NO: 3623723 - DNA, 14 bp, Homo sapiens
cagcgcctttccca

SEQ ID NO: 3623724 - DNA, 22 bp, Homo sapiens
cagcgcctttcccaactctagc

SEQ ID NO: 3623725 - DNA, 16 bp, Homo sapiens
cagcgggaatggcagc

SEQ ID NO: 3623726 - DNA, 23 bp, Homo sapiens
cagcgggcggaggggatccagcc

SEQ ID NO: 3623727 - DNA, 22 bp, Homo sapiens
cagcgggtacttatttctcagc

SEQ ID NO: 3623728 - DNA, 14 bp, Homo sapiens
cagcgtaaaatggt

SEQ ID NO: 3623729 - DNA, 17 bp, Homo sapiens
cagcgtaaaatggtgaa

SEQ ID NO: 3623730 - DNA, 16 bp, Homo sapiens
cagcgtcccttggtga

SEQ ID NO: 3623731 - DNA, 17 bp, Homo sapiens
cagcgtcccttggtgag

SEQ ID NO: 3623732 - DNA, 19 bp, Homo sapiens
cagctaaacaccaacccct

SEQ ID NO: 3623733 - DNA, 18 bp, Homo sapiens
cagctaaattttctgaaa

SEQ ID NO: 3623734 - DNA, 14 bp, Homo sapiens
cagctaagaacctg

SEQ ID NO: 3623735 - DNA, 16 bp, Homo sapiens
cagctaagaacctgga

SEQ ID NO: 3623736 - DNA, 19 bp, Homo sapiens
cagctaagaacctggaact

SEQ ID NO: 3623737 - DNA, 19 bp, Homo sapiens
cagctaatcagcattctca

SEQ ID NO: 3623738 - DNA, 18 bp, Homo sapiens
cagctacaaccctaccct

SEQ ID NO: 3623739 - DNA, 18 bp, Homo sapiens
cagctagaaaacattttt

SEQ ID NO: 3623740 - DNA, 15 bp, Homo sapiens
cagctcaagggctgg

SEQ ID NO: 3623741 - DNA, 11 bp, Homo sapiens
cagctcagccc

SEQ ID NO: 3623742 - DNA, 13 bp, Homo sapiens
cagctcagccctg

SEQ ID NO: 3623743 - DNA, 12 bp, Homo sapiens
cagctcaggaca

SEQ ID NO: 3623744 - DNA, 16 bp, Homo sapiens
cagctcaggacagatg

SEQ ID NO: 3623745 - DNA, 23 bp, Homo sapiens
cagctcatatgctgacagctctt

SEQ ID NO: 3623746 - DNA, 17 bp, Homo sapiens
cagctcccctcggagaa

SEQ ID NO: 3623747 - DNA, 15 bp, Homo sapiens
cagctccctcctcag

SEQ ID NO: 3623748 - DNA, 16 bp, Homo sapiens
cagctccctcctcagg

SEQ ID NO: 3623749 - DNA, 14 bp, Homo sapiens
cagctccctgcctg

SEQ ID NO: 3623750 - DNA, 19 bp, Homo sapiens
cagctccctgcctgtttcc

SEQ ID NO: 3623751 - DNA, 20 bp, Homo sapiens
cagctccctgcctgtttccc

SEQ ID NO: 3623752 - DNA, 15 bp, Homo sapiens
cagctccgtgtttct

SEQ ID NO: 3623753 - DNA, 12 bp, Homo sapiens
cagctcctcagc

SEQ ID NO: 3623754 - DNA, 14 bp, Homo sapiens
cagctcctgacctt

SEQ ID NO: 3623755 - DNA, 15 bp, Homo sapiens
cagctctactggtct

SEQ ID NO: 3623756 - DNA, 18 bp, Homo sapiens
cagctctagcctctggac

SEQ ID NO: 3623757 - DNA, 21 bp, Homo sapiens
cagctctggacagccccaccc

SEQ ID NO: 3623758 - DNA, 11 bp, Homo sapiens
cagctctggag

SEQ ID NO: 3623759 - DNA, 12 bp, Homo sapiens
cagctctggaga

SEQ ID NO: 3623760 - DNA, 14 bp, Homo sapiens
cagctctggagggg

SEQ ID NO: 3623761 - DNA, 16 bp, Homo sapiens
cagctctggagggggt

SEQ ID NO: 3623762 - DNA, 21 bp, Homo sapiens
cagctcttcattccattgact

SEQ ID NO: 3623763 - DNA, 16 bp, Homo sapiens
cagctcttggctccac

SEQ ID NO: 3623764 - DNA, 18 bp, Homo sapiens
cagctgaaattcaccaag

SEQ ID NO: 3623765 - DNA, 19 bp, Homo sapiens
cagctgaaattcaccaaga

SEQ ID NO: 3623766 - DNA, 16 bp, Homo sapiens
cagctgacagccacac

SEQ ID NO: 3623767 - DNA, 22 bp, Homo sapiens
cagctgagcacttagcaggcac

SEQ ID NO: 3623768 - DNA, 11 bp, Homo sapiens
cagctgagcat

SEQ ID NO: 3623769 - DNA, 14 bp, Homo sapiens
cagctgagcatgga

SEQ ID NO: 3623770 - DNA, 19 bp, Homo sapiens
cagctgagcatggagacag

SEQ ID NO: 3623771 - DNA, 12 bp, Homo sapiens
cagctgcacccc

SEQ ID NO: 3623772 - DNA, 17 bp, Homo sapiens
cagctgcaccccttcct

SEQ ID NO: 3623773 - DNA, 12 bp, Homo sapiens
cagctgcactga

SEQ ID NO: 3623774 - DNA, 17 bp, Homo sapiens
cagctgcaggggcctct

SEQ ID NO: 3623775 - DNA, 15 bp, Homo sapiens
cagctgccctagctg

SEQ ID NO: 3623776 - DNA, 19 bp, Homo sapiens
cagctgccctagctgaccc

SEQ ID NO: 3623777 - DNA, 13 bp, Homo sapiens
cagctgcctgggc

SEQ ID NO: 3623778 - DNA, 21 bp, Homo sapiens
cagctgctttgagctacagga

SEQ ID NO: 3623779 - DNA, 17 bp, Homo sapiens
cagctggcggaggctgc

SEQ ID NO: 3623780 - DNA, 18 bp, Homo sapiens
cagctggcggaggctgct

SEQ ID NO: 3623781 - DNA, 15 bp, Homo sapiens
cagctggctgggcct

SEQ ID NO: 3623782 - DNA, 13 bp, Homo sapiens
cagctgggagcac

SEQ ID NO: 3623783 - DNA, 15 bp, Homo sapiens
cagctgggagcctgg

SEQ ID NO: 3623784 - DNA, 14 bp, Homo sapiens
cagctgggctgtgg

SEQ ID NO: 3623785 - DNA, 16 bp, Homo sapiens
cagctgtcaaggctca

SEQ ID NO: 3623786 - DNA, 13 bp, Homo sapiens
cagctgtgcactt

SEQ ID NO: 3623787 - DNA, 15 bp, Homo sapiens
cagctgtgccttccc

SEQ ID NO: 3623788 - DNA, 15 bp, Homo sapiens
cagctgtgctccaca

SEQ ID NO: 3623789 - DNA, 22 bp, Homo sapiens
cagctgtgctccacactcagaa

SEQ ID NO: 3623790 - DNA, 23 bp, Homo sapiens
cagctgtgctccacactcagaaa

SEQ ID NO: 3623791 - DNA, 12 bp, Homo sapiens
cagctgtggcag

SEQ ID NO: 3623792 - DNA, 17 bp, Homo sapiens
cagctgtggcagagtta

SEQ ID NO: 3623793 - DNA, 22 bp, Homo sapiens
cagctgtggggaacacagctac

SEQ ID NO: 3623794 - DNA, 17 bp, Homo sapiens
cagcttacaggagccag

SEQ ID NO: 3623795 - DNA, 19 bp, Homo sapiens
cagcttacaggagccagcc

SEQ ID NO: 3623796 - DNA, 21 bp, Homo sapiens
cagcttcaacttttctcttta

SEQ ID NO: 3623797 - DNA, 21 bp, Homo sapiens
cagcttcctcacacccctgtc

SEQ ID NO: 3623798 - DNA, 17 bp, Homo sapiens
cagcttcctgagggcta

SEQ ID NO: 3623799 - DNA, 16 bp, Homo sapiens
cagcttctactcctgc

SEQ ID NO: 3623800 - DNA, 15 bp, Homo sapiens
cagcttctcctgtgt

SEQ ID NO: 3623801 - DNA, 17 bp, Homo sapiens
cagcttctctctccagg

SEQ ID NO: 3623802 - DNA, 19 bp, Homo sapiens
cagcttcttcacaggcact

SEQ ID NO: 3623803 - DNA, 19 bp, Homo sapiens
cagcttgaatggtttttct

SEQ ID NO: 3623804 - DNA, 12 bp, Homo sapiens
cagcttgcattg

SEQ ID NO: 3623805 - DNA, 14 bp, Homo sapiens
cagcttgctgggct

SEQ ID NO: 3623806 - DNA, 22 bp, Homo sapiens
cagcttgctgggctttgggaag

SEQ ID NO: 3623807 - DNA, 15 bp, Homo sapiens
cagctttccctgcca

SEQ ID NO: 3623808 - DNA, 18 bp, Homo sapiens
cagctttccctgccaggc

SEQ ID NO: 3623809 - DNA, 12 bp, Homo sapiens
cagctttgctgc

SEQ ID NO: 3623810 - DNA, 21 bp, Homo sapiens
cagctttgtctccaaagaaga

SEQ ID NO: 3623811 - DNA, 19 bp, Homo sapiens
cagctttttattccctgcc

SEQ ID NO: 3623812 - DNA, 17 bp, Homo sapiens
caggaaagagctaggaa

SEQ ID NO: 3623813 - DNA, 16 bp, Homo sapiens
caggaaccacaccaca

SEQ ID NO: 3623814 - DNA, 21 bp, Homo sapiens
caggaagaaacttttttattt

SEQ ID NO: 3623815 - DNA, 22 bp, Homo sapiens
caggaagaaacttttttatttt

SEQ ID NO: 3623816 - DNA, 14 bp, Homo sapiens
caggaaggaaaact

SEQ ID NO: 3623817 - DNA, 12 bp, Homo sapiens
caggaaggaaca

SEQ ID NO: 3623818 - DNA, 23 bp, Homo sapiens
caggaagggaaagcgggcagccc

SEQ ID NO: 3623819 - DNA, 16 bp, Homo sapiens
caggaattcagtgcct

SEQ ID NO: 3623820 - DNA, 17 bp, Homo sapiens
caggaatttcccaggac

SEQ ID NO: 3623821 - DNA, 20 bp, Homo sapiens
caggaatttcccaggaccct

SEQ ID NO: 3623822 - DNA, 16 bp, Homo sapiens
caggacaaaggctgac

SEQ ID NO: 3623823 - DNA, 17 bp, Homo sapiens
caggacaggagatgctg

SEQ ID NO: 3623824 - DNA, 19 bp, Homo sapiens
caggacagttgatggagcc

SEQ ID NO: 3623825 - DNA, 21 bp, Homo sapiens
caggacagttgatggagcccc

SEQ ID NO: 3623826 - DNA, 23 bp, Homo sapiens
caggacagttgatggagccccag

SEQ ID NO: 3623827 - DNA, 16 bp, Homo sapiens
caggacattaaaaatg

SEQ ID NO: 3623828 - DNA, 14 bp, Homo sapiens
caggaccagctcag

SEQ ID NO: 3623829 - DNA, 15 bp, Homo sapiens
caggaccagctcagg

SEQ ID NO: 3623830 - DNA, 17 bp, Homo sapiens
caggaccagctcaggac

SEQ ID NO: 3623831 - DNA, 22 bp, Homo sapiens
caggacccatccctgcctggag

SEQ ID NO: 3623832 - DNA, 14 bp, Homo sapiens
caggaccctcagga

SEQ ID NO: 3623833 - DNA, 15 bp, Homo sapiens
caggaccctgaaggg

SEQ ID NO: 3623834 - DNA, 16 bp, Homo sapiens
caggaccctgaagggg

SEQ ID NO: 3623835 - DNA, 17 bp, Homo sapiens
caggaccctgaaggggc

SEQ ID NO: 3623836 - DNA, 23 bp, Homo sapiens
caggaccctgtcctgcagtccca

SEQ ID NO: 3623837 - DNA, 18 bp, Homo sapiens
caggacctcgtgccaccc

SEQ ID NO: 3623838 - DNA, 21 bp, Homo sapiens
caggaccttcgggctgtgccc

SEQ ID NO: 3623839 - DNA, 18 bp, Homo sapiens
caggacgggccacacgtg

SEQ ID NO: 3623840 - DNA, 16 bp, Homo sapiens
caggacgttagactgt

SEQ ID NO: 3623841 - DNA, 13 bp, Homo sapiens
caggactcccaga

SEQ ID NO: 3623842 - DNA, 14 bp, Homo sapiens
caggactcctggca

SEQ ID NO: 3623843 - DNA, 22 bp, Homo sapiens
caggactcctggcagggccacc

SEQ ID NO: 3623844 - DNA, 15 bp, Homo sapiens
caggactctctccag

SEQ ID NO: 3623845 - DNA, 18 bp, Homo sapiens
caggactctctccaggag

SEQ ID NO: 3623846 - DNA, 12 bp, Homo sapiens
caggactctgcc

SEQ ID NO: 3623847 - DNA, 19 bp, Homo sapiens
caggagaagaacctgaaga

SEQ ID NO: 3623848 - DNA, 22 bp, Homo sapiens
caggagaatcgcttgaacctgg

SEQ ID NO: 3623849 - DNA, 15 bp, Homo sapiens
caggagacctccagc

SEQ ID NO: 3623850 - DNA, 16 bp, Homo sapiens
caggagacctccagct

SEQ ID NO: 3623851 - DNA, 15 bp, Homo sapiens
caggagagcctgggg

SEQ ID NO: 3623852 - DNA, 21 bp, Homo sapiens
caggagaggcagcatgcttgg

SEQ ID NO: 3623853 - DNA, 16 bp, Homo sapiens
caggagatgctgtgcc

SEQ ID NO: 3623854 - DNA, 19 bp, Homo sapiens
caggagatgctgtgcccct

SEQ ID NO: 3623855 - DNA, 23 bp, Homo sapiens
caggagatgctgtgcccctggcc

SEQ ID NO: 3623856 - DNA, 16 bp, Homo sapiens
caggagatggagggct

SEQ ID NO: 3623857 - DNA, 15 bp, Homo sapiens
caggagatggggaat

SEQ ID NO: 3623858 - DNA, 18 bp, Homo sapiens
caggagccagcctgcttc

SEQ ID NO: 3623859 - DNA, 18 bp, Homo sapiens
caggagccgaagcccagg

SEQ ID NO: 3623860 - DNA, 21 bp, Homo sapiens
caggagccgaagcccaggggc

SEQ ID NO: 3623861 - DNA, 13 bp, Homo sapiens
caggagcctagcg

SEQ ID NO: 3623862 - DNA, 19 bp, Homo sapiens
caggagcctagcggagccc

SEQ ID NO: 3623863 - DNA, 21 bp, Homo sapiens
caggagcctagcggagcccag

SEQ ID NO: 3623864 - DNA, 16 bp, Homo sapiens
caggagcctggccagg

SEQ ID NO: 3623865 - DNA, 20 bp, Homo sapiens
caggagcctggccaggcagg

SEQ ID NO: 3623866 - DNA, 15 bp, Homo sapiens
caggagcctgtgcct

SEQ ID NO: 3623867 - DNA, 17 bp, Homo sapiens
caggaggctgaggcagg

SEQ ID NO: 3623868 - DNA, 18 bp, Homo sapiens
caggaggctgaggcagga

SEQ ID NO: 3623869 - DNA, 15 bp, Homo sapiens
caggagggaggcagg

SEQ ID NO: 3623870 - DNA, 15 bp, Homo sapiens
caggaggggcagcgc

SEQ ID NO: 3623871 - DNA, 15 bp, Homo sapiens
caggagggttggagt

SEQ ID NO: 3623872 - DNA, 22 bp, Homo sapiens
caggagggttggagtgctcttc

SEQ ID NO: 3623873 - DNA, 15 bp, Homo sapiens
caggagtccctgcca

SEQ ID NO: 3623874 - DNA, 21 bp, Homo sapiens
caggagtccctgccatcatgt

SEQ ID NO: 3623875 - DNA, 17 bp, Homo sapiens
caggagtctctgccagt

SEQ ID NO: 3623876 - DNA, 18 bp, Homo sapiens
caggagtgggctctgagc

SEQ ID NO: 3623877 - DNA, 16 bp, Homo sapiens
caggagtgtcctgccc

SEQ ID NO: 3623878 - DNA, 22 bp, Homo sapiens
caggagtgtcctgcccatgccc

SEQ ID NO: 3623879 - DNA, 23 bp, Homo sapiens
caggagtgtcctgcccatgcccc

SEQ ID NO: 3623880 - DNA, 17 bp, Homo sapiens
caggatatattttattt

SEQ ID NO: 3623881 - DNA, 18 bp, Homo sapiens
caggatccagtgacatga

SEQ ID NO: 3623882 - DNA, 13 bp, Homo sapiens
caggatgcccaga

SEQ ID NO: 3623883 - DNA, 21 bp, Homo sapiens
caggatgcccagatgaactga

SEQ ID NO: 3623884 - DNA, 13 bp, Homo sapiens
caggattctctgc

SEQ ID NO: 3623885 - DNA, 16 bp, Homo sapiens
caggattctctgcagc

SEQ ID NO: 3623886 - DNA, 16 bp, Homo sapiens
caggattgatcattct

SEQ ID NO: 3623887 - DNA, 14 bp, Homo sapiens
caggcaaaatcctt

SEQ ID NO: 3623888 - DNA, 15 bp, Homo sapiens
caggcacaccttgca

SEQ ID NO: 3623889 - DNA, 17 bp, Homo sapiens
caggcacaccttgcaga

SEQ ID NO: 3623890 - DNA, 18 bp, Homo sapiens
caggcacaccttgcagaa

SEQ ID NO: 3623891 - DNA, 16 bp, Homo sapiens
caggcacagcagctgc

SEQ ID NO: 3623892 - DNA, 13 bp, Homo sapiens
caggcaccacagc

SEQ ID NO: 3623893 - DNA, 14 bp, Homo sapiens
caggcaccacagcc

SEQ ID NO: 3623894 - DNA, 21 bp, Homo sapiens
caggcaccgccacgtcccagc

SEQ ID NO: 3623895 - DNA, 24 bp, Homo sapiens
caggcaccgccacgtcccagcatc

SEQ ID NO: 3623896 - DNA, 16 bp, Homo sapiens
caggcactgctgccca

SEQ ID NO: 3623897 - DNA, 20 bp, Homo sapiens
caggcagagtggcgtggcct

SEQ ID NO: 3623898 - DNA, 22 bp, Homo sapiens
caggcagagtggcgtggcctcc

SEQ ID NO: 3623899 - DNA, 18 bp, Homo sapiens
caggcagatccaggacta

SEQ ID NO: 3623900 - DNA, 11 bp, Homo sapiens
caggcagcctc

SEQ ID NO: 3623901 - DNA, 17 bp, Homo sapiens
caggcagcgcagggctg

SEQ ID NO: 3623902 - DNA, 18 bp, Homo sapiens
caggcagctatttcagcc

SEQ ID NO: 3623903 - DNA, 22 bp, Homo sapiens
caggcaggcggctcctcctcac

SEQ ID NO: 3623904 - DNA, 24 bp, Homo sapiens
caggcaggcggctcctcctcaccc

SEQ ID NO: 3623905 - DNA, 16 bp, Homo sapiens
caggcagggagagagt

SEQ ID NO: 3623906 - DNA, 22 bp, Homo sapiens
caggcatggtcccttaaggcac

SEQ ID NO: 3623907 - DNA, 20 bp, Homo sapiens
caggcatgtgtctggcccta

SEQ ID NO: 3623908 - DNA, 18 bp, Homo sapiens
caggccaagggaccaggt

SEQ ID NO: 3623909 - DNA, 22 bp, Homo sapiens
caggccacagtggggctgcagg

SEQ ID NO: 3623910 - DNA, 16 bp, Homo sapiens
caggccagcccagcca

SEQ ID NO: 3623911 - DNA, 14 bp, Homo sapiens
caggccaggccagc

SEQ ID NO: 3623912 - DNA, 14 bp, Homo sapiens
caggcccaatgctg

SEQ ID NO: 3623913 - DNA, 17 bp, Homo sapiens
caggcccaatgctgctt

SEQ ID NO: 3623914 - DNA, 19 bp, Homo sapiens
caggcccaatgctgctttt

SEQ ID NO: 3623915 - DNA, 16 bp, Homo sapiens
caggcccactccccag

SEQ ID NO: 3623916 - DNA, 23 bp, Homo sapiens
caggcccagctttccctgccagg

SEQ ID NO: 3623917 - DNA, 17 bp, Homo sapiens
caggccccaccggccag

SEQ ID NO: 3623918 - DNA, 22 bp, Homo sapiens
caggccccaccggccaggccgc

SEQ ID NO: 3623919 - DNA, 13 bp, Homo sapiens
caggcccgcttgc

SEQ ID NO: 3623920 - DNA, 16 bp, Homo sapiens
caggcccgcttgctgg

SEQ ID NO: 3623921 - DNA, 14 bp, Homo sapiens
caggccctccctgt

SEQ ID NO: 3623922 - DNA, 15 bp, Homo sapiens
caggccctccctgtc

SEQ ID NO: 3623923 - DNA, 22 bp, Homo sapiens
caggccctccctgttccccaga

SEQ ID NO: 3623924 - DNA, 21 bp, Homo sapiens
caggcccttattttcaagaaa

SEQ ID NO: 3623925 - DNA, 21 bp, Homo sapiens
caggcccttcctctccactgc

SEQ ID NO: 3623926 - DNA, 14 bp, Homo sapiens
caggccgcgcccag

SEQ ID NO: 3623927 - DNA, 22 bp, Homo sapiens
caggcctccaacgcccctgtgg

SEQ ID NO: 3623928 - DNA, 13 bp, Homo sapiens
caggcctctggga

SEQ ID NO: 3623929 - DNA, 15 bp, Homo sapiens
caggcctgtccaaca

SEQ ID NO: 3623930 - DNA, 19 bp, Homo sapiens
caggcctgtgtgactccat

SEQ ID NO: 3623931 - DNA, 20 bp, Homo sapiens
caggcctgtgtgactccatt

SEQ ID NO: 3623932 - DNA, 18 bp, Homo sapiens
caggccttacatctggct

SEQ ID NO: 3623933 - DNA, 17 bp, Homo sapiens
caggccttatctccaag

SEQ ID NO: 3623934 - DNA, 23 bp, Homo sapiens
caggcgatggggcaagacagaaa

SEQ ID NO: 3623935 - DNA, 13 bp, Homo sapiens
caggcggctcctc

SEQ ID NO: 3623936 - DNA, 21 bp, Homo sapiens
caggcggctcctcctcaccca

SEQ ID NO: 3623937 - DNA, 19 bp, Homo sapiens
caggctaagaccctgtgtc

SEQ ID NO: 3623938 - DNA, 23 bp, Homo sapiens
caggctcaggagaagccagtgtc

SEQ ID NO: 3623939 - DNA, 22 bp, Homo sapiens
caggctccgggcaccaggggcc

SEQ ID NO: 3623940 - DNA, 16 bp, Homo sapiens
caggctccgggctttc

SEQ ID NO: 3623941 - DNA, 19 bp, Homo sapiens
caggctcctacctgtctgc

SEQ ID NO: 3623942 - DNA, 16 bp, Homo sapiens
caggctcgtcagccac

SEQ ID NO: 3623943 - DNA, 13 bp, Homo sapiens
caggctctcaaca

SEQ ID NO: 3623944 - DNA, 14 bp, Homo sapiens
caggctctgcacag

SEQ ID NO: 3623945 - DNA, 21 bp, Homo sapiens
caggctctgcacagacaagca

SEQ ID NO: 3623946 - DNA, 23 bp, Homo sapiens
caggctgaaatatccacccagca

SEQ ID NO: 3623947 - DNA, 12 bp, Homo sapiens
caggctgaagag

SEQ ID NO: 3623948 - DNA, 20 bp, Homo sapiens
caggctgaagagagggacag

SEQ ID NO: 3623949 - DNA, 14 bp, Homo sapiens
caggctgagaactc

SEQ ID NO: 3623950 - DNA, 16 bp, Homo sapiens
caggctggagtgcaat

SEQ ID NO: 3623951 - DNA, 13 bp, Homo sapiens
caggctgtcctta

SEQ ID NO: 3623952 - DNA, 22 bp, Homo sapiens
caggctgttggaaaatccagaa

SEQ ID NO: 3623953 - DNA, 13 bp, Homo sapiens
caggctgtttcag

SEQ ID NO: 3623954 - DNA, 15 bp, Homo sapiens
caggctgtttcagcc

SEQ ID NO: 3623955 - DNA, 21 bp, Homo sapiens
caggcttatgaatatatttaa

SEQ ID NO: 3623956 - DNA, 17 bp, Homo sapiens
caggcttggcaaagaag

SEQ ID NO: 3623957 - DNA, 16 bp, Homo sapiens
cagggaaatgtatgtg

SEQ ID NO: 3623958 - DNA, 15 bp, Homo sapiens
cagggaactgaccct

SEQ ID NO: 3623959 - DNA, 14 bp, Homo sapiens
cagggaaggacagg

SEQ ID NO: 3623960 - DNA, 16 bp, Homo sapiens
cagggaaggacaggac

SEQ ID NO: 3623961 - DNA, 18 bp, Homo sapiens
cagggaaggacaggaccc

SEQ ID NO: 3623962 - DNA, 14 bp, Homo sapiens
cagggacagaggcc

SEQ ID NO: 3623963 - DNA, 18 bp, Homo sapiens
cagggacaggataagagg

SEQ ID NO: 3623964 - DNA, 18 bp, Homo sapiens
cagggaccatcaagaacc

SEQ ID NO: 3623965 - DNA, 18 bp, Homo sapiens
cagggacctaaagggact

SEQ ID NO: 3623966 - DNA, 20 bp, Homo sapiens
cagggacctaaagggactac

SEQ ID NO: 3623967 - DNA, 17 bp, Homo sapiens
cagggactatctttgct

SEQ ID NO: 3623968 - DNA, 21 bp, Homo sapiens
cagggagacaggcagggaggg

SEQ ID NO: 3623969 - DNA, 23 bp, Homo sapiens
cagggagagagtagctgcagcct

SEQ ID NO: 3623970 - DNA, 15 bp, Homo sapiens
cagggagcagccccc

SEQ ID NO: 3623971 - DNA, 20 bp, Homo sapiens
cagggagcattttcctccat

SEQ ID NO: 3623972 - DNA, 21 bp, Homo sapiens
cagggatgccctggaggtggc

SEQ ID NO: 3623973 - DNA, 23 bp, Homo sapiens
cagggatgccctggaggtggctg

SEQ ID NO: 3623974 - DNA, 14 bp, Homo sapiens
cagggatgctgggc

SEQ ID NO: 3623975 - DNA, 13 bp, Homo sapiens
cagggcagcaggc

SEQ ID NO: 3623976 - DNA, 15 bp, Homo sapiens
cagggcagcggctcc

SEQ ID NO: 3623977 - DNA, 21 bp, Homo sapiens
cagggccacctgcaggaccct

SEQ ID NO: 3623978 - DNA, 21 bp, Homo sapiens
cagggccatctgactgccaag

SEQ ID NO: 3623979 - DNA, 21 bp, Homo sapiens
cagggcccagagcccagctcc

SEQ ID NO: 3623980 - DNA, 13 bp, Homo sapiens
cagggcctccagg

SEQ ID NO: 3623981 - DNA, 14 bp, Homo sapiens
cagggcctccaggg

SEQ ID NO: 3623982 - DNA, 19 bp, Homo sapiens
cagggcctccagggcccag

SEQ ID NO: 3623983 - DNA, 13 bp, Homo sapiens
cagggcctggagc

SEQ ID NO: 3623984 - DNA, 14 bp, Homo sapiens
cagggcctggagcc

SEQ ID NO: 3623985 - DNA, 20 bp, Homo sapiens
cagggctaaataaagaggag

SEQ ID NO: 3623986 - DNA, 13 bp, Homo sapiens
cagggctggagcc

SEQ ID NO: 3623987 - DNA, 13 bp, Homo sapiens
cagggctggcacg

SEQ ID NO: 3623988 - DNA, 22 bp, Homo sapiens
cagggctttactccgtaacaga

SEQ ID NO: 3623989 - DNA, 20 bp, Homo sapiens
caggggaattccctccccct

SEQ ID NO: 3623990 - DNA, 22 bp, Homo sapiens
caggggaattccctccccctcc

SEQ ID NO: 3623991 - DNA, 17 bp, Homo sapiens
caggggaccccactccc

SEQ ID NO: 3623992 - DNA, 20 bp, Homo sapiens
caggggaccccactcccctc

SEQ ID NO: 3623993 - DNA, 22 bp, Homo sapiens
caggggagacaggagcctagcg

SEQ ID NO: 3623994 - DNA, 16 bp, Homo sapiens
caggggagatggggag

SEQ ID NO: 3623995 - DNA, 18 bp, Homo sapiens
caggggagatggggagga

SEQ ID NO: 3623996 - DNA, 15 bp, Homo sapiens
caggggagccctcca

SEQ ID NO: 3623997 - DNA, 21 bp, Homo sapiens
caggggagccctccacgccgg

SEQ ID NO: 3623998 - DNA, 15 bp, Homo sapiens
caggggaggagcctg

SEQ ID NO: 3623999 - DNA, 17 bp, Homo sapiens
caggggaggagcctgtg

SEQ ID NO: 3624000 - DNA, 16 bp, Homo sapiens
caggggaggccatctg

SEQ ID NO: 3624001 - DNA, 13 bp, Homo sapiens
caggggaggggtg

SEQ ID NO: 3624002 - DNA, 13 bp, Homo sapiens
caggggcctctgt

SEQ ID NO: 3624003 - DNA, 22 bp, Homo sapiens
caggggcctgcagaaggaaaga

SEQ ID NO: 3624004 - DNA, 13 bp, Homo sapiens
caggggcctggag

SEQ ID NO: 3624005 - DNA, 19 bp, Homo sapiens
caggggcctggaggtctgg

SEQ ID NO: 3624006 - DNA, 23 bp, Homo sapiens
caggggcctggaggtctggctga

SEQ ID NO: 3624007 - DNA, 22 bp, Homo sapiens
caggggcctttgggtgctgttt

SEQ ID NO: 3624008 - DNA, 16 bp, Homo sapiens
cagggggacagcaggg

SEQ ID NO: 3624009 - DNA, 18 bp, Homo sapiens
cagggggcaactgacatt

SEQ ID NO: 3624010 - DNA, 19 bp, Homo sapiens
cagggggccccgccagggc

SEQ ID NO: 3624011 - DNA, 20 bp, Homo sapiens
cagggggccccgccagggct

SEQ ID NO: 3624012 - DNA, 21 bp, Homo sapiens
cagggggccccgccagggctg

SEQ ID NO: 3624013 - DNA, 13 bp, Homo sapiens
cagggggccctgc

SEQ ID NO: 3624014 - DNA, 13 bp, Homo sapiens
caggggggctgtg

SEQ ID NO: 3624015 - DNA, 18 bp, Homo sapiens
caggggggtgaggagctg

SEQ ID NO: 3624016 - DNA, 16 bp, Homo sapiens
caggggttgagagctt

SEQ ID NO: 3624017 - DNA, 14 bp, Homo sapiens
cagggtacctcaag

SEQ ID NO: 3624018 - DNA, 19 bp, Homo sapiens
cagggtacctcaagcccca

SEQ ID NO: 3624019 - DNA, 16 bp, Homo sapiens
cagggtccacagctgg

SEQ ID NO: 3624020 - DNA, 20 bp, Homo sapiens
cagggtccacagctggaaag

SEQ ID NO: 3624021 - DNA, 12 bp, Homo sapiens
cagggtccctgg

SEQ ID NO: 3624022 - DNA, 23 bp, Homo sapiens
cagggtccttttgacactgctct

SEQ ID NO: 3624023 - DNA, 13 bp, Homo sapiens
cagggtctctcag

SEQ ID NO: 3624024 - DNA, 14 bp, Homo sapiens
cagggtctctcagg

SEQ ID NO: 3624025 - DNA, 22 bp, Homo sapiens
cagggtctctcagggatggagg

SEQ ID NO: 3624026 - DNA, 14 bp, Homo sapiens
cagggtctgggaca

SEQ ID NO: 3624027 - DNA, 22 bp, Homo sapiens
cagggtgagggccacctccaca

SEQ ID NO: 3624028 - DNA, 23 bp, Homo sapiens
cagggtgcttagttggctttgcc

SEQ ID NO: 3624029 - DNA, 22 bp, Homo sapiens
cagggtttacatgaagcagaac

SEQ ID NO: 3624030 - DNA, 18 bp, Homo sapiens
caggtacaggagaggcag

SEQ ID NO: 3624031 - DNA, 15 bp, Homo sapiens
caggtacatttctga

SEQ ID NO: 3624032 - DNA, 16 bp, Homo sapiens
caggtacatttctgat

SEQ ID NO: 3624033 - DNA, 22 bp, Homo sapiens
caggtacatttctgattctgat

SEQ ID NO: 3624034 - DNA, 14 bp, Homo sapiens
caggtacttggagg

SEQ ID NO: 3624035 - DNA, 20 bp, Homo sapiens
caggtacttggagggctcag

SEQ ID NO: 3624036 - DNA, 16 bp, Homo sapiens
caggtagtttgtacca

SEQ ID NO: 3624037 - DNA, 17 bp, Homo sapiens
caggtcagcctggaagg

SEQ ID NO: 3624038 - DNA, 21 bp, Homo sapiens
caggtccaaattcaccttccc

SEQ ID NO: 3624039 - DNA, 16 bp, Homo sapiens
caggtctgactccaaa

SEQ ID NO: 3624040 - DNA, 15 bp, Homo sapiens
caggtgacagtgaag

SEQ ID NO: 3624041 - DNA, 23 bp, Homo sapiens
caggtgcagccccagggcctgcg

SEQ ID NO: 3624042 - DNA, 14 bp, Homo sapiens
caggtgcctaacct

SEQ ID NO: 3624043 - DNA, 16 bp, Homo sapiens
caggtgctcatgctgc

SEQ ID NO: 3624044 - DNA, 18 bp, Homo sapiens
caggtgctcatgctgctc

SEQ ID NO: 3624045 - DNA, 21 bp, Homo sapiens
caggtggccactccagacccc

SEQ ID NO: 3624046 - DNA, 15 bp, Homo sapiens
caggtgttctgctga

SEQ ID NO: 3624047 - DNA, 19 bp, Homo sapiens
caggttccacagaggacac

SEQ ID NO: 3624048 - DNA, 21 bp, Homo sapiens
caggttccccaagggccctgg

SEQ ID NO: 3624049 - DNA, 15 bp, Homo sapiens
caggttcccccagca

SEQ ID NO: 3624050 - DNA, 23 bp, Homo sapiens
caggttccctcccagaggagcca

SEQ ID NO: 3624051 - DNA, 23 bp, Homo sapiens
caggttcctgaaatatccaggaa

SEQ ID NO: 3624052 - DNA, 16 bp, Homo sapiens
caggttggttttgctg

SEQ ID NO: 3624053 - DNA, 22 bp, Homo sapiens
caggttgtctgaagtcactgca

SEQ ID NO: 3624054 - DNA, 21 bp, Homo sapiens
caggtttgcaggagcccccct

SEQ ID NO: 3624055 - DNA, 13 bp, Homo sapiens
caggtttttcaat

SEQ ID NO: 3624056 - DNA, 14 bp, Homo sapiens
caggtttttcaatt

SEQ ID NO: 3624057 - DNA, 15 bp, Homo sapiens
caggtttttcaatta

SEQ ID NO: 3624058 - DNA, 17 bp, Homo sapiens
caggtttttcaattaaa

SEQ ID NO: 3624059 - DNA, 19 bp, Homo sapiens
caggtttttcaattaaacg

SEQ ID NO: 3624060 - DNA, 22 bp, Homo sapiens
caggtttttcaattaaacggat

SEQ ID NO: 3624061 - DNA, 16 bp, Homo sapiens
cagtaaaatttcagga

SEQ ID NO: 3624062 - DNA, 16 bp, Homo sapiens
cagtaagttctgtggt

SEQ ID NO: 3624063 - DNA, 23 bp, Homo sapiens
cagtaccccatggagctgggcta

SEQ ID NO: 3624064 - DNA, 20 bp, Homo sapiens
cagtacctgattgtattttt

SEQ ID NO: 3624065 - DNA, 19 bp, Homo sapiens
cagtactttggaggcccct

SEQ ID NO: 3624066 - DNA, 17 bp, Homo sapiens
cagtaggtcccggccag

SEQ ID NO: 3624067 - DNA, 12 bp, Homo sapiens
cagtatataagc

SEQ ID NO: 3624068 - DNA, 16 bp, Homo sapiens
cagtatctgctgttct

SEQ ID NO: 3624069 - DNA, 17 bp, Homo sapiens
cagtatctgctgttctt

SEQ ID NO: 3624070 - DNA, 18 bp, Homo sapiens
cagtatctgctgttcttc

SEQ ID NO: 3624071 - DNA, 13 bp, Homo sapiens
cagtattaacact

SEQ ID NO: 3624072 - DNA, 17 bp, Homo sapiens
cagtattgaaaacttca

SEQ ID NO: 3624073 - DNA, 20 bp, Homo sapiens
cagtatttctacattacagc

SEQ ID NO: 3624074 - DNA, 23 bp, Homo sapiens
cagtcagggaaggtgcctctgga

SEQ ID NO: 3624075 - DNA, 17 bp, Homo sapiens
cagtccacaggggccac

SEQ ID NO: 3624076 - DNA, 17 bp, Homo sapiens
cagtcccacactgtgca

SEQ ID NO: 3624077 - DNA, 18 bp, Homo sapiens
cagtcccacactgtgcag

SEQ ID NO: 3624078 - DNA, 18 bp, Homo sapiens
cagtcccacactgtggcc

SEQ ID NO: 3624079 - DNA, 22 bp, Homo sapiens
cagtcccagacaattccattca

SEQ ID NO: 3624080 - DNA, 23 bp, Homo sapiens
cagtccccgtgaaggagagccct

SEQ ID NO: 3624081 - DNA, 21 bp, Homo sapiens
cagtcctggaggcagggggtg

SEQ ID NO: 3624082 - DNA, 15 bp, Homo sapiens
cagtcctgttcagaa

SEQ ID NO: 3624083 - DNA, 20 bp, Homo sapiens
cagtccttactcccccacca

SEQ ID NO: 3624084 - DNA, 15 bp, Homo sapiens
cagtcgaccccaaag

SEQ ID NO: 3624085 - DNA, 19 bp, Homo sapiens
cagtcgcctgcctgcagca

SEQ ID NO: 3624086 - DNA, 21 bp, Homo sapiens
cagtcgcctgcctgcagcagg

SEQ ID NO: 3624087 - DNA, 12 bp, Homo sapiens
cagtctcctcac

SEQ ID NO: 3624088 - DNA, 14 bp, Homo sapiens
cagtctcctcactc

SEQ ID NO: 3624089 - DNA, 16 bp, Homo sapiens
cagtctccttcagcac

SEQ ID NO: 3624090 - DNA, 22 bp, Homo sapiens
cagtctctcttctctccagctg

SEQ ID NO: 3624091 - DNA, 13 bp, Homo sapiens
cagtctgctcctc

SEQ ID NO: 3624092 - DNA, 16 bp, Homo sapiens
cagtctgctcctcttg

SEQ ID NO: 3624093 - DNA, 18 bp, Homo sapiens
cagtcttgacgagtgtga

SEQ ID NO: 3624094 - DNA, 21 bp, Homo sapiens
cagtcttggtaaaacattact

SEQ ID NO: 3624095 - DNA, 18 bp, Homo sapiens
cagtctttatttttttcc

SEQ ID NO: 3624096 - DNA, 23 bp, Homo sapiens
cagtctttatttttttcccatga

SEQ ID NO: 3624097 - DNA, 13 bp, Homo sapiens
cagtctttcttca

SEQ ID NO: 3624098 - DNA, 22 bp, Homo sapiens
cagtctttcttcactctggctt

SEQ ID NO: 3624099 - DNA, 17 bp, Homo sapiens
cagtgaagatagaagaa

SEQ ID NO: 3624100 - DNA, 13 bp, Homo sapiens
cagtgacaacatc

SEQ ID NO: 3624101 - DNA, 16 bp, Homo sapiens
cagtgaccagtgcctg

SEQ ID NO: 3624102 - DNA, 16 bp, Homo sapiens
cagtgacgaggaactc

SEQ ID NO: 3624103 - DNA, 17 bp, Homo sapiens
cagtgactccccagccc

SEQ ID NO: 3624104 - DNA, 15 bp, Homo sapiens
cagtgactccctggg

SEQ ID NO: 3624105 - DNA, 17 bp, Homo sapiens
cagtgactcctgctggt

SEQ ID NO: 3624106 - DNA, 19 bp, Homo sapiens
cagtgactcctgctggtac

SEQ ID NO: 3624107 - DNA, 22 bp, Homo sapiens
cagtgactcctgctggtacctg

SEQ ID NO: 3624108 - DNA, 16 bp, Homo sapiens
cagtgagatcaatgtg

SEQ ID NO: 3624109 - DNA, 14 bp, Homo sapiens
cagtgagcagtgtt

SEQ ID NO: 3624110 - DNA, 17 bp, Homo sapiens
cagtgagcccctcccca

SEQ ID NO: 3624111 - DNA, 14 bp, Homo sapiens
cagtgattattttt

SEQ ID NO: 3624112 - DNA, 19 bp, Homo sapiens
cagtgcacatttggaattg

SEQ ID NO: 3624113 - DNA, 19 bp, Homo sapiens
cagtgcagtccatttccta

SEQ ID NO: 3624114 - DNA, 18 bp, Homo sapiens
cagtgcagtttcttttca

SEQ ID NO: 3624115 - DNA, 14 bp, Homo sapiens
cagtgcatcattac

SEQ ID NO: 3624116 - DNA, 16 bp, Homo sapiens
cagtgcatctcagccc

SEQ ID NO: 3624117 - DNA, 23 bp, Homo sapiens
cagtgccagcaagtccttaggct

SEQ ID NO: 3624118 - DNA, 18 bp, Homo sapiens
cagtgccatccccacctt

SEQ ID NO: 3624119 - DNA, 21 bp, Homo sapiens
cagtgcccccactgaccagaa

SEQ ID NO: 3624120 - DNA, 19 bp, Homo sapiens
cagtgccctcattttatgt

SEQ ID NO: 3624121 - DNA, 17 bp, Homo sapiens
cagtgcggttcctcatc

SEQ ID NO: 3624122 - DNA, 15 bp, Homo sapiens
cagtgctaaagcctg

SEQ ID NO: 3624123 - DNA, 11 bp, Homo sapiens
cagtggcctct

SEQ ID NO: 3624124 - DNA, 23 bp, Homo sapiens
cagtggcctcttgagttcctctg

SEQ ID NO: 3624125 - DNA, 17 bp, Homo sapiens
cagtggccttccccagc

SEQ ID NO: 3624126 - DNA, 18 bp, Homo sapiens
cagtggccttccccagca

SEQ ID NO: 3624127 - DNA, 22 bp, Homo sapiens
cagtggcggcacgtccttgggc

SEQ ID NO: 3624128 - DNA, 16 bp, Homo sapiens
cagtggctggatctgt

SEQ ID NO: 3624129 - DNA, 18 bp, Homo sapiens
cagtggctggatctgtga

SEQ ID NO: 3624130 - DNA, 17 bp, Homo sapiens
cagtgggagctgagctg

SEQ ID NO: 3624131 - DNA, 14 bp, Homo sapiens
cagtggggctggca

SEQ ID NO: 3624132 - DNA, 15 bp, Homo sapiens
cagtggggctggcat

SEQ ID NO: 3624133 - DNA, 16 bp, Homo sapiens
cagtggtaagaatagt

SEQ ID NO: 3624134 - DNA, 17 bp, Homo sapiens
cagtggtaagaatagta

SEQ ID NO: 3624135 - DNA, 22 bp, Homo sapiens
cagtggtggcaacattcattgc

SEQ ID NO: 3624136 - DNA, 22 bp, Homo sapiens
cagtgtaaatcccagactgaca

SEQ ID NO: 3624137 - DNA, 19 bp, Homo sapiens
cagtgtcagggtccaggag

SEQ ID NO: 3624138 - DNA, 18 bp, Homo sapiens
cagtgtgagatactgtgt

SEQ ID NO: 3624139 - DNA, 23 bp, Homo sapiens
cagtgtgcactaaggggcccggc

SEQ ID NO: 3624140 - DNA, 15 bp, Homo sapiens
cagtgtgtcagtttt

SEQ ID NO: 3624141 - DNA, 19 bp, Homo sapiens
cagtgtgtcagtttttcct

SEQ ID NO: 3624142 - DNA, 17 bp, Homo sapiens
cagtgtgtggtcaacat

SEQ ID NO: 3624143 - DNA, 16 bp, Homo sapiens
cagtgttcctgaagct

SEQ ID NO: 3624144 - DNA, 20 bp, Homo sapiens
cagtgttcctgaagctgctg

SEQ ID NO: 3624145 - DNA, 18 bp, Homo sapiens
cagtgttgcgtttttcct

SEQ ID NO: 3624146 - DNA, 16 bp, Homo sapiens
cagttaatttttccaa

SEQ ID NO: 3624147 - DNA, 19 bp, Homo sapiens
cagttaatttttccaacta

SEQ ID NO: 3624148 - DNA, 19 bp, Homo sapiens
cagttactccctacactga

SEQ ID NO: 3624149 - DNA, 16 bp, Homo sapiens
cagttacttgggcttc

SEQ ID NO: 3624150 - DNA, 21 bp, Homo sapiens
cagttataagtagcaggccaa

SEQ ID NO: 3624151 - DNA, 14 bp, Homo sapiens
cagttatgaaaact

SEQ ID NO: 3624152 - DNA, 19 bp, Homo sapiens
cagttatggctataggtgc

SEQ ID NO: 3624153 - DNA, 22 bp, Homo sapiens
cagttcaaaaacaagacagact

SEQ ID NO: 3624154 - DNA, 20 bp, Homo sapiens
cagttcagctttaaaggcca

SEQ ID NO: 3624155 - DNA, 23 bp, Homo sapiens
cagttcattctaccaagctgtca

SEQ ID NO: 3624156 - DNA, 22 bp, Homo sapiens
cagttctaggcctttcctctgc

SEQ ID NO: 3624157 - DNA, 23 bp, Homo sapiens
cagttctaggcctttcctctgca

SEQ ID NO: 3624158 - DNA, 17 bp, Homo sapiens
cagttctatttaaaatg

SEQ ID NO: 3624159 - DNA, 19 bp, Homo sapiens
cagttctgaataacttgaa

SEQ ID NO: 3624160 - DNA, 13 bp, Homo sapiens
cagttctgggcaa

SEQ ID NO: 3624161 - DNA, 20 bp, Homo sapiens
cagttctttgggccagacat

SEQ ID NO: 3624162 - DNA, 22 bp, Homo sapiens
cagttgaaaagactccaaagaa

SEQ ID NO: 3624163 - DNA, 21 bp, Homo sapiens
cagttgaaaatgcaactctaa

SEQ ID NO: 3624164 - DNA, 21 bp, Homo sapiens
cagttgatataaaactctggg

SEQ ID NO: 3624165 - DNA, 18 bp, Homo sapiens
cagttgatggagccccag

SEQ ID NO: 3624166 - DNA, 19 bp, Homo sapiens
cagttgatggagccccagg

SEQ ID NO: 3624167 - DNA, 23 bp, Homo sapiens
cagttgatggagccccagggttt

SEQ ID NO: 3624168 - DNA, 14 bp, Homo sapiens
cagttgtatttaat

SEQ ID NO: 3624169 - DNA, 21 bp, Homo sapiens
cagttgttatttattgaaatg

SEQ ID NO: 3624170 - DNA, 20 bp, Homo sapiens
cagtttaagccgcagacctg

SEQ ID NO: 3624171 - DNA, 15 bp, Homo sapiens
cagtttacagtattt

SEQ ID NO: 3624172 - DNA, 17 bp, Homo sapiens
cagtttacagtatttct

SEQ ID NO: 3624173 - DNA, 16 bp, Homo sapiens
cagtttacccagcatg

SEQ ID NO: 3624174 - DNA, 16 bp, Homo sapiens
cagtttatgttgtaca

SEQ ID NO: 3624175 - DNA, 16 bp, Homo sapiens
cagtttcctcagtgat

SEQ ID NO: 3624176 - DNA, 23 bp, Homo sapiens
cagtttcttttcacattaggctg

SEQ ID NO: 3624177 - DNA, 23 bp, Homo sapiens
cagtttgaggaagtggctgtccc

SEQ ID NO: 3624178 - DNA, 15 bp, Homo sapiens
cagttttctgagaaa

SEQ ID NO: 3624179 - DNA, 13 bp, Homo sapiens
cagttttgacatt

SEQ ID NO: 3624180 - DNA, 19 bp, Homo sapiens
cagttttggtgtgtaactt

SEQ ID NO: 3624181 - DNA, 23 bp, Homo sapiens
cagtttttcataagatattttat

SEQ ID NO: 3624182 - DNA, 13 bp, Homo sapiens
cataaaaaggaca

SEQ ID NO: 3624183 - DNA, 16 bp, Homo sapiens
cataaaagccccagct

SEQ ID NO: 3624184 - DNA, 13 bp, Homo sapiens
cataaacaaagac

SEQ ID NO: 3624185 - DNA, 20 bp, Homo sapiens
cataaacaaagacattgaca

SEQ ID NO: 3624186 - DNA, 12 bp, Homo sapiens
cataaacacatt

SEQ ID NO: 3624187 - DNA, 14 bp, Homo sapiens
cataaacacatttc

SEQ ID NO: 3624188 - DNA, 20 bp, Homo sapiens
cataaagaattaatgactta

SEQ ID NO: 3624189 - DNA, 14 bp, Homo sapiens
cataaagtaaatac

SEQ ID NO: 3624190 - DNA, 14 bp, Homo sapiens
cataaagtcttgcc

SEQ ID NO: 3624191 - DNA, 14 bp, Homo sapiens
cataaccctgtcac

SEQ ID NO: 3624192 - DNA, 20 bp, Homo sapiens
cataaccctgtcacccacag

SEQ ID NO: 3624193 - DNA, 12 bp, Homo sapiens
cataagagaaac

SEQ ID NO: 3624194 - DNA, 20 bp, Homo sapiens
cataagttatgcctctgaca

SEQ ID NO: 3624195 - DNA, 14 bp, Homo sapiens
cataataaatcaca

SEQ ID NO: 3624196 - DNA, 16 bp, Homo sapiens
cataataagtttcata

SEQ ID NO: 3624197 - DNA, 19 bp, Homo sapiens
cataatctggactcctctg

SEQ ID NO: 3624198 - DNA, 22 bp, Homo sapiens
cataatctggactcctctgtcc

SEQ ID NO: 3624199 - DNA, 23 bp, Homo sapiens
cataatctggactcctctgtcca

SEQ ID NO: 3624200 - DNA, 17 bp, Homo sapiens
cataatggtactcccaa

SEQ ID NO: 3624201 - DNA, 22 bp, Homo sapiens
cataatggtactcccaaactga

SEQ ID NO: 3624202 - DNA, 20 bp, Homo sapiens
cataatttaaaaatatattt

SEQ ID NO: 3624203 - DNA, 12 bp, Homo sapiens
cataattttgca

SEQ ID NO: 3624204 - DNA, 19 bp, Homo sapiens
catacaaaaattagccggg

SEQ ID NO: 3624205 - DNA, 16 bp, Homo sapiens
catacaaactctcacc

SEQ ID NO: 3624206 - DNA, 16 bp, Homo sapiens
catacaacagaaacca

SEQ ID NO: 3624207 - DNA, 22 bp, Homo sapiens
catacaacagaaaccagaaaag

SEQ ID NO: 3624208 - DNA, 13 bp, Homo sapiens
catacacacgctg

SEQ ID NO: 3624209 - DNA, 16 bp, Homo sapiens
catacacacgctgcct

SEQ ID NO: 3624210 - DNA, 17 bp, Homo sapiens
catacacacgctgcctt

SEQ ID NO: 3624211 - DNA, 19 bp, Homo sapiens
catacacacgctgccttcg

SEQ ID NO: 3624212 - DNA, 14 bp, Homo sapiens
catacaccagcatt

SEQ ID NO: 3624213 - DNA, 18 bp, Homo sapiens
catacaccagcattcctt

SEQ ID NO: 3624214 - DNA, 20 bp, Homo sapiens
catacaccagcattcctttt

SEQ ID NO: 3624215 - DNA, 19 bp, Homo sapiens
catacactaaccaaatctc

SEQ ID NO: 3624216 - DNA, 15 bp, Homo sapiens
catacacttccttct

SEQ ID NO: 3624217 - DNA, 17 bp, Homo sapiens
catacagagtgggcccc

SEQ ID NO: 3624218 - DNA, 22 bp, Homo sapiens
catacagagtgggccccgggct

SEQ ID NO: 3624219 - DNA, 15 bp, Homo sapiens
catacataaaagaaa

SEQ ID NO: 3624220 - DNA, 15 bp, Homo sapiens
catactatgaaatat

SEQ ID NO: 3624221 - DNA, 15 bp, Homo sapiens
catactccactccaa

SEQ ID NO: 3624222 - DNA, 22 bp, Homo sapiens
catactgccttgtttaatgtta

SEQ ID NO: 3624223 - DNA, 20 bp, Homo sapiens
catacttgaagggccagagc

SEQ ID NO: 3624224 - DNA, 22 bp, Homo sapiens
catacttgaagggccagagcca

SEQ ID NO: 3624225 - DNA, 23 bp, Homo sapiens
catacttgaagggccagagccag

SEQ ID NO: 3624226 - DNA, 14 bp, Homo sapiens
catagaatctgtga

SEQ ID NO: 3624227 - DNA, 19 bp, Homo sapiens
catagccccggccccccgc

SEQ ID NO: 3624228 - DNA, 22 bp, Homo sapiens
cataggattccaaggctttaaa

SEQ ID NO: 3624229 - DNA, 19 bp, Homo sapiens
catagtgatggttcccctg

SEQ ID NO: 3624230 - DNA, 13 bp, Homo sapiens
catataattttca

SEQ ID NO: 3624231 - DNA, 15 bp, Homo sapiens
catatagacacacat

SEQ ID NO: 3624232 - DNA, 16 bp, Homo sapiens
catatagacacacata

SEQ ID NO: 3624233 - DNA, 17 bp, Homo sapiens
catatagacacacatac

SEQ ID NO: 3624234 - DNA, 18 bp, Homo sapiens
catatagacacacataca

SEQ ID NO: 3624235 - DNA, 23 bp, Homo sapiens
catatagacacacatacataatg

SEQ ID NO: 3624236 - DNA, 19 bp, Homo sapiens
catatagccattgatcata

SEQ ID NO: 3624237 - DNA, 14 bp, Homo sapiens
catatataaattat

SEQ ID NO: 3624238 - DNA, 19 bp, Homo sapiens
catatcaaaacatcccaat

SEQ ID NO: 3624239 - DNA, 13 bp, Homo sapiens
catatcacatgtc

SEQ ID NO: 3624240 - DNA, 15 bp, Homo sapiens
catatgatctgtttt

SEQ ID NO: 3624241 - DNA, 16 bp, Homo sapiens
catatgctgacagctc

SEQ ID NO: 3624242 - DNA, 21 bp, Homo sapiens
catatgggtgggattttgcaa

SEQ ID NO: 3624243 - DNA, 20 bp, Homo sapiens
catatgtaacatcaagccat

SEQ ID NO: 3624244 - DNA, 21 bp, Homo sapiens
catatgtcactagaatggata

SEQ ID NO: 3624245 - DNA, 23 bp, Homo sapiens
catatgttagcattaaagttcta

SEQ ID NO: 3624246 - DNA, 17 bp, Homo sapiens
catattataaaggataa

SEQ ID NO: 3624247 - DNA, 22 bp, Homo sapiens
catattataaaggataaagaag

SEQ ID NO: 3624248 - DNA, 13 bp, Homo sapiens
catattatttcat

SEQ ID NO: 3624249 - DNA, 18 bp, Homo sapiens
catattcaaggagcaaga

SEQ ID NO: 3624250 - DNA, 18 bp, Homo sapiens
catatttaatttgaagat

SEQ ID NO: 3624251 - DNA, 20 bp, Homo sapiens
catatttacttcttatacat

SEQ ID NO: 3624252 - DNA, 14 bp, Homo sapiens
catatttattttct

SEQ ID NO: 3624253 - DNA, 13 bp, Homo sapiens
catatttgaaaac

SEQ ID NO: 3624254 - DNA, 17 bp, Homo sapiens
catatttgccaataaag

SEQ ID NO: 3624255 - DNA, 19 bp, Homo sapiens
catatttgccaataaagct

SEQ ID NO: 3624256 - DNA, 18 bp, Homo sapiens
catattttaaacagagga

SEQ ID NO: 3624257 - DNA, 21 bp, Homo sapiens
catattttattgtattttgat

SEQ ID NO: 3624258 - DNA, 16 bp, Homo sapiens
catcaaataaatttct

SEQ ID NO: 3624259 - DNA, 18 bp, Homo sapiens
catcaaataaatttctgg

SEQ ID NO: 3624260 - DNA, 12 bp, Homo sapiens
catcaagggaga

SEQ ID NO: 3624261 - DNA, 14 bp, Homo sapiens
catcaccatttcct

SEQ ID NO: 3624262 - DNA, 23 bp, Homo sapiens
catcacggatggtgcatgggctc

SEQ ID NO: 3624263 - DNA, 17 bp, Homo sapiens
catcagaactcttcctc

SEQ ID NO: 3624264 - DNA, 18 bp, Homo sapiens
catcagccccacaggact

SEQ ID NO: 3624265 - DNA, 15 bp, Homo sapiens
catcagtcaatggaa

SEQ ID NO: 3624266 - DNA, 20 bp, Homo sapiens
catcataaggagttggtgta

SEQ ID NO: 3624267 - DNA, 21 bp, Homo sapiens
catcatggactgagctggggg

SEQ ID NO: 3624268 - DNA, 20 bp, Homo sapiens
catcatttctgtctttaaga

SEQ ID NO: 3624269 - DNA, 18 bp, Homo sapiens
catccacataaccctgtc

SEQ ID NO: 3624270 - DNA, 19 bp, Homo sapiens
catccacccgggggagccc

SEQ ID NO: 3624271 - DNA, 22 bp, Homo sapiens
catccacccgggggagcccagt

SEQ ID NO: 3624272 - DNA, 18 bp, Homo sapiens
catccacttacatatatt

SEQ ID NO: 3624273 - DNA, 22 bp, Homo sapiens
catccagtgtgagatactgtgt

SEQ ID NO: 3624274 - DNA, 14 bp, Homo sapiens
catccatcctgagc

SEQ ID NO: 3624275 - DNA, 16 bp, Homo sapiens
catccatcctgagcca

SEQ ID NO: 3624276 - DNA, 18 bp, Homo sapiens
catccatgttccgagaag

SEQ ID NO: 3624277 - DNA, 11 bp, Homo sapiens
catccattcct

SEQ ID NO: 3624278 - DNA, 16 bp, Homo sapiens
catcccctccctgcct

SEQ ID NO: 3624279 - DNA, 20 bp, Homo sapiens
catcccgcttctgaagctgc

SEQ ID NO: 3624280 - DNA, 14 bp, Homo sapiens
catccctcacccat

SEQ ID NO: 3624281 - DNA, 16 bp, Homo sapiens
catccctgcctggagg

SEQ ID NO: 3624282 - DNA, 22 bp, Homo sapiens
catccctgcttgcccgctccca

SEQ ID NO: 3624283 - DNA, 18 bp, Homo sapiens
catccctggagcaggagc

SEQ ID NO: 3624284 - DNA, 22 bp, Homo sapiens
catcccttcctggaaacagcat

SEQ ID NO: 3624285 - DNA, 17 bp, Homo sapiens
catccctttcccttggt

SEQ ID NO: 3624286 - DNA, 16 bp, Homo sapiens
catccctttttttaca

SEQ ID NO: 3624287 - DNA, 14 bp, Homo sapiens
catccgactgcccc

SEQ ID NO: 3624288 - DNA, 15 bp, Homo sapiens
catccgcctgtgggc

SEQ ID NO: 3624289 - DNA, 21 bp, Homo sapiens
catccgtgcctctttttaaag

SEQ ID NO: 3624290 - DNA, 14 bp, Homo sapiens
catcctaggaacca

SEQ ID NO: 3624291 - DNA, 22 bp, Homo sapiens
catcctaggaaccagccaacca

SEQ ID NO: 3624292 - DNA, 20 bp, Homo sapiens
catcctcaaagaaagtgtat

SEQ ID NO: 3624293 - DNA, 15 bp, Homo sapiens
catcctcatccctga

SEQ ID NO: 3624294 - DNA, 16 bp, Homo sapiens
catcctcatccctgac

SEQ ID NO: 3624295 - DNA, 17 bp, Homo sapiens
catcctcatccctgact

SEQ ID NO: 3624296 - DNA, 13 bp, Homo sapiens
catcctggccaac

SEQ ID NO: 3624297 - DNA, 14 bp, Homo sapiens
catccttctcactg

SEQ ID NO: 3624298 - DNA, 16 bp, Homo sapiens
catccttctcactgcc

SEQ ID NO: 3624299 - DNA, 18 bp, Homo sapiens
catccttgattacttcca

SEQ ID NO: 3624300 - DNA, 22 bp, Homo sapiens
catccttgattacttccactga

SEQ ID NO: 3624301 - DNA, 23 bp, Homo sapiens
catcgattgtgtacttttccttt

SEQ ID NO: 3624302 - DNA, 18 bp, Homo sapiens
catcgcacagtttaccca

SEQ ID NO: 3624303 - DNA, 18 bp, Homo sapiens
catcgcgggatggtgcag

SEQ ID NO: 3624304 - DNA, 18 bp, Homo sapiens
catcggaggcccatgccc

SEQ ID NO: 3624305 - DNA, 20 bp, Homo sapiens
catcggccaagaatacttga

SEQ ID NO: 3624306 - DNA, 20 bp, Homo sapiens
catcgggagcacccagagca

SEQ ID NO: 3624307 - DNA, 16 bp, Homo sapiens
catcgtggtgggggag

SEQ ID NO: 3624308 - DNA, 22 bp, Homo sapiens
catcgttttcttcactgtcctc

SEQ ID NO: 3624309 - DNA, 16 bp, Homo sapiens
catctcaaaacaaaac

SEQ ID NO: 3624310 - DNA, 13 bp, Homo sapiens
catctcagcccac

SEQ ID NO: 3624311 - DNA, 22 bp, Homo sapiens
catctcagggaactgaccctca

SEQ ID NO: 3624312 - DNA, 18 bp, Homo sapiens
catctcatgagtgtgccc

SEQ ID NO: 3624313 - DNA, 17 bp, Homo sapiens
catctcccttttccatg

SEQ ID NO: 3624314 - DNA, 21 bp, Homo sapiens
catctctccccatatataaat

SEQ ID NO: 3624315 - DNA, 16 bp, Homo sapiens
catctctctgcccaac

SEQ ID NO: 3624316 - DNA, 18 bp, Homo sapiens
catctgaatgaaaataac

SEQ ID NO: 3624317 - DNA, 21 bp, Homo sapiens
catctgaatgaaaataactga

SEQ ID NO: 3624318 - DNA, 23 bp, Homo sapiens
catctgaatgaaaataactgaac

SEQ ID NO: 3624319 - DNA, 21 bp, Homo sapiens
catctgaccagcagcgccttt

SEQ ID NO: 3624320 - DNA, 19 bp, Homo sapiens
catctgactgccaagccag

SEQ ID NO: 3624321 - DNA, 18 bp, Homo sapiens
catctgagaggctctccg

SEQ ID NO: 3624322 - DNA, 13 bp, Homo sapiens
catctgctgcagt

SEQ ID NO: 3624323 - DNA, 18 bp, Homo sapiens
catctggctgcacaggct

SEQ ID NO: 3624324 - DNA, 19 bp, Homo sapiens
catctggctgcacaggctg

SEQ ID NO: 3624325 - DNA, 15 bp, Homo sapiens
catctgggggagtgg

SEQ ID NO: 3624326 - DNA, 18 bp, Homo sapiens
catctgggggagtggaat

SEQ ID NO: 3624327 - DNA, 18 bp, Homo sapiens
catctgtataccctctgt

SEQ ID NO: 3624328 - DNA, 21 bp, Homo sapiens
catctgtataccctctgtttc

SEQ ID NO: 3624329 - DNA, 11 bp, Homo sapiens
catctgtctcg

SEQ ID NO: 3624330 - DNA, 22 bp, Homo sapiens
catctgtctcggctctgcatgt

SEQ ID NO: 3624331 - DNA, 15 bp, Homo sapiens
catctgtggagctgc

SEQ ID NO: 3624332 - DNA, 20 bp, Homo sapiens
catctgtggagctgccacag

SEQ ID NO: 3624333 - DNA, 22 bp, Homo sapiens
catctgtggagctgccacagag

SEQ ID NO: 3624334 - DNA, 18 bp, Homo sapiens
catcttgcagcatttact

SEQ ID NO: 3624335 - DNA, 14 bp, Homo sapiens
catcttgctaccag

SEQ ID NO: 3624336 - DNA, 17 bp, Homo sapiens
catcttgctaccagtat

SEQ ID NO: 3624337 - DNA, 20 bp, Homo sapiens
catcttgctaccagtattta

SEQ ID NO: 3624338 - DNA, 20 bp, Homo sapiens
catcttggccctcctcagct

SEQ ID NO: 3624339 - DNA, 21 bp, Homo sapiens
catcttggccctcctcagctc

SEQ ID NO: 3624340 - DNA, 19 bp, Homo sapiens
catctttagcagtttcctc

SEQ ID NO: 3624341 - DNA, 15 bp, Homo sapiens
catctttgccatatg

SEQ ID NO: 3624342 - DNA, 14 bp, Homo sapiens
catgaaaaagctgc

SEQ ID NO: 3624343 - DNA, 15 bp, Homo sapiens
catgaaaaagctgct

SEQ ID NO: 3624344 - DNA, 13 bp, Homo sapiens
catgaaacagaaa

SEQ ID NO: 3624345 - DNA, 12 bp, Homo sapiens
catgaaagaaaa

SEQ ID NO: 3624346 - DNA, 13 bp, Homo sapiens
catgaaataaaat

SEQ ID NO: 3624347 - DNA, 12 bp, Homo sapiens
catgaaatatat

SEQ ID NO: 3624348 - DNA, 14 bp, Homo sapiens
catgaaatttttaa

SEQ ID NO: 3624349 - DNA, 15 bp, Homo sapiens
catgaagcagaacct

SEQ ID NO: 3624350 - DNA, 22 bp, Homo sapiens
catgaagcagaaccttctttgg

SEQ ID NO: 3624351 - DNA, 14 bp, Homo sapiens
catgaataaaacac

SEQ ID NO: 3624352 - DNA, 18 bp, Homo sapiens
catgaatgggcatttcta

SEQ ID NO: 3624353 - DNA, 20 bp, Homo sapiens
catgactcgtatatgtctca

SEQ ID NO: 3624354 - DNA, 14 bp, Homo sapiens
catgactgcatgac

SEQ ID NO: 3624355 - DNA, 14 bp, Homo sapiens
catgagccactgtg

SEQ ID NO: 3624356 - DNA, 21 bp, Homo sapiens
catgagccactgtgcttggcc

SEQ ID NO: 3624357 - DNA, 22 bp, Homo sapiens
catgagctggcaaccagccagc

SEQ ID NO: 3624358 - DNA, 17 bp, Homo sapiens
catgaggccatctcagg

SEQ ID NO: 3624359 - DNA, 15 bp, Homo sapiens
catgagtcaaaacaa

SEQ ID NO: 3624360 - DNA, 16 bp, Homo sapiens
catgagtcaaaacaaa

SEQ ID NO: 3624361 - DNA, 17 bp, Homo sapiens
catgagtggaaatacac

SEQ ID NO: 3624362 - DNA, 16 bp, Homo sapiens
catgataataggtcat

SEQ ID NO: 3624363 - DNA, 21 bp, Homo sapiens
catgataataggtcatatgtt

SEQ ID NO: 3624364 - DNA, 23 bp, Homo sapiens
catgatccccgtctctgccctgg

SEQ ID NO: 3624365 - DNA, 13 bp, Homo sapiens
catgatgcacagt

SEQ ID NO: 3624366 - DNA, 20 bp, Homo sapiens
catgatgcacagtatctgct

SEQ ID NO: 3624367 - DNA, 12 bp, Homo sapiens
catgatgtatat

SEQ ID NO: 3624368 - DNA, 13 bp, Homo sapiens
catgatgtatatc

SEQ ID NO: 3624369 - DNA, 13 bp, Homo sapiens
catgatgtccttg

SEQ ID NO: 3624370 - DNA, 22 bp, Homo sapiens
catgatgtgaagagtttcacaa

SEQ ID NO: 3624371 - DNA, 15 bp, Homo sapiens
catgcaactggagtt

SEQ ID NO: 3624372 - DNA, 18 bp, Homo sapiens
catgcaagtggagctgtc

SEQ ID NO: 3624373 - DNA, 16 bp, Homo sapiens
catgcaccctcataca

SEQ ID NO: 3624374 - DNA, 22 bp, Homo sapiens
catgcaccttccagcccggggc

SEQ ID NO: 3624375 - DNA, 16 bp, Homo sapiens
catgcactcaccccta

SEQ ID NO: 3624376 - DNA, 15 bp, Homo sapiens
catgcactcagctct

SEQ ID NO: 3624377 - DNA, 14 bp, Homo sapiens
catgcactgtgaag

SEQ ID NO: 3624378 - DNA, 20 bp, Homo sapiens
catgcactgtgaaggaccct

SEQ ID NO: 3624379 - DNA, 22 bp, Homo sapiens
catgcactgtgaaggacccttg

SEQ ID NO: 3624380 - DNA, 12 bp, Homo sapiens
catgcagcgcca

SEQ ID NO: 3624381 - DNA, 15 bp, Homo sapiens
catgcaggaaggaaa

SEQ ID NO: 3624382 - DNA, 15 bp, Homo sapiens
catgcataaaaatta

SEQ ID NO: 3624383 - DNA, 20 bp, Homo sapiens
catgcatataatgaataaat

SEQ ID NO: 3624384 - DNA, 21 bp, Homo sapiens
catgcatataatgaataaatc

SEQ ID NO: 3624385 - DNA, 14 bp, Homo sapiens
catgcatgcagcgc

SEQ ID NO: 3624386 - DNA, 20 bp, Homo sapiens
catgcattcacatatctgct

SEQ ID NO: 3624387 - DNA, 17 bp, Homo sapiens
catgccacaaggacttc

SEQ ID NO: 3624388 - DNA, 16 bp, Homo sapiens
catgccagtaactgtg

SEQ ID NO: 3624389 - DNA, 22 bp, Homo sapiens
catgccccagtcggccccatct

SEQ ID NO: 3624390 - DNA, 14 bp, Homo sapiens
catgccctcctctc

SEQ ID NO: 3624391 - DNA, 13 bp, Homo sapiens
catgccctctctc

SEQ ID NO: 3624392 - DNA, 23 bp, Homo sapiens
catgccctctctcgggagcccta

SEQ ID NO: 3624393 - DNA, 23 bp, Homo sapiens
catgccgggcccctccatccacc

SEQ ID NO: 3624394 - DNA, 15 bp, Homo sapiens
catgcctcctcagga

SEQ ID NO: 3624395 - DNA, 23 bp, Homo sapiens
catgctagcatgggtatttttat

SEQ ID NO: 3624396 - DNA, 14 bp, Homo sapiens
catgctagtgttgt

SEQ ID NO: 3624397 - DNA, 17 bp, Homo sapiens
catgctcaacccccctc

SEQ ID NO: 3624398 - DNA, 23 bp, Homo sapiens
catgctcaacccccctcccagac

SEQ ID NO: 3624399 - DNA, 12 bp, Homo sapiens
catgctcacaca

SEQ ID NO: 3624400 - DNA, 23 bp, Homo sapiens
catgctctctttcttttctctgt

SEQ ID NO: 3624401 - DNA, 19 bp, Homo sapiens
catgctgaaggctgaaaga

SEQ ID NO: 3624402 - DNA, 13 bp, Homo sapiens
catgctgcctggc

SEQ ID NO: 3624403 - DNA, 15 bp, Homo sapiens
catgctgcctggcac

SEQ ID NO: 3624404 - DNA, 16 bp, Homo sapiens
catgctgcctggcaca

SEQ ID NO: 3624405 - DNA, 17 bp, Homo sapiens
catgctgccttcaggga

SEQ ID NO: 3624406 - DNA, 23 bp, Homo sapiens
catgctgctcccctaaagccagg

SEQ ID NO: 3624407 - DNA, 14 bp, Homo sapiens
catgcttgggctga

SEQ ID NO: 3624408 - DNA, 15 bp, Homo sapiens
catgcttgggctgac

SEQ ID NO: 3624409 - DNA, 15 bp, Homo sapiens
catgcttttctgcca

SEQ ID NO: 3624410 - DNA, 17 bp, Homo sapiens
catgcttttctgccact

SEQ ID NO: 3624411 - DNA, 20 bp, Homo sapiens
catgcttttctgccactcca

SEQ ID NO: 3624412 - DNA, 16 bp, Homo sapiens
catggaaaaatggttg

SEQ ID NO: 3624413 - DNA, 17 bp, Homo sapiens
catggaattccctcctg

SEQ ID NO: 3624414 - DNA, 18 bp, Homo sapiens
catggagccccctctgcc

SEQ ID NO: 3624415 - DNA, 22 bp, Homo sapiens
catggagcctacctctgtctga

SEQ ID NO: 3624416 - DNA, 15 bp, Homo sapiens
catggagctgggcta

SEQ ID NO: 3624417 - DNA, 17 bp, Homo sapiens
catggaggtttgaagat

SEQ ID NO: 3624418 - DNA, 14 bp, Homo sapiens
catggcagctcctg

SEQ ID NO: 3624419 - DNA, 15 bp, Homo sapiens
catggccatcttctt

SEQ ID NO: 3624420 - DNA, 19 bp, Homo sapiens
catggccatcttctttctt

SEQ ID NO: 3624421 - DNA, 16 bp, Homo sapiens
catggccggctttcag

SEQ ID NO: 3624422 - DNA, 17 bp, Homo sapiens
catggccggctttcagg

SEQ ID NO: 3624423 - DNA, 18 bp, Homo sapiens
catggccggctttcagga

SEQ ID NO: 3624424 - DNA, 20 bp, Homo sapiens
catggccggctttcaggagc

SEQ ID NO: 3624425 - DNA, 22 bp, Homo sapiens
catggccggctttcaggagctc

SEQ ID NO: 3624426 - DNA, 16 bp, Homo sapiens
catggctaactggcga

SEQ ID NO: 3624427 - DNA, 22 bp, Homo sapiens
catgggcctttaagaaccttaa

SEQ ID NO: 3624428 - DNA, 13 bp, Homo sapiens
catgggctcttca

SEQ ID NO: 3624429 - DNA, 23 bp, Homo sapiens
catggggaggttgtggggcctca

SEQ ID NO: 3624430 - DNA, 19 bp, Homo sapiens
catggggctgattgtattt

SEQ ID NO: 3624431 - DNA, 16 bp, Homo sapiens
catgggtccagggcct

SEQ ID NO: 3624432 - DNA, 21 bp, Homo sapiens
catgggtccagggcctgacac

SEQ ID NO: 3624433 - DNA, 17 bp, Homo sapiens
catggtcccttaaggca

SEQ ID NO: 3624434 - DNA, 20 bp, Homo sapiens
catggtcccttaaggcacag

SEQ ID NO: 3624435 - DNA, 22 bp, Homo sapiens
catggtgccccaggaccagctc

SEQ ID NO: 3624436 - DNA, 20 bp, Homo sapiens
catggtggcacacgcctgta

SEQ ID NO: 3624437 - DNA, 13 bp, Homo sapiens
catggtgtggggg

SEQ ID NO: 3624438 - DNA, 21 bp, Homo sapiens
catggtgtggggggctggggg

SEQ ID NO: 3624439 - DNA, 22 bp, Homo sapiens
catggtgtggggggctggggga

SEQ ID NO: 3624440 - DNA, 14 bp, Homo sapiens
catggttcaagtat

SEQ ID NO: 3624441 - DNA, 23 bp, Homo sapiens
catgtaaatactttccatgtttt

SEQ ID NO: 3624442 - DNA, 14 bp, Homo sapiens
catgtaagaaataa

SEQ ID NO: 3624443 - DNA, 12 bp, Homo sapiens
catgtagcatat

SEQ ID NO: 3624444 - DNA, 17 bp, Homo sapiens
catgtagcatataaatg

SEQ ID NO: 3624445 - DNA, 21 bp, Homo sapiens
catgtagcatataaatgttta

SEQ ID NO: 3624446 - DNA, 19 bp, Homo sapiens
catgtatgagtgtatgtgt

SEQ ID NO: 3624447 - DNA, 17 bp, Homo sapiens
catgtattgcacattgt

SEQ ID NO: 3624448 - DNA, 18 bp, Homo sapiens
catgtcagccactgtgat

SEQ ID NO: 3624449 - DNA, 20 bp, Homo sapiens
catgtcgcctctgcattcag

SEQ ID NO: 3624450 - DNA, 14 bp, Homo sapiens
catgtcttgtcata

SEQ ID NO: 3624451 - DNA, 21 bp, Homo sapiens
catgtcttgtcatacaaattt

SEQ ID NO: 3624452 - DNA, 13 bp, Homo sapiens
catgtgacattta

SEQ ID NO: 3624453 - DNA, 15 bp, Homo sapiens
catgtgagtctggga

SEQ ID NO: 3624454 - DNA, 18 bp, Homo sapiens
catgtgcattattttcca

SEQ ID NO: 3624455 - DNA, 19 bp, Homo sapiens
catgtgcctttctttgcct

SEQ ID NO: 3624456 - DNA, 21 bp, Homo sapiens
catgtgcctttctttgcctct

SEQ ID NO: 3624457 - DNA, 22 bp, Homo sapiens
catgtgcctttctttgcctctg

SEQ ID NO: 3624458 - DNA, 23 bp, Homo sapiens
catgtgtagagcccctactgtgg

SEQ ID NO: 3624459 - DNA, 18 bp, Homo sapiens
catgtgtgcatgtgctgt

SEQ ID NO: 3624460 - DNA, 16 bp, Homo sapiens
catgtgttttcatcat

SEQ ID NO: 3624461 - DNA, 23 bp, Homo sapiens
catgtgttttcatcatttcagcc

SEQ ID NO: 3624462 - DNA, 22 bp, Homo sapiens
catgttagttaccttatagtta

SEQ ID NO: 3624463 - DNA, 24 bp, Homo sapiens
catgttagttaccttatagttact

SEQ ID NO: 3624464 - DNA, 16 bp, Homo sapiens
catgttatgcagtgaa

SEQ ID NO: 3624465 - DNA, 21 bp, Homo sapiens
catgttatgcagtgaactatt

SEQ ID NO: 3624466 - DNA, 14 bp, Homo sapiens
catgttctttgtac

SEQ ID NO: 3624467 - DNA, 16 bp, Homo sapiens
catgttggaaatgtgt

SEQ ID NO: 3624468 - DNA, 19 bp, Homo sapiens
catgttgggttgttacaga

SEQ ID NO: 3624469 - DNA, 16 bp, Homo sapiens
catgttgtaatgctgc

SEQ ID NO: 3624470 - DNA, 20 bp, Homo sapiens
catgttgtaatgctgcactt

SEQ ID NO: 3624471 - DNA, 20 bp, Homo sapiens
catgtttccatcatttctgt

SEQ ID NO: 3624472 - DNA, 14 bp, Homo sapiens
catgttttagcatt

SEQ ID NO: 3624473 - DNA, 18 bp, Homo sapiens
catgttttatactgctct

SEQ ID NO: 3624474 - DNA, 13 bp, Homo sapiens
catgttttttcat

SEQ ID NO: 3624475 - DNA, 23 bp, Homo sapiens
catgttttttcttcaaatgttta

SEQ ID NO: 3624476 - DNA, 22 bp, Homo sapiens
cattaaaaaaaaaaaaaaaagt

SEQ ID NO: 3624477 - DNA, 18 bp, Homo sapiens
cattaaaaagttgttctt

SEQ ID NO: 3624478 - DNA, 11 bp, Homo sapiens
cattaaaatat

SEQ ID NO: 3624479 - DNA, 19 bp, Homo sapiens
cattaaactagtgttatac

SEQ ID NO: 3624480 - DNA, 17 bp, Homo sapiens
cattaacggtgctaaaa

SEQ ID NO: 3624481 - DNA, 17 bp, Homo sapiens
cattaatatttaccaaa

SEQ ID NO: 3624482 - DNA, 15 bp, Homo sapiens
cattacaccacagca

SEQ ID NO: 3624483 - DNA, 12 bp, Homo sapiens
cattacagccat

SEQ ID NO: 3624484 - DNA, 20 bp, Homo sapiens
cattagagaaaaccttaaaa

SEQ ID NO: 3624485 - DNA, 16 bp, Homo sapiens
cattagttttgaagat

SEQ ID NO: 3624486 - DNA, 15 bp, Homo sapiens
cattatattctctta

SEQ ID NO: 3624487 - DNA, 13 bp, Homo sapiens
cattatatttatt

SEQ ID NO: 3624488 - DNA, 19 bp, Homo sapiens
cattatatttattgtttat

SEQ ID NO: 3624489 - DNA, 23 bp, Homo sapiens
cattatatttattgtttatttta

SEQ ID NO: 3624490 - DNA, 17 bp, Homo sapiens
cattatctacttgtgta

SEQ ID NO: 3624491 - DNA, 12 bp, Homo sapiens
cattatctcaaa

SEQ ID NO: 3624492 - DNA, 13 bp, Homo sapiens
cattatctcaaaa

SEQ ID NO: 3624493 - DNA, 20 bp, Homo sapiens
cattatgactgttgttctta

SEQ ID NO: 3624494 - DNA, 20 bp, Homo sapiens
cattatggtagaatcatttt

SEQ ID NO: 3624495 - DNA, 14 bp, Homo sapiens
cattatgtagctgt

SEQ ID NO: 3624496 - DNA, 15 bp, Homo sapiens
cattatgtagctgtc

SEQ ID NO: 3624497 - DNA, 16 bp, Homo sapiens
cattatgttaatattt

SEQ ID NO: 3624498 - DNA, 20 bp, Homo sapiens
cattatttttgttagcaaag

SEQ ID NO: 3624499 - DNA, 13 bp, Homo sapiens
cattcacaagcct

SEQ ID NO: 3624500 - DNA, 16 bp, Homo sapiens
cattcacaagcctcct

SEQ ID NO: 3624501 - DNA, 16 bp, Homo sapiens
cattcacatatctgct

SEQ ID NO: 3624502 - DNA, 16 bp, Homo sapiens
cattcagactaaaaat

SEQ ID NO: 3624503 - DNA, 20 bp, Homo sapiens
cattcagctctggagaacag

SEQ ID NO: 3624504 - DNA, 21 bp, Homo sapiens
cattcagtaagttctgtggtt

SEQ ID NO: 3624505 - DNA, 17 bp, Homo sapiens
cattcagttctaggcct

SEQ ID NO: 3624506 - DNA, 18 bp, Homo sapiens
cattcagttctaggcctt

SEQ ID NO: 3624507 - DNA, 16 bp, Homo sapiens
cattccaaagctttat

SEQ ID NO: 3624508 - DNA, 17 bp, Homo sapiens
cattccaccctgttact

SEQ ID NO: 3624509 - DNA, 13 bp, Homo sapiens
cattccagaggaa

SEQ ID NO: 3624510 - DNA, 14 bp, Homo sapiens
cattcccagcctga

SEQ ID NO: 3624511 - DNA, 22 bp, Homo sapiens
cattcccagcctgactagaact

SEQ ID NO: 3624512 - DNA, 23 bp, Homo sapiens
cattcccagcctgactagaactc

SEQ ID NO: 3624513 - DNA, 14 bp, Homo sapiens
cattcctccagcct

SEQ ID NO: 3624514 - DNA, 16 bp, Homo sapiens
cattcctccagcctcc

SEQ ID NO: 3624515 - DNA, 17 bp, Homo sapiens
cattcctccagcctccc

SEQ ID NO: 3624516 - DNA, 18 bp, Homo sapiens
cattcctccagcctcccc

SEQ ID NO: 3624517 - DNA, 19 bp, Homo sapiens
cattcctccagcctcccct

SEQ ID NO: 3624518 - DNA, 17 bp, Homo sapiens
cattcctgaagaaccag

SEQ ID NO: 3624519 - DNA, 15 bp, Homo sapiens
cattcctgcctttaa

SEQ ID NO: 3624520 - DNA, 19 bp, Homo sapiens
cattcctgcctttaagcca

SEQ ID NO: 3624521 - DNA, 21 bp, Homo sapiens
cattcctgcctttaagccaaa

SEQ ID NO: 3624522 - DNA, 17 bp, Homo sapiens
cattcctgtgccctaga

SEQ ID NO: 3624523 - DNA, 22 bp, Homo sapiens
cattcggggtgatcctgttctg

SEQ ID NO: 3624524 - DNA, 15 bp, Homo sapiens
cattcgtgagctggg

SEQ ID NO: 3624525 - DNA, 17 bp, Homo sapiens
cattcgtgagctgggga

SEQ ID NO: 3624526 - DNA, 23 bp, Homo sapiens
cattcgtgagctggggactcagg

SEQ ID NO: 3624527 - DNA, 16 bp, Homo sapiens
cattctaccaagctgt

SEQ ID NO: 3624528 - DNA, 15 bp, Homo sapiens
cattctactgaaaag

SEQ ID NO: 3624529 - DNA, 18 bp, Homo sapiens
cattctattctccagaca

SEQ ID NO: 3624530 - DNA, 12 bp, Homo sapiens
cattctcccagc

SEQ ID NO: 3624531 - DNA, 16 bp, Homo sapiens
cattctctcccatcct

SEQ ID NO: 3624532 - DNA, 18 bp, Homo sapiens
cattctctcccatcctgg

SEQ ID NO: 3624533 - DNA, 19 bp, Homo sapiens
cattctggttccctgctgc

SEQ ID NO: 3624534 - DNA, 21 bp, Homo sapiens
cattctggttccctgctgcgc

SEQ ID NO: 3624535 - DNA, 12 bp, Homo sapiens
cattcttactaa

SEQ ID NO: 3624536 - DNA, 22 bp, Homo sapiens
cattcttactaaaaagtataaa

SEQ ID NO: 3624537 - DNA, 13 bp, Homo sapiens
cattcttcctagt

SEQ ID NO: 3624538 - DNA, 15 bp, Homo sapiens
cattctttactgcac

SEQ ID NO: 3624539 - DNA, 16 bp, Homo sapiens
cattctttactgcact

SEQ ID NO: 3624540 - DNA, 20 bp, Homo sapiens
cattctttactgcactcaga

SEQ ID NO: 3624541 - DNA, 14 bp, Homo sapiens
cattctttttgaaa

SEQ ID NO: 3624542 - DNA, 14 bp, Homo sapiens
cattgaaataataa

SEQ ID NO: 3624543 - DNA, 16 bp, Homo sapiens
cattgaaataataata

SEQ ID NO: 3624544 - DNA, 19 bp, Homo sapiens
cattgaatggatcaataca

SEQ ID NO: 3624545 - DNA, 14 bp, Homo sapiens
cattgcacctatct

SEQ ID NO: 3624546 - DNA, 16 bp, Homo sapiens
cattgcagcctaagaa

SEQ ID NO: 3624547 - DNA, 17 bp, Homo sapiens
cattgcagcctaagaag

SEQ ID NO: 3624548 - DNA, 19 bp, Homo sapiens
cattgcagcctaagaagaa

SEQ ID NO: 3624549 - DNA, 13 bp, Homo sapiens
cattgcagcttca

SEQ ID NO: 3624550 - DNA, 17 bp, Homo sapiens
cattgccgctgtataaa

SEQ ID NO: 3624551 - DNA, 14 bp, Homo sapiens
cattgcctgtaaca

SEQ ID NO: 3624552 - DNA, 18 bp, Homo sapiens
cattgctgcatatttgac

SEQ ID NO: 3624553 - DNA, 12 bp, Homo sapiens
cattgctggctg

SEQ ID NO: 3624554 - DNA, 21 bp, Homo sapiens
cattggcaaagtgacaaagca

SEQ ID NO: 3624555 - DNA, 14 bp, Homo sapiens
cattggtcttcttt

SEQ ID NO: 3624556 - DNA, 20 bp, Homo sapiens
cattgtaaaagcattttgta

SEQ ID NO: 3624557 - DNA, 17 bp, Homo sapiens
cattgtagagcttctgg

SEQ ID NO: 3624558 - DNA, 21 bp, Homo sapiens
cattgtagagcttctggcact

SEQ ID NO: 3624559 - DNA, 13 bp, Homo sapiens
cattgtccctctg

SEQ ID NO: 3624560 - DNA, 14 bp, Homo sapiens
cattgtccctctgc

SEQ ID NO: 3624561 - DNA, 15 bp, Homo sapiens
cattgtccctctgcc

SEQ ID NO: 3624562 - DNA, 17 bp, Homo sapiens
cattgtttagatgaggc

SEQ ID NO: 3624563 - DNA, 22 bp, Homo sapiens
cattgtttcccatcactgtatc

SEQ ID NO: 3624564 - DNA, 21 bp, Homo sapiens
catttaaaacattaaaatata

SEQ ID NO: 3624565 - DNA, 12 bp, Homo sapiens
catttaataata

SEQ ID NO: 3624566 - DNA, 15 bp, Homo sapiens
catttatatattgaa

SEQ ID NO: 3624567 - DNA, 22 bp, Homo sapiens
catttatatattgaattaatat

SEQ ID NO: 3624568 - DNA, 16 bp, Homo sapiens
catttatgaagcaagc

SEQ ID NO: 3624569 - DNA, 15 bp, Homo sapiens
catttattaagcagt

SEQ ID NO: 3624570 - DNA, 16 bp, Homo sapiens
catttattaagcagta

SEQ ID NO: 3624571 - DNA, 19 bp, Homo sapiens
catttcaatccatttttta

SEQ ID NO: 3624572 - DNA, 14 bp, Homo sapiens
catttcatgaaaaa

SEQ ID NO: 3624573 - DNA, 16 bp, Homo sapiens
catttccataccattg

SEQ ID NO: 3624574 - DNA, 20 bp, Homo sapiens
catttcctgacagaaggact

SEQ ID NO: 3624575 - DNA, 20 bp, Homo sapiens
catttctagcgcatggcctg

SEQ ID NO: 3624576 - DNA, 19 bp, Homo sapiens
catttctatattcctccag

SEQ ID NO: 3624577 - DNA, 20 bp, Homo sapiens
catttctatattcctccagc

SEQ ID NO: 3624578 - DNA, 17 bp, Homo sapiens
catttctcatgttgaag

SEQ ID NO: 3624579 - DNA, 21 bp, Homo sapiens
catttctcttccccttagaaa

SEQ ID NO: 3624580 - DNA, 15 bp, Homo sapiens
catttctgatgtctc

SEQ ID NO: 3624581 - DNA, 14 bp, Homo sapiens
catttctgattctg

SEQ ID NO: 3624582 - DNA, 21 bp, Homo sapiens
catttgaaacccctgtaggcc

SEQ ID NO: 3624583 - DNA, 13 bp, Homo sapiens
catttgatttgta

SEQ ID NO: 3624584 - DNA, 20 bp, Homo sapiens
catttgcttgtactgggaca

SEQ ID NO: 3624585 - DNA, 12 bp, Homo sapiens
catttgctttaa

SEQ ID NO: 3624586 - DNA, 14 bp, Homo sapiens
catttgctttggaa

SEQ ID NO: 3624587 - DNA, 15 bp, Homo sapiens
catttgctttggaag

SEQ ID NO: 3624588 - DNA, 21 bp, Homo sapiens
catttggaaatgatttactgg

SEQ ID NO: 3624589 - DNA, 15 bp, Homo sapiens
catttggattggatg

SEQ ID NO: 3624590 - DNA, 14 bp, Homo sapiens
catttggattgggg

SEQ ID NO: 3624591 - DNA, 18 bp, Homo sapiens
catttgggagacatgtga

SEQ ID NO: 3624592 - DNA, 17 bp, Homo sapiens
catttggggtaatactt

SEQ ID NO: 3624593 - DNA, 15 bp, Homo sapiens
catttgtaaaaatga

SEQ ID NO: 3624594 - DNA, 16 bp, Homo sapiens
catttgtgaaatgatg

SEQ ID NO: 3624595 - DNA, 17 bp, Homo sapiens
catttgtgggcaagcag

SEQ ID NO: 3624596 - DNA, 16 bp, Homo sapiens
catttgttaatatttc

SEQ ID NO: 3624597 - DNA, 19 bp, Homo sapiens
catttgttaatatttcttc

SEQ ID NO: 3624598 - DNA, 20 bp, Homo sapiens
cattttaaattccactgaaa

SEQ ID NO: 3624599 - DNA, 20 bp, Homo sapiens
cattttacccacacacagat

SEQ ID NO: 3624600 - DNA, 18 bp, Homo sapiens
cattttagaatgtcaata

SEQ ID NO: 3624601 - DNA, 15 bp, Homo sapiens
cattttcgtttttaa

SEQ ID NO: 3624602 - DNA, 21 bp, Homo sapiens
cattttctggtactctgtgaa

SEQ ID NO: 3624603 - DNA, 12 bp, Homo sapiens
cattttgtaaat

SEQ ID NO: 3624604 - DNA, 13 bp, Homo sapiens
cattttgtatcaa

SEQ ID NO: 3624605 - DNA, 20 bp, Homo sapiens
catttttaattcacgtgctt

SEQ ID NO: 3624606 - DNA, 21 bp, Homo sapiens
catttttctcccaagaaacct

SEQ ID NO: 3624607 - DNA, 18 bp, Homo sapiens
cattttttaaaaaagcaa

SEQ ID NO: 3624608 - DNA, 16 bp, Homo sapiens
cattttttaggtgctt

SEQ ID NO: 3624609 - DNA, 22 bp, Homo sapiens
cattttttttctttgaataaat

SEQ ID NO: 3624610 - DNA, 16 bp, Homo sapiens
ccaaaaataaatatat

SEQ ID NO: 3624611 - DNA, 17 bp, Homo sapiens
ccaaaacagctttgtct

SEQ ID NO: 3624612 - DNA, 18 bp, Homo sapiens
ccaaaacagctttgtctc

SEQ ID NO: 3624613 - DNA, 18 bp, Homo sapiens
ccaaaacatttctggaca

SEQ ID NO: 3624614 - DNA, 18 bp, Homo sapiens
ccaaaacattttaaatga

SEQ ID NO: 3624615 - DNA, 21 bp, Homo sapiens
ccaaaacattttaaatgaaag

SEQ ID NO: 3624616 - DNA, 19 bp, Homo sapiens
ccaaaagacattagagaaa

SEQ ID NO: 3624617 - DNA, 22 bp, Homo sapiens
ccaaaagacattagagaaaacc

SEQ ID NO: 3624618 - DNA, 12 bp, Homo sapiens
ccaaaccccagc

SEQ ID NO: 3624619 - DNA, 13 bp, Homo sapiens
ccaaaccccagcc

SEQ ID NO: 3624620 - DNA, 16 bp, Homo sapiens
ccaaaccccctgcagc

SEQ ID NO: 3624621 - DNA, 17 bp, Homo sapiens
ccaaacccttgctttcc

SEQ ID NO: 3624622 - DNA, 13 bp, Homo sapiens
ccaaacctccagc

SEQ ID NO: 3624623 - DNA, 14 bp, Homo sapiens
ccaaacctccagcc

SEQ ID NO: 3624624 - DNA, 17 bp, Homo sapiens
ccaaacctccagcctcc

SEQ ID NO: 3624625 - DNA, 21 bp, Homo sapiens
ccaaacctccagcctccctgt

SEQ ID NO: 3624626 - DNA, 13 bp, Homo sapiens
ccaaacctgtctt

SEQ ID NO: 3624627 - DNA, 20 bp, Homo sapiens
ccaaactgacaattttacct

SEQ ID NO: 3624628 - DNA, 14 bp, Homo sapiens
ccaaactgtagtaa

SEQ ID NO: 3624629 - DNA, 22 bp, Homo sapiens
ccaaactttctcataagcacct

SEQ ID NO: 3624630 - DNA, 18 bp, Homo sapiens
ccaaagaaacaagctgtg

SEQ ID NO: 3624631 - DNA, 21 bp, Homo sapiens
ccaaagaagatagctctctga

SEQ ID NO: 3624632 - DNA, 17 bp, Homo sapiens
ccaaagactctggaggt

SEQ ID NO: 3624633 - DNA, 17 bp, Homo sapiens
ccaaagcaaagaaaata

SEQ ID NO: 3624634 - DNA, 17 bp, Homo sapiens
ccaaagctgttccatta

SEQ ID NO: 3624635 - DNA, 12 bp, Homo sapiens
ccaaataaataa

SEQ ID NO: 3624636 - DNA, 18 bp, Homo sapiens
ccaaatcaaggataaata

SEQ ID NO: 3624637 - DNA, 24 bp, Homo sapiens
ccaaatcctagactgctcctgggc

SEQ ID NO: 3624638 - DNA, 19 bp, Homo sapiens
ccaaatctctcaaatctgt

SEQ ID NO: 3624639 - DNA, 21 bp, Homo sapiens
ccaaatgaaatatatttaaaa

SEQ ID NO: 3624640 - DNA, 18 bp, Homo sapiens
ccaaatgaccgagccctg

SEQ ID NO: 3624641 - DNA, 19 bp, Homo sapiens
ccaaatgaccgagccctgg

SEQ ID NO: 3624642 - DNA, 16 bp, Homo sapiens
ccaaatggccatttta

SEQ ID NO: 3624643 - DNA, 23 bp, Homo sapiens
ccaaatttcatacctatcatctt

SEQ ID NO: 3624644 - DNA, 21 bp, Homo sapiens
ccaacacgagcaggctactgt

SEQ ID NO: 3624645 - DNA, 20 bp, Homo sapiens
ccaacactttgagcattttt

SEQ ID NO: 3624646 - DNA, 19 bp, Homo sapiens
ccaacagaaaccttttatt

SEQ ID NO: 3624647 - DNA, 16 bp, Homo sapiens
ccaacagcacctcccc

SEQ ID NO: 3624648 - DNA, 17 bp, Homo sapiens
ccaacagcacctccccg

SEQ ID NO: 3624649 - DNA, 16 bp, Homo sapiens
ccaacatgatccccgt

SEQ ID NO: 3624650 - DNA, 19 bp, Homo sapiens
ccaaccaaggaatttaaaa

SEQ ID NO: 3624651 - DNA, 12 bp, Homo sapiens
ccaaccagcccg

SEQ ID NO: 3624652 - DNA, 20 bp, Homo sapiens
ccaaccagcccgacagtgcc

SEQ ID NO: 3624653 - DNA, 21 bp, Homo sapiens
ccaaccagcccgacagtgcca

SEQ ID NO: 3624654 - DNA, 14 bp, Homo sapiens
ccaaccctcagagc

SEQ ID NO: 3624655 - DNA, 13 bp, Homo sapiens
ccaaccctgggct

SEQ ID NO: 3624656 - DNA, 15 bp, Homo sapiens
ccaacctcaggctcc

SEQ ID NO: 3624657 - DNA, 12 bp, Homo sapiens
ccaacctccaga

SEQ ID NO: 3624658 - DNA, 13 bp, Homo sapiens
ccaacctccagac

SEQ ID NO: 3624659 - DNA, 14 bp, Homo sapiens
ccaacctccagact

SEQ ID NO: 3624660 - DNA, 18 bp, Homo sapiens
ccaacctgcaaagatctg

SEQ ID NO: 3624661 - DNA, 13 bp, Homo sapiens
ccaacgcccctgt

SEQ ID NO: 3624662 - DNA, 16 bp, Homo sapiens
ccaacgcccctgtggc

SEQ ID NO: 3624663 - DNA, 19 bp, Homo sapiens
ccaacgcccctgtggccaa

SEQ ID NO: 3624664 - DNA, 21 bp, Homo sapiens
ccaacgcccctgtggccaact

SEQ ID NO: 3624665 - DNA, 19 bp, Homo sapiens
ccaacgtgcaaagccaagg

SEQ ID NO: 3624666 - DNA, 14 bp, Homo sapiens
ccaactatgattat

SEQ ID NO: 3624667 - DNA, 17 bp, Homo sapiens
ccaactccatactccac

SEQ ID NO: 3624668 - DNA, 18 bp, Homo sapiens
ccaactccatactccact

SEQ ID NO: 3624669 - DNA, 19 bp, Homo sapiens
ccaactccatactccactc

SEQ ID NO: 3624670 - DNA, 22 bp, Homo sapiens
ccaactctaaagccaagcactt

SEQ ID NO: 3624671 - DNA, 19 bp, Homo sapiens
ccaactgcaaaaaaagcct

SEQ ID NO: 3624672 - DNA, 22 bp, Homo sapiens
ccaactgcaaaaaaagcctcca

SEQ ID NO: 3624673 - DNA, 19 bp, Homo sapiens
ccaactgccaggctgcctc

SEQ ID NO: 3624674 - DNA, 12 bp, Homo sapiens
ccaactgcccta

SEQ ID NO: 3624675 - DNA, 16 bp, Homo sapiens
ccaactgtttccctgc

SEQ ID NO: 3624676 - DNA, 19 bp, Homo sapiens
ccaacttctcttgctttct

SEQ ID NO: 3624677 - DNA, 15 bp, Homo sapiens
ccaagaaacctgact

SEQ ID NO: 3624678 - DNA, 15 bp, Homo sapiens
ccaagaatacttgaa

SEQ ID NO: 3624679 - DNA, 21 bp, Homo sapiens
ccaagagatctgtgtggctcc

SEQ ID NO: 3624680 - DNA, 16 bp, Homo sapiens
ccaagcatataaaatt

SEQ ID NO: 3624681 - DNA, 14 bp, Homo sapiens
ccaagcatttcatg

SEQ ID NO: 3624682 - DNA, 20 bp, Homo sapiens
ccaagccagattctcttgaa

SEQ ID NO: 3624683 - DNA, 17 bp, Homo sapiens
ccaagccgaccttccct

SEQ ID NO: 3624684 - DNA, 21 bp, Homo sapiens
ccaagccgtggcttcccgctc

SEQ ID NO: 3624685 - DNA, 19 bp, Homo sapiens
ccaagccttggctctaccc

SEQ ID NO: 3624686 - DNA, 13 bp, Homo sapiens
ccaagctggcaca

SEQ ID NO: 3624687 - DNA, 15 bp, Homo sapiens
ccaagctggcacaaa

SEQ ID NO: 3624688 - DNA, 22 bp, Homo sapiens
ccaagctggcacaaaagacagc

SEQ ID NO: 3624689 - DNA, 21 bp, Homo sapiens
ccaagctgtgttaactgttca

SEQ ID NO: 3624690 - DNA, 19 bp, Homo sapiens
ccaaggaatttaaaactgt

SEQ ID NO: 3624691 - DNA, 22 bp, Homo sapiens
ccaaggagctgctatagcctgg

SEQ ID NO: 3624692 - DNA, 20 bp, Homo sapiens
ccaaggagggtgagtgcaag

SEQ ID NO: 3624693 - DNA, 14 bp, Homo sapiens
ccaaggcaaacaat

SEQ ID NO: 3624694 - DNA, 17 bp, Homo sapiens
ccaaggcagcgacccca

SEQ ID NO: 3624695 - DNA, 15 bp, Homo sapiens
ccaaggctctcccct

SEQ ID NO: 3624696 - DNA, 19 bp, Homo sapiens
ccaaggctctcccctctcg

SEQ ID NO: 3624697 - DNA, 13 bp, Homo sapiens
ccaagggaccagg

SEQ ID NO: 3624698 - DNA, 21 bp, Homo sapiens
ccaagggatctggtcctaccc

SEQ ID NO: 3624699 - DNA, 21 bp, Homo sapiens
ccaagggccctggcaccccca

SEQ ID NO: 3624700 - DNA, 22 bp, Homo sapiens
ccaagggccctggcacccccac

SEQ ID NO: 3624701 - DNA, 14 bp, Homo sapiens
ccaagggggctgct

SEQ ID NO: 3624702 - DNA, 20 bp, Homo sapiens
ccaagggggctgctgctcct

SEQ ID NO: 3624703 - DNA, 23 bp, Homo sapiens
ccaagggtttcgactggtccagc

SEQ ID NO: 3624704 - DNA, 20 bp, Homo sapiens
ccaaggtgaggtgaactcca

SEQ ID NO: 3624705 - DNA, 16 bp, Homo sapiens
ccaaggttacttaatt

SEQ ID NO: 3624706 - DNA, 18 bp, Homo sapiens
ccaagtaaacagggtacc

SEQ ID NO: 3624707 - DNA, 19 bp, Homo sapiens
ccaagtaaaggttaaaaat

SEQ ID NO: 3624708 - DNA, 17 bp, Homo sapiens
ccaagtgccccaccact

SEQ ID NO: 3624709 - DNA, 22 bp, Homo sapiens
ccaagtggacgttaggccaggc

SEQ ID NO: 3624710 - DNA, 14 bp, Homo sapiens
ccaagtggggtgct

SEQ ID NO: 3624711 - DNA, 20 bp, Homo sapiens
ccaagtggggtgctctggtc

SEQ ID NO: 3624712 - DNA, 22 bp, Homo sapiens
ccaagtggtgagcaagcaccaa

SEQ ID NO: 3624713 - DNA, 15 bp, Homo sapiens
ccaagttctcacctc

SEQ ID NO: 3624714 - DNA, 10 bp, Homo sapiens
ccaataaagc

SEQ ID NO: 3624715 - DNA, 16 bp, Homo sapiens
ccaatctaaaatggca

SEQ ID NO: 3624716 - DNA, 22 bp, Homo sapiens
ccaatctttctatataaaatgt

SEQ ID NO: 3624717 - DNA, 13 bp, Homo sapiens
ccaatgccaaaaa

SEQ ID NO: 3624718 - DNA, 16 bp, Homo sapiens
ccaatgctgcttttgg

SEQ ID NO: 3624719 - DNA, 19 bp, Homo sapiens
ccaatgcttgcatggagaa

SEQ ID NO: 3624720 - DNA, 21 bp, Homo sapiens
ccaatggagactgtctcaaga

SEQ ID NO: 3624721 - DNA, 18 bp, Homo sapiens
ccaattatatctccccca

SEQ ID NO: 3624722 - DNA, 23 bp, Homo sapiens
ccaattatatctcccccactcca

SEQ ID NO: 3624723 - DNA, 15 bp, Homo sapiens
ccacaaacctgcccg

SEQ ID NO: 3624724 - DNA, 16 bp, Homo sapiens
ccacaaactccaggct

SEQ ID NO: 3624725 - DNA, 18 bp, Homo sapiens
ccacaaactccaggctgg

SEQ ID NO: 3624726 - DNA, 22 bp, Homo sapiens
ccacaactactagtgtgactcc

SEQ ID NO: 3624727 - DNA, 15 bp, Homo sapiens
ccacaagctgtccct

SEQ ID NO: 3624728 - DNA, 16 bp, Homo sapiens
ccacaagctgtccctg

SEQ ID NO: 3624729 - DNA, 22 bp, Homo sapiens
ccacaagctgtccctgcagggc

SEQ ID NO: 3624730 - DNA, 16 bp, Homo sapiens
ccacaaggaaccctca

SEQ ID NO: 3624731 - DNA, 17 bp, Homo sapiens
ccacaaggaaccctcag

SEQ ID NO: 3624732 - DNA, 20 bp, Homo sapiens
ccacaaggaaccctcaggcc

SEQ ID NO: 3624733 - DNA, 22 bp, Homo sapiens
ccacaaggaaccctcaggccac

SEQ ID NO: 3624734 - DNA, 19 bp, Homo sapiens
ccacaattattggcaaagt

SEQ ID NO: 3624735 - DNA, 16 bp, Homo sapiens
ccacacagctgcccta

SEQ ID NO: 3624736 - DNA, 21 bp, Homo sapiens
ccacacagctgccctagctga

SEQ ID NO: 3624737 - DNA, 15 bp, Homo sapiens
ccacacccaggaagg

SEQ ID NO: 3624738 - DNA, 16 bp, Homo sapiens
ccacaccctcactgct

SEQ ID NO: 3624739 - DNA, 13 bp, Homo sapiens
ccacacctggcct

SEQ ID NO: 3624740 - DNA, 15 bp, Homo sapiens
ccacacgtggctggc

SEQ ID NO: 3624741 - DNA, 23 bp, Homo sapiens
ccacactcagaaaattccctggg

SEQ ID NO: 3624742 - DNA, 14 bp, Homo sapiens
ccacactgcttggc

SEQ ID NO: 3624743 - DNA, 18 bp, Homo sapiens
ccacactgtgcagaccca

SEQ ID NO: 3624744 - DNA, 14 bp, Homo sapiens
ccacactgtggcca

SEQ ID NO: 3624745 - DNA, 18 bp, Homo sapiens
ccacactgtggccaggcc

SEQ ID NO: 3624746 - DNA, 15 bp, Homo sapiens
ccacacttgttttct

SEQ ID NO: 3624747 - DNA, 11 bp, Homo sapiens
ccacagaactt

SEQ ID NO: 3624748 - DNA, 11 bp, Homo sapiens
ccacagactga

SEQ ID NO: 3624749 - DNA, 20 bp, Homo sapiens
ccacagagaagtttgtagcc

SEQ ID NO: 3624750 - DNA, 20 bp, Homo sapiens
ccacagcagccccaggagaa

SEQ ID NO: 3624751 - DNA, 15 bp, Homo sapiens
ccacagcatcgggag

SEQ ID NO: 3624752 - DNA, 23 bp, Homo sapiens
ccacagccttgcagcggctcctg

SEQ ID NO: 3624753 - DNA, 15 bp, Homo sapiens
ccacagctatttaga

SEQ ID NO: 3624754 - DNA, 23 bp, Homo sapiens
ccacagctggaaagttgggcccc

SEQ ID NO: 3624755 - DNA, 17 bp, Homo sapiens
ccacagcttcctgaggg

SEQ ID NO: 3624756 - DNA, 15 bp, Homo sapiens
ccacaggactttgat

SEQ ID NO: 3624757 - DNA, 19 bp, Homo sapiens
ccacaggagggccagcgct

SEQ ID NO: 3624758 - DNA, 19 bp, Homo sapiens
ccacaggcacacaggtctc

SEQ ID NO: 3624759 - DNA, 18 bp, Homo sapiens
ccacaggcccttcctctc

SEQ ID NO: 3624760 - DNA, 19 bp, Homo sapiens
ccacaggcccttcctctcc

SEQ ID NO: 3624761 - DNA, 23 bp, Homo sapiens
ccacaggcccttcctctccactg

SEQ ID NO: 3624762 - DNA, 16 bp, Homo sapiens
ccacaggggccaccac

SEQ ID NO: 3624763 - DNA, 15 bp, Homo sapiens
ccacagtcactggat

SEQ ID NO: 3624764 - DNA, 17 bp, Homo sapiens
ccacagtggggctgcag

SEQ ID NO: 3624765 - DNA, 19 bp, Homo sapiens
ccacagttattaattaaag

SEQ ID NO: 3624766 - DNA, 20 bp, Homo sapiens
ccacataaaagccccagctt

SEQ ID NO: 3624767 - DNA, 16 bp, Homo sapiens
ccacataaccctgtca

SEQ ID NO: 3624768 - DNA, 21 bp, Homo sapiens
ccacatagtgatggttcccct

SEQ ID NO: 3624769 - DNA, 20 bp, Homo sapiens
ccacatgaggccatctcagg

SEQ ID NO: 3624770 - DNA, 22 bp, Homo sapiens
ccacatgaggccatctcaggag

SEQ ID NO: 3624771 - DNA, 24 bp, Homo sapiens
ccacatgattctgatgtactctaa

SEQ ID NO: 3624772 - DNA, 14 bp, Homo sapiens
ccacatgctgcctg

SEQ ID NO: 3624773 - DNA, 16 bp, Homo sapiens
ccacatgctgcctggc

SEQ ID NO: 3624774 - DNA, 17 bp, Homo sapiens
ccacatgctgcctggca

SEQ ID NO: 3624775 - DNA, 19 bp, Homo sapiens
ccacatgctgcctggcaca

SEQ ID NO: 3624776 - DNA, 23 bp, Homo sapiens
ccacatgctgcctggcacagacc

SEQ ID NO: 3624777 - DNA, 16 bp, Homo sapiens
ccacatggagccccct

SEQ ID NO: 3624778 - DNA, 18 bp, Homo sapiens
ccacatggccatcttctt

SEQ ID NO: 3624779 - DNA, 16 bp, Homo sapiens
ccacattgaagaatgt

SEQ ID NO: 3624780 - DNA, 15 bp, Homo sapiens
ccaccaaccctcaga

SEQ ID NO: 3624781 - DNA, 14 bp, Homo sapiens
ccaccactcaggcc

SEQ ID NO: 3624782 - DNA, 20 bp, Homo sapiens
ccaccagaacgcaccccact

SEQ ID NO: 3624783 - DNA, 21 bp, Homo sapiens
ccaccagaacgcaccccactg

SEQ ID NO: 3624784 - DNA, 23 bp, Homo sapiens
ccaccagaacgcaccccactggg

SEQ ID NO: 3624785 - DNA, 15 bp, Homo sapiens
ccaccagagccggga

SEQ ID NO: 3624786 - DNA, 11 bp, Homo sapiens
ccaccagcagc

SEQ ID NO: 3624787 - DNA, 12 bp, Homo sapiens
ccaccagttctc

SEQ ID NO: 3624788 - DNA, 15 bp, Homo sapiens
ccaccataccttaga

SEQ ID NO: 3624789 - DNA, 19 bp, Homo sapiens
ccaccataccttagagact

SEQ ID NO: 3624790 - DNA, 13 bp, Homo sapiens
ccaccatctgctg

SEQ ID NO: 3624791 - DNA, 13 bp, Homo sapiens
ccaccatgcttgc

SEQ ID NO: 3624792 - DNA, 17 bp, Homo sapiens
ccaccatgcttgcctga

SEQ ID NO: 3624793 - DNA, 19 bp, Homo sapiens
ccaccattcctgcctttaa

SEQ ID NO: 3624794 - DNA, 23 bp, Homo sapiens
ccaccattcctgcctttaagcca

SEQ ID NO: 3624795 - DNA, 17 bp, Homo sapiens
ccacccacaaactccag

SEQ ID NO: 3624796 - DNA, 22 bp, Homo sapiens
ccacccacaaactccaggctgg

SEQ ID NO: 3624797 - DNA, 24 bp, Homo sapiens
ccacccacacagctgccctagctg

SEQ ID NO: 3624798 - DNA, 22 bp, Homo sapiens
ccacccagaatgagacatccag

SEQ ID NO: 3624799 - DNA, 21 bp, Homo sapiens
ccaccccaaaccccagcccca

SEQ ID NO: 3624800 - DNA, 14 bp, Homo sapiens
ccaccccacctcac

SEQ ID NO: 3624801 - DNA, 21 bp, Homo sapiens
ccaccccacctcacagctact

SEQ ID NO: 3624802 - DNA, 17 bp, Homo sapiens
ccaccccactcagggga

SEQ ID NO: 3624803 - DNA, 18 bp, Homo sapiens
ccaccccatccagccaga

SEQ ID NO: 3624804 - DNA, 13 bp, Homo sapiens
ccaccccatggcc

SEQ ID NO: 3624805 - DNA, 22 bp, Homo sapiens
ccaccccccactcagtgcctcc

SEQ ID NO: 3624806 - DNA, 15 bp, Homo sapiens
ccaccccctctggag

SEQ ID NO: 3624807 - DNA, 16 bp, Homo sapiens
ccacccccttccctgg

SEQ ID NO: 3624808 - DNA, 16 bp, Homo sapiens
ccaccccttggaggag

SEQ ID NO: 3624809 - DNA, 21 bp, Homo sapiens
ccaccccttggaggagagaga

SEQ ID NO: 3624810 - DNA, 16 bp, Homo sapiens
ccacccgggggagccc

SEQ ID NO: 3624811 - DNA, 18 bp, Homo sapiens
ccaccctcccctatgctg

SEQ ID NO: 3624812 - DNA, 18 bp, Homo sapiens
ccaccgaccaactgccct

SEQ ID NO: 3624813 - DNA, 22 bp, Homo sapiens
ccaccgaggttcccagggctgg

SEQ ID NO: 3624814 - DNA, 22 bp, Homo sapiens
ccaccgggctgggagctctgca

SEQ ID NO: 3624815 - DNA, 14 bp, Homo sapiens
ccaccggtgggcag

SEQ ID NO: 3624816 - DNA, 17 bp, Homo sapiens
ccacctcccccttcccc

SEQ ID NO: 3624817 - DNA, 16 bp, Homo sapiens
ccacctccctgcctcc

SEQ ID NO: 3624818 - DNA, 18 bp, Homo sapiens
ccacctccctgcctccag

SEQ ID NO: 3624819 - DNA, 20 bp, Homo sapiens
ccacctcggcctcccagagt

SEQ ID NO: 3624820 - DNA, 17 bp, Homo sapiens
ccacctgacacaccagg

SEQ ID NO: 3624821 - DNA, 16 bp, Homo sapiens
ccacctggaagccgcg

SEQ ID NO: 3624822 - DNA, 11 bp, Homo sapiens
ccacctggaga

SEQ ID NO: 3624823 - DNA, 21 bp, Homo sapiens
ccacctggatctatccctgcg

SEQ ID NO: 3624824 - DNA, 12 bp, Homo sapiens
ccacctggctgc

SEQ ID NO: 3624825 - DNA, 15 bp, Homo sapiens
ccacgacctgtcctg

SEQ ID NO: 3624826 - DNA, 19 bp, Homo sapiens
ccacgcctcaccagccccc

SEQ ID NO: 3624827 - DNA, 15 bp, Homo sapiens
ccacggcctggctgg

SEQ ID NO: 3624828 - DNA, 12 bp, Homo sapiens
ccacgtcccagc

SEQ ID NO: 3624829 - DNA, 15 bp, Homo sapiens
ccacgtcccagcatc

SEQ ID NO: 3624830 - DNA, 18 bp, Homo sapiens
ccacgtcccagcatccct

SEQ ID NO: 3624831 - DNA, 18 bp, Homo sapiens
ccacgtcgtggggtaaca

SEQ ID NO: 3624832 - DNA, 14 bp, Homo sapiens
ccacgtggatgggc

SEQ ID NO: 3624833 - DNA, 18 bp, Homo sapiens
ccacgtgtatagtatctg

SEQ ID NO: 3624834 - DNA, 22 bp, Homo sapiens
ccacgtgtatagtatctgtata

SEQ ID NO: 3624835 - DNA, 16 bp, Homo sapiens
ccactaaagcttcaga

SEQ ID NO: 3624836 - DNA, 18 bp, Homo sapiens
ccactaaagcttcagact

SEQ ID NO: 3624837 - DNA, 13 bp, Homo sapiens
ccactaagcagag

SEQ ID NO: 3624838 - DNA, 16 bp, Homo sapiens
ccactaagcagaggag

SEQ ID NO: 3624839 - DNA, 19 bp, Homo sapiens
ccactaagcagaggagggg

SEQ ID NO: 3624840 - DNA, 21 bp, Homo sapiens
ccactaagcagaggaggggcc

SEQ ID NO: 3624841 - DNA, 13 bp, Homo sapiens
ccactaagtagaa

SEQ ID NO: 3624842 - DNA, 17 bp, Homo sapiens
ccactaccaaaagacat

SEQ ID NO: 3624843 - DNA, 18 bp, Homo sapiens
ccactaccaaaagacatt

SEQ ID NO: 3624844 - DNA, 15 bp, Homo sapiens
ccactaccagccagc

SEQ ID NO: 3624845 - DNA, 18 bp, Homo sapiens
ccactactctcttcctcc

SEQ ID NO: 3624846 - DNA, 11 bp, Homo sapiens
ccactcaggcc

SEQ ID NO: 3624847 - DNA, 20 bp, Homo sapiens
ccactccagacccctggctt

SEQ ID NO: 3624848 - DNA, 22 bp, Homo sapiens
ccactccagacccctggctttt

SEQ ID NO: 3624849 - DNA, 12 bp, Homo sapiens
ccactcccagga

SEQ ID NO: 3624850 - DNA, 19 bp, Homo sapiens
ccactcccccgtttctcct

SEQ ID NO: 3624851 - DNA, 21 bp, Homo sapiens
ccactcccccgtttctccttt

SEQ ID NO: 3624852 - DNA, 15 bp, Homo sapiens
ccactcccctcacac

SEQ ID NO: 3624853 - DNA, 12 bp, Homo sapiens
ccactcctggga

SEQ ID NO: 3624854 - DNA, 20 bp, Homo sapiens
ccactctgggcaaagcccct

SEQ ID NO: 3624855 - DNA, 12 bp, Homo sapiens
ccactgaaaatt

SEQ ID NO: 3624856 - DNA, 19 bp, Homo sapiens
ccactgcataccaacctgg

SEQ ID NO: 3624857 - DNA, 11 bp, Homo sapiens
ccactgcctct

SEQ ID NO: 3624858 - DNA, 16 bp, Homo sapiens
ccactgcctcttcctc

SEQ ID NO: 3624859 - DNA, 14 bp, Homo sapiens
ccactgggacagct

SEQ ID NO: 3624860 - DNA, 16 bp, Homo sapiens
ccactgggacagctgg

SEQ ID NO: 3624861 - DNA, 20 bp, Homo sapiens
ccactgggacagctggctgg

SEQ ID NO: 3624862 - DNA, 21 bp, Homo sapiens
ccactgggacagctggctggg

SEQ ID NO: 3624863 - DNA, 15 bp, Homo sapiens
ccactgggtgagaga

SEQ ID NO: 3624864 - DNA, 18 bp, Homo sapiens
ccacttacatatattttt

SEQ ID NO: 3624865 - DNA, 22 bp, Homo sapiens
ccacttattccccattcttcct

SEQ ID NO: 3624866 - DNA, 16 bp, Homo sapiens
ccacttctggccacat

SEQ ID NO: 3624867 - DNA, 17 bp, Homo sapiens
ccacttgtcaagttcag

SEQ ID NO: 3624868 - DNA, 22 bp, Homo sapiens
ccactttcagagcccccagccc

SEQ ID NO: 3624869 - DNA, 20 bp, Homo sapiens
ccactttgcacagctctccg

SEQ ID NO: 3624870 - DNA, 24 bp, Homo sapiens
ccagaaactgttcccacctgctgg

SEQ ID NO: 3624871 - DNA, 19 bp, Homo sapiens
ccagaaagcctcctgcccc

SEQ ID NO: 3624872 - DNA, 20 bp, Homo sapiens
ccagaaagcctcctgccccc

SEQ ID NO: 3624873 - DNA, 22 bp, Homo sapiens
ccagaaaggtgtgaggagagag

SEQ ID NO: 3624874 - DNA, 19 bp, Homo sapiens
ccagaacctctaagtgctg

SEQ ID NO: 3624875 - DNA, 21 bp, Homo sapiens
ccagaacctctaagtgctgct

SEQ ID NO: 3624876 - DNA, 23 bp, Homo sapiens
ccagaacctctaagtgctgctgt

SEQ ID NO: 3624877 - DNA, 24 bp, Homo sapiens
ccagaacctctaagtgctgctgtg

SEQ ID NO: 3624878 - DNA, 16 bp, Homo sapiens
ccagaacgcaccccac

SEQ ID NO: 3624879 - DNA, 19 bp, Homo sapiens
ccagaacgtggctctgctg

SEQ ID NO: 3624880 - DNA, 20 bp, Homo sapiens
ccagaacgtggctctgctgg

SEQ ID NO: 3624881 - DNA, 16 bp, Homo sapiens
ccagaacgtggtttgc

SEQ ID NO: 3624882 - DNA, 12 bp, Homo sapiens
ccagaaggaagc

SEQ ID NO: 3624883 - DNA, 15 bp, Homo sapiens
ccagaatgaccttga

SEQ ID NO: 3624884 - DNA, 16 bp, Homo sapiens
ccagaatgagacatcc

SEQ ID NO: 3624885 - DNA, 13 bp, Homo sapiens
ccagacacccagg

SEQ ID NO: 3624886 - DNA, 17 bp, Homo sapiens
ccagacagacaacactg

SEQ ID NO: 3624887 - DNA, 14 bp, Homo sapiens
ccagacatgccaca

SEQ ID NO: 3624888 - DNA, 15 bp, Homo sapiens
ccagaccccacgctg

SEQ ID NO: 3624889 - DNA, 15 bp, Homo sapiens
ccagacccctggctt

SEQ ID NO: 3624890 - DNA, 16 bp, Homo sapiens
ccagacccctggcttt

SEQ ID NO: 3624891 - DNA, 17 bp, Homo sapiens
ccagacccctggctttt

SEQ ID NO: 3624892 - DNA, 24 bp, Homo sapiens
ccagacccctggcttttcactgct

SEQ ID NO: 3624893 - DNA, 16 bp, Homo sapiens
ccagacctgatcctgg

SEQ ID NO: 3624894 - DNA, 18 bp, Homo sapiens
ccagacctgatcctggag

SEQ ID NO: 3624895 - DNA, 20 bp, Homo sapiens
ccagacctgatcctggaggc

SEQ ID NO: 3624896 - DNA, 19 bp, Homo sapiens
ccagacctggctccactct

SEQ ID NO: 3624897 - DNA, 20 bp, Homo sapiens
ccagacctggctccactctt

SEQ ID NO: 3624898 - DNA, 17 bp, Homo sapiens
ccagactactattttct

SEQ ID NO: 3624899 - DNA, 16 bp, Homo sapiens
ccagactacttgggag

SEQ ID NO: 3624900 - DNA, 13 bp, Homo sapiens
ccagactcagcag

SEQ ID NO: 3624901 - DNA, 16 bp, Homo sapiens
ccagactcagcagagt

SEQ ID NO: 3624902 - DNA, 13 bp, Homo sapiens
ccagactctgggg

SEQ ID NO: 3624903 - DNA, 22 bp, Homo sapiens
ccagactgcttccaattttctg

SEQ ID NO: 3624904 - DNA, 15 bp, Homo sapiens
ccagagaaagcaaag

SEQ ID NO: 3624905 - DNA, 22 bp, Homo sapiens
ccagagaaagcaaaggtgcact

SEQ ID NO: 3624906 - DNA, 24 bp, Homo sapiens
ccagagaatagatcagtatttcac

SEQ ID NO: 3624907 - DNA, 17 bp, Homo sapiens
ccagagacatacttgaa

SEQ ID NO: 3624908 - DNA, 19 bp, Homo sapiens
ccagagacctcatcagcct

SEQ ID NO: 3624909 - DNA, 14 bp, Homo sapiens
ccagagactttagg

SEQ ID NO: 3624910 - DNA, 20 bp, Homo sapiens
ccagagagggaaaaggcagg

SEQ ID NO: 3624911 - DNA, 13 bp, Homo sapiens
ccagagagggaag

SEQ ID NO: 3624912 - DNA, 20 bp, Homo sapiens
ccagagagtggagagagcag

SEQ ID NO: 3624913 - DNA, 21 bp, Homo sapiens
ccagagagtggagagagcagg

SEQ ID NO: 3624914 - DNA, 18 bp, Homo sapiens
ccagagagtggctcctcc

SEQ ID NO: 3624915 - DNA, 13 bp, Homo sapiens
ccagagatccaaa

SEQ ID NO: 3624916 - DNA, 12 bp, Homo sapiens
ccagagatgcct

SEQ ID NO: 3624917 - DNA, 15 bp, Homo sapiens
ccagagccacctgga

SEQ ID NO: 3624918 - DNA, 22 bp, Homo sapiens
ccagagccaggggggtgaggag

SEQ ID NO: 3624919 - DNA, 12 bp, Homo sapiens
ccagagcccagc

SEQ ID NO: 3624920 - DNA, 14 bp, Homo sapiens
ccagagcccagctc

SEQ ID NO: 3624921 - DNA, 16 bp, Homo sapiens
ccagagcccagctcca

SEQ ID NO: 3624922 - DNA, 17 bp, Homo sapiens
ccagagcccagctccaa

SEQ ID NO: 3624923 - DNA, 16 bp, Homo sapiens
ccagagcgaggaaagg

SEQ ID NO: 3624924 - DNA, 11 bp, Homo sapiens
ccagagctccg

SEQ ID NO: 3624925 - DNA, 20 bp, Homo sapiens
ccagagctccgatgcccgcc

SEQ ID NO: 3624926 - DNA, 13 bp, Homo sapiens
ccagagctgtgcc

SEQ ID NO: 3624927 - DNA, 14 bp, Homo sapiens
ccagagctgtgcca

SEQ ID NO: 3624928 - DNA, 17 bp, Homo sapiens
ccagagctgtgccagca

SEQ ID NO: 3624929 - DNA, 18 bp, Homo sapiens
ccagagctgtgccagcag

SEQ ID NO: 3624930 - DNA, 19 bp, Homo sapiens
ccagagctgtttggataca

SEQ ID NO: 3624931 - DNA, 20 bp, Homo sapiens
ccagagctgtttggatacag

SEQ ID NO: 3624932 - DNA, 15 bp, Homo sapiens
ccagaggaccaatgc

SEQ ID NO: 3624933 - DNA, 20 bp, Homo sapiens
ccagaggaccaatgcttgca

SEQ ID NO: 3624934 - DNA, 21 bp, Homo sapiens
ccagaggaccaatgcttgcat

SEQ ID NO: 3624935 - DNA, 16 bp, Homo sapiens
ccagaggagccaccag

SEQ ID NO: 3624936 - DNA, 13 bp, Homo sapiens
ccagaggccctgg

SEQ ID NO: 3624937 - DNA, 19 bp, Homo sapiens
ccagaggctattattttca

SEQ ID NO: 3624938 - DNA, 16 bp, Homo sapiens
ccagagtcatgggaga

SEQ ID NO: 3624939 - DNA, 22 bp, Homo sapiens
ccagagtccccccactcccagc

SEQ ID NO: 3624940 - DNA, 21 bp, Homo sapiens
ccagagtggggatgacatgca

SEQ ID NO: 3624941 - DNA, 16 bp, Homo sapiens
ccagatccagcctggg

SEQ ID NO: 3624942 - DNA, 15 bp, Homo sapiens
ccagattctcttgaa

SEQ ID NO: 3624943 - DNA, 22 bp, Homo sapiens
ccagcaacgcccctccaaacct

SEQ ID NO: 3624944 - DNA, 20 bp, Homo sapiens
ccagcaagcgggagcccgtg

SEQ ID NO: 3624945 - DNA, 21 bp, Homo sapiens
ccagcaagtccttaggctact

SEQ ID NO: 3624946 - DNA, 13 bp, Homo sapiens
ccagcagcatggc

SEQ ID NO: 3624947 - DNA, 23 bp, Homo sapiens
ccagcagcatggcatagccccgg

SEQ ID NO: 3624948 - DNA, 12 bp, Homo sapiens
ccagcagcgcct

SEQ ID NO: 3624949 - DNA, 18 bp, Homo sapiens
ccagcaggaaggacccca

SEQ ID NO: 3624950 - DNA, 20 bp, Homo sapiens
ccagcaggaaggaccccaca

SEQ ID NO: 3624951 - DNA, 22 bp, Homo sapiens
ccagcaggaaggaccccacatc

SEQ ID NO: 3624952 - DNA, 23 bp, Homo sapiens
ccagcaggcagagtggcgtggcc

SEQ ID NO: 3624953 - DNA, 20 bp, Homo sapiens
ccagcagggcatcttggaaa

SEQ ID NO: 3624954 - DNA, 18 bp, Homo sapiens
ccagcatccacactgccg

SEQ ID NO: 3624955 - DNA, 13 bp, Homo sapiens
ccagcatgacttt

SEQ ID NO: 3624956 - DNA, 20 bp, Homo sapiens
ccagcatgactttccttagg

SEQ ID NO: 3624957 - DNA, 10 bp, Homo sapiens
ccagccacag

SEQ ID NO: 3624958 - DNA, 20 bp, Homo sapiens
ccagccacagacccctggga

SEQ ID NO: 3624959 - DNA, 23 bp, Homo sapiens
ccagccacagacccctgggagct

SEQ ID NO: 3624960 - DNA, 16 bp, Homo sapiens
ccagccactccccagc

SEQ ID NO: 3624961 - DNA, 16 bp, Homo sapiens
ccagccacttccccct

SEQ ID NO: 3624962 - DNA, 22 bp, Homo sapiens
ccagccagaacgtggctctgct

SEQ ID NO: 3624963 - DNA, 23 bp, Homo sapiens
ccagccagaacgtggctctgctg

SEQ ID NO: 3624964 - DNA, 15 bp, Homo sapiens
ccagccagcccttcc

SEQ ID NO: 3624965 - DNA, 18 bp, Homo sapiens
ccagccaggctcctacct

SEQ ID NO: 3624966 - DNA, 19 bp, Homo sapiens
ccagccagggctcaatctc

SEQ ID NO: 3624967 - DNA, 14 bp, Homo sapiens
ccagcccaaacctg

SEQ ID NO: 3624968 - DNA, 17 bp, Homo sapiens
ccagcccaaacctggga

SEQ ID NO: 3624969 - DNA, 23 bp, Homo sapiens
ccagcccagagacatacttgaag

SEQ ID NO: 3624970 - DNA, 18 bp, Homo sapiens
ccagcccagcaccccttc

SEQ ID NO: 3624971 - DNA, 15 bp, Homo sapiens
ccagcccagccaggc

SEQ ID NO: 3624972 - DNA, 22 bp, Homo sapiens
ccagcccatttgggcagagagg

SEQ ID NO: 3624973 - DNA, 17 bp, Homo sapiens
ccagcccggggccagct

SEQ ID NO: 3624974 - DNA, 14 bp, Homo sapiens
ccagccctgggaac

SEQ ID NO: 3624975 - DNA, 20 bp, Homo sapiens
ccagcctcagaaggccccag

SEQ ID NO: 3624976 - DNA, 13 bp, Homo sapiens
ccagcctcccctc

SEQ ID NO: 3624977 - DNA, 14 bp, Homo sapiens
ccagcctcccctcc

SEQ ID NO: 3624978 - DNA, 15 bp, Homo sapiens
ccagcctcccctccc

SEQ ID NO: 3624979 - DNA, 17 bp, Homo sapiens
ccagcctcccctcccct

SEQ ID NO: 3624980 - DNA, 15 bp, Homo sapiens
ccagcctccctgaag

SEQ ID NO: 3624981 - DNA, 21 bp, Homo sapiens
ccagcctccctgaagcctttg

SEQ ID NO: 3624982 - DNA, 22 bp, Homo sapiens
ccagcctccctgtctccagctg

SEQ ID NO: 3624983 - DNA, 14 bp, Homo sapiens
ccagcctgactaga

SEQ ID NO: 3624984 - DNA, 21 bp, Homo sapiens
ccagcctgactagaactcctg

SEQ ID NO: 3624985 - DNA, 15 bp, Homo sapiens
ccagcctgcttccca

SEQ ID NO: 3624986 - DNA, 16 bp, Homo sapiens
ccagcctgcttcccac

SEQ ID NO: 3624987 - DNA, 18 bp, Homo sapiens
ccagcctggctctgcccc

SEQ ID NO: 3624988 - DNA, 20 bp, Homo sapiens
ccagcctggctgggactggg

SEQ ID NO: 3624989 - DNA, 16 bp, Homo sapiens
ccagcctgggagccca

SEQ ID NO: 3624990 - DNA, 21 bp, Homo sapiens
ccagcctggggctgaggctga

SEQ ID NO: 3624991 - DNA, 24 bp, Homo sapiens
ccagcgccaagtaaacagggtacc

SEQ ID NO: 3624992 - DNA, 15 bp, Homo sapiens
ccagcgtcccttggt

SEQ ID NO: 3624993 - DNA, 21 bp, Homo sapiens
ccagctaaacaccaacccctg

SEQ ID NO: 3624994 - DNA, 15 bp, Homo sapiens
ccagctaagaacctg

SEQ ID NO: 3624995 - DNA, 18 bp, Homo sapiens
ccagctaagaacctggaa

SEQ ID NO: 3624996 - DNA, 17 bp, Homo sapiens
ccagctacacctttctc

SEQ ID NO: 3624997 - DNA, 19 bp, Homo sapiens
ccagctacacctttctcct

SEQ ID NO: 3624998 - DNA, 23 bp, Homo sapiens
ccagctcaggacagatgccacac

SEQ ID NO: 3624999 - DNA, 22 bp, Homo sapiens
ccagctcatatgctgacagctc

SEQ ID NO: 3625000 - DNA, 16 bp, Homo sapiens
ccagctccgtgtttct

SEQ ID NO: 3625001 - DNA, 21 bp, Homo sapiens
ccagctccgtgtttctctaag

SEQ ID NO: 3625002 - DNA, 14 bp, Homo sapiens
ccagctctgacatc

SEQ ID NO: 3625003 - DNA, 15 bp, Homo sapiens
ccagctctgacatcc

SEQ ID NO: 3625004 - DNA, 20 bp, Homo sapiens
ccagctctgacatcccttcc

SEQ ID NO: 3625005 - DNA, 22 bp, Homo sapiens
ccagctctgacatcccttcctg

SEQ ID NO: 3625006 - DNA, 13 bp, Homo sapiens
ccagctctggagt

SEQ ID NO: 3625007 - DNA, 14 bp, Homo sapiens
ccagctctttagaa

SEQ ID NO: 3625008 - DNA, 13 bp, Homo sapiens
ccagctgaaggca

SEQ ID NO: 3625009 - DNA, 15 bp, Homo sapiens
ccagctgaaggcagt

SEQ ID NO: 3625010 - DNA, 17 bp, Homo sapiens
ccagctgactaaacttt

SEQ ID NO: 3625011 - DNA, 17 bp, Homo sapiens
ccagctgcaccccttcc

SEQ ID NO: 3625012 - DNA, 12 bp, Homo sapiens
ccagctgcctcc

SEQ ID NO: 3625013 - DNA, 13 bp, Homo sapiens
ccagctgcctggg

SEQ ID NO: 3625014 - DNA, 15 bp, Homo sapiens
ccagctgcctgggcc

SEQ ID NO: 3625015 - DNA, 17 bp, Homo sapiens
ccagctgggagcactgg

SEQ ID NO: 3625016 - DNA, 18 bp, Homo sapiens
ccagctgggagcactggt

SEQ ID NO: 3625017 - DNA, 15 bp, Homo sapiens
ccagctgtgcacttt

SEQ ID NO: 3625018 - DNA, 16 bp, Homo sapiens
ccagcttctctctcca

SEQ ID NO: 3625019 - DNA, 17 bp, Homo sapiens
ccagcttctctctccag

SEQ ID NO: 3625020 - DNA, 16 bp, Homo sapiens
ccagcttggctcacaa

SEQ ID NO: 3625021 - DNA, 23 bp, Homo sapiens
ccagcttggctcacaaggcccag

SEQ ID NO: 3625022 - DNA, 24 bp, Homo sapiens
ccaggaaccacaccacatctaagc

SEQ ID NO: 3625023 - DNA, 21 bp, Homo sapiens
ccaggaagggaaagcgggcag

SEQ ID NO: 3625024 - DNA, 19 bp, Homo sapiens
ccaggaatttcccaggacc

SEQ ID NO: 3625025 - DNA, 20 bp, Homo sapiens
ccaggaatttcccaggaccc

SEQ ID NO: 3625026 - DNA, 16 bp, Homo sapiens
ccaggaccagctcagg

SEQ ID NO: 3625027 - DNA, 17 bp, Homo sapiens
ccaggaccagctcagga

SEQ ID NO: 3625028 - DNA, 15 bp, Homo sapiens
ccaggaccatcatcc

SEQ ID NO: 3625029 - DNA, 19 bp, Homo sapiens
ccaggaccctgaaggggcc

SEQ ID NO: 3625030 - DNA, 14 bp, Homo sapiens
ccaggacctccgga

SEQ ID NO: 3625031 - DNA, 16 bp, Homo sapiens
ccaggacctccggagc

SEQ ID NO: 3625032 - DNA, 21 bp, Homo sapiens
ccaggacctccggagcgccct

SEQ ID NO: 3625033 - DNA, 17 bp, Homo sapiens
ccaggagacagaccact

SEQ ID NO: 3625034 - DNA, 23 bp, Homo sapiens
ccaggagacagaccacttgccac

SEQ ID NO: 3625035 - DNA, 16 bp, Homo sapiens
ccaggagagcctgggg

SEQ ID NO: 3625036 - DNA, 17 bp, Homo sapiens
ccaggagagcctggggg

SEQ ID NO: 3625037 - DNA, 16 bp, Homo sapiens
ccaggagcctgtgcct

SEQ ID NO: 3625038 - DNA, 15 bp, Homo sapiens
ccaggagggaggcag

SEQ ID NO: 3625039 - DNA, 16 bp, Homo sapiens
ccaggatatattttat

SEQ ID NO: 3625040 - DNA, 12 bp, Homo sapiens
ccaggcagaggg

SEQ ID NO: 3625041 - DNA, 17 bp, Homo sapiens
ccaggcagatccaggac

SEQ ID NO: 3625042 - DNA, 18 bp, Homo sapiens
ccaggcagatccaggact

SEQ ID NO: 3625043 - DNA, 23 bp, Homo sapiens
ccaggcagctatttcagcctcct

SEQ ID NO: 3625044 - DNA, 17 bp, Homo sapiens
ccaggccaacagcacct

SEQ ID NO: 3625045 - DNA, 15 bp, Homo sapiens
ccaggccagtcagac

SEQ ID NO: 3625046 - DNA, 21 bp, Homo sapiens
ccaggccagtcagacgccagg

SEQ ID NO: 3625047 - DNA, 23 bp, Homo sapiens
ccaggccagtcagacgccaggca

SEQ ID NO: 3625048 - DNA, 23 bp, Homo sapiens
ccaggccccaccggccaggccgc

SEQ ID NO: 3625049 - DNA, 23 bp, Homo sapiens
ccaggccttatctgaaaggccag

SEQ ID NO: 3625050 - DNA, 19 bp, Homo sapiens
ccaggcgccccttccccct

SEQ ID NO: 3625051 - DNA, 15 bp, Homo sapiens
ccaggcgcctgcgct

SEQ ID NO: 3625052 - DNA, 20 bp, Homo sapiens
ccaggctagagtgcaatggt

SEQ ID NO: 3625053 - DNA, 13 bp, Homo sapiens
ccaggctcaggag

SEQ ID NO: 3625054 - DNA, 15 bp, Homo sapiens
ccaggctcaggagaa

SEQ ID NO: 3625055 - DNA, 22 bp, Homo sapiens
ccaggctcctacctgtctgctg

SEQ ID NO: 3625056 - DNA, 20 bp, Homo sapiens
ccaggctgcctcctgccctt

SEQ ID NO: 3625057 - DNA, 13 bp, Homo sapiens
ccaggctgtttca

SEQ ID NO: 3625058 - DNA, 12 bp, Homo sapiens
ccaggctttcta

SEQ ID NO: 3625059 - DNA, 20 bp, Homo sapiens
ccagggacagaggccccagc

SEQ ID NO: 3625060 - DNA, 21 bp, Homo sapiens
ccagggacagaggccccagcc

SEQ ID NO: 3625061 - DNA, 13 bp, Homo sapiens
ccagggagaagct

SEQ ID NO: 3625062 - DNA, 15 bp, Homo sapiens
ccagggagaagctcc

SEQ ID NO: 3625063 - DNA, 20 bp, Homo sapiens
ccagggagcattttcctcca

SEQ ID NO: 3625064 - DNA, 13 bp, Homo sapiens
ccagggaggggtc

SEQ ID NO: 3625065 - DNA, 14 bp, Homo sapiens
ccagggaggggtcc

SEQ ID NO: 3625066 - DNA, 14 bp, Homo sapiens
ccagggatgctggg

SEQ ID NO: 3625067 - DNA, 17 bp, Homo sapiens
ccagggatgctgggctg

SEQ ID NO: 3625068 - DNA, 19 bp, Homo sapiens
ccagggatgctgggctggg

SEQ ID NO: 3625069 - DNA, 16 bp, Homo sapiens
ccagggcagcaggcca

SEQ ID NO: 3625070 - DNA, 17 bp, Homo sapiens
ccagggcagcaggccag

SEQ ID NO: 3625071 - DNA, 16 bp, Homo sapiens
ccagggcctgacaccc

SEQ ID NO: 3625072 - DNA, 19 bp, Homo sapiens
ccagggcctgacaccccct

SEQ ID NO: 3625073 - DNA, 15 bp, Homo sapiens
ccagggctcttctca

SEQ ID NO: 3625074 - DNA, 11 bp, Homo sapiens
ccagggctggg

SEQ ID NO: 3625075 - DNA, 13 bp, Homo sapiens
ccagggctgggga

SEQ ID NO: 3625076 - DNA, 19 bp, Homo sapiens
ccagggctggggacagagg

SEQ ID NO: 3625077 - DNA, 20 bp, Homo sapiens
ccagggcttcctcttccggg

SEQ ID NO: 3625078 - DNA, 16 bp, Homo sapiens
ccaggggaggagcctg

SEQ ID NO: 3625079 - DNA, 19 bp, Homo sapiens
ccaggggccggccagtggc

SEQ ID NO: 3625080 - DNA, 16 bp, Homo sapiens
ccaggggcctttgggt

SEQ ID NO: 3625081 - DNA, 23 bp, Homo sapiens
ccaggggcctttgggtgctgttt

SEQ ID NO: 3625082 - DNA, 14 bp, Homo sapiens
ccaggggctctgtg

SEQ ID NO: 3625083 - DNA, 15 bp, Homo sapiens
ccagggggcaagagg

SEQ ID NO: 3625084 - DNA, 17 bp, Homo sapiens
ccaggggggtgaggagc

SEQ ID NO: 3625085 - DNA, 19 bp, Homo sapiens
ccaggggggtgaggagctg

SEQ ID NO: 3625086 - DNA, 13 bp, Homo sapiens
ccagggtccctgg

SEQ ID NO: 3625087 - DNA, 14 bp, Homo sapiens
ccagggtctctcag

SEQ ID NO: 3625088 - DNA, 20 bp, Homo sapiens
ccagggtgacaaggcctgct

SEQ ID NO: 3625089 - DNA, 20 bp, Homo sapiens
ccagggtttacatgaagcag

SEQ ID NO: 3625090 - DNA, 13 bp, Homo sapiens
ccaggtacaggag

SEQ ID NO: 3625091 - DNA, 20 bp, Homo sapiens
ccaggtactgcattctctcc

SEQ ID NO: 3625092 - DNA, 22 bp, Homo sapiens
ccaggtactgcattctctccca

SEQ ID NO: 3625093 - DNA, 17 bp, Homo sapiens
ccaggtcggagtgcctg

SEQ ID NO: 3625094 - DNA, 19 bp, Homo sapiens
ccaggtcggagtgcctgga

SEQ ID NO: 3625095 - DNA, 20 bp, Homo sapiens
ccaggtcggagtgcctggag

SEQ ID NO: 3625096 - DNA, 19 bp, Homo sapiens
ccaggtctgactccaaagc

SEQ ID NO: 3625097 - DNA, 16 bp, Homo sapiens
ccaggttcccccagca

SEQ ID NO: 3625098 - DNA, 17 bp, Homo sapiens
ccaggtttgcaggagcc

SEQ ID NO: 3625099 - DNA, 16 bp, Homo sapiens
ccaggtttttcaatta

SEQ ID NO: 3625100 - DNA, 21 bp, Homo sapiens
ccaggtttttcaattaaacgg

SEQ ID NO: 3625101 - DNA, 22 bp, Homo sapiens
ccaggtttttcaattaaacgga

SEQ ID NO: 3625102 - DNA, 23 bp, Homo sapiens
ccagtaactgtgctgtactgagc

SEQ ID NO: 3625103 - DNA, 14 bp, Homo sapiens
ccagtagctgggat

SEQ ID NO: 3625104 - DNA, 17 bp, Homo sapiens
ccagtatttaacttctg

SEQ ID NO: 3625105 - DNA, 22 bp, Homo sapiens
ccagtatttaacttctgaggaa

SEQ ID NO: 3625106 - DNA, 17 bp, Homo sapiens
ccagtatttagaagcca

SEQ ID NO: 3625107 - DNA, 18 bp, Homo sapiens
ccagtcagacgccaggca

SEQ ID NO: 3625108 - DNA, 15 bp, Homo sapiens
ccagtcccacactgt

SEQ ID NO: 3625109 - DNA, 19 bp, Homo sapiens
ccagtcccagacaattcca

SEQ ID NO: 3625110 - DNA, 13 bp, Homo sapiens
ccagtcgacccca

SEQ ID NO: 3625111 - DNA, 23 bp, Homo sapiens
ccagtcgaccccaaaggaacact

SEQ ID NO: 3625112 - DNA, 12 bp, Homo sapiens
ccagtctcctca

SEQ ID NO: 3625113 - DNA, 13 bp, Homo sapiens
ccagtctcctcac

SEQ ID NO: 3625114 - DNA, 17 bp, Homo sapiens
ccagtctttcttcactc

SEQ ID NO: 3625115 - DNA, 14 bp, Homo sapiens
ccagtgacaacatc

SEQ ID NO: 3625116 - DNA, 11 bp, Homo sapiens
ccagtgacatg

SEQ ID NO: 3625117 - DNA, 12 bp, Homo sapiens
ccagtgactcca

SEQ ID NO: 3625118 - DNA, 15 bp, Homo sapiens
ccagtgactccaggg

SEQ ID NO: 3625119 - DNA, 17 bp, Homo sapiens
ccagtgcagccactggc

SEQ ID NO: 3625120 - DNA, 15 bp, Homo sapiens
ccagtgccagcaagt

SEQ ID NO: 3625121 - DNA, 22 bp, Homo sapiens
ccagtgctgaatttccctctct

SEQ ID NO: 3625122 - DNA, 17 bp, Homo sapiens
ccagtggtgggtaattg

SEQ ID NO: 3625123 - DNA, 12 bp, Homo sapiens
ccagtgtgagat

SEQ ID NO: 3625124 - DNA, 22 bp, Homo sapiens
ccagtgtgagatactgtgtata

SEQ ID NO: 3625125 - DNA, 22 bp, Homo sapiens
ccagtgttatttattccccagt

SEQ ID NO: 3625126 - DNA, 22 bp, Homo sapiens
ccagtgttcctgaagctgctgt

SEQ ID NO: 3625127 - DNA, 23 bp, Homo sapiens
ccagtgttcctgaagctgctgtg

SEQ ID NO: 3625128 - DNA, 16 bp, Homo sapiens
ccagttaatttttcca

SEQ ID NO: 3625129 - DNA, 18 bp, Homo sapiens
ccataaacggttcctggt

SEQ ID NO: 3625130 - DNA, 20 bp, Homo sapiens
ccataaacggttcctggtga

SEQ ID NO: 3625131 - DNA, 20 bp, Homo sapiens
ccataaagacaatcactgcc

SEQ ID NO: 3625132 - DNA, 21 bp, Homo sapiens
ccataagagaaacctgccaag

SEQ ID NO: 3625133 - DNA, 20 bp, Homo sapiens
ccataattttttttttcctt

SEQ ID NO: 3625134 - DNA, 14 bp, Homo sapiens
ccatacacacgctg

SEQ ID NO: 3625135 - DNA, 23 bp, Homo sapiens
ccatacctgcccctgcctgacag

SEQ ID NO: 3625136 - DNA, 13 bp, Homo sapiens
ccataccttttct

SEQ ID NO: 3625137 - DNA, 16 bp, Homo sapiens
ccatactccactccaa

SEQ ID NO: 3625138 - DNA, 17 bp, Homo sapiens
ccatagtcaatccaaga

SEQ ID NO: 3625139 - DNA, 18 bp, Homo sapiens
ccatagtttgggtatttt

SEQ ID NO: 3625140 - DNA, 14 bp, Homo sapiens
ccatatataaatta

SEQ ID NO: 3625141 - DNA, 18 bp, Homo sapiens
ccatatataaattattac

SEQ ID NO: 3625142 - DNA, 22 bp, Homo sapiens
ccatatataaattattacttta

SEQ ID NO: 3625143 - DNA, 22 bp, Homo sapiens
ccatatggaggactgtgacaga

SEQ ID NO: 3625144 - DNA, 13 bp, Homo sapiens
ccatcaaagagaa

SEQ ID NO: 3625145 - DNA, 18 bp, Homo sapiens
ccatcaaagagaaggaaa

SEQ ID NO: 3625146 - DNA, 16 bp, Homo sapiens
ccatcagcaccccagt

SEQ ID NO: 3625147 - DNA, 13 bp, Homo sapiens
ccatcatcctact

SEQ ID NO: 3625148 - DNA, 12 bp, Homo sapiens
ccatcatctctg

SEQ ID NO: 3625149 - DNA, 13 bp, Homo sapiens
ccatcatctctga

SEQ ID NO: 3625150 - DNA, 16 bp, Homo sapiens
ccatcatgccctctct

SEQ ID NO: 3625151 - DNA, 22 bp, Homo sapiens
ccatcatgtttacagaggacag

SEQ ID NO: 3625152 - DNA, 18 bp, Homo sapiens
ccatccagacctggctcc

SEQ ID NO: 3625153 - DNA, 17 bp, Homo sapiens
ccatcccactgctcccc

SEQ ID NO: 3625154 - DNA, 14 bp, Homo sapiens
ccatccccgcagtg

SEQ ID NO: 3625155 - DNA, 14 bp, Homo sapiens
ccatccctgcctgg

SEQ ID NO: 3625156 - DNA, 20 bp, Homo sapiens
ccatccggtttgccatgttg

SEQ ID NO: 3625157 - DNA, 15 bp, Homo sapiens
ccatcctaggaacca

SEQ ID NO: 3625158 - DNA, 17 bp, Homo sapiens
ccatcctaggaaccagc

SEQ ID NO: 3625159 - DNA, 16 bp, Homo sapiens
ccatcctcatccctga

SEQ ID NO: 3625160 - DNA, 14 bp, Homo sapiens
ccatcctccagcag

SEQ ID NO: 3625161 - DNA, 17 bp, Homo sapiens
ccatcctccagcaggga

SEQ ID NO: 3625162 - DNA, 13 bp, Homo sapiens
ccatcctgagcca

SEQ ID NO: 3625163 - DNA, 13 bp, Homo sapiens
ccatcctgcagat

SEQ ID NO: 3625164 - DNA, 12 bp, Homo sapiens
ccatcctggggc

SEQ ID NO: 3625165 - DNA, 20 bp, Homo sapiens
ccatcctggggcagcactcc

SEQ ID NO: 3625166 - DNA, 22 bp, Homo sapiens
ccatcgattgtgtacttttcct

SEQ ID NO: 3625167 - DNA, 18 bp, Homo sapiens
ccatctctgattttcaaa

SEQ ID NO: 3625168 - DNA, 13 bp, Homo sapiens
ccatctctgctcc

SEQ ID NO: 3625169 - DNA, 14 bp, Homo sapiens
ccatctgactgcca

SEQ ID NO: 3625170 - DNA, 14 bp, Homo sapiens
ccatctgagctggg

SEQ ID NO: 3625171 - DNA, 13 bp, Homo sapiens
ccatctgctgcag

SEQ ID NO: 3625172 - DNA, 22 bp, Homo sapiens
ccatctgctgtcttttctttgc

SEQ ID NO: 3625173 - DNA, 12 bp, Homo sapiens
ccatctggagag

SEQ ID NO: 3625174 - DNA, 19 bp, Homo sapiens
ccatctggagagcccagag

SEQ ID NO: 3625175 - DNA, 24 bp, Homo sapiens
ccatctgtttgaagattatatgaa

SEQ ID NO: 3625176 - DNA, 22 bp, Homo sapiens
ccatcttccacctcacctcttt

SEQ ID NO: 3625177 - DNA, 14 bp, Homo sapiens
ccatctttagcagt

SEQ ID NO: 3625178 - DNA, 22 bp, Homo sapiens
ccatctttagcagtttcctcag

SEQ ID NO: 3625179 - DNA, 14 bp, Homo sapiens
ccatgaaagaaaac

SEQ ID NO: 3625180 - DNA, 15 bp, Homo sapiens
ccatgatgcacagta

SEQ ID NO: 3625181 - DNA, 18 bp, Homo sapiens
ccatgatgcacagtatct

SEQ ID NO: 3625182 - DNA, 19 bp, Homo sapiens
ccatgatgcacagtatctg

SEQ ID NO: 3625183 - DNA, 21 bp, Homo sapiens
ccatgatggcaacagatctgg

SEQ ID NO: 3625184 - DNA, 13 bp, Homo sapiens
ccatgcactgtga

SEQ ID NO: 3625185 - DNA, 16 bp, Homo sapiens
ccatgcactgtgaagg

SEQ ID NO: 3625186 - DNA, 17 bp, Homo sapiens
ccatgcactgtgaagga

SEQ ID NO: 3625187 - DNA, 20 bp, Homo sapiens
ccatgcactgtgaaggaccc

SEQ ID NO: 3625188 - DNA, 21 bp, Homo sapiens
ccatgcactgtgaaggaccct

SEQ ID NO: 3625189 - DNA, 14 bp, Homo sapiens
ccatgcagaaagca

SEQ ID NO: 3625190 - DNA, 15 bp, Homo sapiens
ccatgcagaaagcat

SEQ ID NO: 3625191 - DNA, 16 bp, Homo sapiens
ccatgcaggaaggaaa

SEQ ID NO: 3625192 - DNA, 18 bp, Homo sapiens
ccatgcaggaaggaaaac

SEQ ID NO: 3625193 - DNA, 20 bp, Homo sapiens
ccatgctcaacccccctccc

SEQ ID NO: 3625194 - DNA, 22 bp, Homo sapiens
ccatgctcaacccccctcccag

SEQ ID NO: 3625195 - DNA, 14 bp, Homo sapiens
ccatgctgcctcca

SEQ ID NO: 3625196 - DNA, 15 bp, Homo sapiens
ccatgctgccttcag

SEQ ID NO: 3625197 - DNA, 14 bp, Homo sapiens
ccatgctgctgggg

SEQ ID NO: 3625198 - DNA, 21 bp, Homo sapiens
ccatgctgctggggaagacag

SEQ ID NO: 3625199 - DNA, 12 bp, Homo sapiens
ccatgctgggcc

SEQ ID NO: 3625200 - DNA, 14 bp, Homo sapiens
ccatggagcctacc

SEQ ID NO: 3625201 - DNA, 23 bp, Homo sapiens
ccatggcatgcgccaccatgccc

SEQ ID NO: 3625202 - DNA, 20 bp, Homo sapiens
ccatggccatttctgtggag

SEQ ID NO: 3625203 - DNA, 22 bp, Homo sapiens
ccatggccggctttcaggagct

SEQ ID NO: 3625204 - DNA, 22 bp, Homo sapiens
ccatgggagctggttagaaatg

SEQ ID NO: 3625205 - DNA, 22 bp, Homo sapiens
ccatggtactgtagcaggggaa

SEQ ID NO: 3625206 - DNA, 22 bp, Homo sapiens
ccatgtcaagagtcgctgtgcc

SEQ ID NO: 3625207 - DNA, 15 bp, Homo sapiens
ccatgtcgcctctgc

SEQ ID NO: 3625208 - DNA, 19 bp, Homo sapiens
ccatgtcgcctctgcattc

SEQ ID NO: 3625209 - DNA, 17 bp, Homo sapiens
ccatgtgcctttctttg

SEQ ID NO: 3625210 - DNA, 19 bp, Homo sapiens
ccatgtgcctttctttgcc

SEQ ID NO: 3625211 - DNA, 22 bp, Homo sapiens
ccatgtgcctttctttgcctct

SEQ ID NO: 3625212 - DNA, 13 bp, Homo sapiens
ccatgtgtacatt

SEQ ID NO: 3625213 - DNA, 22 bp, Homo sapiens
ccatgtgtctttacacctcgct

SEQ ID NO: 3625214 - DNA, 16 bp, Homo sapiens
ccatgttgtaatgctg

SEQ ID NO: 3625215 - DNA, 21 bp, Homo sapiens
ccatgttttttcttcaaatgt

SEQ ID NO: 3625216 - DNA, 16 bp, Homo sapiens
ccattacaccacagca

SEQ ID NO: 3625217 - DNA, 19 bp, Homo sapiens
ccattatatttattgttta

SEQ ID NO: 3625218 - DNA, 23 bp, Homo sapiens
ccattatatttattgtttatttt

SEQ ID NO: 3625219 - DNA, 22 bp, Homo sapiens
ccattcactagaaaatgagaaa

SEQ ID NO: 3625220 - DNA, 19 bp, Homo sapiens
ccattcccaagggagactg

SEQ ID NO: 3625221 - DNA, 15 bp, Homo sapiens
ccattcccagcctga

SEQ ID NO: 3625222 - DNA, 19 bp, Homo sapiens
ccattccctccatttttct

SEQ ID NO: 3625223 - DNA, 17 bp, Homo sapiens
ccattctattctccaga

SEQ ID NO: 3625224 - DNA, 14 bp, Homo sapiens
ccattcttcctagt

SEQ ID NO: 3625225 - DNA, 19 bp, Homo sapiens
ccattcttcctagttttct

SEQ ID NO: 3625226 - DNA, 16 bp, Homo sapiens
ccattcttggcccagg

SEQ ID NO: 3625227 - DNA, 20 bp, Homo sapiens
ccattgcactctagcctggc

SEQ ID NO: 3625228 - DNA, 17 bp, Homo sapiens
ccattggttcacctgtg

SEQ ID NO: 3625229 - DNA, 19 bp, Homo sapiens
ccattggttcacctgtgac

SEQ ID NO: 3625230 - DNA, 21 bp, Homo sapiens
ccattggttcacctgtgactc

SEQ ID NO: 3625231 - DNA, 23 bp, Homo sapiens
ccattggttcacctgtgactcct

SEQ ID NO: 3625232 - DNA, 23 bp, Homo sapiens
ccattgtttaaaaatcttaatgt

SEQ ID NO: 3625233 - DNA, 22 bp, Homo sapiens
ccatttaaagcttattaaaact

SEQ ID NO: 3625234 - DNA, 20 bp, Homo sapiens
ccatttaatggggaggacaa

SEQ ID NO: 3625235 - DNA, 11 bp, Homo sapiens
ccatttccctt

SEQ ID NO: 3625236 - DNA, 15 bp, Homo sapiens
ccatttctctacact

SEQ ID NO: 3625237 - DNA, 13 bp, Homo sapiens
ccatttgttttcg

SEQ ID NO: 3625238 - DNA, 18 bp, Homo sapiens
ccattttaacgctgccta

SEQ ID NO: 3625239 - DNA, 14 bp, Homo sapiens
ccattttgcctctg

SEQ ID NO: 3625240 - DNA, 12 bp, Homo sapiens
cccaaaccccag

SEQ ID NO: 3625241 - DNA, 13 bp, Homo sapiens
cccaaaccccagc

SEQ ID NO: 3625242 - DNA, 15 bp, Homo sapiens
cccaaaccccagccc

SEQ ID NO: 3625243 - DNA, 19 bp, Homo sapiens
cccaaacccttaactgaca

SEQ ID NO: 3625244 - DNA, 19 bp, Homo sapiens
cccaaacctgggaaggcca

SEQ ID NO: 3625245 - DNA, 23 bp, Homo sapiens
cccaaagattaggtcgttttcca

SEQ ID NO: 3625246 - DNA, 13 bp, Homo sapiens
cccaacacaaaga

SEQ ID NO: 3625247 - DNA, 15 bp, Homo sapiens
cccaacccctctcca

SEQ ID NO: 3625248 - DNA, 18 bp, Homo sapiens
cccaacccctctccaggc

SEQ ID NO: 3625249 - DNA, 21 bp, Homo sapiens
cccaacctacattccaccctg

SEQ ID NO: 3625250 - DNA, 13 bp, Homo sapiens
cccaacctgctct

SEQ ID NO: 3625251 - DNA, 19 bp, Homo sapiens
cccaactccaggggcacct

SEQ ID NO: 3625252 - DNA, 16 bp, Homo sapiens
cccaactctagctggg

SEQ ID NO: 3625253 - DNA, 16 bp, Homo sapiens
cccaagaaacctgact

SEQ ID NO: 3625254 - DNA, 19 bp, Homo sapiens
cccaagctgttttcttcta

SEQ ID NO: 3625255 - DNA, 18 bp, Homo sapiens
cccaaggcattctcccag

SEQ ID NO: 3625256 - DNA, 18 bp, Homo sapiens
cccaagggagactgacca

SEQ ID NO: 3625257 - DNA, 19 bp, Homo sapiens
cccaagttcatgcagctgt

SEQ ID NO: 3625258 - DNA, 23 bp, Homo sapiens
cccaatcccagctacctcaacca

SEQ ID NO: 3625259 - DNA, 16 bp, Homo sapiens
cccaattctgcccgct

SEQ ID NO: 3625260 - DNA, 18 bp, Homo sapiens
cccacaaactccaggctg

SEQ ID NO: 3625261 - DNA, 14 bp, Homo sapiens
cccacaagctgtcc

SEQ ID NO: 3625262 - DNA, 19 bp, Homo sapiens
cccacaagctgtccctgca

SEQ ID NO: 3625263 - DNA, 20 bp, Homo sapiens
cccacaagctgtccctgcag

SEQ ID NO: 3625264 - DNA, 21 bp, Homo sapiens
cccacaagctgtccctgcagg

SEQ ID NO: 3625265 - DNA, 16 bp, Homo sapiens
cccacaagtggtggta

SEQ ID NO: 3625266 - DNA, 13 bp, Homo sapiens
cccacacagctgc

SEQ ID NO: 3625267 - DNA, 21 bp, Homo sapiens
cccacactgtggccaggcctt

SEQ ID NO: 3625268 - DNA, 17 bp, Homo sapiens
cccacaggagggccagc

SEQ ID NO: 3625269 - DNA, 20 bp, Homo sapiens
cccacataaaagccccagct

SEQ ID NO: 3625270 - DNA, 21 bp, Homo sapiens
cccacatccttctcactgcca

SEQ ID NO: 3625271 - DNA, 22 bp, Homo sapiens
cccacatgaggccatctcagga

SEQ ID NO: 3625272 - DNA, 15 bp, Homo sapiens
cccaccaacctccag

SEQ ID NO: 3625273 - DNA, 22 bp, Homo sapiens
cccaccagaacgcaccccactg

SEQ ID NO: 3625274 - DNA, 20 bp, Homo sapiens
cccaccagagccgggaggaa

SEQ ID NO: 3625275 - DNA, 14 bp, Homo sapiens
cccacccacacagc

SEQ ID NO: 3625276 - DNA, 13 bp, Homo sapiens
cccaccccactca

SEQ ID NO: 3625277 - DNA, 22 bp, Homo sapiens
cccaccccatccagccagaccc

SEQ ID NO: 3625278 - DNA, 11 bp, Homo sapiens
cccacccctca

SEQ ID NO: 3625279 - DNA, 12 bp, Homo sapiens
cccacccctcac

SEQ ID NO: 3625280 - DNA, 14 bp, Homo sapiens
cccacccctcactc

SEQ ID NO: 3625281 - DNA, 20 bp, Homo sapiens
cccaccccttggaggagaga

SEQ ID NO: 3625282 - DNA, 17 bp, Homo sapiens
cccaccgaggttcccag

SEQ ID NO: 3625283 - DNA, 18 bp, Homo sapiens
cccaccgaggttcccagg

SEQ ID NO: 3625284 - DNA, 14 bp, Homo sapiens
cccacctcggcaca

SEQ ID NO: 3625285 - DNA, 14 bp, Homo sapiens
cccacctctcctgc

SEQ ID NO: 3625286 - DNA, 13 bp, Homo sapiens
cccacctggctgc

SEQ ID NO: 3625287 - DNA, 19 bp, Homo sapiens
cccacgacctgtcctgtct

SEQ ID NO: 3625288 - DNA, 14 bp, Homo sapiens
cccacgagggtctc

SEQ ID NO: 3625289 - DNA, 14 bp, Homo sapiens
cccacgctgaccat

SEQ ID NO: 3625290 - DNA, 23 bp, Homo sapiens
cccactaagtagaataaagaaaa

SEQ ID NO: 3625291 - DNA, 15 bp, Homo sapiens
cccactccactactc

SEQ ID NO: 3625292 - DNA, 11 bp, Homo sapiens
cccactccagc

SEQ ID NO: 3625293 - DNA, 13 bp, Homo sapiens
cccactccagctg

SEQ ID NO: 3625294 - DNA, 22 bp, Homo sapiens
cccactcccccgtttctccttt

SEQ ID NO: 3625295 - DNA, 14 bp, Homo sapiens
cccactcccctcac

SEQ ID NO: 3625296 - DNA, 15 bp, Homo sapiens
cccactcccctcaca

SEQ ID NO: 3625297 - DNA, 22 bp, Homo sapiens
cccactgctcgtggactgtgct

SEQ ID NO: 3625298 - DNA, 23 bp, Homo sapiens
cccactgctcgtggactgtgctg

SEQ ID NO: 3625299 - DNA, 13 bp, Homo sapiens
cccactggccggc

SEQ ID NO: 3625300 - DNA, 22 bp, Homo sapiens
cccacttctggccacatcagcc

SEQ ID NO: 3625301 - DNA, 22 bp, Homo sapiens
cccagaacctctaagtgctgct

SEQ ID NO: 3625302 - DNA, 16 bp, Homo sapiens
cccagaactattctgg

SEQ ID NO: 3625303 - DNA, 23 bp, Homo sapiens
cccagaactattctgggggcccg

SEQ ID NO: 3625304 - DNA, 18 bp, Homo sapiens
cccagaatgagacatcca

SEQ ID NO: 3625305 - DNA, 14 bp, Homo sapiens
cccagaatggagcc

SEQ ID NO: 3625306 - DNA, 19 bp, Homo sapiens
cccagaatggagcctgctc

SEQ ID NO: 3625307 - DNA, 21 bp, Homo sapiens
cccagaatttaccatcatctc

SEQ ID NO: 3625308 - DNA, 20 bp, Homo sapiens
cccagacaggccctccctgt

SEQ ID NO: 3625309 - DNA, 22 bp, Homo sapiens
cccagacaggccctccctgtct

SEQ ID NO: 3625310 - DNA, 18 bp, Homo sapiens
cccagactactattttct

SEQ ID NO: 3625311 - DNA, 20 bp, Homo sapiens
cccagactagatgtagtatt

SEQ ID NO: 3625312 - DNA, 23 bp, Homo sapiens
cccagactagatgtagtattttt

SEQ ID NO: 3625313 - DNA, 13 bp, Homo sapiens
cccagactcagac

SEQ ID NO: 3625314 - DNA, 16 bp, Homo sapiens
cccagagagaccctgc

SEQ ID NO: 3625315 - DNA, 22 bp, Homo sapiens
cccagagagaccctgcaagacc

SEQ ID NO: 3625316 - DNA, 18 bp, Homo sapiens
cccagagcaccccctgct

SEQ ID NO: 3625317 - DNA, 16 bp, Homo sapiens
cccagagccacctgga

SEQ ID NO: 3625318 - DNA, 12 bp, Homo sapiens
cccagagcccag

SEQ ID NO: 3625319 - DNA, 13 bp, Homo sapiens
cccagagcccagc

SEQ ID NO: 3625320 - DNA, 20 bp, Homo sapiens
cccagagcgaggaaaggatt

SEQ ID NO: 3625321 - DNA, 14 bp, Homo sapiens
cccagagctgtgcc

SEQ ID NO: 3625322 - DNA, 15 bp, Homo sapiens
cccagaggccctgga

SEQ ID NO: 3625323 - DNA, 17 bp, Homo sapiens
cccagaggccctggagg

SEQ ID NO: 3625324 - DNA, 20 bp, Homo sapiens
cccagagtccccccactccc

SEQ ID NO: 3625325 - DNA, 20 bp, Homo sapiens
cccagagtgctgggattaca

SEQ ID NO: 3625326 - DNA, 15 bp, Homo sapiens
cccagcaacgcccct

SEQ ID NO: 3625327 - DNA, 17 bp, Homo sapiens
cccagcaacgcccctcc

SEQ ID NO: 3625328 - DNA, 20 bp, Homo sapiens
cccagcaacgcccctccaaa

SEQ ID NO: 3625329 - DNA, 23 bp, Homo sapiens
cccagcaacgcccctccaaacct

SEQ ID NO: 3625330 - DNA, 22 bp, Homo sapiens
cccagcaagcgggagcccgtgg

SEQ ID NO: 3625331 - DNA, 20 bp, Homo sapiens
cccagcatccctggagcagg

SEQ ID NO: 3625332 - DNA, 21 bp, Homo sapiens
cccagcatgactttccttagg

SEQ ID NO: 3625333 - DNA, 14 bp, Homo sapiens
cccagccactcccc

SEQ ID NO: 3625334 - DNA, 13 bp, Homo sapiens
cccagccagccct

SEQ ID NO: 3625335 - DNA, 16 bp, Homo sapiens
cccagccagcccttcc

SEQ ID NO: 3625336 - DNA, 12 bp, Homo sapiens
cccagccaggcc

SEQ ID NO: 3625337 - DNA, 14 bp, Homo sapiens
cccagccaggccaa

SEQ ID NO: 3625338 - DNA, 22 bp, Homo sapiens
cccagccaggccaacagcacct

SEQ ID NO: 3625339 - DNA, 17 bp, Homo sapiens
cccagccaggctcctac

SEQ ID NO: 3625340 - DNA, 9 bp, Homo sapiens
cccagccca

SEQ ID NO: 3625341 - DNA, 15 bp, Homo sapiens
cccagcccagagaca

SEQ ID NO: 3625342 - DNA, 13 bp, Homo sapiens
cccagcccagagc

SEQ ID NO: 3625343 - DNA, 21 bp, Homo sapiens
cccagcccagagccacctgga

SEQ ID NO: 3625344 - DNA, 17 bp, Homo sapiens
cccagcccagcacccct

SEQ ID NO: 3625345 - DNA, 12 bp, Homo sapiens
cccagccccagc

SEQ ID NO: 3625346 - DNA, 14 bp, Homo sapiens
cccagccctgggaa

SEQ ID NO: 3625347 - DNA, 16 bp, Homo sapiens
cccagcctccctgaag

SEQ ID NO: 3625348 - DNA, 12 bp, Homo sapiens
cccagcctggga

SEQ ID NO: 3625349 - DNA, 20 bp, Homo sapiens
cccagcctgggagcccagag

SEQ ID NO: 3625350 - DNA, 12 bp, Homo sapiens
cccagcctgtcc

SEQ ID NO: 3625351 - DNA, 16 bp, Homo sapiens
cccagctaagaacctg

SEQ ID NO: 3625352 - DNA, 20 bp, Homo sapiens
cccagctaagaacctggaac

SEQ ID NO: 3625353 - DNA, 9 bp, Homo sapiens
cccagctcc

SEQ ID NO: 3625354 - DNA, 13 bp, Homo sapiens
cccagctccagca

SEQ ID NO: 3625355 - DNA, 18 bp, Homo sapiens
cccagctctagcctctgg

SEQ ID NO: 3625356 - DNA, 20 bp, Homo sapiens
cccagctctgtcctcttggc

SEQ ID NO: 3625357 - DNA, 14 bp, Homo sapiens
cccagctgaaggca

SEQ ID NO: 3625358 - DNA, 17 bp, Homo sapiens
cccagctgaaggcagtg

SEQ ID NO: 3625359 - DNA, 18 bp, Homo sapiens
cccagctgcaccccttcc

SEQ ID NO: 3625360 - DNA, 13 bp, Homo sapiens
cccagcttggctc

SEQ ID NO: 3625361 - DNA, 22 bp, Homo sapiens
cccagcttgggcagatctccca

SEQ ID NO: 3625362 - DNA, 15 bp, Homo sapiens
cccaggaactgggcc

SEQ ID NO: 3625363 - DNA, 12 bp, Homo sapiens
cccaggaaggga

SEQ ID NO: 3625364 - DNA, 15 bp, Homo sapiens
cccaggaccagctca

SEQ ID NO: 3625365 - DNA, 16 bp, Homo sapiens
cccaggaccagctcag

SEQ ID NO: 3625366 - DNA, 22 bp, Homo sapiens
cccaggaccagctcaggacaga

SEQ ID NO: 3625367 - DNA, 12 bp, Homo sapiens
cccaggaccctg

SEQ ID NO: 3625368 - DNA, 15 bp, Homo sapiens
cccaggagacagttc

SEQ ID NO: 3625369 - DNA, 16 bp, Homo sapiens
cccaggaggcctgggc

SEQ ID NO: 3625370 - DNA, 16 bp, Homo sapiens
cccaggcctgcctgtt

SEQ ID NO: 3625371 - DNA, 20 bp, Homo sapiens
cccaggctggagtgcaatga

SEQ ID NO: 3625372 - DNA, 21 bp, Homo sapiens
cccagggaagtttctgggtgc

SEQ ID NO: 3625373 - DNA, 13 bp, Homo sapiens
cccagggcccaga

SEQ ID NO: 3625374 - DNA, 17 bp, Homo sapiens
cccagggcccagagccc

SEQ ID NO: 3625375 - DNA, 20 bp, Homo sapiens
cccagggcccagagcccagc

SEQ ID NO: 3625376 - DNA, 22 bp, Homo sapiens
cccagggcccagagcccagctc

SEQ ID NO: 3625377 - DNA, 21 bp, Homo sapiens
cccagggcctagaggtaaccg

SEQ ID NO: 3625378 - DNA, 18 bp, Homo sapiens
cccaggttcccccagcaa

SEQ ID NO: 3625379 - DNA, 20 bp, Homo sapiens
cccaggttcccccagcaagc

SEQ ID NO: 3625380 - DNA, 13 bp, Homo sapiens
cccagtaaaattt

SEQ ID NO: 3625381 - DNA, 16 bp, Homo sapiens
cccagtaaaatttcag

SEQ ID NO: 3625382 - DNA, 18 bp, Homo sapiens
cccagtaaaatttcagga

SEQ ID NO: 3625383 - DNA, 15 bp, Homo sapiens
cccagtcccacactg

SEQ ID NO: 3625384 - DNA, 16 bp, Homo sapiens
cccagtcccacactgt

SEQ ID NO: 3625385 - DNA, 15 bp, Homo sapiens
cccagtcgaccccaa

SEQ ID NO: 3625386 - DNA, 15 bp, Homo sapiens
cccagtctttcttca

SEQ ID NO: 3625387 - DNA, 18 bp, Homo sapiens
cccagtgaagcctctgag

SEQ ID NO: 3625388 - DNA, 14 bp, Homo sapiens
cccagtgactccag

SEQ ID NO: 3625389 - DNA, 15 bp, Homo sapiens
cccagtgactccagg

SEQ ID NO: 3625390 - DNA, 16 bp, Homo sapiens
cccagtgactccaggg

SEQ ID NO: 3625391 - DNA, 12 bp, Homo sapiens
cccagtgcaaac

SEQ ID NO: 3625392 - DNA, 19 bp, Homo sapiens
cccagtgcccccactgacc

SEQ ID NO: 3625393 - DNA, 22 bp, Homo sapiens
cccagtgcccccactgaccaga

SEQ ID NO: 3625394 - DNA, 17 bp, Homo sapiens
cccagtgggtctgggat

SEQ ID NO: 3625395 - DNA, 19 bp, Homo sapiens
cccagtgtcccctttcttc

SEQ ID NO: 3625396 - DNA, 17 bp, Homo sapiens
cccagtgtgagacccca

SEQ ID NO: 3625397 - DNA, 18 bp, Homo sapiens
cccagtgtgagaccccaa

SEQ ID NO: 3625398 - DNA, 21 bp, Homo sapiens
cccagttcatcaccatttcct

SEQ ID NO: 3625399 - DNA, 17 bp, Homo sapiens
cccataaaatgatcctg

SEQ ID NO: 3625400 - DNA, 18 bp, Homo sapiens
cccatatataaattatta

SEQ ID NO: 3625401 - DNA, 17 bp, Homo sapiens
cccatccagacctggct

SEQ ID NO: 3625402 - DNA, 13 bp, Homo sapiens
cccatccagccag

SEQ ID NO: 3625403 - DNA, 13 bp, Homo sapiens
cccatccctgctt

SEQ ID NO: 3625404 - DNA, 16 bp, Homo sapiens
cccatccctgcttgcc

SEQ ID NO: 3625405 - DNA, 16 bp, Homo sapiens
cccatcctaggaacca

SEQ ID NO: 3625406 - DNA, 17 bp, Homo sapiens
cccatcctaggaaccag

SEQ ID NO: 3625407 - DNA, 18 bp, Homo sapiens
cccatcctaggaaccagc

SEQ ID NO: 3625408 - DNA, 15 bp, Homo sapiens
cccatcctccagcag

SEQ ID NO: 3625409 - DNA, 21 bp, Homo sapiens
cccatcctggggcagcactcc

SEQ ID NO: 3625410 - DNA, 15 bp, Homo sapiens
cccatctgagctggg

SEQ ID NO: 3625411 - DNA, 21 bp, Homo sapiens
cccatgcaccttccagcccgg

SEQ ID NO: 3625412 - DNA, 14 bp, Homo sapiens
cccatgcactgtga

SEQ ID NO: 3625413 - DNA, 22 bp, Homo sapiens
cccatgcactgtgaaggaccct

SEQ ID NO: 3625414 - DNA, 13 bp, Homo sapiens
cccatgccagaga

SEQ ID NO: 3625415 - DNA, 14 bp, Homo sapiens
cccatgccccagtc

SEQ ID NO: 3625416 - DNA, 16 bp, Homo sapiens
cccatgctgccttcag

SEQ ID NO: 3625417 - DNA, 15 bp, Homo sapiens
cccatggcagctcct

SEQ ID NO: 3625418 - DNA, 17 bp, Homo sapiens
cccatggcagctcctga

SEQ ID NO: 3625419 - DNA, 14 bp, Homo sapiens
cccatggccatttc

SEQ ID NO: 3625420 - DNA, 16 bp, Homo sapiens
cccatgggaggctgga

SEQ ID NO: 3625421 - DNA, 17 bp, Homo sapiens
cccatgtgtacattctg

SEQ ID NO: 3625422 - DNA, 19 bp, Homo sapiens
cccatgtgtacattctgcc

SEQ ID NO: 3625423 - DNA, 12 bp, Homo sapiens
cccattcccagc

SEQ ID NO: 3625424 - DNA, 16 bp, Homo sapiens
cccattcccagcctga

SEQ ID NO: 3625425 - DNA, 18 bp, Homo sapiens
cccattcctgaagaacca

SEQ ID NO: 3625426 - DNA, 20 bp, Homo sapiens
cccattgtccctctgcccca

SEQ ID NO: 3625427 - DNA, 15 bp, Homo sapiens
cccattttgcctctg

SEQ ID NO: 3625428 - DNA, 21 bp, Homo sapiens
cccattttttaaaaaagcaag

SEQ ID NO: 3625429 - DNA, 13 bp, Homo sapiens
ccccaaaatccaa

SEQ ID NO: 3625430 - DNA, 15 bp, Homo sapiens
ccccaaaccccagcc

SEQ ID NO: 3625431 - DNA, 20 bp, Homo sapiens
ccccaaaccccagccccaac

SEQ ID NO: 3625432 - DNA, 18 bp, Homo sapiens
ccccaaactgtagtaatt

SEQ ID NO: 3625433 - DNA, 17 bp, Homo sapiens
ccccaaaggaacactga

SEQ ID NO: 3625434 - DNA, 19 bp, Homo sapiens
ccccaaaggaacactgaca

SEQ ID NO: 3625435 - DNA, 16 bp, Homo sapiens
ccccaacccctctcca

SEQ ID NO: 3625436 - DNA, 20 bp, Homo sapiens
ccccaacccctctccaggcc

SEQ ID NO: 3625437 - DNA, 15 bp, Homo sapiens
ccccaactccagggg

SEQ ID NO: 3625438 - DNA, 16 bp, Homo sapiens
ccccaagctgttttct

SEQ ID NO: 3625439 - DNA, 18 bp, Homo sapiens
ccccaagggccctggcac

SEQ ID NO: 3625440 - DNA, 22 bp, Homo sapiens
ccccaattatatctcccccact

SEQ ID NO: 3625441 - DNA, 19 bp, Homo sapiens
ccccacaaggaaccctcag

SEQ ID NO: 3625442 - DNA, 13 bp, Homo sapiens
ccccacagaacct

SEQ ID NO: 3625443 - DNA, 20 bp, Homo sapiens
ccccacatccttctcactgc

SEQ ID NO: 3625444 - DNA, 14 bp, Homo sapiens
ccccaccatctgct

SEQ ID NO: 3625445 - DNA, 14 bp, Homo sapiens
ccccaccccatcca

SEQ ID NO: 3625446 - DNA, 20 bp, Homo sapiens
ccccacccctgggggctctc

SEQ ID NO: 3625447 - DNA, 17 bp, Homo sapiens
ccccacccgctcccaca

SEQ ID NO: 3625448 - DNA, 12 bp, Homo sapiens
ccccaccctcat

SEQ ID NO: 3625449 - DNA, 23 bp, Homo sapiens
ccccaccgaggttcccagggctg

SEQ ID NO: 3625450 - DNA, 12 bp, Homo sapiens
ccccacctccac

SEQ ID NO: 3625451 - DNA, 15 bp, Homo sapiens
ccccagactagatgt

SEQ ID NO: 3625452 - DNA, 18 bp, Homo sapiens
ccccagactagatgtagt

SEQ ID NO: 3625453 - DNA, 18 bp, Homo sapiens
ccccagacttctctttct

SEQ ID NO: 3625454 - DNA, 14 bp, Homo sapiens
ccccagagctgtgc

SEQ ID NO: 3625455 - DNA, 15 bp, Homo sapiens
ccccagaggccctgg

SEQ ID NO: 3625456 - DNA, 16 bp, Homo sapiens
ccccagaggccctgga

SEQ ID NO: 3625457 - DNA, 13 bp, Homo sapiens
ccccagccagccc

SEQ ID NO: 3625458 - DNA, 14 bp, Homo sapiens
ccccagccagccct

SEQ ID NO: 3625459 - DNA, 22 bp, Homo sapiens
ccccagccagcctggctgggac

SEQ ID NO: 3625460 - DNA, 16 bp, Homo sapiens
ccccagcccagagaca

SEQ ID NO: 3625461 - DNA, 15 bp, Homo sapiens
ccccagcccagcacc

SEQ ID NO: 3625462 - DNA, 12 bp, Homo sapiens
ccccagccctgg

SEQ ID NO: 3625463 - DNA, 16 bp, Homo sapiens
ccccagccctgggaac

SEQ ID NO: 3625464 - DNA, 15 bp, Homo sapiens
ccccagcctgtcctt

SEQ ID NO: 3625465 - DNA, 15 bp, Homo sapiens
ccccagcttgggcag

SEQ ID NO: 3625466 - DNA, 15 bp, Homo sapiens
ccccaggaccagctc

SEQ ID NO: 3625467 - DNA, 19 bp, Homo sapiens
ccccaggaccagctcagga

SEQ ID NO: 3625468 - DNA, 19 bp, Homo sapiens
ccccaggaggcctgggccg

SEQ ID NO: 3625469 - DNA, 18 bp, Homo sapiens
ccccaggagggaggcagg

SEQ ID NO: 3625470 - DNA, 16 bp, Homo sapiens
ccccagtgactccagg

SEQ ID NO: 3625471 - DNA, 18 bp, Homo sapiens
ccccatccagacctggct

SEQ ID NO: 3625472 - DNA, 13 bp, Homo sapiens
ccccatccagcca

SEQ ID NO: 3625473 - DNA, 15 bp, Homo sapiens
ccccatcggccaaga

SEQ ID NO: 3625474 - DNA, 18 bp, Homo sapiens
ccccatgctgccttcagg

SEQ ID NO: 3625475 - DNA, 15 bp, Homo sapiens
ccccatggcagctcc

SEQ ID NO: 3625476 - DNA, 16 bp, Homo sapiens
ccccatggcagctcct

SEQ ID NO: 3625477 - DNA, 19 bp, Homo sapiens
ccccatggccggctttcag

SEQ ID NO: 3625478 - DNA, 13 bp, Homo sapiens
ccccattcccagc

SEQ ID NO: 3625479 - DNA, 21 bp, Homo sapiens
ccccattcttcctagttttct

SEQ ID NO: 3625480 - DNA, 16 bp, Homo sapiens
ccccatttcctcacac

SEQ ID NO: 3625481 - DNA, 18 bp, Homo sapiens
cccccaaaatccaaaact

SEQ ID NO: 3625482 - DNA, 23 bp, Homo sapiens
cccccaaccaagtggctcccaca

SEQ ID NO: 3625483 - DNA, 16 bp, Homo sapiens
cccccaaggccactgc

SEQ ID NO: 3625484 - DNA, 23 bp, Homo sapiens
cccccacaagctgtccctgcagg

SEQ ID NO: 3625485 - DNA, 21 bp, Homo sapiens
cccccaccactcaggccacag

SEQ ID NO: 3625486 - DNA, 12 bp, Homo sapiens
cccccactcagt

SEQ ID NO: 3625487 - DNA, 17 bp, Homo sapiens
cccccactcagtgcctc

SEQ ID NO: 3625488 - DNA, 15 bp, Homo sapiens
cccccagaaagcctc

SEQ ID NO: 3625489 - DNA, 18 bp, Homo sapiens
cccccagctaagaacctg

SEQ ID NO: 3625490 - DNA, 14 bp, Homo sapiens
cccccatgcactgt

SEQ ID NO: 3625491 - DNA, 18 bp, Homo sapiens
cccccatgcactgtgaag

SEQ ID NO: 3625492 - DNA, 11 bp, Homo sapiens
cccccatgctg

SEQ ID NO: 3625493 - DNA, 17 bp, Homo sapiens
cccccattcccagcctg

SEQ ID NO: 3625494 - DNA, 18 bp, Homo sapiens
cccccgcgctcgcccagc

SEQ ID NO: 3625495 - DNA, 19 bp, Homo sapiens
cccccgcgctcgcccagca

SEQ ID NO: 3625496 - DNA, 21 bp, Homo sapiens
cccccgcgctcgcccagcagg

SEQ ID NO: 3625497 - DNA, 18 bp, Homo sapiens
ccccctcccccagccact

SEQ ID NO: 3625498 - DNA, 17 bp, Homo sapiens
ccccctgcagcccaggc

SEQ ID NO: 3625499 - DNA, 19 bp, Homo sapiens
ccccctgggctggggcctc

SEQ ID NO: 3625500 - DNA, 22 bp, Homo sapiens
ccccctgggctggggcctcaga

SEQ ID NO: 3625501 - DNA, 15 bp, Homo sapiens
ccccctttcacactg

SEQ ID NO: 3625502 - DNA, 14 bp, Homo sapiens
ccccgagggctgag

SEQ ID NO: 3625503 - DNA, 19 bp, Homo sapiens
ccccgagggctgagcctgg

SEQ ID NO: 3625504 - DNA, 15 bp, Homo sapiens
ccccgcacccggctc

SEQ ID NO: 3625505 - DNA, 13 bp, Homo sapiens
ccccgccagggct

SEQ ID NO: 3625506 - DNA, 16 bp, Homo sapiens
ccccgccagggctggg

SEQ ID NO: 3625507 - DNA, 18 bp, Homo sapiens
ccccgccatgcatgcagc

SEQ ID NO: 3625508 - DNA, 12 bp, Homo sapiens
ccccgccccaga

SEQ ID NO: 3625509 - DNA, 15 bp, Homo sapiens
ccccgcccctgtggc

SEQ ID NO: 3625510 - DNA, 20 bp, Homo sapiens
ccccgggctggagaaagagc

SEQ ID NO: 3625511 - DNA, 13 bp, Homo sapiens
ccccgtctctgcc

SEQ ID NO: 3625512 - DNA, 14 bp, Homo sapiens
ccccgtctctgccc

SEQ ID NO: 3625513 - DNA, 19 bp, Homo sapiens
cccctaaagagcatcctga

SEQ ID NO: 3625514 - DNA, 17 bp, Homo sapiens
cccctaggtgcccaggg

SEQ ID NO: 3625515 - DNA, 19 bp, Homo sapiens
cccctcaaactgcacatct

SEQ ID NO: 3625516 - DNA, 14 bp, Homo sapiens
cccctcacactgca

SEQ ID NO: 3625517 - DNA, 15 bp, Homo sapiens
cccctcacactgcaa

SEQ ID NO: 3625518 - DNA, 15 bp, Homo sapiens
cccctcactccccag

SEQ ID NO: 3625519 - DNA, 20 bp, Homo sapiens
cccctccaaacctccagcct

SEQ ID NO: 3625520 - DNA, 23 bp, Homo sapiens
cccctccaatcccaccaaccctc

SEQ ID NO: 3625521 - DNA, 21 bp, Homo sapiens
cccctccaccccccactcagt

SEQ ID NO: 3625522 - DNA, 14 bp, Homo sapiens
cccctcccagacag

SEQ ID NO: 3625523 - DNA, 16 bp, Homo sapiens
cccctcccagacaggc

SEQ ID NO: 3625524 - DNA, 14 bp, Homo sapiens
cccctccccagcca

SEQ ID NO: 3625525 - DNA, 17 bp, Homo sapiens
cccctcccccagccact

SEQ ID NO: 3625526 - DNA, 18 bp, Homo sapiens
cccctcccccagccactc

SEQ ID NO: 3625527 - DNA, 19 bp, Homo sapiens
cccctcccctggggacgcc

SEQ ID NO: 3625528 - DNA, 16 bp, Homo sapiens
cccctccctgcctgct

SEQ ID NO: 3625529 - DNA, 15 bp, Homo sapiens
cccctcccttcaacc

SEQ ID NO: 3625530 - DNA, 15 bp, Homo sapiens
cccctctccaggcct

SEQ ID NO: 3625531 - DNA, 17 bp, Homo sapiens
cccctctccaggcctgt

SEQ ID NO: 3625532 - DNA, 14 bp, Homo sapiens
cccctctccttcct

SEQ ID NO: 3625533 - DNA, 14 bp, Homo sapiens
cccctctgctgccg

SEQ ID NO: 3625534 - DNA, 19 bp, Homo sapiens
cccctctttcgtctactgc

SEQ ID NO: 3625535 - DNA, 16 bp, Homo sapiens
cccctgacagggccag

SEQ ID NO: 3625536 - DNA, 20 bp, Homo sapiens
cccctgacctaccccagcca

SEQ ID NO: 3625537 - DNA, 21 bp, Homo sapiens
cccctgacctaccccagccag

SEQ ID NO: 3625538 - DNA, 22 bp, Homo sapiens
cccctgacctaccccagccagg

SEQ ID NO: 3625539 - DNA, 13 bp, Homo sapiens
cccctgaggagct

SEQ ID NO: 3625540 - DNA, 22 bp, Homo sapiens
cccctgcaacttccgctgaggg

SEQ ID NO: 3625541 - DNA, 20 bp, Homo sapiens
cccctgcctgacagccttcc

SEQ ID NO: 3625542 - DNA, 11 bp, Homo sapiens
cccctggcctt

SEQ ID NO: 3625543 - DNA, 15 bp, Homo sapiens
cccctggccttggga

SEQ ID NO: 3625544 - DNA, 10 bp, Homo sapiens
cccctggctt

SEQ ID NO: 3625545 - DNA, 17 bp, Homo sapiens
cccctggctttgcctct

SEQ ID NO: 3625546 - DNA, 20 bp, Homo sapiens
cccctggctttgcctcttct

SEQ ID NO: 3625547 - DNA, 23 bp, Homo sapiens
cccctggcttttcactgctggct

SEQ ID NO: 3625548 - DNA, 15 bp, Homo sapiens
cccctgggctggggc

SEQ ID NO: 3625549 - DNA, 20 bp, Homo sapiens
cccctgtcccacccacacag

SEQ ID NO: 3625550 - DNA, 18 bp, Homo sapiens
cccctgtctagagaggga

SEQ ID NO: 3625551 - DNA, 14 bp, Homo sapiens
ccccttcacaaagc

SEQ ID NO: 3625552 - DNA, 18 bp, Homo sapiens
ccccttcatccatcctga

SEQ ID NO: 3625553 - DNA, 15 bp, Homo sapiens
ccccttccctgggag

SEQ ID NO: 3625554 - DNA, 14 bp, Homo sapiens
ccccttcctaccac

SEQ ID NO: 3625555 - DNA, 14 bp, Homo sapiens
ccccttcctgggca

SEQ ID NO: 3625556 - DNA, 17 bp, Homo sapiens
ccccttcctgtttcaga

SEQ ID NO: 3625557 - DNA, 17 bp, Homo sapiens
ccccttctctgcctcac

SEQ ID NO: 3625558 - DNA, 17 bp, Homo sapiens
cccgaaaaatgtgtggt

SEQ ID NO: 3625559 - DNA, 19 bp, Homo sapiens
cccgaaactccacccgttc

SEQ ID NO: 3625560 - DNA, 20 bp, Homo sapiens
cccgacacacggggctcggg

SEQ ID NO: 3625561 - DNA, 15 bp, Homo sapiens
cccgacagcctggca

SEQ ID NO: 3625562 - DNA, 15 bp, Homo sapiens
cccgacaggtgggcc

SEQ ID NO: 3625563 - DNA, 19 bp, Homo sapiens
cccgacaggtgggcctggg

SEQ ID NO: 3625564 - DNA, 13 bp, Homo sapiens
cccgacagtgcca

SEQ ID NO: 3625565 - DNA, 19 bp, Homo sapiens
cccgacagtgccatcccca

SEQ ID NO: 3625566 - DNA, 19 bp, Homo sapiens
cccgacgtttgcggcagtg

SEQ ID NO: 3625567 - DNA, 17 bp, Homo sapiens
cccgagaaccctgagca

SEQ ID NO: 3625568 - DNA, 19 bp, Homo sapiens
cccgagaagtgctcttggc

SEQ ID NO: 3625569 - DNA, 14 bp, Homo sapiens
cccgagtctccggg

SEQ ID NO: 3625570 - DNA, 19 bp, Homo sapiens
cccgcaccccccaagctgt

SEQ ID NO: 3625571 - DNA, 19 bp, Homo sapiens
cccgcagtgtgcactaagg

SEQ ID NO: 3625572 - DNA, 17 bp, Homo sapiens
cccgcatgtgtgcctgg

SEQ ID NO: 3625573 - DNA, 20 bp, Homo sapiens
cccgcatgtgtgcctggccg

SEQ ID NO: 3625574 - DNA, 15 bp, Homo sapiens
cccgccaaaagctgc

SEQ ID NO: 3625575 - DNA, 15 bp, Homo sapiens
cccgccagggctggg

SEQ ID NO: 3625576 - DNA, 16 bp, Homo sapiens
cccgccagggctgggg

SEQ ID NO: 3625577 - DNA, 13 bp, Homo sapiens
cccgccccgcccc

SEQ ID NO: 3625578 - DNA, 21 bp, Homo sapiens
cccgcccttccatgtgccttt

SEQ ID NO: 3625579 - DNA, 13 bp, Homo sapiens
cccgctcagccct

SEQ ID NO: 3625580 - DNA, 18 bp, Homo sapiens
cccgctcaggggcctgga

SEQ ID NO: 3625581 - DNA, 19 bp, Homo sapiens
cccgctcaggggcctggag

SEQ ID NO: 3625582 - DNA, 15 bp, Homo sapiens
cccgctcccacaccc

SEQ ID NO: 3625583 - DNA, 21 bp, Homo sapiens
cccgcttctgaagctgctgca

SEQ ID NO: 3625584 - DNA, 19 bp, Homo sapiens
cccggaagggctttggttc

SEQ ID NO: 3625585 - DNA, 21 bp, Homo sapiens
cccggccgccccgccccagag

SEQ ID NO: 3625586 - DNA, 18 bp, Homo sapiens
cccgggttgggtcaccag

SEQ ID NO: 3625587 - DNA, 13 bp, Homo sapiens
cccgtaaggctgt

SEQ ID NO: 3625588 - DNA, 14 bp, Homo sapiens
cccgtaaggctgta

SEQ ID NO: 3625589 - DNA, 18 bp, Homo sapiens
cccgtaaggctgtacata

SEQ ID NO: 3625590 - DNA, 16 bp, Homo sapiens
cccgtctctgccctgg

SEQ ID NO: 3625591 - DNA, 22 bp, Homo sapiens
cccgtggtggcggtggctgccc

SEQ ID NO: 3625592 - DNA, 19 bp, Homo sapiens
cccgtttctccttttccta

SEQ ID NO: 3625593 - DNA, 21 bp, Homo sapiens
cccgtttgtcaaagaggatgg

SEQ ID NO: 3625594 - DNA, 13 bp, Homo sapiens
cccgttttgtcac

SEQ ID NO: 3625595 - DNA, 22 bp, Homo sapiens
ccctaaaccccaagcttcccaa

SEQ ID NO: 3625596 - DNA, 22 bp, Homo sapiens
ccctaaactgcagcctctctgg

SEQ ID NO: 3625597 - DNA, 18 bp, Homo sapiens
ccctaagcccccagggcc

SEQ ID NO: 3625598 - DNA, 13 bp, Homo sapiens
ccctacagtatat

SEQ ID NO: 3625599 - DNA, 21 bp, Homo sapiens
ccctaccgagtctcttctcca

SEQ ID NO: 3625600 - DNA, 14 bp, Homo sapiens
ccctacctgtgcct

SEQ ID NO: 3625601 - DNA, 13 bp, Homo sapiens
ccctactgtgggc

SEQ ID NO: 3625602 - DNA, 18 bp, Homo sapiens
ccctacttcttttgctct

SEQ ID NO: 3625603 - DNA, 19 bp, Homo sapiens
ccctagccagagaatagat

SEQ ID NO: 3625604 - DNA, 14 bp, Homo sapiens
ccctagccctgctc

SEQ ID NO: 3625605 - DNA, 13 bp, Homo sapiens
ccctagctgaccc

SEQ ID NO: 3625606 - DNA, 15 bp, Homo sapiens
ccctagtaaaaatac

SEQ ID NO: 3625607 - DNA, 16 bp, Homo sapiens
ccctagttcaggtcca

SEQ ID NO: 3625608 - DNA, 19 bp, Homo sapiens
ccctcaaactgcacatcta

SEQ ID NO: 3625609 - DNA, 21 bp, Homo sapiens
ccctcacacacacccccccac

SEQ ID NO: 3625610 - DNA, 13 bp, Homo sapiens
ccctcacactgca

SEQ ID NO: 3625611 - DNA, 16 bp, Homo sapiens
ccctcacactgcaagg

SEQ ID NO: 3625612 - DNA, 23 bp, Homo sapiens
ccctcacactttgccatttgctt

SEQ ID NO: 3625613 - DNA, 20 bp, Homo sapiens
ccctcaccacagccttctaa

SEQ ID NO: 3625614 - DNA, 13 bp, Homo sapiens
ccctcacccatcc

SEQ ID NO: 3625615 - DNA, 17 bp, Homo sapiens
ccctcacccatcctaga

SEQ ID NO: 3625616 - DNA, 21 bp, Homo sapiens
ccctcaccttggcaccagaca

SEQ ID NO: 3625617 - DNA, 14 bp, Homo sapiens
ccctcaggcacacc

SEQ ID NO: 3625618 - DNA, 17 bp, Homo sapiens
ccctcaggcacaccttg

SEQ ID NO: 3625619 - DNA, 20 bp, Homo sapiens
ccctcaggcacaccttgcag

SEQ ID NO: 3625620 - DNA, 18 bp, Homo sapiens
ccctcaggccaccctcca

SEQ ID NO: 3625621 - DNA, 17 bp, Homo sapiens
ccctcatctctctgccc

SEQ ID NO: 3625622 - DNA, 22 bp, Homo sapiens
ccctcattccaccttcccatgc

SEQ ID NO: 3625623 - DNA, 17 bp, Homo sapiens
ccctccaaacctccagc

SEQ ID NO: 3625624 - DNA, 23 bp, Homo sapiens
ccctccaaacctccagcctccct

SEQ ID NO: 3625625 - DNA, 19 bp, Homo sapiens
ccctccaccccccactcag

SEQ ID NO: 3625626 - DNA, 14 bp, Homo sapiens
ccctccactccact

SEQ ID NO: 3625627 - DNA, 16 bp, Homo sapiens
ccctcccaccagaacg

SEQ ID NO: 3625628 - DNA, 14 bp, Homo sapiens
ccctcccacccacc

SEQ ID NO: 3625629 - DNA, 13 bp, Homo sapiens
ccctcccagacag

SEQ ID NO: 3625630 - DNA, 20 bp, Homo sapiens
ccctcccagacaggccctcc

SEQ ID NO: 3625631 - DNA, 14 bp, Homo sapiens
ccctccccagccag

SEQ ID NO: 3625632 - DNA, 18 bp, Homo sapiens
ccctcccccattccctcc

SEQ ID NO: 3625633 - DNA, 16 bp, Homo sapiens
ccctccccgcaccccc

SEQ ID NO: 3625634 - DNA, 17 bp, Homo sapiens
ccctccccgcacccccc

SEQ ID NO: 3625635 - DNA, 15 bp, Homo sapiens
ccctccccgcccctg

SEQ ID NO: 3625636 - DNA, 22 bp, Homo sapiens
ccctcccggagaggtggccgcc

SEQ ID NO: 3625637 - DNA, 15 bp, Homo sapiens
ccctccctgcctgct

SEQ ID NO: 3625638 - DNA, 18 bp, Homo sapiens
ccctccctgtctccaggg

SEQ ID NO: 3625639 - DNA, 19 bp, Homo sapiens
ccctccctgttccccagag

SEQ ID NO: 3625640 - DNA, 20 bp, Homo sapiens
ccctccctgttccccagaga

SEQ ID NO: 3625641 - DNA, 13 bp, Homo sapiens
ccctccgccttct

SEQ ID NO: 3625642 - DNA, 18 bp, Homo sapiens
ccctccggcgggtgacag

SEQ ID NO: 3625643 - DNA, 23 bp, Homo sapiens
ccctccggcgggtgacagctccg

SEQ ID NO: 3625644 - DNA, 19 bp, Homo sapiens
ccctcctaaatgtcagctg

SEQ ID NO: 3625645 - DNA, 14 bp, Homo sapiens
ccctcctcagctcc

SEQ ID NO: 3625646 - DNA, 14 bp, Homo sapiens
ccctcctcccccag

SEQ ID NO: 3625647 - DNA, 17 bp, Homo sapiens
ccctcctctgctgggaa

SEQ ID NO: 3625648 - DNA, 16 bp, Homo sapiens
ccctcctgcacacagg

SEQ ID NO: 3625649 - DNA, 18 bp, Homo sapiens
ccctcgagagccttactt

SEQ ID NO: 3625650 - DNA, 13 bp, Homo sapiens
ccctctatttatt

SEQ ID NO: 3625651 - DNA, 20 bp, Homo sapiens
ccctctcagaggcctgctgc

SEQ ID NO: 3625652 - DNA, 23 bp, Homo sapiens
ccctctcagaggcctgctgccag

SEQ ID NO: 3625653 - DNA, 13 bp, Homo sapiens
ccctctccagcag

SEQ ID NO: 3625654 - DNA, 13 bp, Homo sapiens
ccctctccaggcc

SEQ ID NO: 3625655 - DNA, 15 bp, Homo sapiens
ccctctccaggcctg

SEQ ID NO: 3625656 - DNA, 22 bp, Homo sapiens
ccctctctcataccctccctcc

SEQ ID NO: 3625657 - DNA, 22 bp, Homo sapiens
ccctctgccggtcgggcagcca

SEQ ID NO: 3625658 - DNA, 14 bp, Homo sapiens
ccctctgctgccgg

SEQ ID NO: 3625659 - DNA, 16 bp, Homo sapiens
ccctctgggggtcctc

SEQ ID NO: 3625660 - DNA, 15 bp, Homo sapiens
ccctcttcctctcca

SEQ ID NO: 3625661 - DNA, 21 bp, Homo sapiens
ccctcttgtccctttccctac

SEQ ID NO: 3625662 - DNA, 11 bp, Homo sapiens
ccctctttccc

SEQ ID NO: 3625663 - DNA, 15 bp, Homo sapiens
ccctctttccctgcg

SEQ ID NO: 3625664 - DNA, 14 bp, Homo sapiens
ccctgaacaagaat

SEQ ID NO: 3625665 - DNA, 19 bp, Homo sapiens
ccctgaacgccctggtaag

SEQ ID NO: 3625666 - DNA, 21 bp, Homo sapiens
ccctgacctaccccagccagg

SEQ ID NO: 3625667 - DNA, 18 bp, Homo sapiens
ccctgacctcccaactct

SEQ ID NO: 3625668 - DNA, 19 bp, Homo sapiens
ccctgacctccgcccctgc

SEQ ID NO: 3625669 - DNA, 12 bp, Homo sapiens
ccctgactgggg

SEQ ID NO: 3625670 - DNA, 11 bp, Homo sapiens
ccctgagcagg

SEQ ID NO: 3625671 - DNA, 14 bp, Homo sapiens
ccctgagcaggatt

SEQ ID NO: 3625672 - DNA, 21 bp, Homo sapiens
ccctgatttaggagaagccag

SEQ ID NO: 3625673 - DNA, 17 bp, Homo sapiens
ccctgcaaaactccagg

SEQ ID NO: 3625674 - DNA, 21 bp, Homo sapiens
ccctgcaacttccgctgaggg

SEQ ID NO: 3625675 - DNA, 23 bp, Homo sapiens
ccctgcaacttccgctgaggggt

SEQ ID NO: 3625676 - DNA, 21 bp, Homo sapiens
ccctgcagggccgggcagggg

SEQ ID NO: 3625677 - DNA, 19 bp, Homo sapiens
ccctgcatctgaccagcag

SEQ ID NO: 3625678 - DNA, 16 bp, Homo sapiens
ccctgcccaaaccctt

SEQ ID NO: 3625679 - DNA, 22 bp, Homo sapiens
ccctgcccaaacccttaactga

SEQ ID NO: 3625680 - DNA, 24 bp, Homo sapiens
ccctgcctcaggccaagggaccag

SEQ ID NO: 3625681 - DNA, 18 bp, Homo sapiens
ccctgcctgacagccttc

SEQ ID NO: 3625682 - DNA, 12 bp, Homo sapiens
ccctgcctgaga

SEQ ID NO: 3625683 - DNA, 23 bp, Homo sapiens
ccctgcctgagaagccccgacac

SEQ ID NO: 3625684 - DNA, 13 bp, Homo sapiens
ccctgcctggagg

SEQ ID NO: 3625685 - DNA, 20 bp, Homo sapiens
ccctgcctggaggctcctct

SEQ ID NO: 3625686 - DNA, 18 bp, Homo sapiens
ccctgcctgttggcaggc

SEQ ID NO: 3625687 - DNA, 23 bp, Homo sapiens
ccctgcctgttggcaggcccact

SEQ ID NO: 3625688 - DNA, 15 bp, Homo sapiens
ccctgcgcctccaga

SEQ ID NO: 3625689 - DNA, 16 bp, Homo sapiens
ccctgcgcctccagag

SEQ ID NO: 3625690 - DNA, 18 bp, Homo sapiens
ccctgcgcctccagaggt

SEQ ID NO: 3625691 - DNA, 17 bp, Homo sapiens
ccctgctacctgttctt

SEQ ID NO: 3625692 - DNA, 15 bp, Homo sapiens
ccctgctccaccagc

SEQ ID NO: 3625693 - DNA, 18 bp, Homo sapiens
ccctgctccaccagcagc

SEQ ID NO: 3625694 - DNA, 20 bp, Homo sapiens
ccctgctccaccagcagcat

SEQ ID NO: 3625695 - DNA, 17 bp, Homo sapiens
ccctgctcccacagaac

SEQ ID NO: 3625696 - DNA, 12 bp, Homo sapiens
ccctgctgcgct

SEQ ID NO: 3625697 - DNA, 20 bp, Homo sapiens
ccctgctgtgccatgctggg

SEQ ID NO: 3625698 - DNA, 19 bp, Homo sapiens
ccctgcttgcccgctccca

SEQ ID NO: 3625699 - DNA, 16 bp, Homo sapiens
ccctgctttgcatctt

SEQ ID NO: 3625700 - DNA, 18 bp, Homo sapiens
ccctgctttgggctgccc

SEQ ID NO: 3625701 - DNA, 19 bp, Homo sapiens
ccctgctttgggctgccct

SEQ ID NO: 3625702 - DNA, 15 bp, Homo sapiens
ccctggaaaccttcc

SEQ ID NO: 3625703 - DNA, 19 bp, Homo sapiens
ccctggaaaccttccaccc

SEQ ID NO: 3625704 - DNA, 12 bp, Homo sapiens
ccctggacacag

SEQ ID NO: 3625705 - DNA, 13 bp, Homo sapiens
ccctggacacagc

SEQ ID NO: 3625706 - DNA, 17 bp, Homo sapiens
ccctggacacagctctt

SEQ ID NO: 3625707 - DNA, 21 bp, Homo sapiens
ccctggacacagctcttcatt

SEQ ID NO: 3625708 - DNA, 17 bp, Homo sapiens
ccctggagagccccatg

SEQ ID NO: 3625709 - DNA, 13 bp, Homo sapiens
ccctggagcagga

SEQ ID NO: 3625710 - DNA, 17 bp, Homo sapiens
ccctggaggtctccagg

SEQ ID NO: 3625711 - DNA, 19 bp, Homo sapiens
ccctggaggtctccagggg

SEQ ID NO: 3625712 - DNA, 21 bp, Homo sapiens
ccctggccactaaagcttcag

SEQ ID NO: 3625713 - DNA, 23 bp, Homo sapiens
ccctggccactaaagcttcagac

SEQ ID NO: 3625714 - DNA, 10 bp, Homo sapiens
ccctggcctc

SEQ ID NO: 3625715 - DNA, 19 bp, Homo sapiens
ccctggcctgaactgagga

SEQ ID NO: 3625716 - DNA, 21 bp, Homo sapiens
ccctggcctgaactgaggaga

SEQ ID NO: 3625717 - DNA, 15 bp, Homo sapiens
ccctggcctggctgg

SEQ ID NO: 3625718 - DNA, 16 bp, Homo sapiens
ccctggctcactggca

SEQ ID NO: 3625719 - DNA, 18 bp, Homo sapiens
ccctggctcactggcagg

SEQ ID NO: 3625720 - DNA, 19 bp, Homo sapiens
ccctggctcactggcaggt

SEQ ID NO: 3625721 - DNA, 13 bp, Homo sapiens
ccctggctttgcc

SEQ ID NO: 3625722 - DNA, 17 bp, Homo sapiens
ccctggctttgcctctt

SEQ ID NO: 3625723 - DNA, 13 bp, Homo sapiens
ccctggcttttca

SEQ ID NO: 3625724 - DNA, 18 bp, Homo sapiens
ccctgggaaccactccca

SEQ ID NO: 3625725 - DNA, 17 bp, Homo sapiens
ccctgggagccagtcct

SEQ ID NO: 3625726 - DNA, 19 bp, Homo sapiens
ccctgggagccagtcctcc

SEQ ID NO: 3625727 - DNA, 18 bp, Homo sapiens
ccctgggagccgcctgct

SEQ ID NO: 3625728 - DNA, 15 bp, Homo sapiens
ccctgggagggaggt

SEQ ID NO: 3625729 - DNA, 19 bp, Homo sapiens
ccctgggagggaggtggtc

SEQ ID NO: 3625730 - DNA, 21 bp, Homo sapiens
ccctgggagggaggtggtcct

SEQ ID NO: 3625731 - DNA, 20 bp, Homo sapiens
ccctggggatcttcccacag

SEQ ID NO: 3625732 - DNA, 21 bp, Homo sapiens
ccctggggatcttcccacagg

SEQ ID NO: 3625733 - DNA, 15 bp, Homo sapiens
ccctgggggattcct

SEQ ID NO: 3625734 - DNA, 19 bp, Homo sapiens
ccctgggggtctgggcgtc

SEQ ID NO: 3625735 - DNA, 20 bp, Homo sapiens
ccctggggtcaccttctagt

SEQ ID NO: 3625736 - DNA, 16 bp, Homo sapiens
ccctgggtttgggagc

SEQ ID NO: 3625737 - DNA, 18 bp, Homo sapiens
ccctgggtttgggagcca

SEQ ID NO: 3625738 - DNA, 21 bp, Homo sapiens
ccctgggtttgggagccagga

SEQ ID NO: 3625739 - DNA, 14 bp, Homo sapiens
ccctggtaaggctg

SEQ ID NO: 3625740 - DNA, 17 bp, Homo sapiens
ccctggtcggagaggga

SEQ ID NO: 3625741 - DNA, 14 bp, Homo sapiens
ccctggtgctgcca

SEQ ID NO: 3625742 - DNA, 15 bp, Homo sapiens
ccctggtgctgccac

SEQ ID NO: 3625743 - DNA, 21 bp, Homo sapiens
ccctggtgctgccacacttca

SEQ ID NO: 3625744 - DNA, 17 bp, Homo sapiens
ccctggttagctgacag

SEQ ID NO: 3625745 - DNA, 20 bp, Homo sapiens
ccctggttagctgacagtca

SEQ ID NO: 3625746 - DNA, 19 bp, Homo sapiens
ccctgtcatttgaacctgg

SEQ ID NO: 3625747 - DNA, 23 bp, Homo sapiens
ccctgtcccacccacacagctgc

SEQ ID NO: 3625748 - DNA, 22 bp, Homo sapiens
ccctgtccctctagtgccttct

SEQ ID NO: 3625749 - DNA, 14 bp, Homo sapiens
ccctgtccttccct

SEQ ID NO: 3625750 - DNA, 16 bp, Homo sapiens
ccctgtccttccctgt

SEQ ID NO: 3625751 - DNA, 12 bp, Homo sapiens
ccctgtctagag

SEQ ID NO: 3625752 - DNA, 17 bp, Homo sapiens
ccctgtctagagaggga

SEQ ID NO: 3625753 - DNA, 12 bp, Homo sapiens
ccctgtctccag

SEQ ID NO: 3625754 - DNA, 16 bp, Homo sapiens
ccctgtctccagctgc

SEQ ID NO: 3625755 - DNA, 15 bp, Homo sapiens
ccctgtctccagggc

SEQ ID NO: 3625756 - DNA, 17 bp, Homo sapiens
ccctgtgagcacaaaga

SEQ ID NO: 3625757 - DNA, 14 bp, Homo sapiens
ccctgtggccaact

SEQ ID NO: 3625758 - DNA, 16 bp, Homo sapiens
ccctgtggccaactgc

SEQ ID NO: 3625759 - DNA, 20 bp, Homo sapiens
ccctgtggccaactgcaaaa

SEQ ID NO: 3625760 - DNA, 15 bp, Homo sapiens
ccctgtggccctggc

SEQ ID NO: 3625761 - DNA, 14 bp, Homo sapiens
ccctgttccccaga

SEQ ID NO: 3625762 - DNA, 14 bp, Homo sapiens
ccctgttctccctt

SEQ ID NO: 3625763 - DNA, 16 bp, Homo sapiens
ccctgtttcagaggct

SEQ ID NO: 3625764 - DNA, 24 bp, Homo sapiens
cccttaagccaaactcaggcccag

SEQ ID NO: 3625765 - DNA, 21 bp, Homo sapiens
cccttaaggcacagtgggagc

SEQ ID NO: 3625766 - DNA, 17 bp, Homo sapiens
cccttacagcctctgac

SEQ ID NO: 3625767 - DNA, 12 bp, Homo sapiens
cccttattttca

SEQ ID NO: 3625768 - DNA, 14 bp, Homo sapiens
cccttcagactggc

SEQ ID NO: 3625769 - DNA, 16 bp, Homo sapiens
cccttcagactggccc

SEQ ID NO: 3625770 - DNA, 17 bp, Homo sapiens
cccttcagactggccct

SEQ ID NO: 3625771 - DNA, 14 bp, Homo sapiens
cccttcaggagcct

SEQ ID NO: 3625772 - DNA, 16 bp, Homo sapiens
cccttcaggagcctgg

SEQ ID NO: 3625773 - DNA, 19 bp, Homo sapiens
cccttcaggagcctggcca

SEQ ID NO: 3625774 - DNA, 16 bp, Homo sapiens
cccttcatccatcctg

SEQ ID NO: 3625775 - DNA, 19 bp, Homo sapiens
cccttcatccatcctgagc

SEQ ID NO: 3625776 - DNA, 21 bp, Homo sapiens
cccttccatgtgcctttcttt

SEQ ID NO: 3625777 - DNA, 20 bp, Homo sapiens
cccttcctctccactgcctt

SEQ ID NO: 3625778 - DNA, 22 bp, Homo sapiens
cccttcctggaaacagcatgaa

SEQ ID NO: 3625779 - DNA, 23 bp, Homo sapiens
cccttctagggttattgcatttg

SEQ ID NO: 3625780 - DNA, 22 bp, Homo sapiens
cccttctctgcctcacctggtc

SEQ ID NO: 3625781 - DNA, 22 bp, Homo sapiens
cccttgaggaaacaacagcttt

SEQ ID NO: 3625782 - DNA, 17 bp, Homo sapiens
cccttgattcattctga

SEQ ID NO: 3625783 - DNA, 18 bp, Homo sapiens
cccttgattcattctgaa

SEQ ID NO: 3625784 - DNA, 16 bp, Homo sapiens
cccttgcctctgccct

SEQ ID NO: 3625785 - DNA, 20 bp, Homo sapiens
cccttgcctctgccctggat

SEQ ID NO: 3625786 - DNA, 22 bp, Homo sapiens
cccttgccttcctcagctgcct

SEQ ID NO: 3625787 - DNA, 12 bp, Homo sapiens
cccttgctgccc

SEQ ID NO: 3625788 - DNA, 14 bp, Homo sapiens
cccttggaaagaaa

SEQ ID NO: 3625789 - DNA, 20 bp, Homo sapiens
cccttggaacaccctggatg

SEQ ID NO: 3625790 - DNA, 15 bp, Homo sapiens
cccttggacatttta

SEQ ID NO: 3625791 - DNA, 14 bp, Homo sapiens
cccttggaggagag

SEQ ID NO: 3625792 - DNA, 21 bp, Homo sapiens
cccttggaggagagagacccc

SEQ ID NO: 3625793 - DNA, 22 bp, Homo sapiens
cccttgttgtaaaaagcccagc

SEQ ID NO: 3625794 - DNA, 12 bp, Homo sapiens
ccctttactcgt

SEQ ID NO: 3625795 - DNA, 14 bp, Homo sapiens
ccctttctaagcaa

SEQ ID NO: 3625796 - DNA, 13 bp, Homo sapiens
ccctttctctctc

SEQ ID NO: 3625797 - DNA, 14 bp, Homo sapiens
ccctttctctctcc

SEQ ID NO: 3625798 - DNA, 22 bp, Homo sapiens
ccctttctctctcctctctgct

SEQ ID NO: 3625799 - DNA, 14 bp, Homo sapiens
ccctttctgtccca

SEQ ID NO: 3625800 - DNA, 16 bp, Homo sapiens
cccttttcccccttcc

SEQ ID NO: 3625801 - DNA, 11 bp, Homo sapiens
ccgaaaaatgt

SEQ ID NO: 3625802 - DNA, 23 bp, Homo sapiens
ccgaaatatctatgttttaccaa

SEQ ID NO: 3625803 - DNA, 15 bp, Homo sapiens
ccgaaatgctgtctt

SEQ ID NO: 3625804 - DNA, 18 bp, Homo sapiens
ccgaactgggcatatttc

SEQ ID NO: 3625805 - DNA, 15 bp, Homo sapiens
ccgaagcccaggggc

SEQ ID NO: 3625806 - DNA, 17 bp, Homo sapiens
ccgaagcccaggggccg

SEQ ID NO: 3625807 - DNA, 12 bp, Homo sapiens
ccgacagcctgg

SEQ ID NO: 3625808 - DNA, 14 bp, Homo sapiens
ccgacagtgccatc

SEQ ID NO: 3625809 - DNA, 13 bp, Homo sapiens
ccgaccaactgcc

SEQ ID NO: 3625810 - DNA, 14 bp, Homo sapiens
ccgaccaactgccc

SEQ ID NO: 3625811 - DNA, 16 bp, Homo sapiens
ccgaccaactgcccta

SEQ ID NO: 3625812 - DNA, 11 bp, Homo sapiens
ccgactcaggg

SEQ ID NO: 3625813 - DNA, 15 bp, Homo sapiens
ccgactcagggacct

SEQ ID NO: 3625814 - DNA, 20 bp, Homo sapiens
ccgactgaaaatattgtttt

SEQ ID NO: 3625815 - DNA, 13 bp, Homo sapiens
ccgactgcccctg

SEQ ID NO: 3625816 - DNA, 22 bp, Homo sapiens
ccgagcccaggcagctatttca

SEQ ID NO: 3625817 - DNA, 11 bp, Homo sapiens
ccgagccctgg

SEQ ID NO: 3625818 - DNA, 13 bp, Homo sapiens
ccgagccctggag

SEQ ID NO: 3625819 - DNA, 14 bp, Homo sapiens
ccgagccctggaga

SEQ ID NO: 3625820 - DNA, 15 bp, Homo sapiens
ccgagctctggtgct

SEQ ID NO: 3625821 - DNA, 19 bp, Homo sapiens
ccgaggacgctccctgctc

SEQ ID NO: 3625822 - DNA, 16 bp, Homo sapiens
ccgagggctgagcctg

SEQ ID NO: 3625823 - DNA, 21 bp, Homo sapiens
ccgagtctccgggactgccct

SEQ ID NO: 3625824 - DNA, 13 bp, Homo sapiens
ccgagtgcactgc

SEQ ID NO: 3625825 - DNA, 17 bp, Homo sapiens
ccgatgtgtctcccaga

SEQ ID NO: 3625826 - DNA, 17 bp, Homo sapiens
ccgcacatggtgtgggg

SEQ ID NO: 3625827 - DNA, 18 bp, Homo sapiens
ccgcacatggtgtggggg

SEQ ID NO: 3625828 - DNA, 22 bp, Homo sapiens
ccgcagagaaatgccccagtgt

SEQ ID NO: 3625829 - DNA, 20 bp, Homo sapiens
ccgcagggcgcccagcgccg

SEQ ID NO: 3625830 - DNA, 23 bp, Homo sapiens
ccgcagtgtgcactaaggggccc

SEQ ID NO: 3625831 - DNA, 15 bp, Homo sapiens
ccgcagttgtagcag

SEQ ID NO: 3625832 - DNA, 16 bp, Homo sapiens
ccgcagttgtagcaga

SEQ ID NO: 3625833 - DNA, 18 bp, Homo sapiens
ccgcatgtgtgcctggcc

SEQ ID NO: 3625834 - DNA, 20 bp, Homo sapiens
ccgcatgtgtgcctggccgc

SEQ ID NO: 3625835 - DNA, 14 bp, Homo sapiens
ccgccacagccttc

SEQ ID NO: 3625836 - DNA, 15 bp, Homo sapiens
ccgccagggctgggg

SEQ ID NO: 3625837 - DNA, 16 bp, Homo sapiens
ccgccagggctgggga

SEQ ID NO: 3625838 - DNA, 13 bp, Homo sapiens
ccgcccactcctg

SEQ ID NO: 3625839 - DNA, 12 bp, Homo sapiens
ccgccccagagc

SEQ ID NO: 3625840 - DNA, 14 bp, Homo sapiens
ccgccccagagctc

SEQ ID NO: 3625841 - DNA, 15 bp, Homo sapiens
ccgccccagagctcc

SEQ ID NO: 3625842 - DNA, 13 bp, Homo sapiens
ccgcccggggagt

SEQ ID NO: 3625843 - DNA, 20 bp, Homo sapiens
ccgcccttccatgtgccttt

SEQ ID NO: 3625844 - DNA, 14 bp, Homo sapiens
ccgccgccgccgcc

SEQ ID NO: 3625845 - DNA, 14 bp, Homo sapiens
ccgcctccctctca

SEQ ID NO: 3625846 - DNA, 12 bp, Homo sapiens
ccgcctcttccc

SEQ ID NO: 3625847 - DNA, 11 bp, Homo sapiens
ccgcctgtggg

SEQ ID NO: 3625848 - DNA, 14 bp, Homo sapiens
ccgcctgtgggcgc

SEQ ID NO: 3625849 - DNA, 23 bp, Homo sapiens
ccgcctttgcgctctcgggtcac

SEQ ID NO: 3625850 - DNA, 15 bp, Homo sapiens
ccgcgcagctgccta

SEQ ID NO: 3625851 - DNA, 18 bp, Homo sapiens
ccgcgccacccgggcaag

SEQ ID NO: 3625852 - DNA, 16 bp, Homo sapiens
ccgcgccaggccctca

SEQ ID NO: 3625853 - DNA, 17 bp, Homo sapiens
ccgcgcccagcagaggc

SEQ ID NO: 3625854 - DNA, 16 bp, Homo sapiens
ccgcgctcgcccagca

SEQ ID NO: 3625855 - DNA, 18 bp, Homo sapiens
ccgcgctcgcccagcagg

SEQ ID NO: 3625856 - DNA, 21 bp, Homo sapiens
ccgcggcggcttcgcgctgga

SEQ ID NO: 3625857 - DNA, 20 bp, Homo sapiens
ccgcgggagacagcttctct

SEQ ID NO: 3625858 - DNA, 17 bp, Homo sapiens
ccgcgtcgccctcccag

SEQ ID NO: 3625859 - DNA, 15 bp, Homo sapiens
ccgctcagccctccc

SEQ ID NO: 3625860 - DNA, 16 bp, Homo sapiens
ccgctcccacacccct

SEQ ID NO: 3625861 - DNA, 13 bp, Homo sapiens
ccgctcccacagc

SEQ ID NO: 3625862 - DNA, 14 bp, Homo sapiens
ccgctcccacagct

SEQ ID NO: 3625863 - DNA, 15 bp, Homo sapiens
ccgctcccacagctt

SEQ ID NO: 3625864 - DNA, 15 bp, Homo sapiens
ccgctcccgctccca

SEQ ID NO: 3625865 - DNA, 13 bp, Homo sapiens
ccgctctctctga

SEQ ID NO: 3625866 - DNA, 13 bp, Homo sapiens
ccgctgaggggtc

SEQ ID NO: 3625867 - DNA, 15 bp, Homo sapiens
ccgctgccacccacc

SEQ ID NO: 3625868 - DNA, 15 bp, Homo sapiens
ccgctggccctgccg

SEQ ID NO: 3625869 - DNA, 18 bp, Homo sapiens
ccgctggctggtgggccc

SEQ ID NO: 3625870 - DNA, 12 bp, Homo sapiens
ccgctgtctctg

SEQ ID NO: 3625871 - DNA, 13 bp, Homo sapiens
ccgcttctgaagc

SEQ ID NO: 3625872 - DNA, 21 bp, Homo sapiens
ccggaaggaggccaaccagcc

SEQ ID NO: 3625873 - DNA, 22 bp, Homo sapiens
ccggagatagatgactttgcag

SEQ ID NO: 3625874 - DNA, 23 bp, Homo sapiens
ccggagatagatgactttgcaga

SEQ ID NO: 3625875 - DNA, 15 bp, Homo sapiens
ccggagcgccctgca

SEQ ID NO: 3625876 - DNA, 17 bp, Homo sapiens
ccggagcgccctgcagg

SEQ ID NO: 3625877 - DNA, 12 bp, Homo sapiens
ccggagggccct

SEQ ID NO: 3625878 - DNA, 15 bp, Homo sapiens
ccggaggggcctggc

SEQ ID NO: 3625879 - DNA, 16 bp, Homo sapiens
ccggaggggcctggca

SEQ ID NO: 3625880 - DNA, 21 bp, Homo sapiens
ccggaggggcctggcagccgt

SEQ ID NO: 3625881 - DNA, 17 bp, Homo sapiens
ccggagtccactcccag

SEQ ID NO: 3625882 - DNA, 16 bp, Homo sapiens
ccggatctgagggaga

SEQ ID NO: 3625883 - DNA, 18 bp, Homo sapiens
ccggcaagcgagcacagt

SEQ ID NO: 3625884 - DNA, 19 bp, Homo sapiens
ccggccgccccgccccaga

SEQ ID NO: 3625885 - DNA, 20 bp, Homo sapiens
ccggccgccccgccccagag

SEQ ID NO: 3625886 - DNA, 22 bp, Homo sapiens
ccggccgccccgccccagagct

SEQ ID NO: 3625887 - DNA, 23 bp, Homo sapiens
ccggccgccccgccccagagctc

SEQ ID NO: 3625888 - DNA, 19 bp, Homo sapiens
ccggcgggtgacagctccg

SEQ ID NO: 3625889 - DNA, 16 bp, Homo sapiens
ccggctcgtgtattta

SEQ ID NO: 3625890 - DNA, 18 bp, Homo sapiens
ccggctcgtgtatttatt

SEQ ID NO: 3625891 - DNA, 22 bp, Homo sapiens
ccggctcgtgtatttattaccg

SEQ ID NO: 3625892 - DNA, 23 bp, Homo sapiens
ccggctctgggcctgagggtcca

SEQ ID NO: 3625893 - DNA, 16 bp, Homo sapiens
ccggctgagtggcagc

SEQ ID NO: 3625894 - DNA, 19 bp, Homo sapiens
ccgggaggaaaaggcccct

SEQ ID NO: 3625895 - DNA, 12 bp, Homo sapiens
ccgggctggaga

SEQ ID NO: 3625896 - DNA, 16 bp, Homo sapiens
ccgggctggagaaaga

SEQ ID NO: 3625897 - DNA, 19 bp, Homo sapiens
ccggggagaaacccagaga

SEQ ID NO: 3625898 - DNA, 15 bp, Homo sapiens
ccgggggagcccagt

SEQ ID NO: 3625899 - DNA, 13 bp, Homo sapiens
ccgggggccccac

SEQ ID NO: 3625900 - DNA, 16 bp, Homo sapiens
ccgggggccccacctc

SEQ ID NO: 3625901 - DNA, 19 bp, Homo sapiens
ccggggtgtaacttcctgc

SEQ ID NO: 3625902 - DNA, 22 bp, Homo sapiens
ccggggtgtaacttcctgctgc

SEQ ID NO: 3625903 - DNA, 14 bp, Homo sapiens
ccgggtgggcggca

SEQ ID NO: 3625904 - DNA, 20 bp, Homo sapiens
ccgggtgggcggcacagcct

SEQ ID NO: 3625905 - DNA, 18 bp, Homo sapiens
ccggtaactgtcctgtcc

SEQ ID NO: 3625906 - DNA, 19 bp, Homo sapiens
ccggtaactgtcctgtcct

SEQ ID NO: 3625907 - DNA, 20 bp, Homo sapiens
ccggtcagaggagcgcaggc

SEQ ID NO: 3625908 - DNA, 20 bp, Homo sapiens
ccggtcgggcagccagcaga

SEQ ID NO: 3625909 - DNA, 15 bp, Homo sapiens
ccggtgctgcaggag

SEQ ID NO: 3625910 - DNA, 16 bp, Homo sapiens
ccggtgtatcctggcc

SEQ ID NO: 3625911 - DNA, 23 bp, Homo sapiens
ccgtaaatgtctgcactgaggat

SEQ ID NO: 3625912 - DNA, 12 bp, Homo sapiens
ccgtaaggctgt

SEQ ID NO: 3625913 - DNA, 17 bp, Homo sapiens
ccgtaaggctgtacata

SEQ ID NO: 3625914 - DNA, 17 bp, Homo sapiens
ccgtacaaactcagatc

SEQ ID NO: 3625915 - DNA, 14 bp, Homo sapiens
ccgtagctctgctg

SEQ ID NO: 3625916 - DNA, 20 bp, Homo sapiens
ccgtatgaagacagaggcag

SEQ ID NO: 3625917 - DNA, 13 bp, Homo sapiens
ccgtcacagcctc

SEQ ID NO: 3625918 - DNA, 20 bp, Homo sapiens
ccgtcacccactctgcactg

SEQ ID NO: 3625919 - DNA, 16 bp, Homo sapiens
ccgtccaggagcctgg

SEQ ID NO: 3625920 - DNA, 17 bp, Homo sapiens
ccgtccaggccccaccg

SEQ ID NO: 3625921 - DNA, 21 bp, Homo sapiens
ccgtccaggggagatggggag

SEQ ID NO: 3625922 - DNA, 19 bp, Homo sapiens
ccgtcggactgcccccaga

SEQ ID NO: 3625923 - DNA, 12 bp, Homo sapiens
ccgtctctgccc

SEQ ID NO: 3625924 - DNA, 15 bp, Homo sapiens
ccgtctctgccctgg

SEQ ID NO: 3625925 - DNA, 22 bp, Homo sapiens
ccgtctctgccctgggctcctc

SEQ ID NO: 3625926 - DNA, 16 bp, Homo sapiens
ccgtctggcccaccag

SEQ ID NO: 3625927 - DNA, 16 bp, Homo sapiens
ccgtgaactctggtgc

SEQ ID NO: 3625928 - DNA, 18 bp, Homo sapiens
ccgtgccccttccctggg

SEQ ID NO: 3625929 - DNA, 19 bp, Homo sapiens
ccgtgctgacagctgctcc

SEQ ID NO: 3625930 - DNA, 15 bp, Homo sapiens
ccgtggcacagctgg

SEQ ID NO: 3625931 - DNA, 16 bp, Homo sapiens
ccgtggcagcttgctg

SEQ ID NO: 3625932 - DNA, 22 bp, Homo sapiens
ccgtggcagcttgctgggcttt

SEQ ID NO: 3625933 - DNA, 22 bp, Homo sapiens
ccgtggcctcgtgctccgcagg

SEQ ID NO: 3625934 - DNA, 21 bp, Homo sapiens
ccgtggcttcccgctcagccc

SEQ ID NO: 3625935 - DNA, 23 bp, Homo sapiens
ccgtggcttcccgctcagccctc

SEQ ID NO: 3625936 - DNA, 14 bp, Homo sapiens
ccgtggcttgggga

SEQ ID NO: 3625937 - DNA, 14 bp, Homo sapiens
ccgtttagaaaaaa

SEQ ID NO: 3625938 - DNA, 23 bp, Homo sapiens
ccgtttcatttagtcatgtgacc

SEQ ID NO: 3625939 - DNA, 13 bp, Homo sapiens
ccgtttctccttt

SEQ ID NO: 3625940 - DNA, 17 bp, Homo sapiens
ccgtttctccttttcct

SEQ ID NO: 3625941 - DNA, 14 bp, Homo sapiens
ccgttttgtcactt

SEQ ID NO: 3625942 - DNA, 16 bp, Homo sapiens
cctaaaccaaaaactg

SEQ ID NO: 3625943 - DNA, 15 bp, Homo sapiens
cctaaactgcagcct

SEQ ID NO: 3625944 - DNA, 20 bp, Homo sapiens
cctaaactgcagcctctctg

SEQ ID NO: 3625945 - DNA, 14 bp, Homo sapiens
cctaaagaacaaag

SEQ ID NO: 3625946 - DNA, 15 bp, Homo sapiens
cctaaagaacaaagt

SEQ ID NO: 3625947 - DNA, 13 bp, Homo sapiens
cctaaagagcatc

SEQ ID NO: 3625948 - DNA, 13 bp, Homo sapiens
cctaaagccaggc

SEQ ID NO: 3625949 - DNA, 13 bp, Homo sapiens
cctaaagcctcaa

SEQ ID NO: 3625950 - DNA, 16 bp, Homo sapiens
cctaaagggcagggcc

SEQ ID NO: 3625951 - DNA, 22 bp, Homo sapiens
cctaacaacattgtagcctcaa

SEQ ID NO: 3625952 - DNA, 14 bp, Homo sapiens
cctaacctgggacc

SEQ ID NO: 3625953 - DNA, 24 bp, Homo sapiens
cctaagaagaaggccagagaggga

SEQ ID NO: 3625954 - DNA, 15 bp, Homo sapiens
cctaagaccctgaat

SEQ ID NO: 3625955 - DNA, 13 bp, Homo sapiens
cctaagcccccag

SEQ ID NO: 3625956 - DNA, 16 bp, Homo sapiens
cctaagcccccagggc

SEQ ID NO: 3625957 - DNA, 22 bp, Homo sapiens
cctaagcccccagggcctccag

SEQ ID NO: 3625958 - DNA, 23 bp, Homo sapiens
cctaagcccccagggcctccagg

SEQ ID NO: 3625959 - DNA, 12 bp, Homo sapiens
cctaaggcccat

SEQ ID NO: 3625960 - DNA, 22 bp, Homo sapiens
cctaaggctgcaaggtttaggc

SEQ ID NO: 3625961 - DNA, 19 bp, Homo sapiens
cctaatcaaattctgtctg

SEQ ID NO: 3625962 - DNA, 18 bp, Homo sapiens
cctaattaaaaactgtga

SEQ ID NO: 3625963 - DNA, 17 bp, Homo sapiens
cctaattctatgcctgt

SEQ ID NO: 3625964 - DNA, 15 bp, Homo sapiens
cctaattgtgcccct

SEQ ID NO: 3625965 - DNA, 15 bp, Homo sapiens
cctacactgatgcaa

SEQ ID NO: 3625966 - DNA, 21 bp, Homo sapiens
cctacactgatgcaaggatta

SEQ ID NO: 3625967 - DNA, 12 bp, Homo sapiens
cctacagacagc

SEQ ID NO: 3625968 - DNA, 21 bp, Homo sapiens
cctacagactccatctcttct

SEQ ID NO: 3625969 - DNA, 15 bp, Homo sapiens
cctacagtatataag

SEQ ID NO: 3625970 - DNA, 20 bp, Homo sapiens
cctaccacccggtccccact

SEQ ID NO: 3625971 - DNA, 19 bp, Homo sapiens
cctacccatccccgcagtg

SEQ ID NO: 3625972 - DNA, 13 bp, Homo sapiens
cctaccctcccac

SEQ ID NO: 3625973 - DNA, 14 bp, Homo sapiens
cctaccctggcagg

SEQ ID NO: 3625974 - DNA, 19 bp, Homo sapiens
cctaccgagtctcttctcc

SEQ ID NO: 3625975 - DNA, 20 bp, Homo sapiens
cctaccgagtctcttctcca

SEQ ID NO: 3625976 - DNA, 21 bp, Homo sapiens
cctaccgagtctcttctccac

SEQ ID NO: 3625977 - DNA, 23 bp, Homo sapiens
cctaccgagtctcttctccactg

SEQ ID NO: 3625978 - DNA, 16 bp, Homo sapiens
cctaccgctggccctg

SEQ ID NO: 3625979 - DNA, 22 bp, Homo sapiens
cctaccgctggccctgccgttt

SEQ ID NO: 3625980 - DNA, 13 bp, Homo sapiens
cctacctctgtct

SEQ ID NO: 3625981 - DNA, 14 bp, Homo sapiens
cctacctctgtctg

SEQ ID NO: 3625982 - DNA, 12 bp, Homo sapiens
cctacctgcctt

SEQ ID NO: 3625983 - DNA, 12 bp, Homo sapiens
cctactattggc

SEQ ID NO: 3625984 - DNA, 13 bp, Homo sapiens
cctacttcctgtg

SEQ ID NO: 3625985 - DNA, 15 bp, Homo sapiens
cctacttcctgtgac

SEQ ID NO: 3625986 - DNA, 16 bp, Homo sapiens
cctacttcttttgctc

SEQ ID NO: 3625987 - DNA, 22 bp, Homo sapiens
cctacttcttttgctcttagct

SEQ ID NO: 3625988 - DNA, 15 bp, Homo sapiens
cctagactgctcctg

SEQ ID NO: 3625989 - DNA, 17 bp, Homo sapiens
cctagactgctcctggg

SEQ ID NO: 3625990 - DNA, 13 bp, Homo sapiens
cctagagggaggg

SEQ ID NO: 3625991 - DNA, 20 bp, Homo sapiens
cctagatgcacgtggggccc

SEQ ID NO: 3625992 - DNA, 21 bp, Homo sapiens
cctagatgcacgtggggccca

SEQ ID NO: 3625993 - DNA, 14 bp, Homo sapiens
cctagccctgctcc

SEQ ID NO: 3625994 - DNA, 20 bp, Homo sapiens
cctagcctgtgcctctggga

SEQ ID NO: 3625995 - DNA, 15 bp, Homo sapiens
cctagcggagcccag

SEQ ID NO: 3625996 - DNA, 19 bp, Homo sapiens
cctagcggagcccagcctg

SEQ ID NO: 3625997 - DNA, 17 bp, Homo sapiens
cctagctaggagcaggc

SEQ ID NO: 3625998 - DNA, 15 bp, Homo sapiens
cctagctcctgccac

SEQ ID NO: 3625999 - DNA, 22 bp, Homo sapiens
cctagctcctgccacatggagc

SEQ ID NO: 3626000 - DNA, 14 bp, Homo sapiens
cctagctgaccccg

SEQ ID NO: 3626001 - DNA, 19 bp, Homo sapiens
cctaggcctcagccagaga

SEQ ID NO: 3626002 - DNA, 20 bp, Homo sapiens
cctaggcctcagccagagaa

SEQ ID NO: 3626003 - DNA, 15 bp, Homo sapiens
cctaggctccacccc

SEQ ID NO: 3626004 - DNA, 18 bp, Homo sapiens
cctaggctccaccccatc

SEQ ID NO: 3626005 - DNA, 17 bp, Homo sapiens
cctaggtgcccagggcc

SEQ ID NO: 3626006 - DNA, 21 bp, Homo sapiens
cctagtggagttttataaatt

SEQ ID NO: 3626007 - DNA, 22 bp, Homo sapiens
cctagtggagttttataaatta

SEQ ID NO: 3626008 - DNA, 15 bp, Homo sapiens
cctagttcaggtcca

SEQ ID NO: 3626009 - DNA, 16 bp, Homo sapiens
cctagttcaggtccaa

SEQ ID NO: 3626010 - DNA, 14 bp, Homo sapiens
cctatctcagccat

SEQ ID NO: 3626011 - DNA, 13 bp, Homo sapiens
cctatctccctgg

SEQ ID NO: 3626012 - DNA, 16 bp, Homo sapiens
cctatctccctggctc

SEQ ID NO: 3626013 - DNA, 15 bp, Homo sapiens
cctatctgcctggag

SEQ ID NO: 3626014 - DNA, 16 bp, Homo sapiens
cctatgatactgtctc

SEQ ID NO: 3626015 - DNA, 18 bp, Homo sapiens
cctatgatactgtctctc

SEQ ID NO: 3626016 - DNA, 17 bp, Homo sapiens
cctatgtatatcttcta

SEQ ID NO: 3626017 - DNA, 17 bp, Homo sapiens
cctattatctgtcagct

SEQ ID NO: 3626018 - DNA, 20 bp, Homo sapiens
cctattctgaaaaagacata

SEQ ID NO: 3626019 - DNA, 15 bp, Homo sapiens
cctatttcttgataa

SEQ ID NO: 3626020 - DNA, 14 bp, Homo sapiens
cctatttttccttt

SEQ ID NO: 3626021 - DNA, 18 bp, Homo sapiens
cctcaaactgcacatcta

SEQ ID NO: 3626022 - DNA, 15 bp, Homo sapiens
cctcaacctcctggg

SEQ ID NO: 3626023 - DNA, 16 bp, Homo sapiens
cctcaacctcctgggt

SEQ ID NO: 3626024 - DNA, 14 bp, Homo sapiens
cctcacacccctgt

SEQ ID NO: 3626025 - DNA, 21 bp, Homo sapiens
cctcacacccctgtcccaccc

SEQ ID NO: 3626026 - DNA, 15 bp, Homo sapiens
cctcacactttgcca

SEQ ID NO: 3626027 - DNA, 16 bp, Homo sapiens
cctcactccccaggga

SEQ ID NO: 3626028 - DNA, 18 bp, Homo sapiens
cctcactctgtccctgtc

SEQ ID NO: 3626029 - DNA, 12 bp, Homo sapiens
cctcactggcct

SEQ ID NO: 3626030 - DNA, 14 bp, Homo sapiens
cctcactggcctgc

SEQ ID NO: 3626031 - DNA, 19 bp, Homo sapiens
cctcagaaggccccagaga

SEQ ID NO: 3626032 - DNA, 13 bp, Homo sapiens
cctcagattcttc

SEQ ID NO: 3626033 - DNA, 15 bp, Homo sapiens
cctcagccagagaag

SEQ ID NO: 3626034 - DNA, 15 bp, Homo sapiens
cctcagcctcctgag

SEQ ID NO: 3626035 - DNA, 21 bp, Homo sapiens
cctcagcctgctttcctgcag

SEQ ID NO: 3626036 - DNA, 18 bp, Homo sapiens
cctcagcctggccagaca

SEQ ID NO: 3626037 - DNA, 17 bp, Homo sapiens
cctcagccttgccagag

SEQ ID NO: 3626038 - DNA, 14 bp, Homo sapiens
cctcagccttggga

SEQ ID NO: 3626039 - DNA, 17 bp, Homo sapiens
cctcagctccctgcctg

SEQ ID NO: 3626040 - DNA, 20 bp, Homo sapiens
cctcagctccctgcctgttt

SEQ ID NO: 3626041 - DNA, 21 bp, Homo sapiens
cctcagctccctgcctgtttc

SEQ ID NO: 3626042 - DNA, 14 bp, Homo sapiens
cctcagctgcctcc

SEQ ID NO: 3626043 - DNA, 13 bp, Homo sapiens
cctcaggaccagg

SEQ ID NO: 3626044 - DNA, 18 bp, Homo sapiens
cctcaggacccatccctg

SEQ ID NO: 3626045 - DNA, 22 bp, Homo sapiens
cctcaggagccgaagcccaggg

SEQ ID NO: 3626046 - DNA, 19 bp, Homo sapiens
cctcaggaggcaggacctt

SEQ ID NO: 3626047 - DNA, 11 bp, Homo sapiens
cctcaggcaca

SEQ ID NO: 3626048 - DNA, 14 bp, Homo sapiens
cctcaggcacacct

SEQ ID NO: 3626049 - DNA, 18 bp, Homo sapiens
cctcaggcacaccttgca

SEQ ID NO: 3626050 - DNA, 19 bp, Homo sapiens
cctcaggccaagggaccag

SEQ ID NO: 3626051 - DNA, 18 bp, Homo sapiens
cctcaggccaccctccac

SEQ ID NO: 3626052 - DNA, 16 bp, Homo sapiens
cctcaggctcctaaag

SEQ ID NO: 3626053 - DNA, 18 bp, Homo sapiens
cctcaggctcctaaagag

SEQ ID NO: 3626054 - DNA, 21 bp, Homo sapiens
cctcaggctcctaaagagaca

SEQ ID NO: 3626055 - DNA, 13 bp, Homo sapiens
cctcaggctctgc

SEQ ID NO: 3626056 - DNA, 14 bp, Homo sapiens
cctcaggctctgca

SEQ ID NO: 3626057 - DNA, 19 bp, Homo sapiens
cctcaggctctgcacagac

SEQ ID NO: 3626058 - DNA, 20 bp, Homo sapiens
cctcagttgaaaatgcaact

SEQ ID NO: 3626059 - DNA, 17 bp, Homo sapiens
cctcatcagccttggga

SEQ ID NO: 3626060 - DNA, 24 bp, Homo sapiens
cctcatctgagaggctctccgtgc

SEQ ID NO: 3626061 - DNA, 20 bp, Homo sapiens
cctcatctgggggagtggaa

SEQ ID NO: 3626062 - DNA, 19 bp, Homo sapiens
cctcatgccaaccctgggc

SEQ ID NO: 3626063 - DNA, 21 bp, Homo sapiens
cctcatgccaaccctgggcta

SEQ ID NO: 3626064 - DNA, 21 bp, Homo sapiens
cctcattccaccttcccatgc

SEQ ID NO: 3626065 - DNA, 23 bp, Homo sapiens
cctcattctggttccctgctgcg

SEQ ID NO: 3626066 - DNA, 18 bp, Homo sapiens
cctcattttgggggtcat

SEQ ID NO: 3626067 - DNA, 21 bp, Homo sapiens
cctccaaaaatggcagtgact

SEQ ID NO: 3626068 - DNA, 20 bp, Homo sapiens
cctccaaacctccagcctcc

SEQ ID NO: 3626069 - DNA, 14 bp, Homo sapiens
cctccaaaggaact

SEQ ID NO: 3626070 - DNA, 16 bp, Homo sapiens
cctccaacgcccctgt

SEQ ID NO: 3626071 - DNA, 19 bp, Homo sapiens
cctccaacgcccctgtggc

SEQ ID NO: 3626072 - DNA, 20 bp, Homo sapiens
cctccaacgcccctgtggcc

SEQ ID NO: 3626073 - DNA, 22 bp, Homo sapiens
cctccaagggtttcgactggtc

SEQ ID NO: 3626074 - DNA, 12 bp, Homo sapiens
cctccacagaga

SEQ ID NO: 3626075 - DNA, 14 bp, Homo sapiens
cctccaccagcaag

SEQ ID NO: 3626076 - DNA, 13 bp, Homo sapiens
cctccaccatgca

SEQ ID NO: 3626077 - DNA, 12 bp, Homo sapiens
cctccacctcaa

SEQ ID NO: 3626078 - DNA, 10 bp, Homo sapiens
cctccagact

SEQ ID NO: 3626079 - DNA, 13 bp, Homo sapiens
cctccagactcag

SEQ ID NO: 3626080 - DNA, 14 bp, Homo sapiens
cctccagactcagc

SEQ ID NO: 3626081 - DNA, 17 bp, Homo sapiens
cctccagactcagcaga

SEQ ID NO: 3626082 - DNA, 13 bp, Homo sapiens
cctccagcaggga

SEQ ID NO: 3626083 - DNA, 11 bp, Homo sapiens
cctccagcctc

SEQ ID NO: 3626084 - DNA, 13 bp, Homo sapiens
cctccagcctccc

SEQ ID NO: 3626085 - DNA, 15 bp, Homo sapiens
cctccagcctccctg

SEQ ID NO: 3626086 - DNA, 21 bp, Homo sapiens
cctccagcctccctgtctcca

SEQ ID NO: 3626087 - DNA, 14 bp, Homo sapiens
cctccagctgggat

SEQ ID NO: 3626088 - DNA, 15 bp, Homo sapiens
cctccaggaaccaca

SEQ ID NO: 3626089 - DNA, 18 bp, Homo sapiens
cctccaggagagagccag

SEQ ID NO: 3626090 - DNA, 19 bp, Homo sapiens
cctccaggagagagccagg

SEQ ID NO: 3626091 - DNA, 14 bp, Homo sapiens
cctccagggcccag

SEQ ID NO: 3626092 - DNA, 20 bp, Homo sapiens
cctccaggtcggagtgcctg

SEQ ID NO: 3626093 - DNA, 22 bp, Homo sapiens
cctccaggtcggagtgcctgga

SEQ ID NO: 3626094 - DNA, 18 bp, Homo sapiens
cctccaggtttttcaatt

SEQ ID NO: 3626095 - DNA, 22 bp, Homo sapiens
cctccagtattgccccctctca

SEQ ID NO: 3626096 - DNA, 19 bp, Homo sapiens
cctccagttttgcctgaga

SEQ ID NO: 3626097 - DNA, 15 bp, Homo sapiens
cctccatctttctac

SEQ ID NO: 3626098 - DNA, 16 bp, Homo sapiens
cctccatctttctaca

SEQ ID NO: 3626099 - DNA, 16 bp, Homo sapiens
cctcccaaagtgctgg

SEQ ID NO: 3626100 - DNA, 12 bp, Homo sapiens
cctcccaactct

SEQ ID NO: 3626101 - DNA, 13 bp, Homo sapiens
cctcccacccacc

SEQ ID NO: 3626102 - DNA, 19 bp, Homo sapiens
cctcccacgcctcaccagc

SEQ ID NO: 3626103 - DNA, 15 bp, Homo sapiens
cctcccactgcccac

SEQ ID NO: 3626104 - DNA, 23 bp, Homo sapiens
cctcccactgcccactggccggc

SEQ ID NO: 3626105 - DNA, 14 bp, Homo sapiens
cctcccagacaggc

SEQ ID NO: 3626106 - DNA, 20 bp, Homo sapiens
cctcccagacaggccctccc

SEQ ID NO: 3626107 - DNA, 23 bp, Homo sapiens
cctcccagacaggccctccctgt

SEQ ID NO: 3626108 - DNA, 15 bp, Homo sapiens
cctcccaggctctca

SEQ ID NO: 3626109 - DNA, 23 bp, Homo sapiens
cctccccagccagcccttccctg

SEQ ID NO: 3626110 - DNA, 12 bp, Homo sapiens
cctccccagctc

SEQ ID NO: 3626111 - DNA, 19 bp, Homo sapiens
cctccccatgggcacagtg

SEQ ID NO: 3626112 - DNA, 12 bp, Homo sapiens
cctccccctgca

SEQ ID NO: 3626113 - DNA, 14 bp, Homo sapiens
cctccccctgcaac

SEQ ID NO: 3626114 - DNA, 14 bp, Homo sapiens
cctccccctgtccc

SEQ ID NO: 3626115 - DNA, 19 bp, Homo sapiens
cctccccgaagacactcct

SEQ ID NO: 3626116 - DNA, 15 bp, Homo sapiens
cctccccgcaccccc

SEQ ID NO: 3626117 - DNA, 21 bp, Homo sapiens
cctccccgcaccccccaagct

SEQ ID NO: 3626118 - DNA, 15 bp, Homo sapiens
cctccccgcccctgt

SEQ ID NO: 3626119 - DNA, 15 bp, Homo sapiens
cctccccgctgggaa

SEQ ID NO: 3626120 - DNA, 15 bp, Homo sapiens
cctcccgaaaaatgt

SEQ ID NO: 3626121 - DNA, 19 bp, Homo sapiens
cctcccgccccgcccctcc

SEQ ID NO: 3626122 - DNA, 16 bp, Homo sapiens
cctcccggtgcccaag

SEQ ID NO: 3626123 - DNA, 13 bp, Homo sapiens
cctccctgcccct

SEQ ID NO: 3626124 - DNA, 22 bp, Homo sapiens
cctccctgcccctcccttcaac

SEQ ID NO: 3626125 - DNA, 12 bp, Homo sapiens
cctccctgcctc

SEQ ID NO: 3626126 - DNA, 17 bp, Homo sapiens
cctccctgcctgctcct

SEQ ID NO: 3626127 - DNA, 16 bp, Homo sapiens
cctccctgtctccagc

SEQ ID NO: 3626128 - DNA, 21 bp, Homo sapiens
cctccctgtctccagctgcct

SEQ ID NO: 3626129 - DNA, 18 bp, Homo sapiens
cctccctgtctccagggc

SEQ ID NO: 3626130 - DNA, 10 bp, Homo sapiens
cctcccttct

SEQ ID NO: 3626131 - DNA, 13 bp, Homo sapiens
cctcccttctgct

SEQ ID NO: 3626132 - DNA, 17 bp, Homo sapiens
cctcccttctgctactg

SEQ ID NO: 3626133 - DNA, 14 bp, Homo sapiens
cctccgtagggtct

SEQ ID NO: 3626134 - DNA, 18 bp, Homo sapiens
cctccgtagggtctttct

SEQ ID NO: 3626135 - DNA, 21 bp, Homo sapiens
cctccgtagggtctttcttgg

SEQ ID NO: 3626136 - DNA, 23 bp, Homo sapiens
cctccgtagggtctttcttggga

SEQ ID NO: 3626137 - DNA, 18 bp, Homo sapiens
cctccgtccaggagcctg

SEQ ID NO: 3626138 - DNA, 19 bp, Homo sapiens
cctcctatctccctggctc

SEQ ID NO: 3626139 - DNA, 13 bp, Homo sapiens
cctcctcaccccc

SEQ ID NO: 3626140 - DNA, 16 bp, Homo sapiens
cctcctcagctccctg

SEQ ID NO: 3626141 - DNA, 17 bp, Homo sapiens
cctcctccctgcatctg

SEQ ID NO: 3626142 - DNA, 18 bp, Homo sapiens
cctcctcggagagcagca

SEQ ID NO: 3626143 - DNA, 21 bp, Homo sapiens
cctcctcggagagcagcagca

SEQ ID NO: 3626144 - DNA, 14 bp, Homo sapiens
cctcctctgctggg

SEQ ID NO: 3626145 - DNA, 16 bp, Homo sapiens
cctcctgagtgcccca

SEQ ID NO: 3626146 - DNA, 14 bp, Homo sapiens
cctcctgcacacag

SEQ ID NO: 3626147 - DNA, 19 bp, Homo sapiens
cctcctgcacacagggcag

SEQ ID NO: 3626148 - DNA, 19 bp, Homo sapiens
cctcctgccccctgccagt

SEQ ID NO: 3626149 - DNA, 17 bp, Homo sapiens
cctcctgggttcaagca

SEQ ID NO: 3626150 - DNA, 17 bp, Homo sapiens
cctcctgtacctcagtg

SEQ ID NO: 3626151 - DNA, 21 bp, Homo sapiens
cctccttggctttatgcaaat

SEQ ID NO: 3626152 - DNA, 17 bp, Homo sapiens
cctccttttcttcaccc

SEQ ID NO: 3626153 - DNA, 13 bp, Homo sapiens
cctcgcacacact

SEQ ID NO: 3626154 - DNA, 15 bp, Homo sapiens
cctcggagagcagca

SEQ ID NO: 3626155 - DNA, 17 bp, Homo sapiens
cctcggagagcagcagc

SEQ ID NO: 3626156 - DNA, 18 bp, Homo sapiens
cctcggagagcagcagca

SEQ ID NO: 3626157 - DNA, 16 bp, Homo sapiens
cctcggagggatggag

SEQ ID NO: 3626158 - DNA, 17 bp, Homo sapiens
cctcggcacacactgtg

SEQ ID NO: 3626159 - DNA, 15 bp, Homo sapiens
cctcggtatctggct

SEQ ID NO: 3626160 - DNA, 15 bp, Homo sapiens
cctcgtgaggggcaa

SEQ ID NO: 3626161 - DNA, 16 bp, Homo sapiens
cctcgtgggtcccaga

SEQ ID NO: 3626162 - DNA, 15 bp, Homo sapiens
cctctaagtgctgct

SEQ ID NO: 3626163 - DNA, 18 bp, Homo sapiens
cctctaagtgctgctgtg

SEQ ID NO: 3626164 - DNA, 19 bp, Homo sapiens
cctctaagtgctgctgtgg

SEQ ID NO: 3626165 - DNA, 15 bp, Homo sapiens
cctctaggccctgtg

SEQ ID NO: 3626166 - DNA, 17 bp, Homo sapiens
cctctaggccctgtgag

SEQ ID NO: 3626167 - DNA, 15 bp, Homo sapiens
cctctcaggctgggc

SEQ ID NO: 3626168 - DNA, 17 bp, Homo sapiens
cctctccaggcctgtca

SEQ ID NO: 3626169 - DNA, 21 bp, Homo sapiens
cctctccatacctgcccctgc

SEQ ID NO: 3626170 - DNA, 12 bp, Homo sapiens
cctctcccaggg

SEQ ID NO: 3626171 - DNA, 16 bp, Homo sapiens
cctctccccagcccag

SEQ ID NO: 3626172 - DNA, 18 bp, Homo sapiens
cctctccccagcccagag

SEQ ID NO: 3626173 - DNA, 19 bp, Homo sapiens
cctctccccagcccagaga

SEQ ID NO: 3626174 - DNA, 13 bp, Homo sapiens
cctctccctgggt

SEQ ID NO: 3626175 - DNA, 17 bp, Homo sapiens
cctctcctgccctgtga

SEQ ID NO: 3626176 - DNA, 19 bp, Homo sapiens
cctctcgccccatccctgc

SEQ ID NO: 3626177 - DNA, 21 bp, Homo sapiens
cctctcgccccatccctgctt

SEQ ID NO: 3626178 - DNA, 17 bp, Homo sapiens
cctctcggctgccaggg

SEQ ID NO: 3626179 - DNA, 21 bp, Homo sapiens
cctctcggctgccaggggctc

SEQ ID NO: 3626180 - DNA, 18 bp, Homo sapiens
cctctctccttggccaca

SEQ ID NO: 3626181 - DNA, 21 bp, Homo sapiens
cctctctccttggccacagac

SEQ ID NO: 3626182 - DNA, 23 bp, Homo sapiens
cctctctccttggccacagactg

SEQ ID NO: 3626183 - DNA, 17 bp, Homo sapiens
cctctctgagtcaaatc

SEQ ID NO: 3626184 - DNA, 23 bp, Homo sapiens
cctctctgagtcaaatccagtgg

SEQ ID NO: 3626185 - DNA, 24 bp, Homo sapiens
cctctctgagtcaaatccagtggt

SEQ ID NO: 3626186 - DNA, 10 bp, Homo sapiens
cctctctgct

SEQ ID NO: 3626187 - DNA, 19 bp, Homo sapiens
cctctctgtgtccctgctg

SEQ ID NO: 3626188 - DNA, 12 bp, Homo sapiens
cctctcttcccc

SEQ ID NO: 3626189 - DNA, 16 bp, Homo sapiens
cctctcttccccttcc

SEQ ID NO: 3626190 - DNA, 20 bp, Homo sapiens
cctctgaatgaaccttctgg

SEQ ID NO: 3626191 - DNA, 16 bp, Homo sapiens
cctctgcacccagaac

SEQ ID NO: 3626192 - DNA, 17 bp, Homo sapiens
cctctgcacccagaaca

SEQ ID NO: 3626193 - DNA, 15 bp, Homo sapiens
cctctgcacgctcaa

SEQ ID NO: 3626194 - DNA, 23 bp, Homo sapiens
cctctgcacgctcaatgcccagt

SEQ ID NO: 3626195 - DNA, 16 bp, Homo sapiens
cctctgcactcccacc

SEQ ID NO: 3626196 - DNA, 19 bp, Homo sapiens
cctctgccaaaggatgtga

SEQ ID NO: 3626197 - DNA, 19 bp, Homo sapiens
cctctgccccatcctccag

SEQ ID NO: 3626198 - DNA, 20 bp, Homo sapiens
cctctgccggtcgggcagcc

SEQ ID NO: 3626199 - DNA, 22 bp, Homo sapiens
cctctgccggtcgggcagccag

SEQ ID NO: 3626200 - DNA, 12 bp, Homo sapiens
cctctgcctgtc

SEQ ID NO: 3626201 - DNA, 10 bp, Homo sapiens
cctctgctgc

SEQ ID NO: 3626202 - DNA, 23 bp, Homo sapiens
cctctgctgccggctctgggcct

SEQ ID NO: 3626203 - DNA, 16 bp, Homo sapiens
cctctggactggaaag

SEQ ID NO: 3626204 - DNA, 11 bp, Homo sapiens
cctctggagaa

SEQ ID NO: 3626205 - DNA, 16 bp, Homo sapiens
cctctggagaaggcct

SEQ ID NO: 3626206 - DNA, 18 bp, Homo sapiens
cctctggagaaggcctgg

SEQ ID NO: 3626207 - DNA, 10 bp, Homo sapiens
cctctggctt

SEQ ID NO: 3626208 - DNA, 11 bp, Homo sapiens
cctctgggacc

SEQ ID NO: 3626209 - DNA, 21 bp, Homo sapiens
cctctgggggtcctctctgag

SEQ ID NO: 3626210 - DNA, 21 bp, Homo sapiens
cctctgggtccttggctcccg

SEQ ID NO: 3626211 - DNA, 18 bp, Homo sapiens
cctctggtgtgtggtgag

SEQ ID NO: 3626212 - DNA, 20 bp, Homo sapiens
cctctgtctgagacaggtgc

SEQ ID NO: 3626213 - DNA, 19 bp, Homo sapiens
cctcttaaagaaaacccac

SEQ ID NO: 3626214 - DNA, 21 bp, Homo sapiens
cctcttaaagaaaacccaccc

SEQ ID NO: 3626215 - DNA, 23 bp, Homo sapiens
cctcttaccagtatttaacttct

SEQ ID NO: 3626216 - DNA, 13 bp, Homo sapiens
cctcttagctcag

SEQ ID NO: 3626217 - DNA, 14 bp, Homo sapiens
cctcttctgctctt

SEQ ID NO: 3626218 - DNA, 17 bp, Homo sapiens
cctcttctgctcttttc

SEQ ID NO: 3626219 - DNA, 23 bp, Homo sapiens
cctcttctggagatggaagcttg

SEQ ID NO: 3626220 - DNA, 16 bp, Homo sapiens
cctcttctttgtgcct

SEQ ID NO: 3626221 - DNA, 17 bp, Homo sapiens
cctcttctttgtgcctt

SEQ ID NO: 3626222 - DNA, 23 bp, Homo sapiens
cctcttctttgtgcctttggcct

SEQ ID NO: 3626223 - DNA, 15 bp, Homo sapiens
cctcttgagttcctc

SEQ ID NO: 3626224 - DNA, 19 bp, Homo sapiens
cctcttgagttcctctgca

SEQ ID NO: 3626225 - DNA, 22 bp, Homo sapiens
cctcttggccatccttctgtgt

SEQ ID NO: 3626226 - DNA, 17 bp, Homo sapiens
cctcttgttcctgaaat

SEQ ID NO: 3626227 - DNA, 18 bp, Homo sapiens
cctcttgttcctgaaatg

SEQ ID NO: 3626228 - DNA, 22 bp, Homo sapiens
cctctttcatctgtaagggact

SEQ ID NO: 3626229 - DNA, 14 bp, Homo sapiens
cctctttccctgcg

SEQ ID NO: 3626230 - DNA, 13 bp, Homo sapiens
cctctttgctttg

SEQ ID NO: 3626231 - DNA, 15 bp, Homo sapiens
cctctttgctttgct

SEQ ID NO: 3626232 - DNA, 17 bp, Homo sapiens
cctctttgctttgcttt

SEQ ID NO: 3626233 - DNA, 17 bp, Homo sapiens
cctcttttcctggcagc

SEQ ID NO: 3626234 - DNA, 23 bp, Homo sapiens
cctcttttcctggcagctgctgt

SEQ ID NO: 3626235 - DNA, 15 bp, Homo sapiens
cctgaaacaacttgg

SEQ ID NO: 3626236 - DNA, 22 bp, Homo sapiens
cctgaaagagaggactggttct

SEQ ID NO: 3626237 - DNA, 16 bp, Homo sapiens
cctgaacaagaattgg

SEQ ID NO: 3626238 - DNA, 21 bp, Homo sapiens
cctgaacaagaattggaagct

SEQ ID NO: 3626239 - DNA, 19 bp, Homo sapiens
cctgaactttctccctcat

SEQ ID NO: 3626240 - DNA, 19 bp, Homo sapiens
cctgaagagaagggcaggg

SEQ ID NO: 3626241 - DNA, 13 bp, Homo sapiens
cctgaagagcatt

SEQ ID NO: 3626242 - DNA, 21 bp, Homo sapiens
cctgaagagtcctctgaatga

SEQ ID NO: 3626243 - DNA, 14 bp, Homo sapiens
cctgaagctgctgt

SEQ ID NO: 3626244 - DNA, 17 bp, Homo sapiens
cctgaagcttcggccgc

SEQ ID NO: 3626245 - DNA, 17 bp, Homo sapiens
cctgaaggggttttctt

SEQ ID NO: 3626246 - DNA, 20 bp, Homo sapiens
cctgaagtgacctcactggc

SEQ ID NO: 3626247 - DNA, 21 bp, Homo sapiens
cctgaattttgttgctgtttt

SEQ ID NO: 3626248 - DNA, 18 bp, Homo sapiens
cctgacacaccaggcgct

SEQ ID NO: 3626249 - DNA, 14 bp, Homo sapiens
cctgacaccccctc

SEQ ID NO: 3626250 - DNA, 18 bp, Homo sapiens
cctgacaccccctccccg

SEQ ID NO: 3626251 - DNA, 22 bp, Homo sapiens
cctgacagccttccccagctcc

SEQ ID NO: 3626252 - DNA, 16 bp, Homo sapiens
cctgacattggagcct

SEQ ID NO: 3626253 - DNA, 22 bp, Homo sapiens
cctgaccccgccatgcatgcag

SEQ ID NO: 3626254 - DNA, 17 bp, Homo sapiens
cctgacctccgcccctg

SEQ ID NO: 3626255 - DNA, 22 bp, Homo sapiens
tgtgcctttctttgcctctgca

SEQ ID NO: 3626256 - DNA, 15 bp, Homo sapiens
tgtgcgtcccagctg

SEQ ID NO: 3626257 - DNA, 14 bp, Homo sapiens
tgtgctaaatatca

SEQ ID NO: 3626258 - DNA, 16 bp, Homo sapiens
tgtgctccacactcag

SEQ ID NO: 3626259 - DNA, 15 bp, Homo sapiens
tgtgctctggcacca

SEQ ID NO: 3626260 - DNA, 18 bp, Homo sapiens
tgtgctggaattctaaca

SEQ ID NO: 3626261 - DNA, 22 bp, Homo sapiens
tgtgctgtgtgagtgagcacac

SEQ ID NO: 3626262 - DNA, 15 bp, Homo sapiens
tgtgctgtttcaaag

SEQ ID NO: 3626263 - DNA, 16 bp, Homo sapiens
tgtgcttctaatatta

SEQ ID NO: 3626264 - DNA, 13 bp, Homo sapiens
tgtgctttggaac

SEQ ID NO: 3626265 - DNA, 22 bp, Homo sapiens
tgtgctttttgtcatgttatgc

SEQ ID NO: 3626266 - DNA, 16 bp, Homo sapiens
tgtggaacataaaaag

SEQ ID NO: 3626267 - DNA, 19 bp, Homo sapiens
tgtggaacataaaaaggac

SEQ ID NO: 3626268 - DNA, 15 bp, Homo sapiens
tgtggacctggacaa

SEQ ID NO: 3626269 - DNA, 15 bp, Homo sapiens
tgtggagctgccaca

SEQ ID NO: 3626270 - DNA, 21 bp, Homo sapiens
tgtggagggagggcagctggc

SEQ ID NO: 3626271 - DNA, 14 bp, Homo sapiens
tgtggcagagttac

SEQ ID NO: 3626272 - DNA, 20 bp, Homo sapiens
tgtggcagggggccccgcca

SEQ ID NO: 3626273 - DNA, 20 bp, Homo sapiens
tgtggccaaggagctgctat

SEQ ID NO: 3626274 - DNA, 22 bp, Homo sapiens
tgtggccctggccactaaagct

SEQ ID NO: 3626275 - DNA, 11 bp, Homo sapiens
tgtggcctatg

SEQ ID NO: 3626276 - DNA, 15 bp, Homo sapiens
tgtggcctgcaggag

SEQ ID NO: 3626277 - DNA, 22 bp, Homo sapiens
tgtggcctgtgccagcaccaca

SEQ ID NO: 3626278 - DNA, 24 bp, Homo sapiens
tgtggcctgtgccagcaccacagc

SEQ ID NO: 3626279 - DNA, 14 bp, Homo sapiens
tgtggcctttatgt

SEQ ID NO: 3626280 - DNA, 21 bp, Homo sapiens
tgtggcctttatgttctttca

SEQ ID NO: 3626281 - DNA, 21 bp, Homo sapiens
tgtggctcctgggggttcttt

SEQ ID NO: 3626282 - DNA, 14 bp, Homo sapiens
tgtgggagtgtgta

SEQ ID NO: 3626283 - DNA, 18 bp, Homo sapiens
tgtgggcaaagtcctcct

SEQ ID NO: 3626284 - DNA, 19 bp, Homo sapiens
tgtggggaacacagctaca

SEQ ID NO: 3626285 - DNA, 23 bp, Homo sapiens
tgtggggccatgcctcctcagga

SEQ ID NO: 3626286 - DNA, 18 bp, Homo sapiens
tgtggggggctgggggag

SEQ ID NO: 3626287 - DNA, 14 bp, Homo sapiens
tgtggggttgctga

SEQ ID NO: 3626288 - DNA, 15 bp, Homo sapiens
tgtgggtacctgtat

SEQ ID NO: 3626289 - DNA, 16 bp, Homo sapiens
tgtgggtctgtgtgtg

SEQ ID NO: 3626290 - DNA, 20 bp, Homo sapiens
tgtgggtctgtgtgtgtgta

SEQ ID NO: 3626291 - DNA, 18 bp, Homo sapiens
tgtggtacaaggtggaga

SEQ ID NO: 3626292 - DNA, 15 bp, Homo sapiens
tgtggtcaacatttc

SEQ ID NO: 3626293 - DNA, 15 bp, Homo sapiens
tgtggtcatgtgagt

SEQ ID NO: 3626294 - DNA, 20 bp, Homo sapiens
tgtggtcatgtgagtctggg

SEQ ID NO: 3626295 - DNA, 12 bp, Homo sapiens
tgtggtgagggg

SEQ ID NO: 3626296 - DNA, 18 bp, Homo sapiens
tgtggtgaggggctttct

SEQ ID NO: 3626297 - DNA, 17 bp, Homo sapiens
tgtggtttcatgttagt

SEQ ID NO: 3626298 - DNA, 14 bp, Homo sapiens
tgtgtaacaggata

SEQ ID NO: 3626299 - DNA, 18 bp, Homo sapiens
tgtgtaatttaaaattgt

SEQ ID NO: 3626300 - DNA, 22 bp, Homo sapiens
tgtgtaatttaaaattgtgatg

SEQ ID NO: 3626301 - DNA, 17 bp, Homo sapiens
tgtgtacaatgtacaca

SEQ ID NO: 3626302 - DNA, 17 bp, Homo sapiens
tgtgtaccacttcctga

SEQ ID NO: 3626303 - DNA, 19 bp, Homo sapiens
tgtgtaccacttcctgagg

SEQ ID NO: 3626304 - DNA, 20 bp, Homo sapiens
tgtgtacttttcctttgcta

SEQ ID NO: 3626305 - DNA, 14 bp, Homo sapiens
tgtgtagctttgct

SEQ ID NO: 3626306 - DNA, 17 bp, Homo sapiens
tgtgtagctttgctctt

SEQ ID NO: 3626307 - DNA, 14 bp, Homo sapiens
tgtgtatgtggggg

SEQ ID NO: 3626308 - DNA, 23 bp, Homo sapiens
tgtgtatgtgggggtctgtgtgt

SEQ ID NO: 3626309 - DNA, 15 bp, Homo sapiens
tgtgtcagtttttcc

SEQ ID NO: 3626310 - DNA, 16 bp, Homo sapiens
tgtgtcagtttttcct

SEQ ID NO: 3626311 - DNA, 12 bp, Homo sapiens
tgtgtcatttct

SEQ ID NO: 3626312 - DNA, 14 bp, Homo sapiens
tgtgtccctggaca

SEQ ID NO: 3626313 - DNA, 17 bp, Homo sapiens
tgtgtccctggacacag

SEQ ID NO: 3626314 - DNA, 20 bp, Homo sapiens
tgtgtccctggacacagctc

SEQ ID NO: 3626315 - DNA, 21 bp, Homo sapiens
tgtgtccctggacacagctct

SEQ ID NO: 3626316 - DNA, 14 bp, Homo sapiens
tgtgtctattttgt

SEQ ID NO: 3626317 - DNA, 15 bp, Homo sapiens
tgtgtctattttgta

SEQ ID NO: 3626318 - DNA, 14 bp, Homo sapiens
tgtgtctcccagaa

SEQ ID NO: 3626319 - DNA, 19 bp, Homo sapiens
tgtgtgattgacagctttg

SEQ ID NO: 3626320 - DNA, 10 bp, Homo sapiens
tgtgtgattt

SEQ ID NO: 3626321 - DNA, 12 bp, Homo sapiens
tgtgtggcaggg

SEQ ID NO: 3626322 - DNA, 19 bp, Homo sapiens
tgtgtggcagggggccccg

SEQ ID NO: 3626323 - DNA, 23 bp, Homo sapiens
tgtgtggtcaacatttctcatgt

SEQ ID NO: 3626324 - DNA, 14 bp, Homo sapiens
tgtgtgtaatttct

SEQ ID NO: 3626325 - DNA, 14 bp, Homo sapiens
tgtgtgtatatgta

SEQ ID NO: 3626326 - DNA, 11 bp, Homo sapiens
tgtgtgtatgt

SEQ ID NO: 3626327 - DNA, 14 bp, Homo sapiens
tgtgtgtctgtcct

SEQ ID NO: 3626328 - DNA, 12 bp, Homo sapiens
tgtgtgtgggag

SEQ ID NO: 3626329 - DNA, 14 bp, Homo sapiens
tgtgtgtgtatgtg

SEQ ID NO: 3626330 - DNA, 11 bp, Homo sapiens
tgtgtgtgtgt

SEQ ID NO: 3626331 - DNA, 21 bp, Homo sapiens
tgtgttcagaagaatcttcct

SEQ ID NO: 3626332 - DNA, 12 bp, Homo sapiens
tgtgttcatttc

SEQ ID NO: 3626333 - DNA, 12 bp, Homo sapiens
tgtgttgaaaca

SEQ ID NO: 3626334 - DNA, 12 bp, Homo sapiens
tgtgtttccaca

SEQ ID NO: 3626335 - DNA, 19 bp, Homo sapiens
tgtgtttccttttcaggag

SEQ ID NO: 3626336 - DNA, 14 bp, Homo sapiens
tgtgttttcatcat

SEQ ID NO: 3626337 - DNA, 18 bp, Homo sapiens
tgttaaccttgtaagatg

SEQ ID NO: 3626338 - DNA, 14 bp, Homo sapiens
tgttaactatgaca

SEQ ID NO: 3626339 - DNA, 16 bp, Homo sapiens
tgttaactatgacaga

SEQ ID NO: 3626340 - DNA, 15 bp, Homo sapiens
tgttaatatttctaa

SEQ ID NO: 3626341 - DNA, 19 bp, Homo sapiens
tgttaatctgatgtataat

SEQ ID NO: 3626342 - DNA, 20 bp, Homo sapiens
tgttaatctgatgtataatg

SEQ ID NO: 3626343 - DNA, 21 bp, Homo sapiens
tgttaatctgatgtataatgt

SEQ ID NO: 3626344 - DNA, 14 bp, Homo sapiens
tgttaattttgcta

SEQ ID NO: 3626345 - DNA, 19 bp, Homo sapiens
tgttaccaaaaataaatat

SEQ ID NO: 3626346 - DNA, 22 bp, Homo sapiens
tgttacgtgaagaaataaatga

SEQ ID NO: 3626347 - DNA, 14 bp, Homo sapiens
tgttactgtatcct

SEQ ID NO: 3626348 - DNA, 15 bp, Homo sapiens
tgttacttctctaat

SEQ ID NO: 3626349 - DNA, 23 bp, Homo sapiens
tgttagaaaatgacttatttctg

SEQ ID NO: 3626350 - DNA, 17 bp, Homo sapiens
tgttagattaagaaata

SEQ ID NO: 3626351 - DNA, 20 bp, Homo sapiens
tgttagattaagaaatagac

SEQ ID NO: 3626352 - DNA, 12 bp, Homo sapiens
tgttagcaaaga

SEQ ID NO: 3626353 - DNA, 15 bp, Homo sapiens
tgttagcaaagatta

SEQ ID NO: 3626354 - DNA, 20 bp, Homo sapiens
tgttagtattttaatcctgt

SEQ ID NO: 3626355 - DNA, 20 bp, Homo sapiens
tgttagttaccttatagtta

SEQ ID NO: 3626356 - DNA, 13 bp, Homo sapiens
tgttatacttcaa

SEQ ID NO: 3626357 - DNA, 19 bp, Homo sapiens
tgttatatgttgttcttac

SEQ ID NO: 3626358 - DNA, 12 bp, Homo sapiens
tgttatattata

SEQ ID NO: 3626359 - DNA, 13 bp, Homo sapiens
tgttatcaaaata

SEQ ID NO: 3626360 - DNA, 17 bp, Homo sapiens
tgttatgactatgtaaa

SEQ ID NO: 3626361 - DNA, 13 bp, Homo sapiens
tgttatgagccag

SEQ ID NO: 3626362 - DNA, 13 bp, Homo sapiens
tgttatgcagtga

SEQ ID NO: 3626363 - DNA, 17 bp, Homo sapiens
tgttatgcagtgaacta

SEQ ID NO: 3626364 - DNA, 20 bp, Homo sapiens
tgttatgctgtttcctagct

SEQ ID NO: 3626365 - DNA, 16 bp, Homo sapiens
tgttattattcattat

SEQ ID NO: 3626366 - DNA, 17 bp, Homo sapiens
tgttatttattgaaatg

SEQ ID NO: 3626367 - DNA, 14 bp, Homo sapiens
tgttatttcttccc

SEQ ID NO: 3626368 - DNA, 16 bp, Homo sapiens
tgttatttcttccctg

SEQ ID NO: 3626369 - DNA, 18 bp, Homo sapiens
tgttcaagtttgctgcaa

SEQ ID NO: 3626370 - DNA, 16 bp, Homo sapiens
tgttcacagccagact

SEQ ID NO: 3626371 - DNA, 19 bp, Homo sapiens
tgttcacttttcctccctc

SEQ ID NO: 3626372 - DNA, 13 bp, Homo sapiens
tgttcagaagaat

SEQ ID NO: 3626373 - DNA, 17 bp, Homo sapiens
tgttcatttgaagaaaa

SEQ ID NO: 3626374 - DNA, 23 bp, Homo sapiens
tgttccagattcctatgatggat

SEQ ID NO: 3626375 - DNA, 14 bp, Homo sapiens
tgttcctagtgaaa

SEQ ID NO: 3626376 - DNA, 22 bp, Homo sapiens
tgttcctctagtagtatattta

SEQ ID NO: 3626377 - DNA, 13 bp, Homo sapiens
tgttcctgaaatg

SEQ ID NO: 3626378 - DNA, 12 bp, Homo sapiens
tgttcctgaagc

SEQ ID NO: 3626379 - DNA, 17 bp, Homo sapiens
tgttcctgaagctgctg

SEQ ID NO: 3626380 - DNA, 21 bp, Homo sapiens
tgttcctgaagctgctgtgtc

SEQ ID NO: 3626381 - DNA, 22 bp, Homo sapiens
tgttccttttttcaatatgcaa

SEQ ID NO: 3626382 - DNA, 14 bp, Homo sapiens
tgttctaaaatata

SEQ ID NO: 3626383 - DNA, 22 bp, Homo sapiens
tgttctctgaatgagcctttgt

SEQ ID NO: 3626384 - DNA, 11 bp, Homo sapiens
tgttctgcctc

SEQ ID NO: 3626385 - DNA, 12 bp, Homo sapiens
tgttctgctcct

SEQ ID NO: 3626386 - DNA, 13 bp, Homo sapiens
tgttctgctcctg

SEQ ID NO: 3626387 - DNA, 11 bp, Homo sapiens
tgttctgctga

SEQ ID NO: 3626388 - DNA, 18 bp, Homo sapiens
tgttctgggagttgctgt

SEQ ID NO: 3626389 - DNA, 20 bp, Homo sapiens
tgttctgtagattcatgcaa

SEQ ID NO: 3626390 - DNA, 14 bp, Homo sapiens
tgttcttagagtgt

SEQ ID NO: 3626391 - DNA, 15 bp, Homo sapiens
tgttcttagagtgta

SEQ ID NO: 3626392 - DNA, 16 bp, Homo sapiens
tgttcttataagaaga

SEQ ID NO: 3626393 - DNA, 17 bp, Homo sapiens
tgttcttataagaagaa

SEQ ID NO: 3626394 - DNA, 19 bp, Homo sapiens
tgttgaaaacccagactgt

SEQ ID NO: 3626395 - DNA, 14 bp, Homo sapiens
tgttgaaaatgttc

SEQ ID NO: 3626396 - DNA, 23 bp, Homo sapiens
tgttgacattcggggtgatcctg

SEQ ID NO: 3626397 - DNA, 17 bp, Homo sapiens
tgttgcaagtgcaataa

SEQ ID NO: 3626398 - DNA, 20 bp, Homo sapiens
tgttgcactaaaatgaggat

SEQ ID NO: 3626399 - DNA, 23 bp, Homo sapiens
tgttgcactaaaatgaggatcca

SEQ ID NO: 3626400 - DNA, 13 bp, Homo sapiens
tgttgcagccgca

SEQ ID NO: 3626401 - DNA, 14 bp, Homo sapiens
tgttgcatgtttga

SEQ ID NO: 3626402 - DNA, 15 bp, Homo sapiens
tgttgcatgtttgaa

SEQ ID NO: 3626403 - DNA, 14 bp, Homo sapiens
tgttgcccaggctg

SEQ ID NO: 3626404 - DNA, 15 bp, Homo sapiens
tgttgcccaggctgg

SEQ ID NO: 3626405 - DNA, 15 bp, Homo sapiens
tgttgcgtttttcct

SEQ ID NO: 3626406 - DNA, 16 bp, Homo sapiens
tgttgcgtttttcctt

SEQ ID NO: 3626407 - DNA, 16 bp, Homo sapiens
tgttgctatacatgtt

SEQ ID NO: 3626408 - DNA, 16 bp, Homo sapiens
tgttgctatagtgaca

SEQ ID NO: 3626409 - DNA, 18 bp, Homo sapiens
tgttgctatagtgacatg

SEQ ID NO: 3626410 - DNA, 19 bp, Homo sapiens
tgttgctgtacaaaagcaa

SEQ ID NO: 3626411 - DNA, 14 bp, Homo sapiens
tgttgcttctcagg

SEQ ID NO: 3626412 - DNA, 13 bp, Homo sapiens
tgttggaaatgtg

SEQ ID NO: 3626413 - DNA, 12 bp, Homo sapiens
tgttggaatgaa

SEQ ID NO: 3626414 - DNA, 13 bp, Homo sapiens
tgttggagcagca

SEQ ID NO: 3626415 - DNA, 17 bp, Homo sapiens
tgttggcatagctctgg

SEQ ID NO: 3626416 - DNA, 12 bp, Homo sapiens
tgttggtctgcc

SEQ ID NO: 3626417 - DNA, 12 bp, Homo sapiens
tgttgtcaagga

SEQ ID NO: 3626418 - DNA, 19 bp, Homo sapiens
tgttgtcacatctcaggga

SEQ ID NO: 3626419 - DNA, 22 bp, Homo sapiens
tgttgtgaagctaatgtcacaa

SEQ ID NO: 3626420 - DNA, 14 bp, Homo sapiens
tgttgtgagaatgg

SEQ ID NO: 3626421 - DNA, 14 bp, Homo sapiens
tgttgtggaagcat

SEQ ID NO: 3626422 - DNA, 17 bp, Homo sapiens
tgttgtgtgtatatgta

SEQ ID NO: 3626423 - DNA, 18 bp, Homo sapiens
tgttgtgtgtatatgtat

SEQ ID NO: 3626424 - DNA, 19 bp, Homo sapiens
tgttgtgtgtatatgtatt

SEQ ID NO: 3626425 - DNA, 18 bp, Homo sapiens
tgttgttctgcctggaga

SEQ ID NO: 3626426 - DNA, 16 bp, Homo sapiens
tgttgttgtgtgtata

SEQ ID NO: 3626427 - DNA, 22 bp, Homo sapiens
tgttgttgtgtgtatatgtatt

SEQ ID NO: 3626428 - DNA, 15 bp, Homo sapiens
tgttgtttataataa

SEQ ID NO: 3626429 - DNA, 21 bp, Homo sapiens
tgttgtttataataaaaatat

SEQ ID NO: 3626430 - DNA, 13 bp, Homo sapiens
tgtttaaaatcat

SEQ ID NO: 3626431 - DNA, 18 bp, Homo sapiens
tgtttaaaatcatttctg

SEQ ID NO: 3626432 - DNA, 19 bp, Homo sapiens
tgtttaaacaatctttcat

SEQ ID NO: 3626433 - DNA, 22 bp, Homo sapiens
tgtttaaacaatctttcatgtc

SEQ ID NO: 3626434 - DNA, 18 bp, Homo sapiens
tgtttaactgctgcaggg

SEQ ID NO: 3626435 - DNA, 14 bp, Homo sapiens
tgtttaatcttttt

SEQ ID NO: 3626436 - DNA, 14 bp, Homo sapiens
tgtttacagaggac

SEQ ID NO: 3626437 - DNA, 17 bp, Homo sapiens
tgtttacatttttaaag

SEQ ID NO: 3626438 - DNA, 12 bp, Homo sapiens
tgtttactgaaa

SEQ ID NO: 3626439 - DNA, 21 bp, Homo sapiens
tgtttagatgaggctcagaga

SEQ ID NO: 3626440 - DNA, 19 bp, Homo sapiens
tgtttagcctgaaaacctt

SEQ ID NO: 3626441 - DNA, 20 bp, Homo sapiens
tgtttagcctgaaaaccttt

SEQ ID NO: 3626442 - DNA, 21 bp, Homo sapiens
tgtttatattgtttttatata

SEQ ID NO: 3626443 - DNA, 13 bp, Homo sapiens
tgtttatgtgtgt

SEQ ID NO: 3626444 - DNA, 18 bp, Homo sapiens
tgtttatgttgtttataa

SEQ ID NO: 3626445 - DNA, 15 bp, Homo sapiens
tgtttcagacccccc

SEQ ID NO: 3626446 - DNA, 21 bp, Homo sapiens
tgtttcagaggctcagattgt

SEQ ID NO: 3626447 - DNA, 19 bp, Homo sapiens
tgtttcccgtaaggctgta

SEQ ID NO: 3626448 - DNA, 23 bp, Homo sapiens
tgtttcccgtaaggctgtacata

SEQ ID NO: 3626449 - DNA, 16 bp, Homo sapiens
tgtttccctctgtgtt

SEQ ID NO: 3626450 - DNA, 15 bp, Homo sapiens
tgtttccctgctgaa

SEQ ID NO: 3626451 - DNA, 20 bp, Homo sapiens
tgtttcctagctaggagcag

SEQ ID NO: 3626452 - DNA, 15 bp, Homo sapiens
tgtttctttaaaatt

SEQ ID NO: 3626453 - DNA, 22 bp, Homo sapiens
tgtttgaaatgaggtctgttta

SEQ ID NO: 3626454 - DNA, 13 bp, Homo sapiens
tgtttgatgtttt

SEQ ID NO: 3626455 - DNA, 19 bp, Homo sapiens
tgtttgctcaaaattgctt

SEQ ID NO: 3626456 - DNA, 15 bp, Homo sapiens
tgtttgctgaaattt

SEQ ID NO: 3626457 - DNA, 18 bp, Homo sapiens
tgtttggatacagctgct

SEQ ID NO: 3626458 - DNA, 15 bp, Homo sapiens
tgtttggttcaattt

SEQ ID NO: 3626459 - DNA, 21 bp, Homo sapiens
tgtttggtttcttcattcttt

SEQ ID NO: 3626460 - DNA, 15 bp, Homo sapiens
tgtttgtcatggtga

SEQ ID NO: 3626461 - DNA, 17 bp, Homo sapiens
tgtttgtttcctttgtt

SEQ ID NO: 3626462 - DNA, 21 bp, Homo sapiens
tgttttacaatagttctgtgg

SEQ ID NO: 3626463 - DNA, 13 bp, Homo sapiens
tgttttcatcatt

SEQ ID NO: 3626464 - DNA, 22 bp, Homo sapiens
tgttttcatcatttcagccaaa

SEQ ID NO: 3626465 - DNA, 22 bp, Homo sapiens
tgttttcctcccttctgctact

SEQ ID NO: 3626466 - DNA, 20 bp, Homo sapiens
tgttttctttgtttctttgt

SEQ ID NO: 3626467 - DNA, 17 bp, Homo sapiens
tgttttgccagcccatt

SEQ ID NO: 3626468 - DNA, 15 bp, Homo sapiens
tgttttgccgtggct

SEQ ID NO: 3626469 - DNA, 20 bp, Homo sapiens
tgttttgttggtttttaaag

SEQ ID NO: 3626470 - DNA, 12 bp, Homo sapiens
tgtttttatata

SEQ ID NO: 3626471 - DNA, 22 bp, Homo sapiens
tgtttttatatattataagttg

SEQ ID NO: 3626472 - DNA, 17 bp, Homo sapiens
tgtttttattgttttct

SEQ ID NO: 3626473 - DNA, 22 bp, Homo sapiens
tgtttttatttcaattgtttat

SEQ ID NO: 3626474 - DNA, 23 bp, Homo sapiens
tgtttttatttcaattgtttata

SEQ ID NO: 3626475 - DNA, 15 bp, Homo sapiens
tgtttttcatgtttt

SEQ ID NO: 3626476 - DNA, 17 bp, Homo sapiens
tgtttttctctaatgct

SEQ ID NO: 3626477 - DNA, 19 bp, Homo sapiens
tgttttttcatttgtaaaa

SEQ ID NO: 3626478 - DNA, 17 bp, Homo sapiens
tgtttttttctaaaaag

SEQ ID NO: 3626479 - DNA, 18 bp, Homo sapiens
ttaaaaaaaagaaacttt

SEQ ID NO: 3626480 - DNA, 18 bp, Homo sapiens
ttaaaaaagcaaggcaca

SEQ ID NO: 3626481 - DNA, 14 bp, Homo sapiens
ttaaaaaatagttg

SEQ ID NO: 3626482 - DNA, 16 bp, Homo sapiens
ttaaaaaatgaaatcc

SEQ ID NO: 3626483 - DNA, 16 bp, Homo sapiens
ttaaaaaatggaacat

SEQ ID NO: 3626484 - DNA, 21 bp, Homo sapiens
ttaaaaaatgtgaaatgcttt

SEQ ID NO: 3626485 - DNA, 13 bp, Homo sapiens
ttaaaaagatgaa

SEQ ID NO: 3626486 - DNA, 13 bp, Homo sapiens
ttaaaaagtgttt

SEQ ID NO: 3626487 - DNA, 18 bp, Homo sapiens
ttaaaaatgtcttattgt

SEQ ID NO: 3626488 - DNA, 13 bp, Homo sapiens
ttaaaaattgcat

SEQ ID NO: 3626489 - DNA, 18 bp, Homo sapiens
ttaaaacactttcaaaac

SEQ ID NO: 3626490 - DNA, 15 bp, Homo sapiens
ttaaaacattaaaat

SEQ ID NO: 3626491 - DNA, 18 bp, Homo sapiens
ttaaaacctgcttttcaa

SEQ ID NO: 3626492 - DNA, 15 bp, Homo sapiens
ttaaaactgttattt

SEQ ID NO: 3626493 - DNA, 22 bp, Homo sapiens
ttaaaagaatattttaacttcc

SEQ ID NO: 3626494 - DNA, 19 bp, Homo sapiens
ttaaaaggatgtataaatt

SEQ ID NO: 3626495 - DNA, 16 bp, Homo sapiens
ttaaaagtaataaaga

SEQ ID NO: 3626496 - DNA, 17 bp, Homo sapiens
ttaaaagtaataaagag

SEQ ID NO: 3626497 - DNA, 18 bp, Homo sapiens
ttaaaagtaataaagaga

SEQ ID NO: 3626498 - DNA, 21 bp, Homo sapiens
ttaaaatgaacctgctactta

SEQ ID NO: 3626499 - DNA, 14 bp, Homo sapiens
ttaaacaaaggttg

SEQ ID NO: 3626500 - DNA, 21 bp, Homo sapiens
ttaaacaatctttcatgtctt

SEQ ID NO: 3626501 - DNA, 21 bp, Homo sapiens
ttaaacagggtctcactctgt

SEQ ID NO: 3626502 - DNA, 12 bp, Homo sapiens
ttaaacataata

SEQ ID NO: 3626503 - DNA, 19 bp, Homo sapiens
ttaaacataataaatcaca

SEQ ID NO: 3626504 - DNA, 22 bp, Homo sapiens
ttaaacattaatatttaccaaa

SEQ ID NO: 3626505 - DNA, 14 bp, Homo sapiens
ttaaacggattatt

SEQ ID NO: 3626506 - DNA, 23 bp, Homo sapiens
ttaaagaaaattaattatgtgta

SEQ ID NO: 3626507 - DNA, 17 bp, Homo sapiens
ttaaagaaagtgtattt

SEQ ID NO: 3626508 - DNA, 17 bp, Homo sapiens
ttaaagacagggtcttg

SEQ ID NO: 3626509 - DNA, 16 bp, Homo sapiens
ttaaagcaagcaacac

SEQ ID NO: 3626510 - DNA, 19 bp, Homo sapiens
ttaaagcatatagagatga

SEQ ID NO: 3626511 - DNA, 14 bp, Homo sapiens
ttaaagctgagaga

SEQ ID NO: 3626512 - DNA, 15 bp, Homo sapiens
ttaaagttcaaactc

SEQ ID NO: 3626513 - DNA, 19 bp, Homo sapiens
ttaaagttctaggcatact

SEQ ID NO: 3626514 - DNA, 19 bp, Homo sapiens
ttaaataaaagcacaagta

SEQ ID NO: 3626515 - DNA, 14 bp, Homo sapiens
ttaaatattttgct

SEQ ID NO: 3626516 - DNA, 15 bp, Homo sapiens
ttaaatattttgcta

SEQ ID NO: 3626517 - DNA, 18 bp, Homo sapiens
ttaaatattttgctaact

SEQ ID NO: 3626518 - DNA, 11 bp, Homo sapiens
ttaaatgaaag

SEQ ID NO: 3626519 - DNA, 20 bp, Homo sapiens
ttaaatgtcaaatgtgaatt

SEQ ID NO: 3626520 - DNA, 12 bp, Homo sapiens
ttaaattatatg

SEQ ID NO: 3626521 - DNA, 14 bp, Homo sapiens
ttaaatttgttctt

SEQ ID NO: 3626522 - DNA, 16 bp, Homo sapiens
ttaaattttttttaca

SEQ ID NO: 3626523 - DNA, 19 bp, Homo sapiens
ttaaattttttttacattt

SEQ ID NO: 3626524 - DNA, 13 bp, Homo sapiens
ttaacacatcaaa

SEQ ID NO: 3626525 - DNA, 12 bp, Homo sapiens
ttaacaggacag

SEQ ID NO: 3626526 - DNA, 13 bp, Homo sapiens
ttaacaggacagt

SEQ ID NO: 3626527 - DNA, 16 bp, Homo sapiens
ttaacatattatttca

SEQ ID NO: 3626528 - DNA, 20 bp, Homo sapiens
ttaacatgggctcttcacta

SEQ ID NO: 3626529 - DNA, 22 bp, Homo sapiens
ttaacatgggctcttcactagt

SEQ ID NO: 3626530 - DNA, 16 bp, Homo sapiens
ttaacccacctctcct

SEQ ID NO: 3626531 - DNA, 14 bp, Homo sapiens
ttaaccctcccctt

SEQ ID NO: 3626532 - DNA, 15 bp, Homo sapiens
ttaacggtgctaaaa

SEQ ID NO: 3626533 - DNA, 13 bp, Homo sapiens
ttaactaaagaag

SEQ ID NO: 3626534 - DNA, 17 bp, Homo sapiens
ttaactagacacagata

SEQ ID NO: 3626535 - DNA, 21 bp, Homo sapiens
ttaactatatgtgaaacattt

SEQ ID NO: 3626536 - DNA, 14 bp, Homo sapiens
ttaactattgcatt

SEQ ID NO: 3626537 - DNA, 12 bp, Homo sapiens
ttaactcagtct

SEQ ID NO: 3626538 - DNA, 12 bp, Homo sapiens
ttaactgtattt

SEQ ID NO: 3626539 - DNA, 19 bp, Homo sapiens
ttaactgtattttctttca

SEQ ID NO: 3626540 - DNA, 16 bp, Homo sapiens
ttaacttagctacttt

SEQ ID NO: 3626541 - DNA, 17 bp, Homo sapiens
ttaacttctgttttacc

SEQ ID NO: 3626542 - DNA, 21 bp, Homo sapiens
ttaacttcttgcttctttcta

SEQ ID NO: 3626543 - DNA, 20 bp, Homo sapiens
ttaacttttttttctctctt

SEQ ID NO: 3626544 - DNA, 21 bp, Homo sapiens
ttaagaaagtaatttaatttg

SEQ ID NO: 3626545 - DNA, 11 bp, Homo sapiens
ttaagacctgg

SEQ ID NO: 3626546 - DNA, 19 bp, Homo sapiens
ttaagatacttagattaga

SEQ ID NO: 3626547 - DNA, 14 bp, Homo sapiens
ttaagcaacatctt

SEQ ID NO: 3626548 - DNA, 15 bp, Homo sapiens
ttaagcagcatggaa

SEQ ID NO: 3626549 - DNA, 19 bp, Homo sapiens
ttaagcagtacaaatgttt

SEQ ID NO: 3626550 - DNA, 17 bp, Homo sapiens
ttaaggcacagtgggag

SEQ ID NO: 3626551 - DNA, 21 bp, Homo sapiens
ttaaggcacagtgggagctga

SEQ ID NO: 3626552 - DNA, 13 bp, Homo sapiens
ttaaggcatttgt

SEQ ID NO: 3626553 - DNA, 15 bp, Homo sapiens
ttaaggccctcattc

SEQ ID NO: 3626554 - DNA, 18 bp, Homo sapiens
ttaaggccctcattctca

SEQ ID NO: 3626555 - DNA, 13 bp, Homo sapiens
ttaagggtatgat

SEQ ID NO: 3626556 - DNA, 20 bp, Homo sapiens
ttaaggtctaatcagtgatt

SEQ ID NO: 3626557 - DNA, 21 bp, Homo sapiens
ttaagtccaaggagaagaaga

SEQ ID NO: 3626558 - DNA, 20 bp, Homo sapiens
ttaagtggtctagtcaagga

SEQ ID NO: 3626559 - DNA, 15 bp, Homo sapiens
ttaagtgtgcagcca

SEQ ID NO: 3626560 - DNA, 17 bp, Homo sapiens
ttaagtgtgcagccata

SEQ ID NO: 3626561 - DNA, 20 bp, Homo sapiens
ttaagttagttccactgaga

SEQ ID NO: 3626562 - DNA, 19 bp, Homo sapiens
ttaataaactactctttga

SEQ ID NO: 3626563 - DNA, 12 bp, Homo sapiens
ttaatatggatt

SEQ ID NO: 3626564 - DNA, 17 bp, Homo sapiens
ttaatatggatttgtta

SEQ ID NO: 3626565 - DNA, 18 bp, Homo sapiens
ttaatattgatatgctta

SEQ ID NO: 3626566 - DNA, 22 bp, Homo sapiens
ttaatattgatatgcttataca

SEQ ID NO: 3626567 - DNA, 13 bp, Homo sapiens
ttaatatttacca

SEQ ID NO: 3626568 - DNA, 15 bp, Homo sapiens
ttaatatttaccaaa

SEQ ID NO: 3626569 - DNA, 17 bp, Homo sapiens
ttaatatttaccaaagt

SEQ ID NO: 3626570 - DNA, 20 bp, Homo sapiens
ttaatatttaccaaagtagg

SEQ ID NO: 3626571 - DNA, 15 bp, Homo sapiens
ttaatcatacaaact

SEQ ID NO: 3626572 - DNA, 23 bp, Homo sapiens
ttaatcatatttgaaaaccatat

SEQ ID NO: 3626573 - DNA, 17 bp, Homo sapiens
ttaatccattaaaaagt

SEQ ID NO: 3626574 - DNA, 18 bp, Homo sapiens
ttaatcctgtaccaaatc

SEQ ID NO: 3626575 - DNA, 22 bp, Homo sapiens
ttaatcctgtaccaaatctgac

SEQ ID NO: 3626576 - DNA, 17 bp, Homo sapiens
ttaatccttctttgtaa

SEQ ID NO: 3626577 - DNA, 17 bp, Homo sapiens
ttaatctgatgtataat

SEQ ID NO: 3626578 - DNA, 18 bp, Homo sapiens
ttaatctgatgtataatg

SEQ ID NO: 3626579 - DNA, 20 bp, Homo sapiens
ttaatctgatgtataatgta

SEQ ID NO: 3626580 - DNA, 22 bp, Homo sapiens
ttaatctgatgtataatgtaat

SEQ ID NO: 3626581 - DNA, 14 bp, Homo sapiens
ttaatcttagtgta

SEQ ID NO: 3626582 - DNA, 19 bp, Homo sapiens
ttaatcttagtgtatgatt

SEQ ID NO: 3626583 - DNA, 21 bp, Homo sapiens
ttaatcttagtgtatgattac

SEQ ID NO: 3626584 - DNA, 19 bp, Homo sapiens
ttaatgacaacacttaata

SEQ ID NO: 3626585 - DNA, 15 bp, Homo sapiens
ttaatgacattcccc

SEQ ID NO: 3626586 - DNA, 20 bp, Homo sapiens
ttaatgagtgcacctgcctc

SEQ ID NO: 3626587 - DNA, 22 bp, Homo sapiens
ttaatgagtgcacctgcctcca

SEQ ID NO: 3626588 - DNA, 16 bp, Homo sapiens
ttaatgctgccttttc

SEQ ID NO: 3626589 - DNA, 17 bp, Homo sapiens
ttaatgctgccttttct

SEQ ID NO: 3626590 - DNA, 20 bp, Homo sapiens
ttaatgtctggtgtttgtca

SEQ ID NO: 3626591 - DNA, 22 bp, Homo sapiens
ttaatgtctggtgtttgtcatg

SEQ ID NO: 3626592 - DNA, 23 bp, Homo sapiens
ttaatgtctggtgtttgtcatgg

SEQ ID NO: 3626593 - DNA, 14 bp, Homo sapiens
ttaatgttaattat

SEQ ID NO: 3626594 - DNA, 22 bp, Homo sapiens
ttaatgttgattttaatcctgt

SEQ ID NO: 3626595 - DNA, 18 bp, Homo sapiens
ttaattaaaattggtaaa

SEQ ID NO: 3626596 - DNA, 16 bp, Homo sapiens
ttaattaaacattgtg

SEQ ID NO: 3626597 - DNA, 14 bp, Homo sapiens
ttaattacaaacaa

SEQ ID NO: 3626598 - DNA, 22 bp, Homo sapiens
ttaattactggaattcttctgc

SEQ ID NO: 3626599 - DNA, 17 bp, Homo sapiens
ttaattcaacttaacta

SEQ ID NO: 3626600 - DNA, 20 bp, Homo sapiens
ttaattcaggttttttagtt

SEQ ID NO: 3626601 - DNA, 17 bp, Homo sapiens
ttaattgccagcaaata

SEQ ID NO: 3626602 - DNA, 12 bp, Homo sapiens
ttaatttaaact

SEQ ID NO: 3626603 - DNA, 17 bp, Homo sapiens
ttaatttaatatttact

SEQ ID NO: 3626604 - DNA, 13 bp, Homo sapiens
ttaatttaatttt

SEQ ID NO: 3626605 - DNA, 15 bp, Homo sapiens
ttaatttataatgta

SEQ ID NO: 3626606 - DNA, 19 bp, Homo sapiens
ttaatttataatgtatttg

SEQ ID NO: 3626607 - DNA, 12 bp, Homo sapiens
ttaatttgtaaa

SEQ ID NO: 3626608 - DNA, 20 bp, Homo sapiens
ttaatttgtaaaacttctgc

SEQ ID NO: 3626609 - DNA, 13 bp, Homo sapiens
ttaattttcagtt

SEQ ID NO: 3626610 - DNA, 19 bp, Homo sapiens
ttaattttgaagtgctgtt

SEQ ID NO: 3626611 - DNA, 14 bp, Homo sapiens
ttaattttgctaac

SEQ ID NO: 3626612 - DNA, 18 bp, Homo sapiens
ttaatttttccaactact

SEQ ID NO: 3626613 - DNA, 17 bp, Homo sapiens
ttacaaaacctattttt

SEQ ID NO: 3626614 - DNA, 21 bp, Homo sapiens
ttacaaagaaccatgcaggaa

SEQ ID NO: 3626615 - DNA, 21 bp, Homo sapiens
ttacaaagggaaagcctctgg

SEQ ID NO: 3626616 - DNA, 23 bp, Homo sapiens
ttacaaagggaaagcctctggcc

SEQ ID NO: 3626617 - DNA, 21 bp, Homo sapiens
ttacaaagttaaaattgttat

SEQ ID NO: 3626618 - DNA, 20 bp, Homo sapiens
ttacaacagtagagagggaa

SEQ ID NO: 3626619 - DNA, 16 bp, Homo sapiens
ttacaagtttctagct

SEQ ID NO: 3626620 - DNA, 17 bp, Homo sapiens
ttacaatagttctgtgg

SEQ ID NO: 3626621 - DNA, 22 bp, Homo sapiens
ttacacaaagaacttgctgctg

SEQ ID NO: 3626622 - DNA, 16 bp, Homo sapiens
ttacactttttggaag

SEQ ID NO: 3626623 - DNA, 23 bp, Homo sapiens
ttacagccaagtgccaaatgctc

SEQ ID NO: 3626624 - DNA, 14 bp, Homo sapiens
ttacagcctctgac

SEQ ID NO: 3626625 - DNA, 13 bp, Homo sapiens
ttacagctgcctg

SEQ ID NO: 3626626 - DNA, 14 bp, Homo sapiens
ttacaggagccagc

SEQ ID NO: 3626627 - DNA, 15 bp, Homo sapiens
ttacaggagccagcc

SEQ ID NO: 3626628 - DNA, 15 bp, Homo sapiens
ttacagtatttctac

SEQ ID NO: 3626629 - DNA, 22 bp, Homo sapiens
ttacagttctgtggtttcatgt

SEQ ID NO: 3626630 - DNA, 23 bp, Homo sapiens
ttacatatctgacttctaggatt

SEQ ID NO: 3626631 - DNA, 18 bp, Homo sapiens
ttacatgggccagtttat

SEQ ID NO: 3626632 - DNA, 20 bp, Homo sapiens
ttacatgttttttcatttgt

SEQ ID NO: 3626633 - DNA, 19 bp, Homo sapiens
ttacattgtgtcctgctta

SEQ ID NO: 3626634 - DNA, 17 bp, Homo sapiens
ttacatttttaaaggta

SEQ ID NO: 3626635 - DNA, 21 bp, Homo sapiens
ttacattttttgggcagcaat

SEQ ID NO: 3626636 - DNA, 10 bp, Homo sapiens
ttaccaaagc

SEQ ID NO: 3626637 - DNA, 19 bp, Homo sapiens
ttaccagggactatctttg

SEQ ID NO: 3626638 - DNA, 20 bp, Homo sapiens
ttaccagggactatctttgc

SEQ ID NO: 3626639 - DNA, 17 bp, Homo sapiens
ttaccagggtctttgca

SEQ ID NO: 3626640 - DNA, 16 bp, Homo sapiens
ttaccattttaacgct

SEQ ID NO: 3626641 - DNA, 15 bp, Homo sapiens
ttaccctcctctgct

SEQ ID NO: 3626642 - DNA, 16 bp, Homo sapiens
ttacccttttccccct

SEQ ID NO: 3626643 - DNA, 22 bp, Homo sapiens
ttacccttttcccccttcccat

SEQ ID NO: 3626644 - DNA, 18 bp, Homo sapiens
ttacctaagattacaaat

SEQ ID NO: 3626645 - DNA, 18 bp, Homo sapiens
ttacctagctaattattt

SEQ ID NO: 3626646 - DNA, 18 bp, Homo sapiens
ttacctattctgaaaaag

SEQ ID NO: 3626647 - DNA, 21 bp, Homo sapiens
ttacctgaaggggttttcttg

SEQ ID NO: 3626648 - DNA, 11 bp, Homo sapiens
ttacctggaga

SEQ ID NO: 3626649 - DNA, 13 bp, Homo sapiens
ttacctggagaag

SEQ ID NO: 3626650 - DNA, 12 bp, Homo sapiens
ttacctggatta

SEQ ID NO: 3626651 - DNA, 12 bp, Homo sapiens
ttacctggccta

SEQ ID NO: 3626652 - DNA, 17 bp, Homo sapiens
ttacctggcctagaaag

SEQ ID NO: 3626653 - DNA, 18 bp, Homo sapiens
ttaccttatagttactgt

SEQ ID NO: 3626654 - DNA, 14 bp, Homo sapiens
ttaccttctttcta

SEQ ID NO: 3626655 - DNA, 16 bp, Homo sapiens
ttaccttgtatactgt

SEQ ID NO: 3626656 - DNA, 15 bp, Homo sapiens
ttacgtgctctgtgg

SEQ ID NO: 3626657 - DNA, 21 bp, Homo sapiens
ttactccttaggtgcccagaa

SEQ ID NO: 3626658 - DNA, 23 bp, Homo sapiens
ttactggaattacaaaacctatt

SEQ ID NO: 3626659 - DNA, 13 bp, Homo sapiens
ttactggcctttt

SEQ ID NO: 3626660 - DNA, 18 bp, Homo sapiens
ttactggcctttttcatt

SEQ ID NO: 3626661 - DNA, 14 bp, Homo sapiens
ttactgtcttgaat

SEQ ID NO: 3626662 - DNA, 14 bp, Homo sapiens
ttacttatgtagaa

SEQ ID NO: 3626663 - DNA, 20 bp, Homo sapiens
ttacttcaaagtgcctgggc

SEQ ID NO: 3626664 - DNA, 23 bp, Homo sapiens
ttacttcttatacatttgataaa

SEQ ID NO: 3626665 - DNA, 17 bp, Homo sapiens
ttacttgcctatctgac

SEQ ID NO: 3626666 - DNA, 17 bp, Homo sapiens
ttactttaattactgga

SEQ ID NO: 3626667 - DNA, 20 bp, Homo sapiens
ttactttgctgccttaatga

SEQ ID NO: 3626668 - DNA, 12 bp, Homo sapiens
ttagaaaaaaca

SEQ ID NO: 3626669 - DNA, 14 bp, Homo sapiens
ttagaaaaaacaat

SEQ ID NO: 3626670 - DNA, 14 bp, Homo sapiens
ttagaaaatgactt

SEQ ID NO: 3626671 - DNA, 16 bp, Homo sapiens
ttagaaactacaaata

SEQ ID NO: 3626672 - DNA, 11 bp, Homo sapiens
ttagaaatata

SEQ ID NO: 3626673 - DNA, 22 bp, Homo sapiens
ttagaaccagccgtattttaca

SEQ ID NO: 3626674 - DNA, 16 bp, Homo sapiens
ttagaacctgaggtct

SEQ ID NO: 3626675 - DNA, 16 bp, Homo sapiens
ttagaagaagtgtgtc

SEQ ID NO: 3626676 - DNA, 17 bp, Homo sapiens
ttagaatgtcaataaat

SEQ ID NO: 3626677 - DNA, 19 bp, Homo sapiens
ttagaattttgtgaaacag

SEQ ID NO: 3626678 - DNA, 19 bp, Homo sapiens
ttagacaaagccttaagca

SEQ ID NO: 3626679 - DNA, 21 bp, Homo sapiens
ttagagaaaaccttaaaagta

SEQ ID NO: 3626680 - DNA, 22 bp, Homo sapiens
ttagagaaaaccttaaaagtaa

SEQ ID NO: 3626681 - DNA, 20 bp, Homo sapiens
ttagagataggaaactgaag

SEQ ID NO: 3626682 - DNA, 19 bp, Homo sapiens
ttagagctaaaaaggccct

SEQ ID NO: 3626683 - DNA, 18 bp, Homo sapiens
ttagagggaggagaatga

SEQ ID NO: 3626684 - DNA, 24 bp, Homo sapiens
ttagagtaggtattaatcttattg

SEQ ID NO: 3626685 - DNA, 15 bp, Homo sapiens
ttagagtttctgttt

SEQ ID NO: 3626686 - DNA, 18 bp, Homo sapiens
ttagagtttctgtttgat

SEQ ID NO: 3626687 - DNA, 15 bp, Homo sapiens
ttagataaatattga

SEQ ID NO: 3626688 - DNA, 15 bp, Homo sapiens
ttagattaagaaata

SEQ ID NO: 3626689 - DNA, 13 bp, Homo sapiens
ttagcaaggcaga

SEQ ID NO: 3626690 - DNA, 18 bp, Homo sapiens
ttagcaataaatgctttt

SEQ ID NO: 3626691 - DNA, 20 bp, Homo sapiens
ttagcatgttcctccttttc

SEQ ID NO: 3626692 - DNA, 17 bp, Homo sapiens
ttagcattaaagttcta

SEQ ID NO: 3626693 - DNA, 20 bp, Homo sapiens
ttagccaactgtttccctgc

SEQ ID NO: 3626694 - DNA, 21 bp, Homo sapiens
ttagctactttggcattgctg

SEQ ID NO: 3626695 - DNA, 15 bp, Homo sapiens
ttagctctattgata

SEQ ID NO: 3626696 - DNA, 12 bp, Homo sapiens
ttagcttcctta

SEQ ID NO: 3626697 - DNA, 20 bp, Homo sapiens
ttagctttctgagcaagagg

SEQ ID NO: 3626698 - DNA, 19 bp, Homo sapiens
ttaggaactgagtatgtgt

SEQ ID NO: 3626699 - DNA, 22 bp, Homo sapiens
ttaggaagttgacttatagtac

SEQ ID NO: 3626700 - DNA, 20 bp, Homo sapiens
ttaggagaagtcttctattt

SEQ ID NO: 3626701 - DNA, 16 bp, Homo sapiens
ttaggctggtggccca

SEQ ID NO: 3626702 - DNA, 17 bp, Homo sapiens
ttaggctggtggcccag

SEQ ID NO: 3626703 - DNA, 18 bp, Homo sapiens
ttaggctggtggcccagg

SEQ ID NO: 3626704 - DNA, 19 bp, Homo sapiens
ttaggctggtggcccagga

SEQ ID NO: 3626705 - DNA, 17 bp, Homo sapiens
ttaggctgtaactactt

SEQ ID NO: 3626706 - DNA, 20 bp, Homo sapiens
ttaggctgtaactactttat

SEQ ID NO: 3626707 - DNA, 22 bp, Homo sapiens
ttaggcttttccaaatcaagga

SEQ ID NO: 3626708 - DNA, 22 bp, Homo sapiens
ttagggacaggaccccagctct

SEQ ID NO: 3626709 - DNA, 15 bp, Homo sapiens
ttagggagagaagat

SEQ ID NO: 3626710 - DNA, 17 bp, Homo sapiens
ttaggtaatttttttca

SEQ ID NO: 3626711 - DNA, 18 bp, Homo sapiens
ttagtaaatttctgtgat

SEQ ID NO: 3626712 - DNA, 17 bp, Homo sapiens
ttagtacaaagtttcaa

SEQ ID NO: 3626713 - DNA, 15 bp, Homo sapiens
ttagtatttcagtgt

SEQ ID NO: 3626714 - DNA, 17 bp, Homo sapiens
ttagtatttcagtgttt

SEQ ID NO: 3626715 - DNA, 17 bp, Homo sapiens
ttagtattttaatcctg

SEQ ID NO: 3626716 - DNA, 13 bp, Homo sapiens
ttagtcatgtgac

SEQ ID NO: 3626717 - DNA, 14 bp, Homo sapiens
ttagtcatgtgacc

SEQ ID NO: 3626718 - DNA, 14 bp, Homo sapiens
ttagtcctgtactg

SEQ ID NO: 3626719 - DNA, 19 bp, Homo sapiens
ttagtcctgtactgtatgg

SEQ ID NO: 3626720 - DNA, 18 bp, Homo sapiens
ttagtcgttatatttgac

SEQ ID NO: 3626721 - DNA, 20 bp, Homo sapiens
ttagtcgttatatttgactt

SEQ ID NO: 3626722 - DNA, 14 bp, Homo sapiens
ttagtctttatact

SEQ ID NO: 3626723 - DNA, 14 bp, Homo sapiens
ttagtgtaaaattg

SEQ ID NO: 3626724 - DNA, 15 bp, Homo sapiens
ttagtgtaataagac

SEQ ID NO: 3626725 - DNA, 19 bp, Homo sapiens
ttagttaccttatagttac

SEQ ID NO: 3626726 - DNA, 16 bp, Homo sapiens
ttagttccactgagac

SEQ ID NO: 3626727 - DNA, 17 bp, Homo sapiens
ttagttcttgggggagg

SEQ ID NO: 3626728 - DNA, 18 bp, Homo sapiens
ttataaaataacttgcat

SEQ ID NO: 3626729 - DNA, 17 bp, Homo sapiens
ttataaaccaatcttaa

SEQ ID NO: 3626730 - DNA, 18 bp, Homo sapiens
ttataaaccaatcttaaa

SEQ ID NO: 3626731 - DNA, 18 bp, Homo sapiens
ttataaattaaaaggtca

SEQ ID NO: 3626732 - DNA, 12 bp, Homo sapiens
ttataacaatat

SEQ ID NO: 3626733 - DNA, 15 bp, Homo sapiens
ttataactaacatgt

SEQ ID NO: 3626734 - DNA, 17 bp, Homo sapiens
ttataactattacagtg

SEQ ID NO: 3626735 - DNA, 17 bp, Homo sapiens
ttataaggaaattttac

SEQ ID NO: 3626736 - DNA, 14 bp, Homo sapiens
ttataagttgacct

SEQ ID NO: 3626737 - DNA, 19 bp, Homo sapiens
ttataataaaggactgtaa

SEQ ID NO: 3626738 - DNA, 21 bp, Homo sapiens
ttataataaaggactgtaatc

SEQ ID NO: 3626739 - DNA, 14 bp, Homo sapiens
ttataattggctta

SEQ ID NO: 3626740 - DNA, 18 bp, Homo sapiens
ttatacactgtaagcttt

SEQ ID NO: 3626741 - DNA, 21 bp, Homo sapiens
ttatactgctctataaatagt

SEQ ID NO: 3626742 - DNA, 22 bp, Homo sapiens
ttataggagaaagcaaaataca

SEQ ID NO: 3626743 - DNA, 17 bp, Homo sapiens
ttatagtacatgataaa

SEQ ID NO: 3626744 - DNA, 13 bp, Homo sapiens
ttatagttactgt

SEQ ID NO: 3626745 - DNA, 23 bp, Homo sapiens
ttatatacagaggaaatctgtaa

SEQ ID NO: 3626746 - DNA, 16 bp, Homo sapiens
ttatatctcccccact

SEQ ID NO: 3626747 - DNA, 17 bp, Homo sapiens
ttatatggataatctga

SEQ ID NO: 3626748 - DNA, 17 bp, Homo sapiens
ttatatgtacagtttat

SEQ ID NO: 3626749 - DNA, 14 bp, Homo sapiens
ttatatgtaccgta

SEQ ID NO: 3626750 - DNA, 15 bp, Homo sapiens
ttatatgttgttctt

SEQ ID NO: 3626751 - DNA, 13 bp, Homo sapiens
ttatattctaata

SEQ ID NO: 3626752 - DNA, 23 bp, Homo sapiens
ttatattgtttttatatattata

SEQ ID NO: 3626753 - DNA, 23 bp, Homo sapiens
ttatcaaaatagtctaaggccat

SEQ ID NO: 3626754 - DNA, 15 bp, Homo sapiens
ttatccaaatcttga

SEQ ID NO: 3626755 - DNA, 19 bp, Homo sapiens
ttatccctctcttcccctt

SEQ ID NO: 3626756 - DNA, 13 bp, Homo sapiens
ttatctctttcca

SEQ ID NO: 3626757 - DNA, 23 bp, Homo sapiens
ttatctgaaaggccagcagctga

SEQ ID NO: 3626758 - DNA, 21 bp, Homo sapiens
ttatctgtaattgtaattcca

SEQ ID NO: 3626759 - DNA, 22 bp, Homo sapiens
ttatctgtaattgtaattccaa

SEQ ID NO: 3626760 - DNA, 13 bp, Homo sapiens
ttatcttatcatt

SEQ ID NO: 3626761 - DNA, 14 bp, Homo sapiens
ttatctttgaatat

SEQ ID NO: 3626762 - DNA, 19 bp, Homo sapiens
ttatgaaatgccactggga

SEQ ID NO: 3626763 - DNA, 16 bp, Homo sapiens
ttatgacatcacttgt

SEQ ID NO: 3626764 - DNA, 21 bp, Homo sapiens
ttatgacatcacttgtacaaa

SEQ ID NO: 3626765 - DNA, 23 bp, Homo sapiens
ttatgacatcacttgtacaaaat

SEQ ID NO: 3626766 - DNA, 22 bp, Homo sapiens
ttatgacatgaaaagttattta

SEQ ID NO: 3626767 - DNA, 16 bp, Homo sapiens
ttatgactatgtaaac

SEQ ID NO: 3626768 - DNA, 18 bp, Homo sapiens
ttatgagggccacgggtc

SEQ ID NO: 3626769 - DNA, 22 bp, Homo sapiens
ttatgatagcaaatggcctcat

SEQ ID NO: 3626770 - DNA, 23 bp, Homo sapiens
ttatgattgaatctacttgcaca

SEQ ID NO: 3626771 - DNA, 22 bp, Homo sapiens
ttatgcaaggtcttgcatttaa

SEQ ID NO: 3626772 - DNA, 21 bp, Homo sapiens
ttatgctataaattttttgaa

SEQ ID NO: 3626773 - DNA, 11 bp, Homo sapiens
ttatgctgttt

SEQ ID NO: 3626774 - DNA, 12 bp, Homo sapiens
ttatgctgtttc

SEQ ID NO: 3626775 - DNA, 18 bp, Homo sapiens
ttatgtgaaatgctttct

SEQ ID NO: 3626776 - DNA, 19 bp, Homo sapiens
ttatgtggctgtaatgaca

SEQ ID NO: 3626777 - DNA, 13 bp, Homo sapiens
ttatgttaatatt

SEQ ID NO: 3626778 - DNA, 23 bp, Homo sapiens
ttatgttcttagcaataaatgct

SEQ ID NO: 3626779 - DNA, 14 bp, Homo sapiens
ttattaaacttcag

SEQ ID NO: 3626780 - DNA, 17 bp, Homo sapiens
ttattaaacttcagcaa

SEQ ID NO: 3626781 - DNA, 21 bp, Homo sapiens
ttattaacgatgtccaacccg

SEQ ID NO: 3626782 - DNA, 15 bp, Homo sapiens
ttattaataatgaag

SEQ ID NO: 3626783 - DNA, 17 bp, Homo sapiens
ttattaataatgaagta

SEQ ID NO: 3626784 - DNA, 13 bp, Homo sapiens
ttattaatataat

SEQ ID NO: 3626785 - DNA, 22 bp, Homo sapiens
ttattaatcatacaaactctca

SEQ ID NO: 3626786 - DNA, 14 bp, Homo sapiens
ttattaattaaaga

SEQ ID NO: 3626787 - DNA, 18 bp, Homo sapiens
ttattactttaaattata

SEQ ID NO: 3626788 - DNA, 14 bp, Homo sapiens
ttattataaactgt

SEQ ID NO: 3626789 - DNA, 22 bp, Homo sapiens
ttattatcattgttcttttcaa

SEQ ID NO: 3626790 - DNA, 13 bp, Homo sapiens
ttattatctttaa

SEQ ID NO: 3626791 - DNA, 23 bp, Homo sapiens
ttattatgttcttagcaataaat

SEQ ID NO: 3626792 - DNA, 12 bp, Homo sapiens
ttattcagcctt

SEQ ID NO: 3626793 - DNA, 12 bp, Homo sapiens
ttattcattatg

SEQ ID NO: 3626794 - DNA, 14 bp, Homo sapiens
ttattccctgccca

SEQ ID NO: 3626795 - DNA, 19 bp, Homo sapiens
ttattctcttttatctgtt

SEQ ID NO: 3626796 - DNA, 20 bp, Homo sapiens
ttattgccaaaacccagctg

SEQ ID NO: 3626797 - DNA, 14 bp, Homo sapiens
ttattgctattaaa

SEQ ID NO: 3626798 - DNA, 20 bp, Homo sapiens
ttattggtggctgttcctga

SEQ ID NO: 3626799 - DNA, 20 bp, Homo sapiens
ttattggttttccaatcatt

SEQ ID NO: 3626800 - DNA, 22 bp, Homo sapiens
ttattggtttttttgtatagac

SEQ ID NO: 3626801 - DNA, 14 bp, Homo sapiens
ttattgtattttga

SEQ ID NO: 3626802 - DNA, 16 bp, Homo sapiens
ttattgtattttgatg

SEQ ID NO: 3626803 - DNA, 16 bp, Homo sapiens
ttattgtttgatgttt

SEQ ID NO: 3626804 - DNA, 15 bp, Homo sapiens
ttatttaggcttttc

SEQ ID NO: 3626805 - DNA, 14 bp, Homo sapiens
ttatttattgaaat

SEQ ID NO: 3626806 - DNA, 12 bp, Homo sapiens
ttatttatttct

SEQ ID NO: 3626807 - DNA, 18 bp, Homo sapiens
ttatttcaataaatcttt

SEQ ID NO: 3626808 - DNA, 18 bp, Homo sapiens
ttatttcaattgtttata

SEQ ID NO: 3626809 - DNA, 19 bp, Homo sapiens
ttatttctgctctggaata

SEQ ID NO: 3626810 - DNA, 21 bp, Homo sapiens
ttatttcttccctgctttgca

SEQ ID NO: 3626811 - DNA, 19 bp, Homo sapiens
ttatttgattatttaagac

SEQ ID NO: 3626812 - DNA, 20 bp, Homo sapiens
ttatttgattatttaagact

SEQ ID NO: 3626813 - DNA, 18 bp, Homo sapiens
ttattttcaagaaactga

SEQ ID NO: 3626814 - DNA, 16 bp, Homo sapiens
ttattttgatgtaaag

SEQ ID NO: 3626815 - DNA, 16 bp, Homo sapiens
ttattttgtaataaac

SEQ ID NO: 3626816 - DNA, 21 bp, Homo sapiens
ttatttttgttagcaaagatt

SEQ ID NO: 3626817 - DNA, 18 bp, Homo sapiens
ttattttttaaaaaggta

SEQ ID NO: 3626818 - DNA, 15 bp, Homo sapiens
ttcaaaaagccacag

SEQ ID NO: 3626819 - DNA, 22 bp, Homo sapiens
ttcaaaaagccacagcagagca

SEQ ID NO: 3626820 - DNA, 16 bp, Homo sapiens
ttcaaaagaagagttt

SEQ ID NO: 3626821 - DNA, 18 bp, Homo sapiens
ttcaaacagtctcaggaa

SEQ ID NO: 3626822 - DNA, 22 bp, Homo sapiens
ttcaaacattttgtatcaagga

SEQ ID NO: 3626823 - DNA, 18 bp, Homo sapiens
ttcaaagctgaatatttt

SEQ ID NO: 3626824 - DNA, 22 bp, Homo sapiens
ttcaaagctttttccagaggct

SEQ ID NO: 3626825 - DNA, 15 bp, Homo sapiens
ttcaaagtgcctggg

SEQ ID NO: 3626826 - DNA, 16 bp, Homo sapiens
ttcaaagtgcctgggc

SEQ ID NO: 3626827 - DNA, 16 bp, Homo sapiens
ttcaacagccaagctg

SEQ ID NO: 3626828 - DNA, 15 bp, Homo sapiens
ttcaaccattcccca

SEQ ID NO: 3626829 - DNA, 20 bp, Homo sapiens
ttcaaccattccccatggga

SEQ ID NO: 3626830 - DNA, 15 bp, Homo sapiens
ttcaacgcagccctg

SEQ ID NO: 3626831 - DNA, 20 bp, Homo sapiens
ttcaacgcagccctgctttg

SEQ ID NO: 3626832 - DNA, 21 bp, Homo sapiens
ttcaactgccaaaatgctcta

SEQ ID NO: 3626833 - DNA, 13 bp, Homo sapiens
ttcaagaaactga

SEQ ID NO: 3626834 - DNA, 17 bp, Homo sapiens
ttcaagacaagagctgt

SEQ ID NO: 3626835 - DNA, 13 bp, Homo sapiens
ttcaagcaaacat

SEQ ID NO: 3626836 - DNA, 17 bp, Homo sapiens
ttcaagcaatcctccta

SEQ ID NO: 3626837 - DNA, 23 bp, Homo sapiens
ttcaagctgttatttcttccctg

SEQ ID NO: 3626838 - DNA, 19 bp, Homo sapiens
ttcaaggaatttcttaact

SEQ ID NO: 3626839 - DNA, 21 bp, Homo sapiens
ttcaagtgactctcctgcctc

SEQ ID NO: 3626840 - DNA, 20 bp, Homo sapiens
ttcaagtgattctcctgcct

SEQ ID NO: 3626841 - DNA, 15 bp, Homo sapiens
ttcaatatcctttgc

SEQ ID NO: 3626842 - DNA, 11 bp, Homo sapiens
ttcaatatgca

SEQ ID NO: 3626843 - DNA, 20 bp, Homo sapiens
ttcaatctggattcatattt

SEQ ID NO: 3626844 - DNA, 12 bp, Homo sapiens
ttcaattaaacg

SEQ ID NO: 3626845 - DNA, 18 bp, Homo sapiens
ttcaattggacaattatt

SEQ ID NO: 3626846 - DNA, 21 bp, Homo sapiens
ttcacaaccttctgtggctca

SEQ ID NO: 3626847 - DNA, 20 bp, Homo sapiens
ttcacaagcctcctgtacct

SEQ ID NO: 3626848 - DNA, 16 bp, Homo sapiens
ttcacattaggctgtt

SEQ ID NO: 3626849 - DNA, 16 bp, Homo sapiens
ttcaccagtgttcctg

SEQ ID NO: 3626850 - DNA, 18 bp, Homo sapiens
ttcacccccctctgctgc

SEQ ID NO: 3626851 - DNA, 23 bp, Homo sapiens
ttcacctactaatgtctcttcta

SEQ ID NO: 3626852 - DNA, 16 bp, Homo sapiens
ttcaccttcccctaaa

SEQ ID NO: 3626853 - DNA, 14 bp, Homo sapiens
ttcacgcccttggc

SEQ ID NO: 3626854 - DNA, 15 bp, Homo sapiens
ttcactagaaaatga

SEQ ID NO: 3626855 - DNA, 21 bp, Homo sapiens
ttcactgcaaacacaccttgg

SEQ ID NO: 3626856 - DNA, 17 bp, Homo sapiens
ttcactgctggctgcct

SEQ ID NO: 3626857 - DNA, 23 bp, Homo sapiens
ttcactgctgttatatttcatca

SEQ ID NO: 3626858 - DNA, 15 bp, Homo sapiens
ttcactgtagaatga

SEQ ID NO: 3626859 - DNA, 17 bp, Homo sapiens
ttcactgtagctctaaa

SEQ ID NO: 3626860 - DNA, 22 bp, Homo sapiens
ttcacttaagttagttccactg

SEQ ID NO: 3626861 - DNA, 19 bp, Homo sapiens
ttcagaagaatcttcctgg

SEQ ID NO: 3626862 - DNA, 21 bp, Homo sapiens
ttcagaatcttttcaatgggt

SEQ ID NO: 3626863 - DNA, 23 bp, Homo sapiens
ttcagacccccccatttcccgca

SEQ ID NO: 3626864 - DNA, 17 bp, Homo sapiens
ttcagactaaaaataca

SEQ ID NO: 3626865 - DNA, 20 bp, Homo sapiens
ttcagactcccattcctgaa

SEQ ID NO: 3626866 - DNA, 18 bp, Homo sapiens
ttcagagcccccagccct

SEQ ID NO: 3626867 - DNA, 20 bp, Homo sapiens
ttcagagcccccagccctgg

SEQ ID NO: 3626868 - DNA, 13 bp, Homo sapiens
ttcagaggctcag

SEQ ID NO: 3626869 - DNA, 13 bp, Homo sapiens
ttcagatgtatgt

SEQ ID NO: 3626870 - DNA, 21 bp, Homo sapiens
ttcagattcccagagcaaaat

SEQ ID NO: 3626871 - DNA, 15 bp, Homo sapiens
ttcagcaaacttgtt

SEQ ID NO: 3626872 - DNA, 22 bp, Homo sapiens
ttcagcaaacttgttgaattta

SEQ ID NO: 3626873 - DNA, 14 bp, Homo sapiens
ttcagcaaccctac

SEQ ID NO: 3626874 - DNA, 23 bp, Homo sapiens
ttcagcaaccctacagtatataa

SEQ ID NO: 3626875 - DNA, 19 bp, Homo sapiens
ttcagcaagataaacatta

SEQ ID NO: 3626876 - DNA, 17 bp, Homo sapiens
ttcagcaggcccaagta

SEQ ID NO: 3626877 - DNA, 16 bp, Homo sapiens
ttcagcagtctaaatt

SEQ ID NO: 3626878 - DNA, 20 bp, Homo sapiens
ttcagccaggtctgactcca

SEQ ID NO: 3626879 - DNA, 12 bp, Homo sapiens
ttcagcctctgg

SEQ ID NO: 3626880 - DNA, 20 bp, Homo sapiens
ttcagctaagctaggaatga

SEQ ID NO: 3626881 - DNA, 12 bp, Homo sapiens
ttcagctctgga

SEQ ID NO: 3626882 - DNA, 13 bp, Homo sapiens
ttcagctgcccca

SEQ ID NO: 3626883 - DNA, 20 bp, Homo sapiens
ttcagctttggctctggctg

SEQ ID NO: 3626884 - DNA, 22 bp, Homo sapiens
ttcagctttggctctggctgct

SEQ ID NO: 3626885 - DNA, 20 bp, Homo sapiens
ttcaggactctctccaggag

SEQ ID NO: 3626886 - DNA, 14 bp, Homo sapiens
ttcaggagcctggc

SEQ ID NO: 3626887 - DNA, 16 bp, Homo sapiens
ttcaggagcctggcca

SEQ ID NO: 3626888 - DNA, 16 bp, Homo sapiens
ttcaggcagctgaaat

SEQ ID NO: 3626889 - DNA, 14 bp, Homo sapiens
ttcaggccagccca

SEQ ID NO: 3626890 - DNA, 15 bp, Homo sapiens
ttcaggccagcccag

SEQ ID NO: 3626891 - DNA, 18 bp, Homo sapiens
ttcaggccagcccagcca

SEQ ID NO: 3626892 - DNA, 15 bp, Homo sapiens
ttcaggctcttctcc

SEQ ID NO: 3626893 - DNA, 16 bp, Homo sapiens
ttcaggctcttctcct

SEQ ID NO: 3626894 - DNA, 17 bp, Homo sapiens
ttcagggaccgtccagg

SEQ ID NO: 3626895 - DNA, 23 bp, Homo sapiens
ttcaggtcaggtggctgtgggat

SEQ ID NO: 3626896 - DNA, 19 bp, Homo sapiens
ttcaggtctgtatgtcatg

SEQ ID NO: 3626897 - DNA, 22 bp, Homo sapiens
ttcaggtctgtatgtcatggat

SEQ ID NO: 3626898 - DNA, 19 bp, Homo sapiens
ttcagtaaacataaagcca

SEQ ID NO: 3626899 - DNA, 18 bp, Homo sapiens
ttcagtaagttctgtggt

SEQ ID NO: 3626900 - DNA, 17 bp, Homo sapiens
ttcagtcctttgtcttt

SEQ ID NO: 3626901 - DNA, 19 bp, Homo sapiens
ttcagtcctttgtctttct

SEQ ID NO: 3626902 - DNA, 14 bp, Homo sapiens
ttcagtcttggtaa

SEQ ID NO: 3626903 - DNA, 21 bp, Homo sapiens
ttcagtgaatatttttgtatt

SEQ ID NO: 3626904 - DNA, 22 bp, Homo sapiens
ttcagtgaatatttttgtattt

SEQ ID NO: 3626905 - DNA, 16 bp, Homo sapiens
ttcagtgactcctgct

SEQ ID NO: 3626906 - DNA, 22 bp, Homo sapiens
ttcagtgagcccctccccagcc

SEQ ID NO: 3626907 - DNA, 23 bp, Homo sapiens
ttcagtgagcccctccccagcca

SEQ ID NO: 3626908 - DNA, 16 bp, Homo sapiens
ttcagtgttttcattt

SEQ ID NO: 3626909 - DNA, 15 bp, Homo sapiens
ttcagttcagcttta

SEQ ID NO: 3626910 - DNA, 13 bp, Homo sapiens
ttcagttctaggc

SEQ ID NO: 3626911 - DNA, 16 bp, Homo sapiens
ttcagttgcacttcta

SEQ ID NO: 3626912 - DNA, 14 bp, Homo sapiens
ttcataatctttgc

SEQ ID NO: 3626913 - DNA, 13 bp, Homo sapiens
ttcataattctga

SEQ ID NO: 3626914 - DNA, 18 bp, Homo sapiens
ttcatacactaaccaaat

SEQ ID NO: 3626915 - DNA, 11 bp, Homo sapiens
ttcatagagaa

SEQ ID NO: 3626916 - DNA, 15 bp, Homo sapiens
ttcatagtaaaatac

SEQ ID NO: 3626917 - DNA, 13 bp, Homo sapiens
ttcatatttaatt

SEQ ID NO: 3626918 - DNA, 17 bp, Homo sapiens
ttcatatttaatttgaa

SEQ ID NO: 3626919 - DNA, 20 bp, Homo sapiens
ttcatatttaatttgaagat

SEQ ID NO: 3626920 - DNA, 16 bp, Homo sapiens
ttcatatttacttctt

SEQ ID NO: 3626921 - DNA, 16 bp, Homo sapiens
ttcatcatttcagcca

SEQ ID NO: 3626922 - DNA, 16 bp, Homo sapiens
ttcatccgcctgtggg

SEQ ID NO: 3626923 - DNA, 14 bp, Homo sapiens
ttcatctacctttt

SEQ ID NO: 3626924 - DNA, 18 bp, Homo sapiens
ttcatcttgcagcattta

SEQ ID NO: 3626925 - DNA, 14 bp, Homo sapiens
ttcatgcagctgtg

SEQ ID NO: 3626926 - DNA, 17 bp, Homo sapiens
ttcatgctatctctgtg

SEQ ID NO: 3626927 - DNA, 16 bp, Homo sapiens
ttcatggttcaagtat

SEQ ID NO: 3626928 - DNA, 20 bp, Homo sapiens
ttcatgtccagtgagcagtg

SEQ ID NO: 3626929 - DNA, 13 bp, Homo sapiens
ttcatgttagtta

SEQ ID NO: 3626930 - DNA, 15 bp, Homo sapiens
ttcattaccctacag

SEQ ID NO: 3626931 - DNA, 14 bp, Homo sapiens
ttcattagttttga

SEQ ID NO: 3626932 - DNA, 22 bp, Homo sapiens
ttcattatggtagaatcatttt

SEQ ID NO: 3626933 - DNA, 21 bp, Homo sapiens
ttcattctcgtgagtcattta

SEQ ID NO: 3626934 - DNA, 20 bp, Homo sapiens
ttcattctttactgcactca

SEQ ID NO: 3626935 - DNA, 22 bp, Homo sapiens
ttcattctttactgcactcaga

SEQ ID NO: 3626936 - DNA, 19 bp, Homo sapiens
ttcattggtactgccttaa

SEQ ID NO: 3626937 - DNA, 17 bp, Homo sapiens
ttcatttatctataatt

SEQ ID NO: 3626938 - DNA, 18 bp, Homo sapiens
ttcatttgtaaaaatgag

SEQ ID NO: 3626939 - DNA, 22 bp, Homo sapiens
ttcattttgcactgaggatatt

SEQ ID NO: 3626940 - DNA, 16 bp, Homo sapiens
ttccaaaatccaaaaa

SEQ ID NO: 3626941 - DNA, 14 bp, Homo sapiens
ttccaaataaataa

SEQ ID NO: 3626942 - DNA, 18 bp, Homo sapiens
ttccaactactaatagaa

SEQ ID NO: 3626943 - DNA, 19 bp, Homo sapiens
ttccaaggctttaaagctg

SEQ ID NO: 3626944 - DNA, 13 bp, Homo sapiens
ttccaatcactgt

SEQ ID NO: 3626945 - DNA, 22 bp, Homo sapiens
ttccaatttacatactctgctt

SEQ ID NO: 3626946 - DNA, 13 bp, Homo sapiens
ttccaattttcct

SEQ ID NO: 3626947 - DNA, 14 bp, Homo sapiens
ttccaattttcctt

SEQ ID NO: 3626948 - DNA, 21 bp, Homo sapiens
ttccacagcctgcaagtcagt

SEQ ID NO: 3626949 - DNA, 19 bp, Homo sapiens
ttccaccataccttagaga

SEQ ID NO: 3626950 - DNA, 21 bp, Homo sapiens
ttccacccacaaactccaggc

SEQ ID NO: 3626951 - DNA, 23 bp, Homo sapiens
ttccacccacaaactccaggctg

SEQ ID NO: 3626952 - DNA, 19 bp, Homo sapiens
ttccacctcacctctttgt

SEQ ID NO: 3626953 - DNA, 19 bp, Homo sapiens
ttccactaccaaaagacat

SEQ ID NO: 3626954 - DNA, 20 bp, Homo sapiens
ttccactaccaaaagacatt

SEQ ID NO: 3626955 - DNA, 21 bp, Homo sapiens
ttccactaccaaaagacatta

SEQ ID NO: 3626956 - DNA, 13 bp, Homo sapiens
ttccactgagacc

SEQ ID NO: 3626957 - DNA, 17 bp, Homo sapiens
ttccacttgagtgtcaa

SEQ ID NO: 3626958 - DNA, 14 bp, Homo sapiens
ttccagaatgacct

SEQ ID NO: 3626959 - DNA, 19 bp, Homo sapiens
ttccagagagtggctcctc

SEQ ID NO: 3626960 - DNA, 14 bp, Homo sapiens
ttccagattcctat

SEQ ID NO: 3626961 - DNA, 16 bp, Homo sapiens
ttccagattcctatga

SEQ ID NO: 3626962 - DNA, 23 bp, Homo sapiens
ttccagctccgtgtttctctaag

SEQ ID NO: 3626963 - DNA, 19 bp, Homo sapiens
ttccagcttgcattgattg

SEQ ID NO: 3626964 - DNA, 12 bp, Homo sapiens
ttccagggcagc

SEQ ID NO: 3626965 - DNA, 14 bp, Homo sapiens
ttccagtaaggatt

SEQ ID NO: 3626966 - DNA, 22 bp, Homo sapiens
ttccagtaaggatttttatgta

SEQ ID NO: 3626967 - DNA, 14 bp, Homo sapiens
ttccagtattgaaa

SEQ ID NO: 3626968 - DNA, 21 bp, Homo sapiens
ttccagtattgaaaacttcaa

SEQ ID NO: 3626969 - DNA, 13 bp, Homo sapiens
ttccagtgtctgt

SEQ ID NO: 3626970 - DNA, 14 bp, Homo sapiens
ttccagtgtctgtc

SEQ ID NO: 3626971 - DNA, 23 bp, Homo sapiens
ttccataatctggactcctctgt

SEQ ID NO: 3626972 - DNA, 16 bp, Homo sapiens
ttccatgatgcacagt

SEQ ID NO: 3626973 - DNA, 20 bp, Homo sapiens
ttccatgatgcacagtatct

SEQ ID NO: 3626974 - DNA, 14 bp, Homo sapiens
ttccatgcaactgg

SEQ ID NO: 3626975 - DNA, 21 bp, Homo sapiens
ttccatgtcgcctctgcattc

SEQ ID NO: 3626976 - DNA, 22 bp, Homo sapiens
ttccatgtgcctttctttgcct

SEQ ID NO: 3626977 - DNA, 21 bp, Homo sapiens
ttccatgttttttcttcaaat

SEQ ID NO: 3626978 - DNA, 13 bp, Homo sapiens
ttccattacacca

SEQ ID NO: 3626979 - DNA, 18 bp, Homo sapiens
ttccattacaccacagca

SEQ ID NO: 3626980 - DNA, 16 bp, Homo sapiens
ttccatttattaagca

SEQ ID NO: 3626981 - DNA, 11 bp, Homo sapiens
ttccatttctg

SEQ ID NO: 3626982 - DNA, 12 bp, Homo sapiens
ttccatttctga

SEQ ID NO: 3626983 - DNA, 14 bp, Homo sapiens
ttccatttctgatg

SEQ ID NO: 3626984 - DNA, 15 bp, Homo sapiens
ttcccaacgtgcaaa

SEQ ID NO: 3626985 - DNA, 20 bp, Homo sapiens
ttcccaacttctcttgcttt

SEQ ID NO: 3626986 - DNA, 13 bp, Homo sapiens
ttcccaagggaga

SEQ ID NO: 3626987 - DNA, 23 bp, Homo sapiens
ttcccagagcaaaataattttaa

SEQ ID NO: 3626988 - DNA, 12 bp, Homo sapiens
ttcccagcctga

SEQ ID NO: 3626989 - DNA, 21 bp, Homo sapiens
ttcccagctacacctttctcc

SEQ ID NO: 3626990 - DNA, 14 bp, Homo sapiens
ttccccactccccc

SEQ ID NO: 3626991 - DNA, 22 bp, Homo sapiens
ttccccagacttctctttctta

SEQ ID NO: 3626992 - DNA, 12 bp, Homo sapiens
ttccccagagaa

SEQ ID NO: 3626993 - DNA, 17 bp, Homo sapiens
ttccccagtgactccag

SEQ ID NO: 3626994 - DNA, 14 bp, Homo sapiens
ttcccccactaccg

SEQ ID NO: 3626995 - DNA, 21 bp, Homo sapiens
ttccccccattttgcctctgt

SEQ ID NO: 3626996 - DNA, 14 bp, Homo sapiens
ttccccctccccca

SEQ ID NO: 3626997 - DNA, 22 bp, Homo sapiens
ttccccctgtttcagaggctca

SEQ ID NO: 3626998 - DNA, 13 bp, Homo sapiens
ttccccttccctt

SEQ ID NO: 3626999 - DNA, 13 bp, Homo sapiens
ttcccgcacatgg

SEQ ID NO: 3627000 - DNA, 12 bp, Homo sapiens
ttcccgctcagc

SEQ ID NO: 3627001 - DNA, 16 bp, Homo sapiens
ttcccgctcagccctc

SEQ ID NO: 3627002 - DNA, 21 bp, Homo sapiens
ttcccgctcagccctccctgc

SEQ ID NO: 3627003 - DNA, 16 bp, Homo sapiens
ttccctacttcctgtg

SEQ ID NO: 3627004 - DNA, 21 bp, Homo sapiens
ttccctcaccttggcaccaga

SEQ ID NO: 3627005 - DNA, 11 bp, Homo sapiens
ttccctcaggc

SEQ ID NO: 3627006 - DNA, 20 bp, Homo sapiens
ttccctccatttttctccca

SEQ ID NO: 3627007 - DNA, 23 bp, Homo sapiens
ttccctccatttttctcccaaga

SEQ ID NO: 3627008 - DNA, 23 bp, Homo sapiens
ttccctgcccaaacccttaactg

SEQ ID NO: 3627009 - DNA, 11 bp, Homo sapiens
ttccctgctga

SEQ ID NO: 3627010 - DNA, 13 bp, Homo sapiens
ttccctgctgaat

SEQ ID NO: 3627011 - DNA, 12 bp, Homo sapiens
ttccctgctgcg

SEQ ID NO: 3627012 - DNA, 23 bp, Homo sapiens
ttccctggaaaccttccacccag

SEQ ID NO: 3627013 - DNA, 21 bp, Homo sapiens
ttccctgggtttgggagccag

SEQ ID NO: 3627014 - DNA, 23 bp, Homo sapiens
ttcccttctcttctaacatgaaa

SEQ ID NO: 3627015 - DNA, 23 bp, Homo sapiens
ttccgctttgaaagaagcaagac

SEQ ID NO: 3627016 - DNA, 22 bp, Homo sapiens
ttccgggcagaaacaataaaac

SEQ ID NO: 3627017 - DNA, 15 bp, Homo sapiens
ttccggggagaaacc

SEQ ID NO: 3627018 - DNA, 16 bp, Homo sapiens
ttccgtgaactctggt

SEQ ID NO: 3627019 - DNA, 18 bp, Homo sapiens
ttcctagccctctcacat

SEQ ID NO: 3627020 - DNA, 13 bp, Homo sapiens
ttcctatcacctc

SEQ ID NO: 3627021 - DNA, 22 bp, Homo sapiens
ttcctatcacctcgagaagtaa

SEQ ID NO: 3627022 - DNA, 15 bp, Homo sapiens
ttcctcacacccctg

SEQ ID NO: 3627023 - DNA, 16 bp, Homo sapiens
ttcctcagctgcctcc

SEQ ID NO: 3627024 - DNA, 17 bp, Homo sapiens
ttcctcagtgatggaat

SEQ ID NO: 3627025 - DNA, 15 bp, Homo sapiens
ttcctccagcctccc

SEQ ID NO: 3627026 - DNA, 18 bp, Homo sapiens
ttcctccagcctcccctc

SEQ ID NO: 3627027 - DNA, 13 bp, Homo sapiens
ttcctccagctgg

SEQ ID NO: 3627028 - DNA, 11 bp, Homo sapiens
ttcctcccttc

SEQ ID NO: 3627029 - DNA, 19 bp, Homo sapiens
ttcctcctcccaaggcatt

SEQ ID NO: 3627030 - DNA, 18 bp, Homo sapiens
ttcctcctttacctttca

SEQ ID NO: 3627031 - DNA, 13 bp, Homo sapiens
ttcctctccactg

SEQ ID NO: 3627032 - DNA, 18 bp, Homo sapiens
ttcctctccactgccttc

SEQ ID NO: 3627033 - DNA, 14 bp, Homo sapiens
ttcctctgcacgct

SEQ ID NO: 3627034 - DNA, 14 bp, Homo sapiens
ttcctctgcagttt

SEQ ID NO: 3627035 - DNA, 16 bp, Homo sapiens
ttcctctgttcttttc

SEQ ID NO: 3627036 - DNA, 20 bp, Homo sapiens
ttcctcttctattttgtaaa

SEQ ID NO: 3627037 - DNA, 22 bp, Homo sapiens
ttcctctttgctttgctttctg

SEQ ID NO: 3627038 - DNA, 18 bp, Homo sapiens
ttcctgaaacaacttgga

SEQ ID NO: 3627039 - DNA, 11 bp, Homo sapiens
ttcctgaaatg

SEQ ID NO: 3627040 - DNA, 12 bp, Homo sapiens
ttcctgaagctg

SEQ ID NO: 3627041 - DNA, 19 bp, Homo sapiens
ttcctgaagctgctgtgtc

SEQ ID NO: 3627042 - DNA, 21 bp, Homo sapiens
ttcctgaggaagagggactgt

SEQ ID NO: 3627043 - DNA, 18 bp, Homo sapiens
ttcctgctgcaccctgcg

SEQ ID NO: 3627044 - DNA, 16 bp, Homo sapiens
ttcctgctgctgctac

SEQ ID NO: 3627045 - DNA, 17 bp, Homo sapiens
ttcctgctgctgctact

SEQ ID NO: 3627046 - DNA, 18 bp, Homo sapiens
ttcctggaaacagcatga

SEQ ID NO: 3627047 - DNA, 21 bp, Homo sapiens
ttcctggaaacagcatgaata

SEQ ID NO: 3627048 - DNA, 12 bp, Homo sapiens
ttcctggcacaa

SEQ ID NO: 3627049 - DNA, 14 bp, Homo sapiens
ttcctggcagctgc

SEQ ID NO: 3627050 - DNA, 10 bp, Homo sapiens
ttcctggcat

SEQ ID NO: 3627051 - DNA, 16 bp, Homo sapiens
ttcctgggcacacgct

SEQ ID NO: 3627052 - DNA, 22 bp, Homo sapiens
ttcctgggcacacgctgctctg

SEQ ID NO: 3627053 - DNA, 22 bp, Homo sapiens
ttcctggtttaattcagcagag

SEQ ID NO: 3627054 - DNA, 17 bp, Homo sapiens
ttcctgtccagctccaa

SEQ ID NO: 3627055 - DNA, 22 bp, Homo sapiens
ttcctgtccagctccaacctgc

SEQ ID NO: 3627056 - DNA, 15 bp, Homo sapiens
ttcctgtcccacatg

SEQ ID NO: 3627057 - DNA, 24 bp, Homo sapiens
ttcctgtgaagtttaattgtctca

SEQ ID NO: 3627058 - DNA, 15 bp, Homo sapiens
ttcctgtgccctaga

SEQ ID NO: 3627059 - DNA, 19 bp, Homo sapiens
ttcctgtttcagacccccc

SEQ ID NO: 3627060 - DNA, 22 bp, Homo sapiens
ttccttaggtttttttccttct

SEQ ID NO: 3627061 - DNA, 11 bp, Homo sapiens
ttccttcaggc

SEQ ID NO: 3627062 - DNA, 15 bp, Homo sapiens
ttccttcaggcagct

SEQ ID NO: 3627063 - DNA, 20 bp, Homo sapiens
ttccttcaggcagctgaaat

SEQ ID NO: 3627064 - DNA, 10 bp, Homo sapiens
ttccttctct

SEQ ID NO: 3627065 - DNA, 11 bp, Homo sapiens
ttccttctctg

SEQ ID NO: 3627066 - DNA, 13 bp, Homo sapiens
ttccttctgaagt

SEQ ID NO: 3627067 - DNA, 20 bp, Homo sapiens
ttccttctgaagtctgagcc

SEQ ID NO: 3627068 - DNA, 16 bp, Homo sapiens
ttcctttactcctggc

SEQ ID NO: 3627069 - DNA, 19 bp, Homo sapiens
ttcctttgcatattataaa

SEQ ID NO: 3627070 - DNA, 14 bp, Homo sapiens
ttcctttgctagtt

SEQ ID NO: 3627071 - DNA, 20 bp, Homo sapiens
ttccttttaaaacacttcca

SEQ ID NO: 3627072 - DNA, 15 bp, Homo sapiens
ttcctttttcttcgc

SEQ ID NO: 3627073 - DNA, 19 bp, Homo sapiens
ttccttttttcaatatgca

SEQ ID NO: 3627074 - DNA, 23 bp, Homo sapiens
ttccttttttcaatatgcaagca

SEQ ID NO: 3627075 - DNA, 22 bp, Homo sapiens
ttcgaagccttgcctaaattta

SEQ ID NO: 3627076 - DNA, 23 bp, Homo sapiens
ttcgaatcttaatttattatttt

SEQ ID NO: 3627077 - DNA, 17 bp, Homo sapiens
ttcgactcagcctcagg

SEQ ID NO: 3627078 - DNA, 12 bp, Homo sapiens
ttcgactggtcc

SEQ ID NO: 3627079 - DNA, 13 bp, Homo sapiens
ttcgactggtcca

SEQ ID NO: 3627080 - DNA, 18 bp, Homo sapiens
ttcgactggtccagctct

SEQ ID NO: 3627081 - DNA, 19 bp, Homo sapiens
ttcgactggtccagctctg

SEQ ID NO: 3627082 - DNA, 19 bp, Homo sapiens
ttcgagaccagcctggcca

SEQ ID NO: 3627083 - DNA, 20 bp, Homo sapiens
ttcgataaacaacaaggtgg

SEQ ID NO: 3627084 - DNA, 23 bp, Homo sapiens
ttcgctggactattgtgccaact

SEQ ID NO: 3627085 - DNA, 20 bp, Homo sapiens
ttcggcagatactgtctctt

SEQ ID NO: 3627086 - DNA, 22 bp, Homo sapiens
ttcggctgcttttatgtagttt

SEQ ID NO: 3627087 - DNA, 21 bp, Homo sapiens
ttcgggagccttgtcagtgtg

SEQ ID NO: 3627088 - DNA, 22 bp, Homo sapiens
ttcggtggctagtcaagctcct

SEQ ID NO: 3627089 - DNA, 20 bp, Homo sapiens
ttcgtacataataagtttca

SEQ ID NO: 3627090 - DNA, 12 bp, Homo sapiens
ttctaaaacaat

SEQ ID NO: 3627091 - DNA, 19 bp, Homo sapiens
ttctaaaacaataaagatt

SEQ ID NO: 3627092 - DNA, 15 bp, Homo sapiens
ttctaaaatgttaaa

SEQ ID NO: 3627093 - DNA, 12 bp, Homo sapiens
ttctaacatgaa

SEQ ID NO: 3627094 - DNA, 13 bp, Homo sapiens
ttctaacatgaaa

SEQ ID NO: 3627095 - DNA, 15 bp, Homo sapiens
ttctaacatgaaata

SEQ ID NO: 3627096 - DNA, 16 bp, Homo sapiens
ttctaagtaaaaccac

SEQ ID NO: 3627097 - DNA, 21 bp, Homo sapiens
ttctaagtaaaaccacagcag

SEQ ID NO: 3627098 - DNA, 18 bp, Homo sapiens
ttctaatgccttttgaat

SEQ ID NO: 3627099 - DNA, 18 bp, Homo sapiens
ttctaatgttattttcct

SEQ ID NO: 3627100 - DNA, 18 bp, Homo sapiens
ttctaattggctttacta

SEQ ID NO: 3627101 - DNA, 15 bp, Homo sapiens
ttctacatactatgg

SEQ ID NO: 3627102 - DNA, 19 bp, Homo sapiens
ttctaccgtggatttgtac

SEQ ID NO: 3627103 - DNA, 19 bp, Homo sapiens
ttctactaagttattttat

SEQ ID NO: 3627104 - DNA, 16 bp, Homo sapiens
ttctactatgatcaga

SEQ ID NO: 3627105 - DNA, 18 bp, Homo sapiens
ttctagctctcacagaca

SEQ ID NO: 3627106 - DNA, 20 bp, Homo sapiens
ttctaggcatacttttcaaa

SEQ ID NO: 3627107 - DNA, 16 bp, Homo sapiens
ttctagggtccctgaa

SEQ ID NO: 3627108 - DNA, 11 bp, Homo sapiens
ttctagtgtcc

SEQ ID NO: 3627109 - DNA, 16 bp, Homo sapiens
ttctagtgtccataaa

SEQ ID NO: 3627110 - DNA, 21 bp, Homo sapiens
ttctagtgtccataaataaag

SEQ ID NO: 3627111 - DNA, 22 bp, Homo sapiens
ttctagttgcccccattcccag

SEQ ID NO: 3627112 - DNA, 13 bp, Homo sapiens
ttctatatgaatg

SEQ ID NO: 3627113 - DNA, 18 bp, Homo sapiens
ttctatatgaatgctatt

SEQ ID NO: 3627114 - DNA, 19 bp, Homo sapiens
ttctatattcctccagctg

SEQ ID NO: 3627115 - DNA, 12 bp, Homo sapiens
ttctatgtatta

SEQ ID NO: 3627116 - DNA, 15 bp, Homo sapiens
ttctatgtgacattt

SEQ ID NO: 3627117 - DNA, 15 bp, Homo sapiens
ttctatgttaatatt

SEQ ID NO: 3627118 - DNA, 21 bp, Homo sapiens
ttctatttatttatttattca

SEQ ID NO: 3627119 - DNA, 17 bp, Homo sapiens
ttctatttgcctccagt

SEQ ID NO: 3627120 - DNA, 17 bp, Homo sapiens
ttctattttactgtctt

SEQ ID NO: 3627121 - DNA, 22 bp, Homo sapiens
ttctcaaagagaattgtatgta

SEQ ID NO: 3627122 - DNA, 19 bp, Homo sapiens
ttctcaaagttttattata

SEQ ID NO: 3627123 - DNA, 12 bp, Homo sapiens
ttctcaaatctt

SEQ ID NO: 3627124 - DNA, 16 bp, Homo sapiens
ttctcactcctacctg

SEQ ID NO: 3627125 - DNA, 12 bp, Homo sapiens
ttctcactgcca

SEQ ID NO: 3627126 - DNA, 14 bp, Homo sapiens
ttctcactgccatg

SEQ ID NO: 3627127 - DNA, 15 bp, Homo sapiens
ttctcagctgtgcct

SEQ ID NO: 3627128 - DNA, 22 bp, Homo sapiens
ttctcagggctggagcctgggg

SEQ ID NO: 3627129 - DNA, 16 bp, Homo sapiens
ttctcataattttgca

SEQ ID NO: 3627130 - DNA, 13 bp, Homo sapiens
ttctcatgttgaa

SEQ ID NO: 3627131 - DNA, 12 bp, Homo sapiens
ttctccatcccc

SEQ ID NO: 3627132 - DNA, 20 bp, Homo sapiens
ttctccatcccctccctgcc

SEQ ID NO: 3627133 - DNA, 21 bp, Homo sapiens
ttctccatcccctccctgcct

SEQ ID NO: 3627134 - DNA, 14 bp, Homo sapiens
ttctccatggagcc

SEQ ID NO: 3627135 - DNA, 15 bp, Homo sapiens
ttctccatgttggtc

SEQ ID NO: 3627136 - DNA, 22 bp, Homo sapiens
ttctcccacatgaggccatctc

SEQ ID NO: 3627137 - DNA, 14 bp, Homo sapiens
ttctccctttctct

SEQ ID NO: 3627138 - DNA, 14 bp, Homo sapiens
ttctcctaaagctt

SEQ ID NO: 3627139 - DNA, 20 bp, Homo sapiens
ttctcctgatgttttgccgt

SEQ ID NO: 3627140 - DNA, 12 bp, Homo sapiens
ttctccttttcc

SEQ ID NO: 3627141 - DNA, 14 bp, Homo sapiens
ttctccttttccta

SEQ ID NO: 3627142 - DNA, 18 bp, Homo sapiens
ttctctaatgcttgattt

SEQ ID NO: 3627143 - DNA, 15 bp, Homo sapiens
ttctctagtcatttg

SEQ ID NO: 3627144 - DNA, 12 bp, Homo sapiens
ttctctccagct

SEQ ID NO: 3627145 - DNA, 10 bp, Homo sapiens
ttctctcttt

SEQ ID NO: 3627146 - DNA, 17 bp, Homo sapiens
ttctctgcctcacctgg

SEQ ID NO: 3627147 - DNA, 12 bp, Homo sapiens
ttctctgggctt

SEQ ID NO: 3627148 - DNA, 19 bp, Homo sapiens
ttctctggtaatattgact

SEQ ID NO: 3627149 - DNA, 21 bp, Homo sapiens
ttctcttaggtggctctggga

SEQ ID NO: 3627150 - DNA, 22 bp, Homo sapiens
ttctcttaggtggctctgggaa

SEQ ID NO: 3627151 - DNA, 17 bp, Homo sapiens
ttctcttccccttagaa

SEQ ID NO: 3627152 - DNA, 22 bp, Homo sapiens
ttctctttcttattttgtaata

SEQ ID NO: 3627153 - DNA, 22 bp, Homo sapiens
ttctgaaaaagacataaaacag

SEQ ID NO: 3627154 - DNA, 21 bp, Homo sapiens
ttctgaaccctccaaaggaac

SEQ ID NO: 3627155 - DNA, 23 bp, Homo sapiens
ttctgaagatcagaacattcagc

SEQ ID NO: 3627156 - DNA, 14 bp, Homo sapiens
ttctgagacagctt

SEQ ID NO: 3627157 - DNA, 13 bp, Homo sapiens
ttctgaggccaga

SEQ ID NO: 3627158 - DNA, 19 bp, Homo sapiens
ttctgataaaagatggcca

SEQ ID NO: 3627159 - DNA, 18 bp, Homo sapiens
ttctgatgaatctcaaag

SEQ ID NO: 3627160 - DNA, 12 bp, Homo sapiens
ttctgattctga

SEQ ID NO: 3627161 - DNA, 18 bp, Homo sapiens
ttctgattgctatcagca

SEQ ID NO: 3627162 - DNA, 16 bp, Homo sapiens
ttctgcctgccagctg

SEQ ID NO: 3627163 - DNA, 22 bp, Homo sapiens
ttctgcctgccagctgcactga

SEQ ID NO: 3627164 - DNA, 12 bp, Homo sapiens
ttctgccttttc

SEQ ID NO: 3627165 - DNA, 18 bp, Homo sapiens
ttctgcgctgtgtacaat

SEQ ID NO: 3627166 - DNA, 23 bp, Homo sapiens
ttctgcgctgtgtacaatgtgag

SEQ ID NO: 3627167 - DNA, 14 bp, Homo sapiens
ttctgctcctgctt

SEQ ID NO: 3627168 - DNA, 13 bp, Homo sapiens
ttctgctctggaa

SEQ ID NO: 3627169 - DNA, 14 bp, Homo sapiens
ttctgctctggaat

SEQ ID NO: 3627170 - DNA, 17 bp, Homo sapiens
ttctgctctggaataaa

SEQ ID NO: 3627171 - DNA, 16 bp, Homo sapiens
ttctgctcttttcctg

SEQ ID NO: 3627172 - DNA, 17 bp, Homo sapiens
ttctgctcttttcctgg

SEQ ID NO: 3627173 - DNA, 21 bp, Homo sapiens
ttctggcaaaaaggagccttt

SEQ ID NO: 3627174 - DNA, 19 bp, Homo sapiens
ttctggcgcccctgcctgt

SEQ ID NO: 3627175 - DNA, 22 bp, Homo sapiens
ttctggcgcccctgcctgtgcc

SEQ ID NO: 3627176 - DNA, 21 bp, Homo sapiens
ttctgggaagggagagttctt

SEQ ID NO: 3627177 - DNA, 18 bp, Homo sapiens
ttctgggtgctagatcca

SEQ ID NO: 3627178 - DNA, 19 bp, Homo sapiens
ttctggtgttgactggact

SEQ ID NO: 3627179 - DNA, 22 bp, Homo sapiens
ttctggtgtttggtttcttcat

SEQ ID NO: 3627180 - DNA, 12 bp, Homo sapiens
ttctgtaccagt

SEQ ID NO: 3627181 - DNA, 14 bp, Homo sapiens
ttctgtaccagtta

SEQ ID NO: 3627182 - DNA, 20 bp, Homo sapiens
ttctgtagattcatgcaagt

SEQ ID NO: 3627183 - DNA, 13 bp, Homo sapiens
ttctgtcctgggc

SEQ ID NO: 3627184 - DNA, 14 bp, Homo sapiens
ttctgtcctgggca

SEQ ID NO: 3627185 - DNA, 19 bp, Homo sapiens
ttctgtctggggacgaagg

SEQ ID NO: 3627186 - DNA, 23 bp, Homo sapiens
ttctgtgctgttacagttttctt

SEQ ID NO: 3627187 - DNA, 22 bp, Homo sapiens
ttctgtggtttcatgttagtta

SEQ ID NO: 3627188 - DNA, 14 bp, Homo sapiens
ttctgtttgattct

SEQ ID NO: 3627189 - DNA, 15 bp, Homo sapiens
ttcttaaaagtttct

SEQ ID NO: 3627190 - DNA, 20 bp, Homo sapiens
ttcttaaaatgtcctatgta

SEQ ID NO: 3627191 - DNA, 15 bp, Homo sapiens
ttcttactaaaaagt

SEQ ID NO: 3627192 - DNA, 19 bp, Homo sapiens
ttcttagagtgtagctgta

SEQ ID NO: 3627193 - DNA, 21 bp, Homo sapiens
ttcttatacatttgataaagt

SEQ ID NO: 3627194 - DNA, 15 bp, Homo sapiens
ttcttatttcatttc

SEQ ID NO: 3627195 - DNA, 20 bp, Homo sapiens
ttcttattttgtaataaact

SEQ ID NO: 3627196 - DNA, 16 bp, Homo sapiens
ttcttcactctggctt

SEQ ID NO: 3627197 - DNA, 19 bp, Homo sapiens
ttcttcagcgtaaaatggt

SEQ ID NO: 3627198 - DNA, 22 bp, Homo sapiens
ttcttcagtcctttgtctttct

SEQ ID NO: 3627199 - DNA, 20 bp, Homo sapiens
ttcttcatctttgccatatg

SEQ ID NO: 3627200 - DNA, 20 bp, Homo sapiens
ttcttcccaatagcaaggct

SEQ ID NO: 3627201 - DNA, 17 bp, Homo sapiens
ttcttcccactttcatc

SEQ ID NO: 3627202 - DNA, 13 bp, Homo sapiens
ttcttccctgctt

SEQ ID NO: 3627203 - DNA, 12 bp, Homo sapiens
ttcttcctctgc

SEQ ID NO: 3627204 - DNA, 14 bp, Homo sapiens
ttcttcctgtgaag

SEQ ID NO: 3627205 - DNA, 19 bp, Homo sapiens
ttcttctttctttcttttg

SEQ ID NO: 3627206 - DNA, 12 bp, Homo sapiens
ttcttcttttcc

SEQ ID NO: 3627207 - DNA, 20 bp, Homo sapiens
ttcttgataattttccttta

SEQ ID NO: 3627208 - DNA, 21 bp, Homo sapiens
ttcttgctgccatgatgtata

SEQ ID NO: 3627209 - DNA, 15 bp, Homo sapiens
ttcttggcccaggat

SEQ ID NO: 3627210 - DNA, 19 bp, Homo sapiens
ttcttgggatagtgttctg

SEQ ID NO: 3627211 - DNA, 23 bp, Homo sapiens
ttcttgggcctcaggctctgcac

SEQ ID NO: 3627212 - DNA, 22 bp, Homo sapiens
ttcttgggggaggccaccccaa

SEQ ID NO: 3627213 - DNA, 13 bp, Homo sapiens
ttcttgtatttat

SEQ ID NO: 3627214 - DNA, 18 bp, Homo sapiens
ttctttactgcactcaga

SEQ ID NO: 3627215 - DNA, 18 bp, Homo sapiens
ttctttataattctactt

SEQ ID NO: 3627216 - DNA, 22 bp, Homo sapiens
ttctttccagtatggaaggatt

SEQ ID NO: 3627217 - DNA, 16 bp, Homo sapiens
ttctttccggccaagg

SEQ ID NO: 3627218 - DNA, 19 bp, Homo sapiens
ttctttccgtcaccctggg

SEQ ID NO: 3627219 - DNA, 12 bp, Homo sapiens
ttctttctccat

SEQ ID NO: 3627220 - DNA, 15 bp, Homo sapiens
ttctttctgtcttta

SEQ ID NO: 3627221 - DNA, 13 bp, Homo sapiens
ttctttcttcctc

SEQ ID NO: 3627222 - DNA, 12 bp, Homo sapiens
ttctttctttct

SEQ ID NO: 3627223 - DNA, 17 bp, Homo sapiens
ttctttgaataaatgtc

SEQ ID NO: 3627224 - DNA, 18 bp, Homo sapiens
ttctttgaataaatgtca

SEQ ID NO: 3627225 - DNA, 15 bp, Homo sapiens
ttctttgaatttact

SEQ ID NO: 3627226 - DNA, 18 bp, Homo sapiens
ttctttgccatctctgct

SEQ ID NO: 3627227 - DNA, 14 bp, Homo sapiens
ttctttgctgcccc

SEQ ID NO: 3627228 - DNA, 13 bp, Homo sapiens
ttctttgggccag

SEQ ID NO: 3627229 - DNA, 22 bp, Homo sapiens
ttctttgtacacccatgaaaga

SEQ ID NO: 3627230 - DNA, 15 bp, Homo sapiens
ttctttgtcattcag

SEQ ID NO: 3627231 - DNA, 18 bp, Homo sapiens
ttctttgtcattcagttc

SEQ ID NO: 3627232 - DNA, 19 bp, Homo sapiens
ttctttgtcattcagttct

SEQ ID NO: 3627233 - DNA, 22 bp, Homo sapiens
ttctttgtcattcagttctagg

SEQ ID NO: 3627234 - DNA, 12 bp, Homo sapiens
ttctttgtgcct

SEQ ID NO: 3627235 - DNA, 13 bp, Homo sapiens
ttctttgtgcctt

SEQ ID NO: 3627236 - DNA, 16 bp, Homo sapiens
ttctttgtgcctttgg

SEQ ID NO: 3627237 - DNA, 12 bp, Homo sapiens
ttctttgtgtag

SEQ ID NO: 3627238 - DNA, 12 bp, Homo sapiens
ttctttgtttcc

SEQ ID NO: 3627239 - DNA, 13 bp, Homo sapiens
ttctttttctgag

SEQ ID NO: 3627240 - DNA, 19 bp, Homo sapiens
ttctttttctgagacagct

SEQ ID NO: 3627241 - DNA, 14 bp, Homo sapiens
ttctttttgaaatg

SEQ ID NO: 3627242 - DNA, 14 bp, Homo sapiens
ttctttttgccagt

SEQ ID NO: 3627243 - DNA, 17 bp, Homo sapiens
ttcttttttaaaatcaa

SEQ ID NO: 3627244 - DNA, 13 bp, Homo sapiens
ttgaaaacttcaa

SEQ ID NO: 3627245 - DNA, 16 bp, Homo sapiens
ttgaaaacttcaaagc

SEQ ID NO: 3627246 - DNA, 18 bp, Homo sapiens
ttgaaaagactccaaaga

SEQ ID NO: 3627247 - DNA, 23 bp, Homo sapiens
ttgaaaataaatcttagtgttca

SEQ ID NO: 3627248 - DNA, 17 bp, Homo sapiens
ttgaaacacaataccta

SEQ ID NO: 3627249 - DNA, 14 bp, Homo sapiens
ttgaaactttaaga

SEQ ID NO: 3627250 - DNA, 19 bp, Homo sapiens
ttgaaatgaggtctgttta

SEQ ID NO: 3627251 - DNA, 17 bp, Homo sapiens
ttgaaattatgtgacat

SEQ ID NO: 3627252 - DNA, 17 bp, Homo sapiens
ttgaacccaggagttca

SEQ ID NO: 3627253 - DNA, 17 bp, Homo sapiens
ttgaacgagcagcccag

SEQ ID NO: 3627254 - DNA, 19 bp, Homo sapiens
ttgaacgagcagcccaggg

SEQ ID NO: 3627255 - DNA, 22 bp, Homo sapiens
ttgaacgcccccccccacccct

SEQ ID NO: 3627256 - DNA, 16 bp, Homo sapiens
ttgaagaaggcaaggc

SEQ ID NO: 3627257 - DNA, 19 bp, Homo sapiens
ttgaagaccaatcaaatat

SEQ ID NO: 3627258 - DNA, 15 bp, Homo sapiens
ttgaagcaactgtga

SEQ ID NO: 3627259 - DNA, 12 bp, Homo sapiens
ttgaagcatgaa

SEQ ID NO: 3627260 - DNA, 19 bp, Homo sapiens
ttgaaggtagaatgttttc

SEQ ID NO: 3627261 - DNA, 23 bp, Homo sapiens
ttgaaggtgctgacggccaggga

SEQ ID NO: 3627262 - DNA, 21 bp, Homo sapiens
ttgaagtgcagctcatgtttt

SEQ ID NO: 3627263 - DNA, 17 bp, Homo sapiens
ttgaataaatgtcactt

SEQ ID NO: 3627264 - DNA, 19 bp, Homo sapiens
ttgaatacatttgtattta

SEQ ID NO: 3627265 - DNA, 14 bp, Homo sapiens
ttgaatctatttca

SEQ ID NO: 3627266 - DNA, 16 bp, Homo sapiens
ttgaattagtatttca

SEQ ID NO: 3627267 - DNA, 13 bp, Homo sapiens
ttgacacaggtct

SEQ ID NO: 3627268 - DNA, 19 bp, Homo sapiens
ttgacacaggtctttccta

SEQ ID NO: 3627269 - DNA, 23 bp, Homo sapiens
ttgacactgctctaacagccctc

SEQ ID NO: 3627270 - DNA, 21 bp, Homo sapiens
ttgacagcaattcatggttca

SEQ ID NO: 3627271 - DNA, 19 bp, Homo sapiens
ttgacagctttgctgctga

SEQ ID NO: 3627272 - DNA, 19 bp, Homo sapiens
ttgacaggattattggaaa

SEQ ID NO: 3627273 - DNA, 19 bp, Homo sapiens
ttgacagtgttgaaaatgt

SEQ ID NO: 3627274 - DNA, 19 bp, Homo sapiens
ttgaccagaactttttcct

SEQ ID NO: 3627275 - DNA, 15 bp, Homo sapiens
ttgacctgtcctctt

SEQ ID NO: 3627276 - DNA, 18 bp, Homo sapiens
ttgacctgtcctctttgt

SEQ ID NO: 3627277 - DNA, 17 bp, Homo sapiens
ttgactgatgattttcc

SEQ ID NO: 3627278 - DNA, 15 bp, Homo sapiens
ttgactgtcagcaag

SEQ ID NO: 3627279 - DNA, 16 bp, Homo sapiens
ttgactttccagaatg

SEQ ID NO: 3627280 - DNA, 12 bp, Homo sapiens
ttgactttgtct

SEQ ID NO: 3627281 - DNA, 15 bp, Homo sapiens
ttgagagaaacgtga

SEQ ID NO: 3627282 - DNA, 14 bp, Homo sapiens
ttgagagctttctg

SEQ ID NO: 3627283 - DNA, 22 bp, Homo sapiens
ttgagagttccggggagaaacc

SEQ ID NO: 3627284 - DNA, 23 bp, Homo sapiens
ttgagcttacaattaggaactga

SEQ ID NO: 3627285 - DNA, 15 bp, Homo sapiens
ttgaggaaaaactga

SEQ ID NO: 3627286 - DNA, 20 bp, Homo sapiens
ttgaggaagtggctgtccct

SEQ ID NO: 3627287 - DNA, 16 bp, Homo sapiens
ttgaggagcactgaaa

SEQ ID NO: 3627288 - DNA, 14 bp, Homo sapiens
ttgaggtgaaatgg

SEQ ID NO: 3627289 - DNA, 13 bp, Homo sapiens
ttgagtccctgct

SEQ ID NO: 3627290 - DNA, 22 bp, Homo sapiens
ttgagttaacaggacagttgat

SEQ ID NO: 3627291 - DNA, 20 bp, Homo sapiens
ttgagttacattaaaataaa

SEQ ID NO: 3627292 - DNA, 14 bp, Homo sapiens
ttgagttcctctgc

SEQ ID NO: 3627293 - DNA, 15 bp, Homo sapiens
ttgagttcctctgca

SEQ ID NO: 3627294 - DNA, 18 bp, Homo sapiens
ttgagtttataattcagg

SEQ ID NO: 3627295 - DNA, 18 bp, Homo sapiens
ttgataacaatgttttaa

SEQ ID NO: 3627296 - DNA, 17 bp, Homo sapiens
ttgataacatggaaatg

SEQ ID NO: 3627297 - DNA, 18 bp, Homo sapiens
ttgataattttcctttaa

SEQ ID NO: 3627298 - DNA, 13 bp, Homo sapiens
ttgatactaccag

SEQ ID NO: 3627299 - DNA, 20 bp, Homo sapiens
ttgatactctttctaatgct

SEQ ID NO: 3627300 - DNA, 16 bp, Homo sapiens
ttgatagtgatgtatt

SEQ ID NO: 3627301 - DNA, 16 bp, Homo sapiens
ttgatatgcttataca

SEQ ID NO: 3627302 - DNA, 14 bp, Homo sapiens
ttgatatttaagca

SEQ ID NO: 3627303 - DNA, 23 bp, Homo sapiens
ttgatcataaactgactatcata

SEQ ID NO: 3627304 - DNA, 14 bp, Homo sapiens
ttgatctctcttgt

SEQ ID NO: 3627305 - DNA, 14 bp, Homo sapiens
ttgatctggaaccc

SEQ ID NO: 3627306 - DNA, 16 bp, Homo sapiens
ttgatctggaacccag

SEQ ID NO: 3627307 - DNA, 17 bp, Homo sapiens
ttgatctggaacccaga

SEQ ID NO: 3627308 - DNA, 19 bp, Homo sapiens
ttgatctggaacccagact

SEQ ID NO: 3627309 - DNA, 22 bp, Homo sapiens
ttgatcttgtgctatgaaacaa

SEQ ID NO: 3627310 - DNA, 17 bp, Homo sapiens
ttgatgacccccaacca

SEQ ID NO: 3627311 - DNA, 20 bp, Homo sapiens
ttgatgagatattaaattct

SEQ ID NO: 3627312 - DNA, 13 bp, Homo sapiens
ttgatggaaaata

SEQ ID NO: 3627313 - DNA, 16 bp, Homo sapiens
ttgatggagccccagg

SEQ ID NO: 3627314 - DNA, 20 bp, Homo sapiens
ttgatggctaacttacaaag

SEQ ID NO: 3627315 - DNA, 23 bp, Homo sapiens
ttgatgtaaagatgttctggata

SEQ ID NO: 3627316 - DNA, 20 bp, Homo sapiens
ttgatgtatggtatctttag

SEQ ID NO: 3627317 - DNA, 16 bp, Homo sapiens
ttgatgtttttaaagg

SEQ ID NO: 3627318 - DNA, 18 bp, Homo sapiens
ttgattaaccttttcaaa

SEQ ID NO: 3627319 - DNA, 20 bp, Homo sapiens
ttgattaaccttttcaaatt

SEQ ID NO: 3627320 - DNA, 15 bp, Homo sapiens
ttgattacttccact

SEQ ID NO: 3627321 - DNA, 14 bp, Homo sapiens
ttgattcagcaaaa

SEQ ID NO: 3627322 - DNA, 17 bp, Homo sapiens
ttgattcagcaaaaatc

SEQ ID NO: 3627323 - DNA, 12 bp, Homo sapiens
ttgattggcttt

SEQ ID NO: 3627324 - DNA, 21 bp, Homo sapiens
ttgatttttaagaaagtaatt

SEQ ID NO: 3627325 - DNA, 21 bp, Homo sapiens
ttgcaatctaatctgaactga

SEQ ID NO: 3627326 - DNA, 22 bp, Homo sapiens
ttgcacaccattttgtaaatga

SEQ ID NO: 3627327 - DNA, 12 bp, Homo sapiens
ttgcaccaaaga

SEQ ID NO: 3627328 - DNA, 16 bp, Homo sapiens
ttgcacctatctcagc

SEQ ID NO: 3627329 - DNA, 20 bp, Homo sapiens
ttgcacctatctcagccata

SEQ ID NO: 3627330 - DNA, 21 bp, Homo sapiens
ttgcacctatctcagccatag

SEQ ID NO: 3627331 - DNA, 14 bp, Homo sapiens
ttgcactaaaatga

SEQ ID NO: 3627332 - DNA, 20 bp, Homo sapiens
ttgcactgaagtttttgaaa

SEQ ID NO: 3627333 - DNA, 14 bp, Homo sapiens
ttgcagcatttact

SEQ ID NO: 3627334 - DNA, 15 bp, Homo sapiens
ttgcagcatttacta

SEQ ID NO: 3627335 - DNA, 16 bp, Homo sapiens
ttgcagcatttactat

SEQ ID NO: 3627336 - DNA, 17 bp, Homo sapiens
ttgcagcatttactatg

SEQ ID NO: 3627337 - DNA, 18 bp, Homo sapiens
ttgcagcctaagaagaag

SEQ ID NO: 3627338 - DNA, 15 bp, Homo sapiens
ttgcaggagtttgtg

SEQ ID NO: 3627339 - DNA, 21 bp, Homo sapiens
ttgcagtccagctctttagaa

SEQ ID NO: 3627340 - DNA, 16 bp, Homo sapiens
ttgcatattttgagaa

SEQ ID NO: 3627341 - DNA, 20 bp, Homo sapiens
ttgcatattttgagaaactg

SEQ ID NO: 3627342 - DNA, 15 bp, Homo sapiens
ttgcatggagaatgg

SEQ ID NO: 3627343 - DNA, 16 bp, Homo sapiens
ttgcatggagaatggg

SEQ ID NO: 3627344 - DNA, 13 bp, Homo sapiens
ttgcatgtttgaa

SEQ ID NO: 3627345 - DNA, 22 bp, Homo sapiens
ttgcattgaggaaatattaatt

SEQ ID NO: 3627346 - DNA, 20 bp, Homo sapiens
ttgcatttatatgtaccgta

SEQ ID NO: 3627347 - DNA, 19 bp, Homo sapiens
ttgccaaaacccagctgca

SEQ ID NO: 3627348 - DNA, 23 bp, Homo sapiens
ttgccaaaacccagctgcacccc

SEQ ID NO: 3627349 - DNA, 13 bp, Homo sapiens
ttgccaaaatcct

SEQ ID NO: 3627350 - DNA, 19 bp, Homo sapiens
ttgccaaaatcctgaactt

SEQ ID NO: 3627351 - DNA, 23 bp, Homo sapiens
ttgccaagggcccaaagaaagag

SEQ ID NO: 3627352 - DNA, 12 bp, Homo sapiens
ttgccagcccat

SEQ ID NO: 3627353 - DNA, 20 bp, Homo sapiens
ttgccagcccatttgggcag

SEQ ID NO: 3627354 - DNA, 13 bp, Homo sapiens
ttgccaggggcat

SEQ ID NO: 3627355 - DNA, 18 bp, Homo sapiens
ttgccagttttccctgga

SEQ ID NO: 3627356 - DNA, 14 bp, Homo sapiens
ttgccatgttgcca

SEQ ID NO: 3627357 - DNA, 13 bp, Homo sapiens
ttgcccacccctc

SEQ ID NO: 3627358 - DNA, 19 bp, Homo sapiens
ttgcccacccctcactccc

SEQ ID NO: 3627359 - DNA, 15 bp, Homo sapiens
ttgccccctctcact

SEQ ID NO: 3627360 - DNA, 14 bp, Homo sapiens
ttgcccgctcccac

SEQ ID NO: 3627361 - DNA, 21 bp, Homo sapiens
ttgcccgctcccacagcttcc

SEQ ID NO: 3627362 - DNA, 22 bp, Homo sapiens
ttgcccgctcccacagcttcct

SEQ ID NO: 3627363 - DNA, 20 bp, Homo sapiens
ttgccctaattaaaaactgt

SEQ ID NO: 3627364 - DNA, 15 bp, Homo sapiens
ttgccgctgtataaa

SEQ ID NO: 3627365 - DNA, 22 bp, Homo sapiens
ttgcctaaatttaatgctgcct

SEQ ID NO: 3627366 - DNA, 22 bp, Homo sapiens
ttgcctaagaataaacatttgt

SEQ ID NO: 3627367 - DNA, 17 bp, Homo sapiens
ttgcctatctgacttca

SEQ ID NO: 3627368 - DNA, 16 bp, Homo sapiens
ttgcctatttccccct

SEQ ID NO: 3627369 - DNA, 16 bp, Homo sapiens
ttgcctctgccctgga

SEQ ID NO: 3627370 - DNA, 20 bp, Homo sapiens
ttgcctctgtccgtgcccct

SEQ ID NO: 3627371 - DNA, 17 bp, Homo sapiens
ttgcctgtctgtttgct

SEQ ID NO: 3627372 - DNA, 19 bp, Homo sapiens
ttgccttttatgtaaattt

SEQ ID NO: 3627373 - DNA, 21 bp, Homo sapiens
ttgccttttatgtaaattttt

SEQ ID NO: 3627374 - DNA, 21 bp, Homo sapiens
ttgcgcctcggtatctggctt

SEQ ID NO: 3627375 - DNA, 22 bp, Homo sapiens
ttgcgcctcggtatctggcttc

SEQ ID NO: 3627376 - DNA, 16 bp, Homo sapiens
ttgcgtttttccttgt

SEQ ID NO: 3627377 - DNA, 14 bp, Homo sapiens
ttgctaactgggtt

SEQ ID NO: 3627378 - DNA, 15 bp, Homo sapiens
ttgctaactgggtta

SEQ ID NO: 3627379 - DNA, 12 bp, Homo sapiens
ttgctaactggt

SEQ ID NO: 3627380 - DNA, 13 bp, Homo sapiens
ttgctaactggtt

SEQ ID NO: 3627381 - DNA, 14 bp, Homo sapiens
ttgctaactggtta

SEQ ID NO: 3627382 - DNA, 19 bp, Homo sapiens
ttgctaataccaaaattga

SEQ ID NO: 3627383 - DNA, 12 bp, Homo sapiens
ttgctaccagta

SEQ ID NO: 3627384 - DNA, 15 bp, Homo sapiens
ttgctaccagtattt

SEQ ID NO: 3627385 - DNA, 22 bp, Homo sapiens
ttgctaccagtatttagaagcc

SEQ ID NO: 3627386 - DNA, 23 bp, Homo sapiens
ttgctaccagtatttagaagcca

SEQ ID NO: 3627387 - DNA, 12 bp, Homo sapiens
ttgctatagtga

SEQ ID NO: 3627388 - DNA, 18 bp, Homo sapiens
ttgctcaaaattgcttct

SEQ ID NO: 3627389 - DNA, 19 bp, Homo sapiens
ttgctctaccaaatagtga

SEQ ID NO: 3627390 - DNA, 12 bp, Homo sapiens
ttgctctcctca

SEQ ID NO: 3627391 - DNA, 17 bp, Homo sapiens
ttgctctctgtgaccct

SEQ ID NO: 3627392 - DNA, 19 bp, Homo sapiens
ttgctgaagatgccttgag

SEQ ID NO: 3627393 - DNA, 15 bp, Homo sapiens
ttgctgcccctgtct

SEQ ID NO: 3627394 - DNA, 21 bp, Homo sapiens
ttgctgcccctgtctggaaga

SEQ ID NO: 3627395 - DNA, 18 bp, Homo sapiens
ttgctgcccgcgggagac

SEQ ID NO: 3627396 - DNA, 23 bp, Homo sapiens
ttgctgcctcggatccccttcct

SEQ ID NO: 3627397 - DNA, 11 bp, Homo sapiens
ttgctgctgcc

SEQ ID NO: 3627398 - DNA, 12 bp, Homo sapiens
ttgctgctgcct

SEQ ID NO: 3627399 - DNA, 23 bp, Homo sapiens
ttgctggactgtcatagaaatta

SEQ ID NO: 3627400 - DNA, 11 bp, Homo sapiens
ttgctggctgc

SEQ ID NO: 3627401 - DNA, 12 bp, Homo sapiens
ttgctggctgcc

SEQ ID NO: 3627402 - DNA, 12 bp, Homo sapiens
ttgctggggatt

SEQ ID NO: 3627403 - DNA, 18 bp, Homo sapiens
ttgctggtcctgcacatg

SEQ ID NO: 3627404 - DNA, 21 bp, Homo sapiens
ttgctggtcctgcacatgagt

SEQ ID NO: 3627405 - DNA, 17 bp, Homo sapiens
ttgctgtcaagccattt

SEQ ID NO: 3627406 - DNA, 12 bp, Homo sapiens
ttgctgtggctc

SEQ ID NO: 3627407 - DNA, 22 bp, Homo sapiens
ttgctttgtaagtgaaaaacat

SEQ ID NO: 3627408 - DNA, 15 bp, Homo sapiens
ttgctttttcaccag

SEQ ID NO: 3627409 - DNA, 15 bp, Homo sapiens
ttgcttttttaaata

SEQ ID NO: 3627410 - DNA, 11 bp, Homo sapiens
ttggaaagact

SEQ ID NO: 3627411 - DNA, 18 bp, Homo sapiens
ttggaaaggggaggagct

SEQ ID NO: 3627412 - DNA, 22 bp, Homo sapiens
ttggaagtgcagtcagcagatg

SEQ ID NO: 3627413 - DNA, 22 bp, Homo sapiens
ttggaatattccactatttgca

SEQ ID NO: 3627414 - DNA, 14 bp, Homo sapiens
ttggacagtggcct

SEQ ID NO: 3627415 - DNA, 16 bp, Homo sapiens
ttggacattttatgtc

SEQ ID NO: 3627416 - DNA, 17 bp, Homo sapiens
ttggacattttatgtct

SEQ ID NO: 3627417 - DNA, 19 bp, Homo sapiens
ttggacattttatgtcttt

SEQ ID NO: 3627418 - DNA, 17 bp, Homo sapiens
ttggacgggatgacctc

SEQ ID NO: 3627419 - DNA, 19 bp, Homo sapiens
ttggagaaggtctgtggtg

SEQ ID NO: 3627420 - DNA, 21 bp, Homo sapiens
ttggagaaggtctgtggtgca

SEQ ID NO: 3627421 - DNA, 15 bp, Homo sapiens
ttggagagtttcctg

SEQ ID NO: 3627422 - DNA, 12 bp, Homo sapiens
ttggagcagcag

SEQ ID NO: 3627423 - DNA, 20 bp, Homo sapiens
ttggagcagcaggcctctgg

SEQ ID NO: 3627424 - DNA, 22 bp, Homo sapiens
ttggagcagcaggcctctggga

SEQ ID NO: 3627425 - DNA, 13 bp, Homo sapiens
ttggaggagagag

SEQ ID NO: 3627426 - DNA, 13 bp, Homo sapiens
ttggatacagctg

SEQ ID NO: 3627427 - DNA, 15 bp, Homo sapiens
ttggatagtctccta

SEQ ID NO: 3627428 - DNA, 20 bp, Homo sapiens
ttggatgttgctatagtgac

SEQ ID NO: 3627429 - DNA, 23 bp, Homo sapiens
ttggatgttgctatagtgacatg

SEQ ID NO: 3627430 - DNA, 16 bp, Homo sapiens
ttggcaaactaaagga

SEQ ID NO: 3627431 - DNA, 12 bp, Homo sapiens
ttggcaaagttt

SEQ ID NO: 3627432 - DNA, 16 bp, Homo sapiens
ttggcaatattcctta

SEQ ID NO: 3627433 - DNA, 21 bp, Homo sapiens
ttggcaatgactcaaagtctg

SEQ ID NO: 3627434 - DNA, 20 bp, Homo sapiens
ttggcacatgccacctggca

SEQ ID NO: 3627435 - DNA, 21 bp, Homo sapiens
ttggcaccagacacccaggac

SEQ ID NO: 3627436 - DNA, 19 bp, Homo sapiens
ttggcacccccatgctgcc

SEQ ID NO: 3627437 - DNA, 13 bp, Homo sapiens
ttggcaggcccac

SEQ ID NO: 3627438 - DNA, 23 bp, Homo sapiens
ttggcagtgggaatgttctttct

SEQ ID NO: 3627439 - DNA, 20 bp, Homo sapiens
ttggcccaggattattgtca

SEQ ID NO: 3627440 - DNA, 21 bp, Homo sapiens
ttggcccccttcaggagcctg

SEQ ID NO: 3627441 - DNA, 22 bp, Homo sapiens
ttggccctcctcagctccctgc

SEQ ID NO: 3627442 - DNA, 19 bp, Homo sapiens
ttggccgctgtatgtctta

SEQ ID NO: 3627443 - DNA, 23 bp, Homo sapiens
ttggcctgtctttggattgttaa

SEQ ID NO: 3627444 - DNA, 14 bp, Homo sapiens
ttggctgacccctc

SEQ ID NO: 3627445 - DNA, 15 bp, Homo sapiens
ttggctgcaggaaga

SEQ ID NO: 3627446 - DNA, 14 bp, Homo sapiens
ttggctgcaggtgt

SEQ ID NO: 3627447 - DNA, 16 bp, Homo sapiens
ttggctggtagcagca

SEQ ID NO: 3627448 - DNA, 19 bp, Homo sapiens
ttggctggtagcagcaggc

SEQ ID NO: 3627449 - DNA, 21 bp, Homo sapiens
ttggctggtagcagcaggctc

SEQ ID NO: 3627450 - DNA, 19 bp, Homo sapiens
ttggctttcagagccagcc

SEQ ID NO: 3627451 - DNA, 22 bp, Homo sapiens
ttgggaactgaaatccttgaga

SEQ ID NO: 3627452 - DNA, 12 bp, Homo sapiens
ttgggacagcca

SEQ ID NO: 3627453 - DNA, 19 bp, Homo sapiens
ttgggacagccattttcca

SEQ ID NO: 3627454 - DNA, 17 bp, Homo sapiens
ttgggagacatgtgaca

SEQ ID NO: 3627455 - DNA, 11 bp, Homo sapiens
ttgggagccag

SEQ ID NO: 3627456 - DNA, 13 bp, Homo sapiens
ttgggagccagga

SEQ ID NO: 3627457 - DNA, 18 bp, Homo sapiens
ttgggagccaggactccc

SEQ ID NO: 3627458 - DNA, 22 bp, Homo sapiens
ttgggagccaggactcccagaa

SEQ ID NO: 3627459 - DNA, 16 bp, Homo sapiens
ttgggaggaggaaaag

SEQ ID NO: 3627460 - DNA, 19 bp, Homo sapiens
ttgggatagcaaactccag

SEQ ID NO: 3627461 - DNA, 20 bp, Homo sapiens
ttgggatagtgttctgctcc

SEQ ID NO: 3627462 - DNA, 15 bp, Homo sapiens
ttgggcagagaggct

SEQ ID NO: 3627463 - DNA, 14 bp, Homo sapiens
ttgggccagacatg

SEQ ID NO: 3627464 - DNA, 17 bp, Homo sapiens
ttgggccagacatgcca

SEQ ID NO: 3627465 - DNA, 14 bp, Homo sapiens
ttgggctgacccag

SEQ ID NO: 3627466 - DNA, 16 bp, Homo sapiens
ttgggctgacccagca

SEQ ID NO: 3627467 - DNA, 19 bp, Homo sapiens
ttgggcttcaacagccaag

SEQ ID NO: 3627468 - DNA, 14 bp, Homo sapiens
ttgggctttaacat

SEQ ID NO: 3627469 - DNA, 19 bp, Homo sapiens
ttggggagttaagacctgg

SEQ ID NO: 3627470 - DNA, 20 bp, Homo sapiens
ttggggagttaagacctggc

SEQ ID NO: 3627471 - DNA, 15 bp, Homo sapiens
ttggggattgtacac

SEQ ID NO: 3627472 - DNA, 23 bp, Homo sapiens
ttgggtagaaagagatacagagg

SEQ ID NO: 3627473 - DNA, 20 bp, Homo sapiens
ttgggtgtttttcatgtttt

SEQ ID NO: 3627474 - DNA, 15 bp, Homo sapiens
ttggtaacttttgtg

SEQ ID NO: 3627475 - DNA, 10 bp, Homo sapiens
ttggtcaaat

SEQ ID NO: 3627476 - DNA, 16 bp, Homo sapiens
ttggtccttctttcct

SEQ ID NO: 3627477 - DNA, 19 bp, Homo sapiens
ttggtccttctttcctctt

SEQ ID NO: 3627478 - DNA, 17 bp, Homo sapiens
ttggtctgccttctgct

SEQ ID NO: 3627479 - DNA, 22 bp, Homo sapiens
ttggtgagaaagggattgctga

SEQ ID NO: 3627480 - DNA, 15 bp, Homo sapiens
ttggtggggtggcac

SEQ ID NO: 3627481 - DNA, 18 bp, Homo sapiens
ttggtgttgcagccgcag

SEQ ID NO: 3627482 - DNA, 12 bp, Homo sapiens
ttggttcaattt

SEQ ID NO: 3627483 - DNA, 14 bp, Homo sapiens
ttggttccttctct

SEQ ID NO: 3627484 - DNA, 17 bp, Homo sapiens
ttggtttaaagaaagtg

SEQ ID NO: 3627485 - DNA, 18 bp, Homo sapiens
ttggtttaaagaaagtgt

SEQ ID NO: 3627486 - DNA, 17 bp, Homo sapiens
ttggtttttaaagattt

SEQ ID NO: 3627487 - DNA, 21 bp, Homo sapiens
ttgtaaatgaaacttaagaat

SEQ ID NO: 3627488 - DNA, 11 bp, Homo sapiens
ttgtaaatgtg

SEQ ID NO: 3627489 - DNA, 14 bp, Homo sapiens
ttgtaacaaattga

SEQ ID NO: 3627490 - DNA, 15 bp, Homo sapiens
ttgtaacaagaaaat

SEQ ID NO: 3627491 - DNA, 22 bp, Homo sapiens
ttgtaagacaaaggttttcctc

SEQ ID NO: 3627492 - DNA, 14 bp, Homo sapiens
ttgtaataaactct

SEQ ID NO: 3627493 - DNA, 16 bp, Homo sapiens
ttgtaataaactctct

SEQ ID NO: 3627494 - DNA, 21 bp, Homo sapiens
ttgtaatgctgcacttcctgt

SEQ ID NO: 3627495 - DNA, 14 bp, Homo sapiens
ttgtacaaaataaa

SEQ ID NO: 3627496 - DNA, 14 bp, Homo sapiens
ttgtacaataaatt

SEQ ID NO: 3627497 - DNA, 15 bp, Homo sapiens
ttgtacaataaattt

SEQ ID NO: 3627498 - DNA, 19 bp, Homo sapiens
ttgtagcatttggaaatga

SEQ ID NO: 3627499 - DNA, 22 bp, Homo sapiens
ttgtagtagcgttttttaaatg

SEQ ID NO: 3627500 - DNA, 19 bp, Homo sapiens
ttgtagttttatttgtatt

SEQ ID NO: 3627501 - DNA, 13 bp, Homo sapiens
ttgtatattacaa

SEQ ID NO: 3627502 - DNA, 15 bp, Homo sapiens
ttgtatattacaatg

SEQ ID NO: 3627503 - DNA, 22 bp, Homo sapiens
ttgtatattctattttacaact

SEQ ID NO: 3627504 - DNA, 16 bp, Homo sapiens
ttgtatcacaaatctt

SEQ ID NO: 3627505 - DNA, 15 bp, Homo sapiens
ttgtatgcaatggat

SEQ ID NO: 3627506 - DNA, 12 bp, Homo sapiens
ttgtatttaaga

SEQ ID NO: 3627507 - DNA, 16 bp, Homo sapiens
ttgtatttaagacata

SEQ ID NO: 3627508 - DNA, 22 bp, Homo sapiens
ttgtcaagaatagcattgtaaa

SEQ ID NO: 3627509 - DNA, 16 bp, Homo sapiens
ttgtcatggtgaaatt

SEQ ID NO: 3627510 - DNA, 15 bp, Homo sapiens
ttgtcatgttatgca

SEQ ID NO: 3627511 - DNA, 17 bp, Homo sapiens
ttgtcatgttatgcagt

SEQ ID NO: 3627512 - DNA, 18 bp, Homo sapiens
ttgtccagagataaaaat

SEQ ID NO: 3627513 - DNA, 22 bp, Homo sapiens
ttgtccagagataaaaatcata

SEQ ID NO: 3627514 - DNA, 15 bp, Homo sapiens
ttgtcctcttctgct

SEQ ID NO: 3627515 - DNA, 18 bp, Homo sapiens
ttgtcctcttctgctctt

SEQ ID NO: 3627516 - DNA, 19 bp, Homo sapiens
ttgtcctgatgcttttgtc

SEQ ID NO: 3627517 - DNA, 23 bp, Homo sapiens
ttgtctatttttctcttcatatt

SEQ ID NO: 3627518 - DNA, 18 bp, Homo sapiens
ttgtctcaacgcctcccc

SEQ ID NO: 3627519 - DNA, 16 bp, Homo sapiens
ttgtctccaaagaaga

SEQ ID NO: 3627520 - DNA, 17 bp, Homo sapiens
ttgtctccaaagaagat

SEQ ID NO: 3627521 - DNA, 17 bp, Homo sapiens
ttgtctgaagtcactgc

SEQ ID NO: 3627522 - DNA, 20 bp, Homo sapiens
ttgtctgaagtcactgcaca

SEQ ID NO: 3627523 - DNA, 14 bp, Homo sapiens
ttgtctgcagctgt

SEQ ID NO: 3627524 - DNA, 17 bp, Homo sapiens
ttgtcttaaaaaatgtg

SEQ ID NO: 3627525 - DNA, 18 bp, Homo sapiens
ttgtcttttcaaaatatt

SEQ ID NO: 3627526 - DNA, 21 bp, Homo sapiens
ttgtgaaataaaactggcttt

SEQ ID NO: 3627527 - DNA, 13 bp, Homo sapiens
ttgtgagaatggc

SEQ ID NO: 3627528 - DNA, 21 bp, Homo sapiens
ttgtgagaatggcctggagca

SEQ ID NO: 3627529 - DNA, 22 bp, Homo sapiens
ttgtgagtttaccttgtatact

SEQ ID NO: 3627530 - DNA, 12 bp, Homo sapiens
ttgtgatgtgtc

SEQ ID NO: 3627531 - DNA, 16 bp, Homo sapiens
ttgtgccaactgccag

SEQ ID NO: 3627532 - DNA, 22 bp, Homo sapiens
ttgtgccaactgccaggctgcc

SEQ ID NO: 3627533 - DNA, 10 bp, Homo sapiens
ttgtgccttt

SEQ ID NO: 3627534 - DNA, 16 bp, Homo sapiens
ttgtgctcataaattg

SEQ ID NO: 3627535 - DNA, 15 bp, Homo sapiens
ttgtgctttttgtca

SEQ ID NO: 3627536 - DNA, 17 bp, Homo sapiens
ttgtgctttttgtcatg

SEQ ID NO: 3627537 - DNA, 21 bp, Homo sapiens
ttgtggaaaatgaaaattagg

SEQ ID NO: 3627538 - DNA, 15 bp, Homo sapiens
ttgtggcagcctgat

SEQ ID NO: 3627539 - DNA, 18 bp, Homo sapiens
ttgtggccaaggagctgc

SEQ ID NO: 3627540 - DNA, 15 bp, Homo sapiens
ttgtgtacttttcct

SEQ ID NO: 3627541 - DNA, 16 bp, Homo sapiens
ttgtgtatagaactgg

SEQ ID NO: 3627542 - DNA, 12 bp, Homo sapiens
ttgtgtatctgt

SEQ ID NO: 3627543 - DNA, 11 bp, Homo sapiens
ttgtgtggaat

SEQ ID NO: 3627544 - DNA, 19 bp, Homo sapiens
ttgtgtgtatatgtattta

SEQ ID NO: 3627545 - DNA, 16 bp, Homo sapiens
ttgtgttcagaagaat

SEQ ID NO: 3627546 - DNA, 22 bp, Homo sapiens
ttgtgttcagaagaatcttcct

SEQ ID NO: 3627547 - DNA, 15 bp, Homo sapiens
ttgttacttctctaa

SEQ ID NO: 3627548 - DNA, 22 bp, Homo sapiens
ttgttaggttttctatgtgact

SEQ ID NO: 3627549 - DNA, 13 bp, Homo sapiens
ttgttatacttca

SEQ ID NO: 3627550 - DNA, 15 bp, Homo sapiens
ttgttatacttcaaa

SEQ ID NO: 3627551 - DNA, 13 bp, Homo sapiens
ttgttatattata

SEQ ID NO: 3627552 - DNA, 12 bp, Homo sapiens
ttgttatcaaaa

SEQ ID NO: 3627553 - DNA, 16 bp, Homo sapiens
ttgttatcaaaatagt

SEQ ID NO: 3627554 - DNA, 15 bp, Homo sapiens
ttgttatttattgaa

SEQ ID NO: 3627555 - DNA, 22 bp, Homo sapiens
ttgttccctgtgtcatttcaaa

SEQ ID NO: 3627556 - DNA, 13 bp, Homo sapiens
ttgttcctgaaat

SEQ ID NO: 3627557 - DNA, 13 bp, Homo sapiens
ttgttcttgatag

SEQ ID NO: 3627558 - DNA, 15 bp, Homo sapiens
ttgttctttgttctt

SEQ ID NO: 3627559 - DNA, 15 bp, Homo sapiens
ttgttctttgtttag

SEQ ID NO: 3627560 - DNA, 20 bp, Homo sapiens
ttgttctttgtttagcctga

SEQ ID NO: 3627561 - DNA, 15 bp, Homo sapiens
ttgttgaaagaaagt

SEQ ID NO: 3627562 - DNA, 20 bp, Homo sapiens
ttgttgccccattcctaaga

SEQ ID NO: 3627563 - DNA, 16 bp, Homo sapiens
ttgttggcatagctct

SEQ ID NO: 3627564 - DNA, 14 bp, Homo sapiens
ttgtttaaaatcat

SEQ ID NO: 3627565 - DNA, 17 bp, Homo sapiens
ttgtttaaaatcatttc

SEQ ID NO: 3627566 - DNA, 15 bp, Homo sapiens
ttgtttagaagaagt

SEQ ID NO: 3627567 - DNA, 18 bp, Homo sapiens
ttgtttagaagaagtgtg

SEQ ID NO: 3627568 - DNA, 15 bp, Homo sapiens
ttgtttataataaaa

SEQ ID NO: 3627569 - DNA, 16 bp, Homo sapiens
ttgtttataataaaaa

SEQ ID NO: 3627570 - DNA, 14 bp, Homo sapiens
ttgtttctgatcta

SEQ ID NO: 3627571 - DNA, 16 bp, Homo sapiens
ttgtttctttctctga

SEQ ID NO: 3627572 - DNA, 19 bp, Homo sapiens
ttgtttctttctctgagga

SEQ ID NO: 3627573 - DNA, 15 bp, Homo sapiens
ttgtttgaatatttg

SEQ ID NO: 3627574 - DNA, 16 bp, Homo sapiens
ttgtttgaatatttgt

SEQ ID NO: 3627575 - DNA, 17 bp, Homo sapiens
ttgtttgattcagcaaa

SEQ ID NO: 3627576 - DNA, 19 bp, Homo sapiens
ttgtttgctgaaatttacc

SEQ ID NO: 3627577 - DNA, 13 bp, Homo sapiens
ttgttttacaata

SEQ ID NO: 3627578 - DNA, 16 bp, Homo sapiens
ttgttttagaaccagc

SEQ ID NO: 3627579 - DNA, 21 bp, Homo sapiens
ttgttttagaagattctatgt

SEQ ID NO: 3627580 - DNA, 19 bp, Homo sapiens
ttgttttgctgagagcata

SEQ ID NO: 3627581 - DNA, 19 bp, Homo sapiens
ttgttttttttttccactt

SEQ ID NO: 3627582 - DNA, 15 bp, Homo sapiens
tttaaaaaaataatt

SEQ ID NO: 3627583 - DNA, 16 bp, Homo sapiens
tttaaaaaatggtcac

SEQ ID NO: 3627584 - DNA, 17 bp, Homo sapiens
tttaaaaatacacttgt

SEQ ID NO: 3627585 - DNA, 12 bp, Homo sapiens
tttaaaaattgt

SEQ ID NO: 3627586 - DNA, 23 bp, Homo sapiens
tttaaaacaaagggaaaaaagag

SEQ ID NO: 3627587 - DNA, 11 bp, Homo sapiens
tttaaaactgt

SEQ ID NO: 3627588 - DNA, 16 bp, Homo sapiens
tttaaaactgttattt

SEQ ID NO: 3627589 - DNA, 17 bp, Homo sapiens
tttaaaaggatgtataa

SEQ ID NO: 3627590 - DNA, 20 bp, Homo sapiens
tttaaaatggtttgtcctga

SEQ ID NO: 3627591 - DNA, 13 bp, Homo sapiens
tttaaagaaagtg

SEQ ID NO: 3627592 - DNA, 14 bp, Homo sapiens
tttaaagaaagtgt

SEQ ID NO: 3627593 - DNA, 16 bp, Homo sapiens
tttaaagaaagtgtat

SEQ ID NO: 3627594 - DNA, 15 bp, Homo sapiens
tttaaagaatgttag

SEQ ID NO: 3627595 - DNA, 17 bp, Homo sapiens
tttaaagtttaatgcct

SEQ ID NO: 3627596 - DNA, 15 bp, Homo sapiens
tttaaataaaagcac

SEQ ID NO: 3627597 - DNA, 18 bp, Homo sapiens
tttaaatataaaaatggg

SEQ ID NO: 3627598 - DNA, 16 bp, Homo sapiens
tttaaatatatatttt

SEQ ID NO: 3627599 - DNA, 19 bp, Homo sapiens
tttaaatcctgaagagcat

SEQ ID NO: 3627600 - DNA, 15 bp, Homo sapiens
tttaaatgtatacta

SEQ ID NO: 3627601 - DNA, 16 bp, Homo sapiens
tttaaatgtattttac

SEQ ID NO: 3627602 - DNA, 12 bp, Homo sapiens
tttaaattatat

SEQ ID NO: 3627603 - DNA, 11 bp, Homo sapiens
tttaaattgca

SEQ ID NO: 3627604 - DNA, 21 bp, Homo sapiens
tttaaccacagtgaaagttga

SEQ ID NO: 3627605 - DNA, 21 bp, Homo sapiens
tttaactgattaaaaatacct

SEQ ID NO: 3627606 - DNA, 15 bp, Homo sapiens
tttaacttattgcta

SEQ ID NO: 3627607 - DNA, 12 bp, Homo sapiens
tttaagaaagaa

SEQ ID NO: 3627608 - DNA, 17 bp, Homo sapiens
tttaagaaagtaattta

SEQ ID NO: 3627609 - DNA, 21 bp, Homo sapiens
tttaagaaccttaatgacaac

SEQ ID NO: 3627610 - DNA, 21 bp, Homo sapiens
tttaagaactaaaatgttcta

SEQ ID NO: 3627611 - DNA, 19 bp, Homo sapiens
tttaagaatagttctaaaa

SEQ ID NO: 3627612 - DNA, 22 bp, Homo sapiens
tttaagatgtacatttaataat

SEQ ID NO: 3627613 - DNA, 17 bp, Homo sapiens
tttaagccttacaaagg

SEQ ID NO: 3627614 - DNA, 17 bp, Homo sapiens
tttaagggtttgtggaa

SEQ ID NO: 3627615 - DNA, 20 bp, Homo sapiens
tttaagtactacacattttt

SEQ ID NO: 3627616 - DNA, 13 bp, Homo sapiens
tttaagtgtgcag

SEQ ID NO: 3627617 - DNA, 19 bp, Homo sapiens
tttaatgagtgcacctgcc

SEQ ID NO: 3627618 - DNA, 20 bp, Homo sapiens
tttaattgaaagaatgtaaa

SEQ ID NO: 3627619 - DNA, 21 bp, Homo sapiens
tttaattgaaagaatgtaaag

SEQ ID NO: 3627620 - DNA, 14 bp, Homo sapiens
tttaatttaaactg

SEQ ID NO: 3627621 - DNA, 15 bp, Homo sapiens
tttaatttaaactgt

SEQ ID NO: 3627622 - DNA, 21 bp, Homo sapiens
tttaatttattaattgctttg

SEQ ID NO: 3627623 - DNA, 22 bp, Homo sapiens
tttaatttattaattgctttga

SEQ ID NO: 3627624 - DNA, 16 bp, Homo sapiens
tttaatttcaaatgta

SEQ ID NO: 3627625 - DNA, 12 bp, Homo sapiens
tttacaactaaa

SEQ ID NO: 3627626 - DNA, 20 bp, Homo sapiens
tttacaagggcataaagtaa

SEQ ID NO: 3627627 - DNA, 17 bp, Homo sapiens
tttacaatagttctgtg

SEQ ID NO: 3627628 - DNA, 14 bp, Homo sapiens
tttacagctgtgct

SEQ ID NO: 3627629 - DNA, 14 bp, Homo sapiens
tttacagtatttct

SEQ ID NO: 3627630 - DNA, 15 bp, Homo sapiens
tttacagtatttcta

SEQ ID NO: 3627631 - DNA, 19 bp, Homo sapiens
tttacataacggaaagttt

SEQ ID NO: 3627632 - DNA, 20 bp, Homo sapiens
tttacataacggaaagtttt

SEQ ID NO: 3627633 - DNA, 19 bp, Homo sapiens
tttacatccttcactgctc

SEQ ID NO: 3627634 - DNA, 21 bp, Homo sapiens
tttaccaaagagatattgata

SEQ ID NO: 3627635 - DNA, 11 bp, Homo sapiens
tttaccaaagc

SEQ ID NO: 3627636 - DNA, 15 bp, Homo sapiens
tttaccaaagcatca

SEQ ID NO: 3627637 - DNA, 15 bp, Homo sapiens
tttacctattctgaa

SEQ ID NO: 3627638 - DNA, 22 bp, Homo sapiens
tttacctattctgaaaaagaca

SEQ ID NO: 3627639 - DNA, 13 bp, Homo sapiens
tttacctgtttaa

SEQ ID NO: 3627640 - DNA, 13 bp, Homo sapiens
tttacctttatct

SEQ ID NO: 3627641 - DNA, 17 bp, Homo sapiens
tttacctttcagtgcag

SEQ ID NO: 3627642 - DNA, 15 bp, Homo sapiens
tttacgtagctattt

SEQ ID NO: 3627643 - DNA, 20 bp, Homo sapiens
tttacgtagctatttttata

SEQ ID NO: 3627644 - DNA, 22 bp, Homo sapiens
tttacgtagctatttttataca

SEQ ID NO: 3627645 - DNA, 19 bp, Homo sapiens
tttactgatgagagaatgt

SEQ ID NO: 3627646 - DNA, 20 bp, Homo sapiens
tttactgatgagagaatgtg

SEQ ID NO: 3627647 - DNA, 19 bp, Homo sapiens
tttactgcactcagattta

SEQ ID NO: 3627648 - DNA, 21 bp, Homo sapiens
tttactgcactcagatttaag

SEQ ID NO: 3627649 - DNA, 14 bp, Homo sapiens
tttacttcttatac

SEQ ID NO: 3627650 - DNA, 15 bp, Homo sapiens
tttacttcttataca

SEQ ID NO: 3627651 - DNA, 14 bp, Homo sapiens
tttagaaatataat

SEQ ID NO: 3627652 - DNA, 17 bp, Homo sapiens
tttagaaccgtaggttt

SEQ ID NO: 3627653 - DNA, 18 bp, Homo sapiens
tttagaagattctatgtt

SEQ ID NO: 3627654 - DNA, 21 bp, Homo sapiens
tttagaagattctatgttaat

SEQ ID NO: 3627655 - DNA, 23 bp, Homo sapiens
tttagaataaattcccaacttct

SEQ ID NO: 3627656 - DNA, 18 bp, Homo sapiens
tttagaatggttgagtta

SEQ ID NO: 3627657 - DNA, 23 bp, Homo sapiens
tttagaatggttgagttacatta

SEQ ID NO: 3627658 - DNA, 21 bp, Homo sapiens
tttagaatgttgaaaagtaat

SEQ ID NO: 3627659 - DNA, 16 bp, Homo sapiens
tttagagataattgct

SEQ ID NO: 3627660 - DNA, 22 bp, Homo sapiens
tttagcagtttcctcagtgatg

SEQ ID NO: 3627661 - DNA, 22 bp, Homo sapiens
tttagcatgttcctccttttct

SEQ ID NO: 3627662 - DNA, 23 bp, Homo sapiens
tttagcttacctgggcacaaaca

SEQ ID NO: 3627663 - DNA, 21 bp, Homo sapiens
tttaggtgaattaattaaaca

SEQ ID NO: 3627664 - DNA, 15 bp, Homo sapiens
tttagtcctgtactg

SEQ ID NO: 3627665 - DNA, 19 bp, Homo sapiens
tttagtggaagcttctaaa

SEQ ID NO: 3627666 - DNA, 14 bp, Homo sapiens
tttagtgtgaatat

SEQ ID NO: 3627667 - DNA, 15 bp, Homo sapiens
tttagtgtgaatatt

SEQ ID NO: 3627668 - DNA, 19 bp, Homo sapiens
tttagttggaaaaacaatt

SEQ ID NO: 3627669 - DNA, 21 bp, Homo sapiens
tttataaaccataaaataaat

SEQ ID NO: 3627670 - DNA, 14 bp, Homo sapiens
tttataactaacat

SEQ ID NO: 3627671 - DNA, 16 bp, Homo sapiens
tttataataaaaatat

SEQ ID NO: 3627672 - DNA, 23 bp, Homo sapiens
tttataataaactcttaagagaa

SEQ ID NO: 3627673 - DNA, 13 bp, Homo sapiens
tttataatgtatt

SEQ ID NO: 3627674 - DNA, 14 bp, Homo sapiens
tttataatgtattt

SEQ ID NO: 3627675 - DNA, 15 bp, Homo sapiens
tttataatgtatttg

SEQ ID NO: 3627676 - DNA, 17 bp, Homo sapiens
tttataatgtatttgaa

SEQ ID NO: 3627677 - DNA, 15 bp, Homo sapiens
tttataattggctta

SEQ ID NO: 3627678 - DNA, 21 bp, Homo sapiens
tttatacctcaaactatctgg

SEQ ID NO: 3627679 - DNA, 16 bp, Homo sapiens
tttatatactgctatt

SEQ ID NO: 3627680 - DNA, 20 bp, Homo sapiens
tttatatactgctatttaca

SEQ ID NO: 3627681 - DNA, 23 bp, Homo sapiens
tttatatcaggtgtataaatgta

SEQ ID NO: 3627682 - DNA, 19 bp, Homo sapiens
tttatatggataatctgag

SEQ ID NO: 3627683 - DNA, 12 bp, Homo sapiens
tttatattctaa

SEQ ID NO: 3627684 - DNA, 21 bp, Homo sapiens
tttatattctaatagtttttc

SEQ ID NO: 3627685 - DNA, 18 bp, Homo sapiens
tttatattgtttttatat

SEQ ID NO: 3627686 - DNA, 20 bp, Homo sapiens
tttatattgtttttatatat

SEQ ID NO: 3627687 - DNA, 19 bp, Homo sapiens
tttatatttattgttagaa

SEQ ID NO: 3627688 - DNA, 12 bp, Homo sapiens
tttatattttta

SEQ ID NO: 3627689 - DNA, 15 bp, Homo sapiens
tttatccaaatcttg

SEQ ID NO: 3627690 - DNA, 22 bp, Homo sapiens
tttatcctagtcattcttccct

SEQ ID NO: 3627691 - DNA, 16 bp, Homo sapiens
tttatctgtaattgta

SEQ ID NO: 3627692 - DNA, 22 bp, Homo sapiens
tttatctgtaattgtaattcca

SEQ ID NO: 3627693 - DNA, 13 bp, Homo sapiens
tttatcttcatgt

SEQ ID NO: 3627694 - DNA, 14 bp, Homo sapiens
tttatgaaagtatt

SEQ ID NO: 3627695 - DNA, 13 bp, Homo sapiens
tttatgaacaatt

SEQ ID NO: 3627696 - DNA, 13 bp, Homo sapiens
tttatgaaggttt

SEQ ID NO: 3627697 - DNA, 18 bp, Homo sapiens
tttatgccagttgttaaa

SEQ ID NO: 3627698 - DNA, 12 bp, Homo sapiens
tttatgtaaatt

SEQ ID NO: 3627699 - DNA, 14 bp, Homo sapiens
tttattaatttgaa

SEQ ID NO: 3627700 - DNA, 12 bp, Homo sapiens
tttattaccagt

SEQ ID NO: 3627701 - DNA, 21 bp, Homo sapiens
tttattccccagtgactccag

SEQ ID NO: 3627702 - DNA, 16 bp, Homo sapiens
tttattccctgcccaa

SEQ ID NO: 3627703 - DNA, 17 bp, Homo sapiens
tttattgtttgatgttt

SEQ ID NO: 3627704 - DNA, 22 bp, Homo sapiens
tttattgttttctatttatgcc

SEQ ID NO: 3627705 - DNA, 16 bp, Homo sapiens
tttatttacagctgtg

SEQ ID NO: 3627706 - DNA, 18 bp, Homo sapiens
tttatttacagctgtgct

SEQ ID NO: 3627707 - DNA, 13 bp, Homo sapiens
tttatttatttct

SEQ ID NO: 3627708 - DNA, 10 bp, Homo sapiens
tttatttcaa

SEQ ID NO: 3627709 - DNA, 19 bp, Homo sapiens
tttatttcaataaatcttt

SEQ ID NO: 3627710 - DNA, 16 bp, Homo sapiens
tttatttcagcaaact

SEQ ID NO: 3627711 - DNA, 19 bp, Homo sapiens
tttatttcagcaaacttgt

SEQ ID NO: 3627712 - DNA, 16 bp, Homo sapiens
tttatttctaagtatt

SEQ ID NO: 3627713 - DNA, 17 bp, Homo sapiens
tttatttgaggtcagtg

SEQ ID NO: 3627714 - DNA, 11 bp, Homo sapiens
tttattttctt

SEQ ID NO: 3627715 - DNA, 20 bp, Homo sapiens
tttcaatcttttaaattgca

SEQ ID NO: 3627716 - DNA, 22 bp, Homo sapiens
tttcaatgggttttaattttca

SEQ ID NO: 3627717 - DNA, 12 bp, Homo sapiens
tttcaattaaac

SEQ ID NO: 3627718 - DNA, 17 bp, Homo sapiens
tttcaattgtttatatg

SEQ ID NO: 3627719 - DNA, 22 bp, Homo sapiens
tttcacaaccttctgtggctca

SEQ ID NO: 3627720 - DNA, 19 bp, Homo sapiens
tttcacactggtaaatgtt

SEQ ID NO: 3627721 - DNA, 12 bp, Homo sapiens
tttcacccatcc

SEQ ID NO: 3627722 - DNA, 17 bp, Homo sapiens
tttcacccatcctagga

SEQ ID NO: 3627723 - DNA, 18 bp, Homo sapiens
tttcacccatcctaggaa

SEQ ID NO: 3627724 - DNA, 16 bp, Homo sapiens
tttcacctagattttt

SEQ ID NO: 3627725 - DNA, 18 bp, Homo sapiens
tttcactgctggctgcct

SEQ ID NO: 3627726 - DNA, 14 bp, Homo sapiens
tttcacttatacct

SEQ ID NO: 3627727 - DNA, 16 bp, Homo sapiens
tttcacttgctctttg

SEQ ID NO: 3627728 - DNA, 20 bp, Homo sapiens
tttcactttgtgtattaaat

SEQ ID NO: 3627729 - DNA, 12 bp, Homo sapiens
tttcagaccccc

SEQ ID NO: 3627730 - DNA, 19 bp, Homo sapiens
tttcagagcccccagccct

SEQ ID NO: 3627731 - DNA, 22 bp, Homo sapiens
tttcagagcccccagccctggg

SEQ ID NO: 3627732 - DNA, 20 bp, Homo sapiens
tttcagattcccagagcaaa

SEQ ID NO: 3627733 - DNA, 18 bp, Homo sapiens
tttcagcaagataaacat

SEQ ID NO: 3627734 - DNA, 14 bp, Homo sapiens
tttcagcagtctaa

SEQ ID NO: 3627735 - DNA, 17 bp, Homo sapiens
tttcagcagtctaaatt

SEQ ID NO: 3627736 - DNA, 20 bp, Homo sapiens
tttcagcagtctaaattttc

SEQ ID NO: 3627737 - DNA, 18 bp, Homo sapiens
tttcaggactctctccag

SEQ ID NO: 3627738 - DNA, 20 bp, Homo sapiens
tttcaggactctctccagga

SEQ ID NO: 3627739 - DNA, 14 bp, Homo sapiens
tttcagtgttttca

SEQ ID NO: 3627740 - DNA, 18 bp, Homo sapiens
tttcataaattatttgat

SEQ ID NO: 3627741 - DNA, 19 bp, Homo sapiens
tttcataaattatttgatt

SEQ ID NO: 3627742 - DNA, 18 bp, Homo sapiens
tttcataagatattttat

SEQ ID NO: 3627743 - DNA, 14 bp, Homo sapiens
tttcataatctttg

SEQ ID NO: 3627744 - DNA, 15 bp, Homo sapiens
tttcataattctgaa

SEQ ID NO: 3627745 - DNA, 17 bp, Homo sapiens
tttcatcatttcagcca

SEQ ID NO: 3627746 - DNA, 12 bp, Homo sapiens
tttcatgagttt

SEQ ID NO: 3627747 - DNA, 19 bp, Homo sapiens
tttcatgctatctctgtgt

SEQ ID NO: 3627748 - DNA, 14 bp, Homo sapiens
tttcatgctttatc

SEQ ID NO: 3627749 - DNA, 15 bp, Homo sapiens
tttcatgtaaaaagt

SEQ ID NO: 3627750 - DNA, 19 bp, Homo sapiens
tttcatttagtcatgtgac

SEQ ID NO: 3627751 - DNA, 14 bp, Homo sapiens
tttcatttgtaaaa

SEQ ID NO: 3627752 - DNA, 15 bp, Homo sapiens
tttcattttagacat

SEQ ID NO: 3627753 - DNA, 18 bp, Homo sapiens
tttccaactactaataga

SEQ ID NO: 3627754 - DNA, 16 bp, Homo sapiens
tttccaagaggctgta

SEQ ID NO: 3627755 - DNA, 12 bp, Homo sapiens
tttccagaatga

SEQ ID NO: 3627756 - DNA, 19 bp, Homo sapiens
tttccagaatgaccttgag

SEQ ID NO: 3627757 - DNA, 19 bp, Homo sapiens
tttccagaggctattattt

SEQ ID NO: 3627758 - DNA, 17 bp, Homo sapiens
tttccagcttgcattga

SEQ ID NO: 3627759 - DNA, 20 bp, Homo sapiens
tttccaggactgtttcaaac

SEQ ID NO: 3627760 - DNA, 21 bp, Homo sapiens
tttccagtattgaaaacttca

SEQ ID NO: 3627761 - DNA, 14 bp, Homo sapiens
tttccatcaactcc

SEQ ID NO: 3627762 - DNA, 13 bp, Homo sapiens
tttccatttctga

SEQ ID NO: 3627763 - DNA, 16 bp, Homo sapiens
tttcccaggaccctga

SEQ ID NO: 3627764 - DNA, 18 bp, Homo sapiens
tttcccaggaccctgaag

SEQ ID NO: 3627765 - DNA, 14 bp, Homo sapiens
tttcccattggttc

SEQ ID NO: 3627766 - DNA, 20 bp, Homo sapiens
tttcccattggttcacctgt

SEQ ID NO: 3627767 - DNA, 21 bp, Homo sapiens
tttcccccttcatccatcctg

SEQ ID NO: 3627768 - DNA, 21 bp, Homo sapiens
tttcccgtaaggctgtacata

SEQ ID NO: 3627769 - DNA, 13 bp, Homo sapiens
tttccctgcctct

SEQ ID NO: 3627770 - DNA, 16 bp, Homo sapiens
tttccctgctgaatgc

SEQ ID NO: 3627771 - DNA, 14 bp, Homo sapiens
tttccctggaactc

SEQ ID NO: 3627772 - DNA, 19 bp, Homo sapiens
tttcccttacaaggtgggg

SEQ ID NO: 3627773 - DNA, 20 bp, Homo sapiens
tttcccttctggacactgag

SEQ ID NO: 3627774 - DNA, 16 bp, Homo sapiens
tttccgaagtctctga

SEQ ID NO: 3627775 - DNA, 21 bp, Homo sapiens
tttccggccaaggtgccacca

SEQ ID NO: 3627776 - DNA, 15 bp, Homo sapiens
tttcctaaggctgca

SEQ ID NO: 3627777 - DNA, 22 bp, Homo sapiens
tttcctagtggagttttataaa

SEQ ID NO: 3627778 - DNA, 13 bp, Homo sapiens
tttcctccctcag

SEQ ID NO: 3627779 - DNA, 11 bp, Homo sapiens
tttcctccctt

SEQ ID NO: 3627780 - DNA, 12 bp, Homo sapiens
tttcctctgcac

SEQ ID NO: 3627781 - DNA, 23 bp, Homo sapiens
tttcctgacagaaggactcaggt

SEQ ID NO: 3627782 - DNA, 17 bp, Homo sapiens
tttcctggcagctgctg

SEQ ID NO: 3627783 - DNA, 17 bp, Homo sapiens
tttccttatttgccttc

SEQ ID NO: 3627784 - DNA, 12 bp, Homo sapiens
tttccttcaggc

SEQ ID NO: 3627785 - DNA, 17 bp, Homo sapiens
tttcctttaatatgaaa

SEQ ID NO: 3627786 - DNA, 21 bp, Homo sapiens
tttccttttaaaacacttcca

SEQ ID NO: 3627787 - DNA, 16 bp, Homo sapiens
tttccttttcaggaga

SEQ ID NO: 3627788 - DNA, 17 bp, Homo sapiens
tttccttttttgttatt

SEQ ID NO: 3627789 - DNA, 19 bp, Homo sapiens
tttcgactggtccagctct

SEQ ID NO: 3627790 - DNA, 15 bp, Homo sapiens
tttctaaaaaggctg

SEQ ID NO: 3627791 - DNA, 20 bp, Homo sapiens
tttctaaaatgttaaaacat

SEQ ID NO: 3627792 - DNA, 19 bp, Homo sapiens
tttctaatccttttcctta

SEQ ID NO: 3627793 - DNA, 21 bp, Homo sapiens
tttctaatgttattttccttc

SEQ ID NO: 3627794 - DNA, 16 bp, Homo sapiens
tttctagttctttcct

SEQ ID NO: 3627795 - DNA, 17 bp, Homo sapiens
tttctatacagtagctt

SEQ ID NO: 3627796 - DNA, 21 bp, Homo sapiens
tttctatataaaatgtattca

SEQ ID NO: 3627797 - DNA, 17 bp, Homo sapiens
tttctatattcctccag

SEQ ID NO: 3627798 - DNA, 20 bp, Homo sapiens
tttctatattcctccagctg

SEQ ID NO: 3627799 - DNA, 22 bp, Homo sapiens
tttctatattcctccagctggg

SEQ ID NO: 3627800 - DNA, 17 bp, Homo sapiens
tttctatttatgccttg

SEQ ID NO: 3627801 - DNA, 16 bp, Homo sapiens
tttctcaaatctgctt

SEQ ID NO: 3627802 - DNA, 15 bp, Homo sapiens
tttctcatgttgaag

SEQ ID NO: 3627803 - DNA, 23 bp, Homo sapiens
tttctcatgttgaagctttaaga

SEQ ID NO: 3627804 - DNA, 19 bp, Homo sapiens
tttctcattgctctgaata

SEQ ID NO: 3627805 - DNA, 14 bp, Homo sapiens
tttctccatcccct

SEQ ID NO: 3627806 - DNA, 19 bp, Homo sapiens
tttctccatcccctccctg

SEQ ID NO: 3627807 - DNA, 20 bp, Homo sapiens
tttctccatcccctccctgc

SEQ ID NO: 3627808 - DNA, 23 bp, Homo sapiens
tttctccatcccctccctgcctg

SEQ ID NO: 3627809 - DNA, 16 bp, Homo sapiens
tttctcctttgtactt

SEQ ID NO: 3627810 - DNA, 19 bp, Homo sapiens
tttctccttttcctatcct

SEQ ID NO: 3627811 - DNA, 12 bp, Homo sapiens
tttctctctcct

SEQ ID NO: 3627812 - DNA, 14 bp, Homo sapiens
tttctctctcctct

SEQ ID NO: 3627813 - DNA, 15 bp, Homo sapiens
tttctcttccccttc

SEQ ID NO: 3627814 - DNA, 14 bp, Homo sapiens
tttctgactcttat

SEQ ID NO: 3627815 - DNA, 13 bp, Homo sapiens
tttctgattctga

SEQ ID NO: 3627816 - DNA, 14 bp, Homo sapiens
tttctgcagaaaca

SEQ ID NO: 3627817 - DNA, 14 bp, Homo sapiens
tttctgcatcagct

SEQ ID NO: 3627818 - DNA, 15 bp, Homo sapiens
tttctgccttagcct

SEQ ID NO: 3627819 - DNA, 19 bp, Homo sapiens
tttctgctcagcttctcct

SEQ ID NO: 3627820 - DNA, 17 bp, Homo sapiens
tttctgctttaaaaatg

SEQ ID NO: 3627821 - DNA, 20 bp, Homo sapiens
tttctggaatacatgaaata

SEQ ID NO: 3627822 - DNA, 11 bp, Homo sapiens
tttctggcaaa

SEQ ID NO: 3627823 - DNA, 16 bp, Homo sapiens
tttctgtttgattctt

SEQ ID NO: 3627824 - DNA, 21 bp, Homo sapiens
tttcttaacttcttgcttctt

SEQ ID NO: 3627825 - DNA, 21 bp, Homo sapiens
tttcttattttgtaataaact

SEQ ID NO: 3627826 - DNA, 22 bp, Homo sapiens
tttcttcatctttgccatatgg

SEQ ID NO: 3627827 - DNA, 14 bp, Homo sapiens
tttcttccattcct

SEQ ID NO: 3627828 - DNA, 12 bp, Homo sapiens
tttcttccctgc

SEQ ID NO: 3627829 - DNA, 13 bp, Homo sapiens
tttcttccctgct

SEQ ID NO: 3627830 - DNA, 15 bp, Homo sapiens
tttcttccctgcttt

SEQ ID NO: 3627831 - DNA, 20 bp, Homo sapiens
tttcttccctgctttgcatc

SEQ ID NO: 3627832 - DNA, 13 bp, Homo sapiens
tttcttctttctt

SEQ ID NO: 3627833 - DNA, 13 bp, Homo sapiens
tttctttcacttt

SEQ ID NO: 3627834 - DNA, 20 bp, Homo sapiens
tttctttccaaaacatttct

SEQ ID NO: 3627835 - DNA, 14 bp, Homo sapiens
tttctttctgtctt

SEQ ID NO: 3627836 - DNA, 15 bp, Homo sapiens
tttctttcttccatt

SEQ ID NO: 3627837 - DNA, 13 bp, Homo sapiens
tttctttgaataa

SEQ ID NO: 3627838 - DNA, 14 bp, Homo sapiens
tttctttgaataaa

SEQ ID NO: 3627839 - DNA, 15 bp, Homo sapiens
tttctttgaataaat

SEQ ID NO: 3627840 - DNA, 15 bp, Homo sapiens
tttctttgccatctc

SEQ ID NO: 3627841 - DNA, 12 bp, Homo sapiens
tttctttgcctc

SEQ ID NO: 3627842 - DNA, 13 bp, Homo sapiens
tttctttgcctct

SEQ ID NO: 3627843 - DNA, 15 bp, Homo sapiens
tttcttttgcaggag

SEQ ID NO: 3627844 - DNA, 19 bp, Homo sapiens
tttgaaaaccatattttat

SEQ ID NO: 3627845 - DNA, 11 bp, Homo sapiens
tttgaaaatgg

SEQ ID NO: 3627846 - DNA, 13 bp, Homo sapiens
tttgaaaattaca

SEQ ID NO: 3627847 - DNA, 22 bp, Homo sapiens
tttgaaaattacatgttttttc

SEQ ID NO: 3627848 - DNA, 18 bp, Homo sapiens
tttgaaacacaataccta

SEQ ID NO: 3627849 - DNA, 12 bp, Homo sapiens
tttgaaagcttt

SEQ ID NO: 3627850 - DNA, 13 bp, Homo sapiens
tttgaaatacctt

SEQ ID NO: 3627851 - DNA, 21 bp, Homo sapiens
tttgaaatgaggtctgtttaa

SEQ ID NO: 3627852 - DNA, 17 bp, Homo sapiens
tttgaaattatgtgaca

SEQ ID NO: 3627853 - DNA, 22 bp, Homo sapiens
tttgaagatgccgcatttggat

SEQ ID NO: 3627854 - DNA, 16 bp, Homo sapiens
tttgaagtgcagctca

SEQ ID NO: 3627855 - DNA, 16 bp, Homo sapiens
tttgaagtgctgttta

SEQ ID NO: 3627856 - DNA, 17 bp, Homo sapiens
tttgaatatttgtttta

SEQ ID NO: 3627857 - DNA, 21 bp, Homo sapiens
tttgaatatttgttttaatac

SEQ ID NO: 3627858 - DNA, 13 bp, Homo sapiens
tttgacagccttc

SEQ ID NO: 3627859 - DNA, 19 bp, Homo sapiens
tttgacagtgttgaaaatg

SEQ ID NO: 3627860 - DNA, 20 bp, Homo sapiens
tttgacatttttgccaaaat

SEQ ID NO: 3627861 - DNA, 22 bp, Homo sapiens
tttgaccagaactttttcctct

SEQ ID NO: 3627862 - DNA, 15 bp, Homo sapiens
tttgactttcttctg

SEQ ID NO: 3627863 - DNA, 22 bp, Homo sapiens
tttgactttcttctgaatattt

SEQ ID NO: 3627864 - DNA, 12 bp, Homo sapiens
tttgagcatttt

SEQ ID NO: 3627865 - DNA, 13 bp, Homo sapiens
tttgataaactga

SEQ ID NO: 3627866 - DNA, 15 bp, Homo sapiens
tttgataagaaaacc

SEQ ID NO: 3627867 - DNA, 13 bp, Homo sapiens
tttgatatgccac

SEQ ID NO: 3627868 - DNA, 20 bp, Homo sapiens
tttgatgagatattaaattc

SEQ ID NO: 3627869 - DNA, 21 bp, Homo sapiens
tttgatgagatattaaattct

SEQ ID NO: 3627870 - DNA, 21 bp, Homo sapiens
tttgattaaccttttcaaatt

SEQ ID NO: 3627871 - DNA, 10 bp, Homo sapiens
tttgattggc

SEQ ID NO: 3627872 - DNA, 12 bp, Homo sapiens
tttgattggctt

SEQ ID NO: 3627873 - DNA, 14 bp, Homo sapiens
tttgcaccaaagac

SEQ ID NO: 3627874 - DNA, 16 bp, Homo sapiens
tttgcaccaaagacat

SEQ ID NO: 3627875 - DNA, 19 bp, Homo sapiens
tttgcaggagtttgtggta

SEQ ID NO: 3627876 - DNA, 20 bp, Homo sapiens
tttgccaaggctctcccctc

SEQ ID NO: 3627877 - DNA, 15 bp, Homo sapiens
tttgccaataaagct

SEQ ID NO: 3627878 - DNA, 16 bp, Homo sapiens
tttgccactgtgtttc

SEQ ID NO: 3627879 - DNA, 15 bp, Homo sapiens
tttgccatctctgct

SEQ ID NO: 3627880 - DNA, 16 bp, Homo sapiens
tttgcctcttctttgt

SEQ ID NO: 3627881 - DNA, 22 bp, Homo sapiens
tttgcgcctcggtatctggctt

SEQ ID NO: 3627882 - DNA, 13 bp, Homo sapiens
tttgcggcagtgt

SEQ ID NO: 3627883 - DNA, 14 bp, Homo sapiens
tttgctaactggtt

SEQ ID NO: 3627884 - DNA, 16 bp, Homo sapiens
tttgctaactggttaa

SEQ ID NO: 3627885 - DNA, 13 bp, Homo sapiens
tttgctgaaattt

SEQ ID NO: 3627886 - DNA, 18 bp, Homo sapiens
tttgcttgtactgggaca

SEQ ID NO: 3627887 - DNA, 18 bp, Homo sapiens
tttgctttgctttctgct

SEQ ID NO: 3627888 - DNA, 12 bp, Homo sapiens
tttggaaaataa

SEQ ID NO: 3627889 - DNA, 16 bp, Homo sapiens
tttggacagtggcctc

SEQ ID NO: 3627890 - DNA, 20 bp, Homo sapiens
tttggagagggaaaatcttc

SEQ ID NO: 3627891 - DNA, 21 bp, Homo sapiens
tttggagagggaaaatcttca

SEQ ID NO: 3627892 - DNA, 14 bp, Homo sapiens
tttggatgttgcta

SEQ ID NO: 3627893 - DNA, 22 bp, Homo sapiens
tttggattggatgaattccaaa

SEQ ID NO: 3627894 - DNA, 13 bp, Homo sapiens
tttggcaataaat

SEQ ID NO: 3627895 - DNA, 18 bp, Homo sapiens
tttggcaataaataaagc

SEQ ID NO: 3627896 - DNA, 21 bp, Homo sapiens
tttgggagacatgtgacattt

SEQ ID NO: 3627897 - DNA, 14 bp, Homo sapiens
tttgggagccagga

SEQ ID NO: 3627898 - DNA, 21 bp, Homo sapiens
tttgggagccaggactcccag

SEQ ID NO: 3627899 - DNA, 17 bp, Homo sapiens
tttgggcagagaggctg

SEQ ID NO: 3627900 - DNA, 14 bp, Homo sapiens
tttgggctgccctg

SEQ ID NO: 3627901 - DNA, 23 bp, Homo sapiens
tttgggcttgttgtttgtaacaa

SEQ ID NO: 3627902 - DNA, 22 bp, Homo sapiens
tttgggggtaaagtttgctcta

SEQ ID NO: 3627903 - DNA, 20 bp, Homo sapiens
tttgggggtcagcatccagt

SEQ ID NO: 3627904 - DNA, 19 bp, Homo sapiens
tttggtgagagtcaaagct

SEQ ID NO: 3627905 - DNA, 21 bp, Homo sapiens
tttggtgagagtcaaagctga

SEQ ID NO: 3627906 - DNA, 21 bp, Homo sapiens
tttggttagaagtaaggatta

SEQ ID NO: 3627907 - DNA, 20 bp, Homo sapiens
tttggttatgaatactttgc

SEQ ID NO: 3627908 - DNA, 15 bp, Homo sapiens
tttggtttcttcatt

SEQ ID NO: 3627909 - DNA, 23 bp, Homo sapiens
tttggtttgccttttatgtaaat

SEQ ID NO: 3627910 - DNA, 15 bp, Homo sapiens
tttgtaaaacttctg

SEQ ID NO: 3627911 - DNA, 22 bp, Homo sapiens
tttgtaaactcaaaatatttgt

SEQ ID NO: 3627912 - DNA, 21 bp, Homo sapiens
tttgtaaatgaaacttaagaa

SEQ ID NO: 3627913 - DNA, 24 bp, Homo sapiens
tttgtaaatgaaacttaagaattg

SEQ ID NO: 3627914 - DNA, 13 bp, Homo sapiens
tttgtaataaact

SEQ ID NO: 3627915 - DNA, 17 bp, Homo sapiens
tttgtaataaactctct

SEQ ID NO: 3627916 - DNA, 22 bp, Homo sapiens
tttgtaatctagttgtcaataa

SEQ ID NO: 3627917 - DNA, 20 bp, Homo sapiens
tttgtaccttttgtagtttt

SEQ ID NO: 3627918 - DNA, 14 bp, Homo sapiens
tttgtactgaaaaa

SEQ ID NO: 3627919 - DNA, 19 bp, Homo sapiens
tttgtagtagcgtttttta

SEQ ID NO: 3627920 - DNA, 18 bp, Homo sapiens
tttgtagtgaaataatag

SEQ ID NO: 3627921 - DNA, 21 bp, Homo sapiens
tttgtataattggatttccta

SEQ ID NO: 3627922 - DNA, 14 bp, Homo sapiens
tttgtatcttttat

SEQ ID NO: 3627923 - DNA, 19 bp, Homo sapiens
tttgtatttattaatttga

SEQ ID NO: 3627924 - DNA, 15 bp, Homo sapiens
tttgtcactttttct

SEQ ID NO: 3627925 - DNA, 17 bp, Homo sapiens
tttgtcatggtgaaatt

SEQ ID NO: 3627926 - DNA, 20 bp, Homo sapiens
tttgtcatgttatgcagtga

SEQ ID NO: 3627927 - DNA, 15 bp, Homo sapiens
tttgtcattcagttc

SEQ ID NO: 3627928 - DNA, 16 bp, Homo sapiens
tttgtcattcagttct

SEQ ID NO: 3627929 - DNA, 22 bp, Homo sapiens
tttgtcattcagttctaggcct

SEQ ID NO: 3627930 - DNA, 16 bp, Homo sapiens
tttgtctccaaagaag

SEQ ID NO: 3627931 - DNA, 18 bp, Homo sapiens
tttgtctccaaagaagat

SEQ ID NO: 3627932 - DNA, 22 bp, Homo sapiens
tttgtctccaaagaagatagct

SEQ ID NO: 3627933 - DNA, 18 bp, Homo sapiens
tttgtcttaaaaaatgtg

SEQ ID NO: 3627934 - DNA, 22 bp, Homo sapiens
tttgtcttaaaaaatgtgaaat

SEQ ID NO: 3627935 - DNA, 18 bp, Homo sapiens
tttgtgaaacagacttgt

SEQ ID NO: 3627936 - DNA, 15 bp, Homo sapiens
tttgtgaattaggct

SEQ ID NO: 3627937 - DNA, 15 bp, Homo sapiens
tttgtgcctttggcc

SEQ ID NO: 3627938 - DNA, 16 bp, Homo sapiens
tttgtgctttttgtca

SEQ ID NO: 3627939 - DNA, 17 bp, Homo sapiens
tttgtgctttttgtcat

SEQ ID NO: 3627940 - DNA, 21 bp, Homo sapiens
tttgtggagtttgacacctta

SEQ ID NO: 3627941 - DNA, 18 bp, Homo sapiens
tttgtggccaaggagctg

SEQ ID NO: 3627942 - DNA, 22 bp, Homo sapiens
tttgtggccaaggagctgctat

SEQ ID NO: 3627943 - DNA, 21 bp, Homo sapiens
tttgtggtaacttgagattca

SEQ ID NO: 3627944 - DNA, 15 bp, Homo sapiens
tttgttaatatttct

SEQ ID NO: 3627945 - DNA, 15 bp, Homo sapiens
tttgttacttcctta

SEQ ID NO: 3627946 - DNA, 16 bp, Homo sapiens
tttgttacttccttat

SEQ ID NO: 3627947 - DNA, 17 bp, Homo sapiens
tttgttaggttttctat

SEQ ID NO: 3627948 - DNA, 20 bp, Homo sapiens
tttgttggtttttaaagatt

SEQ ID NO: 3627949 - DNA, 22 bp, Homo sapiens
tttgtttagcctgaaaaccttt

SEQ ID NO: 3627950 - DNA, 17 bp, Homo sapiens
tttgtttctttctctga

SEQ ID NO: 3627951 - DNA, 20 bp, Homo sapiens
tttgttttaaccaataacta

SEQ ID NO: 3627952 - DNA, 17 bp, Homo sapiens
tttgttttatttaggca

SEQ ID NO: 3627953 - DNA, 15 bp, Homo sapiens
tttgttttgctgaga

SEQ ID NO: 3627954 - DNA, 17 bp, Homo sapiens
ttttaaaaaatggtcac

SEQ ID NO: 3627955 - DNA, 21 bp, Homo sapiens
ttttaaaaaggtaaatggtta

SEQ ID NO: 3627956 - DNA, 11 bp, Homo sapiens
ttttaaaattt

SEQ ID NO: 3627957 - DNA, 12 bp, Homo sapiens
ttttaaaattta

SEQ ID NO: 3627958 - DNA, 12 bp, Homo sapiens
ttttaaatgtat

SEQ ID NO: 3627959 - DNA, 19 bp, Homo sapiens
ttttaaattatgttttact

SEQ ID NO: 3627960 - DNA, 12 bp, Homo sapiens
ttttaaattcca

SEQ ID NO: 3627961 - DNA, 19 bp, Homo sapiens
ttttaaattccactgaaaa

SEQ ID NO: 3627962 - DNA, 13 bp, Homo sapiens
ttttaaattgcaa

SEQ ID NO: 3627963 - DNA, 17 bp, Homo sapiens
ttttaacttttaattta

SEQ ID NO: 3627964 - DNA, 20 bp, Homo sapiens
ttttaagaaaaaataaaagg

SEQ ID NO: 3627965 - DNA, 22 bp, Homo sapiens
ttttaagaaagaaatactgtat

SEQ ID NO: 3627966 - DNA, 20 bp, Homo sapiens
ttttaagggtttgtggaaaa

SEQ ID NO: 3627967 - DNA, 20 bp, Homo sapiens
ttttaaggtctaatcagtga

SEQ ID NO: 3627968 - DNA, 21 bp, Homo sapiens
ttttaattactgctataaata

SEQ ID NO: 3627969 - DNA, 21 bp, Homo sapiens
ttttaatttaatttttccttt

SEQ ID NO: 3627970 - DNA, 16 bp, Homo sapiens
ttttacagctgcctgc

SEQ ID NO: 3627971 - DNA, 16 bp, Homo sapiens
ttttacatctaaacta

SEQ ID NO: 3627972 - DNA, 21 bp, Homo sapiens
ttttacatgaagctgtataat

SEQ ID NO: 3627973 - DNA, 12 bp, Homo sapiens
ttttacatttca

SEQ ID NO: 3627974 - DNA, 16 bp, Homo sapiens
ttttacatttcataca

SEQ ID NO: 3627975 - DNA, 11 bp, Homo sapiens
ttttaccaaag

SEQ ID NO: 3627976 - DNA, 12 bp, Homo sapiens
ttttaccaaagc

SEQ ID NO: 3627977 - DNA, 17 bp, Homo sapiens
ttttaccaaagcatcaa

SEQ ID NO: 3627978 - DNA, 21 bp, Homo sapiens
ttttaccctgaggtcactgct

SEQ ID NO: 3627979 - DNA, 22 bp, Homo sapiens
ttttacctattctgaaaaagac

SEQ ID NO: 3627980 - DNA, 15 bp, Homo sapiens
ttttactctttgaaa

SEQ ID NO: 3627981 - DNA, 19 bp, Homo sapiens
ttttactgaagcctttctt

SEQ ID NO: 3627982 - DNA, 22 bp, Homo sapiens
ttttagaagattctatgttaat

SEQ ID NO: 3627983 - DNA, 12 bp, Homo sapiens
ttttataaatta

SEQ ID NO: 3627984 - DNA, 20 bp, Homo sapiens
ttttatagaaaacctgactt

SEQ ID NO: 3627985 - DNA, 19 bp, Homo sapiens
ttttatatgtgagcgagca

SEQ ID NO: 3627986 - DNA, 9 bp, Homo sapiens
ttttatatt

SEQ ID NO: 3627987 - DNA, 21 bp, Homo sapiens
ttttatattgtttttgtattt

SEQ ID NO: 3627988 - DNA, 13 bp, Homo sapiens
ttttatgccccat

SEQ ID NO: 3627989 - DNA, 15 bp, Homo sapiens
ttttatgtaaatttt

SEQ ID NO: 3627990 - DNA, 13 bp, Homo sapiens
ttttattccctgc

SEQ ID NO: 3627991 - DNA, 15 bp, Homo sapiens
ttttattgttttcta

SEQ ID NO: 3627992 - DNA, 13 bp, Homo sapiens
ttttatttctaag

SEQ ID NO: 3627993 - DNA, 13 bp, Homo sapiens
ttttatttctgac

SEQ ID NO: 3627994 - DNA, 12 bp, Homo sapiens
ttttatttgtaa

SEQ ID NO: 3627995 - DNA, 18 bp, Homo sapiens
ttttatttgtaaagtgat

SEQ ID NO: 3627996 - DNA, 17 bp, Homo sapiens
ttttatttttagaattt

SEQ ID NO: 3627997 - DNA, 17 bp, Homo sapiens
ttttcaacgcagccctg

SEQ ID NO: 3627998 - DNA, 22 bp, Homo sapiens
ttttcaacgcagccctgctttg

SEQ ID NO: 3627999 - DNA, 19 bp, Homo sapiens
ttttcaatatgcaagcagc

SEQ ID NO: 3628000 - DNA, 22 bp, Homo sapiens
ttttcaatatgcaagcagcttt

SEQ ID NO: 3628001 - DNA, 12 bp, Homo sapiens
ttttcaattaaa

SEQ ID NO: 3628002 - DNA, 13 bp, Homo sapiens
ttttcaattaaac

SEQ ID NO: 3628003 - DNA, 16 bp, Homo sapiens
ttttcaattaaacgga

SEQ ID NO: 3628004 - DNA, 17 bp, Homo sapiens
ttttcaattaaacggat

SEQ ID NO: 3628005 - DNA, 21 bp, Homo sapiens
ttttcaattaaacggattatt

SEQ ID NO: 3628006 - DNA, 16 bp, Homo sapiens
ttttcactgtagaatg

SEQ ID NO: 3628007 - DNA, 14 bp, Homo sapiens
ttttcagagaatta

SEQ ID NO: 3628008 - DNA, 19 bp, Homo sapiens
ttttcataagatattttat

SEQ ID NO: 3628009 - DNA, 15 bp, Homo sapiens
ttttcatatctcttg

SEQ ID NO: 3628010 - DNA, 13 bp, Homo sapiens
ttttcatcatttc

SEQ ID NO: 3628011 - DNA, 19 bp, Homo sapiens
ttttcatcatttcagccaa

SEQ ID NO: 3628012 - DNA, 16 bp, Homo sapiens
ttttcatgctttatca

SEQ ID NO: 3628013 - DNA, 17 bp, Homo sapiens
ttttcatgctttatcaa

SEQ ID NO: 3628014 - DNA, 10 bp, Homo sapiens
ttttcatgtt

SEQ ID NO: 3628015 - DNA, 12 bp, Homo sapiens
ttttcatgtttt

SEQ ID NO: 3628016 - DNA, 17 bp, Homo sapiens
ttttcattttagacatt

SEQ ID NO: 3628017 - DNA, 13 bp, Homo sapiens
ttttccagtattg

SEQ ID NO: 3628018 - DNA, 13 bp, Homo sapiens
ttttccattttat

SEQ ID NO: 3628019 - DNA, 16 bp, Homo sapiens
ttttcccccttcccat

SEQ ID NO: 3628020 - DNA, 14 bp, Homo sapiens
ttttccgtaaatgt

SEQ ID NO: 3628021 - DNA, 21 bp, Homo sapiens
ttttccgtaaatgtctgcact

SEQ ID NO: 3628022 - DNA, 16 bp, Homo sapiens
ttttcctggcagctgc

SEQ ID NO: 3628023 - DNA, 17 bp, Homo sapiens
ttttccttcagatattt

SEQ ID NO: 3628024 - DNA, 20 bp, Homo sapiens
ttttcctttttcttcgctgg

SEQ ID NO: 3628025 - DNA, 11 bp, Homo sapiens
ttttctaaaat

SEQ ID NO: 3628026 - DNA, 19 bp, Homo sapiens
ttttctcctcccaggaact

SEQ ID NO: 3628027 - DNA, 12 bp, Homo sapiens
ttttctctcttt

SEQ ID NO: 3628028 - DNA, 16 bp, Homo sapiens
ttttctctggtaatat

SEQ ID NO: 3628029 - DNA, 15 bp, Homo sapiens
ttttctgagaaagac

SEQ ID NO: 3628030 - DNA, 18 bp, Homo sapiens
ttttctgagaaagactat

SEQ ID NO: 3628031 - DNA, 23 bp, Homo sapiens
ttttctgaggtccttatgtcctg

SEQ ID NO: 3628032 - DNA, 21 bp, Homo sapiens
ttttctggaatacatgaaata

SEQ ID NO: 3628033 - DNA, 11 bp, Homo sapiens
ttttcttctga

SEQ ID NO: 3628034 - DNA, 12 bp, Homo sapiens
ttttcttgataa

SEQ ID NO: 3628035 - DNA, 16 bp, Homo sapiens
ttttcttgataatttt

SEQ ID NO: 3628036 - DNA, 20 bp, Homo sapiens
ttttctttgccatctctgct

SEQ ID NO: 3628037 - DNA, 19 bp, Homo sapiens
ttttctttgtgtagctttg

SEQ ID NO: 3628038 - DNA, 22 bp, Homo sapiens
ttttgaaaaatgcactgggaaa

SEQ ID NO: 3628039 - DNA, 19 bp, Homo sapiens
ttttgaaacacaataccta

SEQ ID NO: 3628040 - DNA, 14 bp, Homo sapiens
ttttgaaatacctt

SEQ ID NO: 3628041 - DNA, 20 bp, Homo sapiens
ttttgaaattatgtgacatt

SEQ ID NO: 3628042 - DNA, 18 bp, Homo sapiens
ttttgaatacatttgtat

SEQ ID NO: 3628043 - DNA, 19 bp, Homo sapiens
ttttgaatacatttgtatt

SEQ ID NO: 3628044 - DNA, 24 bp, Homo sapiens
ttttgacagtgttgaaaatgttca

SEQ ID NO: 3628045 - DNA, 17 bp, Homo sapiens
ttttgatcttgtgctat

SEQ ID NO: 3628046 - DNA, 21 bp, Homo sapiens
ttttgatttgtactgaaaaat

SEQ ID NO: 3628047 - DNA, 21 bp, Homo sapiens
ttttgattttgtttactgaaa

SEQ ID NO: 3628048 - DNA, 19 bp, Homo sapiens
ttttgcaaattatattttg

SEQ ID NO: 3628049 - DNA, 14 bp, Homo sapiens
ttttgctaactggt

SEQ ID NO: 3628050 - DNA, 15 bp, Homo sapiens
ttttgctcagttcca

SEQ ID NO: 3628051 - DNA, 14 bp, Homo sapiens
ttttgctgaattcc

SEQ ID NO: 3628052 - DNA, 15 bp, Homo sapiens
ttttgctgagagcat

SEQ ID NO: 3628053 - DNA, 16 bp, Homo sapiens
ttttggaggcctgact

SEQ ID NO: 3628054 - DNA, 14 bp, Homo sapiens
ttttggatgttgct

SEQ ID NO: 3628055 - DNA, 17 bp, Homo sapiens
ttttggcagccatgata

SEQ ID NO: 3628056 - DNA, 19 bp, Homo sapiens
ttttgggggtcagcatcca

SEQ ID NO: 3628057 - DNA, 13 bp, Homo sapiens
ttttggtcaaatt

SEQ ID NO: 3628058 - DNA, 15 bp, Homo sapiens
ttttggtccttcttt

SEQ ID NO: 3628059 - DNA, 21 bp, Homo sapiens
ttttggttagaagtaaggatt

SEQ ID NO: 3628060 - DNA, 23 bp, Homo sapiens
ttttggtttgccttttatgtaaa

SEQ ID NO: 3628061 - DNA, 18 bp, Homo sapiens
ttttgtaaactcaaaata

SEQ ID NO: 3628062 - DNA, 14 bp, Homo sapiens
ttttgtaagacaaa

SEQ ID NO: 3628063 - DNA, 16 bp, Homo sapiens
ttttgtaataaactct

SEQ ID NO: 3628064 - DNA, 14 bp, Homo sapiens
ttttgtagttttat

SEQ ID NO: 3628065 - DNA, 14 bp, Homo sapiens
ttttgtataattgg

SEQ ID NO: 3628066 - DNA, 13 bp, Homo sapiens
ttttgtatcttaa

SEQ ID NO: 3628067 - DNA, 16 bp, Homo sapiens
ttttgtcatataagat

SEQ ID NO: 3628068 - DNA, 11 bp, Homo sapiens
ttttgtcatgt

SEQ ID NO: 3628069 - DNA, 15 bp, Homo sapiens
ttttgtctaattaaa

SEQ ID NO: 3628070 - DNA, 14 bp, Homo sapiens
ttttgtgaattagg

SEQ ID NO: 3628071 - DNA, 20 bp, Homo sapiens
ttttgtgtcttttaaactgg

SEQ ID NO: 3628072 - DNA, 15 bp, Homo sapiens
ttttgttccacaagt

SEQ ID NO: 3628073 - DNA, 15 bp, Homo sapiens
ttttgttttgttgga

SEQ ID NO: 3628074 - DNA, 18 bp, Homo sapiens
tttttaaaaaaactggat

SEQ ID NO: 3628075 - DNA, 20 bp, Homo sapiens
tttttaaaaatccatttacc

SEQ ID NO: 3628076 - DNA, 12 bp, Homo sapiens
tttttaaaattt

SEQ ID NO: 3628077 - DNA, 16 bp, Homo sapiens
tttttaaacaataaag

SEQ ID NO: 3628078 - DNA, 17 bp, Homo sapiens
tttttaaagacagagtc

SEQ ID NO: 3628079 - DNA, 16 bp, Homo sapiens
tttttaaataaaagca

SEQ ID NO: 3628080 - DNA, 19 bp, Homo sapiens
tttttaaataaaagcacaa

SEQ ID NO: 3628081 - DNA, 13 bp, Homo sapiens
tttttaaattgtt

SEQ ID NO: 3628082 - DNA, 13 bp, Homo sapiens
tttttaagtgaaa

SEQ ID NO: 3628083 - DNA, 12 bp, Homo sapiens
tttttaataaac

SEQ ID NO: 3628084 - DNA, 15 bp, Homo sapiens
tttttaataaactac

SEQ ID NO: 3628085 - DNA, 20 bp, Homo sapiens
tttttaataaagacagggtt

SEQ ID NO: 3628086 - DNA, 17 bp, Homo sapiens
tttttaggtgctttaga

SEQ ID NO: 3628087 - DNA, 12 bp, Homo sapiens
tttttatataca

SEQ ID NO: 3628088 - DNA, 13 bp, Homo sapiens
tttttatgttata

SEQ ID NO: 3628089 - DNA, 14 bp, Homo sapiens
tttttattaaaata

SEQ ID NO: 3628090 - DNA, 23 bp, Homo sapiens
tttttattaaaatatttcaggtt

SEQ ID NO: 3628091 - DNA, 12 bp, Homo sapiens
tttttcaattaa

SEQ ID NO: 3628092 - DNA, 14 bp, Homo sapiens
tttttcaattaaac

SEQ ID NO: 3628093 - DNA, 15 bp, Homo sapiens
tttttcaattaaacg

SEQ ID NO: 3628094 - DNA, 17 bp, Homo sapiens
tttttcaattaaacgga

SEQ ID NO: 3628095 - DNA, 20 bp, Homo sapiens
tttttcaattaaacggatta

SEQ ID NO: 3628096 - DNA, 21 bp, Homo sapiens
tttttcaattaaacggattat

SEQ ID NO: 3628097 - DNA, 20 bp, Homo sapiens
tttttccaaccaaggaattt

SEQ ID NO: 3628098 - DNA, 17 bp, Homo sapiens
tttttccgtaaatgtct

SEQ ID NO: 3628099 - DNA, 13 bp, Homo sapiens
tttttcgtgtttt

SEQ ID NO: 3628100 - DNA, 11 bp, Homo sapiens
tttttcttctg

SEQ ID NO: 3628101 - DNA, 14 bp, Homo sapiens
tttttgaaatacct

SEQ ID NO: 3628102 - DNA, 19 bp, Homo sapiens
tttttggaagtgaaaactt

SEQ ID NO: 3628103 - DNA, 22 bp, Homo sapiens
tttttggaccaccgttcagtca

SEQ ID NO: 3628104 - DNA, 20 bp, Homo sapiens
tttttgggcagcaatttaaa

SEQ ID NO: 3628105 - DNA, 11 bp, Homo sapiens
tttttgtagta

SEQ ID NO: 3628106 - DNA, 12 bp, Homo sapiens
tttttgtttgca

SEQ ID NO: 3628107 - DNA, 19 bp, Homo sapiens
ttttttaaatcttgaccaa

SEQ ID NO: 3628108 - DNA, 13 bp, Homo sapiens
ttttttacagatt

SEQ ID NO: 3628109 - DNA, 14 bp, Homo sapiens
ttttttcagaccga

SEQ ID NO: 3628110 - DNA, 13 bp, Homo sapiens
ttttttcccatga

SEQ ID NO: 3628111 - DNA, 12 bp, Homo sapiens
ttttttgttatt

SEQ ID NO: 3628112 - DNA, 14 bp, Homo sapiens
tttttttgttatta

SEQ ID NO: 3628113 - DNA, 21 bp, Homo sapiens
aagtaacttttaaaatttgtc

SEQ ID NO: 3628114 - DNA, 17 bp, Homo sapiens
aagtaatgacagaacat

SEQ ID NO: 3628115 - DNA, 12 bp, Homo sapiens
aagtaatttaat

SEQ ID NO: 3628116 - DNA, 17 bp, Homo sapiens
aagtacacaataagcaa

SEQ ID NO: 3628117 - DNA, 19 bp, Homo sapiens
aagtacacaataagcaaaa

SEQ ID NO: 3628118 - DNA, 23 bp, Homo sapiens
aagtacggctggctacaactgct

SEQ ID NO: 3628119 - DNA, 23 bp, Homo sapiens
aagtacttggcccccttcaggag

SEQ ID NO: 3628120 - DNA, 16 bp, Homo sapiens
aagtagacctcttttt

SEQ ID NO: 3628121 - DNA, 20 bp, Homo sapiens
aagtagaggttgtatacacc

SEQ ID NO: 3628122 - DNA, 21 bp, Homo sapiens
aagtagggacttctgtcttca

SEQ ID NO: 3628123 - DNA, 23 bp, Homo sapiens
aagtatatcatgtaaagaaatgt

SEQ ID NO: 3628124 - DNA, 21 bp, Homo sapiens
aagtatgtatattaaaaaaga

SEQ ID NO: 3628125 - DNA, 18 bp, Homo sapiens
aagtattaagcagttcat

SEQ ID NO: 3628126 - DNA, 21 bp, Homo sapiens
aagtattaagcagttcattct

SEQ ID NO: 3628127 - DNA, 13 bp, Homo sapiens
aagtatttaaatg

SEQ ID NO: 3628128 - DNA, 21 bp, Homo sapiens
aagtatttaaatgttctaaca

SEQ ID NO: 3628129 - DNA, 10 bp, Homo sapiens
aagtatttag

SEQ ID NO: 3628130 - DNA, 11 bp, Homo sapiens
aagtatttagg

SEQ ID NO: 3628131 - DNA, 14 bp, Homo sapiens
aagtcaaaaggaac

SEQ ID NO: 3628132 - DNA, 15 bp, Homo sapiens
aagtcaaaaggaaca

SEQ ID NO: 3628133 - DNA, 21 bp, Homo sapiens
aagtcacacattacaaagtta

SEQ ID NO: 3628134 - DNA, 23 bp, Homo sapiens
aagtcactcccaagccccctcct

SEQ ID NO: 3628135 - DNA, 20 bp, Homo sapiens
aagtcatcttgctaccagta

SEQ ID NO: 3628136 - DNA, 15 bp, Homo sapiens
aagtcattaaagaca

SEQ ID NO: 3628137 - DNA, 15 bp, Homo sapiens
aagtccaataagaca

SEQ ID NO: 3628138 - DNA, 21 bp, Homo sapiens
aagtcccttcagactggccct

SEQ ID NO: 3628139 - DNA, 23 bp, Homo sapiens
aagtctctgattagttgacagta

SEQ ID NO: 3628140 - DNA, 11 bp, Homo sapiens
aagtcttccta

SEQ ID NO: 3628141 - DNA, 15 bp, Homo sapiens
aagtgaaaaacatga

SEQ ID NO: 3628142 - DNA, 12 bp, Homo sapiens
aagtgaaaatat

SEQ ID NO: 3628143 - DNA, 19 bp, Homo sapiens
aagtgaactaccatgcttt

SEQ ID NO: 3628144 - DNA, 20 bp, Homo sapiens
aagtgacctcactggcctgc

SEQ ID NO: 3628145 - DNA, 20 bp, Homo sapiens
aagtgagcagtcgcctgcct

SEQ ID NO: 3628146 - DNA, 22 bp, Homo sapiens
aagtgcaataaatctgacccag

SEQ ID NO: 3628147 - DNA, 14 bp, Homo sapiens
aagtgcacaggagc

SEQ ID NO: 3628148 - DNA, 17 bp, Homo sapiens
aagtgcagctcatgttt

SEQ ID NO: 3628149 - DNA, 18 bp, Homo sapiens
aagtgcagtcagcagatg

SEQ ID NO: 3628150 - DNA, 15 bp, Homo sapiens
aagtgccaaatgctc

SEQ ID NO: 3628151 - DNA, 22 bp, Homo sapiens
aagtgccccaccactccccaac

SEQ ID NO: 3628152 - DNA, 14 bp, Homo sapiens
aagtgcctgagctg

SEQ ID NO: 3628153 - DNA, 19 bp, Homo sapiens
aagtgcctgagctggggaa

SEQ ID NO: 3628154 - DNA, 13 bp, Homo sapiens
aagtgcctgggct

SEQ ID NO: 3628155 - DNA, 17 bp, Homo sapiens
aagtgctcatctgttgt

SEQ ID NO: 3628156 - DNA, 22 bp, Homo sapiens
aagtgctcttggctgacccctc

SEQ ID NO: 3628157 - DNA, 23 bp, Homo sapiens
aagtgctcttggctgacccctct

SEQ ID NO: 3628158 - DNA, 14 bp, Homo sapiens
aagtgctgtttatt

SEQ ID NO: 3628159 - DNA, 18 bp, Homo sapiens
aagtgctgtttattaatc

SEQ ID NO: 3628160 - DNA, 16 bp, Homo sapiens
aagtggagacagtcct

SEQ ID NO: 3628161 - DNA, 14 bp, Homo sapiens
aagtggagctgtct

SEQ ID NO: 3628162 - DNA, 16 bp, Homo sapiens
aagtggagctgtctgt

SEQ ID NO: 3628163 - DNA, 18 bp, Homo sapiens
aagtggggtgctctggtc

SEQ ID NO: 3628164 - DNA, 14 bp, Homo sapiens
aagtgtacatatgt

SEQ ID NO: 3628165 - DNA, 22 bp, Homo sapiens
aagtgtgaagacccaaaacagc

SEQ ID NO: 3628166 - DNA, 19 bp, Homo sapiens
aagtgtgagctcttccctt

SEQ ID NO: 3628167 - DNA, 19 bp, Homo sapiens
aagtgtgcagccatagttt

SEQ ID NO: 3628168 - DNA, 15 bp, Homo sapiens
aagtgtgctgggcag

SEQ ID NO: 3628169 - DNA, 17 bp, Homo sapiens
aagtgtgctgggcagag

SEQ ID NO: 3628170 - DNA, 19 bp, Homo sapiens
aagtgttgctgtggctcca

SEQ ID NO: 3628171 - DNA, 19 bp, Homo sapiens
aagtgtttatgttgtttat

SEQ ID NO: 3628172 - DNA, 14 bp, Homo sapiens
aagttaaataaatc

SEQ ID NO: 3628173 - DNA, 22 bp, Homo sapiens
aagttacttaattgccagcaaa

SEQ ID NO: 3628174 - DNA, 21 bp, Homo sapiens
aagttattttatgacatgaaa

SEQ ID NO: 3628175 - DNA, 20 bp, Homo sapiens
aagttccctacttcctgtga

SEQ ID NO: 3628176 - DNA, 19 bp, Homo sapiens
aagttctatttcttgaaga

SEQ ID NO: 3628177 - DNA, 18 bp, Homo sapiens
aagttctgtggttccagt

SEQ ID NO: 3628178 - DNA, 21 bp, Homo sapiens
aagttgacttatagtacatga

SEQ ID NO: 3628179 - DNA, 21 bp, Homo sapiens
aagttgcctttatttgctgtt

SEQ ID NO: 3628180 - DNA, 12 bp, Homo sapiens
aagtttaaatgt

SEQ ID NO: 3628181 - DNA, 16 bp, Homo sapiens
aagtttaattgtctca

SEQ ID NO: 3628182 - DNA, 12 bp, Homo sapiens
aagtttgtagcc

SEQ ID NO: 3628183 - DNA, 16 bp, Homo sapiens
aagttttccagtattg

SEQ ID NO: 3628184 - DNA, 15 bp, Homo sapiens
aagtttttagaatgt

SEQ ID NO: 3628185 - DNA, 11 bp, Homo sapiens
aataaaaatat

SEQ ID NO: 3628186 - DNA, 20 bp, Homo sapiens
aataaaaatatattttcaac

SEQ ID NO: 3628187 - DNA, 19 bp, Homo sapiens
aataaaaggtggatttgag

SEQ ID NO: 3628188 - DNA, 16 bp, Homo sapiens
aataaaatcttgaaaa

SEQ ID NO: 3628189 - DNA, 18 bp, Homo sapiens
aataaaccaaaggaaaat

SEQ ID NO: 3628190 - DNA, 15 bp, Homo sapiens
aataaaccaaatatg

SEQ ID NO: 3628191 - DNA, 17 bp, Homo sapiens
aataaactactctttga

SEQ ID NO: 3628192 - DNA, 20 bp, Homo sapiens
aataaactactctttgattt

SEQ ID NO: 3628193 - DNA, 15 bp, Homo sapiens
aataaactctctagg

SEQ ID NO: 3628194 - DNA, 14 bp, Homo sapiens
aataaactcttaag

SEQ ID NO: 3628195 - DNA, 18 bp, Homo sapiens
aataaactcttaagagaa

SEQ ID NO: 3628196 - DNA, 15 bp, Homo sapiens
aataaacttacagat

SEQ ID NO: 3628197 - DNA, 17 bp, Homo sapiens
aataaacttacagatct

SEQ ID NO: 3628198 - DNA, 13 bp, Homo sapiens
aataaagagaaat

SEQ ID NO: 3628199 - DNA, 16 bp, Homo sapiens
aataaagatacaaaat

SEQ ID NO: 3628200 - DNA, 16 bp, Homo sapiens
aataaagcaataagaa

SEQ ID NO: 3628201 - DNA, 14 bp, Homo sapiens
aataaagcaatgtg

SEQ ID NO: 3628202 - DNA, 15 bp, Homo sapiens
aataaaggcagtttt

SEQ ID NO: 3628203 - DNA, 16 bp, Homo sapiens
aataaaggcagttttc

SEQ ID NO: 3628204 - DNA, 14 bp, Homo sapiens
aataaagtattcta

SEQ ID NO: 3628205 - DNA, 15 bp, Homo sapiens
aataaagttgcagat

SEQ ID NO: 3628206 - DNA, 11 bp, Homo sapiens
aataaataatc

SEQ ID NO: 3628207 - DNA, 11 bp, Homo sapiens
aataaatgaaa

SEQ ID NO: 3628208 - DNA, 20 bp, Homo sapiens
aataaatgaaacttggccag

SEQ ID NO: 3628209 - DNA, 14 bp, Homo sapiens
aataaatgtcactt

SEQ ID NO: 3628210 - DNA, 21 bp, Homo sapiens
aataaatgtgccttcattttt

SEQ ID NO: 3628211 - DNA, 12 bp, Homo sapiens
aataaattattt

SEQ ID NO: 3628212 - DNA, 20 bp, Homo sapiens
aataaattctacctccttgt

SEQ ID NO: 3628213 - DNA, 16 bp, Homo sapiens
aataaattgctccttg

SEQ ID NO: 3628214 - DNA, 18 bp, Homo sapiens
aataacacagatattgtt

SEQ ID NO: 3628215 - DNA, 15 bp, Homo sapiens
aataaccaatagttg

SEQ ID NO: 3628216 - DNA, 13 bp, Homo sapiens
aataactgaacca

SEQ ID NO: 3628217 - DNA, 23 bp, Homo sapiens
aataactgaaccaaattgcactg

SEQ ID NO: 3628218 - DNA, 24 bp, Homo sapiens
aataactgaaccaaattgcactga

SEQ ID NO: 3628219 - DNA, 12 bp, Homo sapiens
aataacttgaag

SEQ ID NO: 3628220 - DNA, 15 bp, Homo sapiens
aataagaacaagttt

SEQ ID NO: 3628221 - DNA, 23 bp, Homo sapiens
aataagaacaagttttggcagcc

SEQ ID NO: 3628222 - DNA, 16 bp, Homo sapiens
aataaggcccagagcg

SEQ ID NO: 3628223 - DNA, 22 bp, Homo sapiens
aataagggtttttgcataataa

SEQ ID NO: 3628224 - DNA, 12 bp, Homo sapiens
aataataaagaa

SEQ ID NO: 3628225 - DNA, 20 bp, Homo sapiens
aataataaagaatagcttta

SEQ ID NO: 3628226 - DNA, 11 bp, Homo sapiens
aataatgctgc

SEQ ID NO: 3628227 - DNA, 14 bp, Homo sapiens
aataatttctcttg

SEQ ID NO: 3628228 - DNA, 16 bp, Homo sapiens
aataattttaaacaaa

SEQ ID NO: 3628229 - DNA, 18 bp, Homo sapiens
aataattttcattttgca

SEQ ID NO: 3628230 - DNA, 14 bp, Homo sapiens
aataattttgtaat

SEQ ID NO: 3628231 - DNA, 14 bp, Homo sapiens
aatacaaaaaatta

SEQ ID NO: 3628232 - DNA, 17 bp, Homo sapiens
aatacattaacggtgct

SEQ ID NO: 3628233 - DNA, 21 bp, Homo sapiens
aatacatttaaaacattaaaa

SEQ ID NO: 3628234 - DNA, 22 bp, Homo sapiens
aatacatttaaaacattaaaat

SEQ ID NO: 3628235 - DNA, 13 bp, Homo sapiens
aatacatttgtat

SEQ ID NO: 3628236 - DNA, 20 bp, Homo sapiens
aataccacagctatttagaa

SEQ ID NO: 3628237 - DNA, 18 bp, Homo sapiens
aataccactagtggaaag

SEQ ID NO: 3628238 - DNA, 22 bp, Homo sapiens
aataccactagtggaaagtcag

SEQ ID NO: 3628239 - DNA, 17 bp, Homo sapiens
aataccttctatgtatt

SEQ ID NO: 3628240 - DNA, 18 bp, Homo sapiens
aataccttctatgtatta

SEQ ID NO: 3628241 - DNA, 23 bp, Homo sapiens
aatacgtgatctctgttacaaaa

SEQ ID NO: 3628242 - DNA, 11 bp, Homo sapiens
aatacttattt

SEQ ID NO: 3628243 - DNA, 21 bp, Homo sapiens
aatacttattttcagtgcatc

SEQ ID NO: 3628244 - DNA, 12 bp, Homo sapiens
aatacttccaga

SEQ ID NO: 3628245 - DNA, 15 bp, Homo sapiens
aatacttccagaagt

SEQ ID NO: 3628246 - DNA, 20 bp, Homo sapiens
acacctgggcatttggtgag

SEQ ID NO: 3628247 - DNA, 23 bp, Homo sapiens
acaccttggggtccctccacccc

SEQ ID NO: 3628248 - DNA, 21 bp, Homo sapiens
acacgagcaggctactgtcag

SEQ ID NO: 3628249 - DNA, 21 bp, Homo sapiens
acacggatctgctgggctctg

SEQ ID NO: 3628250 - DNA, 16 bp, Homo sapiens
acacgggaccagctca

SEQ ID NO: 3628251 - DNA, 15 bp, Homo sapiens
acactaaattgcagt

SEQ ID NO: 3628252 - DNA, 17 bp, Homo sapiens
acactaaattgcagttt

SEQ ID NO: 3628253 - DNA, 21 bp, Homo sapiens
acactaaattgcagtttacag

SEQ ID NO: 3628254 - DNA, 23 bp, Homo sapiens
acactaaattgcagtttacagta

SEQ ID NO: 3628255 - DNA, 14 bp, Homo sapiens
acactaaccaaatc

SEQ ID NO: 3628256 - DNA, 15 bp, Homo sapiens
acactattatttcct

SEQ ID NO: 3628257 - DNA, 17 bp, Homo sapiens
acactattatttcctat

SEQ ID NO: 3628258 - DNA, 18 bp, Homo sapiens
acactcaaatcaagaaac

SEQ ID NO: 3628259 - DNA, 21 bp, Homo sapiens
acactcagaaaattccctggg

SEQ ID NO: 3628260 - DNA, 21 bp, Homo sapiens
acactctcccattatatttat

SEQ ID NO: 3628261 - DNA, 21 bp, Homo sapiens
acactcttcagtgactcctgc

SEQ ID NO: 3628262 - DNA, 23 bp, Homo sapiens
acactgaaaaatctaagtgatat

SEQ ID NO: 3628263 - DNA, 19 bp, Homo sapiens
acactgagaaagaggcagg

SEQ ID NO: 3628264 - DNA, 22 bp, Homo sapiens
acactgatgcaaggattacaga

SEQ ID NO: 3628265 - DNA, 13 bp, Homo sapiens
acactgcaaattt

SEQ ID NO: 3628266 - DNA, 14 bp, Homo sapiens
acactgctctaaca

SEQ ID NO: 3628267 - DNA, 17 bp, Homo sapiens
acactgctctaacagcc

SEQ ID NO: 3628268 - DNA, 19 bp, Homo sapiens
acactgctctaacagccct

SEQ ID NO: 3628269 - DNA, 16 bp, Homo sapiens
acactggtatttatat

SEQ ID NO: 3628270 - DNA, 20 bp, Homo sapiens
acactgtaagctttgttctg

SEQ ID NO: 3628271 - DNA, 21 bp, Homo sapiens
acactgtaagctttgttctgg

SEQ ID NO: 3628272 - DNA, 18 bp, Homo sapiens
acactgtcctattatatt

SEQ ID NO: 3628273 - DNA, 17 bp, Homo sapiens
acactgtgcagacccag

SEQ ID NO: 3628274 - DNA, 13 bp, Homo sapiens
acactgtggccag

SEQ ID NO: 3628275 - DNA, 15 bp, Homo sapiens
acactgtggccaggc

SEQ ID NO: 3628276 - DNA, 16 bp, Homo sapiens
acacttacactttatg

SEQ ID NO: 3628277 - DNA, 13 bp, Homo sapiens
acacttataaaat

SEQ ID NO: 3628278 - DNA, 22 bp, Homo sapiens
acacttataaaataacttgcat

SEQ ID NO: 3628279 - DNA, 15 bp, Homo sapiens
acacttcaggctctt

SEQ ID NO: 3628280 - DNA, 22 bp, Homo sapiens
acacttcaggctcttctccttt

SEQ ID NO: 3628281 - DNA, 14 bp, Homo sapiens
acacttccataatc

SEQ ID NO: 3628282 - DNA, 22 bp, Homo sapiens
acacttgtgattataaaattaa

SEQ ID NO: 3628283 - DNA, 13 bp, Homo sapiens
acactttctggca

SEQ ID NO: 3628284 - DNA, 18 bp, Homo sapiens
acactttgccaaggctct

SEQ ID NO: 3628285 - DNA, 21 bp, Homo sapiens
acactttgccaaggctctccc

SEQ ID NO: 3628286 - DNA, 21 bp, Homo sapiens
acactttgccatttgcttgta

SEQ ID NO: 3628287 - DNA, 23 bp, Homo sapiens
acagaaaaaataaactgagttta

SEQ ID NO: 3628288 - DNA, 14 bp, Homo sapiens
acagaaaaataagt

SEQ ID NO: 3628289 - DNA, 22 bp, Homo sapiens
acagaaaaataagtcaaaagga

SEQ ID NO: 3628290 - DNA, 12 bp, Homo sapiens
acagaaacaaaa

SEQ ID NO: 3628291 - DNA, 17 bp, Homo sapiens
acagaaaccagaaaagc

SEQ ID NO: 3628292 - DNA, 12 bp, Homo sapiens
acagaaaccttt

SEQ ID NO: 3628293 - DNA, 21 bp, Homo sapiens
acagaacatgctgttatttag

SEQ ID NO: 3628294 - DNA, 17 bp, Homo sapiens
acagaacccctacatga

SEQ ID NO: 3628295 - DNA, 21 bp, Homo sapiens
acagaaccttcaacccagtgg

SEQ ID NO: 3628296 - DNA, 20 bp, Homo sapiens
acagaactcggtgtccccac

SEQ ID NO: 3628297 - DNA, 13 bp, Homo sapiens
acagacaagcagc

SEQ ID NO: 3628298 - DNA, 14 bp, Homo sapiens
acagacaagcagcc

SEQ ID NO: 3628299 - DNA, 15 bp, Homo sapiens
acagacaagcagccc

SEQ ID NO: 3628300 - DNA, 20 bp, Homo sapiens
acagacagcttacaggagcc

SEQ ID NO: 3628301 - DNA, 22 bp, Homo sapiens
acagacagcttacaggagccag

SEQ ID NO: 3628302 - DNA, 13 bp, Homo sapiens
acagacaggaatt

SEQ ID NO: 3628303 - DNA, 18 bp, Homo sapiens
acagacatggaacagtgt

SEQ ID NO: 3628304 - DNA, 15 bp, Homo sapiens
acagacccctgggag

SEQ ID NO: 3628305 - DNA, 14 bp, Homo sapiens
acagactccatctc

SEQ ID NO: 3628306 - DNA, 18 bp, Homo sapiens
acagactccatctcttct

SEQ ID NO: 3628307 - DNA, 17 bp, Homo sapiens
acagacttagaacctga

SEQ ID NO: 3628308 - DNA, 12 bp, Homo sapiens
acagacttgtat

SEQ ID NO: 3628309 - DNA, 17 bp, Homo sapiens
acagactttagctttct

SEQ ID NO: 3628310 - DNA, 16 bp, Homo sapiens
acagactttggacagt

SEQ ID NO: 3628311 - DNA, 19 bp, Homo sapiens
acagactttggacagtggc

SEQ ID NO: 3628312 - DNA, 20 bp, Homo sapiens
acagactttggacagtggcc

SEQ ID NO: 3628313 - DNA, 21 bp, Homo sapiens
acagagaagtttgtagccagg

SEQ ID NO: 3628314 - DNA, 19 bp, Homo sapiens
acagagatgctaagagaaa

SEQ ID NO: 3628315 - DNA, 22 bp, Homo sapiens
acagagattactttgctgcctt

SEQ ID NO: 3628316 - DNA, 21 bp, Homo sapiens
acagaggaatttatacctcaa

SEQ ID NO: 3628317 - DNA, 17 bp, Homo sapiens
acagaggccccagcctc

SEQ ID NO: 3628318 - DNA, 18 bp, Homo sapiens
acagaggtttgaaggaga

SEQ ID NO: 3628319 - DNA, 12 bp, Homo sapiens
acagagtaacta

SEQ ID NO: 3628320 - DNA, 22 bp, Homo sapiens
acagagtgccaacttctttcat

SEQ ID NO: 3628321 - DNA, 18 bp, Homo sapiens
acagagtggcctccctgc

SEQ ID NO: 3628322 - DNA, 19 bp, Homo sapiens
acagagtgggccccgggct

SEQ ID NO: 3628323 - DNA, 16 bp, Homo sapiens
acagataaaatgtaaa

SEQ ID NO: 3628324 - DNA, 16 bp, Homo sapiens
acagatcactcctgga

SEQ ID NO: 3628325 - DNA, 17 bp, Homo sapiens
acagatcactcctggag

SEQ ID NO: 3628326 - DNA, 20 bp, Homo sapiens
acagatctggaacctcagcc

SEQ ID NO: 3628327 - DNA, 23 bp, Homo sapiens
acagattcaggccagcccagcca

SEQ ID NO: 3628328 - DNA, 18 bp, Homo sapiens
acagcaagggtgatggga

SEQ ID NO: 3628329 - DNA, 16 bp, Homo sapiens
acagcaattcatggtt

SEQ ID NO: 3628330 - DNA, 17 bp, Homo sapiens
acagcaattcatggttc

SEQ ID NO: 3628331 - DNA, 19 bp, Homo sapiens
acagcaattcctcaggcta

SEQ ID NO: 3628332 - DNA, 17 bp, Homo sapiens
acagcagccccaggaga

SEQ ID NO: 3628333 - DNA, 18 bp, Homo sapiens
acagcagccccaggagaa

SEQ ID NO: 3628334 - DNA, 23 bp, Homo sapiens
acagcagctgcaggggcctctgt

SEQ ID NO: 3628335 - DNA, 15 bp, Homo sapiens
acagcagggaccggg

SEQ ID NO: 3628336 - DNA, 21 bp, Homo sapiens
acagcagttgaaaagactcca

SEQ ID NO: 3628337 - DNA, 16 bp, Homo sapiens
acagcatgaataaaac

SEQ ID NO: 3628338 - DNA, 24 bp, Homo sapiens
acagcatgaataaaacactcatcc

SEQ ID NO: 3628339 - DNA, 17 bp, Homo sapiens
acagcattgtgtggaat

SEQ ID NO: 3628340 - DNA, 13 bp, Homo sapiens
acagccaagctgg

SEQ ID NO: 3628341 - DNA, 15 bp, Homo sapiens
acagccaagtgccaa

SEQ ID NO: 3628342 - DNA, 18 bp, Homo sapiens
acagccacaccgtggcag

SEQ ID NO: 3628343 - DNA, 13 bp, Homo sapiens
acagccagactgg

SEQ ID NO: 3628344 - DNA, 17 bp, Homo sapiens
acagccctatttcttga

SEQ ID NO: 3628345 - DNA, 14 bp, Homo sapiens
acagccctgcctga

SEQ ID NO: 3628346 - DNA, 22 bp, Homo sapiens
acagcccttatgcggttaattt

SEQ ID NO: 3628347 - DNA, 23 bp, Homo sapiens
acagcccttatgcggttaatttt

SEQ ID NO: 3628348 - DNA, 19 bp, Homo sapiens
acagccggtcagaggagcg

SEQ ID NO: 3628349 - DNA, 13 bp, Homo sapiens
acagcctctgact

SEQ ID NO: 3628350 - DNA, 14 bp, Homo sapiens
acagcctggcacag

SEQ ID NO: 3628351 - DNA, 15 bp, Homo sapiens
acagcctggcacagg

SEQ ID NO: 3628352 - DNA, 19 bp, Homo sapiens
acagccttagagctcttgt

SEQ ID NO: 3628353 - DNA, 18 bp, Homo sapiens
acagccttccccagctcc

SEQ ID NO: 3628354 - DNA, 21 bp, Homo sapiens
acagccttctaaattcccaaa

SEQ ID NO: 3628355 - DNA, 17 bp, Homo sapiens
acagccttgcagcggct

SEQ ID NO: 3628356 - DNA, 22 bp, Homo sapiens
acagccttgcagcggctcctgc

SEQ ID NO: 3628357 - DNA, 19 bp, Homo sapiens
acagcgtgctaaaataaca

SEQ ID NO: 3628358 - DNA, 20 bp, Homo sapiens
acagctaatcagcattctca

SEQ ID NO: 3628359 - DNA, 23 bp, Homo sapiens
acagctacaaccctaccctggca

SEQ ID NO: 3628360 - DNA, 20 bp, Homo sapiens
acagctactcagtggggctg

SEQ ID NO: 3628361 - DNA, 23 bp, Homo sapiens
acagctactcagtggggctggca

SEQ ID NO: 3628362 - DNA, 17 bp, Homo sapiens
acagctcactgcagcct

SEQ ID NO: 3628363 - DNA, 22 bp, Homo sapiens
acagctcactgcagcctcaacc

SEQ ID NO: 3628364 - DNA, 13 bp, Homo sapiens
acagctcagccag

SEQ ID NO: 3628365 - DNA, 14 bp, Homo sapiens
acagctcagccagt

SEQ ID NO: 3628366 - DNA, 20 bp, Homo sapiens
acagctcctccatgcctgac

SEQ ID NO: 3628367 - DNA, 16 bp, Homo sapiens
acagctcttcattcca

SEQ ID NO: 3628368 - DNA, 22 bp, Homo sapiens
acagctcttccagggcagcggc

SEQ ID NO: 3628369 - DNA, 16 bp, Homo sapiens
acagctgagcacttag

SEQ ID NO: 3628370 - DNA, 10 bp, Homo sapiens
acagctgccc

SEQ ID NO: 3628371 - DNA, 16 bp, Homo sapiens
acagctgcctgcagta

SEQ ID NO: 3628372 - DNA, 22 bp, Homo sapiens
acagctgctcctagagggaggg

SEQ ID NO: 3628373 - DNA, 15 bp, Homo sapiens
acagctgctttgagc

SEQ ID NO: 3628374 - DNA, 18 bp, Homo sapiens
acagctggaaagttgggc

SEQ ID NO: 3628375 - DNA, 21 bp, Homo sapiens
acagctggaaagttgggcccc

SEQ ID NO: 3628376 - DNA, 13 bp, Homo sapiens
acagctggctggg

SEQ ID NO: 3628377 - DNA, 16 bp, Homo sapiens
acagctggctgggcct

SEQ ID NO: 3628378 - DNA, 16 bp, Homo sapiens
acagctgggagcctgg

SEQ ID NO: 3628379 - DNA, 17 bp, Homo sapiens
acagctgggagcctggt

SEQ ID NO: 3628380 - DNA, 17 bp, Homo sapiens
acagctgtgctccacac

SEQ ID NO: 3628381 - DNA, 21 bp, Homo sapiens
acagctgtgctccacactcag

SEQ ID NO: 3628382 - DNA, 16 bp, Homo sapiens
acagcttacaggagcc

SEQ ID NO: 3628383 - DNA, 18 bp, Homo sapiens
acagcttacaggagccag

SEQ ID NO: 3628384 - DNA, 19 bp, Homo sapiens
acagcttacaggagccagc

SEQ ID NO: 3628385 - DNA, 11 bp, Homo sapiens
acagcttcctc

SEQ ID NO: 3628386 - DNA, 20 bp, Homo sapiens
acagcttcctcacacccctg

SEQ ID NO: 3628387 - DNA, 12 bp, Homo sapiens
acagctttgctg

SEQ ID NO: 3628388 - DNA, 15 bp, Homo sapiens
acagctttgctgctg

SEQ ID NO: 3628389 - DNA, 22 bp, Homo sapiens
acagctttgtctccaaagaaga

SEQ ID NO: 3628390 - DNA, 16 bp, Homo sapiens
acaggaaagagctagg

SEQ ID NO: 3628391 - DNA, 14 bp, Homo sapiens
acaggaaaggagca

SEQ ID NO: 3628392 - DNA, 12 bp, Homo sapiens
acaggaccccag

SEQ ID NO: 3628393 - DNA, 14 bp, Homo sapiens
acaggaccccagct

SEQ ID NO: 3628394 - DNA, 15 bp, Homo sapiens
acaggaccccagctc

SEQ ID NO: 3628395 - DNA, 16 bp, Homo sapiens
acaggaccccagctct

SEQ ID NO: 3628396 - DNA, 19 bp, Homo sapiens
acaggaccccagctctgcg

SEQ ID NO: 3628397 - DNA, 14 bp, Homo sapiens
acaggaccctcagg

SEQ ID NO: 3628398 - DNA, 15 bp, Homo sapiens
acaggagacaaaaga

SEQ ID NO: 3628399 - DNA, 14 bp, Homo sapiens
acaggagaggcagc

SEQ ID NO: 3628400 - DNA, 17 bp, Homo sapiens
acaggagaggcagcatg

SEQ ID NO: 3628401 - DNA, 18 bp, Homo sapiens
acaggagaggcagcatgc

SEQ ID NO: 3628402 - DNA, 19 bp, Homo sapiens
acaggagatgctgtgcccc

SEQ ID NO: 3628403 - DNA, 17 bp, Homo sapiens
acaggagcctagcggag

SEQ ID NO: 3628404 - DNA, 19 bp, Homo sapiens
acaggatcagttaactatt

SEQ ID NO: 3628405 - DNA, 18 bp, Homo sapiens
acaggattgatcattctt

SEQ ID NO: 3628406 - DNA, 12 bp, Homo sapiens
acaggccctccc

SEQ ID NO: 3628407 - DNA, 13 bp, Homo sapiens
acaggcccttcct

SEQ ID NO: 3628408 - DNA, 21 bp, Homo sapiens
acaggctcgtcagccacctgg

SEQ ID NO: 3628409 - DNA, 19 bp, Homo sapiens
acaggctgaagagagggac

SEQ ID NO: 3628410 - DNA, 23 bp, Homo sapiens
acaggctgtccttaacccacctc

SEQ ID NO: 3628411 - DNA, 16 bp, Homo sapiens
acagggaatggccaca

SEQ ID NO: 3628412 - DNA, 22 bp, Homo sapiens
acagggactgaaaacctctcct

SEQ ID NO: 3628413 - DNA, 20 bp, Homo sapiens
acagggatttagacttacta

SEQ ID NO: 3628414 - DNA, 17 bp, Homo sapiens
acagggccagtgcagtt

SEQ ID NO: 3628415 - DNA, 14 bp, Homo sapiens
acagggtctgggac

SEQ ID NO: 3628416 - DNA, 15 bp, Homo sapiens
acagggtctgggaca

SEQ ID NO: 3628417 - DNA, 21 bp, Homo sapiens
acagggtgagggccacctcca

SEQ ID NO: 3628418 - DNA, 17 bp, Homo sapiens
acaggtaactaattgga

SEQ ID NO: 3628419 - DNA, 13 bp, Homo sapiens
acaggtggctgtt

SEQ ID NO: 3628420 - DNA, 23 bp, Homo sapiens
acaggtggctgtttcttgtctgt

SEQ ID NO: 3628421 - DNA, 13 bp, Homo sapiens
acaggtgggcctg

SEQ ID NO: 3628422 - DNA, 16 bp, Homo sapiens
acaggtgggcctggga

SEQ ID NO: 3628423 - DNA, 22 bp, Homo sapiens
acagtacccttggcctttacag

SEQ ID NO: 3628424 - DNA, 13 bp, Homo sapiens
acagtagagaggg

SEQ ID NO: 3628425 - DNA, 18 bp, Homo sapiens
acagtagcttgaaattga

SEQ ID NO: 3628426 - DNA, 18 bp, Homo sapiens
acagtaggtcccggccag

SEQ ID NO: 3628427 - DNA, 14 bp, Homo sapiens
acagtatctgctgt

SEQ ID NO: 3628428 - DNA, 17 bp, Homo sapiens
acagtatctgctgttct

SEQ ID NO: 3628429 - DNA, 19 bp, Homo sapiens
acagtatctgctgttcttc

SEQ ID NO: 3628430 - DNA, 13 bp, Homo sapiens
acagtcactggat

SEQ ID NO: 3628431 - DNA, 12 bp, Homo sapiens
acagtccacagg

SEQ ID NO: 3628432 - DNA, 13 bp, Homo sapiens
acagtccacaggg

SEQ ID NO: 3628433 - DNA, 17 bp, Homo sapiens
acagtctcaggaaatca

SEQ ID NO: 3628434 - DNA, 17 bp, Homo sapiens
acagtgactccctggga

SEQ ID NO: 3628435 - DNA, 14 bp, Homo sapiens
acagtgccatcccc

SEQ ID NO: 3628436 - DNA, 21 bp, Homo sapiens
acagtgccatccccaccttca

SEQ ID NO: 3628437 - DNA, 15 bp, Homo sapiens
acagtgctcttttct

SEQ ID NO: 3628438 - DNA, 16 bp, Homo sapiens
acagtgctcttttctc

SEQ ID NO: 3628439 - DNA, 20 bp, Homo sapiens
acagtgctgaccagacagcc

SEQ ID NO: 3628440 - DNA, 12 bp, Homo sapiens
acagtggcctct

SEQ ID NO: 3628441 - DNA, 18 bp, Homo sapiens
acagtgggagctgagctg

SEQ ID NO: 3628442 - DNA, 22 bp, Homo sapiens
acagtgggcgttgggagcctag

SEQ ID NO: 3628443 - DNA, 21 bp, Homo sapiens
acagtggggctgcaggcaggc

SEQ ID NO: 3628444 - DNA, 23 bp, Homo sapiens
acagtggtggcaacattcattgc

SEQ ID NO: 3628445 - DNA, 21 bp, Homo sapiens
acagtgtaaatcccagactga

SEQ ID NO: 3628446 - DNA, 21 bp, Homo sapiens
acagtgttgaaaatgttcaga

SEQ ID NO: 3628447 - DNA, 18 bp, Homo sapiens
acagttattaattaaaga

SEQ ID NO: 3628448 - DNA, 16 bp, Homo sapiens
acagttcaagaaagct

SEQ ID NO: 3628449 - DNA, 13 bp, Homo sapiens
acagttctgtcat

SEQ ID NO: 3628450 - DNA, 22 bp, Homo sapiens
acagttctgtggtttcatgtta

SEQ ID NO: 3628451 - DNA, 17 bp, Homo sapiens
acagttctttgggccag

SEQ ID NO: 3628452 - DNA, 19 bp, Homo sapiens
acagttctttgggccagac

SEQ ID NO: 3628453 - DNA, 18 bp, Homo sapiens
acagttgatggagcccca

SEQ ID NO: 3628454 - DNA, 19 bp, Homo sapiens
acagttgatggagccccag

SEQ ID NO: 3628455 - DNA, 20 bp, Homo sapiens
acagttgatggagccccagg

SEQ ID NO: 3628456 - DNA, 21 bp, Homo sapiens
acagttgatggagccccaggg

SEQ ID NO: 3628457 - DNA, 22 bp, Homo sapiens
acagttgatggagccccagggt

SEQ ID NO: 3628458 - DNA, 21 bp, Homo sapiens
acagttgccacatttagtcct

SEQ ID NO: 3628459 - DNA, 19 bp, Homo sapiens
acagttttctgagaaagac

SEQ ID NO: 3628460 - DNA, 20 bp, Homo sapiens
acagttttctgagaaagact

SEQ ID NO: 3628461 - DNA, 20 bp, Homo sapiens
acataaaaaggacatcagca

SEQ ID NO: 3628462 - DNA, 22 bp, Homo sapiens
acataaaaaggacatcagcaaa

SEQ ID NO: 3628463 - DNA, 11 bp, Homo sapiens
acataaaacag

SEQ ID NO: 3628464 - DNA, 14 bp, Homo sapiens
acataaaacagaat

SEQ ID NO: 3628465 - DNA, 15 bp, Homo sapiens
acataaacaaagaca

SEQ ID NO: 3628466 - DNA, 16 bp, Homo sapiens
acataaacacatttcc

SEQ ID NO: 3628467 - DNA, 15 bp, Homo sapiens
acataacggaaagtt

SEQ ID NO: 3628468 - DNA, 16 bp, Homo sapiens
acataagtaactttta

SEQ ID NO: 3628469 - DNA, 17 bp, Homo sapiens
acataagtaacttttaa

SEQ ID NO: 3628470 - DNA, 15 bp, Homo sapiens
acataataaatcaca

SEQ ID NO: 3628471 - DNA, 18 bp, Homo sapiens
acataataaatcacacat

SEQ ID NO: 3628472 - DNA, 19 bp, Homo sapiens
acataatggtactcccaaa

SEQ ID NO: 3628473 - DNA, 22 bp, Homo sapiens
acataatggtactcccaaactg

SEQ ID NO: 3628474 - DNA, 14 bp, Homo sapiens
acatacaccagcat

SEQ ID NO: 3628475 - DNA, 15 bp, Homo sapiens
acatacaccagcatt

SEQ ID NO: 3628476 - DNA, 17 bp, Homo sapiens
acatacataatggtact

SEQ ID NO: 3628477 - DNA, 18 bp, Homo sapiens
acatacttgaagggccag

SEQ ID NO: 3628478 - DNA, 23 bp, Homo sapiens
acatacttgaagggccagagcca

SEQ ID NO: 3628479 - DNA, 22 bp, Homo sapiens
acatatataggcagttgcatgc

SEQ ID NO: 3628480 - DNA, 14 bp, Homo sapiens
acatatgaggggga

SEQ ID NO: 3628481 - DNA, 21 bp, Homo sapiens
acatattcaaggagcaagaaa

SEQ ID NO: 3628482 - DNA, 17 bp, Homo sapiens
acatcaaatatttcttg

SEQ ID NO: 3628483 - DNA, 17 bp, Homo sapiens
acatcactaatttggct

SEQ ID NO: 3628484 - DNA, 12 bp, Homo sapiens
acatcagcaaac

SEQ ID NO: 3628485 - DNA, 13 bp, Homo sapiens
acatcagcaaaca

SEQ ID NO: 3628486 - DNA, 22 bp, Homo sapiens
acatcatggactgagctggggg

SEQ ID NO: 3628487 - DNA, 12 bp, Homo sapiens
acatccagcaga

SEQ ID NO: 3628488 - DNA, 18 bp, Homo sapiens
acatccccccgccaaaag

SEQ ID NO: 3628489 - DNA, 12 bp, Homo sapiens
acatcccttcct

SEQ ID NO: 3628490 - DNA, 18 bp, Homo sapiens
acatcccttcctggaaac

SEQ ID NO: 3628491 - DNA, 19 bp, Homo sapiens
acatcccttcctggaaaca

SEQ ID NO: 3628492 - DNA, 20 bp, Homo sapiens
acatccttctcactgccatg

SEQ ID NO: 3628493 - DNA, 18 bp, Homo sapiens
acatccttgattacttcc

SEQ ID NO: 3628494 - DNA, 14 bp, Homo sapiens
acatcgcacagttt

SEQ ID NO: 3628495 - DNA, 23 bp, Homo sapiens
acatctcccttttccatgactgt

SEQ ID NO: 3628496 - DNA, 21 bp, Homo sapiens
acatctggctgcacaggctga

SEQ ID NO: 3628497 - DNA, 16 bp, Homo sapiens
acatctgttatcaaac

SEQ ID NO: 3628498 - DNA, 13 bp, Homo sapiens
acatctgttttgt

SEQ ID NO: 3628499 - DNA, 23 bp, Homo sapiens
acatcttgtcattttttttcttt

SEQ ID NO: 3628500 - DNA, 15 bp, Homo sapiens
acatgaaaagttatt

SEQ ID NO: 3628501 - DNA, 15 bp, Homo sapiens
acatgaaacagaaac

SEQ ID NO: 3628502 - DNA, 20 bp, Homo sapiens
acatgaagaatgcattcaaa

SEQ ID NO: 3628503 - DNA, 21 bp, Homo sapiens
acatgaagcaattagtctgaa

SEQ ID NO: 3628504 - DNA, 22 bp, Homo sapiens
acatgaagcaattagtctgaaa

SEQ ID NO: 3628505 - DNA, 23 bp, Homo sapiens
acatgaagcagaaccttctttgg

SEQ ID NO: 3628506 - DNA, 17 bp, Homo sapiens
acatgaagctgtataat

SEQ ID NO: 3628507 - DNA, 13 bp, Homo sapiens
acatgacagatat

SEQ ID NO: 3628508 - DNA, 18 bp, Homo sapiens
acatgacagatattttat

SEQ ID NO: 3628509 - DNA, 14 bp, Homo sapiens
accttatagttact

SEQ ID NO: 3628510 - DNA, 18 bp, Homo sapiens
accttcagattccccatc

SEQ ID NO: 3628511 - DNA, 12 bp, Homo sapiens
accttccaccca

SEQ ID NO: 3628512 - DNA, 14 bp, Homo sapiens
accttccacccagt

SEQ ID NO: 3628513 - DNA, 18 bp, Homo sapiens
accttctggcctcccaca

SEQ ID NO: 3628514 - DNA, 17 bp, Homo sapiens
accttctttctaataca

SEQ ID NO: 3628515 - DNA, 20 bp, Homo sapiens
accttgagttaacaggacag

SEQ ID NO: 3628516 - DNA, 14 bp, Homo sapiens
accttgctctcctc

SEQ ID NO: 3628517 - DNA, 15 bp, Homo sapiens
accttgctctcctca

SEQ ID NO: 3628518 - DNA, 18 bp, Homo sapiens
accttgctttgagactcc

SEQ ID NO: 3628519 - DNA, 19 bp, Homo sapiens
acctttaacttttttttct

SEQ ID NO: 3628520 - DNA, 23 bp, Homo sapiens
acctttatttattaaacttcagc

SEQ ID NO: 3628521 - DNA, 23 bp, Homo sapiens
acctttcagtgcagtttcttttc

SEQ ID NO: 3628522 - DNA, 19 bp, Homo sapiens
acctttcataatctttgct

SEQ ID NO: 3628523 - DNA, 21 bp, Homo sapiens
acctttcataatctttgcttt

SEQ ID NO: 3628524 - DNA, 13 bp, Homo sapiens
acctttggctggt

SEQ ID NO: 3628525 - DNA, 15 bp, Homo sapiens
acctttgtagttact

SEQ ID NO: 3628526 - DNA, 11 bp, Homo sapiens
accttttgtag

SEQ ID NO: 3628527 - DNA, 22 bp, Homo sapiens
accttttgtagttttatttgta

SEQ ID NO: 3628528 - DNA, 14 bp, Homo sapiens
accttttgttttct

SEQ ID NO: 3628529 - DNA, 20 bp, Homo sapiens
acctttttttagttatatat

SEQ ID NO: 3628530 - DNA, 17 bp, Homo sapiens
acgaaatatcaaagtca

SEQ ID NO: 3628531 - DNA, 13 bp, Homo sapiens
acgacctgtcctg

SEQ ID NO: 3628532 - DNA, 15 bp, Homo sapiens
acgagcagcccaggg

SEQ ID NO: 3628533 - DNA, 18 bp, Homo sapiens
acgagcagcccagggcct

SEQ ID NO: 3628534 - DNA, 22 bp, Homo sapiens
acgagcagcccagggcctagag

SEQ ID NO: 3628535 - DNA, 19 bp, Homo sapiens
acgaggggcagggaaggac

SEQ ID NO: 3628536 - DNA, 13 bp, Homo sapiens
acgatcaggagga

SEQ ID NO: 3628537 - DNA, 18 bp, Homo sapiens
acgatcaggaggaagtga

SEQ ID NO: 3628538 - DNA, 22 bp, Homo sapiens
acgatgaccacagactcaatgt

SEQ ID NO: 3628539 - DNA, 16 bp, Homo sapiens
acgcacacagctgagc

SEQ ID NO: 3628540 - DNA, 18 bp, Homo sapiens
acgcaccattttgtcagg

SEQ ID NO: 3628541 - DNA, 22 bp, Homo sapiens
acgcagccctgctttgggctgc

SEQ ID NO: 3628542 - DNA, 19 bp, Homo sapiens
acgccaggcaccacagcct

SEQ ID NO: 3628543 - DNA, 21 bp, Homo sapiens
acgcccctccaaacctccagc

SEQ ID NO: 3628544 - DNA, 12 bp, Homo sapiens
acgccgagtgca

SEQ ID NO: 3628545 - DNA, 15 bp, Homo sapiens
acgctcaatgcccag

SEQ ID NO: 3628546 - DNA, 20 bp, Homo sapiens
acgctcaatgcccagtaaaa

SEQ ID NO: 3628547 - DNA, 19 bp, Homo sapiens
acgctctcgtctctcgttt

SEQ ID NO: 3628548 - DNA, 22 bp, Homo sapiens
acgctgaccatgcgtcaggggc

SEQ ID NO: 3628549 - DNA, 23 bp, Homo sapiens
acgctgaccatgcgtcaggggcc

SEQ ID NO: 3628550 - DNA, 22 bp, Homo sapiens
acgctggcgacacactccgtcc

SEQ ID NO: 3628551 - DNA, 21 bp, Homo sapiens
acggaaagtttttagaatgtt

SEQ ID NO: 3628552 - DNA, 19 bp, Homo sapiens
acggatggtgcatgggctc

SEQ ID NO: 3628553 - DNA, 18 bp, Homo sapiens
acggattattttttcaga

SEQ ID NO: 3628554 - DNA, 14 bp, Homo sapiens
acggcaacagcatg

SEQ ID NO: 3628555 - DNA, 20 bp, Homo sapiens
acggcaacgtagcctgggct

SEQ ID NO: 3628556 - DNA, 22 bp, Homo sapiens
acggcaacgtagcctgggctca

SEQ ID NO: 3628557 - DNA, 23 bp, Homo sapiens
acggccagggagaagctcctctc

SEQ ID NO: 3628558 - DNA, 22 bp, Homo sapiens
acggccatctctttgtacagga

SEQ ID NO: 3628559 - DNA, 12 bp, Homo sapiens
acggcctggctg

SEQ ID NO: 3628560 - DNA, 17 bp, Homo sapiens
acggcctggctggtggg

SEQ ID NO: 3628561 - DNA, 23 bp, Homo sapiens
acggcgtggtgtgtccctggaca

SEQ ID NO: 3628562 - DNA, 16 bp, Homo sapiens
acggcttgctttcctg

SEQ ID NO: 3628563 - DNA, 16 bp, Homo sapiens
acgggccacacgtggc

SEQ ID NO: 3628564 - DNA, 16 bp, Homo sapiens
acggtctgtgtgctgt

SEQ ID NO: 3628565 - DNA, 22 bp, Homo sapiens
acggtggcggctgcacaacagc

SEQ ID NO: 3628566 - DNA, 16 bp, Homo sapiens
acggtgttaattttgc

SEQ ID NO: 3628567 - DNA, 17 bp, Homo sapiens
acggtgttaattttgct

SEQ ID NO: 3628568 - DNA, 22 bp, Homo sapiens
acggtttttttctttggctgca

SEQ ID NO: 3628569 - DNA, 23 bp, Homo sapiens
acggtttttttctttggctgcag

SEQ ID NO: 3628570 - DNA, 19 bp, Homo sapiens
acgtaatgcattgcctgta

SEQ ID NO: 3628571 - DNA, 19 bp, Homo sapiens
acgtcccagcatccctgga

SEQ ID NO: 3628572 - DNA, 14 bp, Homo sapiens
acgtgaagaaataa

SEQ ID NO: 3628573 - DNA, 14 bp, Homo sapiens
acgtgagagaaaga

SEQ ID NO: 3628574 - DNA, 14 bp, Homo sapiens
acgtgcaaagccaa

SEQ ID NO: 3628575 - DNA, 20 bp, Homo sapiens
acgtgctccgtagctctgct

SEQ ID NO: 3628576 - DNA, 18 bp, Homo sapiens
acgtggattgtatttaag

SEQ ID NO: 3628577 - DNA, 21 bp, Homo sapiens
acgtggattgtatttaagaca

SEQ ID NO: 3628578 - DNA, 23 bp, Homo sapiens
acgtggattgtatttaagacata

SEQ ID NO: 3628579 - DNA, 20 bp, Homo sapiens
acgtggcccgcatgtgcatt

SEQ ID NO: 3628580 - DNA, 21 bp, Homo sapiens
acgtggcctcgtgaggggcaa

SEQ ID NO: 3628581 - DNA, 14 bp, Homo sapiens
acgtggctctgctg

SEQ ID NO: 3628582 - DNA, 23 bp, Homo sapiens
acgtgttccagtgtctgtctgag

SEQ ID NO: 3628583 - DNA, 22 bp, Homo sapiens
acgttaagtccaaggagaagaa

SEQ ID NO: 3628584 - DNA, 15 bp, Homo sapiens
acgttaggccaggcc

SEQ ID NO: 3628585 - DNA, 20 bp, Homo sapiens
actaaaaagtataaaatagt

SEQ ID NO: 3628586 - DNA, 15 bp, Homo sapiens
actaaaataattttg

SEQ ID NO: 3628587 - DNA, 17 bp, Homo sapiens
actaaaataattttgta

SEQ ID NO: 3628588 - DNA, 14 bp, Homo sapiens
actaaaatatttat

SEQ ID NO: 3628589 - DNA, 18 bp, Homo sapiens
actaaaatgaggatccag

SEQ ID NO: 3628590 - DNA, 15 bp, Homo sapiens
actaaaatgttctaa

SEQ ID NO: 3628591 - DNA, 16 bp, Homo sapiens
actaaactccatgata

SEQ ID NO: 3628592 - DNA, 22 bp, Homo sapiens
actaaactccatgatatttaag

SEQ ID NO: 3628593 - DNA, 13 bp, Homo sapiens
actaaacttaatt

SEQ ID NO: 3628594 - DNA, 18 bp, Homo sapiens
actaaactttttttctgt

SEQ ID NO: 3628595 - DNA, 11 bp, Homo sapiens
actaaagaaga

SEQ ID NO: 3628596 - DNA, 16 bp, Homo sapiens
actaaagcttcagact

SEQ ID NO: 3628597 - DNA, 21 bp, Homo sapiens
actaaattgcagtttacagta

SEQ ID NO: 3628598 - DNA, 21 bp, Homo sapiens
actaacccagtctttcttcac

SEQ ID NO: 3628599 - DNA, 22 bp, Homo sapiens
actaacgaaatatcaaagtcat

SEQ ID NO: 3628600 - DNA, 14 bp, Homo sapiens
actaagcagaggag

SEQ ID NO: 3628601 - DNA, 15 bp, Homo sapiens
actaagcagaggagg

SEQ ID NO: 3628602 - DNA, 19 bp, Homo sapiens
actaagcagaggaggggcc

SEQ ID NO: 3628603 - DNA, 16 bp, Homo sapiens
actaaggatttttcaa

SEQ ID NO: 3628604 - DNA, 21 bp, Homo sapiens
actaaggggcccggccagcca

SEQ ID NO: 3628605 - DNA, 22 bp, Homo sapiens
actaagttattttatgacatga

SEQ ID NO: 3628606 - DNA, 16 bp, Homo sapiens
actaatagaataaagg

SEQ ID NO: 3628607 - DNA, 17 bp, Homo sapiens
actaatagaataaaggc

SEQ ID NO: 3628608 - DNA, 21 bp, Homo sapiens
actaatcaatacgtgatctct

SEQ ID NO: 3628609 - DNA, 14 bp, Homo sapiens
actaatctttctgc

SEQ ID NO: 3628610 - DNA, 12 bp, Homo sapiens
actaatgtaaaa

SEQ ID NO: 3628611 - DNA, 15 bp, Homo sapiens
actacacatttttaa

SEQ ID NO: 3628612 - DNA, 21 bp, Homo sapiens
actacacatttttaaattgtt

SEQ ID NO: 3628613 - DNA, 22 bp, Homo sapiens
actacacatttttaaattgtta

SEQ ID NO: 3628614 - DNA, 13 bp, Homo sapiens
actacatctggga

SEQ ID NO: 3628615 - DNA, 15 bp, Homo sapiens
actacatctgggact

SEQ ID NO: 3628616 - DNA, 23 bp, Homo sapiens
actacatttctactatgatcaga

SEQ ID NO: 3628617 - DNA, 14 bp, Homo sapiens
actaccaaaagaca

SEQ ID NO: 3628618 - DNA, 21 bp, Homo sapiens
actaccaaaagacattagaga

SEQ ID NO: 3628619 - DNA, 16 bp, Homo sapiens
actaccaatcccaact

SEQ ID NO: 3628620 - DNA, 13 bp, Homo sapiens
actaccagccagc

SEQ ID NO: 3628621 - DNA, 20 bp, Homo sapiens
actaccagggtctctcaggg

SEQ ID NO: 3628622 - DNA, 18 bp, Homo sapiens
actaccatgctttgttta

SEQ ID NO: 3628623 - DNA, 22 bp, Homo sapiens
actacctatccttacatttcac

SEQ ID NO: 3628624 - DNA, 14 bp, Homo sapiens
actacctctgtgcc

SEQ ID NO: 3628625 - DNA, 15 bp, Homo sapiens
actaccttatcactg

SEQ ID NO: 3628626 - DNA, 15 bp, Homo sapiens
actactctttgattt

SEQ ID NO: 3628627 - DNA, 19 bp, Homo sapiens
actactgcagtctttattt

SEQ ID NO: 3628628 - DNA, 17 bp, Homo sapiens
actacttgggagcaccg

SEQ ID NO: 3628629 - DNA, 14 bp, Homo sapiens
actacttttctaaa

SEQ ID NO: 3628630 - DNA, 17 bp, Homo sapiens
actacttttctaaaatc

SEQ ID NO: 3628631 - DNA, 18 bp, Homo sapiens
actagaaagaaggaccca

SEQ ID NO: 3628632 - DNA, 13 bp, Homo sapiens
actagaattctgt

SEQ ID NO: 3628633 - DNA, 16 bp, Homo sapiens
actagacacagataat

SEQ ID NO: 3628634 - DNA, 17 bp, Homo sapiens
actagactactcaatat

SEQ ID NO: 3628635 - DNA, 13 bp, Homo sapiens
actagagacaaat

SEQ ID NO: 3628636 - DNA, 22 bp, Homo sapiens
actagagggacctctcccaggg

SEQ ID NO: 3628637 - DNA, 16 bp, Homo sapiens
actagatgtagtattt

SEQ ID NO: 3628638 - DNA, 16 bp, Homo sapiens
actagtgtgactcctt

SEQ ID NO: 3628639 - DNA, 17 bp, Homo sapiens
actagtttatgctacct

SEQ ID NO: 3628640 - DNA, 13 bp, Homo sapiens
actatatataatg

SEQ ID NO: 3628641 - DNA, 15 bp, Homo sapiens
actgaccctcaggca

SEQ ID NO: 3628642 - DNA, 15 bp, Homo sapiens
actgacgtcctccct

SEQ ID NO: 3628643 - DNA, 21 bp, Homo sapiens
actgactatcataaaatcaaa

SEQ ID NO: 3628644 - DNA, 23 bp, Homo sapiens
actgactgaaggaaaagcaagaa

SEQ ID NO: 3628645 - DNA, 15 bp, Homo sapiens
actgagaaagaggca

SEQ ID NO: 3628646 - DNA, 16 bp, Homo sapiens
actgagcactgaacca

SEQ ID NO: 3628647 - DNA, 16 bp, Homo sapiens
actgaggaattttctt

SEQ ID NO: 3628648 - DNA, 15 bp, Homo sapiens
actgaggaccagcca

SEQ ID NO: 3628649 - DNA, 15 bp, Homo sapiens
actgaggatattcag

SEQ ID NO: 3628650 - DNA, 21 bp, Homo sapiens
actgaggatttctttttggtt

SEQ ID NO: 3628651 - DNA, 13 bp, Homo sapiens
actgaggcccaga

SEQ ID NO: 3628652 - DNA, 15 bp, Homo sapiens
actgaggcccagaga

SEQ ID NO: 3628653 - DNA, 14 bp, Homo sapiens
actgatagacacca

SEQ ID NO: 3628654 - DNA, 14 bp, Homo sapiens
actgatgagagaat

SEQ ID NO: 3628655 - DNA, 16 bp, Homo sapiens
actgatgattttcctt

SEQ ID NO: 3628656 - DNA, 12 bp, Homo sapiens
actgatgcaagg

SEQ ID NO: 3628657 - DNA, 11 bp, Homo sapiens
actgatgctgc

SEQ ID NO: 3628658 - DNA, 12 bp, Homo sapiens
actgatgctgcc

SEQ ID NO: 3628659 - DNA, 14 bp, Homo sapiens
actgatgctgcccc

SEQ ID NO: 3628660 - DNA, 23 bp, Homo sapiens
actgattacgtttacattcttct

SEQ ID NO: 3628661 - DNA, 18 bp, Homo sapiens
actgattttgtaaagttg

SEQ ID NO: 3628662 - DNA, 19 bp, Homo sapiens
actgcaacctccgccttcc

SEQ ID NO: 3628663 - DNA, 14 bp, Homo sapiens
actgcaacttctgc

SEQ ID NO: 3628664 - DNA, 17 bp, Homo sapiens
actgcagcctcaacctc

SEQ ID NO: 3628665 - DNA, 20 bp, Homo sapiens
actgcagcctctctggctgg

SEQ ID NO: 3628666 - DNA, 20 bp, Homo sapiens
actgcataccaacctgggca

SEQ ID NO: 3628667 - DNA, 20 bp, Homo sapiens
actgcatgacggagccgagc

SEQ ID NO: 3628668 - DNA, 16 bp, Homo sapiens
actgcattctctccca

SEQ ID NO: 3628669 - DNA, 21 bp, Homo sapiens
actgcattctctcccatcctg

SEQ ID NO: 3628670 - DNA, 21 bp, Homo sapiens
actgcattgactttcagtaaa

SEQ ID NO: 3628671 - DNA, 13 bp, Homo sapiens
actgccaggctgc

SEQ ID NO: 3628672 - DNA, 16 bp, Homo sapiens
actgccaggctgcctc

SEQ ID NO: 3628673 - DNA, 20 bp, Homo sapiens
actgccatggaattccctcc

SEQ ID NO: 3628674 - DNA, 16 bp, Homo sapiens
actgcccccagaaagc

SEQ ID NO: 3628675 - DNA, 21 bp, Homo sapiens
actgcccccagaaagcctcct

SEQ ID NO: 3628676 - DNA, 23 bp, Homo sapiens
actgcccccagaaagcctcctgc

SEQ ID NO: 3628677 - DNA, 15 bp, Homo sapiens
actgcccctgctgtg

SEQ ID NO: 3628678 - DNA, 13 bp, Homo sapiens
actgccctaagcc

SEQ ID NO: 3628679 - DNA, 20 bp, Homo sapiens
actgccctaagcccccaggg

SEQ ID NO: 3628680 - DNA, 18 bp, Homo sapiens
actgcccttgctgcccgc

SEQ ID NO: 3628681 - DNA, 22 bp, Homo sapiens
actgccgtcacccactctgcac

SEQ ID NO: 3628682 - DNA, 15 bp, Homo sapiens
actgcctgcatgagc

SEQ ID NO: 3628683 - DNA, 20 bp, Homo sapiens
actgccttgtttaatgttaa

SEQ ID NO: 3628684 - DNA, 12 bp, Homo sapiens
actgcgcctcgt

SEQ ID NO: 3628685 - DNA, 18 bp, Homo sapiens
actgctagagacgctgat

SEQ ID NO: 3628686 - DNA, 12 bp, Homo sapiens
actgctcctggg

SEQ ID NO: 3628687 - DNA, 15 bp, Homo sapiens
actgctcctgggcat

SEQ ID NO: 3628688 - DNA, 19 bp, Homo sapiens
actgctcgtggactgtgct

SEQ ID NO: 3628689 - DNA, 20 bp, Homo sapiens
actgctcgtggactgtgctg

SEQ ID NO: 3628690 - DNA, 15 bp, Homo sapiens
actgctgcagattag

SEQ ID NO: 3628691 - DNA, 18 bp, Homo sapiens
actgctgcccagcctcca

SEQ ID NO: 3628692 - DNA, 18 bp, Homo sapiens
actgctgctgctgctgcc

SEQ ID NO: 3628693 - DNA, 19 bp, Homo sapiens
actgctggagtccagtgct

SEQ ID NO: 3628694 - DNA, 12 bp, Homo sapiens
actgctggctgc

SEQ ID NO: 3628695 - DNA, 22 bp, Homo sapiens
actgcttcaatctcaattgctt

SEQ ID NO: 3628696 - DNA, 22 bp, Homo sapiens
actggaaaatcttctagcatgt

SEQ ID NO: 3628697 - DNA, 22 bp, Homo sapiens
actggaagctttgtagaaatta

SEQ ID NO: 3628698 - DNA, 18 bp, Homo sapiens
actggacataacattttc

SEQ ID NO: 3628699 - DNA, 15 bp, Homo sapiens
actggaggaggcctg

SEQ ID NO: 3628700 - DNA, 16 bp, Homo sapiens
actggaggaggcctgt

SEQ ID NO: 3628701 - DNA, 20 bp, Homo sapiens
actggaggaggcctgtccca

SEQ ID NO: 3628702 - DNA, 23 bp, Homo sapiens
actggagttccttatccctctct

SEQ ID NO: 3628703 - DNA, 17 bp, Homo sapiens
actggatatttcaatct

SEQ ID NO: 3628704 - DNA, 15 bp, Homo sapiens
actggcccagtgcca

SEQ ID NO: 3628705 - DNA, 17 bp, Homo sapiens
actggcctgccatgcca

SEQ ID NO: 3628706 - DNA, 21 bp, Homo sapiens
actggcgtctggactgttctg

SEQ ID NO: 3628707 - DNA, 13 bp, Homo sapiens
actggctttggct

SEQ ID NO: 3628708 - DNA, 16 bp, Homo sapiens
actggctttggcttct

SEQ ID NO: 3628709 - DNA, 16 bp, Homo sapiens
actgggaacagaactc

SEQ ID NO: 3628710 - DNA, 14 bp, Homo sapiens
actgggacagctgg

SEQ ID NO: 3628711 - DNA, 16 bp, Homo sapiens
actgggacagctggct

SEQ ID NO: 3628712 - DNA, 22 bp, Homo sapiens
actgggatgggaggagaggaca

SEQ ID NO: 3628713 - DNA, 23 bp, Homo sapiens
actgggattaagaaaccttgctc

SEQ ID NO: 3628714 - DNA, 13 bp, Homo sapiens
actgggcaatgat

SEQ ID NO: 3628715 - DNA, 18 bp, Homo sapiens
actgggcaatgatggcaa

SEQ ID NO: 3628716 - DNA, 23 bp, Homo sapiens
actggggactttatttatttcta

SEQ ID NO: 3628717 - DNA, 13 bp, Homo sapiens
actgggtgagaga

SEQ ID NO: 3628718 - DNA, 15 bp, Homo sapiens
actgggttaaatatt

SEQ ID NO: 3628719 - DNA, 17 bp, Homo sapiens
actgggttaaatatttt

SEQ ID NO: 3628720 - DNA, 20 bp, Homo sapiens
actgggttaaatattttgct

SEQ ID NO: 3628721 - DNA, 18 bp, Homo sapiens
actggtatgaataattgc

SEQ ID NO: 3628722 - DNA, 14 bp, Homo sapiens
actggtatttatat

SEQ ID NO: 3628723 - DNA, 22 bp, Homo sapiens
actggtgaactgagctgggcag

SEQ ID NO: 3628724 - DNA, 12 bp, Homo sapiens
actggtggcccg

SEQ ID NO: 3628725 - DNA, 22 bp, Homo sapiens
actggtggcccgacagcctggc

SEQ ID NO: 3628726 - DNA, 15 bp, Homo sapiens
actggttacctggag

SEQ ID NO: 3628727 - DNA, 16 bp, Homo sapiens
actggttacctggaga

SEQ ID NO: 3628728 - DNA, 19 bp, Homo sapiens
actggtttataataaactc

SEQ ID NO: 3628729 - DNA, 17 bp, Homo sapiens
actgtaaagatgaatgt

SEQ ID NO: 3628730 - DNA, 20 bp, Homo sapiens
actgtaacttccaaataaat

SEQ ID NO: 3628731 - DNA, 21 bp, Homo sapiens
actgtaagctttgttctggga

SEQ ID NO: 3628732 - DNA, 16 bp, Homo sapiens
actgtaataaagatga

SEQ ID NO: 3628733 - DNA, 19 bp, Homo sapiens
actgtaatcttatttagga

SEQ ID NO: 3628734 - DNA, 17 bp, Homo sapiens
actgtaatgctgcctca

SEQ ID NO: 3628735 - DNA, 19 bp, Homo sapiens
actgtaatgctgcctcagg

SEQ ID NO: 3628736 - DNA, 13 bp, Homo sapiens
actgtactcctcc

SEQ ID NO: 3628737 - DNA, 15 bp, Homo sapiens
actgtactcctccca

SEQ ID NO: 3628738 - DNA, 20 bp, Homo sapiens
actgtactcctcccaggcgc

SEQ ID NO: 3628739 - DNA, 15 bp, Homo sapiens
actgtaggcacactt

SEQ ID NO: 3628740 - DNA, 21 bp, Homo sapiens
actgtaggtatgatctcttct

SEQ ID NO: 3628741 - DNA, 18 bp, Homo sapiens
actgtaggtgttatgtat

SEQ ID NO: 3628742 - DNA, 20 bp, Homo sapiens
actgtaggtgttatgtattc

SEQ ID NO: 3628743 - DNA, 12 bp, Homo sapiens
actgtatgctca

SEQ ID NO: 3628744 - DNA, 16 bp, Homo sapiens
actgtatggaaacact

SEQ ID NO: 3628745 - DNA, 23 bp, Homo sapiens
actgtatggaaacactgattttg

SEQ ID NO: 3628746 - DNA, 23 bp, Homo sapiens
actgtcagtggggcagcctctcc

SEQ ID NO: 3628747 - DNA, 13 bp, Homo sapiens
actgtcatagaaa

SEQ ID NO: 3628748 - DNA, 21 bp, Homo sapiens
actgtcatcctcaaagaaagt

SEQ ID NO: 3628749 - DNA, 15 bp, Homo sapiens
actgtcctattatat

SEQ ID NO: 3628750 - DNA, 16 bp, Homo sapiens
actgtcctccaagcca

SEQ ID NO: 3628751 - DNA, 15 bp, Homo sapiens
actgtcctgtcctgc

SEQ ID NO: 3628752 - DNA, 21 bp, Homo sapiens
actgtctcaagagggcactgg

SEQ ID NO: 3628753 - DNA, 16 bp, Homo sapiens
actgtctctccagtga

SEQ ID NO: 3628754 - DNA, 20 bp, Homo sapiens
actgtctctccagtgaaatg

SEQ ID NO: 3628755 - DNA, 18 bp, Homo sapiens
actgtcttgaattagtat

SEQ ID NO: 3628756 - DNA, 15 bp, Homo sapiens
actgtgaaggaccct

SEQ ID NO: 3628757 - DNA, 13 bp, Homo sapiens
actgtgacagact

SEQ ID NO: 3628758 - DNA, 18 bp, Homo sapiens
actgtgatttttatcaca

SEQ ID NO: 3628759 - DNA, 11 bp, Homo sapiens
actgtgctggg

SEQ ID NO: 3628760 - DNA, 14 bp, Homo sapiens
actgtgctgtactg

SEQ ID NO: 3628761 - DNA, 13 bp, Homo sapiens
actgtgtaattag

SEQ ID NO: 3628762 - DNA, 19 bp, Homo sapiens
actgtgtttaactgctgca

SEQ ID NO: 3628763 - DNA, 22 bp, Homo sapiens
actgtgttttagtgtaaaattg

SEQ ID NO: 3628764 - DNA, 17 bp, Homo sapiens
actgttccagattccta

SEQ ID NO: 3628765 - DNA, 18 bp, Homo sapiens
actgttccagattcctat

SEQ ID NO: 3628766 - DNA, 15 bp, Homo sapiens
actgttgataaaaac

SEQ ID NO: 3628767 - DNA, 11 bp, Homo sapiens
actgtttcaaa

SEQ ID NO: 3628768 - DNA, 14 bp, Homo sapiens
actgtttccctgct

SEQ ID NO: 3628769 - DNA, 15 bp, Homo sapiens
acttaaaagtattca

SEQ ID NO: 3628770 - DNA, 14 bp, Homo sapiens
acttaaaatacatg

SEQ ID NO: 3628771 - DNA, 16 bp, Homo sapiens
acttaaaatacatgaa

SEQ ID NO: 3628772 - DNA, 20 bp, Homo sapiens
acttaaaatattcctgcatt

SEQ ID NO: 3628773 - DNA, 17 bp, Homo sapiens
acttaaacaaaaaacta

SEQ ID NO: 3628774 - DNA, 10 bp, Homo sapiens
agagaaactt

SEQ ID NO: 3628775 - DNA, 17 bp, Homo sapiens
agagaaagagagaagcc

SEQ ID NO: 3628776 - DNA, 18 bp, Homo sapiens
agagaaagagagaagcca

SEQ ID NO: 3628777 - DNA, 20 bp, Homo sapiens
agagaaagcaaaggtgcact

SEQ ID NO: 3628778 - DNA, 21 bp, Homo sapiens
agagaagagggcccagcccag

SEQ ID NO: 3628779 - DNA, 13 bp, Homo sapiens
agagaagccagcc

SEQ ID NO: 3628780 - DNA, 17 bp, Homo sapiens
agagaagtgagtggtgt

SEQ ID NO: 3628781 - DNA, 17 bp, Homo sapiens
agagaagtttgtagcca

SEQ ID NO: 3628782 - DNA, 20 bp, Homo sapiens
agagaatgtgtgtgtgtggc

SEQ ID NO: 3628783 - DNA, 23 bp, Homo sapiens
agagaatttctaccatttcagag

SEQ ID NO: 3628784 - DNA, 19 bp, Homo sapiens
agagacaaacacctcccag

SEQ ID NO: 3628785 - DNA, 13 bp, Homo sapiens
agagacaaatctt

SEQ ID NO: 3628786 - DNA, 17 bp, Homo sapiens
agagacacatacagagt

SEQ ID NO: 3628787 - DNA, 20 bp, Homo sapiens
agagacactgttgataaaaa

SEQ ID NO: 3628788 - DNA, 17 bp, Homo sapiens
agagaccataagagaaa

SEQ ID NO: 3628789 - DNA, 16 bp, Homo sapiens
agagacctcatcagcc

SEQ ID NO: 3628790 - DNA, 15 bp, Homo sapiens
agagactgagcagcc

SEQ ID NO: 3628791 - DNA, 14 bp, Homo sapiens
agagagaagccagc

SEQ ID NO: 3628792 - DNA, 17 bp, Homo sapiens
agagagcttcctcccct

SEQ ID NO: 3628793 - DNA, 14 bp, Homo sapiens
agagagggaagatg

SEQ ID NO: 3628794 - DNA, 18 bp, Homo sapiens
agagagggaggcaagccc

SEQ ID NO: 3628795 - DNA, 19 bp, Homo sapiens
agagaggggaaagtgtgag

SEQ ID NO: 3628796 - DNA, 18 bp, Homo sapiens
agagagtagctgcagcct

SEQ ID NO: 3628797 - DNA, 17 bp, Homo sapiens
agagagtggctcctccc

SEQ ID NO: 3628798 - DNA, 14 bp, Homo sapiens
agagataaaaatca

SEQ ID NO: 3628799 - DNA, 20 bp, Homo sapiens
agagataaaaatcatataga

SEQ ID NO: 3628800 - DNA, 13 bp, Homo sapiens
agagatacagagg

SEQ ID NO: 3628801 - DNA, 21 bp, Homo sapiens
agagataggaaactgaagcat

SEQ ID NO: 3628802 - DNA, 21 bp, Homo sapiens
agagatattgatattgaagga

SEQ ID NO: 3628803 - DNA, 18 bp, Homo sapiens
agagatccaaaagaagcc

SEQ ID NO: 3628804 - DNA, 15 bp, Homo sapiens
agagatccctgcaga

SEQ ID NO: 3628805 - DNA, 15 bp, Homo sapiens
agagatcgagaccat

SEQ ID NO: 3628806 - DNA, 19 bp, Homo sapiens
agagatctgtgtggctcct

SEQ ID NO: 3628807 - DNA, 15 bp, Homo sapiens
agagcaccccctgct

SEQ ID NO: 3628808 - DNA, 22 bp, Homo sapiens
agagcaccccctgctccaccag

SEQ ID NO: 3628809 - DNA, 15 bp, Homo sapiens
agagcagcagcacca

SEQ ID NO: 3628810 - DNA, 20 bp, Homo sapiens
agagcataatttaaaaatat

SEQ ID NO: 3628811 - DNA, 23 bp, Homo sapiens
agagcataatttaaaaatatatt

SEQ ID NO: 3628812 - DNA, 12 bp, Homo sapiens
agagcatcctga

SEQ ID NO: 3628813 - DNA, 21 bp, Homo sapiens
agagcatctcaggaggggcag

SEQ ID NO: 3628814 - DNA, 12 bp, Homo sapiens
agagcatgaaat

SEQ ID NO: 3628815 - DNA, 14 bp, Homo sapiens
agagcatgaaattt

SEQ ID NO: 3628816 - DNA, 12 bp, Homo sapiens
agagcattgtca

SEQ ID NO: 3628817 - DNA, 23 bp, Homo sapiens
agagcattgtcaccgcaggtgct

SEQ ID NO: 3628818 - DNA, 13 bp, Homo sapiens
agagccacctgga

SEQ ID NO: 3628819 - DNA, 13 bp, Homo sapiens
agagccagcctgg

SEQ ID NO: 3628820 - DNA, 14 bp, Homo sapiens
agagccagcctggc

SEQ ID NO: 3628821 - DNA, 20 bp, Homo sapiens
agagccagcctggctctgcc

SEQ ID NO: 3628822 - DNA, 22 bp, Homo sapiens
agagccaggggggtgaggagct

SEQ ID NO: 3628823 - DNA, 16 bp, Homo sapiens
agagccatacataaaa

SEQ ID NO: 3628824 - DNA, 15 bp, Homo sapiens
agagcccagagtccc

SEQ ID NO: 3628825 - DNA, 14 bp, Homo sapiens
agagcccccagccc

SEQ ID NO: 3628826 - DNA, 16 bp, Homo sapiens
agagcccccagccctg

SEQ ID NO: 3628827 - DNA, 16 bp, Homo sapiens
agagcccctactgtgg

SEQ ID NO: 3628828 - DNA, 15 bp, Homo sapiens
agagcccttcatttg

SEQ ID NO: 3628829 - DNA, 24 bp, Homo sapiens
agagccgggaggaaaaggcccctg

SEQ ID NO: 3628830 - DNA, 20 bp, Homo sapiens
agagccttacttcaaagtgc

SEQ ID NO: 3628831 - DNA, 22 bp, Homo sapiens
agagcctttttacctggcctag

SEQ ID NO: 3628832 - DNA, 16 bp, Homo sapiens
agagcggctggagaaa

SEQ ID NO: 3628833 - DNA, 19 bp, Homo sapiens
agagcggctggagaaagat

SEQ ID NO: 3628834 - DNA, 21 bp, Homo sapiens
agagctaaaaaggcccttaga

SEQ ID NO: 3628835 - DNA, 17 bp, Homo sapiens
agagctactcccacagc

SEQ ID NO: 3628836 - DNA, 19 bp, Homo sapiens
agagctaggaaccctggag

SEQ ID NO: 3628837 - DNA, 16 bp, Homo sapiens
agagctccgatgcccg

SEQ ID NO: 3628838 - DNA, 16 bp, Homo sapiens
agagctcttgtgttca

SEQ ID NO: 3628839 - DNA, 11 bp, Homo sapiens
agagctgcctg

SEQ ID NO: 3628840 - DNA, 14 bp, Homo sapiens
agagctgcctggat

SEQ ID NO: 3628841 - DNA, 17 bp, Homo sapiens
agagctgcctggatgag

SEQ ID NO: 3628842 - DNA, 19 bp, Homo sapiens
agagctgcctggatgagaa

SEQ ID NO: 3628843 - DNA, 10 bp, Homo sapiens
agagctgtgc

SEQ ID NO: 3628844 - DNA, 12 bp, Homo sapiens
agagctgtgcca

SEQ ID NO: 3628845 - DNA, 13 bp, Homo sapiens
agagctgtgccag

SEQ ID NO: 3628846 - DNA, 17 bp, Homo sapiens
agagctgtgccagcagg

SEQ ID NO: 3628847 - DNA, 16 bp, Homo sapiens
agagcttgtaataaat

SEQ ID NO: 3628848 - DNA, 20 bp, Homo sapiens
agagcttgtaataaatactg

SEQ ID NO: 3628849 - DNA, 21 bp, Homo sapiens
agaggaaatctgtaacaggta

SEQ ID NO: 3628850 - DNA, 18 bp, Homo sapiens
agaggaccaatgcttgca

SEQ ID NO: 3628851 - DNA, 23 bp, Homo sapiens
agaggaccaatgcttgcatggag

SEQ ID NO: 3628852 - DNA, 22 bp, Homo sapiens
agaggactggttctgaggccag

SEQ ID NO: 3628853 - DNA, 21 bp, Homo sapiens
agaggagaaaaagaagaaaag

SEQ ID NO: 3628854 - DNA, 16 bp, Homo sapiens
agaggagaaagtggaa

SEQ ID NO: 3628855 - DNA, 20 bp, Homo sapiens
agaggagaacttgctgcctc

SEQ ID NO: 3628856 - DNA, 17 bp, Homo sapiens
agaggagataaggtggc

SEQ ID NO: 3628857 - DNA, 22 bp, Homo sapiens
agaggagataaggtggcttctc

SEQ ID NO: 3628858 - DNA, 15 bp, Homo sapiens
agaggagcgcaggca

SEQ ID NO: 3628859 - DNA, 17 bp, Homo sapiens
agaggagcgcaggcagc

SEQ ID NO: 3628860 - DNA, 21 bp, Homo sapiens
agaggagcgcaggcagcgcag

SEQ ID NO: 3628861 - DNA, 14 bp, Homo sapiens
agaggaggggccgc

SEQ ID NO: 3628862 - DNA, 20 bp, Homo sapiens
agaggaggggccgctgccac

SEQ ID NO: 3628863 - DNA, 20 bp, Homo sapiens
agaggcagcatgcttgggct

SEQ ID NO: 3628864 - DNA, 14 bp, Homo sapiens
agaggccccagcct

SEQ ID NO: 3628865 - DNA, 16 bp, Homo sapiens
agaggccccagcctcc

SEQ ID NO: 3628866 - DNA, 22 bp, Homo sapiens
agaggccctctggagtggccac

SEQ ID NO: 3628867 - DNA, 23 bp, Homo sapiens
agaggccctctggagtggccact

SEQ ID NO: 3628868 - DNA, 13 bp, Homo sapiens
agaggccctggag

SEQ ID NO: 3628869 - DNA, 22 bp, Homo sapiens
agaggccctggaggtctccagg

SEQ ID NO: 3628870 - DNA, 21 bp, Homo sapiens
agaggcgtactacccagctct

SEQ ID NO: 3628871 - DNA, 22 bp, Homo sapiens
agaggcgtactacccagctctg

SEQ ID NO: 3628872 - DNA, 16 bp, Homo sapiens
agaggctctccgtgca

SEQ ID NO: 3628873 - DNA, 13 bp, Homo sapiens
agaggctgaggac

SEQ ID NO: 3628874 - DNA, 16 bp, Homo sapiens
agagggaaaaggcagg

SEQ ID NO: 3628875 - DNA, 15 bp, Homo sapiens
agagggaagccatgt

SEQ ID NO: 3628876 - DNA, 18 bp, Homo sapiens
agagggacatagaatctg

SEQ ID NO: 3628877 - DNA, 14 bp, Homo sapiens
agagggaggaaggg

SEQ ID NO: 3628878 - DNA, 24 bp, Homo sapiens
agagggaggagaatgagcctcggc

SEQ ID NO: 3628879 - DNA, 16 bp, Homo sapiens
agagggaggcaagccc

SEQ ID NO: 3628880 - DNA, 18 bp, Homo sapiens
agagggaggcaagccctg

SEQ ID NO: 3628881 - DNA, 13 bp, Homo sapiens
agagggaggggcc

SEQ ID NO: 3628882 - DNA, 16 bp, Homo sapiens
agagggcccagcccag

SEQ ID NO: 3628883 - DNA, 17 bp, Homo sapiens
agagggcccagcccaga

SEQ ID NO: 3628884 - DNA, 21 bp, Homo sapiens
agaggtaaccgttaggcggga

SEQ ID NO: 3628885 - DNA, 19 bp, Homo sapiens
agaggtagcactctcagag

SEQ ID NO: 3628886 - DNA, 14 bp, Homo sapiens
agaggtctgattgg

SEQ ID NO: 3628887 - DNA, 20 bp, Homo sapiens
agaggtgattctcagggctg

SEQ ID NO: 3628888 - DNA, 16 bp, Homo sapiens
agaggtggggagcaga

SEQ ID NO: 3628889 - DNA, 19 bp, Homo sapiens
agaggtggggatcctgcct

SEQ ID NO: 3628890 - DNA, 14 bp, Homo sapiens
agaggttaggagta

SEQ ID NO: 3628891 - DNA, 17 bp, Homo sapiens
agaggtttgaaggagaa

SEQ ID NO: 3628892 - DNA, 22 bp, Homo sapiens
agagtaaaagtcccagttaagt

SEQ ID NO: 3628893 - DNA, 17 bp, Homo sapiens
agagtacatttgcttta

SEQ ID NO: 3628894 - DNA, 23 bp, Homo sapiens
agagtatatttttgtctgcagct

SEQ ID NO: 3628895 - DNA, 21 bp, Homo sapiens
agagtccccccactcccagca

SEQ ID NO: 3628896 - DNA, 12 bp, Homo sapiens
agagtcctctga

SEQ ID NO: 3628897 - DNA, 14 bp, Homo sapiens
agagtggcctccct

SEQ ID NO: 3628898 - DNA, 17 bp, Homo sapiens
agagtggcctccctgct

SEQ ID NO: 3628899 - DNA, 18 bp, Homo sapiens
agagtggcgtggcctccc

SEQ ID NO: 3628900 - DNA, 13 bp, Homo sapiens
agagtggctcctc

SEQ ID NO: 3628901 - DNA, 14 bp, Homo sapiens
agagtggctcctcc

SEQ ID NO: 3628902 - DNA, 15 bp, Homo sapiens
agagtggctcctccc

SEQ ID NO: 3628903 - DNA, 19 bp, Homo sapiens
agagtggctcctcccggtg

SEQ ID NO: 3628904 - DNA, 23 bp, Homo sapiens
agagtggctcctcccggtgccca

SEQ ID NO: 3628905 - DNA, 14 bp, Homo sapiens
agagtgggccccgg

SEQ ID NO: 3628906 - DNA, 21 bp, Homo sapiens
agcctccaagctccatctcca

SEQ ID NO: 3628907 - DNA, 22 bp, Homo sapiens
agcctccagtccaaagccggct

SEQ ID NO: 3628908 - DNA, 13 bp, Homo sapiens
agcctcccctccc

SEQ ID NO: 3628909 - DNA, 17 bp, Homo sapiens
agcctcccctcccctgg

SEQ ID NO: 3628910 - DNA, 21 bp, Homo sapiens
agcctcccctcccctggggac

SEQ ID NO: 3628911 - DNA, 21 bp, Homo sapiens
agcctccctgtctccagctgc

SEQ ID NO: 3628912 - DNA, 22 bp, Homo sapiens
agcctccgggcgtgtgaagaac

SEQ ID NO: 3628913 - DNA, 19 bp, Homo sapiens
agcctcctgccccctgcca

SEQ ID NO: 3628914 - DNA, 20 bp, Homo sapiens
agcctcctgtacctcagtgg

SEQ ID NO: 3628915 - DNA, 21 bp, Homo sapiens
agcctctctccttggccacag

SEQ ID NO: 3628916 - DNA, 15 bp, Homo sapiens
agcctctctggctgg

SEQ ID NO: 3628917 - DNA, 19 bp, Homo sapiens
agcctctctggctggtctt

SEQ ID NO: 3628918 - DNA, 21 bp, Homo sapiens
agcctctgacttaagctgcct

SEQ ID NO: 3628919 - DNA, 19 bp, Homo sapiens
agcctctggactggaaagc

SEQ ID NO: 3628920 - DNA, 13 bp, Homo sapiens
agcctctggccgt

SEQ ID NO: 3628921 - DNA, 11 bp, Homo sapiens
agcctctggct

SEQ ID NO: 3628922 - DNA, 14 bp, Homo sapiens
agcctctggcttcc

SEQ ID NO: 3628923 - DNA, 16 bp, Homo sapiens
agcctctggcttccct

SEQ ID NO: 3628924 - DNA, 23 bp, Homo sapiens
agcctctggcttccctaaactgc

SEQ ID NO: 3628925 - DNA, 21 bp, Homo sapiens
agcctgactagaactcctgtc

SEQ ID NO: 3628926 - DNA, 23 bp, Homo sapiens
agcctgactagaactcctgtctt

SEQ ID NO: 3628927 - DNA, 16 bp, Homo sapiens
agcctgagtcacctgc

SEQ ID NO: 3628928 - DNA, 20 bp, Homo sapiens
agcctggcacagggcagtgg

SEQ ID NO: 3628929 - DNA, 12 bp, Homo sapiens
agcctggccaga

SEQ ID NO: 3628930 - DNA, 14 bp, Homo sapiens
agcctggccagaca

SEQ ID NO: 3628931 - DNA, 15 bp, Homo sapiens
agcctggccagacac

SEQ ID NO: 3628932 - DNA, 16 bp, Homo sapiens
agcctggccagacaca

SEQ ID NO: 3628933 - DNA, 14 bp, Homo sapiens
agcctggccaggca

SEQ ID NO: 3628934 - DNA, 18 bp, Homo sapiens
agcctggccaggcaggga

SEQ ID NO: 3628935 - DNA, 21 bp, Homo sapiens
agcctggccaggcagggagag

SEQ ID NO: 3628936 - DNA, 12 bp, Homo sapiens
agcctggctctg

SEQ ID NO: 3628937 - DNA, 17 bp, Homo sapiens
agcctggctctgccccc

SEQ ID NO: 3628938 - DNA, 19 bp, Homo sapiens
agcctgggagcccagaggg

SEQ ID NO: 3628939 - DNA, 23 bp, Homo sapiens
agcctgggcaacgagtgaaactc

SEQ ID NO: 3628940 - DNA, 11 bp, Homo sapiens
agcctgggctc

SEQ ID NO: 3628941 - DNA, 18 bp, Homo sapiens
agcctgggctcactgtgc

SEQ ID NO: 3628942 - DNA, 22 bp, Homo sapiens
agcctgggctcactgtgctggg

SEQ ID NO: 3628943 - DNA, 18 bp, Homo sapiens
agcctggttcagacacag

SEQ ID NO: 3628944 - DNA, 20 bp, Homo sapiens
agcctggttcagacacagct

SEQ ID NO: 3628945 - DNA, 17 bp, Homo sapiens
agcctgtcctgggctgg

SEQ ID NO: 3628946 - DNA, 19 bp, Homo sapiens
agcctgtgcctctgggact

SEQ ID NO: 3628947 - DNA, 21 bp, Homo sapiens
agcctgtgcctctgggactgg

SEQ ID NO: 3628948 - DNA, 23 bp, Homo sapiens
agcctgtgcgtcccagctgaagg

SEQ ID NO: 3628949 - DNA, 17 bp, Homo sapiens
agcctgttccagaagga

SEQ ID NO: 3628950 - DNA, 15 bp, Homo sapiens
agccttacttcaaag

SEQ ID NO: 3628951 - DNA, 22 bp, Homo sapiens
agccttacttcaaagtgcctgg

SEQ ID NO: 3628952 - DNA, 18 bp, Homo sapiens
agccttagagctcttgtg

SEQ ID NO: 3628953 - DNA, 16 bp, Homo sapiens
agccttagaggtcttt

SEQ ID NO: 3628954 - DNA, 18 bp, Homo sapiens
agccttataaaccaatct

SEQ ID NO: 3628955 - DNA, 20 bp, Homo sapiens
agccttataaaccaatctta

SEQ ID NO: 3628956 - DNA, 16 bp, Homo sapiens
agccttcatcagaact

SEQ ID NO: 3628957 - DNA, 13 bp, Homo sapiens
agccttccccagc

SEQ ID NO: 3628958 - DNA, 14 bp, Homo sapiens
agccttccccagct

SEQ ID NO: 3628959 - DNA, 18 bp, Homo sapiens
agccttgcagcggctcct

SEQ ID NO: 3628960 - DNA, 17 bp, Homo sapiens
agccttgccagagatcc

SEQ ID NO: 3628961 - DNA, 23 bp, Homo sapiens
agccttgggatagcaaactccag

SEQ ID NO: 3628962 - DNA, 17 bp, Homo sapiens
agccttgtacagtctgc

SEQ ID NO: 3628963 - DNA, 21 bp, Homo sapiens
agccttgtacagtctgctcct

SEQ ID NO: 3628964 - DNA, 22 bp, Homo sapiens
agccttgtacagtctgctcctc

SEQ ID NO: 3628965 - DNA, 13 bp, Homo sapiens
agccttgtcagtg

SEQ ID NO: 3628966 - DNA, 20 bp, Homo sapiens
agcctttgcccaaaactgtc

SEQ ID NO: 3628967 - DNA, 17 bp, Homo sapiens
agccttttatgtatttt

SEQ ID NO: 3628968 - DNA, 15 bp, Homo sapiens
agcgaacagccttag

SEQ ID NO: 3628969 - DNA, 13 bp, Homo sapiens
agcgacttcaggt

SEQ ID NO: 3628970 - DNA, 13 bp, Homo sapiens
agcgaggaaagga

SEQ ID NO: 3628971 - DNA, 20 bp, Homo sapiens
agcgcatgtgtgcatgtgct

SEQ ID NO: 3628972 - DNA, 22 bp, Homo sapiens
agcgcatgtgtgcatgtgctgt

SEQ ID NO: 3628973 - DNA, 16 bp, Homo sapiens
agcgccctgcagggcc

SEQ ID NO: 3628974 - DNA, 20 bp, Homo sapiens
agcgcctttcccaactctag

SEQ ID NO: 3628975 - DNA, 19 bp, Homo sapiens
agcggacatcagctggtca

SEQ ID NO: 3628976 - DNA, 15 bp, Homo sapiens
agcggagcccagcct

SEQ ID NO: 3628977 - DNA, 16 bp, Homo sapiens
agcggagcccagcctg

SEQ ID NO: 3628978 - DNA, 14 bp, Homo sapiens
agcgggagcccgtg

SEQ ID NO: 3628979 - DNA, 17 bp, Homo sapiens
agcggtccctgtccctc

SEQ ID NO: 3628980 - DNA, 13 bp, Homo sapiens
agcgtaaaatggt

SEQ ID NO: 3628981 - DNA, 14 bp, Homo sapiens
agcgttttttaaat

SEQ ID NO: 3628982 - DNA, 20 bp, Homo sapiens
agcgttttttaaatgtatac

SEQ ID NO: 3628983 - DNA, 23 bp, Homo sapiens
agcgttttttaaatgtatactat

SEQ ID NO: 3628984 - DNA, 13 bp, Homo sapiens
agctaagaacctg

SEQ ID NO: 3628985 - DNA, 19 bp, Homo sapiens
agctaaggtttagataaat

SEQ ID NO: 3628986 - DNA, 16 bp, Homo sapiens
agctaatcagcattct

SEQ ID NO: 3628987 - DNA, 17 bp, Homo sapiens
agctacaaccctaccct

SEQ ID NO: 3628988 - DNA, 23 bp, Homo sapiens
agctacaaccctaccctggcagg

SEQ ID NO: 3628989 - DNA, 15 bp, Homo sapiens
agctacaggacaaag

SEQ ID NO: 3628990 - DNA, 14 bp, Homo sapiens
agctacctcaacca

SEQ ID NO: 3628991 - DNA, 22 bp, Homo sapiens
agctactcagtggggctggcat

SEQ ID NO: 3628992 - DNA, 21 bp, Homo sapiens
agctagaacattccatttgct

SEQ ID NO: 3628993 - DNA, 19 bp, Homo sapiens
agctaggaaccctggaggt

SEQ ID NO: 3628994 - DNA, 23 bp, Homo sapiens
agctaggagcaggcttgtggcag

SEQ ID NO: 3628995 - DNA, 16 bp, Homo sapiens
agctaggccccagagg

SEQ ID NO: 3628996 - DNA, 17 bp, Homo sapiens
agctaggccccagaggc

SEQ ID NO: 3628997 - DNA, 22 bp, Homo sapiens
agctaggccccagaggccctgg

SEQ ID NO: 3628998 - DNA, 21 bp, Homo sapiens
agctagtgcctttagagggta

SEQ ID NO: 3628999 - DNA, 15 bp, Homo sapiens
agctatcacctagca

SEQ ID NO: 3629000 - DNA, 15 bp, Homo sapiens
agctatttttataca

SEQ ID NO: 3629001 - DNA, 20 bp, Homo sapiens
agctatttttatacactgta

SEQ ID NO: 3629002 - DNA, 22 bp, Homo sapiens
agctatttttatacactgtaag

SEQ ID NO: 3629003 - DNA, 17 bp, Homo sapiens
agctcaaataaaaataa

SEQ ID NO: 3629004 - DNA, 17 bp, Homo sapiens
agctcaagggctggcac

SEQ ID NO: 3629005 - DNA, 18 bp, Homo sapiens
agctcaagggctggcact

SEQ ID NO: 3629006 - DNA, 20 bp, Homo sapiens
agctcaagggctggcacttt

SEQ ID NO: 3629007 - DNA, 13 bp, Homo sapiens
agctcacccctgg

SEQ ID NO: 3629008 - DNA, 16 bp, Homo sapiens
agctcacgtaatgcat

SEQ ID NO: 3629009 - DNA, 13 bp, Homo sapiens
agctcagccctgg

SEQ ID NO: 3629010 - DNA, 13 bp, Homo sapiens
agctcaggacaga

SEQ ID NO: 3629011 - DNA, 20 bp, Homo sapiens
agctcatatgctgacagctc

SEQ ID NO: 3629012 - DNA, 16 bp, Homo sapiens
agctcatgtttttaac

SEQ ID NO: 3629013 - DNA, 13 bp, Homo sapiens
agctccaacctgc

SEQ ID NO: 3629014 - DNA, 14 bp, Homo sapiens
agctccaacctgca

SEQ ID NO: 3629015 - DNA, 22 bp, Homo sapiens
agctccaacctgcaaagatctg

SEQ ID NO: 3629016 - DNA, 19 bp, Homo sapiens
agctccatacacacgctgc

SEQ ID NO: 3629017 - DNA, 20 bp, Homo sapiens
agctccatacacacgctgcc

SEQ ID NO: 3629018 - DNA, 22 bp, Homo sapiens
agctccatacacacgctgcctt

SEQ ID NO: 3629019 - DNA, 16 bp, Homo sapiens
agctccatctccactc

SEQ ID NO: 3629020 - DNA, 19 bp, Homo sapiens
agctcccctcggagaagag

SEQ ID NO: 3629021 - DNA, 12 bp, Homo sapiens
agctccctcctc

SEQ ID NO: 3629022 - DNA, 14 bp, Homo sapiens
agctccctcctcag

SEQ ID NO: 3629023 - DNA, 16 bp, Homo sapiens
agctccctgcctgttt

SEQ ID NO: 3629024 - DNA, 19 bp, Homo sapiens
agctccctgcctgtttccc

SEQ ID NO: 3629025 - DNA, 13 bp, Homo sapiens
agctccgtgtttc

SEQ ID NO: 3629026 - DNA, 14 bp, Homo sapiens
agctcctcctccct

SEQ ID NO: 3629027 - DNA, 15 bp, Homo sapiens
agctcctcctccctg

SEQ ID NO: 3629028 - DNA, 16 bp, Homo sapiens
agctcctcctccctgc

SEQ ID NO: 3629029 - DNA, 17 bp, Homo sapiens
agctcctcctccctgca

SEQ ID NO: 3629030 - DNA, 16 bp, Homo sapiens
agctcctctccccagc

SEQ ID NO: 3629031 - DNA, 13 bp, Homo sapiens
agctcctgacctt

SEQ ID NO: 3629032 - DNA, 14 bp, Homo sapiens
agctctagcctctg

SEQ ID NO: 3629033 - DNA, 15 bp, Homo sapiens
agctctagcctctgg

SEQ ID NO: 3629034 - DNA, 15 bp, Homo sapiens
agctctcacagacat

SEQ ID NO: 3629035 - DNA, 20 bp, Homo sapiens
agctctcaggaccgtgccct

SEQ ID NO: 3629036 - DNA, 15 bp, Homo sapiens
agctctcccctcaga

SEQ ID NO: 3629037 - DNA, 17 bp, Homo sapiens
agctctccgagctctgg

SEQ ID NO: 3629038 - DNA, 13 bp, Homo sapiens
aggcacactttct

SEQ ID NO: 3629039 - DNA, 17 bp, Homo sapiens
aggcacagtgggagctg

SEQ ID NO: 3629040 - DNA, 14 bp, Homo sapiens
aggcaccgccacgt

SEQ ID NO: 3629041 - DNA, 21 bp, Homo sapiens
aggcaccgccacgtcccagca

SEQ ID NO: 3629042 - DNA, 22 bp, Homo sapiens
aggcaccgccacgtcccagcat

SEQ ID NO: 3629043 - DNA, 21 bp, Homo sapiens
aggcaccgtccaggccccacc

SEQ ID NO: 3629044 - DNA, 22 bp, Homo sapiens
aggcagagtggcgtggcctccc

SEQ ID NO: 3629045 - DNA, 15 bp, Homo sapiens
aggcagatccaggac

SEQ ID NO: 3629046 - DNA, 17 bp, Homo sapiens
aggcagatccaggacta

SEQ ID NO: 3629047 - DNA, 24 bp, Homo sapiens
aggcagcatgcttgggctgaccca

SEQ ID NO: 3629048 - DNA, 12 bp, Homo sapiens
aggcagcgaccc

SEQ ID NO: 3629049 - DNA, 15 bp, Homo sapiens
aggcagcgaccccag

SEQ ID NO: 3629050 - DNA, 15 bp, Homo sapiens
aggcagcgcagggct

SEQ ID NO: 3629051 - DNA, 16 bp, Homo sapiens
aggcagcgcagggctg

SEQ ID NO: 3629052 - DNA, 17 bp, Homo sapiens
aggcagctgcctgctct

SEQ ID NO: 3629053 - DNA, 22 bp, Homo sapiens
aggcaggaccttcgggctgtgc

SEQ ID NO: 3629054 - DNA, 17 bp, Homo sapiens
aggcaggcggctcctcc

SEQ ID NO: 3629055 - DNA, 23 bp, Homo sapiens
aggcagggagagagtagctgcag

SEQ ID NO: 3629056 - DNA, 15 bp, Homo sapiens
aggcagggagggctt

SEQ ID NO: 3629057 - DNA, 18 bp, Homo sapiens
aggcagggggccctgccc

SEQ ID NO: 3629058 - DNA, 21 bp, Homo sapiens
aggcaggtgcttttggcagag

SEQ ID NO: 3629059 - DNA, 14 bp, Homo sapiens
aggcagtggcaggg

SEQ ID NO: 3629060 - DNA, 12 bp, Homo sapiens
aggcagttttct

SEQ ID NO: 3629061 - DNA, 14 bp, Homo sapiens
aggcagttttctaa

SEQ ID NO: 3629062 - DNA, 22 bp, Homo sapiens
aggcatatggagaacatgtttt

SEQ ID NO: 3629063 - DNA, 14 bp, Homo sapiens
aggcatctgagggg

SEQ ID NO: 3629064 - DNA, 14 bp, Homo sapiens
aggccaacagcacc

SEQ ID NO: 3629065 - DNA, 18 bp, Homo sapiens
aggccaacagcacctccc

SEQ ID NO: 3629066 - DNA, 15 bp, Homo sapiens
aggccacattgctgg

SEQ ID NO: 3629067 - DNA, 12 bp, Homo sapiens
aggccaccccaa

SEQ ID NO: 3629068 - DNA, 14 bp, Homo sapiens
aggccaccccaaac

SEQ ID NO: 3629069 - DNA, 14 bp, Homo sapiens
aggccagaaaggtg

SEQ ID NO: 3629070 - DNA, 22 bp, Homo sapiens
aggccagaaaggtgtgaggaga

SEQ ID NO: 3629071 - DNA, 11 bp, Homo sapiens
aggccagagaa

SEQ ID NO: 3629072 - DNA, 13 bp, Homo sapiens
aggccagagaaag

SEQ ID NO: 3629073 - DNA, 15 bp, Homo sapiens
aggccagagaaagca

SEQ ID NO: 3629074 - DNA, 20 bp, Homo sapiens
aggccagagaaagcaaaggt

SEQ ID NO: 3629075 - DNA, 11 bp, Homo sapiens
aggccagccca

SEQ ID NO: 3629076 - DNA, 13 bp, Homo sapiens
aggccagcccagc

SEQ ID NO: 3629077 - DNA, 18 bp, Homo sapiens
aggccagcccagccaggc

SEQ ID NO: 3629078 - DNA, 23 bp, Homo sapiens
aggccagccttgtacagtctgct

SEQ ID NO: 3629079 - DNA, 19 bp, Homo sapiens
aggccaggacgggccacac

SEQ ID NO: 3629080 - DNA, 21 bp, Homo sapiens
aggccaggacgggccacacgt

SEQ ID NO: 3629081 - DNA, 21 bp, Homo sapiens
aggccagtcagacgccaggca

SEQ ID NO: 3629082 - DNA, 15 bp, Homo sapiens
aggccagtgagctgt

SEQ ID NO: 3629083 - DNA, 16 bp, Homo sapiens
aggccatctcaggaga

SEQ ID NO: 3629084 - DNA, 11 bp, Homo sapiens
aggccatctgg

SEQ ID NO: 3629085 - DNA, 14 bp, Homo sapiens
aggccatctggaga

SEQ ID NO: 3629086 - DNA, 15 bp, Homo sapiens
aggccatctggagag

SEQ ID NO: 3629087 - DNA, 22 bp, Homo sapiens
aggccatggcatccctttttca

SEQ ID NO: 3629088 - DNA, 21 bp, Homo sapiens
aggcccagaattgcagttcag

SEQ ID NO: 3629089 - DNA, 16 bp, Homo sapiens
aggcccatgggaggct

SEQ ID NO: 3629090 - DNA, 17 bp, Homo sapiens
aggccccaccggccagg

SEQ ID NO: 3629091 - DNA, 13 bp, Homo sapiens
aggccccagaggc

SEQ ID NO: 3629092 - DNA, 16 bp, Homo sapiens
aggccccagaggccct

SEQ ID NO: 3629093 - DNA, 18 bp, Homo sapiens
aggcccctaggtgcccag

SEQ ID NO: 3629094 - DNA, 21 bp, Homo sapiens
aggcccctatgtagtccgtgc

SEQ ID NO: 3629095 - DNA, 23 bp, Homo sapiens
aggcccgcttgctgggtacctgg

SEQ ID NO: 3629096 - DNA, 22 bp, Homo sapiens
aggccctccctgtctccagggc

SEQ ID NO: 3629097 - DNA, 20 bp, Homo sapiens
aggccctctggagtggccac

SEQ ID NO: 3629098 - DNA, 14 bp, Homo sapiens
aggccctgccctgc

SEQ ID NO: 3629099 - DNA, 15 bp, Homo sapiens
aggccctgccctgcc

SEQ ID NO: 3629100 - DNA, 16 bp, Homo sapiens
aggccctgccctgccc

SEQ ID NO: 3629101 - DNA, 17 bp, Homo sapiens
aggccctgccctgccca

SEQ ID NO: 3629102 - DNA, 22 bp, Homo sapiens
aggccctgccctgcccaacctc

SEQ ID NO: 3629103 - DNA, 12 bp, Homo sapiens
aggccctggagg

SEQ ID NO: 3629104 - DNA, 20 bp, Homo sapiens
aggccctggaggtctccagg

SEQ ID NO: 3629105 - DNA, 18 bp, Homo sapiens
aggccctgtgagcacaaa

SEQ ID NO: 3629106 - DNA, 16 bp, Homo sapiens
aggcccttagagggaa

SEQ ID NO: 3629107 - DNA, 17 bp, Homo sapiens
aggcccttcctctccac

SEQ ID NO: 3629108 - DNA, 19 bp, Homo sapiens
aggcccttcctctccactg

SEQ ID NO: 3629109 - DNA, 13 bp, Homo sapiens
aggccgcgcccag

SEQ ID NO: 3629110 - DNA, 16 bp, Homo sapiens
aggccgcgcccagcag

SEQ ID NO: 3629111 - DNA, 18 bp, Homo sapiens
aggccggcagcgggcgga

SEQ ID NO: 3629112 - DNA, 23 bp, Homo sapiens
aggccgtatgaagacagaggcag

SEQ ID NO: 3629113 - DNA, 15 bp, Homo sapiens
aggcctcagccagag

SEQ ID NO: 3629114 - DNA, 16 bp, Homo sapiens
aggcctcagccagaga

SEQ ID NO: 3629115 - DNA, 21 bp, Homo sapiens
aggcctctcattccagaggaa

SEQ ID NO: 3629116 - DNA, 12 bp, Homo sapiens
aggcctctggga

SEQ ID NO: 3629117 - DNA, 14 bp, Homo sapiens
aggcctgaagtctt

SEQ ID NO: 3629118 - DNA, 13 bp, Homo sapiens
aggcctgacttgg

SEQ ID NO: 3629119 - DNA, 17 bp, Homo sapiens
aggcctgccccctgggc

SEQ ID NO: 3629120 - DNA, 19 bp, Homo sapiens
aggcctgccccctgggctg

SEQ ID NO: 3629121 - DNA, 14 bp, Homo sapiens
aggcctggacagct

SEQ ID NO: 3629122 - DNA, 22 bp, Homo sapiens
aggcctgggtgatctgctgctg

SEQ ID NO: 3629123 - DNA, 18 bp, Homo sapiens
aggcctgtcccttgcctc

SEQ ID NO: 3629124 - DNA, 19 bp, Homo sapiens
aggcctgtcccttgcctct

SEQ ID NO: 3629125 - DNA, 17 bp, Homo sapiens
aggccttacatctggct

SEQ ID NO: 3629126 - DNA, 15 bp, Homo sapiens
aggccttgccagttt

SEQ ID NO: 3629127 - DNA, 15 bp, Homo sapiens
aggcctttcctctgc

SEQ ID NO: 3629128 - DNA, 21 bp, Homo sapiens
aggcgggatttatgtgcactg

SEQ ID NO: 3629129 - DNA, 19 bp, Homo sapiens
aggcgtactacccagctct

SEQ ID NO: 3629130 - DNA, 20 bp, Homo sapiens
aggcgtactacccagctctg

SEQ ID NO: 3629131 - DNA, 21 bp, Homo sapiens
aggcgtttggagaaggtctgt

SEQ ID NO: 3629132 - DNA, 14 bp, Homo sapiens
aggctaagaccctg

SEQ ID NO: 3629133 - DNA, 21 bp, Homo sapiens
aggctacctcacctgggcagg

SEQ ID NO: 3629134 - DNA, 18 bp, Homo sapiens
aggctactagaattctgt

SEQ ID NO: 3629135 - DNA, 22 bp, Homo sapiens
aggctactagaattctgtattg

SEQ ID NO: 3629136 - DNA, 17 bp, Homo sapiens
aggctactgtaatgctg

SEQ ID NO: 3629137 - DNA, 24 bp, Homo sapiens
aggctactgtaatgctgcctcagg

SEQ ID NO: 3629138 - DNA, 19 bp, Homo sapiens
aggctatggggatagatgt

SEQ ID NO: 3629139 - DNA, 22 bp, Homo sapiens
aggctatggggtaggagaaaag

SEQ ID NO: 3629140 - DNA, 19 bp, Homo sapiens
aggctattattttcactgt

SEQ ID NO: 3629141 - DNA, 17 bp, Homo sapiens
aggctattttctaaaga

SEQ ID NO: 3629142 - DNA, 22 bp, Homo sapiens
aggctcaggagaagccagtgtc

SEQ ID NO: 3629143 - DNA, 22 bp, Homo sapiens
aggctccaccccatccagttca

SEQ ID NO: 3629144 - DNA, 17 bp, Homo sapiens
aggctccgggcaccagg

SEQ ID NO: 3629145 - DNA, 23 bp, Homo sapiens
aggctccgggcaccaggggccaa

SEQ ID NO: 3629146 - DNA, 19 bp, Homo sapiens
aggctcctacctgtctgct

SEQ ID NO: 3629147 - DNA, 22 bp, Homo sapiens
aggctcctacctgtctgctgcc

SEQ ID NO: 3629148 - DNA, 23 bp, Homo sapiens
aggctcctacctgtctgctgcca

SEQ ID NO: 3629149 - DNA, 22 bp, Homo sapiens
aggctcctctaggccctgtgag

SEQ ID NO: 3629150 - DNA, 22 bp, Homo sapiens
aggctcctgaccccgccatgca

SEQ ID NO: 3629151 - DNA, 23 bp, Homo sapiens
aggctcctgaccccgccatgcat

SEQ ID NO: 3629152 - DNA, 16 bp, Homo sapiens
aggctcgtcagccacc

SEQ ID NO: 3629153 - DNA, 21 bp, Homo sapiens
aggctcgtcagccacctggga

SEQ ID NO: 3629154 - DNA, 20 bp, Homo sapiens
aggctctcaacaggggagag

SEQ ID NO: 3629155 - DNA, 14 bp, Homo sapiens
aggctctcccctct

SEQ ID NO: 3629156 - DNA, 22 bp, Homo sapiens
aggctctcccctctcgccccat

SEQ ID NO: 3629157 - DNA, 22 bp, Homo sapiens
aggctctgcacagacaagcagc

SEQ ID NO: 3629158 - DNA, 23 bp, Homo sapiens
aggctctgcacagacaagcagcc

SEQ ID NO: 3629159 - DNA, 18 bp, Homo sapiens
aggctcttaagcagcatg

SEQ ID NO: 3629160 - DNA, 11 bp, Homo sapiens
aggctgaggac

SEQ ID NO: 3629161 - DNA, 16 bp, Homo sapiens
aggctgagggtcgtgg

SEQ ID NO: 3629162 - DNA, 21 bp, Homo sapiens
aggctgcaaggtttaggctgg

SEQ ID NO: 3629163 - DNA, 18 bp, Homo sapiens
aggctgcctgctgtgctg

SEQ ID NO: 3629164 - DNA, 18 bp, Homo sapiens
aggctggagtgcaatggt

SEQ ID NO: 3629165 - DNA, 22 bp, Homo sapiens
aggctggtctcaaactcctgac

SEQ ID NO: 3629166 - DNA, 17 bp, Homo sapiens
aggctgtaactgagaga

SEQ ID NO: 3629167 - DNA, 20 bp, Homo sapiens
aggctgtaactgagagaaag

SEQ ID NO: 3629168 - DNA, 12 bp, Homo sapiens
aggctgtacata

SEQ ID NO: 3629169 - DNA, 23 bp, Homo sapiens
agtaagtttatccaaatcttgaa

SEQ ID NO: 3629170 - DNA, 14 bp, Homo sapiens
agtaataaagagaa

SEQ ID NO: 3629171 - DNA, 17 bp, Homo sapiens
agtaataaagagaaata

SEQ ID NO: 3629172 - DNA, 18 bp, Homo sapiens
agtaataggcattttaag

SEQ ID NO: 3629173 - DNA, 13 bp, Homo sapiens
agtaatatattct

SEQ ID NO: 3629174 - DNA, 15 bp, Homo sapiens
agtaatatattctga

SEQ ID NO: 3629175 - DNA, 13 bp, Homo sapiens
agtaatattatta

SEQ ID NO: 3629176 - DNA, 14 bp, Homo sapiens
agtaatccacctgc

SEQ ID NO: 3629177 - DNA, 15 bp, Homo sapiens
agtaatgaaatggag

SEQ ID NO: 3629178 - DNA, 15 bp, Homo sapiens
agtaatttgaggaca

SEQ ID NO: 3629179 - DNA, 16 bp, Homo sapiens
agtacaaatgccttaa

SEQ ID NO: 3629180 - DNA, 21 bp, Homo sapiens
agtacaaatgccttaaaatgg

SEQ ID NO: 3629181 - DNA, 22 bp, Homo sapiens
agtacacaataagcaaaaacaa

SEQ ID NO: 3629182 - DNA, 12 bp, Homo sapiens
agtaccatttaa

SEQ ID NO: 3629183 - DNA, 17 bp, Homo sapiens
agtacctgattgtattt

SEQ ID NO: 3629184 - DNA, 15 bp, Homo sapiens
agtacctgtgactct

SEQ ID NO: 3629185 - DNA, 14 bp, Homo sapiens
agtactaaaattaa

SEQ ID NO: 3629186 - DNA, 16 bp, Homo sapiens
agtactacacattttt

SEQ ID NO: 3629187 - DNA, 22 bp, Homo sapiens
agtactacacatttttaaattg

SEQ ID NO: 3629188 - DNA, 22 bp, Homo sapiens
agtacttggcccccttcaggag

SEQ ID NO: 3629189 - DNA, 17 bp, Homo sapiens
agtactttggaggcccc

SEQ ID NO: 3629190 - DNA, 22 bp, Homo sapiens
agtagacctctttttcttacca

SEQ ID NO: 3629191 - DNA, 15 bp, Homo sapiens
agtagagagggaaca

SEQ ID NO: 3629192 - DNA, 18 bp, Homo sapiens
agtagatgtggcctttga

SEQ ID NO: 3629193 - DNA, 20 bp, Homo sapiens
agtagatgtggcctttgaat

SEQ ID NO: 3629194 - DNA, 18 bp, Homo sapiens
agtagcgttttttaaatg

SEQ ID NO: 3629195 - DNA, 21 bp, Homo sapiens
agtagcgttttttaaatgtat

SEQ ID NO: 3629196 - DNA, 22 bp, Homo sapiens
agtagcgttttttaaatgtata

SEQ ID NO: 3629197 - DNA, 15 bp, Homo sapiens
agtagcttgaaattg

SEQ ID NO: 3629198 - DNA, 21 bp, Homo sapiens
agtagggatgcggatcctgct

SEQ ID NO: 3629199 - DNA, 23 bp, Homo sapiens
agtagggatgcggatcctgctgg

SEQ ID NO: 3629200 - DNA, 20 bp, Homo sapiens
agtaggtgggggaacactga

SEQ ID NO: 3629201 - DNA, 16 bp, Homo sapiens
agtagtatatttaatt

SEQ ID NO: 3629202 - DNA, 22 bp, Homo sapiens
agtataacagttttgagtaatt

SEQ ID NO: 3629203 - DNA, 14 bp, Homo sapiens
agtataagaaatgc

SEQ ID NO: 3629204 - DNA, 21 bp, Homo sapiens
agtatatttttgtctgcagct

SEQ ID NO: 3629205 - DNA, 17 bp, Homo sapiens
agtatcctccaggtttt

SEQ ID NO: 3629206 - DNA, 19 bp, Homo sapiens
agtatcctccaggtttttc

SEQ ID NO: 3629207 - DNA, 21 bp, Homo sapiens
agtatcctccaggtttttcaa

SEQ ID NO: 3629208 - DNA, 22 bp, Homo sapiens
agtatcctccaggtttttcaat

SEQ ID NO: 3629209 - DNA, 23 bp, Homo sapiens
agtatcctccaggtttttcaatt

SEQ ID NO: 3629210 - DNA, 12 bp, Homo sapiens
agtatctgctgt

SEQ ID NO: 3629211 - DNA, 14 bp, Homo sapiens
agtatctgctgttc

SEQ ID NO: 3629212 - DNA, 14 bp, Homo sapiens
agtatctgtgaact

SEQ ID NO: 3629213 - DNA, 19 bp, Homo sapiens
agtatgaaaatggaaattt

SEQ ID NO: 3629214 - DNA, 15 bp, Homo sapiens
agtatgtatattaaa

SEQ ID NO: 3629215 - DNA, 20 bp, Homo sapiens
agtatgtatattaaaaaaga

SEQ ID NO: 3629216 - DNA, 17 bp, Homo sapiens
agtatgtggaagtgtgg

SEQ ID NO: 3629217 - DNA, 19 bp, Homo sapiens
agtatgtggaagtgtgggt

SEQ ID NO: 3629218 - DNA, 22 bp, Homo sapiens
agtattaacactaaattgcagt

SEQ ID NO: 3629219 - DNA, 13 bp, Homo sapiens
agtattaaggttt

SEQ ID NO: 3629220 - DNA, 14 bp, Homo sapiens
agtattataaattg

SEQ ID NO: 3629221 - DNA, 21 bp, Homo sapiens
agtattataaattgtgtattt

SEQ ID NO: 3629222 - DNA, 23 bp, Homo sapiens
agtattatccacaattattggca

SEQ ID NO: 3629223 - DNA, 14 bp, Homo sapiens
agtattgaaaactt

SEQ ID NO: 3629224 - DNA, 15 bp, Homo sapiens
agtattgaaaacttc

SEQ ID NO: 3629225 - DNA, 20 bp, Homo sapiens
agtattgaaaacttcaaagc

SEQ ID NO: 3629226 - DNA, 21 bp, Homo sapiens
agtattgaaaacttcaaagct

SEQ ID NO: 3629227 - DNA, 15 bp, Homo sapiens
agtatttaaatgttc

SEQ ID NO: 3629228 - DNA, 15 bp, Homo sapiens
agtatttagaagcca

SEQ ID NO: 3629229 - DNA, 19 bp, Homo sapiens
agtatttagaagccaacta

SEQ ID NO: 3629230 - DNA, 20 bp, Homo sapiens
agtatttcagtgttttcatt

SEQ ID NO: 3629231 - DNA, 22 bp, Homo sapiens
agtatttcagtgttttcatttt

SEQ ID NO: 3629232 - DNA, 23 bp, Homo sapiens
agtatttctacattacagccata

SEQ ID NO: 3629233 - DNA, 14 bp, Homo sapiens
agtatttgtgggga

SEQ ID NO: 3629234 - DNA, 17 bp, Homo sapiens
agtattttaatcctgta

SEQ ID NO: 3629235 - DNA, 13 bp, Homo sapiens
agtattttttgta

SEQ ID NO: 3629236 - DNA, 19 bp, Homo sapiens
agtattttttgtataattg

SEQ ID NO: 3629237 - DNA, 20 bp, Homo sapiens
agtattttttgtataattgg

SEQ ID NO: 3629238 - DNA, 12 bp, Homo sapiens
agtcaaaaggaa

SEQ ID NO: 3629239 - DNA, 14 bp, Homo sapiens
agtcaaaaggaaca

SEQ ID NO: 3629240 - DNA, 12 bp, Homo sapiens
agtcaaatccag

SEQ ID NO: 3629241 - DNA, 13 bp, Homo sapiens
agtcaaatccagt

SEQ ID NO: 3629242 - DNA, 14 bp, Homo sapiens
agtcaaatccagtg

SEQ ID NO: 3629243 - DNA, 18 bp, Homo sapiens
agtcaaatccagtggtgg

SEQ ID NO: 3629244 - DNA, 23 bp, Homo sapiens
agtcaacagagaggggcagggaa

SEQ ID NO: 3629245 - DNA, 17 bp, Homo sapiens
agtcaagctcctcctcc

SEQ ID NO: 3629246 - DNA, 20 bp, Homo sapiens
agtcaagctcctcctccctg

SEQ ID NO: 3629247 - DNA, 19 bp, Homo sapiens
agtcaccctacctgtgcct

SEQ ID NO: 3629248 - DNA, 13 bp, Homo sapiens
agtcacctgctcc

SEQ ID NO: 3629249 - DNA, 15 bp, Homo sapiens
agtcagacatttctt

SEQ ID NO: 3629250 - DNA, 17 bp, Homo sapiens
agtcagactgatagaca

SEQ ID NO: 3629251 - DNA, 20 bp, Homo sapiens
agtcagatggaaaattcatt

SEQ ID NO: 3629252 - DNA, 22 bp, Homo sapiens
agtcagatggaaaattcatttt

SEQ ID NO: 3629253 - DNA, 18 bp, Homo sapiens
agtcaggctagctgtgct

SEQ ID NO: 3629254 - DNA, 22 bp, Homo sapiens
agtcataggttaatatttaaga

SEQ ID NO: 3629255 - DNA, 13 bp, Homo sapiens
agtcatcttgcta

SEQ ID NO: 3629256 - DNA, 23 bp, Homo sapiens
agtcattaaagacaggagacaaa

SEQ ID NO: 3629257 - DNA, 12 bp, Homo sapiens
agtcattatgtt

SEQ ID NO: 3629258 - DNA, 22 bp, Homo sapiens
agtcattggcaaagtgacaaag

SEQ ID NO: 3629259 - DNA, 22 bp, Homo sapiens
agtcatttgttaatatttcttc

SEQ ID NO: 3629260 - DNA, 13 bp, Homo sapiens
agtccaataagac

SEQ ID NO: 3629261 - DNA, 14 bp, Homo sapiens
agtccaatttaagg

SEQ ID NO: 3629262 - DNA, 16 bp, Homo sapiens
agtccactcccagtgc

SEQ ID NO: 3629263 - DNA, 12 bp, Homo sapiens
agtcccacactg

SEQ ID NO: 3629264 - DNA, 16 bp, Homo sapiens
agtcccacactgtgca

SEQ ID NO: 3629265 - DNA, 17 bp, Homo sapiens
agtcccacactgtggcc

SEQ ID NO: 3629266 - DNA, 22 bp, Homo sapiens
agtcccacactgtggccaggcc

SEQ ID NO: 3629267 - DNA, 14 bp, Homo sapiens
agtccccccactcc

SEQ ID NO: 3629268 - DNA, 21 bp, Homo sapiens
agtccgtgctgacagctgctc

SEQ ID NO: 3629269 - DNA, 23 bp, Homo sapiens
agtccgtgctgacagctgctcct

SEQ ID NO: 3629270 - DNA, 19 bp, Homo sapiens
agtcctaacttcctgtgcc

SEQ ID NO: 3629271 - DNA, 14 bp, Homo sapiens
agtcctcaggaagg

SEQ ID NO: 3629272 - DNA, 14 bp, Homo sapiens
agtcctgtactgta

SEQ ID NO: 3629273 - DNA, 15 bp, Homo sapiens
agtccttccacctgc

SEQ ID NO: 3629274 - DNA, 22 bp, Homo sapiens
agtcctttcccaccattcctgc

SEQ ID NO: 3629275 - DNA, 17 bp, Homo sapiens
agtcctttgtctttctt

SEQ ID NO: 3629276 - DNA, 21 bp, Homo sapiens
agtcctttgtctttctttgtc

SEQ ID NO: 3629277 - DNA, 12 bp, Homo sapiens
agtcgaccccaa

SEQ ID NO: 3629278 - DNA, 15 bp, Homo sapiens
agtcgcctgcctgca

SEQ ID NO: 3629279 - DNA, 15 bp, Homo sapiens
agtcgttatatttga

SEQ ID NO: 3629280 - DNA, 18 bp, Homo sapiens
agtctaaggccatggcat

SEQ ID NO: 3629281 - DNA, 22 bp, Homo sapiens
agtctccaacatgtttctgttt

SEQ ID NO: 3629282 - DNA, 21 bp, Homo sapiens
agtctcctacgcaccattttg

SEQ ID NO: 3629283 - DNA, 15 bp, Homo sapiens
agtctcctcactctg

SEQ ID NO: 3629284 - DNA, 18 bp, Homo sapiens
agtctccttcagcacggc

SEQ ID NO: 3629285 - DNA, 19 bp, Homo sapiens
agtctcgctctgttgccca

SEQ ID NO: 3629286 - DNA, 23 bp, Homo sapiens
agtctctgccagttacttgggct

SEQ ID NO: 3629287 - DNA, 14 bp, Homo sapiens
agtctcttctccac

SEQ ID NO: 3629288 - DNA, 15 bp, Homo sapiens
agtctcttctccact

SEQ ID NO: 3629289 - DNA, 18 bp, Homo sapiens
agtctcttctccactgga

SEQ ID NO: 3629290 - DNA, 21 bp, Homo sapiens
agtctgaaactggcttcccca

SEQ ID NO: 3629291 - DNA, 15 bp, Homo sapiens
agtctgataaactga

SEQ ID NO: 3629292 - DNA, 20 bp, Homo sapiens
agtctgctcctcttgttcct

SEQ ID NO: 3629293 - DNA, 14 bp, Homo sapiens
agtctgtggaactt

SEQ ID NO: 3629294 - DNA, 16 bp, Homo sapiens
agtctgttgattaaag

SEQ ID NO: 3629295 - DNA, 10 bp, Homo sapiens
agtcttccta

SEQ ID NO: 3629296 - DNA, 17 bp, Homo sapiens
agtcttgacgagtgtga

SEQ ID NO: 3629297 - DNA, 22 bp, Homo sapiens
agtctttatttttttcccatga

SEQ ID NO: 3629298 - DNA, 23 bp, Homo sapiens
agtctttatttttttcccatgag

SEQ ID NO: 3629299 - DNA, 20 bp, Homo sapiens
agtctttcttcactctggct

SEQ ID NO: 3629300 - DNA, 21 bp, Homo sapiens
agtctttcttcactctggctt

SEQ ID NO: 3629301 - DNA, 21 bp, Homo sapiens
atcacagctcactgcagcctc

SEQ ID NO: 3629302 - DNA, 13 bp, Homo sapiens
atcacagggaatg

SEQ ID NO: 3629303 - DNA, 13 bp, Homo sapiens
atcaccagaataa

SEQ ID NO: 3629304 - DNA, 21 bp, Homo sapiens
atcaccatctttgtcaaactt

SEQ ID NO: 3629305 - DNA, 22 bp, Homo sapiens
atcacggatggtgcatgggctc

SEQ ID NO: 3629306 - DNA, 11 bp, Homo sapiens
atcactcctgg

SEQ ID NO: 3629307 - DNA, 22 bp, Homo sapiens
atcactgcattattctctttta

SEQ ID NO: 3629308 - DNA, 11 bp, Homo sapiens
atcactgccaa

SEQ ID NO: 3629309 - DNA, 14 bp, Homo sapiens
atcacttgtacaaa

SEQ ID NO: 3629310 - DNA, 18 bp, Homo sapiens
atcacttgtacaaaataa

SEQ ID NO: 3629311 - DNA, 21 bp, Homo sapiens
atcacttgtacaaaataaaca

SEQ ID NO: 3629312 - DNA, 16 bp, Homo sapiens
atcagaaatacaaaaa

SEQ ID NO: 3629313 - DNA, 18 bp, Homo sapiens
atcagaacaaaacttcta

SEQ ID NO: 3629314 - DNA, 19 bp, Homo sapiens
atcagaacattcagctctg

SEQ ID NO: 3629315 - DNA, 22 bp, Homo sapiens
atcagaacattcagctctggag

SEQ ID NO: 3629316 - DNA, 23 bp, Homo sapiens
atcagaacattcagctctggaga

SEQ ID NO: 3629317 - DNA, 15 bp, Homo sapiens
atcagaactcttcct

SEQ ID NO: 3629318 - DNA, 16 bp, Homo sapiens
atcagattcctgacta

SEQ ID NO: 3629319 - DNA, 19 bp, Homo sapiens
atcagcaacccttcctgct

SEQ ID NO: 3629320 - DNA, 14 bp, Homo sapiens
atcagcattttaga

SEQ ID NO: 3629321 - DNA, 20 bp, Homo sapiens
atcagcctgttccagaagga

SEQ ID NO: 3629322 - DNA, 15 bp, Homo sapiens
atcagccttttatgt

SEQ ID NO: 3629323 - DNA, 19 bp, Homo sapiens
atcagccttttatgtattt

SEQ ID NO: 3629324 - DNA, 20 bp, Homo sapiens
atcagccttttatgtatttt

SEQ ID NO: 3629325 - DNA, 22 bp, Homo sapiens
atcagctgctgaaacaacaaat

SEQ ID NO: 3629326 - DNA, 13 bp, Homo sapiens
atcaggaggaagt

SEQ ID NO: 3629327 - DNA, 13 bp, Homo sapiens
atcaggccattgt

SEQ ID NO: 3629328 - DNA, 20 bp, Homo sapiens
atcaggctaagaccctgtgt

SEQ ID NO: 3629329 - DNA, 18 bp, Homo sapiens
atcaggtgtataaatgta

SEQ ID NO: 3629330 - DNA, 16 bp, Homo sapiens
atcagtcaacagagag

SEQ ID NO: 3629331 - DNA, 23 bp, Homo sapiens
atcagtcaatggaagaaatggct

SEQ ID NO: 3629332 - DNA, 15 bp, Homo sapiens
atcatacaaactctc

SEQ ID NO: 3629333 - DNA, 16 bp, Homo sapiens
atcatacaaactctca

SEQ ID NO: 3629334 - DNA, 22 bp, Homo sapiens
atcatatagaccaattgaagca

SEQ ID NO: 3629335 - DNA, 14 bp, Homo sapiens
atcatatttgaaaa

SEQ ID NO: 3629336 - DNA, 15 bp, Homo sapiens
atcatccctttccct

SEQ ID NO: 3629337 - DNA, 11 bp, Homo sapiens
atcatgtaaag

SEQ ID NO: 3629338 - DNA, 18 bp, Homo sapiens
atcatgtaaagaaatgtc

SEQ ID NO: 3629339 - DNA, 18 bp, Homo sapiens
atcatgtgtagagcccct

SEQ ID NO: 3629340 - DNA, 14 bp, Homo sapiens
atcatgttgttgtg

SEQ ID NO: 3629341 - DNA, 14 bp, Homo sapiens
atcattcttactaa

SEQ ID NO: 3629342 - DNA, 18 bp, Homo sapiens
atcattcttactaaaaag

SEQ ID NO: 3629343 - DNA, 13 bp, Homo sapiens
atcattcttttat

SEQ ID NO: 3629344 - DNA, 19 bp, Homo sapiens
atcattcttttatagagca

SEQ ID NO: 3629345 - DNA, 12 bp, Homo sapiens
atcatttcagcc

SEQ ID NO: 3629346 - DNA, 13 bp, Homo sapiens
atcatttcagcca

SEQ ID NO: 3629347 - DNA, 11 bp, Homo sapiens
atcatttctgt

SEQ ID NO: 3629348 - DNA, 23 bp, Homo sapiens
atcatttctgtctttaagaacta

SEQ ID NO: 3629349 - DNA, 18 bp, Homo sapiens
atcatttgttggaatgaa

SEQ ID NO: 3629350 - DNA, 19 bp, Homo sapiens
atccaaaagaagcccccag

SEQ ID NO: 3629351 - DNA, 22 bp, Homo sapiens
atccaaaagaagcccccagcta

SEQ ID NO: 3629352 - DNA, 14 bp, Homo sapiens
atccaaggcaaaca

SEQ ID NO: 3629353 - DNA, 13 bp, Homo sapiens
atccaagtggcct

SEQ ID NO: 3629354 - DNA, 23 bp, Homo sapiens
atccaatgtgaagttcatcttgc

SEQ ID NO: 3629355 - DNA, 13 bp, Homo sapiens
atccacaattatt

SEQ ID NO: 3629356 - DNA, 22 bp, Homo sapiens
atccacagccttgcagcggctc

SEQ ID NO: 3629357 - DNA, 18 bp, Homo sapiens
atccacataaccctgtca

SEQ ID NO: 3629358 - DNA, 12 bp, Homo sapiens
atccacccccag

SEQ ID NO: 3629359 - DNA, 21 bp, Homo sapiens
atccacccccaggtgcagccc

SEQ ID NO: 3629360 - DNA, 20 bp, Homo sapiens
atccacccgggggagcccag

SEQ ID NO: 3629361 - DNA, 21 bp, Homo sapiens
atccacccgggggagcccagt

SEQ ID NO: 3629362 - DNA, 15 bp, Homo sapiens
atccagacctggctc

SEQ ID NO: 3629363 - DNA, 20 bp, Homo sapiens
atccagacctggctccactc

SEQ ID NO: 3629364 - DNA, 21 bp, Homo sapiens
atccagagtcatgggagagta

SEQ ID NO: 3629365 - DNA, 11 bp, Homo sapiens
atccagccact

SEQ ID NO: 3629366 - DNA, 17 bp, Homo sapiens
atccagcctggggtctg

SEQ ID NO: 3629367 - DNA, 19 bp, Homo sapiens
atccaggcagatccaggac

SEQ ID NO: 3629368 - DNA, 20 bp, Homo sapiens
atccaggcccctccctctcc

SEQ ID NO: 3629369 - DNA, 13 bp, Homo sapiens
atccagggacaga

SEQ ID NO: 3629370 - DNA, 16 bp, Homo sapiens
atccagggacagaggc

SEQ ID NO: 3629371 - DNA, 21 bp, Homo sapiens
atccagggacagaggccccag

SEQ ID NO: 3629372 - DNA, 16 bp, Homo sapiens
atccagggcagcaggc

SEQ ID NO: 3629373 - DNA, 13 bp, Homo sapiens
atccagtgacatg

SEQ ID NO: 3629374 - DNA, 12 bp, Homo sapiens
atccagtggtgg

SEQ ID NO: 3629375 - DNA, 13 bp, Homo sapiens
atccagtggtggg

SEQ ID NO: 3629376 - DNA, 17 bp, Homo sapiens
atccagtggtgggtaat

SEQ ID NO: 3629377 - DNA, 18 bp, Homo sapiens
atccagtggtgggtaatt

SEQ ID NO: 3629378 - DNA, 14 bp, Homo sapiens
atccagtgtgagat

SEQ ID NO: 3629379 - DNA, 18 bp, Homo sapiens
atccagtgtgagatactg

SEQ ID NO: 3629380 - DNA, 20 bp, Homo sapiens
atccagtgtgagatactgtg

SEQ ID NO: 3629381 - DNA, 21 bp, Homo sapiens
atccatactaacccttttcca

SEQ ID NO: 3629382 - DNA, 19 bp, Homo sapiens
atccatagcacctccacat

SEQ ID NO: 3629383 - DNA, 16 bp, Homo sapiens
atccatcctgagccaa

SEQ ID NO: 3629384 - DNA, 19 bp, Homo sapiens
atccattcacaagcctcct

SEQ ID NO: 3629385 - DNA, 16 bp, Homo sapiens
atcccaatcattgttg

SEQ ID NO: 3629386 - DNA, 17 bp, Homo sapiens
atcccaatctttctata

SEQ ID NO: 3629387 - DNA, 15 bp, Homo sapiens
atcccaccaaccctc

SEQ ID NO: 3629388 - DNA, 15 bp, Homo sapiens
atcccaccttcccac

SEQ ID NO: 3629389 - DNA, 19 bp, Homo sapiens
atcccatttagtgtgaata

SEQ ID NO: 3629390 - DNA, 21 bp, Homo sapiens
atcccatttagtgtgaatatt

SEQ ID NO: 3629391 - DNA, 22 bp, Homo sapiens
atccccgcagtgtgcactaagg

SEQ ID NO: 3629392 - DNA, 11 bp, Homo sapiens
atccccttcct

SEQ ID NO: 3629393 - DNA, 13 bp, Homo sapiens
atccctacatgta

SEQ ID NO: 3629394 - DNA, 18 bp, Homo sapiens
atccctacatgtattgca

SEQ ID NO: 3629395 - DNA, 13 bp, Homo sapiens
atccctcacctgt

SEQ ID NO: 3629396 - DNA, 17 bp, Homo sapiens
atccctcacctgtagca

SEQ ID NO: 3629397 - DNA, 21 bp, Homo sapiens
atccctcccccccatgcactg

SEQ ID NO: 3629398 - DNA, 22 bp, Homo sapiens
atccctcccccccatgcactgt

SEQ ID NO: 3629399 - DNA, 21 bp, Homo sapiens
atccctctcttccccttccct

SEQ ID NO: 3629400 - DNA, 13 bp, Homo sapiens
atccctgcctgga

SEQ ID NO: 3629401 - DNA, 16 bp, Homo sapiens
atccctgcggcctcca

SEQ ID NO: 3629402 - DNA, 18 bp, Homo sapiens
atccctggagcaggagcc

SEQ ID NO: 3629403 - DNA, 15 bp, Homo sapiens
atcccttcctggaaa

SEQ ID NO: 3629404 - DNA, 23 bp, Homo sapiens
atcccttcctggaaacagcatga

SEQ ID NO: 3629405 - DNA, 20 bp, Homo sapiens
atcccttggacattttatgt

SEQ ID NO: 3629406 - DNA, 22 bp, Homo sapiens
atcccttggtttagaggaaccc

SEQ ID NO: 3629407 - DNA, 16 bp, Homo sapiens
atccctttcccttggt

SEQ ID NO: 3629408 - DNA, 20 bp, Homo sapiens
atccctttttttacatttca

SEQ ID NO: 3629409 - DNA, 13 bp, Homo sapiens
atccgcctgtggg

SEQ ID NO: 3629410 - DNA, 14 bp, Homo sapiens
atccgcctgtgggc

SEQ ID NO: 3629411 - DNA, 22 bp, Homo sapiens
atccgcctgtgggcgcatacta

SEQ ID NO: 3629412 - DNA, 15 bp, Homo sapiens
atcctagacttgaaa

SEQ ID NO: 3629413 - DNA, 14 bp, Homo sapiens
atcctaggaaccag

SEQ ID NO: 3629414 - DNA, 20 bp, Homo sapiens
atcctagtcattcttcccta

SEQ ID NO: 3629415 - DNA, 13 bp, Homo sapiens
atcctatatagaa

SEQ ID NO: 3629416 - DNA, 15 bp, Homo sapiens
atcctatatagaatg

SEQ ID NO: 3629417 - DNA, 13 bp, Homo sapiens
atcctccagcagg

SEQ ID NO: 3629418 - DNA, 12 bp, Homo sapiens
atcctccaggtt

SEQ ID NO: 3629419 - DNA, 16 bp, Homo sapiens
atcctccaggtttttc

SEQ ID NO: 3629420 - DNA, 22 bp, Homo sapiens
atcctccaggtttttcaattaa

SEQ ID NO: 3629421 - DNA, 23 bp, Homo sapiens
atcctccaggtttttcaattaaa

SEQ ID NO: 3629422 - DNA, 17 bp, Homo sapiens
atcctgaaatttcagat

SEQ ID NO: 3629423 - DNA, 19 bp, Homo sapiens
atcctgcttctgatatgca

SEQ ID NO: 3629424 - DNA, 14 bp, Homo sapiens
atcctggaggccca

SEQ ID NO: 3629425 - DNA, 16 bp, Homo sapiens
atcctggaggcccagt

SEQ ID NO: 3629426 - DNA, 19 bp, Homo sapiens
atcctggaggcccagttca

SEQ ID NO: 3629427 - DNA, 15 bp, Homo sapiens
atcctggccctgggg

SEQ ID NO: 3629428 - DNA, 22 bp, Homo sapiens
atcctggccctgggggtctggg

SEQ ID NO: 3629429 - DNA, 16 bp, Homo sapiens
atcctgtaccaaatct

SEQ ID NO: 3629430 - DNA, 15 bp, Homo sapiens
atccttacatttcac

SEQ ID NO: 3629431 - DNA, 19 bp, Homo sapiens
atccttataggcctgtccc

SEQ ID NO: 3629432 - DNA, 18 bp, Homo sapiens
atccttcaaaataaaaag

SEQ ID NO: 3629433 - DNA, 14 bp, Homo sapiens
atccttctcactgc

SEQ ID NO: 3629434 - DNA, 23 bp, Homo sapiens
atctttgtggccaaggagctgct

SEQ ID NO: 3629435 - DNA, 17 bp, Homo sapiens
atctttgttacttcctt

SEQ ID NO: 3629436 - DNA, 19 bp, Homo sapiens
atcttttaaattgcaatat

SEQ ID NO: 3629437 - DNA, 18 bp, Homo sapiens
atcttttatcctgggagc

SEQ ID NO: 3629438 - DNA, 17 bp, Homo sapiens
atgaaaaagctgcttct

SEQ ID NO: 3629439 - DNA, 13 bp, Homo sapiens
atgaaaagttatt

SEQ ID NO: 3629440 - DNA, 13 bp, Homo sapiens
atgaaaataactg

SEQ ID NO: 3629441 - DNA, 14 bp, Homo sapiens
atgaaaataactga

SEQ ID NO: 3629442 - DNA, 22 bp, Homo sapiens
atgaaaatatagacattctcac

SEQ ID NO: 3629443 - DNA, 15 bp, Homo sapiens
atgaaacaatcttcc

SEQ ID NO: 3629444 - DNA, 12 bp, Homo sapiens
atgaaacacagc

SEQ ID NO: 3629445 - DNA, 18 bp, Homo sapiens
atgaaacagaaacaaaaa

SEQ ID NO: 3629446 - DNA, 14 bp, Homo sapiens
atgaaactggttta

SEQ ID NO: 3629447 - DNA, 16 bp, Homo sapiens
atgaaacttaagaatt

SEQ ID NO: 3629448 - DNA, 18 bp, Homo sapiens
atgaaacttaagaattga

SEQ ID NO: 3629449 - DNA, 22 bp, Homo sapiens
atgaaacttaagaattgaattg

SEQ ID NO: 3629450 - DNA, 23 bp, Homo sapiens
atgaaagatggctgtgcctctgc

SEQ ID NO: 3629451 - DNA, 16 bp, Homo sapiens
atgaaatccttttcct

SEQ ID NO: 3629452 - DNA, 15 bp, Homo sapiens
atgaaatttgataaa

SEQ ID NO: 3629453 - DNA, 16 bp, Homo sapiens
atgaacagaaactaca

SEQ ID NO: 3629454 - DNA, 18 bp, Homo sapiens
atgaacgtggattgtatt

SEQ ID NO: 3629455 - DNA, 17 bp, Homo sapiens
atgaagaaggaagctgt

SEQ ID NO: 3629456 - DNA, 12 bp, Homo sapiens
atgaagaatgca

SEQ ID NO: 3629457 - DNA, 14 bp, Homo sapiens
atgaagacagaggc

SEQ ID NO: 3629458 - DNA, 17 bp, Homo sapiens
atgaagcaattagtctg

SEQ ID NO: 3629459 - DNA, 13 bp, Homo sapiens
atgaagtttaaat

SEQ ID NO: 3629460 - DNA, 15 bp, Homo sapiens
atgaagtttaaattc

SEQ ID NO: 3629461 - DNA, 14 bp, Homo sapiens
atgaataattgcat

SEQ ID NO: 3629462 - DNA, 17 bp, Homo sapiens
atgaatgggcatttcta

SEQ ID NO: 3629463 - DNA, 14 bp, Homo sapiens
atgaattaaataaa

SEQ ID NO: 3629464 - DNA, 16 bp, Homo sapiens
atgaattaaataaacc

SEQ ID NO: 3629465 - DNA, 13 bp, Homo sapiens
atgacaacactta

SEQ ID NO: 3629466 - DNA, 13 bp, Homo sapiens
atgacaagcattt

SEQ ID NO: 3629467 - DNA, 21 bp, Homo sapiens
atgacacccatgccagagagg

SEQ ID NO: 3629468 - DNA, 16 bp, Homo sapiens
atgacaccctggcctg

SEQ ID NO: 3629469 - DNA, 22 bp, Homo sapiens
atgacagaggtttgaaggagaa

SEQ ID NO: 3629470 - DNA, 15 bp, Homo sapiens
atgacagatatattt

SEQ ID NO: 3629471 - DNA, 20 bp, Homo sapiens
atgacagatatatttaagcc

SEQ ID NO: 3629472 - DNA, 12 bp, Homo sapiens
atgacagccttg

SEQ ID NO: 3629473 - DNA, 13 bp, Homo sapiens
atgacagccttgc

SEQ ID NO: 3629474 - DNA, 19 bp, Homo sapiens
atgacagccttgcaaccca

SEQ ID NO: 3629475 - DNA, 18 bp, Homo sapiens
atgacatgaaaagttatt

SEQ ID NO: 3629476 - DNA, 14 bp, Homo sapiens
atgaccagggatgc

SEQ ID NO: 3629477 - DNA, 19 bp, Homo sapiens
atgaccattgagtccctgc

SEQ ID NO: 3629478 - DNA, 9 bp, Homo sapiens
atgaccttc

SEQ ID NO: 3629479 - DNA, 23 bp, Homo sapiens
atgaccttcccagggagaaaccc

SEQ ID NO: 3629480 - DNA, 20 bp, Homo sapiens
atgaccttgagttaacagga

SEQ ID NO: 3629481 - DNA, 23 bp, Homo sapiens
atgaccttgagttaacaggacag

SEQ ID NO: 3629482 - DNA, 22 bp, Homo sapiens
atgacggtgttaattttgctaa

SEQ ID NO: 3629483 - DNA, 22 bp, Homo sapiens
atgactccactgtttttctcta

SEQ ID NO: 3629484 - DNA, 21 bp, Homo sapiens
atgactgttgttcttataaga

SEQ ID NO: 3629485 - DNA, 13 bp, Homo sapiens
atgactttgcaga

SEQ ID NO: 3629486 - DNA, 17 bp, Homo sapiens
atgagaaacagctcagc

SEQ ID NO: 3629487 - DNA, 19 bp, Homo sapiens
atgagaaacagctcagcca

SEQ ID NO: 3629488 - DNA, 22 bp, Homo sapiens
atgagaaacagctcagccagtg

SEQ ID NO: 3629489 - DNA, 11 bp, Homo sapiens
atgagaatcta

SEQ ID NO: 3629490 - DNA, 13 bp, Homo sapiens
atgagagcataat

SEQ ID NO: 3629491 - DNA, 20 bp, Homo sapiens
atgagagcataatttaaaaa

SEQ ID NO: 3629492 - DNA, 17 bp, Homo sapiens
atgagatattaaattct

SEQ ID NO: 3629493 - DNA, 21 bp, Homo sapiens
atgagctttgtctacttcaaa

SEQ ID NO: 3629494 - DNA, 16 bp, Homo sapiens
atgaggatccagggca

SEQ ID NO: 3629495 - DNA, 17 bp, Homo sapiens
atgaggatccagggcag

SEQ ID NO: 3629496 - DNA, 13 bp, Homo sapiens
atgaggctcagag

SEQ ID NO: 3629497 - DNA, 14 bp, Homo sapiens
atgaggtcaccagg

SEQ ID NO: 3629498 - DNA, 17 bp, Homo sapiens
atgagtacaaatgcctt

SEQ ID NO: 3629499 - DNA, 18 bp, Homo sapiens
atgagtagcttatacaat

SEQ ID NO: 3629500 - DNA, 21 bp, Homo sapiens
atgagtcatttgtttaaacaa

SEQ ID NO: 3629501 - DNA, 15 bp, Homo sapiens
atgagtgaataaatg

SEQ ID NO: 3629502 - DNA, 14 bp, Homo sapiens
atgagtgcacctgc

SEQ ID NO: 3629503 - DNA, 13 bp, Homo sapiens
atgagtggaaata

SEQ ID NO: 3629504 - DNA, 14 bp, Homo sapiens
atgagtggaaatac

SEQ ID NO: 3629505 - DNA, 16 bp, Homo sapiens
atgagtggaaatacac

SEQ ID NO: 3629506 - DNA, 13 bp, Homo sapiens
atgagtgtctgga

SEQ ID NO: 3629507 - DNA, 14 bp, Homo sapiens
atgataacagaact

SEQ ID NO: 3629508 - DNA, 14 bp, Homo sapiens
atgataataggtca

SEQ ID NO: 3629509 - DNA, 17 bp, Homo sapiens
atgatactgtctctcca

SEQ ID NO: 3629510 - DNA, 23 bp, Homo sapiens
atgatactgtctctccagtgaaa

SEQ ID NO: 3629511 - DNA, 13 bp, Homo sapiens
atgatatgcatgt

SEQ ID NO: 3629512 - DNA, 19 bp, Homo sapiens
atgatatgcatgtagcata

SEQ ID NO: 3629513 - DNA, 18 bp, Homo sapiens
atgatcaccgactgaaaa

SEQ ID NO: 3629514 - DNA, 19 bp, Homo sapiens
atgatccccgtctctgccc

SEQ ID NO: 3629515 - DNA, 23 bp, Homo sapiens
atgatccccgtctctgccctggg

SEQ ID NO: 3629516 - DNA, 14 bp, Homo sapiens
atgatcttctttat

SEQ ID NO: 3629517 - DNA, 15 bp, Homo sapiens
atgatcttctttata

SEQ ID NO: 3629518 - DNA, 23 bp, Homo sapiens
atgatcttgagtataagaaatgc

SEQ ID NO: 3629519 - DNA, 16 bp, Homo sapiens
atgatgaccccggcct

SEQ ID NO: 3629520 - DNA, 19 bp, Homo sapiens
atgatgacttagtacaaag

SEQ ID NO: 3629521 - DNA, 13 bp, Homo sapiens
atgatgagggaag

SEQ ID NO: 3629522 - DNA, 14 bp, Homo sapiens
atgatgatctcatt

SEQ ID NO: 3629523 - DNA, 21 bp, Homo sapiens
atgatgatctttaaaatacac

SEQ ID NO: 3629524 - DNA, 12 bp, Homo sapiens
atgatgcacagt

SEQ ID NO: 3629525 - DNA, 15 bp, Homo sapiens
atgatggatggcaga

SEQ ID NO: 3629526 - DNA, 15 bp, Homo sapiens
atgatggcagagcca

SEQ ID NO: 3629527 - DNA, 16 bp, Homo sapiens
atgatggcagagccag

SEQ ID NO: 3629528 - DNA, 21 bp, Homo sapiens
atgatggcagagccaggctgt

SEQ ID NO: 3629529 - DNA, 15 bp, Homo sapiens
atgattactcctcca

SEQ ID NO: 3629530 - DNA, 15 bp, Homo sapiens
atgattactggcctt

SEQ ID NO: 3629531 - DNA, 24 bp, Homo sapiens
atgatttaaaggttgagtatgtga

SEQ ID NO: 3629532 - DNA, 15 bp, Homo sapiens
atgatttactggaat

SEQ ID NO: 3629533 - DNA, 20 bp, Homo sapiens
atgattttcctttttcttcg

SEQ ID NO: 3629534 - DNA, 23 bp, Homo sapiens
atgattttcctttttcttcgctg

SEQ ID NO: 3629535 - DNA, 12 bp, Homo sapiens
atgcaaaatgga

SEQ ID NO: 3629536 - DNA, 13 bp, Homo sapiens
atgcaaagcactg

SEQ ID NO: 3629537 - DNA, 12 bp, Homo sapiens
atgcaaatacaa

SEQ ID NO: 3629538 - DNA, 23 bp, Homo sapiens
atgcaaatagattcagagaaatt

SEQ ID NO: 3629539 - DNA, 23 bp, Homo sapiens
atgcaactggagttccttatccc

SEQ ID NO: 3629540 - DNA, 12 bp, Homo sapiens
atgcaaggatta

SEQ ID NO: 3629541 - DNA, 20 bp, Homo sapiens
atgcaaggattacagaaact

SEQ ID NO: 3629542 - DNA, 16 bp, Homo sapiens
atgcaataatccaccc

SEQ ID NO: 3629543 - DNA, 19 bp, Homo sapiens
atgcaataatccaccccca

SEQ ID NO: 3629544 - DNA, 15 bp, Homo sapiens
atgcacagtatctgc

SEQ ID NO: 3629545 - DNA, 19 bp, Homo sapiens
atgcacagtatctgctgtt

SEQ ID NO: 3629546 - DNA, 20 bp, Homo sapiens
atgcacagtatctgctgttc

SEQ ID NO: 3629547 - DNA, 21 bp, Homo sapiens
atgcacagtatctgctgttct

SEQ ID NO: 3629548 - DNA, 22 bp, Homo sapiens
atgcacagtatctgctgttctt

SEQ ID NO: 3629549 - DNA, 21 bp, Homo sapiens
atgcacatgctgtctggccct

SEQ ID NO: 3629550 - DNA, 19 bp, Homo sapiens
atgcaccttccagcccggg

SEQ ID NO: 3629551 - DNA, 22 bp, Homo sapiens
atgcactcacccctagccctgg

SEQ ID NO: 3629552 - DNA, 19 bp, Homo sapiens
atgcactgtgaaggaccct

SEQ ID NO: 3629553 - DNA, 22 bp, Homo sapiens
atgcagaaaacagggtctggga

SEQ ID NO: 3629554 - DNA, 15 bp, Homo sapiens
atgcagaaagcatcc

SEQ ID NO: 3629555 - DNA, 19 bp, Homo sapiens
atgcagcagggatgccctg

SEQ ID NO: 3629556 - DNA, 20 bp, Homo sapiens
atgcagcgccgtgtcctctc

SEQ ID NO: 3629557 - DNA, 14 bp, Homo sapiens
atgcaggaaggaaa

SEQ ID NO: 3629558 - DNA, 16 bp, Homo sapiens
atgcagtgaactattt

SEQ ID NO: 3629559 - DNA, 22 bp, Homo sapiens
atgcagtgtttccctctgtgtt

SEQ ID NO: 3629560 - DNA, 15 bp, Homo sapiens
atgcagttttcctta

SEQ ID NO: 3629561 - DNA, 20 bp, Homo sapiens
atgcataaaaattaaatgga

SEQ ID NO: 3629562 - DNA, 19 bp, Homo sapiens
atgcatataatgaataaat

SEQ ID NO: 3629563 - DNA, 21 bp, Homo sapiens
atgcatataatgaataaatca

SEQ ID NO: 3629564 - DNA, 15 bp, Homo sapiens
atgcatatagacaca

SEQ ID NO: 3629565 - DNA, 16 bp, Homo sapiens
atgcatatagacacac

SEQ ID NO: 3629566 - DNA, 19 bp, Homo sapiens
atgcatgggaggaattcat

SEQ ID NO: 3629567 - DNA, 20 bp, Homo sapiens
attattttttaataaactgc

SEQ ID NO: 3629568 - DNA, 14 bp, Homo sapiens
attattttttcaga

SEQ ID NO: 3629569 - DNA, 14 bp, Homo sapiens
attcaaacagtctc

SEQ ID NO: 3629570 - DNA, 20 bp, Homo sapiens
attcaaacagtctcaggaaa

SEQ ID NO: 3629571 - DNA, 22 bp, Homo sapiens
attcaaacagtctcaggaaatc

SEQ ID NO: 3629572 - DNA, 14 bp, Homo sapiens
attcaaatgtttta

SEQ ID NO: 3629573 - DNA, 16 bp, Homo sapiens
attcaagacaagagct

SEQ ID NO: 3629574 - DNA, 21 bp, Homo sapiens
attcaagacaagagctgttat

SEQ ID NO: 3629575 - DNA, 22 bp, Homo sapiens
attcaagacaagagctgttatg

SEQ ID NO: 3629576 - DNA, 13 bp, Homo sapiens
attcaagcaaaca

SEQ ID NO: 3629577 - DNA, 15 bp, Homo sapiens
attcaagcaaacatc

SEQ ID NO: 3629578 - DNA, 15 bp, Homo sapiens
attcaagcctctaaa

SEQ ID NO: 3629579 - DNA, 16 bp, Homo sapiens
attcaaggaatttctt

SEQ ID NO: 3629580 - DNA, 18 bp, Homo sapiens
attcaaggaatttcttaa

SEQ ID NO: 3629581 - DNA, 20 bp, Homo sapiens
attcaaggaatttcttaact

SEQ ID NO: 3629582 - DNA, 18 bp, Homo sapiens
attcaaggagcaagaaat

SEQ ID NO: 3629583 - DNA, 19 bp, Homo sapiens
attcaatatcctttgcctc

SEQ ID NO: 3629584 - DNA, 17 bp, Homo sapiens
attcacaagcctcctgt

SEQ ID NO: 3629585 - DNA, 23 bp, Homo sapiens
attcacagttctttgggccagac

SEQ ID NO: 3629586 - DNA, 16 bp, Homo sapiens
attcaccagtgttcct

SEQ ID NO: 3629587 - DNA, 20 bp, Homo sapiens
attcacccccctctgctgcc

SEQ ID NO: 3629588 - DNA, 19 bp, Homo sapiens
attcacgtgctttgtgttc

SEQ ID NO: 3629589 - DNA, 13 bp, Homo sapiens
attcagagaaatt

SEQ ID NO: 3629590 - DNA, 14 bp, Homo sapiens
attcagatgtatgt

SEQ ID NO: 3629591 - DNA, 21 bp, Homo sapiens
attcagctctggagaacagtg

SEQ ID NO: 3629592 - DNA, 19 bp, Homo sapiens
attcaggccagcccagcca

SEQ ID NO: 3629593 - DNA, 20 bp, Homo sapiens
attcaggccagcccagccag

SEQ ID NO: 3629594 - DNA, 22 bp, Homo sapiens
attcaggctactgcttcaatct

SEQ ID NO: 3629595 - DNA, 15 bp, Homo sapiens
attcagttctaggcc

SEQ ID NO: 3629596 - DNA, 17 bp, Homo sapiens
attcagttctaggcctt

SEQ ID NO: 3629597 - DNA, 17 bp, Homo sapiens
attcatagtaaaatacc

SEQ ID NO: 3629598 - DNA, 18 bp, Homo sapiens
attcatagtaaaatacct

SEQ ID NO: 3629599 - DNA, 23 bp, Homo sapiens
attcatagtgatagagtgcagtg

SEQ ID NO: 3629600 - DNA, 20 bp, Homo sapiens
attcatatttacttcttata

SEQ ID NO: 3629601 - DNA, 21 bp, Homo sapiens
attcatgcaagtggagctgtc

SEQ ID NO: 3629602 - DNA, 16 bp, Homo sapiens
attcatggatatttgt

SEQ ID NO: 3629603 - DNA, 20 bp, Homo sapiens
attcatggatatttgtcaac

SEQ ID NO: 3629604 - DNA, 18 bp, Homo sapiens
attcatggttcaagtatt

SEQ ID NO: 3629605 - DNA, 14 bp, Homo sapiens
attcattagttttg

SEQ ID NO: 3629606 - DNA, 15 bp, Homo sapiens
attcattagttttga

SEQ ID NO: 3629607 - DNA, 15 bp, Homo sapiens
attcattctggaggg

SEQ ID NO: 3629608 - DNA, 15 bp, Homo sapiens
attcattctttttga

SEQ ID NO: 3629609 - DNA, 15 bp, Homo sapiens
attcatttcactgta

SEQ ID NO: 3629610 - DNA, 17 bp, Homo sapiens
attcattttttaaattc

SEQ ID NO: 3629611 - DNA, 21 bp, Homo sapiens
attccaactgggcatttcaat

SEQ ID NO: 3629612 - DNA, 22 bp, Homo sapiens
attccaactgggcatttcaatc

SEQ ID NO: 3629613 - DNA, 20 bp, Homo sapiens
attccactatttgcagaggc

SEQ ID NO: 3629614 - DNA, 14 bp, Homo sapiens
attccactgaaaat

SEQ ID NO: 3629615 - DNA, 23 bp, Homo sapiens
attccagactgcttccaattttc

SEQ ID NO: 3629616 - DNA, 19 bp, Homo sapiens
attccagagagtggctcct

SEQ ID NO: 3629617 - DNA, 12 bp, Homo sapiens
attccagaggaa

SEQ ID NO: 3629618 - DNA, 20 bp, Homo sapiens
attccatcaaagagaaggaa

SEQ ID NO: 3629619 - DNA, 20 bp, Homo sapiens
attcccaacgtgcaaagcca

SEQ ID NO: 3629620 - DNA, 21 bp, Homo sapiens
attcccaacgtgcaaagccaa

SEQ ID NO: 3629621 - DNA, 19 bp, Homo sapiens
attcccaagccgaccttcc

SEQ ID NO: 3629622 - DNA, 17 bp, Homo sapiens
attcccagagcaaaata

SEQ ID NO: 3629623 - DNA, 13 bp, Homo sapiens
attcccagcctga

SEQ ID NO: 3629624 - DNA, 16 bp, Homo sapiens
attccccagtgactcc

SEQ ID NO: 3629625 - DNA, 14 bp, Homo sapiens
attccccattcttc

SEQ ID NO: 3629626 - DNA, 15 bp, Homo sapiens
attccccattcttcc

SEQ ID NO: 3629627 - DNA, 16 bp, Homo sapiens
attcccgttttgtcac

SEQ ID NO: 3629628 - DNA, 23 bp, Homo sapiens
attccctgcccaaacccttaact

SEQ ID NO: 3629629 - DNA, 22 bp, Homo sapiens
attcctatgatggatggcagac

SEQ ID NO: 3629630 - DNA, 13 bp, Homo sapiens
attcctccagcct

SEQ ID NO: 3629631 - DNA, 17 bp, Homo sapiens
attcctccagctgggat

SEQ ID NO: 3629632 - DNA, 14 bp, Homo sapiens
attcctctttgctt

SEQ ID NO: 3629633 - DNA, 15 bp, Homo sapiens
attcctctttgcttt

SEQ ID NO: 3629634 - DNA, 16 bp, Homo sapiens
attcctgaagaaccag

SEQ ID NO: 3629635 - DNA, 22 bp, Homo sapiens
attcctgactaacccctctctt

SEQ ID NO: 3629636 - DNA, 16 bp, Homo sapiens
attcctgagctggcct

SEQ ID NO: 3629637 - DNA, 14 bp, Homo sapiens
attcctttgcatat

SEQ ID NO: 3629638 - DNA, 18 bp, Homo sapiens
attcggggtgatcctgtt

SEQ ID NO: 3629639 - DNA, 18 bp, Homo sapiens
attctacctccttgtgtt

SEQ ID NO: 3629640 - DNA, 21 bp, Homo sapiens
attctactaagttattttatg

SEQ ID NO: 3629641 - DNA, 13 bp, Homo sapiens
attctatgttaat

SEQ ID NO: 3629642 - DNA, 15 bp, Homo sapiens
attctatgttaatat

SEQ ID NO: 3629643 - DNA, 18 bp, Homo sapiens
attctatgttaatatttt

SEQ ID NO: 3629644 - DNA, 18 bp, Homo sapiens
attctattttagaataaa

SEQ ID NO: 3629645 - DNA, 19 bp, Homo sapiens
attctcaaagttttattat

SEQ ID NO: 3629646 - DNA, 23 bp, Homo sapiens
attctcacataagcccagttcat

SEQ ID NO: 3629647 - DNA, 12 bp, Homo sapiens
attctcccctcc

SEQ ID NO: 3629648 - DNA, 16 bp, Homo sapiens
attctcttgaataaag

SEQ ID NO: 3629649 - DNA, 16 bp, Homo sapiens
attctcttttatctgt

SEQ ID NO: 3629650 - DNA, 17 bp, Homo sapiens
attctcttttatctgtt

SEQ ID NO: 3629651 - DNA, 23 bp, Homo sapiens
attctgaaaaagacataaaacag

SEQ ID NO: 3629652 - DNA, 18 bp, Homo sapiens
attctgaaccctccaaag

SEQ ID NO: 3629653 - DNA, 15 bp, Homo sapiens
attctgaagcaacat

SEQ ID NO: 3629654 - DNA, 19 bp, Homo sapiens
attctgaagcaacatttta

SEQ ID NO: 3629655 - DNA, 19 bp, Homo sapiens
attctgagcatactcaaca

SEQ ID NO: 3629656 - DNA, 21 bp, Homo sapiens
attctgcctagagtgtagcct

SEQ ID NO: 3629657 - DNA, 21 bp, Homo sapiens
attctggttccctgctgcgct

SEQ ID NO: 3629658 - DNA, 15 bp, Homo sapiens
attctgtaaaagaaa

SEQ ID NO: 3629659 - DNA, 17 bp, Homo sapiens
attctgttttcccccag

SEQ ID NO: 3629660 - DNA, 15 bp, Homo sapiens
attcttaaccatgga

SEQ ID NO: 3629661 - DNA, 20 bp, Homo sapiens
attcttagctgtaacttaac

SEQ ID NO: 3629662 - DNA, 10 bp, Homo sapiens
attcttctta

SEQ ID NO: 3629663 - DNA, 19 bp, Homo sapiens
attcttcttaaaagtttct

SEQ ID NO: 3629664 - DNA, 19 bp, Homo sapiens
attcttgttgctgtacaaa

SEQ ID NO: 3629665 - DNA, 19 bp, Homo sapiens
attctttgacctgttggga

SEQ ID NO: 3629666 - DNA, 14 bp, Homo sapiens
attgaaaacttcaa

SEQ ID NO: 3629667 - DNA, 19 bp, Homo sapiens
attgaaaacttcaaagctg

SEQ ID NO: 3629668 - DNA, 14 bp, Homo sapiens
attgaaaatggctt

SEQ ID NO: 3629669 - DNA, 21 bp, Homo sapiens
attgaaaatggctttctcagc

SEQ ID NO: 3629670 - DNA, 10 bp, Homo sapiens
attgaagaat

SEQ ID NO: 3629671 - DNA, 14 bp, Homo sapiens
attgaagcatgaac

SEQ ID NO: 3629672 - DNA, 20 bp, Homo sapiens
attgaatggatcaatacaca

SEQ ID NO: 3629673 - DNA, 22 bp, Homo sapiens
attgaatgtggctgaagttgaa

SEQ ID NO: 3629674 - DNA, 18 bp, Homo sapiens
attgaattcatttcactg

SEQ ID NO: 3629675 - DNA, 12 bp, Homo sapiens
attgacagcaat

SEQ ID NO: 3629676 - DNA, 14 bp, Homo sapiens
attgacagcaattc

SEQ ID NO: 3629677 - DNA, 16 bp, Homo sapiens
attgacagcaattcat

SEQ ID NO: 3629678 - DNA, 22 bp, Homo sapiens
attgacagcaattcatggttca

SEQ ID NO: 3629679 - DNA, 13 bp, Homo sapiens
attgacagctttg

SEQ ID NO: 3629680 - DNA, 15 bp, Homo sapiens
attgacagctttgct

SEQ ID NO: 3629681 - DNA, 18 bp, Homo sapiens
attgacagctttgctgct

SEQ ID NO: 3629682 - DNA, 18 bp, Homo sapiens
attgacaggattattgga

SEQ ID NO: 3629683 - DNA, 15 bp, Homo sapiens
attgactttcagtaa

SEQ ID NO: 3629684 - DNA, 20 bp, Homo sapiens
attgagaaaaatatatacta

SEQ ID NO: 3629685 - DNA, 20 bp, Homo sapiens
attgaggaaaaactgacaga

SEQ ID NO: 3629686 - DNA, 15 bp, Homo sapiens
attgaggggccctgg

SEQ ID NO: 3629687 - DNA, 19 bp, Homo sapiens
attgaggggccctggccag

SEQ ID NO: 3629688 - DNA, 17 bp, Homo sapiens
attgataaccatagcat

SEQ ID NO: 3629689 - DNA, 21 bp, Homo sapiens
attgatactctttctaatgct

SEQ ID NO: 3629690 - DNA, 20 bp, Homo sapiens
attgatctgttttggatgtt

SEQ ID NO: 3629691 - DNA, 13 bp, Homo sapiens
attgatttttaag

SEQ ID NO: 3629692 - DNA, 15 bp, Homo sapiens
attgatttttaagaa

SEQ ID NO: 3629693 - DNA, 16 bp, Homo sapiens
attgatttttaagaaa

SEQ ID NO: 3629694 - DNA, 23 bp, Homo sapiens
attgatttttaagaaagtaattt

SEQ ID NO: 3629695 - DNA, 18 bp, Homo sapiens
attgcactctagcctggc

SEQ ID NO: 3629696 - DNA, 19 bp, Homo sapiens
attgcactctagcctggca

SEQ ID NO: 3629697 - DNA, 20 bp, Homo sapiens
attgcactgaagtttttgaa

SEQ ID NO: 3629698 - DNA, 21 bp, Homo sapiens
attgcactgaagtttttgaaa

SEQ ID NO: 3629699 - DNA, 12 bp, Homo sapiens
caaagggaaaaa

SEQ ID NO: 3629700 - DNA, 16 bp, Homo sapiens
caaagggaaaaaagag

SEQ ID NO: 3629701 - DNA, 18 bp, Homo sapiens
caaagggaaaaaagagtt

SEQ ID NO: 3629702 - DNA, 17 bp, Homo sapiens
caaagggccatcgttca

SEQ ID NO: 3629703 - DNA, 14 bp, Homo sapiens
caaaggtgcactcc

SEQ ID NO: 3629704 - DNA, 17 bp, Homo sapiens
caaaggtgcactccaga

SEQ ID NO: 3629705 - DNA, 23 bp, Homo sapiens
caaaggtggcagcttgtgaagat

SEQ ID NO: 3629706 - DNA, 19 bp, Homo sapiens
caaaggttttcctcttcta

SEQ ID NO: 3629707 - DNA, 18 bp, Homo sapiens
caaagtaatgacagaaca

SEQ ID NO: 3629708 - DNA, 16 bp, Homo sapiens
caaagtaggattttga

SEQ ID NO: 3629709 - DNA, 12 bp, Homo sapiens
caaagtcattaa

SEQ ID NO: 3629710 - DNA, 15 bp, Homo sapiens
caaagtcctcctttc

SEQ ID NO: 3629711 - DNA, 16 bp, Homo sapiens
caaagtcctcctttca

SEQ ID NO: 3629712 - DNA, 20 bp, Homo sapiens
caaagtctgctctcatataa

SEQ ID NO: 3629713 - DNA, 20 bp, Homo sapiens
caaagtgctgggattacagg

SEQ ID NO: 3629714 - DNA, 17 bp, Homo sapiens
caaagttaaaattgtta

SEQ ID NO: 3629715 - DNA, 17 bp, Homo sapiens
caaagttctctgtggca

SEQ ID NO: 3629716 - DNA, 20 bp, Homo sapiens
caaataaacttacagatctg

SEQ ID NO: 3629717 - DNA, 19 bp, Homo sapiens
caaataaatacgtgtcaaa

SEQ ID NO: 3629718 - DNA, 13 bp, Homo sapiens
caaatagtgattg

SEQ ID NO: 3629719 - DNA, 12 bp, Homo sapiens
caaatatgcaaa

SEQ ID NO: 3629720 - DNA, 16 bp, Homo sapiens
caaatatgcaaagcac

SEQ ID NO: 3629721 - DNA, 17 bp, Homo sapiens
caaatatgcaaagcact

SEQ ID NO: 3629722 - DNA, 14 bp, Homo sapiens
caaatatgttctct

SEQ ID NO: 3629723 - DNA, 14 bp, Homo sapiens
caaatattaaaatt

SEQ ID NO: 3629724 - DNA, 21 bp, Homo sapiens
caaatatttagatgtaatttt

SEQ ID NO: 3629725 - DNA, 15 bp, Homo sapiens
caaatcagaagtcat

SEQ ID NO: 3629726 - DNA, 10 bp, Homo sapiens
caaatccagt

SEQ ID NO: 3629727 - DNA, 13 bp, Homo sapiens
caaatccagtggt

SEQ ID NO: 3629728 - DNA, 14 bp, Homo sapiens
caaatccttcaaaa

SEQ ID NO: 3629729 - DNA, 16 bp, Homo sapiens
caaatctgacatatta

SEQ ID NO: 3629730 - DNA, 19 bp, Homo sapiens
caaatgaaatatatttaaa

SEQ ID NO: 3629731 - DNA, 17 bp, Homo sapiens
caaatgaccgagccctg

SEQ ID NO: 3629732 - DNA, 18 bp, Homo sapiens
caaatgaccgagccctgg

SEQ ID NO: 3629733 - DNA, 19 bp, Homo sapiens
caaatgaccgagccctgga

SEQ ID NO: 3629734 - DNA, 17 bp, Homo sapiens
caaatgccttaaaatgg

SEQ ID NO: 3629735 - DNA, 20 bp, Homo sapiens
caaatgctggcaaatccagg

SEQ ID NO: 3629736 - DNA, 16 bp, Homo sapiens
caaatggccattttaa

SEQ ID NO: 3629737 - DNA, 12 bp, Homo sapiens
caaatgtaaagt

SEQ ID NO: 3629738 - DNA, 21 bp, Homo sapiens
caaatgtggctgtatccactt

SEQ ID NO: 3629739 - DNA, 22 bp, Homo sapiens
caaattctgcttgcttgctttt

SEQ ID NO: 3629740 - DNA, 18 bp, Homo sapiens
caaattgcactgaagttt

SEQ ID NO: 3629741 - DNA, 20 bp, Homo sapiens
caaattgcactgaagttttt

SEQ ID NO: 3629742 - DNA, 15 bp, Homo sapiens
caaatttttctgctt

SEQ ID NO: 3629743 - DNA, 20 bp, Homo sapiens
caaatttttctgctttaaaa

SEQ ID NO: 3629744 - DNA, 19 bp, Homo sapiens
caacaacgtgagagaaaga

SEQ ID NO: 3629745 - DNA, 13 bp, Homo sapiens
caacacaaagatt

SEQ ID NO: 3629746 - DNA, 15 bp, Homo sapiens
caacacgagcaggct

SEQ ID NO: 3629747 - DNA, 23 bp, Homo sapiens
caacacgagcaggctactgtcag

SEQ ID NO: 3629748 - DNA, 20 bp, Homo sapiens
caacactgggaaacagaggc

SEQ ID NO: 3629749 - DNA, 15 bp, Homo sapiens
caacactttgagcat

SEQ ID NO: 3629750 - DNA, 18 bp, Homo sapiens
caacactttgagcatttt

SEQ ID NO: 3629751 - DNA, 14 bp, Homo sapiens
caacagaaaccttt

SEQ ID NO: 3629752 - DNA, 18 bp, Homo sapiens
caacagaaaccttttatt

SEQ ID NO: 3629753 - DNA, 18 bp, Homo sapiens
caacagcacctccccgct

SEQ ID NO: 3629754 - DNA, 22 bp, Homo sapiens
caacagcagtctccttcagcac

SEQ ID NO: 3629755 - DNA, 23 bp, Homo sapiens
caacagccaagctggcacaaaag

SEQ ID NO: 3629756 - DNA, 13 bp, Homo sapiens
caacagcttccct

SEQ ID NO: 3629757 - DNA, 23 bp, Homo sapiens
caacatgttctaccgtggatttg

SEQ ID NO: 3629758 - DNA, 22 bp, Homo sapiens
caacatttctcatgttgaaact

SEQ ID NO: 3629759 - DNA, 15 bp, Homo sapiens
caaccacactgcttg

SEQ ID NO: 3629760 - DNA, 20 bp, Homo sapiens
caaccagataacataccttt

SEQ ID NO: 3629761 - DNA, 13 bp, Homo sapiens
caaccagccagcg

SEQ ID NO: 3629762 - DNA, 16 bp, Homo sapiens
caaccagccagcgtcc

SEQ ID NO: 3629763 - DNA, 20 bp, Homo sapiens
caaccagcccgacagtgcca

SEQ ID NO: 3629764 - DNA, 14 bp, Homo sapiens
caaccatcatgtgt

SEQ ID NO: 3629765 - DNA, 17 bp, Homo sapiens
caaccatcatgtgtaga

SEQ ID NO: 3629766 - DNA, 13 bp, Homo sapiens
caaccattccaga

SEQ ID NO: 3629767 - DNA, 14 bp, Homo sapiens
caaccattccccat

SEQ ID NO: 3629768 - DNA, 14 bp, Homo sapiens
caaccatttgaaac

SEQ ID NO: 3629769 - DNA, 18 bp, Homo sapiens
caacccccctcccagaca

SEQ ID NO: 3629770 - DNA, 14 bp, Homo sapiens
caacccctctccag

SEQ ID NO: 3629771 - DNA, 16 bp, Homo sapiens
caacccctctccaggc

SEQ ID NO: 3629772 - DNA, 18 bp, Homo sapiens
caacccctctccaggcct

SEQ ID NO: 3629773 - DNA, 19 bp, Homo sapiens
caacccctctccaggcctg

SEQ ID NO: 3629774 - DNA, 22 bp, Homo sapiens
caacccctctccaggcctgtca

SEQ ID NO: 3629775 - DNA, 18 bp, Homo sapiens
caacccctgacctacccc

SEQ ID NO: 3629776 - DNA, 22 bp, Homo sapiens
caacccgtctggcccaccaggg

SEQ ID NO: 3629777 - DNA, 16 bp, Homo sapiens
caaccctacagtatat

SEQ ID NO: 3629778 - DNA, 14 bp, Homo sapiens
caaccctaccctgg

SEQ ID NO: 3629779 - DNA, 15 bp, Homo sapiens
caaccctaccctggc

SEQ ID NO: 3629780 - DNA, 21 bp, Homo sapiens
caaccctcagagccaccccta

SEQ ID NO: 3629781 - DNA, 14 bp, Homo sapiens
caaccctgccctgc

SEQ ID NO: 3629782 - DNA, 22 bp, Homo sapiens
caaccctgggctattgctgctg

SEQ ID NO: 3629783 - DNA, 17 bp, Homo sapiens
caacccttcctgctgct

SEQ ID NO: 3629784 - DNA, 18 bp, Homo sapiens
caacccttcctgctgctg

SEQ ID NO: 3629785 - DNA, 14 bp, Homo sapiens
caacccttctctgt

SEQ ID NO: 3629786 - DNA, 17 bp, Homo sapiens
caaccgcctcaaaatgt

SEQ ID NO: 3629787 - DNA, 21 bp, Homo sapiens
caaccgggatgggagccgggc

SEQ ID NO: 3629788 - DNA, 13 bp, Homo sapiens
caacctccagact

SEQ ID NO: 3629789 - DNA, 20 bp, Homo sapiens
caacctccagactcagcaga

SEQ ID NO: 3629790 - DNA, 13 bp, Homo sapiens
caacctcctgggt

SEQ ID NO: 3629791 - DNA, 21 bp, Homo sapiens
caacctgctctcctcttgcca

SEQ ID NO: 3629792 - DNA, 23 bp, Homo sapiens
caacctgctctcctcttgccact

SEQ ID NO: 3629793 - DNA, 16 bp, Homo sapiens
caacctggtcacagga

SEQ ID NO: 3629794 - DNA, 20 bp, Homo sapiens
caacctgttcttagagtgta

SEQ ID NO: 3629795 - DNA, 21 bp, Homo sapiens
caacctgttcttagagtgtag

SEQ ID NO: 3629796 - DNA, 24 bp, Homo sapiens
caacctgttcttagagtgtagctg

SEQ ID NO: 3629797 - DNA, 16 bp, Homo sapiens
caaccttctgtggctc

SEQ ID NO: 3629798 - DNA, 15 bp, Homo sapiens
caacgcagccctgct

SEQ ID NO: 3629799 - DNA, 13 bp, Homo sapiens
caacgcccctcca

SEQ ID NO: 3629800 - DNA, 20 bp, Homo sapiens
caacgtgagagaaagagaga

SEQ ID NO: 3629801 - DNA, 21 bp, Homo sapiens
caacgtgagagaaagagagaa

SEQ ID NO: 3629802 - DNA, 23 bp, Homo sapiens
caacgtgagagaaagagagaagc

SEQ ID NO: 3629803 - DNA, 18 bp, Homo sapiens
caacgtgcaaagccaagg

SEQ ID NO: 3629804 - DNA, 20 bp, Homo sapiens
caacgtgcaaagccaaggca

SEQ ID NO: 3629805 - DNA, 13 bp, Homo sapiens
caacgttgctatt

SEQ ID NO: 3629806 - DNA, 12 bp, Homo sapiens
caactaaataac

SEQ ID NO: 3629807 - DNA, 14 bp, Homo sapiens
caactaaataacac

SEQ ID NO: 3629808 - DNA, 18 bp, Homo sapiens
caactactagtgtgactc

SEQ ID NO: 3629809 - DNA, 17 bp, Homo sapiens
caactccaggggcacct

SEQ ID NO: 3629810 - DNA, 19 bp, Homo sapiens
caactgcaaaaaaagcctc

SEQ ID NO: 3629811 - DNA, 18 bp, Homo sapiens
caactgccaggctgcctc

SEQ ID NO: 3629812 - DNA, 20 bp, Homo sapiens
caactgccaggctgcctcct

SEQ ID NO: 3629813 - DNA, 21 bp, Homo sapiens
caactgccaggctgcctcctg

SEQ ID NO: 3629814 - DNA, 22 bp, Homo sapiens
caactgccctaagcccccaggg

SEQ ID NO: 3629815 - DNA, 13 bp, Homo sapiens
caactggaagctt

SEQ ID NO: 3629816 - DNA, 16 bp, Homo sapiens
caactggagttcctta

SEQ ID NO: 3629817 - DNA, 24 bp, Homo sapiens
caactggttgtatatttttatatt

SEQ ID NO: 3629818 - DNA, 15 bp, Homo sapiens
caacttaacatgggc

SEQ ID NO: 3629819 - DNA, 15 bp, Homo sapiens
caacttctcttgctt

SEQ ID NO: 3629820 - DNA, 18 bp, Homo sapiens
caacttcttcctgtgaag

SEQ ID NO: 3629821 - DNA, 19 bp, Homo sapiens
caagaaaatggccagtgag

SEQ ID NO: 3629822 - DNA, 17 bp, Homo sapiens
caagaaccactccttca

SEQ ID NO: 3629823 - DNA, 14 bp, Homo sapiens
caagacaagagctg

SEQ ID NO: 3629824 - DNA, 16 bp, Homo sapiens
caagacaagagctgtt

SEQ ID NO: 3629825 - DNA, 16 bp, Homo sapiens
caagacacgtggcctc

SEQ ID NO: 3629826 - DNA, 14 bp, Homo sapiens
caagacagaaaagt

SEQ ID NO: 3629827 - DNA, 15 bp, Homo sapiens
caagacagaaaagtg

SEQ ID NO: 3629828 - DNA, 19 bp, Homo sapiens
caagacagaaaagtgcctg

SEQ ID NO: 3629829 - DNA, 13 bp, Homo sapiens
caagacagactcg

SEQ ID NO: 3629830 - DNA, 16 bp, Homo sapiens
caagaccgatcggcgg

SEQ ID NO: 3629831 - DNA, 17 bp, Homo sapiens
caagacctcatctgtgg

SEQ ID NO: 3629832 - DNA, 17 bp, Homo sapiens
cacagtggggctgcagg

SEQ ID NO: 3629833 - DNA, 23 bp, Homo sapiens
cacagtgtgtggtcaacatttct

SEQ ID NO: 3629834 - DNA, 18 bp, Homo sapiens
cacagttattaattaaag

SEQ ID NO: 3629835 - DNA, 19 bp, Homo sapiens
cacagttctttgggccaga

SEQ ID NO: 3629836 - DNA, 23 bp, Homo sapiens
cacagttctttgggccagacatg

SEQ ID NO: 3629837 - DNA, 19 bp, Homo sapiens
cacagtttacccagcatga

SEQ ID NO: 3629838 - DNA, 21 bp, Homo sapiens
cacagttttctgagaaagact

SEQ ID NO: 3629839 - DNA, 22 bp, Homo sapiens
cacagttttctgagaaagacta

SEQ ID NO: 3629840 - DNA, 17 bp, Homo sapiens
cacataaaagccccagc

SEQ ID NO: 3629841 - DNA, 15 bp, Homo sapiens
cacatacataatggt

SEQ ID NO: 3629842 - DNA, 17 bp, Homo sapiens
cacatcaaatatttctt

SEQ ID NO: 3629843 - DNA, 19 bp, Homo sapiens
cacatcacacccatttaaa

SEQ ID NO: 3629844 - DNA, 12 bp, Homo sapiens
cacatcagcccc

SEQ ID NO: 3629845 - DNA, 16 bp, Homo sapiens
cacatcagccccacag

SEQ ID NO: 3629846 - DNA, 18 bp, Homo sapiens
cacatccttctcactgcc

SEQ ID NO: 3629847 - DNA, 14 bp, Homo sapiens
cacatctaagcctg

SEQ ID NO: 3629848 - DNA, 13 bp, Homo sapiens
cacatctcaggga

SEQ ID NO: 3629849 - DNA, 22 bp, Homo sapiens
cacatctcagggaactgaccct

SEQ ID NO: 3629850 - DNA, 21 bp, Homo sapiens
cacatctggctgcacaggctg

SEQ ID NO: 3629851 - DNA, 22 bp, Homo sapiens
cacatctggctgcacaggctga

SEQ ID NO: 3629852 - DNA, 16 bp, Homo sapiens
cacatcttgctctgca

SEQ ID NO: 3629853 - DNA, 18 bp, Homo sapiens
cacatgactctcatttta

SEQ ID NO: 3629854 - DNA, 22 bp, Homo sapiens
cacatgactctcattttattta

SEQ ID NO: 3629855 - DNA, 15 bp, Homo sapiens
cacatgaggccatct

SEQ ID NO: 3629856 - DNA, 17 bp, Homo sapiens
cacatgagtcaaaacaa

SEQ ID NO: 3629857 - DNA, 18 bp, Homo sapiens
cacatgagtcaaaacaaa

SEQ ID NO: 3629858 - DNA, 16 bp, Homo sapiens
cacatgccacctggca

SEQ ID NO: 3629859 - DNA, 20 bp, Homo sapiens
cacatggagccccctctgcc

SEQ ID NO: 3629860 - DNA, 14 bp, Homo sapiens
cacatgtttaactt

SEQ ID NO: 3629861 - DNA, 13 bp, Homo sapiens
cacattgctggct

SEQ ID NO: 3629862 - DNA, 14 bp, Homo sapiens
cacattgctggctg

SEQ ID NO: 3629863 - DNA, 11 bp, Homo sapiens
cacatttccat

SEQ ID NO: 3629864 - DNA, 19 bp, Homo sapiens
cacatttgccttcagtctt

SEQ ID NO: 3629865 - DNA, 16 bp, Homo sapiens
cacatttttaaattgt

SEQ ID NO: 3629866 - DNA, 23 bp, Homo sapiens
caccaaaattattaatcctcttg

SEQ ID NO: 3629867 - DNA, 22 bp, Homo sapiens
caccaaccacagcatcgggagc

SEQ ID NO: 3629868 - DNA, 15 bp, Homo sapiens
caccaacctccagac

SEQ ID NO: 3629869 - DNA, 16 bp, Homo sapiens
caccaacctccagact

SEQ ID NO: 3629870 - DNA, 23 bp, Homo sapiens
caccaagcccgaccgggccaggc

SEQ ID NO: 3629871 - DNA, 22 bp, Homo sapiens
caccaagttggaacatccttgg

SEQ ID NO: 3629872 - DNA, 20 bp, Homo sapiens
caccacagccggtcagagga

SEQ ID NO: 3629873 - DNA, 14 bp, Homo sapiens
caccacatctaagc

SEQ ID NO: 3629874 - DNA, 13 bp, Homo sapiens
caccaccatgccc

SEQ ID NO: 3629875 - DNA, 23 bp, Homo sapiens
caccactatctccgttccatctg

SEQ ID NO: 3629876 - DNA, 11 bp, Homo sapiens
caccactcagg

SEQ ID NO: 3629877 - DNA, 18 bp, Homo sapiens
caccagaacgcaccccac

SEQ ID NO: 3629878 - DNA, 19 bp, Homo sapiens
caccagaacgcaccccact

SEQ ID NO: 3629879 - DNA, 16 bp, Homo sapiens
caccagacacccagga

SEQ ID NO: 3629880 - DNA, 17 bp, Homo sapiens
caccagacggggctgga

SEQ ID NO: 3629881 - DNA, 14 bp, Homo sapiens
caccagcattcctt

SEQ ID NO: 3629882 - DNA, 14 bp, Homo sapiens
caccagccccccgc

SEQ ID NO: 3629883 - DNA, 17 bp, Homo sapiens
caccaggggaggagcct

SEQ ID NO: 3629884 - DNA, 20 bp, Homo sapiens
caccaggggaggagcctgtg

SEQ ID NO: 3629885 - DNA, 22 bp, Homo sapiens
caccagggtccttttgacactg

SEQ ID NO: 3629886 - DNA, 14 bp, Homo sapiens
caccagtgttcctg

SEQ ID NO: 3629887 - DNA, 14 bp, Homo sapiens
caccatcagcctgt

SEQ ID NO: 3629888 - DNA, 17 bp, Homo sapiens
caccatctttgtcaaac

SEQ ID NO: 3629889 - DNA, 18 bp, Homo sapiens
caccatgcactcacccct

SEQ ID NO: 3629890 - DNA, 17 bp, Homo sapiens
caccatgctgctgggga

SEQ ID NO: 3629891 - DNA, 16 bp, Homo sapiens
caccatgcttgcctga

SEQ ID NO: 3629892 - DNA, 12 bp, Homo sapiens
caccattcctgc

SEQ ID NO: 3629893 - DNA, 23 bp, Homo sapiens
caccattcctgcctttaagccaa

SEQ ID NO: 3629894 - DNA, 14 bp, Homo sapiens
caccattttgtaaa

SEQ ID NO: 3629895 - DNA, 13 bp, Homo sapiens
caccattttgtca

SEQ ID NO: 3629896 - DNA, 13 bp, Homo sapiens
cacccacaaactc

SEQ ID NO: 3629897 - DNA, 20 bp, Homo sapiens
cacccacaaactccaggctg

SEQ ID NO: 3629898 - DNA, 16 bp, Homo sapiens
cacccacacagctgcc

SEQ ID NO: 3629899 - DNA, 18 bp, Homo sapiens
cacccaccccctctggag

SEQ ID NO: 3629900 - DNA, 15 bp, Homo sapiens
cacccacctccctgc

SEQ ID NO: 3629901 - DNA, 18 bp, Homo sapiens
cacccacctctgggtcct

SEQ ID NO: 3629902 - DNA, 17 bp, Homo sapiens
cacccagagcaccccct

SEQ ID NO: 3629903 - DNA, 21 bp, Homo sapiens
cacccagagcaccccctgctc

SEQ ID NO: 3629904 - DNA, 14 bp, Homo sapiens
cacccagtgggaag

SEQ ID NO: 3629905 - DNA, 16 bp, Homo sapiens
cacccatgcatcttcc

SEQ ID NO: 3629906 - DNA, 19 bp, Homo sapiens
cacccatgcatcttccact

SEQ ID NO: 3629907 - DNA, 16 bp, Homo sapiens
caccccaaaccccagc

SEQ ID NO: 3629908 - DNA, 16 bp, Homo sapiens
caccccacagaacctt

SEQ ID NO: 3629909 - DNA, 12 bp, Homo sapiens
caccccatccag

SEQ ID NO: 3629910 - DNA, 23 bp, Homo sapiens
caccccatctttgctgccagctc

SEQ ID NO: 3629911 - DNA, 15 bp, Homo sapiens
caccccatggccggc

SEQ ID NO: 3629912 - DNA, 21 bp, Homo sapiens
cacccccacaagctgtccctg

SEQ ID NO: 3629913 - DNA, 12 bp, Homo sapiens
cacccccagctt

SEQ ID NO: 3629914 - DNA, 13 bp, Homo sapiens
cacccccatgctg

SEQ ID NO: 3629915 - DNA, 17 bp, Homo sapiens
cacccccatgctgcctt

SEQ ID NO: 3629916 - DNA, 15 bp, Homo sapiens
caccccccaagctgt

SEQ ID NO: 3629917 - DNA, 12 bp, Homo sapiens
caccccccactc

SEQ ID NO: 3629918 - DNA, 15 bp, Homo sapiens
caccccccactcagt

SEQ ID NO: 3629919 - DNA, 18 bp, Homo sapiens
cacccccctctgctgccg

SEQ ID NO: 3629920 - DNA, 11 bp, Homo sapiens
caccccctcct

SEQ ID NO: 3629921 - DNA, 18 bp, Homo sapiens
caccccctcctcccccag

SEQ ID NO: 3629922 - DNA, 14 bp, Homo sapiens
caccccctctggag

SEQ ID NO: 3629923 - DNA, 21 bp, Homo sapiens
caccccctctggagaaggcct

SEQ ID NO: 3629924 - DNA, 22 bp, Homo sapiens
caccccctctggagaaggcctg

SEQ ID NO: 3629925 - DNA, 13 bp, Homo sapiens
caccccctgctcc

SEQ ID NO: 3629926 - DNA, 17 bp, Homo sapiens
cacccccttccctggga

SEQ ID NO: 3629927 - DNA, 18 bp, Homo sapiens
cacccccttccctgggag

SEQ ID NO: 3629928 - DNA, 15 bp, Homo sapiens
cacccctaaagagat

SEQ ID NO: 3629929 - DNA, 13 bp, Homo sapiens
cacccctcactcc

SEQ ID NO: 3629930 - DNA, 19 bp, Homo sapiens
cacccctcactccccaggg

SEQ ID NO: 3629931 - DNA, 12 bp, Homo sapiens
cacccctggggg

SEQ ID NO: 3629932 - DNA, 14 bp, Homo sapiens
cacccctgggggct

SEQ ID NO: 3629933 - DNA, 17 bp, Homo sapiens
cacccctgtcccaccca

SEQ ID NO: 3629934 - DNA, 20 bp, Homo sapiens
cacccctgtcccacccacac

SEQ ID NO: 3629935 - DNA, 17 bp, Homo sapiens
caccccttggaggagag

SEQ ID NO: 3629936 - DNA, 22 bp, Homo sapiens
caccccttggaggagagagacc

SEQ ID NO: 3629937 - DNA, 12 bp, Homo sapiens
cacccctttcta

SEQ ID NO: 3629938 - DNA, 22 bp, Homo sapiens
cacccctttctagttcaatgcc

SEQ ID NO: 3629939 - DNA, 20 bp, Homo sapiens
cacccggctcgtgtatttat

SEQ ID NO: 3629940 - DNA, 20 bp, Homo sapiens
cacccgggggagcccagtga

SEQ ID NO: 3629941 - DNA, 23 bp, Homo sapiens
cacccgggggagcccagtgaagc

SEQ ID NO: 3629942 - DNA, 21 bp, Homo sapiens
caccctcccctatgctggtag

SEQ ID NO: 3629943 - DNA, 23 bp, Homo sapiens
caccctctgggggtcctctctga

SEQ ID NO: 3629944 - DNA, 21 bp, Homo sapiens
caccctgccccccctaagaga

SEQ ID NO: 3629945 - DNA, 16 bp, Homo sapiens
caccctgcgcctccag

SEQ ID NO: 3629946 - DNA, 17 bp, Homo sapiens
caccctgcgcctccaga

SEQ ID NO: 3629947 - DNA, 18 bp, Homo sapiens
caccctgcgcctccagag

SEQ ID NO: 3629948 - DNA, 16 bp, Homo sapiens
caccctggcctgaact

SEQ ID NO: 3629949 - DNA, 21 bp, Homo sapiens
caccctggcctgaactgagga

SEQ ID NO: 3629950 - DNA, 16 bp, Homo sapiens
caccgaccaactgccc

SEQ ID NO: 3629951 - DNA, 18 bp, Homo sapiens
caccgaccaactgcccta

SEQ ID NO: 3629952 - DNA, 14 bp, Homo sapiens
caccgaggttccca

SEQ ID NO: 3629953 - DNA, 16 bp, Homo sapiens
caccgaggttcccagg

SEQ ID NO: 3629954 - DNA, 15 bp, Homo sapiens
caccgcctcttcccg

SEQ ID NO: 3629955 - DNA, 13 bp, Homo sapiens
caccgggcctgga

SEQ ID NO: 3629956 - DNA, 16 bp, Homo sapiens
caccgtccaggcccca

SEQ ID NO: 3629957 - DNA, 22 bp, Homo sapiens
caccgtggcagcttgctgggct

SEQ ID NO: 3629958 - DNA, 14 bp, Homo sapiens
caccgttcattcag

SEQ ID NO: 3629959 - DNA, 20 bp, Homo sapiens
caccgtttagaaaaaacaat

SEQ ID NO: 3629960 - DNA, 21 bp, Homo sapiens
cacctagttctccccgatggg

SEQ ID NO: 3629961 - DNA, 15 bp, Homo sapiens
cacctatctcagcca

SEQ ID NO: 3629962 - DNA, 16 bp, Homo sapiens
cacctatctcagccat

SEQ ID NO: 3629963 - DNA, 18 bp, Homo sapiens
cacctcaatatttactat

SEQ ID NO: 3629964 - DNA, 18 bp, Homo sapiens
cacctccaagcatttcat

SEQ ID NO: 3629965 - DNA, 22 bp, Homo sapiens
cagagaaagcaaaggtgcactc

SEQ ID NO: 3629966 - DNA, 16 bp, Homo sapiens
cagagaaatgtctgtc

SEQ ID NO: 3629967 - DNA, 21 bp, Homo sapiens
cagagaaatttagagctaaaa

SEQ ID NO: 3629968 - DNA, 23 bp, Homo sapiens
cagagaagctataaattcctctt

SEQ ID NO: 3629969 - DNA, 20 bp, Homo sapiens
cagagaatagatcagtattt

SEQ ID NO: 3629970 - DNA, 20 bp, Homo sapiens
cagagaattatctcaagtaa

SEQ ID NO: 3629971 - DNA, 13 bp, Homo sapiens
cagagaatttcta

SEQ ID NO: 3629972 - DNA, 22 bp, Homo sapiens
cagagaatttctaccatttcag

SEQ ID NO: 3629973 - DNA, 17 bp, Homo sapiens
cagagacatacttgaag

SEQ ID NO: 3629974 - DNA, 21 bp, Homo sapiens
cagagacatacttgaagggcc

SEQ ID NO: 3629975 - DNA, 23 bp, Homo sapiens
cagagacatacttgaagggccag

SEQ ID NO: 3629976 - DNA, 21 bp, Homo sapiens
cagagaccataagagaaacct

SEQ ID NO: 3629977 - DNA, 19 bp, Homo sapiens
cagagacctcatcagcctt

SEQ ID NO: 3629978 - DNA, 17 bp, Homo sapiens
cagagactttagggggt

SEQ ID NO: 3629979 - DNA, 13 bp, Homo sapiens
cagagagggaaga

SEQ ID NO: 3629980 - DNA, 13 bp, Homo sapiens
cagagaggggcag

SEQ ID NO: 3629981 - DNA, 21 bp, Homo sapiens
cagagaggtagcactctcaga

SEQ ID NO: 3629982 - DNA, 22 bp, Homo sapiens
cagagaggtttcgatatttatt

SEQ ID NO: 3629983 - DNA, 18 bp, Homo sapiens
cagagagtggctcctccc

SEQ ID NO: 3629984 - DNA, 20 bp, Homo sapiens
cagagatgcctgatttcatt

SEQ ID NO: 3629985 - DNA, 16 bp, Homo sapiens
cagagcaaaataattt

SEQ ID NO: 3629986 - DNA, 15 bp, Homo sapiens
cagagcaccccctgc

SEQ ID NO: 3629987 - DNA, 19 bp, Homo sapiens
cagagcaccccctgctcca

SEQ ID NO: 3629988 - DNA, 13 bp, Homo sapiens
cagagccacctgg

SEQ ID NO: 3629989 - DNA, 14 bp, Homo sapiens
cagagccacctgga

SEQ ID NO: 3629990 - DNA, 14 bp, Homo sapiens
cagagccagcctgg

SEQ ID NO: 3629991 - DNA, 15 bp, Homo sapiens
cagagccagcctggc

SEQ ID NO: 3629992 - DNA, 18 bp, Homo sapiens
cagagccagcctggctct

SEQ ID NO: 3629993 - DNA, 21 bp, Homo sapiens
cagagccagcctggctctgcc

SEQ ID NO: 3629994 - DNA, 11 bp, Homo sapiens
cagagccaggc

SEQ ID NO: 3629995 - DNA, 19 bp, Homo sapiens
cagagccaggctgttggaa

SEQ ID NO: 3629996 - DNA, 11 bp, Homo sapiens
cagagcccagc

SEQ ID NO: 3629997 - DNA, 13 bp, Homo sapiens
cagagcccagctc

SEQ ID NO: 3629998 - DNA, 18 bp, Homo sapiens
cagagcccccagccctgg

SEQ ID NO: 3629999 - DNA, 22 bp, Homo sapiens
cagagccgggaggaaaaggccc

SEQ ID NO: 3630000 - DNA, 23 bp, Homo sapiens
cagagccgggaggaaaaggcccc

SEQ ID NO: 3630001 - DNA, 18 bp, Homo sapiens
cagagcctttttacctgg

SEQ ID NO: 3630002 - DNA, 16 bp, Homo sapiens
cagagctccgatgccc

SEQ ID NO: 3630003 - DNA, 12 bp, Homo sapiens
cagagctgtgcc

SEQ ID NO: 3630004 - DNA, 14 bp, Homo sapiens
cagagctgtgccag

SEQ ID NO: 3630005 - DNA, 15 bp, Homo sapiens
cagagctgtgccagc

SEQ ID NO: 3630006 - DNA, 16 bp, Homo sapiens
cagagctgtgccagca

SEQ ID NO: 3630007 - DNA, 17 bp, Homo sapiens
cagagctgtgccagcag

SEQ ID NO: 3630008 - DNA, 19 bp, Homo sapiens
cagagctgtttggatacag

SEQ ID NO: 3630009 - DNA, 21 bp, Homo sapiens
cagaggagaacttgctgcctc

SEQ ID NO: 3630010 - DNA, 20 bp, Homo sapiens
cagaggagccaccagttctc

SEQ ID NO: 3630011 - DNA, 16 bp, Homo sapiens
cagaggaggggaaagt

SEQ ID NO: 3630012 - DNA, 19 bp, Homo sapiens
cagaggaggggccgctgcc

SEQ ID NO: 3630013 - DNA, 15 bp, Homo sapiens
cagaggccctggagg

SEQ ID NO: 3630014 - DNA, 17 bp, Homo sapiens
cagaggcctgctgccag

SEQ ID NO: 3630015 - DNA, 20 bp, Homo sapiens
cagaggctattattttcact

SEQ ID NO: 3630016 - DNA, 23 bp, Homo sapiens
cagaggggcgttctcccaaagat

SEQ ID NO: 3630017 - DNA, 17 bp, Homo sapiens
cagaggtttgaaggaga

SEQ ID NO: 3630018 - DNA, 19 bp, Homo sapiens
cagaggtttgaaggagaat

SEQ ID NO: 3630019 - DNA, 21 bp, Homo sapiens
cagagtatatttttgtctgca

SEQ ID NO: 3630020 - DNA, 23 bp, Homo sapiens
cagagtatatttttgtctgcagc

SEQ ID NO: 3630021 - DNA, 16 bp, Homo sapiens
cagagtccaatttaag

SEQ ID NO: 3630022 - DNA, 20 bp, Homo sapiens
cagagtgcaagcccctgctc

SEQ ID NO: 3630023 - DNA, 16 bp, Homo sapiens
cagagtggcctccctg

SEQ ID NO: 3630024 - DNA, 23 bp, Homo sapiens
cagagtggcctccctgctgtgcc

SEQ ID NO: 3630025 - DNA, 15 bp, Homo sapiens
cagataacttagctt

SEQ ID NO: 3630026 - DNA, 13 bp, Homo sapiens
cagatcactcctg

SEQ ID NO: 3630027 - DNA, 18 bp, Homo sapiens
cagatcactcctggaggc

SEQ ID NO: 3630028 - DNA, 20 bp, Homo sapiens
cagatcatatggtaggaccc

SEQ ID NO: 3630029 - DNA, 21 bp, Homo sapiens
cagatcatatggtaggaccct

SEQ ID NO: 3630030 - DNA, 13 bp, Homo sapiens
cagatccaggact

SEQ ID NO: 3630031 - DNA, 23 bp, Homo sapiens
cagatctcccacatgccaggggc

SEQ ID NO: 3630032 - DNA, 17 bp, Homo sapiens
cagatctgcaccaccat

SEQ ID NO: 3630033 - DNA, 14 bp, Homo sapiens
cagatctggaacct

SEQ ID NO: 3630034 - DNA, 18 bp, Homo sapiens
cagatctggaacctcagc

SEQ ID NO: 3630035 - DNA, 22 bp, Homo sapiens
cagatctggaacctcagcctgg

SEQ ID NO: 3630036 - DNA, 19 bp, Homo sapiens
cagatgaactgactgaagg

SEQ ID NO: 3630037 - DNA, 20 bp, Homo sapiens
cagatgaactgactgaagga

SEQ ID NO: 3630038 - DNA, 23 bp, Homo sapiens
cagatgacagaggtttgaaggag

SEQ ID NO: 3630039 - DNA, 21 bp, Homo sapiens
cagatgcatatagacacacat

SEQ ID NO: 3630040 - DNA, 22 bp, Homo sapiens
cagatgcatatagacacacata

SEQ ID NO: 3630041 - DNA, 14 bp, Homo sapiens
cagatgcttttgct

SEQ ID NO: 3630042 - DNA, 15 bp, Homo sapiens
cagatgcttttgcta

SEQ ID NO: 3630043 - DNA, 15 bp, Homo sapiens
cagatgttgggagga

SEQ ID NO: 3630044 - DNA, 23 bp, Homo sapiens
cagatgttgggaggatacagagg

SEQ ID NO: 3630045 - DNA, 12 bp, Homo sapiens
cagattcctatg

SEQ ID NO: 3630046 - DNA, 14 bp, Homo sapiens
cagatttccagcct

SEQ ID NO: 3630047 - DNA, 14 bp, Homo sapiens
cagatttctgagga

SEQ ID NO: 3630048 - DNA, 15 bp, Homo sapiens
cagatttctgaggaa

SEQ ID NO: 3630049 - DNA, 17 bp, Homo sapiens
cagatttctgaggaaat

SEQ ID NO: 3630050 - DNA, 21 bp, Homo sapiens
cagatttgatatttgcattga

SEQ ID NO: 3630051 - DNA, 20 bp, Homo sapiens
cagatttttatgttttgaaa

SEQ ID NO: 3630052 - DNA, 13 bp, Homo sapiens
cagcaaaggaact

SEQ ID NO: 3630053 - DNA, 14 bp, Homo sapiens
cagcaaataaatac

SEQ ID NO: 3630054 - DNA, 19 bp, Homo sapiens
cagcaacccttcctgctgc

SEQ ID NO: 3630055 - DNA, 21 bp, Homo sapiens
cagcaacccttcctgctgctg

SEQ ID NO: 3630056 - DNA, 24 bp, Homo sapiens
cagcaacccttcctgctgctgcta

SEQ ID NO: 3630057 - DNA, 23 bp, Homo sapiens
cagcaacgcccctccaaacctcc

SEQ ID NO: 3630058 - DNA, 22 bp, Homo sapiens
cagcaagggtgatgggaaagca

SEQ ID NO: 3630059 - DNA, 14 bp, Homo sapiens
cagcaattcatggt

SEQ ID NO: 3630060 - DNA, 22 bp, Homo sapiens
cagcaattcatggttcaagtat

SEQ ID NO: 3630061 - DNA, 16 bp, Homo sapiens
cagcacagtaggtccc

SEQ ID NO: 3630062 - DNA, 13 bp, Homo sapiens
cagcaccacagcc

SEQ ID NO: 3630063 - DNA, 12 bp, Homo sapiens
cagcacccctcc

SEQ ID NO: 3630064 - DNA, 14 bp, Homo sapiens
cagcacccctccag

SEQ ID NO: 3630065 - DNA, 23 bp, Homo sapiens
cagcacccctccagttttgcctg

SEQ ID NO: 3630066 - DNA, 14 bp, Homo sapiens
cagcaccgcctctt

SEQ ID NO: 3630067 - DNA, 17 bp, Homo sapiens
cagcacgtgtggcctgt

SEQ ID NO: 3630068 - DNA, 20 bp, Homo sapiens
cagcactccccagagctgtg

SEQ ID NO: 3630069 - DNA, 23 bp, Homo sapiens
cagcactccccagagctgtgcca

SEQ ID NO: 3630070 - DNA, 22 bp, Homo sapiens
cagcactggtgaactgagctgg

SEQ ID NO: 3630071 - DNA, 15 bp, Homo sapiens
cagcagagtgagggg

SEQ ID NO: 3630072 - DNA, 14 bp, Homo sapiens
cagcagcaccaacc

SEQ ID NO: 3630073 - DNA, 23 bp, Homo sapiens
cagcagcccctgcacaaagccct

SEQ ID NO: 3630074 - DNA, 17 bp, Homo sapiens
cagcagcgcctttccca

SEQ ID NO: 3630075 - DNA, 16 bp, Homo sapiens
cagcaggaaggacccc

SEQ ID NO: 3630076 - DNA, 11 bp, Homo sapiens
cagcaggagag

SEQ ID NO: 3630077 - DNA, 19 bp, Homo sapiens
cagcaggagagactgagca

SEQ ID NO: 3630078 - DNA, 15 bp, Homo sapiens
cagcaggagggggga

SEQ ID NO: 3630079 - DNA, 18 bp, Homo sapiens
cagcaggaggggggaggg

SEQ ID NO: 3630080 - DNA, 13 bp, Homo sapiens
cagcaggcagagt

SEQ ID NO: 3630081 - DNA, 15 bp, Homo sapiens
cagcaggcagagtgg

SEQ ID NO: 3630082 - DNA, 11 bp, Homo sapiens
cagcaggcctc

SEQ ID NO: 3630083 - DNA, 14 bp, Homo sapiens
cagcaggcctctgg

SEQ ID NO: 3630084 - DNA, 11 bp, Homo sapiens
cagcaggctca

SEQ ID NO: 3630085 - DNA, 16 bp, Homo sapiens
cagcagggatgccctg

SEQ ID NO: 3630086 - DNA, 19 bp, Homo sapiens
cagcaggggggctgtgcca

SEQ ID NO: 3630087 - DNA, 21 bp, Homo sapiens
cagcagtcgcccaagcagaca

SEQ ID NO: 3630088 - DNA, 23 bp, Homo sapiens
cagcagtctaaattttctaaata

SEQ ID NO: 3630089 - DNA, 22 bp, Homo sapiens
cagcagtctccttcagcacggc

SEQ ID NO: 3630090 - DNA, 20 bp, Homo sapiens
cagcagttgaaaagactcca

SEQ ID NO: 3630091 - DNA, 21 bp, Homo sapiens
cagcagttgaaaagactccaa

SEQ ID NO: 3630092 - DNA, 22 bp, Homo sapiens
cagcagttgaaaagactccaaa

SEQ ID NO: 3630093 - DNA, 20 bp, Homo sapiens
cagcatccctggagcaggag

SEQ ID NO: 3630094 - DNA, 19 bp, Homo sapiens
cagcatcgcactctggcag

SEQ ID NO: 3630095 - DNA, 19 bp, Homo sapiens
cagcatcgggagcacccag

SEQ ID NO: 3630096 - DNA, 13 bp, Homo sapiens
caggggaccccac

SEQ ID NO: 3630097 - DNA, 16 bp, Homo sapiens
caggggaccccactcc

SEQ ID NO: 3630098 - DNA, 12 bp, Homo sapiens
caggggagccct

SEQ ID NO: 3630099 - DNA, 14 bp, Homo sapiens
caggggaggccatc

SEQ ID NO: 3630100 - DNA, 21 bp, Homo sapiens
caggggaggccatctggagag

SEQ ID NO: 3630101 - DNA, 19 bp, Homo sapiens
caggggccaacctcaggct

SEQ ID NO: 3630102 - DNA, 17 bp, Homo sapiens
caggggccggccagtgg

SEQ ID NO: 3630103 - DNA, 14 bp, Homo sapiens
caggggcctggagg

SEQ ID NO: 3630104 - DNA, 15 bp, Homo sapiens
caggggcctggaggt

SEQ ID NO: 3630105 - DNA, 24 bp, Homo sapiens
caggggcctggaggtctggctgag

SEQ ID NO: 3630106 - DNA, 16 bp, Homo sapiens
caggggctctgtggca

SEQ ID NO: 3630107 - DNA, 23 bp, Homo sapiens
caggggctctgtggcaaaaagag

SEQ ID NO: 3630108 - DNA, 22 bp, Homo sapiens
cagggggccccgccagggctgg

SEQ ID NO: 3630109 - DNA, 23 bp, Homo sapiens
cagggggccctgccccaccccat

SEQ ID NO: 3630110 - DNA, 15 bp, Homo sapiens
caggggggctgtgcc

SEQ ID NO: 3630111 - DNA, 17 bp, Homo sapiens
caggggggctgtgccaa

SEQ ID NO: 3630112 - DNA, 19 bp, Homo sapiens
caggggggtgaggagctgg

SEQ ID NO: 3630113 - DNA, 17 bp, Homo sapiens
cagggtacctcaagccc

SEQ ID NO: 3630114 - DNA, 17 bp, Homo sapiens
cagggtccacagctgga

SEQ ID NO: 3630115 - DNA, 18 bp, Homo sapiens
cagggtccaggagagcct

SEQ ID NO: 3630116 - DNA, 14 bp, Homo sapiens
cagggtccttttga

SEQ ID NO: 3630117 - DNA, 21 bp, Homo sapiens
cagggtccttttgacactgct

SEQ ID NO: 3630118 - DNA, 22 bp, Homo sapiens
cagggtccttttgacactgctc

SEQ ID NO: 3630119 - DNA, 11 bp, Homo sapiens
cagggtctcac

SEQ ID NO: 3630120 - DNA, 14 bp, Homo sapiens
cagggtcttggctg

SEQ ID NO: 3630121 - DNA, 13 bp, Homo sapiens
cagggtgacaagg

SEQ ID NO: 3630122 - DNA, 19 bp, Homo sapiens
cagggtgacaaggcctgct

SEQ ID NO: 3630123 - DNA, 23 bp, Homo sapiens
cagggtgagacgtgatgggctag

SEQ ID NO: 3630124 - DNA, 17 bp, Homo sapiens
cagggtgtggggccatg

SEQ ID NO: 3630125 - DNA, 22 bp, Homo sapiens
cagggtgtggggccatgcctcc

SEQ ID NO: 3630126 - DNA, 18 bp, Homo sapiens
cagggtttacatgaagca

SEQ ID NO: 3630127 - DNA, 20 bp, Homo sapiens
cagggtttacatgaagcaga

SEQ ID NO: 3630128 - DNA, 21 bp, Homo sapiens
cagggtttacatgaagcagaa

SEQ ID NO: 3630129 - DNA, 19 bp, Homo sapiens
caggtaactaattggaagg

SEQ ID NO: 3630130 - DNA, 20 bp, Homo sapiens
caggtacatttctgattctg

SEQ ID NO: 3630131 - DNA, 17 bp, Homo sapiens
caggtagtttgtaccat

SEQ ID NO: 3630132 - DNA, 11 bp, Homo sapiens
caggtattttg

SEQ ID NO: 3630133 - DNA, 13 bp, Homo sapiens
caggtcagcctgg

SEQ ID NO: 3630134 - DNA, 20 bp, Homo sapiens
caggtcctcagagaatttct

SEQ ID NO: 3630135 - DNA, 18 bp, Homo sapiens
caggtcggagtgcctgga

SEQ ID NO: 3630136 - DNA, 17 bp, Homo sapiens
caggtctcattgcttct

SEQ ID NO: 3630137 - DNA, 17 bp, Homo sapiens
caggtctgactccaaag

SEQ ID NO: 3630138 - DNA, 17 bp, Homo sapiens
caggtctgtatgtcatg

SEQ ID NO: 3630139 - DNA, 14 bp, Homo sapiens
caggtctttcctaa

SEQ ID NO: 3630140 - DNA, 13 bp, Homo sapiens
caggtgcagacct

SEQ ID NO: 3630141 - DNA, 16 bp, Homo sapiens
caggtgcagaccttgg

SEQ ID NO: 3630142 - DNA, 16 bp, Homo sapiens
caggtgcagccccagg

SEQ ID NO: 3630143 - DNA, 20 bp, Homo sapiens
caggtgcctaacctgggacc

SEQ ID NO: 3630144 - DNA, 17 bp, Homo sapiens
caggtgcttttggcaga

SEQ ID NO: 3630145 - DNA, 15 bp, Homo sapiens
caggtggccactcca

SEQ ID NO: 3630146 - DNA, 15 bp, Homo sapiens
caggtgggcctggga

SEQ ID NO: 3630147 - DNA, 16 bp, Homo sapiens
caggtgggcctgggag

SEQ ID NO: 3630148 - DNA, 14 bp, Homo sapiens
caggtgtataaatg

SEQ ID NO: 3630149 - DNA, 19 bp, Homo sapiens
caggtgtataaatgtacat

SEQ ID NO: 3630150 - DNA, 19 bp, Homo sapiens
caggtgtgggatctgggga

SEQ ID NO: 3630151 - DNA, 21 bp, Homo sapiens
caggtgtgggatctggggaga

SEQ ID NO: 3630152 - DNA, 14 bp, Homo sapiens
caggttccccaagg

SEQ ID NO: 3630153 - DNA, 22 bp, Homo sapiens
caggttccccaagggccctggc

SEQ ID NO: 3630154 - DNA, 15 bp, Homo sapiens
caggtttgcaggagc

SEQ ID NO: 3630155 - DNA, 16 bp, Homo sapiens
caggtttttcaattaa

SEQ ID NO: 3630156 - DNA, 23 bp, Homo sapiens
caggtttttcaattaaacggatt

SEQ ID NO: 3630157 - DNA, 15 bp, Homo sapiens
cagtaaaacacattt

SEQ ID NO: 3630158 - DNA, 18 bp, Homo sapiens
cagtaaaatttcaggatt

SEQ ID NO: 3630159 - DNA, 22 bp, Homo sapiens
cagtaaaatttcaggattaact

SEQ ID NO: 3630160 - DNA, 16 bp, Homo sapiens
cagtacctgattgtat

SEQ ID NO: 3630161 - DNA, 20 bp, Homo sapiens
cagtactttggaggccccta

SEQ ID NO: 3630162 - DNA, 19 bp, Homo sapiens
cagtaggggcttataataa

SEQ ID NO: 3630163 - DNA, 16 bp, Homo sapiens
cagtatccactttgca

SEQ ID NO: 3630164 - DNA, 20 bp, Homo sapiens
cagtatctgctgttcttcag

SEQ ID NO: 3630165 - DNA, 22 bp, Homo sapiens
cagtatctgctgttcttcagtc

SEQ ID NO: 3630166 - DNA, 21 bp, Homo sapiens
cagtattatagatataaatat

SEQ ID NO: 3630167 - DNA, 20 bp, Homo sapiens
cagtattatttctccatccc

SEQ ID NO: 3630168 - DNA, 22 bp, Homo sapiens
cagtattatttctccatcccct

SEQ ID NO: 3630169 - DNA, 15 bp, Homo sapiens
cagtattgaaaactt

SEQ ID NO: 3630170 - DNA, 15 bp, Homo sapiens
cagtatttgtgggga

SEQ ID NO: 3630171 - DNA, 17 bp, Homo sapiens
cagtcagacgccaggca

SEQ ID NO: 3630172 - DNA, 14 bp, Homo sapiens
cagtcagctgtggg

SEQ ID NO: 3630173 - DNA, 13 bp, Homo sapiens
cagtccacagggg

SEQ ID NO: 3630174 - DNA, 20 bp, Homo sapiens
cagtccacaggggccaccac

SEQ ID NO: 3630175 - DNA, 19 bp, Homo sapiens
cagtccagctctttagaat

SEQ ID NO: 3630176 - DNA, 15 bp, Homo sapiens
cagtcccacactgtg

SEQ ID NO: 3630177 - DNA, 14 bp, Homo sapiens
cagtccccccaccc

SEQ ID NO: 3630178 - DNA, 14 bp, Homo sapiens
cagtcctcaggaag

SEQ ID NO: 3630179 - DNA, 12 bp, Homo sapiens
cagtcctggagg

SEQ ID NO: 3630180 - DNA, 22 bp, Homo sapiens
cagtcctttcccaccattcctg

SEQ ID NO: 3630181 - DNA, 12 bp, Homo sapiens
cagtcctttgtc

SEQ ID NO: 3630182 - DNA, 13 bp, Homo sapiens
cagtcgaccccaa

SEQ ID NO: 3630183 - DNA, 18 bp, Homo sapiens
cagtcgcccaagcagaca

SEQ ID NO: 3630184 - DNA, 19 bp, Homo sapiens
cagtctcctcactctgtcc

SEQ ID NO: 3630185 - DNA, 20 bp, Homo sapiens
cagtctcctcactctgtccc

SEQ ID NO: 3630186 - DNA, 22 bp, Homo sapiens
cagtctcctcccctactctgcc

SEQ ID NO: 3630187 - DNA, 14 bp, Homo sapiens
cagtctctcttctc

SEQ ID NO: 3630188 - DNA, 17 bp, Homo sapiens
cagtctctcttctctcc

SEQ ID NO: 3630189 - DNA, 17 bp, Homo sapiens
cagtctgctcctcttgt

SEQ ID NO: 3630190 - DNA, 20 bp, Homo sapiens
cagtctggctgagccctgct

SEQ ID NO: 3630191 - DNA, 19 bp, Homo sapiens
cagtcttatcaactggttg

SEQ ID NO: 3630192 - DNA, 14 bp, Homo sapiens
cagtcttcctgccg

SEQ ID NO: 3630193 - DNA, 22 bp, Homo sapiens
cagtctttaatctgagaggcca

SEQ ID NO: 3630194 - DNA, 20 bp, Homo sapiens
cagtctttatttttttccca

SEQ ID NO: 3630195 - DNA, 22 bp, Homo sapiens
cagtctttatttttttcccatg

SEQ ID NO: 3630196 - DNA, 16 bp, Homo sapiens
cagtctttcttcactc

SEQ ID NO: 3630197 - DNA, 21 bp, Homo sapiens
cagtctttcttcactctggct

SEQ ID NO: 3630198 - DNA, 16 bp, Homo sapiens
cagtgaaatgattact

SEQ ID NO: 3630199 - DNA, 14 bp, Homo sapiens
cagtgaactatttt

SEQ ID NO: 3630200 - DNA, 22 bp, Homo sapiens
cagtgaactatttttaaggtct

SEQ ID NO: 3630201 - DNA, 12 bp, Homo sapiens
cagtgaagcctc

SEQ ID NO: 3630202 - DNA, 22 bp, Homo sapiens
cagtgaaggtggggagaagctg

SEQ ID NO: 3630203 - DNA, 14 bp, Homo sapiens
cagtgaccagtgcc

SEQ ID NO: 3630204 - DNA, 14 bp, Homo sapiens
cagtgacgctgctg

SEQ ID NO: 3630205 - DNA, 13 bp, Homo sapiens
cagtgactccagg

SEQ ID NO: 3630206 - DNA, 14 bp, Homo sapiens
cagtgactccaggg

SEQ ID NO: 3630207 - DNA, 18 bp, Homo sapiens
cagtgactccagggtgac

SEQ ID NO: 3630208 - DNA, 22 bp, Homo sapiens
cagtgactccccagcccagcac

SEQ ID NO: 3630209 - DNA, 20 bp, Homo sapiens
cagtgactcctgctggtacc

SEQ ID NO: 3630210 - DNA, 13 bp, Homo sapiens
cagtgagcagtgt

SEQ ID NO: 3630211 - DNA, 13 bp, Homo sapiens
cagtgagcccctc

SEQ ID NO: 3630212 - DNA, 21 bp, Homo sapiens
cagtgagcccctccccagcca

SEQ ID NO: 3630213 - DNA, 22 bp, Homo sapiens
cagtgatggaatatcatgaatg

SEQ ID NO: 3630214 - DNA, 21 bp, Homo sapiens
cagtgatgtttgccatttgct

SEQ ID NO: 3630215 - DNA, 14 bp, Homo sapiens
cagtgcagccactg

SEQ ID NO: 3630216 - DNA, 16 bp, Homo sapiens
cagtgcagccactggc

SEQ ID NO: 3630217 - DNA, 18 bp, Homo sapiens
cagtgcagtccatttcct

SEQ ID NO: 3630218 - DNA, 20 bp, Homo sapiens
cagtgcagtccatttcctaa

SEQ ID NO: 3630219 - DNA, 22 bp, Homo sapiens
cagtgcagtttggtgtgtcctc

SEQ ID NO: 3630220 - DNA, 10 bp, Homo sapiens
cagtgcatca

SEQ ID NO: 3630221 - DNA, 15 bp, Homo sapiens
cagtgcatctcagcc

SEQ ID NO: 3630222 - DNA, 13 bp, Homo sapiens
cagtgccatcccc

SEQ ID NO: 3630223 - DNA, 15 bp, Homo sapiens
cagtgcccatgtgta

SEQ ID NO: 3630224 - DNA, 23 bp, Homo sapiens
cagtgcccatgtgtacattctgc

SEQ ID NO: 3630225 - DNA, 12 bp, Homo sapiens
cagtgcccccac

SEQ ID NO: 3630226 - DNA, 15 bp, Homo sapiens
cagtgcccccactga

SEQ ID NO: 3630227 - DNA, 17 bp, Homo sapiens
cagtgcccccactgacc

SEQ ID NO: 3630228 - DNA, 21 bp, Homo sapiens
catcttgagccacagtcactg

SEQ ID NO: 3630229 - DNA, 20 bp, Homo sapiens
catcttgcagcatttactat

SEQ ID NO: 3630230 - DNA, 12 bp, Homo sapiens
catcttgctacc

SEQ ID NO: 3630231 - DNA, 16 bp, Homo sapiens
catcttgctaccagta

SEQ ID NO: 3630232 - DNA, 23 bp, Homo sapiens
catcttgctaccagtatttagaa

SEQ ID NO: 3630233 - DNA, 15 bp, Homo sapiens
catctttaatttata

SEQ ID NO: 3630234 - DNA, 23 bp, Homo sapiens
catctttagcagtttcctcagtg

SEQ ID NO: 3630235 - DNA, 15 bp, Homo sapiens
catgaaaatagcaat

SEQ ID NO: 3630236 - DNA, 14 bp, Homo sapiens
catgaaataaaata

SEQ ID NO: 3630237 - DNA, 23 bp, Homo sapiens
catgaaatgccctcctaaatgtc

SEQ ID NO: 3630238 - DNA, 13 bp, Homo sapiens
catgaataaaaca

SEQ ID NO: 3630239 - DNA, 16 bp, Homo sapiens
catgaataaaacactc

SEQ ID NO: 3630240 - DNA, 19 bp, Homo sapiens
catgaatgtgagtcattat

SEQ ID NO: 3630241 - DNA, 23 bp, Homo sapiens
catgactcgtatatgtctcaggt

SEQ ID NO: 3630242 - DNA, 15 bp, Homo sapiens
catgactctcatttt

SEQ ID NO: 3630243 - DNA, 14 bp, Homo sapiens
catgactttcctta

SEQ ID NO: 3630244 - DNA, 13 bp, Homo sapiens
catgagctggcaa

SEQ ID NO: 3630245 - DNA, 17 bp, Homo sapiens
catgagctggcaaccag

SEQ ID NO: 3630246 - DNA, 14 bp, Homo sapiens
catgaggccatctc

SEQ ID NO: 3630247 - DNA, 20 bp, Homo sapiens
catgaggccatctcaggaga

SEQ ID NO: 3630248 - DNA, 13 bp, Homo sapiens
catgagtggaaat

SEQ ID NO: 3630249 - DNA, 20 bp, Homo sapiens
catgagtggaaatacactca

SEQ ID NO: 3630250 - DNA, 19 bp, Homo sapiens
catgagttggctgggaata

SEQ ID NO: 3630251 - DNA, 13 bp, Homo sapiens
catgataaatgat

SEQ ID NO: 3630252 - DNA, 23 bp, Homo sapiens
catgatgacttagtacaaagttt

SEQ ID NO: 3630253 - DNA, 23 bp, Homo sapiens
catgatgcacagtatctgctgtt

SEQ ID NO: 3630254 - DNA, 19 bp, Homo sapiens
catgatggcaacagatctg

SEQ ID NO: 3630255 - DNA, 17 bp, Homo sapiens
catgattttacaagtat

SEQ ID NO: 3630256 - DNA, 20 bp, Homo sapiens
catgattttacaagtataac

SEQ ID NO: 3630257 - DNA, 12 bp, Homo sapiens
catgcaagtgga

SEQ ID NO: 3630258 - DNA, 22 bp, Homo sapiens
catgcacatgctgtctggccct

SEQ ID NO: 3630259 - DNA, 18 bp, Homo sapiens
catgcacccctgagccag

SEQ ID NO: 3630260 - DNA, 20 bp, Homo sapiens
catgcaccctcatacacaga

SEQ ID NO: 3630261 - DNA, 22 bp, Homo sapiens
catgcactcacccctagccctg

SEQ ID NO: 3630262 - DNA, 16 bp, Homo sapiens
catgcactcagctctt

SEQ ID NO: 3630263 - DNA, 17 bp, Homo sapiens
catgcactgtgaaggac

SEQ ID NO: 3630264 - DNA, 16 bp, Homo sapiens
catgcaggaaggaaaa

SEQ ID NO: 3630265 - DNA, 18 bp, Homo sapiens
catgcaggaaggaaaact

SEQ ID NO: 3630266 - DNA, 19 bp, Homo sapiens
catgcaggaaggaaaacta

SEQ ID NO: 3630267 - DNA, 19 bp, Homo sapiens
catgcagttatatattttg

SEQ ID NO: 3630268 - DNA, 17 bp, Homo sapiens
catgcataaaaattaaa

SEQ ID NO: 3630269 - DNA, 21 bp, Homo sapiens
catgcataaaaattaaatgga

SEQ ID NO: 3630270 - DNA, 14 bp, Homo sapiens
catgcatataatga

SEQ ID NO: 3630271 - DNA, 16 bp, Homo sapiens
catgccaaccctgggc

SEQ ID NO: 3630272 - DNA, 21 bp, Homo sapiens
catgccacaaggacttcctgt

SEQ ID NO: 3630273 - DNA, 14 bp, Homo sapiens
catgccacctggca

SEQ ID NO: 3630274 - DNA, 15 bp, Homo sapiens
catgccacctggcaa

SEQ ID NO: 3630275 - DNA, 16 bp, Homo sapiens
catgccacctggcaaa

SEQ ID NO: 3630276 - DNA, 13 bp, Homo sapiens
catgccaggggcc

SEQ ID NO: 3630277 - DNA, 14 bp, Homo sapiens
catgccaggggcct

SEQ ID NO: 3630278 - DNA, 12 bp, Homo sapiens
catgccccagtc

SEQ ID NO: 3630279 - DNA, 13 bp, Homo sapiens
catgccccagtcg

SEQ ID NO: 3630280 - DNA, 21 bp, Homo sapiens
catgccctccactccactgcc

SEQ ID NO: 3630281 - DNA, 22 bp, Homo sapiens
catgccctctctcgggagccct

SEQ ID NO: 3630282 - DNA, 22 bp, Homo sapiens
catgctagcatgggtattttta

SEQ ID NO: 3630283 - DNA, 21 bp, Homo sapiens
catgctagtgttgtatttcta

SEQ ID NO: 3630284 - DNA, 19 bp, Homo sapiens
catgctcaacccccctccc

SEQ ID NO: 3630285 - DNA, 20 bp, Homo sapiens
catgctcaacccccctccca

SEQ ID NO: 3630286 - DNA, 22 bp, Homo sapiens
catgctcaacccccctcccaga

SEQ ID NO: 3630287 - DNA, 14 bp, Homo sapiens
catgctgcctccag

SEQ ID NO: 3630288 - DNA, 15 bp, Homo sapiens
catgctgccttcagg

SEQ ID NO: 3630289 - DNA, 17 bp, Homo sapiens
catgctgctggggaaga

SEQ ID NO: 3630290 - DNA, 22 bp, Homo sapiens
catgctgctggggaagacagtg

SEQ ID NO: 3630291 - DNA, 19 bp, Homo sapiens
catgctgtctggccctggg

SEQ ID NO: 3630292 - DNA, 19 bp, Homo sapiens
catgctgtgattgtgccta

SEQ ID NO: 3630293 - DNA, 15 bp, Homo sapiens
catgcttctgtgccg

SEQ ID NO: 3630294 - DNA, 18 bp, Homo sapiens
catgcttgggctgaccca

SEQ ID NO: 3630295 - DNA, 15 bp, Homo sapiens
catggaattccctcc

SEQ ID NO: 3630296 - DNA, 22 bp, Homo sapiens
catggaccgaggttcccactct

SEQ ID NO: 3630297 - DNA, 19 bp, Homo sapiens
catggactgagctggggga

SEQ ID NO: 3630298 - DNA, 12 bp, Homo sapiens
catggagacagc

SEQ ID NO: 3630299 - DNA, 19 bp, Homo sapiens
catggagccccctctgccg

SEQ ID NO: 3630300 - DNA, 19 bp, Homo sapiens
catggagcctacctctgtc

SEQ ID NO: 3630301 - DNA, 22 bp, Homo sapiens
catggattcacccccctctgct

SEQ ID NO: 3630302 - DNA, 21 bp, Homo sapiens
catggcaattttgtaaattga

SEQ ID NO: 3630303 - DNA, 15 bp, Homo sapiens
catggcagctcctga

SEQ ID NO: 3630304 - DNA, 19 bp, Homo sapiens
catggcagctcctgacctt

SEQ ID NO: 3630305 - DNA, 23 bp, Homo sapiens
catggcagctggttgctccattt

SEQ ID NO: 3630306 - DNA, 20 bp, Homo sapiens
catggcaggagtctctgcca

SEQ ID NO: 3630307 - DNA, 17 bp, Homo sapiens
catggcatccctttttc

SEQ ID NO: 3630308 - DNA, 23 bp, Homo sapiens
catggcatccctttttcataaat

SEQ ID NO: 3630309 - DNA, 14 bp, Homo sapiens
catggccaggtggc

SEQ ID NO: 3630310 - DNA, 15 bp, Homo sapiens
catggccaggtggcc

SEQ ID NO: 3630311 - DNA, 15 bp, Homo sapiens
catggccatttctgt

SEQ ID NO: 3630312 - DNA, 21 bp, Homo sapiens
catgggagctggttagaaatg

SEQ ID NO: 3630313 - DNA, 15 bp, Homo sapiens
catgggcacagtggt

SEQ ID NO: 3630314 - DNA, 20 bp, Homo sapiens
catgggcctttaagaacctt

SEQ ID NO: 3630315 - DNA, 13 bp, Homo sapiens
catgggctgtgtc

SEQ ID NO: 3630316 - DNA, 15 bp, Homo sapiens
catggggccaggaaa

SEQ ID NO: 3630317 - DNA, 22 bp, Homo sapiens
catgggtatttttataacaata

SEQ ID NO: 3630318 - DNA, 14 bp, Homo sapiens
catgggtccagggc

SEQ ID NO: 3630319 - DNA, 15 bp, Homo sapiens
catggtactgtagca

SEQ ID NO: 3630320 - DNA, 16 bp, Homo sapiens
catggtgaaagggttt

SEQ ID NO: 3630321 - DNA, 15 bp, Homo sapiens
catggtgccccagga

SEQ ID NO: 3630322 - DNA, 18 bp, Homo sapiens
catggtgccccaggacca

SEQ ID NO: 3630323 - DNA, 20 bp, Homo sapiens
catggtgccccaggaccagc

SEQ ID NO: 3630324 - DNA, 21 bp, Homo sapiens
catggtggggtctcctcagga

SEQ ID NO: 3630325 - DNA, 12 bp, Homo sapiens
catggtgggtag

SEQ ID NO: 3630326 - DNA, 17 bp, Homo sapiens
catggttcaagtattaa

SEQ ID NO: 3630327 - DNA, 17 bp, Homo sapiens
catgtaaagaaatgtct

SEQ ID NO: 3630328 - DNA, 18 bp, Homo sapiens
catgtaaagaaatgtctt

SEQ ID NO: 3630329 - DNA, 16 bp, Homo sapiens
catgtagactgtgcca

SEQ ID NO: 3630330 - DNA, 15 bp, Homo sapiens
catgtagcatataaa

SEQ ID NO: 3630331 - DNA, 19 bp, Homo sapiens
catgtagcatataaatgtt

SEQ ID NO: 3630332 - DNA, 18 bp, Homo sapiens
catgtatgagtgtatgtg

SEQ ID NO: 3630333 - DNA, 23 bp, Homo sapiens
catgtccctaccgagtctcttct

SEQ ID NO: 3630334 - DNA, 13 bp, Homo sapiens
catgtcctgccta

SEQ ID NO: 3630335 - DNA, 22 bp, Homo sapiens
catgtcctgcctattatctgtc

SEQ ID NO: 3630336 - DNA, 15 bp, Homo sapiens
catgtcgcctctgca

SEQ ID NO: 3630337 - DNA, 18 bp, Homo sapiens
catgtcgcctctgcattc

SEQ ID NO: 3630338 - DNA, 15 bp, Homo sapiens
catgtctgcatttcg

SEQ ID NO: 3630339 - DNA, 23 bp, Homo sapiens
catgtctgcatttcggtggctag

SEQ ID NO: 3630340 - DNA, 18 bp, Homo sapiens
catgtgaccactctgtct

SEQ ID NO: 3630341 - DNA, 19 bp, Homo sapiens
catgtgcattattttccag

SEQ ID NO: 3630342 - DNA, 17 bp, Homo sapiens
catgtgcctttctttgc

SEQ ID NO: 3630343 - DNA, 23 bp, Homo sapiens
catgtgcctttctttgcctctgc

SEQ ID NO: 3630344 - DNA, 21 bp, Homo sapiens
catgtgctgtgtgagtgagca

SEQ ID NO: 3630345 - DNA, 15 bp, Homo sapiens
catgtgtacattctg

SEQ ID NO: 3630346 - DNA, 22 bp, Homo sapiens
catgtgtacattctgcctagag

SEQ ID NO: 3630347 - DNA, 17 bp, Homo sapiens
catgtgtagagccccta

SEQ ID NO: 3630348 - DNA, 14 bp, Homo sapiens
catgtgtctggccc

SEQ ID NO: 3630349 - DNA, 17 bp, Homo sapiens
catgtgtgcctggccgc

SEQ ID NO: 3630350 - DNA, 21 bp, Homo sapiens
catgtgttttcatcatttcag

SEQ ID NO: 3630351 - DNA, 22 bp, Homo sapiens
catgtgttttcatcatttcagc

SEQ ID NO: 3630352 - DNA, 14 bp, Homo sapiens
catgttagttacct

SEQ ID NO: 3630353 - DNA, 21 bp, Homo sapiens
catgttagttaccttatagtt

SEQ ID NO: 3630354 - DNA, 13 bp, Homo sapiens
catgttatgcagt

SEQ ID NO: 3630355 - DNA, 15 bp, Homo sapiens
catgttatgcagtga

SEQ ID NO: 3630356 - DNA, 13 bp, Homo sapiens
catgttcctcctt

SEQ ID NO: 3630357 - DNA, 22 bp, Homo sapiens
catgttctaccgtggatttgta

SEQ ID NO: 3630358 - DNA, 23 bp, Homo sapiens
catgttctaccgtggatttgtac

SEQ ID NO: 3630359 - DNA, 18 bp, Homo sapiens
ccactcttgatctctctt

SEQ ID NO: 3630360 - DNA, 18 bp, Homo sapiens
ccactgcataccaacctg

SEQ ID NO: 3630361 - DNA, 21 bp, Homo sapiens
ccactgccttcgatacaccgg

SEQ ID NO: 3630362 - DNA, 22 bp, Homo sapiens
ccactggaacgtttcactgcaa

SEQ ID NO: 3630363 - DNA, 22 bp, Homo sapiens
ccactgggacagctggctgggc

SEQ ID NO: 3630364 - DNA, 19 bp, Homo sapiens
ccactgtcctgggcctgca

SEQ ID NO: 3630365 - DNA, 20 bp, Homo sapiens
ccactgtcctgggcctgcag

SEQ ID NO: 3630366 - DNA, 21 bp, Homo sapiens
ccactgtcctgggcctgcaga

SEQ ID NO: 3630367 - DNA, 15 bp, Homo sapiens
ccacttaatgtatgt

SEQ ID NO: 3630368 - DNA, 17 bp, Homo sapiens
ccacttaatgtatgtta

SEQ ID NO: 3630369 - DNA, 19 bp, Homo sapiens
ccacttagaaattgcattt

SEQ ID NO: 3630370 - DNA, 18 bp, Homo sapiens
ccacttcatttttccctt

SEQ ID NO: 3630371 - DNA, 17 bp, Homo sapiens
ccacttcctgaggcctc

SEQ ID NO: 3630372 - DNA, 17 bp, Homo sapiens
ccacttctggccacatc

SEQ ID NO: 3630373 - DNA, 13 bp, Homo sapiens
ccactttcagagc

SEQ ID NO: 3630374 - DNA, 23 bp, Homo sapiens
ccactttcagagcccccagccct

SEQ ID NO: 3630375 - DNA, 18 bp, Homo sapiens
ccactttcatctaccttt

SEQ ID NO: 3630376 - DNA, 19 bp, Homo sapiens
ccactttcatctacctttt

SEQ ID NO: 3630377 - DNA, 21 bp, Homo sapiens
ccagaaaacctctcctgaccc

SEQ ID NO: 3630378 - DNA, 13 bp, Homo sapiens
ccagaaaggtgtg

SEQ ID NO: 3630379 - DNA, 20 bp, Homo sapiens
ccagaaaggtgtgaggagag

SEQ ID NO: 3630380 - DNA, 24 bp, Homo sapiens
ccagaaaggtgtgaggagagagga

SEQ ID NO: 3630381 - DNA, 17 bp, Homo sapiens
ccagaacctctaagtgc

SEQ ID NO: 3630382 - DNA, 18 bp, Homo sapiens
ccagaacgcaccccactg

SEQ ID NO: 3630383 - DNA, 23 bp, Homo sapiens
ccagaacgcaccccactgggaga

SEQ ID NO: 3630384 - DNA, 21 bp, Homo sapiens
ccagaacgtggctctgctggc

SEQ ID NO: 3630385 - DNA, 18 bp, Homo sapiens
ccagaactttttcctctc

SEQ ID NO: 3630386 - DNA, 21 bp, Homo sapiens
ccagaagatgccagcttctct

SEQ ID NO: 3630387 - DNA, 15 bp, Homo sapiens
ccagaatggagcctg

SEQ ID NO: 3630388 - DNA, 17 bp, Homo sapiens
ccagaattgcagttcag

SEQ ID NO: 3630389 - DNA, 19 bp, Homo sapiens
ccagaatttaccatcatct

SEQ ID NO: 3630390 - DNA, 21 bp, Homo sapiens
ccagaatttaccatcatctct

SEQ ID NO: 3630391 - DNA, 19 bp, Homo sapiens
ccagacacaggccctccct

SEQ ID NO: 3630392 - DNA, 14 bp, Homo sapiens
ccagacacccagga

SEQ ID NO: 3630393 - DNA, 20 bp, Homo sapiens
ccagacaggccctccctgtc

SEQ ID NO: 3630394 - DNA, 21 bp, Homo sapiens
ccagacaggccctccctgtct

SEQ ID NO: 3630395 - DNA, 16 bp, Homo sapiens
ccagacatggagggga

SEQ ID NO: 3630396 - DNA, 14 bp, Homo sapiens
ccagacccctggct

SEQ ID NO: 3630397 - DNA, 18 bp, Homo sapiens
ccagacccctggcttttc

SEQ ID NO: 3630398 - DNA, 15 bp, Homo sapiens
ccagacctgatcctg

SEQ ID NO: 3630399 - DNA, 21 bp, Homo sapiens
ccagacctgatcctggaggcc

SEQ ID NO: 3630400 - DNA, 13 bp, Homo sapiens
ccagacctggctc

SEQ ID NO: 3630401 - DNA, 22 bp, Homo sapiens
ccagactagatgtagtattttt

SEQ ID NO: 3630402 - DNA, 18 bp, Homo sapiens
ccagactgtctccacggc

SEQ ID NO: 3630403 - DNA, 23 bp, Homo sapiens
ccagagaaaggggagcccactgt

SEQ ID NO: 3630404 - DNA, 12 bp, Homo sapiens
ccagagaagcta

SEQ ID NO: 3630405 - DNA, 22 bp, Homo sapiens
ccagagacatacttgaagggcc

SEQ ID NO: 3630406 - DNA, 23 bp, Homo sapiens
ccagagacatacttgaagggcca

SEQ ID NO: 3630407 - DNA, 12 bp, Homo sapiens
ccagagacctca

SEQ ID NO: 3630408 - DNA, 18 bp, Homo sapiens
ccagagacctcatcagcc

SEQ ID NO: 3630409 - DNA, 12 bp, Homo sapiens
ccagagagggaa

SEQ ID NO: 3630410 - DNA, 19 bp, Homo sapiens
ccagagagggaaaaggcag

SEQ ID NO: 3630411 - DNA, 18 bp, Homo sapiens
ccagagagtggagagagc

SEQ ID NO: 3630412 - DNA, 23 bp, Homo sapiens
ccagagagtggagagagcagggc

SEQ ID NO: 3630413 - DNA, 14 bp, Homo sapiens
ccagagagtggctc

SEQ ID NO: 3630414 - DNA, 16 bp, Homo sapiens
ccagagagtggctcct

SEQ ID NO: 3630415 - DNA, 22 bp, Homo sapiens
ccagagagtggctcctcccggt

SEQ ID NO: 3630416 - DNA, 19 bp, Homo sapiens
ccagagatgagtgtctgga

SEQ ID NO: 3630417 - DNA, 11 bp, Homo sapiens
ccagagccagg

SEQ ID NO: 3630418 - DNA, 23 bp, Homo sapiens
ccagagccaggggggtgaggagc

SEQ ID NO: 3630419 - DNA, 15 bp, Homo sapiens
ccagagcccagctcc

SEQ ID NO: 3630420 - DNA, 14 bp, Homo sapiens
ccagagccgggagg

SEQ ID NO: 3630421 - DNA, 15 bp, Homo sapiens
ccagagctgtgccag

SEQ ID NO: 3630422 - DNA, 23 bp, Homo sapiens
ccagaggaccaatgcttgcatgg

SEQ ID NO: 3630423 - DNA, 19 bp, Homo sapiens
ccagaggagccaccagttc

SEQ ID NO: 3630424 - DNA, 21 bp, Homo sapiens
ccagaggagccaccagttctc

SEQ ID NO: 3630425 - DNA, 15 bp, Homo sapiens
ccagaggccctggag

SEQ ID NO: 3630426 - DNA, 15 bp, Homo sapiens
ccagagggttgctgg

SEQ ID NO: 3630427 - DNA, 22 bp, Homo sapiens
ccagagggttgctggtcctgca

SEQ ID NO: 3630428 - DNA, 23 bp, Homo sapiens
ccagaggtcctccgtagggtctt

SEQ ID NO: 3630429 - DNA, 15 bp, Homo sapiens
ccagagtgctgggat

SEQ ID NO: 3630430 - DNA, 12 bp, Homo sapiens
ccagataactta

SEQ ID NO: 3630431 - DNA, 21 bp, Homo sapiens
ccagatttgctaatttatcct

SEQ ID NO: 3630432 - DNA, 18 bp, Homo sapiens
ccagcaacgcccctccaa

SEQ ID NO: 3630433 - DNA, 23 bp, Homo sapiens
ccagcaagacctcatctgtggag

SEQ ID NO: 3630434 - DNA, 14 bp, Homo sapiens
ccagcacaaagcag

SEQ ID NO: 3630435 - DNA, 18 bp, Homo sapiens
ccagcacagtaggtcccg

SEQ ID NO: 3630436 - DNA, 14 bp, Homo sapiens
ccagcaccacagcc

SEQ ID NO: 3630437 - DNA, 18 bp, Homo sapiens
ccagcagatttccagcct

SEQ ID NO: 3630438 - DNA, 19 bp, Homo sapiens
ccagcagcgcctttcccaa

SEQ ID NO: 3630439 - DNA, 17 bp, Homo sapiens
ccagcagctgatgctgt

SEQ ID NO: 3630440 - DNA, 19 bp, Homo sapiens
ccagcaggaaggaccccac

SEQ ID NO: 3630441 - DNA, 22 bp, Homo sapiens
ccagcaggagagactgagcagc

SEQ ID NO: 3630442 - DNA, 12 bp, Homo sapiens
ccagcaggccca

SEQ ID NO: 3630443 - DNA, 16 bp, Homo sapiens
ccagcaggggggctgt

SEQ ID NO: 3630444 - DNA, 14 bp, Homo sapiens
ccagcatccctgga

SEQ ID NO: 3630445 - DNA, 15 bp, Homo sapiens
ccagcatccctggag

SEQ ID NO: 3630446 - DNA, 16 bp, Homo sapiens
ccagcatccctggagc

SEQ ID NO: 3630447 - DNA, 17 bp, Homo sapiens
ccagcatccctggagca

SEQ ID NO: 3630448 - DNA, 18 bp, Homo sapiens
ccagcatcgcactctggc

SEQ ID NO: 3630449 - DNA, 20 bp, Homo sapiens
ccagcatgcaccacgggccc

SEQ ID NO: 3630450 - DNA, 15 bp, Homo sapiens
ccagccacagacccc

SEQ ID NO: 3630451 - DNA, 16 bp, Homo sapiens
ccagccacagacccct

SEQ ID NO: 3630452 - DNA, 17 bp, Homo sapiens
ccagccacagacccctg

SEQ ID NO: 3630453 - DNA, 19 bp, Homo sapiens
ccagccacagacccctggg

SEQ ID NO: 3630454 - DNA, 22 bp, Homo sapiens
ccagccacagacccctgggagc

SEQ ID NO: 3630455 - DNA, 20 bp, Homo sapiens
ccagccagaggcatctgagg

SEQ ID NO: 3630456 - DNA, 16 bp, Homo sapiens
ccagccagcctggctg

SEQ ID NO: 3630457 - DNA, 14 bp, Homo sapiens
ccagccagcgtccc

SEQ ID NO: 3630458 - DNA, 16 bp, Homo sapiens
ccagccatgtctgcat

SEQ ID NO: 3630459 - DNA, 17 bp, Homo sapiens
ccagccatgtctgcatt

SEQ ID NO: 3630460 - DNA, 18 bp, Homo sapiens
ccagccatgtctgcattt

SEQ ID NO: 3630461 - DNA, 13 bp, Homo sapiens
ccagcccaaacct

SEQ ID NO: 3630462 - DNA, 15 bp, Homo sapiens
ccagcccaaacctgg

SEQ ID NO: 3630463 - DNA, 20 bp, Homo sapiens
ccagcccaaacctgggaagg

SEQ ID NO: 3630464 - DNA, 11 bp, Homo sapiens
ccagcccagag

SEQ ID NO: 3630465 - DNA, 14 bp, Homo sapiens
ccagcccagagaca

SEQ ID NO: 3630466 - DNA, 22 bp, Homo sapiens
ccagcccagagacatacttgaa

SEQ ID NO: 3630467 - DNA, 12 bp, Homo sapiens
ccagcccagagc

SEQ ID NO: 3630468 - DNA, 13 bp, Homo sapiens
ccagcccagagcc

SEQ ID NO: 3630469 - DNA, 20 bp, Homo sapiens
ccagcccagagccacctgga

SEQ ID NO: 3630470 - DNA, 16 bp, Homo sapiens
ccagcccagcacccct

SEQ ID NO: 3630471 - DNA, 17 bp, Homo sapiens
ccagcccagcacccctt

SEQ ID NO: 3630472 - DNA, 17 bp, Homo sapiens
ccagcccatttgggcag

SEQ ID NO: 3630473 - DNA, 16 bp, Homo sapiens
ccagccccccgcgcgc

SEQ ID NO: 3630474 - DNA, 22 bp, Homo sapiens
ccagccccccgcgcgcccaccc

SEQ ID NO: 3630475 - DNA, 21 bp, Homo sapiens
ccagcccgacagtgccatccc

SEQ ID NO: 3630476 - DNA, 22 bp, Homo sapiens
ccagccctgggaaccactccca

SEQ ID NO: 3630477 - DNA, 23 bp, Homo sapiens
ccagccctgggggattcctgagc

SEQ ID NO: 3630478 - DNA, 13 bp, Homo sapiens
ccagcccttccct

SEQ ID NO: 3630479 - DNA, 16 bp, Homo sapiens
ccagcccttccctggc

SEQ ID NO: 3630480 - DNA, 17 bp, Homo sapiens
ccagcctccctgaagcc

SEQ ID NO: 3630481 - DNA, 15 bp, Homo sapiens
ccagcctccctgtct

SEQ ID NO: 3630482 - DNA, 17 bp, Homo sapiens
ccagcctccctgtctcc

SEQ ID NO: 3630483 - DNA, 19 bp, Homo sapiens
ccagcctccctgtctccag

SEQ ID NO: 3630484 - DNA, 21 bp, Homo sapiens
ccagcctccctgtctccagct

SEQ ID NO: 3630485 - DNA, 22 bp, Homo sapiens
ccagcctgactagaactcctgt

SEQ ID NO: 3630486 - DNA, 21 bp, Homo sapiens
ccagcctggctctgccccctc

SEQ ID NO: 3630487 - DNA, 23 bp, Homo sapiens
ccagcctggctctgccccctccc

SEQ ID NO: 3630488 - DNA, 21 bp, Homo sapiens
ccagccttgtacagtctgctc

SEQ ID NO: 3630489 - DNA, 17 bp, Homo sapiens
ccagcgtcccttggtga

SEQ ID NO: 3630490 - DNA, 13 bp, Homo sapiens
cccagcgctgctg

SEQ ID NO: 3630491 - DNA, 18 bp, Homo sapiens
cccagctaagaacctgga

SEQ ID NO: 3630492 - DNA, 14 bp, Homo sapiens
cccagctacctcaa

SEQ ID NO: 3630493 - DNA, 22 bp, Homo sapiens
cccagctctagcctctggactg

SEQ ID NO: 3630494 - DNA, 11 bp, Homo sapiens
cccagctctgc

SEQ ID NO: 3630495 - DNA, 13 bp, Homo sapiens
cccagctgcaccc

SEQ ID NO: 3630496 - DNA, 14 bp, Homo sapiens
cccagcttggctca

SEQ ID NO: 3630497 - DNA, 23 bp, Homo sapiens
cccagcttggctcacaaggccca

SEQ ID NO: 3630498 - DNA, 19 bp, Homo sapiens
cccagctttccctgccagg

SEQ ID NO: 3630499 - DNA, 16 bp, Homo sapiens
cccaggaaaggcccag

SEQ ID NO: 3630500 - DNA, 12 bp, Homo sapiens
cccaggaccagc

SEQ ID NO: 3630501 - DNA, 14 bp, Homo sapiens
cccaggaccagctc

SEQ ID NO: 3630502 - DNA, 11 bp, Homo sapiens
cccaggaccct

SEQ ID NO: 3630503 - DNA, 21 bp, Homo sapiens
cccaggagacagaccacttgc

SEQ ID NO: 3630504 - DNA, 17 bp, Homo sapiens
cccaggagacagttcaa

SEQ ID NO: 3630505 - DNA, 16 bp, Homo sapiens
cccaggagacctccag

SEQ ID NO: 3630506 - DNA, 17 bp, Homo sapiens
cccaggagacctccagc

SEQ ID NO: 3630507 - DNA, 18 bp, Homo sapiens
cccaggagacctccagct

SEQ ID NO: 3630508 - DNA, 13 bp, Homo sapiens
cccaggcagctat

SEQ ID NO: 3630509 - DNA, 18 bp, Homo sapiens
cccaggcagctatttcag

SEQ ID NO: 3630510 - DNA, 22 bp, Homo sapiens
cccaggcagctatttcagcctc

SEQ ID NO: 3630511 - DNA, 19 bp, Homo sapiens
cccaggctagagtgcaatg

SEQ ID NO: 3630512 - DNA, 13 bp, Homo sapiens
cccagggagctct

SEQ ID NO: 3630513 - DNA, 16 bp, Homo sapiens
cccagggcccagagcc

SEQ ID NO: 3630514 - DNA, 16 bp, Homo sapiens
cccagggcctccaggg

SEQ ID NO: 3630515 - DNA, 15 bp, Homo sapiens
cccaggggagccctc

SEQ ID NO: 3630516 - DNA, 19 bp, Homo sapiens
cccaggggagccctccacg

SEQ ID NO: 3630517 - DNA, 13 bp, Homo sapiens
cccaggtcctcac

SEQ ID NO: 3630518 - DNA, 13 bp, Homo sapiens
cccaggtgccagt

SEQ ID NO: 3630519 - DNA, 17 bp, Homo sapiens
cccaggttcccccagca

SEQ ID NO: 3630520 - DNA, 17 bp, Homo sapiens
cccagtcccacactgtg

SEQ ID NO: 3630521 - DNA, 22 bp, Homo sapiens
cccagtcggccccatctctcat

SEQ ID NO: 3630522 - DNA, 17 bp, Homo sapiens
cccagtgaagcctctga

SEQ ID NO: 3630523 - DNA, 21 bp, Homo sapiens
cccagtgggaagagtgtgggg

SEQ ID NO: 3630524 - DNA, 16 bp, Homo sapiens
cccagtgggtctggga

SEQ ID NO: 3630525 - DNA, 22 bp, Homo sapiens
cccagttctgaataacttgaag

SEQ ID NO: 3630526 - DNA, 17 bp, Homo sapiens
cccatcatacacttcct

SEQ ID NO: 3630527 - DNA, 20 bp, Homo sapiens
cccatccaaccactgtacac

SEQ ID NO: 3630528 - DNA, 14 bp, Homo sapiens
cccatccagccaga

SEQ ID NO: 3630529 - DNA, 14 bp, Homo sapiens
cccatccagttcat

SEQ ID NO: 3630530 - DNA, 16 bp, Homo sapiens
cccatccccgcagtgt

SEQ ID NO: 3630531 - DNA, 16 bp, Homo sapiens
cccatccctgcctgga

SEQ ID NO: 3630532 - DNA, 14 bp, Homo sapiens
cccatcctccagca

SEQ ID NO: 3630533 - DNA, 16 bp, Homo sapiens
cccatcctccagcagg

SEQ ID NO: 3630534 - DNA, 13 bp, Homo sapiens
cccatcctggggc

SEQ ID NO: 3630535 - DNA, 14 bp, Homo sapiens
cccatcctggggca

SEQ ID NO: 3630536 - DNA, 16 bp, Homo sapiens
cccatgcactgtgaag

SEQ ID NO: 3630537 - DNA, 18 bp, Homo sapiens
cccatgcactgtgaagga

SEQ ID NO: 3630538 - DNA, 20 bp, Homo sapiens
cccatgcactgtgaaggacc

SEQ ID NO: 3630539 - DNA, 15 bp, Homo sapiens
cccatgccagagagg

SEQ ID NO: 3630540 - DNA, 19 bp, Homo sapiens
cccatgctgccttcaggga

SEQ ID NO: 3630541 - DNA, 18 bp, Homo sapiens
cccatgttgtaatgctgc

SEQ ID NO: 3630542 - DNA, 15 bp, Homo sapiens
cccattcccagcctg

SEQ ID NO: 3630543 - DNA, 15 bp, Homo sapiens
cccattccctccatt

SEQ ID NO: 3630544 - DNA, 13 bp, Homo sapiens
cccattcctaaga

SEQ ID NO: 3630545 - DNA, 12 bp, Homo sapiens
cccattcctgaa

SEQ ID NO: 3630546 - DNA, 13 bp, Homo sapiens
cccattcctgaag

SEQ ID NO: 3630547 - DNA, 20 bp, Homo sapiens
cccattcttcctagttttct

SEQ ID NO: 3630548 - DNA, 21 bp, Homo sapiens
cccattcttcctagttttctc

SEQ ID NO: 3630549 - DNA, 14 bp, Homo sapiens
cccatttcccgcac

SEQ ID NO: 3630550 - DNA, 18 bp, Homo sapiens
cccatttcctcacactaa

SEQ ID NO: 3630551 - DNA, 20 bp, Homo sapiens
cccatttgggcagagaggct

SEQ ID NO: 3630552 - DNA, 22 bp, Homo sapiens
ccccaaaatccaaaacttctct

SEQ ID NO: 3630553 - DNA, 14 bp, Homo sapiens
ccccaaaccccagc

SEQ ID NO: 3630554 - DNA, 21 bp, Homo sapiens
ccccaacccctctccaggcct

SEQ ID NO: 3630555 - DNA, 15 bp, Homo sapiens
ccccaagcttcccaa

SEQ ID NO: 3630556 - DNA, 20 bp, Homo sapiens
ccccaaggctgcaaagcaaa

SEQ ID NO: 3630557 - DNA, 18 bp, Homo sapiens
ccccaagggggctgctgc

SEQ ID NO: 3630558 - DNA, 15 bp, Homo sapiens
ccccaattctcccct

SEQ ID NO: 3630559 - DNA, 19 bp, Homo sapiens
ccccacaagctgtccctgc

SEQ ID NO: 3630560 - DNA, 13 bp, Homo sapiens
ccccaccactccc

SEQ ID NO: 3630561 - DNA, 15 bp, Homo sapiens
ccccaccatctgctg

SEQ ID NO: 3630562 - DNA, 12 bp, Homo sapiens
ccccacccctgg

SEQ ID NO: 3630563 - DNA, 20 bp, Homo sapiens
ccccaccgaggttcccaggg

SEQ ID NO: 3630564 - DNA, 19 bp, Homo sapiens
ccccacctcccccttcccc

SEQ ID NO: 3630565 - DNA, 15 bp, Homo sapiens
ccccactcaggggac

SEQ ID NO: 3630566 - DNA, 19 bp, Homo sapiens
ccccactcaggggacccca

SEQ ID NO: 3630567 - DNA, 13 bp, Homo sapiens
ccccactcccagc

SEQ ID NO: 3630568 - DNA, 15 bp, Homo sapiens
ccccactcccagcat

SEQ ID NO: 3630569 - DNA, 15 bp, Homo sapiens
ccccactgctgagct

SEQ ID NO: 3630570 - DNA, 16 bp, Homo sapiens
ccccactgctgagctg

SEQ ID NO: 3630571 - DNA, 21 bp, Homo sapiens
ccccactgctgagctggccct

SEQ ID NO: 3630572 - DNA, 17 bp, Homo sapiens
ccccagaaagcctcctg

SEQ ID NO: 3630573 - DNA, 12 bp, Homo sapiens
ccccagagagac

SEQ ID NO: 3630574 - DNA, 23 bp, Homo sapiens
ccccagagagaccctgcaagacc

SEQ ID NO: 3630575 - DNA, 11 bp, Homo sapiens
ccccagagctc

SEQ ID NO: 3630576 - DNA, 17 bp, Homo sapiens
ccccagaggccctggag

SEQ ID NO: 3630577 - DNA, 20 bp, Homo sapiens
ccccagcaacgcccctccaa

SEQ ID NO: 3630578 - DNA, 22 bp, Homo sapiens
ccccagcaacgcccctccaaac

SEQ ID NO: 3630579 - DNA, 17 bp, Homo sapiens
ccccagcaagcgggagc

SEQ ID NO: 3630580 - DNA, 22 bp, Homo sapiens
ccccagcaagcgggagcccgtg

SEQ ID NO: 3630581 - DNA, 14 bp, Homo sapiens
ccccagccactccc

SEQ ID NO: 3630582 - DNA, 16 bp, Homo sapiens
ccccagccaggctcct

SEQ ID NO: 3630583 - DNA, 17 bp, Homo sapiens
ccccagccatccagggg

SEQ ID NO: 3630584 - DNA, 12 bp, Homo sapiens
ccccagcccaga

SEQ ID NO: 3630585 - DNA, 15 bp, Homo sapiens
ccccagcccagagac

SEQ ID NO: 3630586 - DNA, 13 bp, Homo sapiens
ccccagcccagca

SEQ ID NO: 3630587 - DNA, 16 bp, Homo sapiens
ccccagcccagcaccc

SEQ ID NO: 3630588 - DNA, 17 bp, Homo sapiens
ccccagccccagcccct

SEQ ID NO: 3630589 - DNA, 15 bp, Homo sapiens
ccccagccccttcca

SEQ ID NO: 3630590 - DNA, 14 bp, Homo sapiens
ccccagggagctct

SEQ ID NO: 3630591 - DNA, 18 bp, Homo sapiens
ccccagggagctctgggg

SEQ ID NO: 3630592 - DNA, 15 bp, Homo sapiens
ccccagggcctccag

SEQ ID NO: 3630593 - DNA, 16 bp, Homo sapiens
ccccagggcctccagg

SEQ ID NO: 3630594 - DNA, 20 bp, Homo sapiens
ccccaggggaactggcagcg

SEQ ID NO: 3630595 - DNA, 22 bp, Homo sapiens
ccccagggtttacatgaagcag

SEQ ID NO: 3630596 - DNA, 23 bp, Homo sapiens
ccccagggtttacatgaagcaga

SEQ ID NO: 3630597 - DNA, 20 bp, Homo sapiens
ccccaggtgcagccccaggg

SEQ ID NO: 3630598 - DNA, 22 bp, Homo sapiens
ccccaggtgcagccccagggcc

SEQ ID NO: 3630599 - DNA, 14 bp, Homo sapiens
ccccaggtgccagt

SEQ ID NO: 3630600 - DNA, 15 bp, Homo sapiens
ccccagtgactccag

SEQ ID NO: 3630601 - DNA, 17 bp, Homo sapiens
ccccagtgactccaggg

SEQ ID NO: 3630602 - DNA, 17 bp, Homo sapiens
ccccatatataaattat

SEQ ID NO: 3630603 - DNA, 19 bp, Homo sapiens
ccccatcctcatccctgac

SEQ ID NO: 3630604 - DNA, 15 bp, Homo sapiens
ccccatcctccagca

SEQ ID NO: 3630605 - DNA, 13 bp, Homo sapiens
ccccatctgagct

SEQ ID NO: 3630606 - DNA, 13 bp, Homo sapiens
ccccatgcactgt

SEQ ID NO: 3630607 - DNA, 14 bp, Homo sapiens
ccccatgctgcctt

SEQ ID NO: 3630608 - DNA, 24 bp, Homo sapiens
ccccatggccggctttcaggagct

SEQ ID NO: 3630609 - DNA, 12 bp, Homo sapiens
ccccatgggctg

SEQ ID NO: 3630610 - DNA, 20 bp, Homo sapiens
ccccatgttgtaatgctgca

SEQ ID NO: 3630611 - DNA, 23 bp, Homo sapiens
ccccatgttgtaatgctgcactt

SEQ ID NO: 3630612 - DNA, 17 bp, Homo sapiens
ccccattcccagcctga

SEQ ID NO: 3630613 - DNA, 12 bp, Homo sapiens
ccccattccctc

SEQ ID NO: 3630614 - DNA, 23 bp, Homo sapiens
ccccattcttcctagttttctcc

SEQ ID NO: 3630615 - DNA, 17 bp, Homo sapiens
cccccacaaggaaccct

SEQ ID NO: 3630616 - DNA, 15 bp, Homo sapiens
cccccaccactcagg

SEQ ID NO: 3630617 - DNA, 18 bp, Homo sapiens
cccccactcagtgcctcc

SEQ ID NO: 3630618 - DNA, 20 bp, Homo sapiens
cccccagaaagcctcctgcc

SEQ ID NO: 3630619 - DNA, 13 bp, Homo sapiens
cccccagctaaga

SEQ ID NO: 3630620 - DNA, 21 bp, Homo sapiens
cccccagctaagaacctggaa

SEQ ID NO: 3630621 - DNA, 23 bp, Homo sapiens
cccccagctttgctaccaaagca

SEQ ID NO: 3630622 - DNA, 18 bp, Homo sapiens
cccccagggcctccaggg

SEQ ID NO: 3630623 - DNA, 20 bp, Homo sapiens
cccccagggcctccagggcc

SEQ ID NO: 3630624 - DNA, 16 bp, Homo sapiens
ccctgttccccagaga

SEQ ID NO: 3630625 - DNA, 21 bp, Homo sapiens
cccttaaacacaggctgtcct

SEQ ID NO: 3630626 - DNA, 20 bp, Homo sapiens
cccttaagccaaactcaggc

SEQ ID NO: 3630627 - DNA, 18 bp, Homo sapiens
cccttacagcctctgact

SEQ ID NO: 3630628 - DNA, 17 bp, Homo sapiens
cccttaccctcctctgc

SEQ ID NO: 3630629 - DNA, 19 bp, Homo sapiens
cccttaccctcctctgctg

SEQ ID NO: 3630630 - DNA, 19 bp, Homo sapiens
cccttatgcggttaatttt

SEQ ID NO: 3630631 - DNA, 14 bp, Homo sapiens
cccttcaaccattc

SEQ ID NO: 3630632 - DNA, 18 bp, Homo sapiens
cccttcacaaagcccaag

SEQ ID NO: 3630633 - DNA, 12 bp, Homo sapiens
cccttcaggagc

SEQ ID NO: 3630634 - DNA, 13 bp, Homo sapiens
cccttcaggagcc

SEQ ID NO: 3630635 - DNA, 15 bp, Homo sapiens
cccttcaggagcctg

SEQ ID NO: 3630636 - DNA, 24 bp, Homo sapiens
cccttcaggagcctggccaggcag

SEQ ID NO: 3630637 - DNA, 17 bp, Homo sapiens
cccttcatccatcctga

SEQ ID NO: 3630638 - DNA, 11 bp, Homo sapiens
cccttcatttg

SEQ ID NO: 3630639 - DNA, 15 bp, Homo sapiens
cccttccatgtgcct

SEQ ID NO: 3630640 - DNA, 17 bp, Homo sapiens
cccttccatgtgccttt

SEQ ID NO: 3630641 - DNA, 17 bp, Homo sapiens
cccttcccatttcttcc

SEQ ID NO: 3630642 - DNA, 16 bp, Homo sapiens
cccttccggtgcgtgt

SEQ ID NO: 3630643 - DNA, 22 bp, Homo sapiens
cccttcctactcctcatagcat

SEQ ID NO: 3630644 - DNA, 17 bp, Homo sapiens
cccttcctctccactgc

SEQ ID NO: 3630645 - DNA, 12 bp, Homo sapiens
cccttcctggaa

SEQ ID NO: 3630646 - DNA, 13 bp, Homo sapiens
cccttcctggaaa

SEQ ID NO: 3630647 - DNA, 15 bp, Homo sapiens
cccttcctggaaaca

SEQ ID NO: 3630648 - DNA, 18 bp, Homo sapiens
cccttcctggaaacagca

SEQ ID NO: 3630649 - DNA, 21 bp, Homo sapiens
cccttcctggaaacagcatga

SEQ ID NO: 3630650 - DNA, 22 bp, Homo sapiens
cccttcctgggcacacgctgct

SEQ ID NO: 3630651 - DNA, 10 bp, Homo sapiens
cccttcctgt

SEQ ID NO: 3630652 - DNA, 20 bp, Homo sapiens
cccttctatacccacccaga

SEQ ID NO: 3630653 - DNA, 21 bp, Homo sapiens
cccttctatacccacccagaa

SEQ ID NO: 3630654 - DNA, 14 bp, Homo sapiens
cccttctctgcctc

SEQ ID NO: 3630655 - DNA, 12 bp, Homo sapiens
cccttctctgtt

SEQ ID NO: 3630656 - DNA, 13 bp, Homo sapiens
cccttctgggtcc

SEQ ID NO: 3630657 - DNA, 14 bp, Homo sapiens
cccttctgggtcca

SEQ ID NO: 3630658 - DNA, 18 bp, Homo sapiens
cccttctgggtccaggga

SEQ ID NO: 3630659 - DNA, 11 bp, Homo sapiens
cccttcttttt

SEQ ID NO: 3630660 - DNA, 19 bp, Homo sapiens
cccttctttttcttctttt

SEQ ID NO: 3630661 - DNA, 11 bp, Homo sapiens
cccttgcctct

SEQ ID NO: 3630662 - DNA, 13 bp, Homo sapiens
cccttgcctctgc

SEQ ID NO: 3630663 - DNA, 13 bp, Homo sapiens
cccttgctgcccg

SEQ ID NO: 3630664 - DNA, 18 bp, Homo sapiens
cccttgctttcctgggcc

SEQ ID NO: 3630665 - DNA, 16 bp, Homo sapiens
cccttggaacaccctg

SEQ ID NO: 3630666 - DNA, 19 bp, Homo sapiens
cccttggaacaccctggat

SEQ ID NO: 3630667 - DNA, 16 bp, Homo sapiens
ccctttcacactggat

SEQ ID NO: 3630668 - DNA, 21 bp, Homo sapiens
cccttttttgtacaatatgtt

SEQ ID NO: 3630669 - DNA, 18 bp, Homo sapiens
ccctttttttacatttca

SEQ ID NO: 3630670 - DNA, 16 bp, Homo sapiens
ccgaagcccaggggcc

SEQ ID NO: 3630671 - DNA, 14 bp, Homo sapiens
ccgaagtctctgat

SEQ ID NO: 3630672 - DNA, 19 bp, Homo sapiens
ccgacaggtgggcctggga

SEQ ID NO: 3630673 - DNA, 15 bp, Homo sapiens
ccgaccacctgccca

SEQ ID NO: 3630674 - DNA, 23 bp, Homo sapiens
ccgaccttccctccgccttctcc

SEQ ID NO: 3630675 - DNA, 12 bp, Homo sapiens
ccgactcaggga

SEQ ID NO: 3630676 - DNA, 12 bp, Homo sapiens
ccgagaaccctg

SEQ ID NO: 3630677 - DNA, 17 bp, Homo sapiens
ccgagaaccctgagcag

SEQ ID NO: 3630678 - DNA, 13 bp, Homo sapiens
ccgagaagaacag

SEQ ID NO: 3630679 - DNA, 22 bp, Homo sapiens
ccgagctctggtgctttagtta

SEQ ID NO: 3630680 - DNA, 15 bp, Homo sapiens
ccgagggcgaccccg

SEQ ID NO: 3630681 - DNA, 16 bp, Homo sapiens
ccgagggcgaccccgt

SEQ ID NO: 3630682 - DNA, 22 bp, Homo sapiens
ccgagggctgagcctggtccca

SEQ ID NO: 3630683 - DNA, 16 bp, Homo sapiens
ccgagtctcttctcca

SEQ ID NO: 3630684 - DNA, 18 bp, Homo sapiens
ccgagtctcttctccact

SEQ ID NO: 3630685 - DNA, 22 bp, Homo sapiens
ccgagtctcttctccactggat

SEQ ID NO: 3630686 - DNA, 20 bp, Homo sapiens
ccgcacatggtgtggggggc

SEQ ID NO: 3630687 - DNA, 16 bp, Homo sapiens
ccgcagaagcctcccc

SEQ ID NO: 3630688 - DNA, 20 bp, Homo sapiens
ccgcagaagcctccccagct

SEQ ID NO: 3630689 - DNA, 14 bp, Homo sapiens
ccgcagacctggag

SEQ ID NO: 3630690 - DNA, 15 bp, Homo sapiens
ccgcagacctggagc

SEQ ID NO: 3630691 - DNA, 16 bp, Homo sapiens
ccgcagacctggagct

SEQ ID NO: 3630692 - DNA, 20 bp, Homo sapiens
ccgcagacggtctgtgtgct

SEQ ID NO: 3630693 - DNA, 13 bp, Homo sapiens
ccgcagagaaatg

SEQ ID NO: 3630694 - DNA, 14 bp, Homo sapiens
ccgcagagaaatgc

SEQ ID NO: 3630695 - DNA, 17 bp, Homo sapiens
ccgcagagaaatgcccc

SEQ ID NO: 3630696 - DNA, 20 bp, Homo sapiens
ccgcagagaaatgccccagt

SEQ ID NO: 3630697 - DNA, 12 bp, Homo sapiens
ccgcaggtgctc

SEQ ID NO: 3630698 - DNA, 14 bp, Homo sapiens
ccgcatgtgtgcct

SEQ ID NO: 3630699 - DNA, 15 bp, Homo sapiens
ccgcatgtgtgcctg

SEQ ID NO: 3630700 - DNA, 21 bp, Homo sapiens
ccgccaaaagctgctcaggga

SEQ ID NO: 3630701 - DNA, 11 bp, Homo sapiens
ccgccacagcc

SEQ ID NO: 3630702 - DNA, 16 bp, Homo sapiens
ccgccacggcctggct

SEQ ID NO: 3630703 - DNA, 21 bp, Homo sapiens
ccgccacgtcccagcatccct

SEQ ID NO: 3630704 - DNA, 15 bp, Homo sapiens
ccgccagctgggagc

SEQ ID NO: 3630705 - DNA, 13 bp, Homo sapiens
ccgccagggctgg

SEQ ID NO: 3630706 - DNA, 19 bp, Homo sapiens
ccgccatgcttctgtgccg

SEQ ID NO: 3630707 - DNA, 14 bp, Homo sapiens
ccgcccactcctgg

SEQ ID NO: 3630708 - DNA, 14 bp, Homo sapiens
ccgcccagcccacc

SEQ ID NO: 3630709 - DNA, 13 bp, Homo sapiens
ccgccccagagct

SEQ ID NO: 3630710 - DNA, 17 bp, Homo sapiens
ccgccccagagctccga

SEQ ID NO: 3630711 - DNA, 15 bp, Homo sapiens
ccgccccgcccctcc

SEQ ID NO: 3630712 - DNA, 18 bp, Homo sapiens
ccgcccctgtggccctgg

SEQ ID NO: 3630713 - DNA, 17 bp, Homo sapiens
ccgcccggcagtgcacg

SEQ ID NO: 3630714 - DNA, 18 bp, Homo sapiens
ccgcctaagaccctgaat

SEQ ID NO: 3630715 - DNA, 15 bp, Homo sapiens
ccgcctcaaaatgtg

SEQ ID NO: 3630716 - DNA, 19 bp, Homo sapiens
ccgcctcgacctccccacc

SEQ ID NO: 3630717 - DNA, 19 bp, Homo sapiens
ccgccttctcccacatgag

SEQ ID NO: 3630718 - DNA, 12 bp, Homo sapiens
ccgcgcccagca

SEQ ID NO: 3630719 - DNA, 23 bp, Homo sapiens
ccgcgcctacccttcccgcctcc

SEQ ID NO: 3630720 - DNA, 17 bp, Homo sapiens
ccgcgggagacagcttc

SEQ ID NO: 3630721 - DNA, 21 bp, Homo sapiens
ccgcgggagacagcttctctg

SEQ ID NO: 3630722 - DNA, 23 bp, Homo sapiens
ccgcgggagacagcttctctgca

SEQ ID NO: 3630723 - DNA, 19 bp, Homo sapiens
ccgcgtcgccctcccaggc

SEQ ID NO: 3630724 - DNA, 13 bp, Homo sapiens
ccgctcagccctc

SEQ ID NO: 3630725 - DNA, 16 bp, Homo sapiens
ccgctcaggggcctgg

SEQ ID NO: 3630726 - DNA, 19 bp, Homo sapiens
ccgctcaggggcctggagg

SEQ ID NO: 3630727 - DNA, 17 bp, Homo sapiens
ccgctcccgctcccagg

SEQ ID NO: 3630728 - DNA, 19 bp, Homo sapiens
ccgctctctctgagggggt

SEQ ID NO: 3630729 - DNA, 18 bp, Homo sapiens
ccgctgaggggtctcgga

SEQ ID NO: 3630730 - DNA, 11 bp, Homo sapiens
ccgctgccacc

SEQ ID NO: 3630731 - DNA, 12 bp, Homo sapiens
ccgctggccctg

SEQ ID NO: 3630732 - DNA, 21 bp, Homo sapiens
ccgctggctggtgggccccca

SEQ ID NO: 3630733 - DNA, 11 bp, Homo sapiens
ccgctttctct

SEQ ID NO: 3630734 - DNA, 19 bp, Homo sapiens
ccgctttctctgagggggt

SEQ ID NO: 3630735 - DNA, 22 bp, Homo sapiens
ccggaaggaatgtcagggccag

SEQ ID NO: 3630736 - DNA, 12 bp, Homo sapiens
ccggaagggctt

SEQ ID NO: 3630737 - DNA, 17 bp, Homo sapiens
ccggagcaaactctgct

SEQ ID NO: 3630738 - DNA, 18 bp, Homo sapiens
ccggagcaaactctgctg

SEQ ID NO: 3630739 - DNA, 18 bp, Homo sapiens
ccggagcaagcaggagtg

SEQ ID NO: 3630740 - DNA, 14 bp, Homo sapiens
ccggagcgccctgc

SEQ ID NO: 3630741 - DNA, 20 bp, Homo sapiens
ccggagcgccctgcagggcc

SEQ ID NO: 3630742 - DNA, 22 bp, Homo sapiens
ccggagcgccctgcagggccgg

SEQ ID NO: 3630743 - DNA, 13 bp, Homo sapiens
ccggagggcagga

SEQ ID NO: 3630744 - DNA, 16 bp, Homo sapiens
ccggagggcaggaccc

SEQ ID NO: 3630745 - DNA, 14 bp, Homo sapiens
ccggaggggcctgg

SEQ ID NO: 3630746 - DNA, 15 bp, Homo sapiens
ccggccagccatgtc

SEQ ID NO: 3630747 - DNA, 15 bp, Homo sapiens
ccggccagctctgga

SEQ ID NO: 3630748 - DNA, 13 bp, Homo sapiens
ccggccaggccgc

SEQ ID NO: 3630749 - DNA, 22 bp, Homo sapiens
ccggccaggccgcgcccagcag

SEQ ID NO: 3630750 - DNA, 15 bp, Homo sapiens
ccggccggagggcag

SEQ ID NO: 3630751 - DNA, 11 bp, Homo sapiens
ccggcctgtct

SEQ ID NO: 3630752 - DNA, 21 bp, Homo sapiens
ccggcgctgattcctcgtgtc

SEQ ID NO: 3630753 - DNA, 18 bp, Homo sapiens
ccggcggccccgccgcag

SEQ ID NO: 3630754 - DNA, 15 bp, Homo sapiens
ccggctgagtggcag

SEQ ID NO: 3630755 - DNA, 18 bp, Homo sapiens
ccggctgagtggcagcag

SEQ ID NO: 3630756 - DNA, 12 bp, Homo sapiens
ccgggactccag

SEQ ID NO: 3630757 - DNA, 23 bp, Homo sapiens
ccgggaggaaaaggcccctgcaa

SEQ ID NO: 3630758 - DNA, 19 bp, Homo sapiens
cctcacccccagctttgct

SEQ ID NO: 3630759 - DNA, 19 bp, Homo sapiens
cctcacctctcccccaagg

SEQ ID NO: 3630760 - DNA, 12 bp, Homo sapiens
cctcacctgggc

SEQ ID NO: 3630761 - DNA, 15 bp, Homo sapiens
cctcacctgtagcag

SEQ ID NO: 3630762 - DNA, 21 bp, Homo sapiens
cctcaccttggcaccagacac

SEQ ID NO: 3630763 - DNA, 13 bp, Homo sapiens
cctcactccccag

SEQ ID NO: 3630764 - DNA, 14 bp, Homo sapiens
cctcactccccagg

SEQ ID NO: 3630765 - DNA, 16 bp, Homo sapiens
cctcactggcctgcca

SEQ ID NO: 3630766 - DNA, 18 bp, Homo sapiens
cctcactggcctgccatg

SEQ ID NO: 3630767 - DNA, 15 bp, Homo sapiens
cctcagaaggcccca

SEQ ID NO: 3630768 - DNA, 16 bp, Homo sapiens
cctcagaaggccccag

SEQ ID NO: 3630769 - DNA, 14 bp, Homo sapiens
cctcagagtgcaag

SEQ ID NO: 3630770 - DNA, 13 bp, Homo sapiens
cctcagcacccct

SEQ ID NO: 3630771 - DNA, 14 bp, Homo sapiens
cctcagcacccctc

SEQ ID NO: 3630772 - DNA, 16 bp, Homo sapiens
cctcagcacccctcca

SEQ ID NO: 3630773 - DNA, 17 bp, Homo sapiens
cctcagcacccctccag

SEQ ID NO: 3630774 - DNA, 17 bp, Homo sapiens
cctcagccagagaagct

SEQ ID NO: 3630775 - DNA, 16 bp, Homo sapiens
cctcagcctccccagt

SEQ ID NO: 3630776 - DNA, 14 bp, Homo sapiens
cctcagcctcctga

SEQ ID NO: 3630777 - DNA, 16 bp, Homo sapiens
cctcagcctcctgggt

SEQ ID NO: 3630778 - DNA, 19 bp, Homo sapiens
cctcagcctcctgggtagc

SEQ ID NO: 3630779 - DNA, 11 bp, Homo sapiens
cctcagcctgg

SEQ ID NO: 3630780 - DNA, 15 bp, Homo sapiens
cctcagcctggccag

SEQ ID NO: 3630781 - DNA, 16 bp, Homo sapiens
cctcagcctggccaga

SEQ ID NO: 3630782 - DNA, 17 bp, Homo sapiens
cctcagcctggccagac

SEQ ID NO: 3630783 - DNA, 20 bp, Homo sapiens
cctcagccttgccagagatc

SEQ ID NO: 3630784 - DNA, 21 bp, Homo sapiens
cctcagccttgccagagatcc

SEQ ID NO: 3630785 - DNA, 19 bp, Homo sapiens
cctcagctccctgcctgtt

SEQ ID NO: 3630786 - DNA, 18 bp, Homo sapiens
cctcagctgcctcctgcg

SEQ ID NO: 3630787 - DNA, 12 bp, Homo sapiens
cctcaggagccg

SEQ ID NO: 3630788 - DNA, 21 bp, Homo sapiens
cctcaggagccgaagcccagg

SEQ ID NO: 3630789 - DNA, 20 bp, Homo sapiens
cctcaggccaccctccacga

SEQ ID NO: 3630790 - DNA, 12 bp, Homo sapiens
cctcaggctcct

SEQ ID NO: 3630791 - DNA, 18 bp, Homo sapiens
cctcagtggatcttcaga

SEQ ID NO: 3630792 - DNA, 22 bp, Homo sapiens
cctcagttgaaaatgcaactct

SEQ ID NO: 3630793 - DNA, 23 bp, Homo sapiens
cctcagttttatgccccattgga

SEQ ID NO: 3630794 - DNA, 15 bp, Homo sapiens
cctcatcagccttgg

SEQ ID NO: 3630795 - DNA, 17 bp, Homo sapiens
cctcatctctctgccca

SEQ ID NO: 3630796 - DNA, 19 bp, Homo sapiens
cctcatctctctgcccaac

SEQ ID NO: 3630797 - DNA, 20 bp, Homo sapiens
cctcatctctctgcccaacc

SEQ ID NO: 3630798 - DNA, 13 bp, Homo sapiens
cctcatctgagag

SEQ ID NO: 3630799 - DNA, 19 bp, Homo sapiens
cctcatctgagaggctctc

SEQ ID NO: 3630800 - DNA, 15 bp, Homo sapiens
cctcatctgtggagc

SEQ ID NO: 3630801 - DNA, 18 bp, Homo sapiens
cctcatctgtggagctgc

SEQ ID NO: 3630802 - DNA, 14 bp, Homo sapiens
cctcattcagtaag

SEQ ID NO: 3630803 - DNA, 21 bp, Homo sapiens
cctcattctggttccctgctg

SEQ ID NO: 3630804 - DNA, 15 bp, Homo sapiens
cctccaaacctccag

SEQ ID NO: 3630805 - DNA, 17 bp, Homo sapiens
cctccaaacctccagcc

SEQ ID NO: 3630806 - DNA, 19 bp, Homo sapiens
cctccaaacctccagcctc

SEQ ID NO: 3630807 - DNA, 20 bp, Homo sapiens
cctccaaaggaactctagag

SEQ ID NO: 3630808 - DNA, 18 bp, Homo sapiens
cctccaacgcccctgtgg

SEQ ID NO: 3630809 - DNA, 14 bp, Homo sapiens
cctccaagcatttc

SEQ ID NO: 3630810 - DNA, 17 bp, Homo sapiens
cctccaagcatttcatg

SEQ ID NO: 3630811 - DNA, 22 bp, Homo sapiens
cctccaatcccaccaaccctca

SEQ ID NO: 3630812 - DNA, 14 bp, Homo sapiens
cctccacacccacc

SEQ ID NO: 3630813 - DNA, 20 bp, Homo sapiens
cctccacacccaccccctct

SEQ ID NO: 3630814 - DNA, 18 bp, Homo sapiens
cctccacatgctgcctgg

SEQ ID NO: 3630815 - DNA, 19 bp, Homo sapiens
cctccacatgctgcctggc

SEQ ID NO: 3630816 - DNA, 21 bp, Homo sapiens
cctccacatgctgcctggcac

SEQ ID NO: 3630817 - DNA, 16 bp, Homo sapiens
cctccagactcagcag

SEQ ID NO: 3630818 - DNA, 16 bp, Homo sapiens
cctccagaggtcctcc

SEQ ID NO: 3630819 - DNA, 14 bp, Homo sapiens
cctccagcctcccc

SEQ ID NO: 3630820 - DNA, 16 bp, Homo sapiens
cctccagcctcccctc

SEQ ID NO: 3630821 - DNA, 22 bp, Homo sapiens
cctccagcctccctgtctccag

SEQ ID NO: 3630822 - DNA, 15 bp, Homo sapiens
cctccaggagagagc

SEQ ID NO: 3630823 - DNA, 21 bp, Homo sapiens
cctccaggtcggagtgcctgg

SEQ ID NO: 3630824 - DNA, 21 bp, Homo sapiens
cctccaggtttttcaattaaa

SEQ ID NO: 3630825 - DNA, 19 bp, Homo sapiens
cctccagtgtcagggtcca

SEQ ID NO: 3630826 - DNA, 17 bp, Homo sapiens
cctccagttttgcctga

SEQ ID NO: 3630827 - DNA, 18 bp, Homo sapiens
cctccagttttgcctgag

SEQ ID NO: 3630828 - DNA, 23 bp, Homo sapiens
cctccatgcactttatgtggaga

SEQ ID NO: 3630829 - DNA, 13 bp, Homo sapiens
cctccatgcctga

SEQ ID NO: 3630830 - DNA, 19 bp, Homo sapiens
cctcccaatttcagactcc

SEQ ID NO: 3630831 - DNA, 11 bp, Homo sapiens
cctcccaccag

SEQ ID NO: 3630832 - DNA, 15 bp, Homo sapiens
cctcccaccagagcc

SEQ ID NO: 3630833 - DNA, 14 bp, Homo sapiens
cctcccactgccca

SEQ ID NO: 3630834 - DNA, 18 bp, Homo sapiens
cctcccagacaggccctc

SEQ ID NO: 3630835 - DNA, 21 bp, Homo sapiens
cctcccagaggagccaccagt

SEQ ID NO: 3630836 - DNA, 23 bp, Homo sapiens
cctcccagaggagccaccagttc

SEQ ID NO: 3630837 - DNA, 14 bp, Homo sapiens
cctccccacccgct

SEQ ID NO: 3630838 - DNA, 15 bp, Homo sapiens
cctccccacccgctc

SEQ ID NO: 3630839 - DNA, 18 bp, Homo sapiens
cctcccccagccactccc

SEQ ID NO: 3630840 - DNA, 17 bp, Homo sapiens
cctcccccattccctcc

SEQ ID NO: 3630841 - DNA, 19 bp, Homo sapiens
cctcccccccatgcactgt

SEQ ID NO: 3630842 - DNA, 12 bp, Homo sapiens
cctccccctcct

SEQ ID NO: 3630843 - DNA, 20 bp, Homo sapiens
cctccccctttcacactgga

SEQ ID NO: 3630844 - DNA, 14 bp, Homo sapiens
cctcccctcccctg

SEQ ID NO: 3630845 - DNA, 20 bp, Homo sapiens
cctcccgaaaaatgtgtggt

SEQ ID NO: 3630846 - DNA, 22 bp, Homo sapiens
cctcccgaaaaatgtgtggttc

SEQ ID NO: 3630847 - DNA, 14 bp, Homo sapiens
cctcccgccccgcc

SEQ ID NO: 3630848 - DNA, 13 bp, Homo sapiens
cctcccggtgccc

SEQ ID NO: 3630849 - DNA, 22 bp, Homo sapiens
cctccctaccctaaccaagttc

SEQ ID NO: 3630850 - DNA, 13 bp, Homo sapiens
cctccctctccag

SEQ ID NO: 3630851 - DNA, 19 bp, Homo sapiens
cctccctgaagcctttgca

SEQ ID NO: 3630852 - DNA, 24 bp, Homo sapiens
cctccctgcccctcccttcaacca

SEQ ID NO: 3630853 - DNA, 14 bp, Homo sapiens
cctccctgcctgct

SEQ ID NO: 3630854 - DNA, 16 bp, Homo sapiens
cctccctgcctgctcc

SEQ ID NO: 3630855 - DNA, 15 bp, Homo sapiens
cctccctgtctccag

SEQ ID NO: 3630856 - DNA, 16 bp, Homo sapiens
cctccctgtctccagg

SEQ ID NO: 3630857 - DNA, 18 bp, Homo sapiens
cctccctgttccccagag

SEQ ID NO: 3630858 - DNA, 18 bp, Homo sapiens
cctccggcgggtgacagc

SEQ ID NO: 3630859 - DNA, 22 bp, Homo sapiens
cctccggcgggtgacagctccg

SEQ ID NO: 3630860 - DNA, 19 bp, Homo sapiens
cctccgtcactacctggct

SEQ ID NO: 3630861 - DNA, 20 bp, Homo sapiens
cctccgtcactacctggctg

SEQ ID NO: 3630862 - DNA, 18 bp, Homo sapiens
cctcctaaatgtcagctg

SEQ ID NO: 3630863 - DNA, 15 bp, Homo sapiens
cctcctaccctccca

SEQ ID NO: 3630864 - DNA, 23 bp, Homo sapiens
cctcctaccctcccaccagaacg

SEQ ID NO: 3630865 - DNA, 17 bp, Homo sapiens
cctcctatctccctggc

SEQ ID NO: 3630866 - DNA, 13 bp, Homo sapiens
cctcctcacccac

SEQ ID NO: 3630867 - DNA, 14 bp, Homo sapiens
cctcctcacccacc

SEQ ID NO: 3630868 - DNA, 13 bp, Homo sapiens
cctcctcagctcc

SEQ ID NO: 3630869 - DNA, 14 bp, Homo sapiens
cctcctcagctccc

SEQ ID NO: 3630870 - DNA, 22 bp, Homo sapiens
cctcctcagggatcacactgcc

SEQ ID NO: 3630871 - DNA, 23 bp, Homo sapiens
cctcctcatctgggggagtggaa

SEQ ID NO: 3630872 - DNA, 15 bp, Homo sapiens
cctcctcccaaggca

SEQ ID NO: 3630873 - DNA, 13 bp, Homo sapiens
cctcctctgctgg

SEQ ID NO: 3630874 - DNA, 13 bp, Homo sapiens
cctcctgccccct

SEQ ID NO: 3630875 - DNA, 16 bp, Homo sapiens
cctcctgccccctgcc

SEQ ID NO: 3630876 - DNA, 11 bp, Homo sapiens
cctcctgggaa

SEQ ID NO: 3630877 - DNA, 16 bp, Homo sapiens
cctccttgtgttgcac

SEQ ID NO: 3630878 - DNA, 22 bp, Homo sapiens
cctcctttcattaccctacaga

SEQ ID NO: 3630879 - DNA, 20 bp, Homo sapiens
cctcgacagggcctggagcc

SEQ ID NO: 3630880 - DNA, 18 bp, Homo sapiens
cctcgccggatctgaggg

SEQ ID NO: 3630881 - DNA, 12 bp, Homo sapiens
cctcggagaaga

SEQ ID NO: 3630882 - DNA, 16 bp, Homo sapiens
cctcggtatctggctt

SEQ ID NO: 3630883 - DNA, 18 bp, Homo sapiens
cctcgtcaagagcatgca

SEQ ID NO: 3630884 - DNA, 23 bp, Homo sapiens
cctcgtgaggggcaagctaggcc

SEQ ID NO: 3630885 - DNA, 20 bp, Homo sapiens
cctcgtgctccgcagggcgc

SEQ ID NO: 3630886 - DNA, 23 bp, Homo sapiens
cctcgtgctggcggacgcagctg

SEQ ID NO: 3630887 - DNA, 20 bp, Homo sapiens
cctcgtgggtcccagagacc

SEQ ID NO: 3630888 - DNA, 18 bp, Homo sapiens
cctctagtagtatattta

SEQ ID NO: 3630889 - DNA, 17 bp, Homo sapiens
cctctcagaggcctgct

SEQ ID NO: 3630890 - DNA, 15 bp, Homo sapiens
cctctcagtactttg

SEQ ID NO: 3630891 - DNA, 23 bp, Homo sapiens
ccttccatgtgcctttctttgcc

SEQ ID NO: 3630892 - DNA, 18 bp, Homo sapiens
ccttcccatttctctaca

SEQ ID NO: 3630893 - DNA, 15 bp, Homo sapiens
ccttcccatttcttc

SEQ ID NO: 3630894 - DNA, 19 bp, Homo sapiens
ccttccccagctccagcag

SEQ ID NO: 3630895 - DNA, 12 bp, Homo sapiens
ccttcccctccc

SEQ ID NO: 3630896 - DNA, 24 bp, Homo sapiens
ccttccctcaccttggcaccagac

SEQ ID NO: 3630897 - DNA, 12 bp, Homo sapiens
ccttccctggga

SEQ ID NO: 3630898 - DNA, 17 bp, Homo sapiens
ccttccctgttctccct

SEQ ID NO: 3630899 - DNA, 23 bp, Homo sapiens
ccttccctgttctccctttctct

SEQ ID NO: 3630900 - DNA, 16 bp, Homo sapiens
ccttcctcagctgcct

SEQ ID NO: 3630901 - DNA, 19 bp, Homo sapiens
ccttcctcagctgcctcct

SEQ ID NO: 3630902 - DNA, 20 bp, Homo sapiens
ccttcctcagctgcctcctg

SEQ ID NO: 3630903 - DNA, 20 bp, Homo sapiens
ccttcctctccactgccttc

SEQ ID NO: 3630904 - DNA, 21 bp, Homo sapiens
ccttcctctccactgccttcg

SEQ ID NO: 3630905 - DNA, 14 bp, Homo sapiens
ccttcctgctgctg

SEQ ID NO: 3630906 - DNA, 18 bp, Homo sapiens
ccttcctgctgctgctac

SEQ ID NO: 3630907 - DNA, 16 bp, Homo sapiens
ccttcctggaaacagc

SEQ ID NO: 3630908 - DNA, 21 bp, Homo sapiens
ccttcctggaaacagcatgaa

SEQ ID NO: 3630909 - DNA, 19 bp, Homo sapiens
ccttcctggggcatctggc

SEQ ID NO: 3630910 - DNA, 14 bp, Homo sapiens
ccttcgggctgtgc

SEQ ID NO: 3630911 - DNA, 22 bp, Homo sapiens
ccttctaaaggtgttgtccctt

SEQ ID NO: 3630912 - DNA, 16 bp, Homo sapiens
ccttctaaattcccaa

SEQ ID NO: 3630913 - DNA, 20 bp, Homo sapiens
ccttctagggttattgcatt

SEQ ID NO: 3630914 - DNA, 18 bp, Homo sapiens
ccttctatacccacccag

SEQ ID NO: 3630915 - DNA, 20 bp, Homo sapiens
ccttctatacccacccagaa

SEQ ID NO: 3630916 - DNA, 14 bp, Homo sapiens
ccttctctgcctca

SEQ ID NO: 3630917 - DNA, 13 bp, Homo sapiens
ccttctctgggtc

SEQ ID NO: 3630918 - DNA, 20 bp, Homo sapiens
ccttctctgggtctgatttt

SEQ ID NO: 3630919 - DNA, 18 bp, Homo sapiens
ccttctggcctcccacag

SEQ ID NO: 3630920 - DNA, 20 bp, Homo sapiens
ccttctggcctcccacagac

SEQ ID NO: 3630921 - DNA, 21 bp, Homo sapiens
ccttctgtggctcacagaacc

SEQ ID NO: 3630922 - DNA, 15 bp, Homo sapiens
ccttcttgtcaccag

SEQ ID NO: 3630923 - DNA, 20 bp, Homo sapiens
ccttctttggttccatgttg

SEQ ID NO: 3630924 - DNA, 14 bp, Homo sapiens
ccttctttttcttc

SEQ ID NO: 3630925 - DNA, 16 bp, Homo sapiens
ccttctttttcttctt

SEQ ID NO: 3630926 - DNA, 21 bp, Homo sapiens
ccttgaggaaacaacagcttt

SEQ ID NO: 3630927 - DNA, 15 bp, Homo sapiens
ccttgaggtgaaatg

SEQ ID NO: 3630928 - DNA, 15 bp, Homo sapiens
ccttgattacttcca

SEQ ID NO: 3630929 - DNA, 19 bp, Homo sapiens
ccttgattacttccactga

SEQ ID NO: 3630930 - DNA, 17 bp, Homo sapiens
ccttgccacattaaatt

SEQ ID NO: 3630931 - DNA, 18 bp, Homo sapiens
ccttgccacattaaattg

SEQ ID NO: 3630932 - DNA, 16 bp, Homo sapiens
ccttgccccacctccc

SEQ ID NO: 3630933 - DNA, 23 bp, Homo sapiens
ccttgcctaaatttaatgctgcc

SEQ ID NO: 3630934 - DNA, 11 bp, Homo sapiens
ccttgcctctg

SEQ ID NO: 3630935 - DNA, 14 bp, Homo sapiens
ccttgctctcctca

SEQ ID NO: 3630936 - DNA, 17 bp, Homo sapiens
ccttgctctcctcatct

SEQ ID NO: 3630937 - DNA, 22 bp, Homo sapiens
ccttgctgcaagcacagccctt

SEQ ID NO: 3630938 - DNA, 15 bp, Homo sapiens
ccttgctttcctggg

SEQ ID NO: 3630939 - DNA, 15 bp, Homo sapiens
ccttgctttcggagc

SEQ ID NO: 3630940 - DNA, 20 bp, Homo sapiens
ccttgctttcggagctcctg

SEQ ID NO: 3630941 - DNA, 21 bp, Homo sapiens
ccttgctttcggagctcctgt

SEQ ID NO: 3630942 - DNA, 16 bp, Homo sapiens
ccttggaacaccctgg

SEQ ID NO: 3630943 - DNA, 17 bp, Homo sapiens
ccttggaacaccctgga

SEQ ID NO: 3630944 - DNA, 19 bp, Homo sapiens
ccttggaacaccctggatg

SEQ ID NO: 3630945 - DNA, 15 bp, Homo sapiens
ccttggactcatttt

SEQ ID NO: 3630946 - DNA, 11 bp, Homo sapiens
ccttggactcc

SEQ ID NO: 3630947 - DNA, 17 bp, Homo sapiens
ccttggaggagagagac

SEQ ID NO: 3630948 - DNA, 19 bp, Homo sapiens
ccttggaggagagagaccc

SEQ ID NO: 3630949 - DNA, 22 bp, Homo sapiens
ccttggatcctgaatctgtgca

SEQ ID NO: 3630950 - DNA, 15 bp, Homo sapiens
ccttggcaccagaca

SEQ ID NO: 3630951 - DNA, 21 bp, Homo sapiens
ccttggcaccagacacccagg

SEQ ID NO: 3630952 - DNA, 22 bp, Homo sapiens
ccttggcaccagacacccagga

SEQ ID NO: 3630953 - DNA, 23 bp, Homo sapiens
ccttggcaccagacacccaggac

SEQ ID NO: 3630954 - DNA, 17 bp, Homo sapiens
ccttggccatgcagaaa

SEQ ID NO: 3630955 - DNA, 18 bp, Homo sapiens
ccttggcctttacagaaa

SEQ ID NO: 3630956 - DNA, 21 bp, Homo sapiens
ccttggctcccgggggcccca

SEQ ID NO: 3630957 - DNA, 18 bp, Homo sapiens
ccttggctttcagagcca

SEQ ID NO: 3630958 - DNA, 19 bp, Homo sapiens
ccttggctttcagagccag

SEQ ID NO: 3630959 - DNA, 22 bp, Homo sapiens
ccttgggatagcaaactccagg

SEQ ID NO: 3630960 - DNA, 14 bp, Homo sapiens
ccttgggatccagg

SEQ ID NO: 3630961 - DNA, 22 bp, Homo sapiens
ccttggtttagaggaacccaag

SEQ ID NO: 3630962 - DNA, 20 bp, Homo sapiens
ccttgtacagtctgctcctc

SEQ ID NO: 3630963 - DNA, 22 bp, Homo sapiens
ccttgtcacgatcacaggcctt

SEQ ID NO: 3630964 - DNA, 16 bp, Homo sapiens
ccttgtggcctatgaa

SEQ ID NO: 3630965 - DNA, 20 bp, Homo sapiens
ccttgtgttgcactgaacag

SEQ ID NO: 3630966 - DNA, 23 bp, Homo sapiens
ccttgtgttgcactgaacaggtt

SEQ ID NO: 3630967 - DNA, 21 bp, Homo sapiens
cctttaaaacgcgtctgcctg

SEQ ID NO: 3630968 - DNA, 15 bp, Homo sapiens
cctttaagaacctta

SEQ ID NO: 3630969 - DNA, 14 bp, Homo sapiens
cctttaagccaaag

SEQ ID NO: 3630970 - DNA, 22 bp, Homo sapiens
cctttaagccaaagaaacaagc

SEQ ID NO: 3630971 - DNA, 15 bp, Homo sapiens
cctttacaactaaat

SEQ ID NO: 3630972 - DNA, 16 bp, Homo sapiens
cctttatctttcacct

SEQ ID NO: 3630973 - DNA, 14 bp, Homo sapiens
cctttatttattaa

SEQ ID NO: 3630974 - DNA, 18 bp, Homo sapiens
cctttatttattaaactt

SEQ ID NO: 3630975 - DNA, 23 bp, Homo sapiens
cctttatttattaaacttcagca

SEQ ID NO: 3630976 - DNA, 21 bp, Homo sapiens
cctttcaaagcacttaagtgt

SEQ ID NO: 3630977 - DNA, 13 bp, Homo sapiens
cctttccaggaat

SEQ ID NO: 3630978 - DNA, 13 bp, Homo sapiens
cctttcccttggt

SEQ ID NO: 3630979 - DNA, 14 bp, Homo sapiens
cctttctcctttgt

SEQ ID NO: 3630980 - DNA, 17 bp, Homo sapiens
cctttctctctcctctc

SEQ ID NO: 3630981 - DNA, 18 bp, Homo sapiens
cctttctctctcctctct

SEQ ID NO: 3630982 - DNA, 16 bp, Homo sapiens
cctttctctgggctta

SEQ ID NO: 3630983 - DNA, 13 bp, Homo sapiens
cctttctttgcct

SEQ ID NO: 3630984 - DNA, 17 bp, Homo sapiens
cctttctttgcctctgc

SEQ ID NO: 3630985 - DNA, 18 bp, Homo sapiens
cctttctttgcctctgca

SEQ ID NO: 3630986 - DNA, 13 bp, Homo sapiens
cctttgaagaagg

SEQ ID NO: 3630987 - DNA, 11 bp, Homo sapiens
cctttggcctg

SEQ ID NO: 3630988 - DNA, 19 bp, Homo sapiens
cctttgggtgctgttttgc

SEQ ID NO: 3630989 - DNA, 21 bp, Homo sapiens
cctttgggtgctgttttgcca

SEQ ID NO: 3630990 - DNA, 19 bp, Homo sapiens
cctttgtctttctttgtca

SEQ ID NO: 3630991 - DNA, 11 bp, Homo sapiens
ccttttatata

SEQ ID NO: 3630992 - DNA, 15 bp, Homo sapiens
ccttttatgtatttt

SEQ ID NO: 3630993 - DNA, 14 bp, Homo sapiens
ccttttcaaattaa

SEQ ID NO: 3630994 - DNA, 14 bp, Homo sapiens
ccttttcaggagat

SEQ ID NO: 3630995 - DNA, 17 bp, Homo sapiens
ccttttcctatccttat

SEQ ID NO: 3630996 - DNA, 14 bp, Homo sapiens
ccttttctcttttc

SEQ ID NO: 3630997 - DNA, 13 bp, Homo sapiens
ccttttgacactg

SEQ ID NO: 3630998 - DNA, 12 bp, Homo sapiens
ccttttgggaag

SEQ ID NO: 3630999 - DNA, 13 bp, Homo sapiens
ccttttgttttct

SEQ ID NO: 3631000 - DNA, 24 bp, Homo sapiens
ccttttttcaatatgcaagcagct

SEQ ID NO: 3631001 - DNA, 10 bp, Homo sapiens
cgaaaaatgt

SEQ ID NO: 3631002 - DNA, 13 bp, Homo sapiens
cgaaaaccaggcc

SEQ ID NO: 3631003 - DNA, 22 bp, Homo sapiens
cgaaaaccaggccttatctcca

SEQ ID NO: 3631004 - DNA, 21 bp, Homo sapiens
cgaaactccatctcaaaacaa

SEQ ID NO: 3631005 - DNA, 22 bp, Homo sapiens
cgaaactccatctcaaaacaaa

SEQ ID NO: 3631006 - DNA, 18 bp, Homo sapiens
cgaaatgctgtctttctt

SEQ ID NO: 3631007 - DNA, 12 bp, Homo sapiens
cgaacatgtgtt

SEQ ID NO: 3631008 - DNA, 13 bp, Homo sapiens
cgaacatgtgttt

SEQ ID NO: 3631009 - DNA, 15 bp, Homo sapiens
cgaagggattgtgta

SEQ ID NO: 3631010 - DNA, 16 bp, Homo sapiens
cgaaggggaggcacac

SEQ ID NO: 3631011 - DNA, 22 bp, Homo sapiens
cgaaggggaggcacactttctg

SEQ ID NO: 3631012 - DNA, 16 bp, Homo sapiens
cgaatctagaggaggg

SEQ ID NO: 3631013 - DNA, 21 bp, Homo sapiens
cgacaaaaacgaaactccatc

SEQ ID NO: 3631014 - DNA, 19 bp, Homo sapiens
cgacacacggggctcgggc

SEQ ID NO: 3631015 - DNA, 20 bp, Homo sapiens
cgacacacggggctcgggcc

SEQ ID NO: 3631016 - DNA, 14 bp, Homo sapiens
cgacagcctggcac

SEQ ID NO: 3631017 - DNA, 16 bp, Homo sapiens
cgaccacgccccagga

SEQ ID NO: 3631018 - DNA, 17 bp, Homo sapiens
cgaccacgccccaggac

SEQ ID NO: 3631019 - DNA, 13 bp, Homo sapiens
cgactcagcctca

SEQ ID NO: 3631020 - DNA, 12 bp, Homo sapiens
cgactcagggac

SEQ ID NO: 3631021 - DNA, 16 bp, Homo sapiens
cgactctttgatatgc

SEQ ID NO: 3631022 - DNA, 19 bp, Homo sapiens
cgactgactggaggaggcc

SEQ ID NO: 3631023 - DNA, 19 bp, Homo sapiens
ctacttatgaaatgtgcac

SEQ ID NO: 3631024 - DNA, 22 bp, Homo sapiens
ctacttcttttgctcttagctg

SEQ ID NO: 3631025 - DNA, 18 bp, Homo sapiens
ctactttataactaacat

SEQ ID NO: 3631026 - DNA, 19 bp, Homo sapiens
ctactttataactaacatg

SEQ ID NO: 3631027 - DNA, 24 bp, Homo sapiens
ctactttggcattgctgcatattt

SEQ ID NO: 3631028 - DNA, 14 bp, Homo sapiens
ctagaacacaggca

SEQ ID NO: 3631029 - DNA, 22 bp, Homo sapiens
ctagaacacaggcaaaatcctt

SEQ ID NO: 3631030 - DNA, 20 bp, Homo sapiens
ctagaacattccatttgctt

SEQ ID NO: 3631031 - DNA, 21 bp, Homo sapiens
ctagaacattccatttgcttg

SEQ ID NO: 3631032 - DNA, 13 bp, Homo sapiens
ctagaactcctgt

SEQ ID NO: 3631033 - DNA, 21 bp, Homo sapiens
ctagaagatgcagttcaaaaa

SEQ ID NO: 3631034 - DNA, 20 bp, Homo sapiens
ctagaattctgtattggata

SEQ ID NO: 3631035 - DNA, 13 bp, Homo sapiens
ctagacacagata

SEQ ID NO: 3631036 - DNA, 22 bp, Homo sapiens
ctagactactcaatattaaagg

SEQ ID NO: 3631037 - DNA, 15 bp, Homo sapiens
ctagactgctcctgg

SEQ ID NO: 3631038 - DNA, 14 bp, Homo sapiens
ctagacttgaaagt

SEQ ID NO: 3631039 - DNA, 16 bp, Homo sapiens
ctagacttgaaagttt

SEQ ID NO: 3631040 - DNA, 16 bp, Homo sapiens
ctagagacaaatcttt

SEQ ID NO: 3631041 - DNA, 17 bp, Homo sapiens
ctagagacgctgatcca

SEQ ID NO: 3631042 - DNA, 14 bp, Homo sapiens
ctagagggacctct

SEQ ID NO: 3631043 - DNA, 16 bp, Homo sapiens
ctagagggacctctcc

SEQ ID NO: 3631044 - DNA, 21 bp, Homo sapiens
ctagagggacctctcccaggg

SEQ ID NO: 3631045 - DNA, 15 bp, Homo sapiens
ctagagggcgaggga

SEQ ID NO: 3631046 - DNA, 22 bp, Homo sapiens
ctagagtaaaagtcccagttaa

SEQ ID NO: 3631047 - DNA, 22 bp, Homo sapiens
ctagataatagggttttcagat

SEQ ID NO: 3631048 - DNA, 17 bp, Homo sapiens
ctagatagctattaaga

SEQ ID NO: 3631049 - DNA, 14 bp, Homo sapiens
ctagatccagccca

SEQ ID NO: 3631050 - DNA, 14 bp, Homo sapiens
ctagatggctcctc

SEQ ID NO: 3631051 - DNA, 18 bp, Homo sapiens
ctagatggctcctctcag

SEQ ID NO: 3631052 - DNA, 20 bp, Homo sapiens
ctagatgtagtattttttgt

SEQ ID NO: 3631053 - DNA, 12 bp, Homo sapiens
ctagcacacctg

SEQ ID NO: 3631054 - DNA, 14 bp, Homo sapiens
ctagcaccatggca

SEQ ID NO: 3631055 - DNA, 13 bp, Homo sapiens
ctagccctggtta

SEQ ID NO: 3631056 - DNA, 19 bp, Homo sapiens
ctagccctggttagctgac

SEQ ID NO: 3631057 - DNA, 20 bp, Homo sapiens
ctagccctggttagctgaca

SEQ ID NO: 3631058 - DNA, 15 bp, Homo sapiens
ctagcctctggactg

SEQ ID NO: 3631059 - DNA, 14 bp, Homo sapiens
ctagcggagcccag

SEQ ID NO: 3631060 - DNA, 16 bp, Homo sapiens
ctagcggagcccagcc

SEQ ID NO: 3631061 - DNA, 20 bp, Homo sapiens
ctagcggagcccagcctggg

SEQ ID NO: 3631062 - DNA, 14 bp, Homo sapiens
ctagctaattattt

SEQ ID NO: 3631063 - DNA, 15 bp, Homo sapiens
ctagctaattattta

SEQ ID NO: 3631064 - DNA, 18 bp, Homo sapiens
ctagctaggagcaggctt

SEQ ID NO: 3631065 - DNA, 16 bp, Homo sapiens
ctagctctcacagaca

SEQ ID NO: 3631066 - DNA, 20 bp, Homo sapiens
ctagctgaccccgagaagtg

SEQ ID NO: 3631067 - DNA, 16 bp, Homo sapiens
ctaggaaccctggagg

SEQ ID NO: 3631068 - DNA, 17 bp, Homo sapiens
ctaggaatgaaatcctg

SEQ ID NO: 3631069 - DNA, 18 bp, Homo sapiens
ctaggagatgttgggaac

SEQ ID NO: 3631070 - DNA, 15 bp, Homo sapiens
ctaggagcaggcttg

SEQ ID NO: 3631071 - DNA, 20 bp, Homo sapiens
ctaggaggagctagtaggaa

SEQ ID NO: 3631072 - DNA, 22 bp, Homo sapiens
ctaggataacttgctttcttct

SEQ ID NO: 3631073 - DNA, 14 bp, Homo sapiens
ctaggcactgagca

SEQ ID NO: 3631074 - DNA, 16 bp, Homo sapiens
ctaggcactgagcagg

SEQ ID NO: 3631075 - DNA, 19 bp, Homo sapiens
ctaggccccagaggccctg

SEQ ID NO: 3631076 - DNA, 21 bp, Homo sapiens
ctaggccccagaggccctgga

SEQ ID NO: 3631077 - DNA, 14 bp, Homo sapiens
ctaggccctgtgag

SEQ ID NO: 3631078 - DNA, 18 bp, Homo sapiens
ctaggccctgtgagcaca

SEQ ID NO: 3631079 - DNA, 22 bp, Homo sapiens
ctaggccctgtgagcacaaaga

SEQ ID NO: 3631080 - DNA, 13 bp, Homo sapiens
ctaggcctcagcc

SEQ ID NO: 3631081 - DNA, 16 bp, Homo sapiens
ctaggcctcagccaga

SEQ ID NO: 3631082 - DNA, 18 bp, Homo sapiens
ctaggcctttcctctgca

SEQ ID NO: 3631083 - DNA, 22 bp, Homo sapiens
ctaggctcttatgtgtgccttt

SEQ ID NO: 3631084 - DNA, 14 bp, Homo sapiens
ctagggtccctgaa

SEQ ID NO: 3631085 - DNA, 19 bp, Homo sapiens
ctaggtgcagctcctcagc

SEQ ID NO: 3631086 - DNA, 14 bp, Homo sapiens
ctaggtgcccaggg

SEQ ID NO: 3631087 - DNA, 18 bp, Homo sapiens
ctaggtgcccagggccag

SEQ ID NO: 3631088 - DNA, 16 bp, Homo sapiens
ctagtaaaaatacaaa

SEQ ID NO: 3631089 - DNA, 15 bp, Homo sapiens
ctagtacctgtgact

SEQ ID NO: 3631090 - DNA, 18 bp, Homo sapiens
ctagtagtatatttaatt

SEQ ID NO: 3631091 - DNA, 16 bp, Homo sapiens
ctagtagtgtggcctg

SEQ ID NO: 3631092 - DNA, 20 bp, Homo sapiens
ctagtcatttgttaatattt

SEQ ID NO: 3631093 - DNA, 12 bp, Homo sapiens
ctagtccttgtt

SEQ ID NO: 3631094 - DNA, 19 bp, Homo sapiens
ctagtgaccccttccctgt

SEQ ID NO: 3631095 - DNA, 20 bp, Homo sapiens
ctagtggagttttataaatt

SEQ ID NO: 3631096 - DNA, 22 bp, Homo sapiens
ctagtggtatggggctgagccc

SEQ ID NO: 3631097 - DNA, 19 bp, Homo sapiens
ctagtgtccataaataaag

SEQ ID NO: 3631098 - DNA, 14 bp, Homo sapiens
ctagtgtgactcct

SEQ ID NO: 3631099 - DNA, 14 bp, Homo sapiens
ctagtgttgtattt

SEQ ID NO: 3631100 - DNA, 16 bp, Homo sapiens
ctagtgttgtatttct

SEQ ID NO: 3631101 - DNA, 15 bp, Homo sapiens
ctagttctttcctcc

SEQ ID NO: 3631102 - DNA, 18 bp, Homo sapiens
ctagttgcccccattccc

SEQ ID NO: 3631103 - DNA, 16 bp, Homo sapiens
ctagttttctcctccc

SEQ ID NO: 3631104 - DNA, 20 bp, Homo sapiens
ctataaagggcccacacctg

SEQ ID NO: 3631105 - DNA, 13 bp, Homo sapiens
ctataaagtgcct

SEQ ID NO: 3631106 - DNA, 17 bp, Homo sapiens
ctataaattcctctttg

SEQ ID NO: 3631107 - DNA, 19 bp, Homo sapiens
ctataaattcctctttgct

SEQ ID NO: 3631108 - DNA, 19 bp, Homo sapiens
ctataaattttttgaaaca

SEQ ID NO: 3631109 - DNA, 23 bp, Homo sapiens
ctataaattttttgaaacacaat

SEQ ID NO: 3631110 - DNA, 21 bp, Homo sapiens
ctataacagatcctttcaaaa

SEQ ID NO: 3631111 - DNA, 22 bp, Homo sapiens
ctataatttacctaagattaca

SEQ ID NO: 3631112 - DNA, 15 bp, Homo sapiens
ctatactgtggcctg

SEQ ID NO: 3631113 - DNA, 16 bp, Homo sapiens
ctatactgtggcctgc

SEQ ID NO: 3631114 - DNA, 21 bp, Homo sapiens
ctatactgtggcctgcaggag

SEQ ID NO: 3631115 - DNA, 13 bp, Homo sapiens
ctatagcctgggg

SEQ ID NO: 3631116 - DNA, 14 bp, Homo sapiens
ctatagcctggggt

SEQ ID NO: 3631117 - DNA, 18 bp, Homo sapiens
ctatagcctggggtgggg

SEQ ID NO: 3631118 - DNA, 15 bp, Homo sapiens
ctatagctaagtaca

SEQ ID NO: 3631119 - DNA, 15 bp, Homo sapiens
ctatagctacatgtt

SEQ ID NO: 3631120 - DNA, 20 bp, Homo sapiens
ctatagtgacatgcagttat

SEQ ID NO: 3631121 - DNA, 21 bp, Homo sapiens
ctatataaaatgtattcaagc

SEQ ID NO: 3631122 - DNA, 18 bp, Homo sapiens
ctatatagaatgctgcac

SEQ ID NO: 3631123 - DNA, 17 bp, Homo sapiens
ctatatgaatgctattt

SEQ ID NO: 3631124 - DNA, 19 bp, Homo sapiens
ctatatgtgaaacattttt

SEQ ID NO: 3631125 - DNA, 21 bp, Homo sapiens
ctatatgtgaaacattttttc

SEQ ID NO: 3631126 - DNA, 22 bp, Homo sapiens
ctatatgtgaaacattttttct

SEQ ID NO: 3631127 - DNA, 15 bp, Homo sapiens
ctatattcctccagc

SEQ ID NO: 3631128 - DNA, 17 bp, Homo sapiens
ctatattcctccagctg

SEQ ID NO: 3631129 - DNA, 18 bp, Homo sapiens
ctatattcctccagctgg

SEQ ID NO: 3631130 - DNA, 21 bp, Homo sapiens
ctatattcctccagctgggat

SEQ ID NO: 3631131 - DNA, 22 bp, Homo sapiens
ctatattgcccaggctggtctt

SEQ ID NO: 3631132 - DNA, 12 bp, Homo sapiens
ctatatttgggc

SEQ ID NO: 3631133 - DNA, 22 bp, Homo sapiens
ctatatttgggcctgctccaga

SEQ ID NO: 3631134 - DNA, 19 bp, Homo sapiens
ctatcagaaatacaaaaaa

SEQ ID NO: 3631135 - DNA, 17 bp, Homo sapiens
ctatcagcaatgcccca

SEQ ID NO: 3631136 - DNA, 17 bp, Homo sapiens
ctatccttacatttcac

SEQ ID NO: 3631137 - DNA, 12 bp, Homo sapiens
ctatctcagcca

SEQ ID NO: 3631138 - DNA, 17 bp, Homo sapiens
ctatctcatctgtctcg

SEQ ID NO: 3631139 - DNA, 14 bp, Homo sapiens
ctatctccctggct

SEQ ID NO: 3631140 - DNA, 16 bp, Homo sapiens
ctatctccctggctca

SEQ ID NO: 3631141 - DNA, 13 bp, Homo sapiens
ctatctgcctgga

SEQ ID NO: 3631142 - DNA, 16 bp, Homo sapiens
ctatctgcctggaggc

SEQ ID NO: 3631143 - DNA, 24 bp, Homo sapiens
ctatctggccatatttactacctt

SEQ ID NO: 3631144 - DNA, 17 bp, Homo sapiens
ctatgaaacaatcttcc

SEQ ID NO: 3631145 - DNA, 16 bp, Homo sapiens
ctatgaaatactttat

SEQ ID NO: 3631146 - DNA, 23 bp, Homo sapiens
ctatgacagatatatttaagcct

SEQ ID NO: 3631147 - DNA, 22 bp, Homo sapiens
ctatgagatggccatgctcaac

SEQ ID NO: 3631148 - DNA, 16 bp, Homo sapiens
ctatgatactgtctct

SEQ ID NO: 3631149 - DNA, 21 bp, Homo sapiens
ctatgatcagaagaacatgat

SEQ ID NO: 3631150 - DNA, 21 bp, Homo sapiens
ctatgatggatggcagactct

SEQ ID NO: 3631151 - DNA, 22 bp, Homo sapiens
ctatgatggatggcagactctt

SEQ ID NO: 3631152 - DNA, 14 bp, Homo sapiens
ctatgattattaac

SEQ ID NO: 3631153 - DNA, 20 bp, Homo sapiens
ctatgatttaatttgaaata

SEQ ID NO: 3631154 - DNA, 22 bp, Homo sapiens
ctatgcaataatccacccccag

SEQ ID NO: 3631155 - DNA, 17 bp, Homo sapiens
ctcctcccaggcgcccc

SEQ ID NO: 3631156 - DNA, 22 bp, Homo sapiens
ctcctcccaggcgccccttccc

SEQ ID NO: 3631157 - DNA, 13 bp, Homo sapiens
ctcctcccgcccc

SEQ ID NO: 3631158 - DNA, 21 bp, Homo sapiens
ctcctcccgccccgcccctcc

SEQ ID NO: 3631159 - DNA, 15 bp, Homo sapiens
ctcctcccgcccttc

SEQ ID NO: 3631160 - DNA, 17 bp, Homo sapiens
ctcctcccggtgcccaa

SEQ ID NO: 3631161 - DNA, 16 bp, Homo sapiens
ctcctccctgcatctg

SEQ ID NO: 3631162 - DNA, 19 bp, Homo sapiens
ctcctcggagagcagcagc

SEQ ID NO: 3631163 - DNA, 23 bp, Homo sapiens
ctcctcggagagcagcagcacca

SEQ ID NO: 3631164 - DNA, 20 bp, Homo sapiens
ctcctctaggccctgtgagc

SEQ ID NO: 3631165 - DNA, 16 bp, Homo sapiens
ctcctctcaggctggg

SEQ ID NO: 3631166 - DNA, 18 bp, Homo sapiens
ctcctctcaggctgggcc

SEQ ID NO: 3631167 - DNA, 23 bp, Homo sapiens
ctcctctcccattgtccctctgc

SEQ ID NO: 3631168 - DNA, 21 bp, Homo sapiens
ctcctctccccagcccagaga

SEQ ID NO: 3631169 - DNA, 11 bp, Homo sapiens
ctcctctctgc

SEQ ID NO: 3631170 - DNA, 12 bp, Homo sapiens
ctcctctgcact

SEQ ID NO: 3631171 - DNA, 13 bp, Homo sapiens
ctcctctgctggg

SEQ ID NO: 3631172 - DNA, 15 bp, Homo sapiens
ctcctctgctgggaa

SEQ ID NO: 3631173 - DNA, 15 bp, Homo sapiens
ctcctcttgccactg

SEQ ID NO: 3631174 - DNA, 16 bp, Homo sapiens
ctcctcttgccactgc

SEQ ID NO: 3631175 - DNA, 15 bp, Homo sapiens
ctcctcttgttcctg

SEQ ID NO: 3631176 - DNA, 17 bp, Homo sapiens
ctcctcttgttcctgaa

SEQ ID NO: 3631177 - DNA, 24 bp, Homo sapiens
ctcctgaccttgggtcctgaagtg

SEQ ID NO: 3631178 - DNA, 18 bp, Homo sapiens
ctcctgagtgccccactt

SEQ ID NO: 3631179 - DNA, 19 bp, Homo sapiens
ctcctgagtgccccacttc

SEQ ID NO: 3631180 - DNA, 22 bp, Homo sapiens
ctcctgccacatggagccccct

SEQ ID NO: 3631181 - DNA, 13 bp, Homo sapiens
ctcctgccccctg

SEQ ID NO: 3631182 - DNA, 17 bp, Homo sapiens
ctcctgctggtacctgc

SEQ ID NO: 3631183 - DNA, 20 bp, Homo sapiens
ctcctgctggtacctgccct

SEQ ID NO: 3631184 - DNA, 22 bp, Homo sapiens
ctcctgctggtacctgccctct

SEQ ID NO: 3631185 - DNA, 13 bp, Homo sapiens
ctcctgcttttct

SEQ ID NO: 3631186 - DNA, 14 bp, Homo sapiens
ctcctggcagggcc

SEQ ID NO: 3631187 - DNA, 21 bp, Homo sapiens
ctcctggcagggccacctgca

SEQ ID NO: 3631188 - DNA, 14 bp, Homo sapiens
ctcctgggaacaca

SEQ ID NO: 3631189 - DNA, 15 bp, Homo sapiens
ctcctgggccggctg

SEQ ID NO: 3631190 - DNA, 19 bp, Homo sapiens
ctcctgggccggctgagtg

SEQ ID NO: 3631191 - DNA, 22 bp, Homo sapiens
ctcctgggggttctttcttcct

SEQ ID NO: 3631192 - DNA, 18 bp, Homo sapiens
ctcctgtacctcagtgga

SEQ ID NO: 3631193 - DNA, 17 bp, Homo sapiens
ctcctgtcccttttccc

SEQ ID NO: 3631194 - DNA, 18 bp, Homo sapiens
ctcctgtcccttttccct

SEQ ID NO: 3631195 - DNA, 23 bp, Homo sapiens
ctcctgtcttctttctccatgga

SEQ ID NO: 3631196 - DNA, 17 bp, Homo sapiens
ctccttatctctttcca

SEQ ID NO: 3631197 - DNA, 12 bp, Homo sapiens
ctccttcagcac

SEQ ID NO: 3631198 - DNA, 16 bp, Homo sapiens
ctccttcatgtttgga

SEQ ID NO: 3631199 - DNA, 18 bp, Homo sapiens
ctccttcatgtttggaaa

SEQ ID NO: 3631200 - DNA, 22 bp, Homo sapiens
ctccttcccatttctctacact

SEQ ID NO: 3631201 - DNA, 16 bp, Homo sapiens
ctccttggcaccccca

SEQ ID NO: 3631202 - DNA, 21 bp, Homo sapiens
ctccttggcacccccatgctg

SEQ ID NO: 3631203 - DNA, 15 bp, Homo sapiens
ctccttggccacaga

SEQ ID NO: 3631204 - DNA, 22 bp, Homo sapiens
ctcctttatctgtaattgtaat

SEQ ID NO: 3631205 - DNA, 23 bp, Homo sapiens
ctcctttatctgtaattgtaatt

SEQ ID NO: 3631206 - DNA, 14 bp, Homo sapiens
ctcctttgaagaag

SEQ ID NO: 3631207 - DNA, 13 bp, Homo sapiens
ctcctttgtactt

SEQ ID NO: 3631208 - DNA, 15 bp, Homo sapiens
ctccttttgctcttt

SEQ ID NO: 3631209 - DNA, 15 bp, Homo sapiens
ctcgaactcctgacc

SEQ ID NO: 3631210 - DNA, 21 bp, Homo sapiens
ctcgacccagaatggagcctg

SEQ ID NO: 3631211 - DNA, 15 bp, Homo sapiens
ctcgacctccccacc

SEQ ID NO: 3631212 - DNA, 16 bp, Homo sapiens
ctcgacctccccaccc

SEQ ID NO: 3631213 - DNA, 22 bp, Homo sapiens
ctcgagaaccaaccagggaagc

SEQ ID NO: 3631214 - DNA, 21 bp, Homo sapiens
ctcgcagggaatgcagcagga

SEQ ID NO: 3631215 - DNA, 13 bp, Homo sapiens
ctcgccccatccc

SEQ ID NO: 3631216 - DNA, 22 bp, Homo sapiens
ctcgccgtgtctcagcctctgc

SEQ ID NO: 3631217 - DNA, 13 bp, Homo sapiens
ctcgctcccttca

SEQ ID NO: 3631218 - DNA, 12 bp, Homo sapiens
ctcggagaagag

SEQ ID NO: 3631219 - DNA, 17 bp, Homo sapiens
ctcggagagcagcagca

SEQ ID NO: 3631220 - DNA, 23 bp, Homo sapiens
ctcggagggatggagaaagaagt

SEQ ID NO: 3631221 - DNA, 16 bp, Homo sapiens
ctcggagggtgccgtg

SEQ ID NO: 3631222 - DNA, 17 bp, Homo sapiens
ctcggatgacaccctgg

SEQ ID NO: 3631223 - DNA, 13 bp, Homo sapiens
ctcggcacacact

SEQ ID NO: 3631224 - DNA, 22 bp, Homo sapiens
ctcggcacacactgtgccccac

SEQ ID NO: 3631225 - DNA, 22 bp, Homo sapiens
ctcggctactggttacctggag

SEQ ID NO: 3631226 - DNA, 23 bp, Homo sapiens
ctcggctactggttacctggaga

SEQ ID NO: 3631227 - DNA, 22 bp, Homo sapiens
ctcggctgccaggggctctgtg

SEQ ID NO: 3631228 - DNA, 12 bp, Homo sapiens
ctcggtatctgg

SEQ ID NO: 3631229 - DNA, 16 bp, Homo sapiens
ctcggtgtccccacca

SEQ ID NO: 3631230 - DNA, 18 bp, Homo sapiens
ctcgtatatgtctcaggt

SEQ ID NO: 3631231 - DNA, 19 bp, Homo sapiens
ctcgtcagccacctgggaa

SEQ ID NO: 3631232 - DNA, 20 bp, Homo sapiens
ctcgtgaggggcaagctagg

SEQ ID NO: 3631233 - DNA, 21 bp, Homo sapiens
ctcgtggactgtgctggtgca

SEQ ID NO: 3631234 - DNA, 17 bp, Homo sapiens
ctcgtgggtcccagaga

SEQ ID NO: 3631235 - DNA, 15 bp, Homo sapiens
ctctaacagtggaca

SEQ ID NO: 3631236 - DNA, 21 bp, Homo sapiens
ctctaaggaattatttcacac

SEQ ID NO: 3631237 - DNA, 18 bp, Homo sapiens
ctctaataaacactgttt

SEQ ID NO: 3631238 - DNA, 19 bp, Homo sapiens
ctctaataaacactgtttt

SEQ ID NO: 3631239 - DNA, 22 bp, Homo sapiens
ctctaatctgtgctgtttcaaa

SEQ ID NO: 3631240 - DNA, 17 bp, Homo sapiens
ctctaatgtctgcagct

SEQ ID NO: 3631241 - DNA, 15 bp, Homo sapiens
ctctaattcacagtg

SEQ ID NO: 3631242 - DNA, 17 bp, Homo sapiens
ctctaattcttcctttg

SEQ ID NO: 3631243 - DNA, 15 bp, Homo sapiens
ctctaatttaactta

SEQ ID NO: 3631244 - DNA, 16 bp, Homo sapiens
ctctaatttaacttat

SEQ ID NO: 3631245 - DNA, 14 bp, Homo sapiens
ctctacactaaggg

SEQ ID NO: 3631246 - DNA, 16 bp, Homo sapiens
ctctacttagcatgtc

SEQ ID NO: 3631247 - DNA, 20 bp, Homo sapiens
ctctacttagcatgtcccta

SEQ ID NO: 3631248 - DNA, 23 bp, Homo sapiens
ctctagcctggcaacagagcgag

SEQ ID NO: 3631249 - DNA, 20 bp, Homo sapiens
ctctaggccctgtgagcaca

SEQ ID NO: 3631250 - DNA, 17 bp, Homo sapiens
ctctagtagtgtggcct

SEQ ID NO: 3631251 - DNA, 21 bp, Homo sapiens
ctctagtagtgtggcctgtgc

SEQ ID NO: 3631252 - DNA, 18 bp, Homo sapiens
ctctagtcatttgttaat

SEQ ID NO: 3631253 - DNA, 16 bp, Homo sapiens
ctctagttgagtttct

SEQ ID NO: 3631254 - DNA, 20 bp, Homo sapiens
ctctataaatagtattccaa

SEQ ID NO: 3631255 - DNA, 22 bp, Homo sapiens
ctctatactgtggcctgcagga

SEQ ID NO: 3631256 - DNA, 21 bp, Homo sapiens
ctctatcagaaatacaaaaaa

SEQ ID NO: 3631257 - DNA, 18 bp, Homo sapiens
ctctattgatacaatatt

SEQ ID NO: 3631258 - DNA, 20 bp, Homo sapiens
ctctatttattagccaactg

SEQ ID NO: 3631259 - DNA, 13 bp, Homo sapiens
ctctatttctgga

SEQ ID NO: 3631260 - DNA, 12 bp, Homo sapiens
ctctcagaaata

SEQ ID NO: 3631261 - DNA, 16 bp, Homo sapiens
ctctcaggctgggccc

SEQ ID NO: 3631262 - DNA, 23 bp, Homo sapiens
ctctcagtgaaggtggggagaag

SEQ ID NO: 3631263 - DNA, 14 bp, Homo sapiens
ctctcatcggaggc

SEQ ID NO: 3631264 - DNA, 20 bp, Homo sapiens
ctctcatcggaggcccatgc

SEQ ID NO: 3631265 - DNA, 20 bp, Homo sapiens
ctctcatgttttcaactgcc

SEQ ID NO: 3631266 - DNA, 11 bp, Homo sapiens
ctctccactgc

SEQ ID NO: 3631267 - DNA, 16 bp, Homo sapiens
ctctccactgccttcg

SEQ ID NO: 3631268 - DNA, 16 bp, Homo sapiens
ctctccagcaggccca

SEQ ID NO: 3631269 - DNA, 18 bp, Homo sapiens
ctctccagctgactaaac

SEQ ID NO: 3631270 - DNA, 15 bp, Homo sapiens
ctctccaggagggct

SEQ ID NO: 3631271 - DNA, 12 bp, Homo sapiens
ctctccaggcct

SEQ ID NO: 3631272 - DNA, 13 bp, Homo sapiens
ctctccaggcctg

SEQ ID NO: 3631273 - DNA, 14 bp, Homo sapiens
ctctcccatcctgg

SEQ ID NO: 3631274 - DNA, 19 bp, Homo sapiens
ctctccccagcccagagac

SEQ ID NO: 3631275 - DNA, 15 bp, Homo sapiens
ctctccccatatata

SEQ ID NO: 3631276 - DNA, 22 bp, Homo sapiens
ctctccccatatataaattatt

SEQ ID NO: 3631277 - DNA, 17 bp, Homo sapiens
ctctcccccaaggccac

SEQ ID NO: 3631278 - DNA, 16 bp, Homo sapiens
ctctccccgctcaggg

SEQ ID NO: 3631279 - DNA, 12 bp, Homo sapiens
ctctccctgggt

SEQ ID NO: 3631280 - DNA, 23 bp, Homo sapiens
ctctccgactctgcacccgcctc

SEQ ID NO: 3631281 - DNA, 16 bp, Homo sapiens
ctctccgagctctggt

SEQ ID NO: 3631282 - DNA, 19 bp, Homo sapiens
ctctccgagctctggtgct

SEQ ID NO: 3631283 - DNA, 13 bp, Homo sapiens
ctctccgtgcagg

SEQ ID NO: 3631284 - DNA, 20 bp, Homo sapiens
ctctcctcccgccccgcccc

SEQ ID NO: 3631285 - DNA, 15 bp, Homo sapiens
ctctcctctctgctt

SEQ ID NO: 3631286 - DNA, 22 bp, Homo sapiens
ctctcctcttgccactgcctct

SEQ ID NO: 3631287 - DNA, 14 bp, Homo sapiens
ctgcagcagtcgcc

SEQ ID NO: 3631288 - DNA, 24 bp, Homo sapiens
ctgcagcccattcccaagggagac

SEQ ID NO: 3631289 - DNA, 12 bp, Homo sapiens
ctgcagcctctc

SEQ ID NO: 3631290 - DNA, 23 bp, Homo sapiens
ctgcagcctctctggctggtctt

SEQ ID NO: 3631291 - DNA, 12 bp, Homo sapiens
ctgcagcctgca

SEQ ID NO: 3631292 - DNA, 18 bp, Homo sapiens
ctgcagctccctcctcag

SEQ ID NO: 3631293 - DNA, 13 bp, Homo sapiens
ctgcaggaagaaa

SEQ ID NO: 3631294 - DNA, 12 bp, Homo sapiens
ctgcaggaccct

SEQ ID NO: 3631295 - DNA, 23 bp, Homo sapiens
ctgcaggagggttggagtgctct

SEQ ID NO: 3631296 - DNA, 17 bp, Homo sapiens
ctgcaggagtgtcctgc

SEQ ID NO: 3631297 - DNA, 20 bp, Homo sapiens
ctgcaggagtgtcctgccca

SEQ ID NO: 3631298 - DNA, 20 bp, Homo sapiens
ctgcaggcaggcggctcctc

SEQ ID NO: 3631299 - DNA, 23 bp, Homo sapiens
ctgcaggccaggccagctgcctc

SEQ ID NO: 3631300 - DNA, 16 bp, Homo sapiens
ctgcagggccaagcac

SEQ ID NO: 3631301 - DNA, 23 bp, Homo sapiens
ctgcagggccatctgactgccaa

SEQ ID NO: 3631302 - DNA, 17 bp, Homo sapiens
ctgcagggccgggcagg

SEQ ID NO: 3631303 - DNA, 15 bp, Homo sapiens
ctgcaggggcctctg

SEQ ID NO: 3631304 - DNA, 23 bp, Homo sapiens
ctgcaggggttgagagctttctg

SEQ ID NO: 3631305 - DNA, 15 bp, Homo sapiens
ctgcagtaaaacaca

SEQ ID NO: 3631306 - DNA, 15 bp, Homo sapiens
ctgcagtcccacact

SEQ ID NO: 3631307 - DNA, 17 bp, Homo sapiens
ctgcagtcccacactgt

SEQ ID NO: 3631308 - DNA, 12 bp, Homo sapiens
ctgcagtctcat

SEQ ID NO: 3631309 - DNA, 18 bp, Homo sapiens
ctgcagtctcatttctca

SEQ ID NO: 3631310 - DNA, 20 bp, Homo sapiens
ctgcagtctggctgagccct

SEQ ID NO: 3631311 - DNA, 22 bp, Homo sapiens
ctgcagtctttatttttttccc

SEQ ID NO: 3631312 - DNA, 15 bp, Homo sapiens
ctgcagttaccacag

SEQ ID NO: 3631313 - DNA, 22 bp, Homo sapiens
ctgcagttaccacagcaactga

SEQ ID NO: 3631314 - DNA, 20 bp, Homo sapiens
ctgcataagtgaaaatctta

SEQ ID NO: 3631315 - DNA, 16 bp, Homo sapiens
ctgcataccaacctgg

SEQ ID NO: 3631316 - DNA, 20 bp, Homo sapiens
ctgcatcagctgctgaaaca

SEQ ID NO: 3631317 - DNA, 19 bp, Homo sapiens
ctgcatctgaccagcagcg

SEQ ID NO: 3631318 - DNA, 14 bp, Homo sapiens
ctgcatgagctggc

SEQ ID NO: 3631319 - DNA, 18 bp, Homo sapiens
ctgcattattctctttta

SEQ ID NO: 3631320 - DNA, 20 bp, Homo sapiens
ctgcattcaggatcaaaccc

SEQ ID NO: 3631321 - DNA, 15 bp, Homo sapiens
ctgcattcctgtgcc

SEQ ID NO: 3631322 - DNA, 14 bp, Homo sapiens
ctgcattctctccc

SEQ ID NO: 3631323 - DNA, 16 bp, Homo sapiens
ctgcattctctcccat

SEQ ID NO: 3631324 - DNA, 20 bp, Homo sapiens
ctgcattctctcccatcctg

SEQ ID NO: 3631325 - DNA, 17 bp, Homo sapiens
ctgcatttcggtggcta

SEQ ID NO: 3631326 - DNA, 18 bp, Homo sapiens
ctgcatttcggtggctag

SEQ ID NO: 3631327 - DNA, 22 bp, Homo sapiens
ctgccaaaggatgtgatatata

SEQ ID NO: 3631328 - DNA, 22 bp, Homo sapiens
ctgccaagccagattctcttga

SEQ ID NO: 3631329 - DNA, 13 bp, Homo sapiens
ctgccaaggagca

SEQ ID NO: 3631330 - DNA, 20 bp, Homo sapiens
ctgccaaggagcatccttgg

SEQ ID NO: 3631331 - DNA, 14 bp, Homo sapiens
ctgccaataaattc

SEQ ID NO: 3631332 - DNA, 16 bp, Homo sapiens
ctgccaataaattcta

SEQ ID NO: 3631333 - DNA, 23 bp, Homo sapiens
ctgccacagagaagtttgtagcc

SEQ ID NO: 3631334 - DNA, 23 bp, Homo sapiens
ctgccacatggagccccctctgc

SEQ ID NO: 3631335 - DNA, 15 bp, Homo sapiens
ctgccacccacctcc

SEQ ID NO: 3631336 - DNA, 22 bp, Homo sapiens
ctgccacccacctccctgcctc

SEQ ID NO: 3631337 - DNA, 17 bp, Homo sapiens
ctgccacccagccccag

SEQ ID NO: 3631338 - DNA, 20 bp, Homo sapiens
ctgccacccagccccagcca

SEQ ID NO: 3631339 - DNA, 20 bp, Homo sapiens
ctgccacccccttccctggg

SEQ ID NO: 3631340 - DNA, 13 bp, Homo sapiens
ctgccagcacagt

SEQ ID NO: 3631341 - DNA, 12 bp, Homo sapiens
ctgccagctgca

SEQ ID NO: 3631342 - DNA, 17 bp, Homo sapiens
ctgccagctgcactgat

SEQ ID NO: 3631343 - DNA, 14 bp, Homo sapiens
ctgccaggctgcct

SEQ ID NO: 3631344 - DNA, 13 bp, Homo sapiens
ctgccaggctgtt

SEQ ID NO: 3631345 - DNA, 13 bp, Homo sapiens
ctgccagggcttc

SEQ ID NO: 3631346 - DNA, 21 bp, Homo sapiens
ctgccaggggctctgtggcaa

SEQ ID NO: 3631347 - DNA, 23 bp, Homo sapiens
ctgccaggggctctgtggcaaaa

SEQ ID NO: 3631348 - DNA, 22 bp, Homo sapiens
ctgccagtccccctgccccagg

SEQ ID NO: 3631349 - DNA, 17 bp, Homo sapiens
ctgccagtgcagccact

SEQ ID NO: 3631350 - DNA, 18 bp, Homo sapiens
ctgccagttacttgggct

SEQ ID NO: 3631351 - DNA, 13 bp, Homo sapiens
ctgccatttccct

SEQ ID NO: 3631352 - DNA, 14 bp, Homo sapiens
ctgcccaaaccctt

SEQ ID NO: 3631353 - DNA, 17 bp, Homo sapiens
ctgcccaacccttccct

SEQ ID NO: 3631354 - DNA, 16 bp, Homo sapiens
ctgcccaacctctgtg

SEQ ID NO: 3631355 - DNA, 17 bp, Homo sapiens
ctgcccaacctctgtgg

SEQ ID NO: 3631356 - DNA, 17 bp, Homo sapiens
ctgcccaacctgctctc

SEQ ID NO: 3631357 - DNA, 18 bp, Homo sapiens
ctgcccacctggctgcca

SEQ ID NO: 3631358 - DNA, 12 bp, Homo sapiens
ctgcccaggaga

SEQ ID NO: 3631359 - DNA, 21 bp, Homo sapiens
ctgcccaggagacagaccact

SEQ ID NO: 3631360 - DNA, 18 bp, Homo sapiens
ctgcccaggcctgcctgt

SEQ ID NO: 3631361 - DNA, 16 bp, Homo sapiens
ctgcccaggggagccc

SEQ ID NO: 3631362 - DNA, 17 bp, Homo sapiens
ctgcccaggggagccct

SEQ ID NO: 3631363 - DNA, 22 bp, Homo sapiens
ctgcccaggggagccctccacg

SEQ ID NO: 3631364 - DNA, 17 bp, Homo sapiens
ctgcccagtcgacccca

SEQ ID NO: 3631365 - DNA, 23 bp, Homo sapiens
ctgcccagtcgaccccaaaggaa

SEQ ID NO: 3631366 - DNA, 23 bp, Homo sapiens
ctgccccaccccacctcacagct

SEQ ID NO: 3631367 - DNA, 22 bp, Homo sapiens
ctgccccaccccatccagccag

SEQ ID NO: 3631368 - DNA, 13 bp, Homo sapiens
ctgccccagcctg

SEQ ID NO: 3631369 - DNA, 18 bp, Homo sapiens
ctgccccatcctccagca

SEQ ID NO: 3631370 - DNA, 22 bp, Homo sapiens
ctgccccatcctccagcaggga

SEQ ID NO: 3631371 - DNA, 19 bp, Homo sapiens
ctgcccccagaaagcctcc

SEQ ID NO: 3631372 - DNA, 23 bp, Homo sapiens
ctgcccccgctcccgctcccagg

SEQ ID NO: 3631373 - DNA, 15 bp, Homo sapiens
ctgccccctccccca

SEQ ID NO: 3631374 - DNA, 16 bp, Homo sapiens
ctgccccctcccccat

SEQ ID NO: 3631375 - DNA, 14 bp, Homo sapiens
ctgccccctgccag

SEQ ID NO: 3631376 - DNA, 22 bp, Homo sapiens
ctgccccctgggctggggcctc

SEQ ID NO: 3631377 - DNA, 23 bp, Homo sapiens
ctgccccgcagacggtctgtgtg

SEQ ID NO: 3631378 - DNA, 22 bp, Homo sapiens
ctgccccgtcggactgccccca

SEQ ID NO: 3631379 - DNA, 16 bp, Homo sapiens
ctgcccctgctgtgct

SEQ ID NO: 3631380 - DNA, 21 bp, Homo sapiens
ctgccccttaaacacaggctg

SEQ ID NO: 3631381 - DNA, 12 bp, Homo sapiens
ctgccctaagcc

SEQ ID NO: 3631382 - DNA, 17 bp, Homo sapiens
ctgccctagctgacccc

SEQ ID NO: 3631383 - DNA, 14 bp, Homo sapiens
ctgccctgggctcc

SEQ ID NO: 3631384 - DNA, 15 bp, Homo sapiens
ctgccctgggctcct

SEQ ID NO: 3631385 - DNA, 16 bp, Homo sapiens
ctgccctgggctcctc

SEQ ID NO: 3631386 - DNA, 18 bp, Homo sapiens
ctgccctgggctcctctt

SEQ ID NO: 3631387 - DNA, 18 bp, Homo sapiens
ctgccctggtgctgccac

SEQ ID NO: 3631388 - DNA, 19 bp, Homo sapiens
ctgccctggtgctgccaca

SEQ ID NO: 3631389 - DNA, 12 bp, Homo sapiens
ctgccctgtgat

SEQ ID NO: 3631390 - DNA, 21 bp, Homo sapiens
ctgccctgtgatatgtctgct

SEQ ID NO: 3631391 - DNA, 12 bp, Homo sapiens
ctgccgagccac

SEQ ID NO: 3631392 - DNA, 13 bp, Homo sapiens
ctgccgagccacc

SEQ ID NO: 3631393 - DNA, 20 bp, Homo sapiens
ctgccgagccaccatgcttg

SEQ ID NO: 3631394 - DNA, 21 bp, Homo sapiens
ctgccggcaggatgcagcgcc

SEQ ID NO: 3631395 - DNA, 14 bp, Homo sapiens
ctgccggctctggg

SEQ ID NO: 3631396 - DNA, 20 bp, Homo sapiens
ctgccggtcgggcagccagc

SEQ ID NO: 3631397 - DNA, 15 bp, Homo sapiens
ctgcctagagtgtag

SEQ ID NO: 3631398 - DNA, 18 bp, Homo sapiens
ctgcctagagtgtagcct

SEQ ID NO: 3631399 - DNA, 23 bp, Homo sapiens
ctgcctattatctgtcagctgca

SEQ ID NO: 3631400 - DNA, 14 bp, Homo sapiens
ctgcctcaggaccc

SEQ ID NO: 3631401 - DNA, 20 bp, Homo sapiens
ctgcctcaggacccatccct

SEQ ID NO: 3631402 - DNA, 21 bp, Homo sapiens
ctgcctcaggacccatccctg

SEQ ID NO: 3631403 - DNA, 22 bp, Homo sapiens
ctgcctcaggaggcaggacctt

SEQ ID NO: 3631404 - DNA, 13 bp, Homo sapiens
ctgcctccaccag

SEQ ID NO: 3631405 - DNA, 23 bp, Homo sapiens
ctgcctccgcgtgatcaaagcca

SEQ ID NO: 3631406 - DNA, 14 bp, Homo sapiens
ctgcctcctcttca

SEQ ID NO: 3631407 - DNA, 15 bp, Homo sapiens
ctgcctcctcttcaa

SEQ ID NO: 3631408 - DNA, 12 bp, Homo sapiens
ctgcctcctgcc

SEQ ID NO: 3631409 - DNA, 14 bp, Homo sapiens
ctgcctcctgccct

SEQ ID NO: 3631410 - DNA, 17 bp, Homo sapiens
ctgcctgcagcaggcag

SEQ ID NO: 3631411 - DNA, 20 bp, Homo sapiens
ctgcctgcagtactttacct

SEQ ID NO: 3631412 - DNA, 21 bp, Homo sapiens
ctgcctgcatgagctggcaac

SEQ ID NO: 3631413 - DNA, 23 bp, Homo sapiens
ctgcctgcatgagctggcaacca

SEQ ID NO: 3631414 - DNA, 15 bp, Homo sapiens
ctgcctgccagctgc

SEQ ID NO: 3631415 - DNA, 12 bp, Homo sapiens
ctgcctgctcct

SEQ ID NO: 3631416 - DNA, 15 bp, Homo sapiens
ctgcctgctccttgg

SEQ ID NO: 3631417 - DNA, 24 bp, Homo sapiens
ctgcctgctccttggcacccccat

SEQ ID NO: 3631418 - DNA, 15 bp, Homo sapiens
ctgcctgctgtgctg

SEQ ID NO: 3631419 - DNA, 18 bp, Homo sapiens
cttacctgggcacaaaca

SEQ ID NO: 3631420 - DNA, 24 bp, Homo sapiens
cttactcccccaccactcaggcca

SEQ ID NO: 3631421 - DNA, 17 bp, Homo sapiens
cttactgactttgcatt

SEQ ID NO: 3631422 - DNA, 14 bp, Homo sapiens
cttagaaacactgc

SEQ ID NO: 3631423 - DNA, 15 bp, Homo sapiens
cttagaacctttctt

SEQ ID NO: 3631424 - DNA, 12 bp, Homo sapiens
cttagagtgtag

SEQ ID NO: 3631425 - DNA, 16 bp, Homo sapiens
cttagagtgtagctgt

SEQ ID NO: 3631426 - DNA, 17 bp, Homo sapiens
cttagagtgtagctgta

SEQ ID NO: 3631427 - DNA, 19 bp, Homo sapiens
cttagagtgtagctgtaag

SEQ ID NO: 3631428 - DNA, 17 bp, Homo sapiens
cttagagtttctgtttg

SEQ ID NO: 3631429 - DNA, 22 bp, Homo sapiens
cttagagtttctgtttgattct

SEQ ID NO: 3631430 - DNA, 16 bp, Homo sapiens
cttagccctcaccaca

SEQ ID NO: 3631431 - DNA, 21 bp, Homo sapiens
cttaggagacagatcactcct

SEQ ID NO: 3631432 - DNA, 21 bp, Homo sapiens
cttaggctactgtaatgctgc

SEQ ID NO: 3631433 - DNA, 22 bp, Homo sapiens
cttaggctactgtaatgctgcc

SEQ ID NO: 3631434 - DNA, 23 bp, Homo sapiens
cttagggacaggaccccagctct

SEQ ID NO: 3631435 - DNA, 19 bp, Homo sapiens
cttagtacaaagtttcaat

SEQ ID NO: 3631436 - DNA, 15 bp, Homo sapiens
cttagtgtatgatta

SEQ ID NO: 3631437 - DNA, 18 bp, Homo sapiens
cttataaaccaatcttaa

SEQ ID NO: 3631438 - DNA, 18 bp, Homo sapiens
cttataggcctgtccctt

SEQ ID NO: 3631439 - DNA, 13 bp, Homo sapiens
cttatagtacatg

SEQ ID NO: 3631440 - DNA, 14 bp, Homo sapiens
cttatagttactgt

SEQ ID NO: 3631441 - DNA, 16 bp, Homo sapiens
cttatagttactgtgt

SEQ ID NO: 3631442 - DNA, 14 bp, Homo sapiens
cttatatgtacttt

SEQ ID NO: 3631443 - DNA, 21 bp, Homo sapiens
cttatcactgcattattctct

SEQ ID NO: 3631444 - DNA, 23 bp, Homo sapiens
cttatccaggttggttttgctgt

SEQ ID NO: 3631445 - DNA, 12 bp, Homo sapiens
cttatccctctc

SEQ ID NO: 3631446 - DNA, 22 bp, Homo sapiens
cttatgacatcacttgtacaaa

SEQ ID NO: 3631447 - DNA, 14 bp, Homo sapiens
cttatgcaaaatgg

SEQ ID NO: 3631448 - DNA, 15 bp, Homo sapiens
cttatgcaaaatgga

SEQ ID NO: 3631449 - DNA, 16 bp, Homo sapiens
cttatgcaaaatggaa

SEQ ID NO: 3631450 - DNA, 17 bp, Homo sapiens
cttatgcggttaatttt

SEQ ID NO: 3631451 - DNA, 14 bp, Homo sapiens
cttatgtcctgtca

SEQ ID NO: 3631452 - DNA, 13 bp, Homo sapiens
cttattaagactg

SEQ ID NO: 3631453 - DNA, 18 bp, Homo sapiens
cttattaagactggcttt

SEQ ID NO: 3631454 - DNA, 21 bp, Homo sapiens
cttattaatcatacaaactct

SEQ ID NO: 3631455 - DNA, 19 bp, Homo sapiens
cttattcagcaccaagcat

SEQ ID NO: 3631456 - DNA, 17 bp, Homo sapiens
cttattcagttcttaca

SEQ ID NO: 3631457 - DNA, 13 bp, Homo sapiens
cttattgaatata

SEQ ID NO: 3631458 - DNA, 18 bp, Homo sapiens
cttattgtttaatctttt

SEQ ID NO: 3631459 - DNA, 15 bp, Homo sapiens
cttatttaccctttt

SEQ ID NO: 3631460 - DNA, 19 bp, Homo sapiens
cttatttacccttttcccc

SEQ ID NO: 3631461 - DNA, 15 bp, Homo sapiens
cttatttcatttctt

SEQ ID NO: 3631462 - DNA, 14 bp, Homo sapiens
cttatttgccttct

SEQ ID NO: 3631463 - DNA, 23 bp, Homo sapiens
cttatttgccttctactcccctt

SEQ ID NO: 3631464 - DNA, 14 bp, Homo sapiens
cttattttcaagaa

SEQ ID NO: 3631465 - DNA, 15 bp, Homo sapiens
cttattttcaagaaa

SEQ ID NO: 3631466 - DNA, 19 bp, Homo sapiens
cttattttcaagaaactga

SEQ ID NO: 3631467 - DNA, 13 bp, Homo sapiens
cttattttgtaat

SEQ ID NO: 3631468 - DNA, 15 bp, Homo sapiens
cttattttgtaataa

SEQ ID NO: 3631469 - DNA, 16 bp, Homo sapiens
cttattttgtaataaa

SEQ ID NO: 3631470 - DNA, 17 bp, Homo sapiens
cttcaaaaagccacagc

SEQ ID NO: 3631471 - DNA, 18 bp, Homo sapiens
cttcaaaaagccacagca

SEQ ID NO: 3631472 - DNA, 21 bp, Homo sapiens
cttcaaaaagccacagcagag

SEQ ID NO: 3631473 - DNA, 17 bp, Homo sapiens
cttcaaagtgcctgggc

SEQ ID NO: 3631474 - DNA, 19 bp, Homo sapiens
cttcaaagtgcctgggctc

SEQ ID NO: 3631475 - DNA, 13 bp, Homo sapiens
cttcaaatgttta

SEQ ID NO: 3631476 - DNA, 19 bp, Homo sapiens
cttcaaccccgaggtccct

SEQ ID NO: 3631477 - DNA, 21 bp, Homo sapiens
cttcaaccccgaggtccctgt

SEQ ID NO: 3631478 - DNA, 18 bp, Homo sapiens
cttcaacttttctcttta

SEQ ID NO: 3631479 - DNA, 18 bp, Homo sapiens
cttcaagacgaggggcag

SEQ ID NO: 3631480 - DNA, 22 bp, Homo sapiens
cttcaatttctagtacctgtga

SEQ ID NO: 3631481 - DNA, 14 bp, Homo sapiens
cttcacaaagccca

SEQ ID NO: 3631482 - DNA, 15 bp, Homo sapiens
cttcacaaagcccaa

SEQ ID NO: 3631483 - DNA, 23 bp, Homo sapiens
cttcacaaagcccaagggatctg

SEQ ID NO: 3631484 - DNA, 14 bp, Homo sapiens
cttcacacagacac

SEQ ID NO: 3631485 - DNA, 16 bp, Homo sapiens
cttcacttacaagaaa

SEQ ID NO: 3631486 - DNA, 21 bp, Homo sapiens
cttcacttacaagaaaggcct

SEQ ID NO: 3631487 - DNA, 13 bp, Homo sapiens
cttcactttctta

SEQ ID NO: 3631488 - DNA, 15 bp, Homo sapiens
cttcagaactgccct

SEQ ID NO: 3631489 - DNA, 16 bp, Homo sapiens
cttcagaactgccctt

SEQ ID NO: 3631490 - DNA, 14 bp, Homo sapiens
cttcagactggccc

SEQ ID NO: 3631491 - DNA, 11 bp, Homo sapiens
cttcagcaacc

SEQ ID NO: 3631492 - DNA, 23 bp, Homo sapiens
cttcagcaaccctacagtatata

SEQ ID NO: 3631493 - DNA, 16 bp, Homo sapiens
cttcagcgtaaaatgg

SEQ ID NO: 3631494 - DNA, 14 bp, Homo sapiens
cttcaggagcctgg

SEQ ID NO: 3631495 - DNA, 17 bp, Homo sapiens
cttcaggagcctggcca

SEQ ID NO: 3631496 - DNA, 21 bp, Homo sapiens
cttcaggagcctggccaggca

SEQ ID NO: 3631497 - DNA, 23 bp, Homo sapiens
cttcaggagcctggccaggcagg

SEQ ID NO: 3631498 - DNA, 15 bp, Homo sapiens
cttcaggctcttctc

SEQ ID NO: 3631499 - DNA, 22 bp, Homo sapiens
cttcagtgaatatttttgtatt

SEQ ID NO: 3631500 - DNA, 14 bp, Homo sapiens
cttcagtgactcct

SEQ ID NO: 3631501 - DNA, 21 bp, Homo sapiens
cttcagtgactcctgctggta

SEQ ID NO: 3631502 - DNA, 23 bp, Homo sapiens
cttcagtgactcctgctggtacc

SEQ ID NO: 3631503 - DNA, 21 bp, Homo sapiens
cttcagtgagcccctccccag

SEQ ID NO: 3631504 - DNA, 13 bp, Homo sapiens
cttcatccatcct

SEQ ID NO: 3631505 - DNA, 15 bp, Homo sapiens
cttcatccatcctga

SEQ ID NO: 3631506 - DNA, 22 bp, Homo sapiens
cttcatccatcctgagccaaat

SEQ ID NO: 3631507 - DNA, 23 bp, Homo sapiens
cttcatggatgggggaactcaga

SEQ ID NO: 3631508 - DNA, 17 bp, Homo sapiens
cttcatgtccagtgagc

SEQ ID NO: 3631509 - DNA, 12 bp, Homo sapiens
cttcattctcgt

SEQ ID NO: 3631510 - DNA, 10 bp, Homo sapiens
cttcattctt

SEQ ID NO: 3631511 - DNA, 14 bp, Homo sapiens
cttcatttggagat

SEQ ID NO: 3631512 - DNA, 17 bp, Homo sapiens
cttcatttttctttctt

SEQ ID NO: 3631513 - DNA, 14 bp, Homo sapiens
cttccaaataaata

SEQ ID NO: 3631514 - DNA, 23 bp, Homo sapiens
cttccaccaagttggaacatcct

SEQ ID NO: 3631515 - DNA, 20 bp, Homo sapiens
cttccacccacaaactccag

SEQ ID NO: 3631516 - DNA, 23 bp, Homo sapiens
cttccacccacaaactccaggct

SEQ ID NO: 3631517 - DNA, 16 bp, Homo sapiens
cttccacctcacctct

SEQ ID NO: 3631518 - DNA, 21 bp, Homo sapiens
cttccactaccaaaagacatt

SEQ ID NO: 3631519 - DNA, 21 bp, Homo sapiens
cttccagggcagcggctccac

SEQ ID NO: 3631520 - DNA, 11 bp, Homo sapiens
cttccataatc

SEQ ID NO: 3631521 - DNA, 16 bp, Homo sapiens
cttccatgatgcacag

SEQ ID NO: 3631522 - DNA, 22 bp, Homo sapiens
cttccatggtactgtagcaggg

SEQ ID NO: 3631523 - DNA, 14 bp, Homo sapiens
cttccatgtgcctt

SEQ ID NO: 3631524 - DNA, 15 bp, Homo sapiens
cttccatgtgccttt

SEQ ID NO: 3631525 - DNA, 16 bp, Homo sapiens
cttccatgtgcctttc

SEQ ID NO: 3631526 - DNA, 15 bp, Homo sapiens
cttcccaacagatca

SEQ ID NO: 3631527 - DNA, 12 bp, Homo sapiens
cttcccactcca

SEQ ID NO: 3631528 - DNA, 16 bp, Homo sapiens
cttcccactccagctg

SEQ ID NO: 3631529 - DNA, 10 bp, Homo sapiens
cttcccaggg

SEQ ID NO: 3631530 - DNA, 13 bp, Homo sapiens
cttcccagggaga

SEQ ID NO: 3631531 - DNA, 18 bp, Homo sapiens
cttcccatttctctacac

SEQ ID NO: 3631532 - DNA, 15 bp, Homo sapiens
cttcccatttcttcc

SEQ ID NO: 3631533 - DNA, 17 bp, Homo sapiens
cttcccatttcttccca

SEQ ID NO: 3631534 - DNA, 22 bp, Homo sapiens
cttccccagacttctctttctt

SEQ ID NO: 3631535 - DNA, 12 bp, Homo sapiens
cttccccctcca

SEQ ID NO: 3631536 - DNA, 20 bp, Homo sapiens
cttccccctcttcttctgaa

SEQ ID NO: 3631537 - DNA, 14 bp, Homo sapiens
cttcccctccctgt

SEQ ID NO: 3631538 - DNA, 14 bp, Homo sapiens
cttcccctgggccc

SEQ ID NO: 3631539 - DNA, 15 bp, Homo sapiens
cttcccctgggccct

SEQ ID NO: 3631540 - DNA, 14 bp, Homo sapiens
cttccccttccctt

SEQ ID NO: 3631541 - DNA, 13 bp, Homo sapiens
cttccccttcctg

SEQ ID NO: 3631542 - DNA, 15 bp, Homo sapiens
cttccccttcctgtt

SEQ ID NO: 3631543 - DNA, 17 bp, Homo sapiens
cttcccgctcagccctc

SEQ ID NO: 3631544 - DNA, 22 bp, Homo sapiens
cttcccgggcgggcgtgggagg

SEQ ID NO: 3631545 - DNA, 21 bp, Homo sapiens
cttccctaaactgcagcctct

SEQ ID NO: 3631546 - DNA, 23 bp, Homo sapiens
cttccctattttgaatgcagaaa

SEQ ID NO: 3631547 - DNA, 17 bp, Homo sapiens
cttccctcaccttggca

SEQ ID NO: 3631548 - DNA, 19 bp, Homo sapiens
cttccctcccctctagttt

SEQ ID NO: 3631549 - DNA, 20 bp, Homo sapiens
cttccctcccctctagtttt

SEQ ID NO: 3631550 - DNA, 22 bp, Homo sapiens
cttccctggaaaccttccaccc

SEQ ID NO: 3631551 - DNA, 15 bp, Homo sapiens
cttccctggccccgc

SEQ ID NO: 3631552 - DNA, 23 bp, Homo sapiens
gaaaaatggttgatggaaaataa

SEQ ID NO: 3631553 - DNA, 14 bp, Homo sapiens
gaaaacagggtctg

SEQ ID NO: 3631554 - DNA, 22 bp, Homo sapiens
gaaaaccatattttattgtatt

SEQ ID NO: 3631555 - DNA, 11 bp, Homo sapiens
gaaaacccacc

SEQ ID NO: 3631556 - DNA, 13 bp, Homo sapiens
gaaaacctctcct

SEQ ID NO: 3631557 - DNA, 17 bp, Homo sapiens
gaaaacctctcctgacc

SEQ ID NO: 3631558 - DNA, 16 bp, Homo sapiens
gaaaaccttaaaagta

SEQ ID NO: 3631559 - DNA, 23 bp, Homo sapiens
gaaaaccttaaaagtaataaaga

SEQ ID NO: 3631560 - DNA, 20 bp, Homo sapiens
gaaaactatgtattaattta

SEQ ID NO: 3631561 - DNA, 18 bp, Homo sapiens
gaaaacttaaagaggaat

SEQ ID NO: 3631562 - DNA, 20 bp, Homo sapiens
gaaaacttaaagaggaatgg

SEQ ID NO: 3631563 - DNA, 23 bp, Homo sapiens
gaaaagaaacctggggtgaatac

SEQ ID NO: 3631564 - DNA, 18 bp, Homo sapiens
gaaaagactccaaagaaa

SEQ ID NO: 3631565 - DNA, 20 bp, Homo sapiens
gaaaagactccaaagaaatg

SEQ ID NO: 3631566 - DNA, 18 bp, Homo sapiens
gaaaagacttgtaatatt

SEQ ID NO: 3631567 - DNA, 15 bp, Homo sapiens
gaaaagattcttctt

SEQ ID NO: 3631568 - DNA, 14 bp, Homo sapiens
gaaaagcagctctc

SEQ ID NO: 3631569 - DNA, 17 bp, Homo sapiens
gaaaagcagctctcccc

SEQ ID NO: 3631570 - DNA, 17 bp, Homo sapiens
gaaaaggccttcttccc

SEQ ID NO: 3631571 - DNA, 18 bp, Homo sapiens
gaaaagtcacttactatt

SEQ ID NO: 3631572 - DNA, 14 bp, Homo sapiens
gaaaagtcttccta

SEQ ID NO: 3631573 - DNA, 11 bp, Homo sapiens
gaaaagtgcct

SEQ ID NO: 3631574 - DNA, 21 bp, Homo sapiens
gaaaataaatcttagtgttca

SEQ ID NO: 3631575 - DNA, 15 bp, Homo sapiens
gaaaataactgaacc

SEQ ID NO: 3631576 - DNA, 16 bp, Homo sapiens
gaaaataactgaacca

SEQ ID NO: 3631577 - DNA, 20 bp, Homo sapiens
gaaaataactgaaccaaatt

SEQ ID NO: 3631578 - DNA, 23 bp, Homo sapiens
gaaaataactgaaccaaattgca

SEQ ID NO: 3631579 - DNA, 22 bp, Homo sapiens
gaaaatattgttttacaatagt

SEQ ID NO: 3631580 - DNA, 18 bp, Homo sapiens
gaaaatatttgtatcaca

SEQ ID NO: 3631581 - DNA, 13 bp, Homo sapiens
gaaaatgcaactc

SEQ ID NO: 3631582 - DNA, 23 bp, Homo sapiens
gaaaatgcagcagggatgccctg

SEQ ID NO: 3631583 - DNA, 23 bp, Homo sapiens
gaaaattacatgttttttcattt

SEQ ID NO: 3631584 - DNA, 14 bp, Homo sapiens
gaaaattcaggtct

SEQ ID NO: 3631585 - DNA, 16 bp, Homo sapiens
gaaaattcaggtctgt

SEQ ID NO: 3631586 - DNA, 13 bp, Homo sapiens
gaaaattcatttt

SEQ ID NO: 3631587 - DNA, 17 bp, Homo sapiens
gaaaattccctggggtc

SEQ ID NO: 3631588 - DNA, 12 bp, Homo sapiens
gaaaattgcccc

SEQ ID NO: 3631589 - DNA, 14 bp, Homo sapiens
gaaaatttaacagt

SEQ ID NO: 3631590 - DNA, 23 bp, Homo sapiens
gaaacaaaaacactaaaaataaa

SEQ ID NO: 3631591 - DNA, 21 bp, Homo sapiens
gaaacaacagctttaaaagaa

SEQ ID NO: 3631592 - DNA, 12 bp, Homo sapiens
gaaacagaaaaa

SEQ ID NO: 3631593 - DNA, 19 bp, Homo sapiens
gaaacagagtccaatttaa

SEQ ID NO: 3631594 - DNA, 22 bp, Homo sapiens
gaaacagagtccaatttaagga

SEQ ID NO: 3631595 - DNA, 22 bp, Homo sapiens
gaaacagattcaggccagccca

SEQ ID NO: 3631596 - DNA, 12 bp, Homo sapiens
gaaacagcatga

SEQ ID NO: 3631597 - DNA, 13 bp, Homo sapiens
gaaacagcatgaa

SEQ ID NO: 3631598 - DNA, 14 bp, Homo sapiens
gaaacagcatgaat

SEQ ID NO: 3631599 - DNA, 15 bp, Homo sapiens
gaaacagcatgaata

SEQ ID NO: 3631600 - DNA, 21 bp, Homo sapiens
gaaacagttggtaacttttgt

SEQ ID NO: 3631601 - DNA, 23 bp, Homo sapiens
gaaacagttggtaacttttgtga

SEQ ID NO: 3631602 - DNA, 19 bp, Homo sapiens
gaaacatttatatttttat

SEQ ID NO: 3631603 - DNA, 20 bp, Homo sapiens
gaaacattttttcttctgaa

SEQ ID NO: 3631604 - DNA, 19 bp, Homo sapiens
gaaaccacagtcttcccag

SEQ ID NO: 3631605 - DNA, 17 bp, Homo sapiens
gaaaccaggacattaaa

SEQ ID NO: 3631606 - DNA, 20 bp, Homo sapiens
gaaacccacgacctgtcctg

SEQ ID NO: 3631607 - DNA, 19 bp, Homo sapiens
gaaacccctgtaggcctca

SEQ ID NO: 3631608 - DNA, 13 bp, Homo sapiens
gaaaccttttatt

SEQ ID NO: 3631609 - DNA, 15 bp, Homo sapiens
gaaaccttttatttt

SEQ ID NO: 3631610 - DNA, 22 bp, Homo sapiens
gaaacgccacaaaaatagagaa

SEQ ID NO: 3631611 - DNA, 20 bp, Homo sapiens
gaaactccatctcaaaacaa

SEQ ID NO: 3631612 - DNA, 15 bp, Homo sapiens
gaaactgaggcccag

SEQ ID NO: 3631613 - DNA, 20 bp, Homo sapiens
gaaactgaggcccagagagg

SEQ ID NO: 3631614 - DNA, 13 bp, Homo sapiens
gaaactgatgcca

SEQ ID NO: 3631615 - DNA, 14 bp, Homo sapiens
gaaactgctgcaga

SEQ ID NO: 3631616 - DNA, 18 bp, Homo sapiens
gaaactggtttataataa

SEQ ID NO: 3631617 - DNA, 20 bp, Homo sapiens
gaaactgttcccacctgctg

SEQ ID NO: 3631618 - DNA, 14 bp, Homo sapiens
gaaacttggccagt

SEQ ID NO: 3631619 - DNA, 13 bp, Homo sapiens
gaaagaaagagga

SEQ ID NO: 3631620 - DNA, 14 bp, Homo sapiens
gaaagaagcaagac

SEQ ID NO: 3631621 - DNA, 16 bp, Homo sapiens
gaaagaagggggccct

SEQ ID NO: 3631622 - DNA, 23 bp, Homo sapiens
gaaagaagggggccctgctacct

SEQ ID NO: 3631623 - DNA, 14 bp, Homo sapiens
gaaagaatgtaaag

SEQ ID NO: 3631624 - DNA, 15 bp, Homo sapiens
gaaagaatgtaaagc

SEQ ID NO: 3631625 - DNA, 14 bp, Homo sapiens
gaaagactattcaa

SEQ ID NO: 3631626 - DNA, 15 bp, Homo sapiens
gaaagactattcaaa

SEQ ID NO: 3631627 - DNA, 22 bp, Homo sapiens
gaaagactattcaaacagtctc

SEQ ID NO: 3631628 - DNA, 15 bp, Homo sapiens
gaaagagaggactgg

SEQ ID NO: 3631629 - DNA, 17 bp, Homo sapiens
gaaagagctgcctggat

SEQ ID NO: 3631630 - DNA, 22 bp, Homo sapiens
gaaagatggctgtgcctctgcc

SEQ ID NO: 3631631 - DNA, 13 bp, Homo sapiens
gaaagcaaaatac

SEQ ID NO: 3631632 - DNA, 18 bp, Homo sapiens
gaaagcagagcctcctgg

SEQ ID NO: 3631633 - DNA, 11 bp, Homo sapiens
gaaagccacat

SEQ ID NO: 3631634 - DNA, 16 bp, Homo sapiens
gaaagcctcctgcccc

SEQ ID NO: 3631635 - DNA, 16 bp, Homo sapiens
gaaagcgacttcaggt

SEQ ID NO: 3631636 - DNA, 18 bp, Homo sapiens
gaaagcgggcagccccgt

SEQ ID NO: 3631637 - DNA, 21 bp, Homo sapiens
gaaagctttgttgaaagaaag

SEQ ID NO: 3631638 - DNA, 14 bp, Homo sapiens
gaaaggatctgtga

SEQ ID NO: 3631639 - DNA, 21 bp, Homo sapiens
gaaaggattttaccaaagcat

SEQ ID NO: 3631640 - DNA, 24 bp, Homo sapiens
gaaaggattttaccaaagcatcaa

SEQ ID NO: 3631641 - DNA, 13 bp, Homo sapiens
gaaaggccagcag

SEQ ID NO: 3631642 - DNA, 14 bp, Homo sapiens
gaaagggttaatca

SEQ ID NO: 3631643 - DNA, 13 bp, Homo sapiens
gaaagtaatttaa

SEQ ID NO: 3631644 - DNA, 22 bp, Homo sapiens
gaaagtaatttaatttgtaaaa

SEQ ID NO: 3631645 - DNA, 23 bp, Homo sapiens
gaaagtgtgaagacccaaaacag

SEQ ID NO: 3631646 - DNA, 18 bp, Homo sapiens
gaaagtgtgagctcttcc

SEQ ID NO: 3631647 - DNA, 19 bp, Homo sapiens
gaaagtgtgagctcttccc

SEQ ID NO: 3631648 - DNA, 21 bp, Homo sapiens
gaaagtgtgagctcttccctt

SEQ ID NO: 3631649 - DNA, 13 bp, Homo sapiens
gaaagttttccag

SEQ ID NO: 3631650 - DNA, 17 bp, Homo sapiens
gaaagtttttagaatgt

SEQ ID NO: 3631651 - DNA, 13 bp, Homo sapiens
gaaataaatcaca

SEQ ID NO: 3631652 - DNA, 18 bp, Homo sapiens
gaaataatagaatgagca

SEQ ID NO: 3631653 - DNA, 17 bp, Homo sapiens
gaaatacagactggatg

SEQ ID NO: 3631654 - DNA, 17 bp, Homo sapiens
gaaatacctttgtagtt

SEQ ID NO: 3631655 - DNA, 18 bp, Homo sapiens
gaaatagacagcatgaga

SEQ ID NO: 3631656 - DNA, 13 bp, Homo sapiens
gaaatataattga

SEQ ID NO: 3631657 - DNA, 16 bp, Homo sapiens
gaaatatcaaagtcat

SEQ ID NO: 3631658 - DNA, 13 bp, Homo sapiens
gaaatatgtataa

SEQ ID NO: 3631659 - DNA, 16 bp, Homo sapiens
gaaatatgtattctgt

SEQ ID NO: 3631660 - DNA, 17 bp, Homo sapiens
gaaatcaaatatgcaaa

SEQ ID NO: 3631661 - DNA, 18 bp, Homo sapiens
gaaatcaaatatgcaaag

SEQ ID NO: 3631662 - DNA, 19 bp, Homo sapiens
gaaatcaaatatgcaaagc

SEQ ID NO: 3631663 - DNA, 21 bp, Homo sapiens
gaaatcaaatatgcaaagcac

SEQ ID NO: 3631664 - DNA, 23 bp, Homo sapiens
gaaatcaaatatgcaaagcactg

SEQ ID NO: 3631665 - DNA, 17 bp, Homo sapiens
gaaatcaaatgtaaagt

SEQ ID NO: 3631666 - DNA, 11 bp, Homo sapiens
gaaatccagga

SEQ ID NO: 3631667 - DNA, 15 bp, Homo sapiens
gaaatcttcccagta

SEQ ID NO: 3631668 - DNA, 23 bp, Homo sapiens
gaaatgacggtgttaattttgct

SEQ ID NO: 3631669 - DNA, 21 bp, Homo sapiens
gaaatgaggtctgtttaaagt

SEQ ID NO: 3631670 - DNA, 13 bp, Homo sapiens
gaaatgccccagt

SEQ ID NO: 3631671 - DNA, 19 bp, Homo sapiens
gaaatgccctcctaaatgt

SEQ ID NO: 3631672 - DNA, 22 bp, Homo sapiens
gaaatgctgttagtaaatttct

SEQ ID NO: 3631673 - DNA, 21 bp, Homo sapiens
gaaatggaggatctctaaaga

SEQ ID NO: 3631674 - DNA, 19 bp, Homo sapiens
gaaatgtagatgatatgtt

SEQ ID NO: 3631675 - DNA, 18 bp, Homo sapiens
gaaatgtgaagaggtctg

SEQ ID NO: 3631676 - DNA, 23 bp, Homo sapiens
gaaattactgcccacttgtcaag

SEQ ID NO: 3631677 - DNA, 21 bp, Homo sapiens
gaaattataactattacagtg

SEQ ID NO: 3631678 - DNA, 23 bp, Homo sapiens
gaaattatgtgacattttacatt

SEQ ID NO: 3631679 - DNA, 19 bp, Homo sapiens
gaaattgcatttcctgaca

SEQ ID NO: 3631680 - DNA, 18 bp, Homo sapiens
gaaattgctttgtattgt

SEQ ID NO: 3631681 - DNA, 14 bp, Homo sapiens
gaaatttaattaca

SEQ ID NO: 3631682 - DNA, 18 bp, Homo sapiens
gaaatttaattacaaaca

SEQ ID NO: 3631683 - DNA, 17 bp, Homo sapiens
gaaatttctcatcacag

SEQ ID NO: 3631684 - DNA, 18 bp, Homo sapiens
gaattcaccacagacttt

SEQ ID NO: 3631685 - DNA, 13 bp, Homo sapiens
gaattcagtgcct

SEQ ID NO: 3631686 - DNA, 14 bp, Homo sapiens
gaattcagtgcctt

SEQ ID NO: 3631687 - DNA, 24 bp, Homo sapiens
gaattcagtgccttcaacaacgtg

SEQ ID NO: 3631688 - DNA, 21 bp, Homo sapiens
gaattcattctggaggggcag

SEQ ID NO: 3631689 - DNA, 14 bp, Homo sapiens
gaattccctccccc

SEQ ID NO: 3631690 - DNA, 15 bp, Homo sapiens
gaattccctccccct

SEQ ID NO: 3631691 - DNA, 14 bp, Homo sapiens
gaattcctttacaa

SEQ ID NO: 3631692 - DNA, 23 bp, Homo sapiens
gaattcctttacaactaaataac

SEQ ID NO: 3631693 - DNA, 13 bp, Homo sapiens
gaattcttctgca

SEQ ID NO: 3631694 - DNA, 14 bp, Homo sapiens
gaattcttctgcaa

SEQ ID NO: 3631695 - DNA, 18 bp, Homo sapiens
gaattcttctgcaacatt

SEQ ID NO: 3631696 - DNA, 16 bp, Homo sapiens
gaattgggagcttggg

SEQ ID NO: 3631697 - DNA, 15 bp, Homo sapiens
gaatttaaaactgtt

SEQ ID NO: 3631698 - DNA, 15 bp, Homo sapiens
gaatttcccaggacc

SEQ ID NO: 3631699 - DNA, 14 bp, Homo sapiens
gaatttccctctct

SEQ ID NO: 3631700 - DNA, 18 bp, Homo sapiens
gaatttcttaacttcttg

SEQ ID NO: 3631701 - DNA, 14 bp, Homo sapiens
gaatttcttctttt

SEQ ID NO: 3631702 - DNA, 20 bp, Homo sapiens
gaatttgaggtctagagaga

SEQ ID NO: 3631703 - DNA, 15 bp, Homo sapiens
gaatttggggcagga

SEQ ID NO: 3631704 - DNA, 18 bp, Homo sapiens
gaattttattgacacagt

SEQ ID NO: 3631705 - DNA, 21 bp, Homo sapiens
gaattttctttgtgtagcttt

SEQ ID NO: 3631706 - DNA, 15 bp, Homo sapiens
gaattttttttaaaa

SEQ ID NO: 3631707 - DNA, 16 bp, Homo sapiens
gacaaacacctcccag

SEQ ID NO: 3631708 - DNA, 12 bp, Homo sapiens
gacaaataagaa

SEQ ID NO: 3631709 - DNA, 11 bp, Homo sapiens
gacaaatattc

SEQ ID NO: 3631710 - DNA, 16 bp, Homo sapiens
gacaaatctttaagaa

SEQ ID NO: 3631711 - DNA, 14 bp, Homo sapiens
gacaacatgtttaa

SEQ ID NO: 3631712 - DNA, 23 bp, Homo sapiens
gacaacctgtgtgagagaattta

SEQ ID NO: 3631713 - DNA, 14 bp, Homo sapiens
gacaagagctgtta

SEQ ID NO: 3631714 - DNA, 15 bp, Homo sapiens
gacaagagctgttat

SEQ ID NO: 3631715 - DNA, 22 bp, Homo sapiens
gacaagagctgttatgctgttt

SEQ ID NO: 3631716 - DNA, 13 bp, Homo sapiens
gacaaggtgctaa

SEQ ID NO: 3631717 - DNA, 19 bp, Homo sapiens
gacaataattctggagata

SEQ ID NO: 3631718 - DNA, 20 bp, Homo sapiens
gacaatgtccaaacccactc

SEQ ID NO: 3631719 - DNA, 20 bp, Homo sapiens
gacaattttacctattctga

SEQ ID NO: 3631720 - DNA, 12 bp, Homo sapiens
gacacagataat

SEQ ID NO: 3631721 - DNA, 11 bp, Homo sapiens
gacacagctct

SEQ ID NO: 3631722 - DNA, 16 bp, Homo sapiens
gacacaggtctttcct

SEQ ID NO: 3631723 - DNA, 15 bp, Homo sapiens
gacacatacagagtg

SEQ ID NO: 3631724 - DNA, 23 bp, Homo sapiens
gacacatttaaggtgtagtatta

SEQ ID NO: 3631725 - DNA, 19 bp, Homo sapiens
gacaccacacttgttttct

SEQ ID NO: 3631726 - DNA, 14 bp, Homo sapiens
gacacccaggactt

SEQ ID NO: 3631727 - DNA, 12 bp, Homo sapiens
gacaccctggcc

SEQ ID NO: 3631728 - DNA, 14 bp, Homo sapiens
gacaccctggcctg

SEQ ID NO: 3631729 - DNA, 15 bp, Homo sapiens
gacacctcccccttt

SEQ ID NO: 3631730 - DNA, 13 bp, Homo sapiens
gacactccttccc

SEQ ID NO: 3631731 - DNA, 19 bp, Homo sapiens
gacacttcacgcccttggc

SEQ ID NO: 3631732 - DNA, 15 bp, Homo sapiens
gacagaaaagtgcct

SEQ ID NO: 3631733 - DNA, 18 bp, Homo sapiens
gacagaaaagtgcctgag

SEQ ID NO: 3631734 - DNA, 11 bp, Homo sapiens
gacagaggcag

SEQ ID NO: 3631735 - DNA, 14 bp, Homo sapiens
gacagatatattta

SEQ ID NO: 3631736 - DNA, 15 bp, Homo sapiens
gacagatatatttaa

SEQ ID NO: 3631737 - DNA, 14 bp, Homo sapiens
gacagatcacaggg

SEQ ID NO: 3631738 - DNA, 19 bp, Homo sapiens
gacagcaattcatggttca

SEQ ID NO: 3631739 - DNA, 20 bp, Homo sapiens
gacagcagaactgctatttt

SEQ ID NO: 3631740 - DNA, 12 bp, Homo sapiens
gacagcatgaga

SEQ ID NO: 3631741 - DNA, 15 bp, Homo sapiens
gacagccccaccctg

SEQ ID NO: 3631742 - DNA, 12 bp, Homo sapiens
gacagcctggca

SEQ ID NO: 3631743 - DNA, 13 bp, Homo sapiens
gacagcctggcac

SEQ ID NO: 3631744 - DNA, 19 bp, Homo sapiens
gacagcctggcacagggca

SEQ ID NO: 3631745 - DNA, 15 bp, Homo sapiens
gacagctccgggatc

SEQ ID NO: 3631746 - DNA, 17 bp, Homo sapiens
gacagctgctcctagag

SEQ ID NO: 3631747 - DNA, 13 bp, Homo sapiens
gacagctggctgg

SEQ ID NO: 3631748 - DNA, 14 bp, Homo sapiens
gacagctggctggg

SEQ ID NO: 3631749 - DNA, 16 bp, Homo sapiens
gacagctggctgggcc

SEQ ID NO: 3631750 - DNA, 17 bp, Homo sapiens
gacagctggctgggcct

SEQ ID NO: 3631751 - DNA, 22 bp, Homo sapiens
gacagctggctgggccttcacc

SEQ ID NO: 3631752 - DNA, 19 bp, Homo sapiens
gacagcttacaggagccag

SEQ ID NO: 3631753 - DNA, 12 bp, Homo sapiens
gacagcttcctc

SEQ ID NO: 3631754 - DNA, 16 bp, Homo sapiens
gacagcttcctcacac

SEQ ID NO: 3631755 - DNA, 14 bp, Homo sapiens
gacagcttctctgc

SEQ ID NO: 3631756 - DNA, 15 bp, Homo sapiens
gacagcttctctgca

SEQ ID NO: 3631757 - DNA, 18 bp, Homo sapiens
gacagcttctctgcagta

SEQ ID NO: 3631758 - DNA, 19 bp, Homo sapiens
gacaggaccccagctctgc

SEQ ID NO: 3631759 - DNA, 22 bp, Homo sapiens
gacaggcactccaaacctgtct

SEQ ID NO: 3631760 - DNA, 15 bp, Homo sapiens
gacaggcagggaggg

SEQ ID NO: 3631761 - DNA, 19 bp, Homo sapiens
gacaggccctccctgtctc

SEQ ID NO: 3631762 - DNA, 13 bp, Homo sapiens
gacaggctgaaga

SEQ ID NO: 3631763 - DNA, 22 bp, Homo sapiens
gacagggcatggccaggtggcc

SEQ ID NO: 3631764 - DNA, 17 bp, Homo sapiens
gacagggtttcaccatg

SEQ ID NO: 3631765 - DNA, 21 bp, Homo sapiens
gacaggtacttggagggctca

SEQ ID NO: 3631766 - DNA, 15 bp, Homo sapiens
gacaggtgggcctgg

SEQ ID NO: 3631767 - DNA, 16 bp, Homo sapiens
gacaggtgggcctggg

SEQ ID NO: 3631768 - DNA, 17 bp, Homo sapiens
gacagtccgcagttgta

SEQ ID NO: 3631769 - DNA, 23 bp, Homo sapiens
gacagtcctttcccaccattcct

SEQ ID NO: 3631770 - DNA, 17 bp, Homo sapiens
gacagttgatggagccc

SEQ ID NO: 3631771 - DNA, 19 bp, Homo sapiens
gacagttgatggagcccca

SEQ ID NO: 3631772 - DNA, 20 bp, Homo sapiens
gacagttgatggagccccag

SEQ ID NO: 3631773 - DNA, 13 bp, Homo sapiens
gacataaaacaga

SEQ ID NO: 3631774 - DNA, 14 bp, Homo sapiens
gacataaaacagaa

SEQ ID NO: 3631775 - DNA, 15 bp, Homo sapiens
gacataaacaaagac

SEQ ID NO: 3631776 - DNA, 14 bp, Homo sapiens
gacataagtaactt

SEQ ID NO: 3631777 - DNA, 16 bp, Homo sapiens
gacatactgctggagt

SEQ ID NO: 3631778 - DNA, 17 bp, Homo sapiens
gacatacttgaagggcc

SEQ ID NO: 3631779 - DNA, 16 bp, Homo sapiens
gacatcacttgtacaa

SEQ ID NO: 3631780 - DNA, 13 bp, Homo sapiens
gacatccagcaga

SEQ ID NO: 3631781 - DNA, 17 bp, Homo sapiens
gacatcccttcctggaa

SEQ ID NO: 3631782 - DNA, 17 bp, Homo sapiens
gacatcttgtcattttt

SEQ ID NO: 3631783 - DNA, 15 bp, Homo sapiens
gacatgaaaagttat

SEQ ID NO: 3631784 - DNA, 17 bp, Homo sapiens
gacatgaaaagttattt

SEQ ID NO: 3631785 - DNA, 23 bp, Homo sapiens
gacatgaaaatagcaatattctt

SEQ ID NO: 3631786 - DNA, 12 bp, Homo sapiens
gacatgctcaca

SEQ ID NO: 3631787 - DNA, 22 bp, Homo sapiens
gacatgcttttctgccactcca

SEQ ID NO: 3631788 - DNA, 23 bp, Homo sapiens
gacattaaaaatgttagtatttt

SEQ ID NO: 3631789 - DNA, 17 bp, Homo sapiens
gacattcagactaaaaa

SEQ ID NO: 3631790 - DNA, 15 bp, Homo sapiens
gacattcccctccca

SEQ ID NO: 3631791 - DNA, 13 bp, Homo sapiens
gacatttctttgg

SEQ ID NO: 3631792 - DNA, 20 bp, Homo sapiens
gacattttaaaaaatggtca

SEQ ID NO: 3631793 - DNA, 13 bp, Homo sapiens
gacattttacatt

SEQ ID NO: 3631794 - DNA, 15 bp, Homo sapiens
gacattttacattaa

SEQ ID NO: 3631795 - DNA, 16 bp, Homo sapiens
gacattttatgtcttt

SEQ ID NO: 3631796 - DNA, 20 bp, Homo sapiens
gacattttatgtctttcttg

SEQ ID NO: 3631797 - DNA, 21 bp, Homo sapiens
gacattttatgtctttcttgt

SEQ ID NO: 3631798 - DNA, 13 bp, Homo sapiens
gaccaactgccct

SEQ ID NO: 3631799 - DNA, 14 bp, Homo sapiens
gaccaactgcccta

SEQ ID NO: 3631800 - DNA, 18 bp, Homo sapiens
gaccaaggctctgaaata

SEQ ID NO: 3631801 - DNA, 18 bp, Homo sapiens
gaccaataaacagctccc

SEQ ID NO: 3631802 - DNA, 22 bp, Homo sapiens
gaccaatcaaatatattattta

SEQ ID NO: 3631803 - DNA, 21 bp, Homo sapiens
gaccaattctggacagacaga

SEQ ID NO: 3631804 - DNA, 18 bp, Homo sapiens
gaccaattgaagcatgaa

SEQ ID NO: 3631805 - DNA, 23 bp, Homo sapiens
gaccacagactcaatgtgctctg

SEQ ID NO: 3631806 - DNA, 14 bp, Homo sapiens
gaccacctgcccaa

SEQ ID NO: 3631807 - DNA, 22 bp, Homo sapiens
gaccagcctccatgctgcctcc

SEQ ID NO: 3631808 - DNA, 12 bp, Homo sapiens
gaccagctcagg

SEQ ID NO: 3631809 - DNA, 21 bp, Homo sapiens
gaccagggatgctgggctggg

SEQ ID NO: 3631810 - DNA, 22 bp, Homo sapiens
gaccagggatgctgggctgggc

SEQ ID NO: 3631811 - DNA, 15 bp, Homo sapiens
gaccagtgcctgtga

SEQ ID NO: 3631812 - DNA, 15 bp, Homo sapiens
gaccataagagaaac

SEQ ID NO: 3631813 - DNA, 18 bp, Homo sapiens
gaccataagagaaacctg

SEQ ID NO: 3631814 - DNA, 22 bp, Homo sapiens
gaccatctttagcagtttcctc

SEQ ID NO: 3631815 - DNA, 20 bp, Homo sapiens
gacccaaaacagctttgtct

SEQ ID NO: 3631816 - DNA, 13 bp, Homo sapiens
gacccacagaact

SEQ ID NO: 3631817 - DNA, 18 bp, Homo sapiens
gacccacgggctcatgca

SEQ ID NO: 3631818 - DNA, 15 bp, Homo sapiens
gaggataggacagag

SEQ ID NO: 3631819 - DNA, 17 bp, Homo sapiens
gaggatccactcccagg

SEQ ID NO: 3631820 - DNA, 13 bp, Homo sapiens
gaggatccagggc

SEQ ID NO: 3631821 - DNA, 14 bp, Homo sapiens
gaggatccagggca

SEQ ID NO: 3631822 - DNA, 17 bp, Homo sapiens
gaggattgttgaatcta

SEQ ID NO: 3631823 - DNA, 16 bp, Homo sapiens
gaggcaaaggcctgga

SEQ ID NO: 3631824 - DNA, 13 bp, Homo sapiens
gaggcacactttc

SEQ ID NO: 3631825 - DNA, 15 bp, Homo sapiens
gaggcacactttctg

SEQ ID NO: 3631826 - DNA, 19 bp, Homo sapiens
gaggcacactttctggcaa

SEQ ID NO: 3631827 - DNA, 21 bp, Homo sapiens
gaggcagcatgcttgggctga

SEQ ID NO: 3631828 - DNA, 12 bp, Homo sapiens
gaggcagggacc

SEQ ID NO: 3631829 - DNA, 16 bp, Homo sapiens
gaggcagggacctaaa

SEQ ID NO: 3631830 - DNA, 20 bp, Homo sapiens
gaggccaaccagcccgacag

SEQ ID NO: 3631831 - DNA, 19 bp, Homo sapiens
gaggccacattgctggctg

SEQ ID NO: 3631832 - DNA, 20 bp, Homo sapiens
gaggccacattgctggctgc

SEQ ID NO: 3631833 - DNA, 12 bp, Homo sapiens
gaggccacccca

SEQ ID NO: 3631834 - DNA, 21 bp, Homo sapiens
gaggccaccccaaaccccagc

SEQ ID NO: 3631835 - DNA, 22 bp, Homo sapiens
gaggccaccccaaaccccagcc

SEQ ID NO: 3631836 - DNA, 21 bp, Homo sapiens
gaggccagaaaggtgtgagga

SEQ ID NO: 3631837 - DNA, 13 bp, Homo sapiens
gaggcccagagag

SEQ ID NO: 3631838 - DNA, 13 bp, Homo sapiens
gaggcccatgccc

SEQ ID NO: 3631839 - DNA, 19 bp, Homo sapiens
gaggccccagcctccctga

SEQ ID NO: 3631840 - DNA, 22 bp, Homo sapiens
gaggccccagcctccctgaagc

SEQ ID NO: 3631841 - DNA, 11 bp, Homo sapiens
gaggccctgga

SEQ ID NO: 3631842 - DNA, 22 bp, Homo sapiens
gaggccctggaggtctccaggg

SEQ ID NO: 3631843 - DNA, 21 bp, Homo sapiens
gaggcctgctgccagtgcagc

SEQ ID NO: 3631844 - DNA, 20 bp, Homo sapiens
gaggccttcccatggccatt

SEQ ID NO: 3631845 - DNA, 16 bp, Homo sapiens
gaggctacctcacctg

SEQ ID NO: 3631846 - DNA, 20 bp, Homo sapiens
gaggctattattttcactgt

SEQ ID NO: 3631847 - DNA, 16 bp, Homo sapiens
gaggctcagagaggta

SEQ ID NO: 3631848 - DNA, 21 bp, Homo sapiens
gaggctgacatgctcacacat

SEQ ID NO: 3631849 - DNA, 14 bp, Homo sapiens
gaggctgaggcagg

SEQ ID NO: 3631850 - DNA, 21 bp, Homo sapiens
gaggctgtaactgagagaaag

SEQ ID NO: 3631851 - DNA, 14 bp, Homo sapiens
gaggcttctccttc

SEQ ID NO: 3631852 - DNA, 21 bp, Homo sapiens
gagggaaaaggcaggtgcttt

SEQ ID NO: 3631853 - DNA, 21 bp, Homo sapiens
gagggaagacctgaaagagag

SEQ ID NO: 3631854 - DNA, 14 bp, Homo sapiens
gagggaagggagcc

SEQ ID NO: 3631855 - DNA, 19 bp, Homo sapiens
gagggaagggagccaaggg

SEQ ID NO: 3631856 - DNA, 20 bp, Homo sapiens
gagggaagggagccaaggga

SEQ ID NO: 3631857 - DNA, 15 bp, Homo sapiens
gagggaatctagccc

SEQ ID NO: 3631858 - DNA, 16 bp, Homo sapiens
gagggaatctagccca

SEQ ID NO: 3631859 - DNA, 13 bp, Homo sapiens
gagggacaggctg

SEQ ID NO: 3631860 - DNA, 14 bp, Homo sapiens
gagggacaggctga

SEQ ID NO: 3631861 - DNA, 21 bp, Homo sapiens
gagggacaggctgaagagagg

SEQ ID NO: 3631862 - DNA, 17 bp, Homo sapiens
gagggacctctcccagg

SEQ ID NO: 3631863 - DNA, 13 bp, Homo sapiens
gagggagcgacac

SEQ ID NO: 3631864 - DNA, 22 bp, Homo sapiens
gagggagcgacacttgaatgta

SEQ ID NO: 3631865 - DNA, 17 bp, Homo sapiens
gagggaggcaagccctg

SEQ ID NO: 3631866 - DNA, 16 bp, Homo sapiens
gagggatgatgaggga

SEQ ID NO: 3631867 - DNA, 22 bp, Homo sapiens
gagggatgatgagggaagcaat

SEQ ID NO: 3631868 - DNA, 15 bp, Homo sapiens
gagggatggagaaag

SEQ ID NO: 3631869 - DNA, 18 bp, Homo sapiens
gagggatggagaaagaag

SEQ ID NO: 3631870 - DNA, 12 bp, Homo sapiens
gagggcactggt

SEQ ID NO: 3631871 - DNA, 21 bp, Homo sapiens
gagggccaccggtgggcagtg

SEQ ID NO: 3631872 - DNA, 19 bp, Homo sapiens
gagggccacctccacaccc

SEQ ID NO: 3631873 - DNA, 20 bp, Homo sapiens
gagggccacctccacaccca

SEQ ID NO: 3631874 - DNA, 18 bp, Homo sapiens
gagggcccagcccagagc

SEQ ID NO: 3631875 - DNA, 23 bp, Homo sapiens
gagggcccagcccagagccacct

SEQ ID NO: 3631876 - DNA, 20 bp, Homo sapiens
gagggctgagcctggtccca

SEQ ID NO: 3631877 - DNA, 16 bp, Homo sapiens
gaggggatccagccac

SEQ ID NO: 3631878 - DNA, 17 bp, Homo sapiens
gaggggatccagccact

SEQ ID NO: 3631879 - DNA, 13 bp, Homo sapiens
gaggggatgataa

SEQ ID NO: 3631880 - DNA, 15 bp, Homo sapiens
gaggggcagggaagg

SEQ ID NO: 3631881 - DNA, 23 bp, Homo sapiens
gaggggcaggtctagtgttcctg

SEQ ID NO: 3631882 - DNA, 13 bp, Homo sapiens
gaggggcctggca

SEQ ID NO: 3631883 - DNA, 13 bp, Homo sapiens
gagggggtaaagc

SEQ ID NO: 3631884 - DNA, 19 bp, Homo sapiens
gaggggtgcggcggtccca

SEQ ID NO: 3631885 - DNA, 16 bp, Homo sapiens
gagggtcgtgggaaag

SEQ ID NO: 3631886 - DNA, 22 bp, Homo sapiens
gagggtcgtgggaaaggggagt

SEQ ID NO: 3631887 - DNA, 19 bp, Homo sapiens
gagggtctcccctcctgca

SEQ ID NO: 3631888 - DNA, 20 bp, Homo sapiens
gagggtctcccctcctgcac

SEQ ID NO: 3631889 - DNA, 21 bp, Homo sapiens
gagggtctcccctcctgcaca

SEQ ID NO: 3631890 - DNA, 16 bp, Homo sapiens
gagggttcagagagga

SEQ ID NO: 3631891 - DNA, 12 bp, Homo sapiens
gaggtaagtttt

SEQ ID NO: 3631892 - DNA, 15 bp, Homo sapiens
gaggtataggggtcc

SEQ ID NO: 3631893 - DNA, 15 bp, Homo sapiens
gaggtcaccagggga

SEQ ID NO: 3631894 - DNA, 20 bp, Homo sapiens
gaggtcaccaggggaggagc

SEQ ID NO: 3631895 - DNA, 15 bp, Homo sapiens
gaggtcactcttttg

SEQ ID NO: 3631896 - DNA, 24 bp, Homo sapiens
gaggtcatctggcggaggtctctg

SEQ ID NO: 3631897 - DNA, 12 bp, Homo sapiens
gaggtccaagca

SEQ ID NO: 3631898 - DNA, 16 bp, Homo sapiens
gaggtctagagagaac

SEQ ID NO: 3631899 - DNA, 20 bp, Homo sapiens
gaggtctccaggggcctgca

SEQ ID NO: 3631900 - DNA, 14 bp, Homo sapiens
gaggtctctgggag

SEQ ID NO: 3631901 - DNA, 19 bp, Homo sapiens
gaggtctctgggagcccag

SEQ ID NO: 3631902 - DNA, 16 bp, Homo sapiens
gaggtctgattggctg

SEQ ID NO: 3631903 - DNA, 18 bp, Homo sapiens
gaggtctgattggctgct

SEQ ID NO: 3631904 - DNA, 13 bp, Homo sapiens
gaggtctggctga

SEQ ID NO: 3631905 - DNA, 17 bp, Homo sapiens
gaggtctggctgagccc

SEQ ID NO: 3631906 - DNA, 18 bp, Homo sapiens
gaggtgattctcagggct

SEQ ID NO: 3631907 - DNA, 21 bp, Homo sapiens
gaggtgattctcagggctgga

SEQ ID NO: 3631908 - DNA, 20 bp, Homo sapiens
gaggtgggaggatcttttga

SEQ ID NO: 3631909 - DNA, 21 bp, Homo sapiens
gaggtgtgtgacgtttttcca

SEQ ID NO: 3631910 - DNA, 14 bp, Homo sapiens
gaggttcccagggc

SEQ ID NO: 3631911 - DNA, 14 bp, Homo sapiens
gaggttgtggggcc

SEQ ID NO: 3631912 - DNA, 22 bp, Homo sapiens
gaggtttgtttagaagaagtgt

SEQ ID NO: 3631913 - DNA, 21 bp, Homo sapiens
gagtaaaaaaaaaaacaatta

SEQ ID NO: 3631914 - DNA, 15 bp, Homo sapiens
gagtaaagtctgggc

SEQ ID NO: 3631915 - DNA, 23 bp, Homo sapiens
gagtaataaagatacaaaatgtt

SEQ ID NO: 3631916 - DNA, 18 bp, Homo sapiens
gagtaattgaggaaaaac

SEQ ID NO: 3631917 - DNA, 13 bp, Homo sapiens
gagtacaaatgcc

SEQ ID NO: 3631918 - DNA, 14 bp, Homo sapiens
gagtacaaatgcct

SEQ ID NO: 3631919 - DNA, 15 bp, Homo sapiens
gagtataagaaatgc

SEQ ID NO: 3631920 - DNA, 17 bp, Homo sapiens
gagtataagaaatgcat

SEQ ID NO: 3631921 - DNA, 18 bp, Homo sapiens
gagtataagaaatgcata

SEQ ID NO: 3631922 - DNA, 13 bp, Homo sapiens
gagtcaaaacaaa

SEQ ID NO: 3631923 - DNA, 14 bp, Homo sapiens
gagtcaaagctgac

SEQ ID NO: 3631924 - DNA, 21 bp, Homo sapiens
gagtcaaagctgaccatggat

SEQ ID NO: 3631925 - DNA, 12 bp, Homo sapiens
gagtcaaatcca

SEQ ID NO: 3631926 - DNA, 14 bp, Homo sapiens
gagtcaaatccagt

SEQ ID NO: 3631927 - DNA, 16 bp, Homo sapiens
gagtcaaatccagtgg

SEQ ID NO: 3631928 - DNA, 21 bp, Homo sapiens
gagtcaaatccagtggtgggt

SEQ ID NO: 3631929 - DNA, 18 bp, Homo sapiens
gagtcacctgctccagaa

SEQ ID NO: 3631930 - DNA, 12 bp, Homo sapiens
gagtcagactga

SEQ ID NO: 3631931 - DNA, 15 bp, Homo sapiens
gagtcagtgccaggt

SEQ ID NO: 3631932 - DNA, 17 bp, Homo sapiens
gagtcattatgtagctg

SEQ ID NO: 3631933 - DNA, 13 bp, Homo sapiens
gagtcatttaaat

SEQ ID NO: 3631934 - DNA, 16 bp, Homo sapiens
gagtcatttaaatgtg

SEQ ID NO: 3631935 - DNA, 20 bp, Homo sapiens
gagtcatttgtttaaacaat

SEQ ID NO: 3631936 - DNA, 12 bp, Homo sapiens
gagtctcttctc

SEQ ID NO: 3631937 - DNA, 19 bp, Homo sapiens
gagtgagatgtagaaagtt

SEQ ID NO: 3631938 - DNA, 18 bp, Homo sapiens
gagtgaggatgtctgggc

SEQ ID NO: 3631939 - DNA, 14 bp, Homo sapiens
gagtgagtcacctg

SEQ ID NO: 3631940 - DNA, 20 bp, Homo sapiens
gagtgagtcacctgctccag

SEQ ID NO: 3631941 - DNA, 21 bp, Homo sapiens
gagtgagtcacctgctccaga

SEQ ID NO: 3631942 - DNA, 22 bp, Homo sapiens
gagtgcacctgcctccaccagc

SEQ ID NO: 3631943 - DNA, 23 bp, Homo sapiens
gagtgcacctgcctccaccagca

SEQ ID NO: 3631944 - DNA, 16 bp, Homo sapiens
gagtgcctggagtcag

SEQ ID NO: 3631945 - DNA, 21 bp, Homo sapiens
gagtgctcttcccactccagc

SEQ ID NO: 3631946 - DNA, 16 bp, Homo sapiens
gagtggagagagcagg

SEQ ID NO: 3631947 - DNA, 20 bp, Homo sapiens
gagtggagagagcagggcta

SEQ ID NO: 3631948 - DNA, 15 bp, Homo sapiens
gagtggcagcagccc

SEQ ID NO: 3631949 - DNA, 15 bp, Homo sapiens
gagtggcctccctgc

SEQ ID NO: 3631950 - DNA, 16 bp, Homo sapiens
gagtggcctccctgct

SEQ ID NO: 3631951 - DNA, 24 bp, Homo sapiens
gcactcctttatctgtaattgtaa

SEQ ID NO: 3631952 - DNA, 12 bp, Homo sapiens
gcactgaacagg

SEQ ID NO: 3631953 - DNA, 20 bp, Homo sapiens
gcactgaagtttttgaaata

SEQ ID NO: 3631954 - DNA, 21 bp, Homo sapiens
gcactgaagtttttgaaatac

SEQ ID NO: 3631955 - DNA, 15 bp, Homo sapiens
gcactgacttctaag

SEQ ID NO: 3631956 - DNA, 18 bp, Homo sapiens
gcactgacttctaagtaa

SEQ ID NO: 3631957 - DNA, 17 bp, Homo sapiens
gcactgcattcctgtgc

SEQ ID NO: 3631958 - DNA, 20 bp, Homo sapiens
gcactgcctgcatgagctgg

SEQ ID NO: 3631959 - DNA, 17 bp, Homo sapiens
gcactggtttgttccct

SEQ ID NO: 3631960 - DNA, 19 bp, Homo sapiens
gcactggtttgttccctgt

SEQ ID NO: 3631961 - DNA, 16 bp, Homo sapiens
gcactgtgaaggaccc

SEQ ID NO: 3631962 - DNA, 20 bp, Homo sapiens
gcacttacacttataaaata

SEQ ID NO: 3631963 - DNA, 18 bp, Homo sapiens
gcacttattgaatatatg

SEQ ID NO: 3631964 - DNA, 20 bp, Homo sapiens
gcacttattgaatatatgat

SEQ ID NO: 3631965 - DNA, 22 bp, Homo sapiens
gcacttgagaaccagtctcctc

SEQ ID NO: 3631966 - DNA, 20 bp, Homo sapiens
gcactttatattttcctctt

SEQ ID NO: 3631967 - DNA, 12 bp, Homo sapiens
gcactttatcct

SEQ ID NO: 3631968 - DNA, 18 bp, Homo sapiens
gcagaaagtaagcatttc

SEQ ID NO: 3631969 - DNA, 23 bp, Homo sapiens
gcagaagacgtctccccttctct

SEQ ID NO: 3631970 - DNA, 16 bp, Homo sapiens
gcagacagccctggca

SEQ ID NO: 3631971 - DNA, 17 bp, Homo sapiens
gcagacattttaaaaaa

SEQ ID NO: 3631972 - DNA, 21 bp, Homo sapiens
gcagaccagctggcgggtgtg

SEQ ID NO: 3631973 - DNA, 23 bp, Homo sapiens
gcagacctggagcttcagccagg

SEQ ID NO: 3631974 - DNA, 16 bp, Homo sapiens
gcagacgcggcgggga

SEQ ID NO: 3631975 - DNA, 18 bp, Homo sapiens
gcagacggtctgtgtgct

SEQ ID NO: 3631976 - DNA, 23 bp, Homo sapiens
gcagacggtctgtgtgctgtttg

SEQ ID NO: 3631977 - DNA, 19 bp, Homo sapiens
gcagactggtttgcagtga

SEQ ID NO: 3631978 - DNA, 23 bp, Homo sapiens
gcagactgttctaaaatataata

SEQ ID NO: 3631979 - DNA, 19 bp, Homo sapiens
gcagagaccataagagaaa

SEQ ID NO: 3631980 - DNA, 14 bp, Homo sapiens
gcagagaggctgtg

SEQ ID NO: 3631981 - DNA, 12 bp, Homo sapiens
gcagagccaggc

SEQ ID NO: 3631982 - DNA, 14 bp, Homo sapiens
gcagagcctcctgg

SEQ ID NO: 3631983 - DNA, 21 bp, Homo sapiens
gcagagcctttttacctggcc

SEQ ID NO: 3631984 - DNA, 22 bp, Homo sapiens
gcagaggagaacttgctgcctc

SEQ ID NO: 3631985 - DNA, 14 bp, Homo sapiens
gcagaggaggggcc

SEQ ID NO: 3631986 - DNA, 17 bp, Homo sapiens
gcagaggggcgttctcc

SEQ ID NO: 3631987 - DNA, 18 bp, Homo sapiens
gcagagggggagtagcca

SEQ ID NO: 3631988 - DNA, 22 bp, Homo sapiens
gcagagtggcgtggcctcccca

SEQ ID NO: 3631989 - DNA, 15 bp, Homo sapiens
gcagatactgtctct

SEQ ID NO: 3631990 - DNA, 13 bp, Homo sapiens
gcagatgacagag

SEQ ID NO: 3631991 - DNA, 13 bp, Homo sapiens
gcagatgcaatga

SEQ ID NO: 3631992 - DNA, 19 bp, Homo sapiens
gcagatgcaatgactcagg

SEQ ID NO: 3631993 - DNA, 15 bp, Homo sapiens
gcagcacagctgaga

SEQ ID NO: 3631994 - DNA, 17 bp, Homo sapiens
gcagcaccaaccacagc

SEQ ID NO: 3631995 - DNA, 21 bp, Homo sapiens
gcagcaccaaccacagcatcg

SEQ ID NO: 3631996 - DNA, 20 bp, Homo sapiens
gcagcactccccagagctgt

SEQ ID NO: 3631997 - DNA, 23 bp, Homo sapiens
gcagcactccccagagctgtgcc

SEQ ID NO: 3631998 - DNA, 15 bp, Homo sapiens
gcagcaggagggggg

SEQ ID NO: 3631999 - DNA, 11 bp, Homo sapiens
gcagcaggcca

SEQ ID NO: 3632000 - DNA, 16 bp, Homo sapiens
gcagcaggccagagaa

SEQ ID NO: 3632001 - DNA, 23 bp, Homo sapiens
gcagcaggcctctgggacccaca

SEQ ID NO: 3632002 - DNA, 13 bp, Homo sapiens
gcagcaggctcag

SEQ ID NO: 3632003 - DNA, 15 bp, Homo sapiens
gcagcaggctcaggc

SEQ ID NO: 3632004 - DNA, 16 bp, Homo sapiens
gcagcaggctcaggca

SEQ ID NO: 3632005 - DNA, 17 bp, Homo sapiens
gcagcagtcgcccaagc

SEQ ID NO: 3632006 - DNA, 14 bp, Homo sapiens
gcagcatgcttggg

SEQ ID NO: 3632007 - DNA, 20 bp, Homo sapiens
gcagcatgcttgggctgacc

SEQ ID NO: 3632008 - DNA, 14 bp, Homo sapiens
gcagcatggcatag

SEQ ID NO: 3632009 - DNA, 15 bp, Homo sapiens
gcagccagcagaggg

SEQ ID NO: 3632010 - DNA, 14 bp, Homo sapiens
gcagccatgataat

SEQ ID NO: 3632011 - DNA, 18 bp, Homo sapiens
gcagccatgataataggt

SEQ ID NO: 3632012 - DNA, 14 bp, Homo sapiens
gcagcccaggccag

SEQ ID NO: 3632013 - DNA, 18 bp, Homo sapiens
gcagccccgggcggagcc

SEQ ID NO: 3632014 - DNA, 19 bp, Homo sapiens
gcagccccgggcggagcct

SEQ ID NO: 3632015 - DNA, 21 bp, Homo sapiens
gcagccccgttttggggacgt

SEQ ID NO: 3632016 - DNA, 15 bp, Homo sapiens
gcagccgcagagaaa

SEQ ID NO: 3632017 - DNA, 16 bp, Homo sapiens
gcagccgcagagaaat

SEQ ID NO: 3632018 - DNA, 23 bp, Homo sapiens
gcagccgcagagaaatgccccag

SEQ ID NO: 3632019 - DNA, 13 bp, Homo sapiens
gcagccgccagct

SEQ ID NO: 3632020 - DNA, 17 bp, Homo sapiens
gcagccgccagctggga

SEQ ID NO: 3632021 - DNA, 16 bp, Homo sapiens
gcagcctaagaagaag

SEQ ID NO: 3632022 - DNA, 21 bp, Homo sapiens
gcagcctcaaaacgggtcagt

SEQ ID NO: 3632023 - DNA, 19 bp, Homo sapiens
gcagcctctccgactctgc

SEQ ID NO: 3632024 - DNA, 23 bp, Homo sapiens
gcagcctctctggctggtcttca

SEQ ID NO: 3632025 - DNA, 13 bp, Homo sapiens
gcagcctgcagga

SEQ ID NO: 3632026 - DNA, 23 bp, Homo sapiens
gcagcctgtcctgggctggtggc

SEQ ID NO: 3632027 - DNA, 16 bp, Homo sapiens
gcagccttcccctccc

SEQ ID NO: 3632028 - DNA, 18 bp, Homo sapiens
gcagccttcccctccctg

SEQ ID NO: 3632029 - DNA, 21 bp, Homo sapiens
gcagccttcccctccctgtat

SEQ ID NO: 3632030 - DNA, 18 bp, Homo sapiens
gcagcgccgtgtcctctc

SEQ ID NO: 3632031 - DNA, 13 bp, Homo sapiens
gcagcgcctttcc

SEQ ID NO: 3632032 - DNA, 14 bp, Homo sapiens
gcagcgggcggagg

SEQ ID NO: 3632033 - DNA, 12 bp, Homo sapiens
gcagctagtgcc

SEQ ID NO: 3632034 - DNA, 15 bp, Homo sapiens
gcagctatttcagcc

SEQ ID NO: 3632035 - DNA, 19 bp, Homo sapiens
gcagctccctcctcaggga

SEQ ID NO: 3632036 - DNA, 14 bp, Homo sapiens
gcagctcctgacct

SEQ ID NO: 3632037 - DNA, 18 bp, Homo sapiens
gcagctcctgaccttggg

SEQ ID NO: 3632038 - DNA, 23 bp, Homo sapiens
gcagctcctgaccttgggtcctg

SEQ ID NO: 3632039 - DNA, 19 bp, Homo sapiens
gcagctgaaatatgctggc

SEQ ID NO: 3632040 - DNA, 22 bp, Homo sapiens
gcagctgaaatatgctggctgg

SEQ ID NO: 3632041 - DNA, 11 bp, Homo sapiens
gcagctgagca

SEQ ID NO: 3632042 - DNA, 11 bp, Homo sapiens
gcagctggccc

SEQ ID NO: 3632043 - DNA, 14 bp, Homo sapiens
gcagctgggtgcag

SEQ ID NO: 3632044 - DNA, 18 bp, Homo sapiens
gcagcttctactcctgcc

SEQ ID NO: 3632045 - DNA, 21 bp, Homo sapiens
gcagcttctactcctgcctca

SEQ ID NO: 3632046 - DNA, 13 bp, Homo sapiens
gcagcttgctggg

SEQ ID NO: 3632047 - DNA, 22 bp, Homo sapiens
gcagctttttattccctgccca

SEQ ID NO: 3632048 - DNA, 14 bp, Homo sapiens
gcaggaaagccaca

SEQ ID NO: 3632049 - DNA, 22 bp, Homo sapiens
gcaggaaggaacaaagacaggc

SEQ ID NO: 3632050 - DNA, 16 bp, Homo sapiens
gcaggaaggaccccac

SEQ ID NO: 3632051 - DNA, 17 bp, Homo sapiens
gcaggaccctgtcctgc

SEQ ID NO: 3632052 - DNA, 18 bp, Homo sapiens
gcaggaccctgtcctgca

SEQ ID NO: 3632053 - DNA, 21 bp, Homo sapiens
gcaggaccttcgggctgtgcc

SEQ ID NO: 3632054 - DNA, 14 bp, Homo sapiens
gcaggactcctggc

SEQ ID NO: 3632055 - DNA, 16 bp, Homo sapiens
gcaggagccccgccac

SEQ ID NO: 3632056 - DNA, 19 bp, Homo sapiens
gcaggagccccgccacagc

SEQ ID NO: 3632057 - DNA, 21 bp, Homo sapiens
gcaggaggatcacttgaggcc

SEQ ID NO: 3632058 - DNA, 14 bp, Homo sapiens
gcaggaggggggag

SEQ ID NO: 3632059 - DNA, 18 bp, Homo sapiens
gcaggaggggggagggaa

SEQ ID NO: 3632060 - DNA, 16 bp, Homo sapiens
gcaggcaggcggctcc

SEQ ID NO: 3632061 - DNA, 18 bp, Homo sapiens
gcaggcaggcggctcctc

SEQ ID NO: 3632062 - DNA, 13 bp, Homo sapiens
gcaggcatttctg

SEQ ID NO: 3632063 - DNA, 20 bp, Homo sapiens
gcaggccaagtcaggccctt

SEQ ID NO: 3632064 - DNA, 15 bp, Homo sapiens
gcaggccagagaaag

SEQ ID NO: 3632065 - DNA, 16 bp, Homo sapiens
gcaggccagagaaagc

SEQ ID NO: 3632066 - DNA, 17 bp, Homo sapiens
gcaggcccaatgctgct

SEQ ID NO: 3632067 - DNA, 16 bp, Homo sapiens
gcaggcccactcccca

SEQ ID NO: 3632068 - DNA, 23 bp, Homo sapiens
gcaggcccactccccagccccag

SEQ ID NO: 3632069 - DNA, 13 bp, Homo sapiens
gcaggcctaggtg

SEQ ID NO: 3632070 - DNA, 20 bp, Homo sapiens
gcaggcctccaacgcccctg

SEQ ID NO: 3632071 - DNA, 21 bp, Homo sapiens
gcaggcctccaacgcccctgt

SEQ ID NO: 3632072 - DNA, 23 bp, Homo sapiens
gcaggcctccaacgcccctgtgg

SEQ ID NO: 3632073 - DNA, 22 bp, Homo sapiens
gcaggcctctgggacccacaga

SEQ ID NO: 3632074 - DNA, 18 bp, Homo sapiens
gcaggcggctcctcctca

SEQ ID NO: 3632075 - DNA, 22 bp, Homo sapiens
gcaggctgagggtcgtgggaaa

SEQ ID NO: 3632076 - DNA, 18 bp, Homo sapiens
gcagggaaggagacacca

SEQ ID NO: 3632077 - DNA, 17 bp, Homo sapiens
gcagggaatgcagcagg

SEQ ID NO: 3632078 - DNA, 18 bp, Homo sapiens
gcagggaatgcagcagga

SEQ ID NO: 3632079 - DNA, 22 bp, Homo sapiens
gcagggaatgcagcaggaagga

SEQ ID NO: 3632080 - DNA, 20 bp, Homo sapiens
gcagggacctaaagggacta

SEQ ID NO: 3632081 - DNA, 23 bp, Homo sapiens
gcagggagagagtagctgcagcc

SEQ ID NO: 3632082 - DNA, 17 bp, Homo sapiens
gccggtaactgtcctgt

SEQ ID NO: 3632083 - DNA, 17 bp, Homo sapiens
gccggtcgggcagccag

SEQ ID NO: 3632084 - DNA, 19 bp, Homo sapiens
gccggtcgggcagccagca

SEQ ID NO: 3632085 - DNA, 13 bp, Homo sapiens
gccgtaggggctc

SEQ ID NO: 3632086 - DNA, 16 bp, Homo sapiens
gccgtaggggctcctg

SEQ ID NO: 3632087 - DNA, 18 bp, Homo sapiens
gccgtcacccactctgca

SEQ ID NO: 3632088 - DNA, 12 bp, Homo sapiens
gccgtctaactc

SEQ ID NO: 3632089 - DNA, 14 bp, Homo sapiens
gccgtgcgggcgag

SEQ ID NO: 3632090 - DNA, 18 bp, Homo sapiens
gccgtgtctcagcctctg

SEQ ID NO: 3632091 - DNA, 14 bp, Homo sapiens
gcctaaagggcagg

SEQ ID NO: 3632092 - DNA, 21 bp, Homo sapiens
gcctaaagggcagggcccacg

SEQ ID NO: 3632093 - DNA, 18 bp, Homo sapiens
gcctaaatttaatgctgc

SEQ ID NO: 3632094 - DNA, 14 bp, Homo sapiens
gcctaacctgggac

SEQ ID NO: 3632095 - DNA, 23 bp, Homo sapiens
gcctaacctgggacctgtggtca

SEQ ID NO: 3632096 - DNA, 22 bp, Homo sapiens
gcctaagaagaaggccagagag

SEQ ID NO: 3632097 - DNA, 14 bp, Homo sapiens
gcctacctctgtct

SEQ ID NO: 3632098 - DNA, 22 bp, Homo sapiens
gcctagaaagggcaaggggtga

SEQ ID NO: 3632099 - DNA, 12 bp, Homo sapiens
gcctagagtgta

SEQ ID NO: 3632100 - DNA, 14 bp, Homo sapiens
gcctagagtgtagc

SEQ ID NO: 3632101 - DNA, 15 bp, Homo sapiens
gcctagagtgtagcc

SEQ ID NO: 3632102 - DNA, 15 bp, Homo sapiens
gcctagcctgagcca

SEQ ID NO: 3632103 - DNA, 14 bp, Homo sapiens
gcctagcctggctc

SEQ ID NO: 3632104 - DNA, 16 bp, Homo sapiens
gcctagcctggctctg

SEQ ID NO: 3632105 - DNA, 18 bp, Homo sapiens
gcctagcggagcccagcc

SEQ ID NO: 3632106 - DNA, 22 bp, Homo sapiens
gcctagcggagcccagcctggg

SEQ ID NO: 3632107 - DNA, 16 bp, Homo sapiens
gcctagctcctgccac

SEQ ID NO: 3632108 - DNA, 13 bp, Homo sapiens
gcctaggcctcag

SEQ ID NO: 3632109 - DNA, 16 bp, Homo sapiens
gcctaggcctcagcca

SEQ ID NO: 3632110 - DNA, 18 bp, Homo sapiens
gcctaggcctcagccaga

SEQ ID NO: 3632111 - DNA, 13 bp, Homo sapiens
gcctatgaaactg

SEQ ID NO: 3632112 - DNA, 21 bp, Homo sapiens
gcctattatctgtcagctgca

SEQ ID NO: 3632113 - DNA, 18 bp, Homo sapiens
gcctatttcccccttcat

SEQ ID NO: 3632114 - DNA, 13 bp, Homo sapiens
gcctcaaaatgtg

SEQ ID NO: 3632115 - DNA, 16 bp, Homo sapiens
gcctcaagtcactccc

SEQ ID NO: 3632116 - DNA, 16 bp, Homo sapiens
gcctcaccagcccccc

SEQ ID NO: 3632117 - DNA, 15 bp, Homo sapiens
gcctcagaaggcccc

SEQ ID NO: 3632118 - DNA, 14 bp, Homo sapiens
gcctcagcctgctt

SEQ ID NO: 3632119 - DNA, 20 bp, Homo sapiens
gcctcaggacccatccctgc

SEQ ID NO: 3632120 - DNA, 13 bp, Homo sapiens
gcctcaggctccg

SEQ ID NO: 3632121 - DNA, 17 bp, Homo sapiens
gcctcaggctccgggca

SEQ ID NO: 3632122 - DNA, 14 bp, Homo sapiens
gcctcaggctctgc

SEQ ID NO: 3632123 - DNA, 16 bp, Homo sapiens
gcctccaacgcccctg

SEQ ID NO: 3632124 - DNA, 19 bp, Homo sapiens
gcctccaacgcccctgtgg

SEQ ID NO: 3632125 - DNA, 22 bp, Homo sapiens
gcctccaacgcccctgtggcca

SEQ ID NO: 3632126 - DNA, 23 bp, Homo sapiens
gcctccaacgcccctgtggccaa

SEQ ID NO: 3632127 - DNA, 22 bp, Homo sapiens
gcctccaattttttaagtgaaa

SEQ ID NO: 3632128 - DNA, 11 bp, Homo sapiens
gcctccagagg

SEQ ID NO: 3632129 - DNA, 17 bp, Homo sapiens
gcctccagaggtcctcc

SEQ ID NO: 3632130 - DNA, 11 bp, Homo sapiens
gcctccagggc

SEQ ID NO: 3632131 - DNA, 18 bp, Homo sapiens
gcctccagggcccaggtt

SEQ ID NO: 3632132 - DNA, 14 bp, Homo sapiens
gcctccagtgcagt

SEQ ID NO: 3632133 - DNA, 11 bp, Homo sapiens
gcctccatgct

SEQ ID NO: 3632134 - DNA, 17 bp, Homo sapiens
gcctcccaaagtgctgg

SEQ ID NO: 3632135 - DNA, 15 bp, Homo sapiens
gcctcccaccagagc

SEQ ID NO: 3632136 - DNA, 20 bp, Homo sapiens
gcctcccaccagagccggga

SEQ ID NO: 3632137 - DNA, 18 bp, Homo sapiens
gcctcccagagtgctggg

SEQ ID NO: 3632138 - DNA, 22 bp, Homo sapiens
gcctcccattcactagaaaatg

SEQ ID NO: 3632139 - DNA, 17 bp, Homo sapiens
gcctccccagctcaccc

SEQ ID NO: 3632140 - DNA, 12 bp, Homo sapiens
gcctcccctccc

SEQ ID NO: 3632141 - DNA, 13 bp, Homo sapiens
gcctcccctcccc

SEQ ID NO: 3632142 - DNA, 19 bp, Homo sapiens
gcctcccctcccctgggga

SEQ ID NO: 3632143 - DNA, 19 bp, Homo sapiens
gcctcccctctccttcctg

SEQ ID NO: 3632144 - DNA, 24 bp, Homo sapiens
gcctccctctcagaggcctgctgc

SEQ ID NO: 3632145 - DNA, 18 bp, Homo sapiens
gcctccctgaagcctttg

SEQ ID NO: 3632146 - DNA, 13 bp, Homo sapiens
gcctccctgtctc

SEQ ID NO: 3632147 - DNA, 14 bp, Homo sapiens
gcctccctgtctcc

SEQ ID NO: 3632148 - DNA, 15 bp, Homo sapiens
gcctccctgtctcca

SEQ ID NO: 3632149 - DNA, 19 bp, Homo sapiens
gcctccctgtctccagctg

SEQ ID NO: 3632150 - DNA, 14 bp, Homo sapiens
gcctccggaagctg

SEQ ID NO: 3632151 - DNA, 20 bp, Homo sapiens
gcctccgttgtctggttgct

SEQ ID NO: 3632152 - DNA, 18 bp, Homo sapiens
gcctcctcacccccagct

SEQ ID NO: 3632153 - DNA, 15 bp, Homo sapiens
gcctcctcaggagcc

SEQ ID NO: 3632154 - DNA, 14 bp, Homo sapiens
gcctcctcatctgg

SEQ ID NO: 3632155 - DNA, 21 bp, Homo sapiens
gcctcctcggagagcagcagc

SEQ ID NO: 3632156 - DNA, 18 bp, Homo sapiens
gcctcctgccccctgcca

SEQ ID NO: 3632157 - DNA, 12 bp, Homo sapiens
gcctcctgcgcc

SEQ ID NO: 3632158 - DNA, 12 bp, Homo sapiens
gcctcctgggaa

SEQ ID NO: 3632159 - DNA, 16 bp, Homo sapiens
gcctcctgtacctcag

SEQ ID NO: 3632160 - DNA, 22 bp, Homo sapiens
gcctcgacagggcctggagccc

SEQ ID NO: 3632161 - DNA, 17 bp, Homo sapiens
gcctcgacctccccacc

SEQ ID NO: 3632162 - DNA, 18 bp, Homo sapiens
gcctcggatccccttcct

SEQ ID NO: 3632163 - DNA, 18 bp, Homo sapiens
gcctcggtatctggcttc

SEQ ID NO: 3632164 - DNA, 23 bp, Homo sapiens
gcctcggtatctggcttccctgg

SEQ ID NO: 3632165 - DNA, 14 bp, Homo sapiens
gcctcgtgaggggc

SEQ ID NO: 3632166 - DNA, 17 bp, Homo sapiens
gcctcgtgctccgcagg

SEQ ID NO: 3632167 - DNA, 19 bp, Homo sapiens
gcctctcattccagaggaa

SEQ ID NO: 3632168 - DNA, 14 bp, Homo sapiens
gcctctccctgggt

SEQ ID NO: 3632169 - DNA, 13 bp, Homo sapiens
gcctctctggctg

SEQ ID NO: 3632170 - DNA, 18 bp, Homo sapiens
gcctctgacagtccacag

SEQ ID NO: 3632171 - DNA, 19 bp, Homo sapiens
gcctctgacagtccacagg

SEQ ID NO: 3632172 - DNA, 23 bp, Homo sapiens
gcctctgacagtccacaggggcc

SEQ ID NO: 3632173 - DNA, 12 bp, Homo sapiens
gcctctgcagtc

SEQ ID NO: 3632174 - DNA, 18 bp, Homo sapiens
gcctctgcagtctcattt

SEQ ID NO: 3632175 - DNA, 20 bp, Homo sapiens
gcctctgcagtctcatttct

SEQ ID NO: 3632176 - DNA, 23 bp, Homo sapiens
gcctctgccaaaggatgtgatat

SEQ ID NO: 3632177 - DNA, 16 bp, Homo sapiens
gcctctgccagcgcca

SEQ ID NO: 3632178 - DNA, 13 bp, Homo sapiens
gcctctgccctgg

SEQ ID NO: 3632179 - DNA, 11 bp, Homo sapiens
gcctctggccg

SEQ ID NO: 3632180 - DNA, 21 bp, Homo sapiens
gcctctggcttccctaaactg

SEQ ID NO: 3632181 - DNA, 12 bp, Homo sapiens
gcctctgggact

SEQ ID NO: 3632182 - DNA, 14 bp, Homo sapiens
gcctctgggactgg

SEQ ID NO: 3632183 - DNA, 18 bp, Homo sapiens
gcctctgtccgtgcccct

SEQ ID NO: 3632184 - DNA, 22 bp, Homo sapiens
gcctctgttcctttctctgggc

SEQ ID NO: 3632185 - DNA, 19 bp, Homo sapiens
gcctcttctttgtgccttt

SEQ ID NO: 3632186 - DNA, 22 bp, Homo sapiens
gcctcttgagttcctctgcagt

SEQ ID NO: 3632187 - DNA, 24 bp, Homo sapiens
gcctcttgagttcctctgcagttt

SEQ ID NO: 3632188 - DNA, 17 bp, Homo sapiens
gcctgaaggggcgtctg

SEQ ID NO: 3632189 - DNA, 16 bp, Homo sapiens
gcctgacaccccctcc

SEQ ID NO: 3632190 - DNA, 21 bp, Homo sapiens
gcctgacaccccctccccgcc

SEQ ID NO: 3632191 - DNA, 19 bp, Homo sapiens
gcctgacagccttccccag

SEQ ID NO: 3632192 - DNA, 23 bp, Homo sapiens
gcctgaccctacttcttttgctc

SEQ ID NO: 3632193 - DNA, 13 bp, Homo sapiens
gcctgaggctgta

SEQ ID NO: 3632194 - DNA, 20 bp, Homo sapiens
gcctgagggtccacctggag

SEQ ID NO: 3632195 - DNA, 21 bp, Homo sapiens
gcctgagggtccacctggaga

SEQ ID NO: 3632196 - DNA, 20 bp, Homo sapiens
gcctgattcggggctgacct

SEQ ID NO: 3632197 - DNA, 16 bp, Homo sapiens
gcctgcagaatttggg

SEQ ID NO: 3632198 - DNA, 18 bp, Homo sapiens
gcctgcaggacctcgtgc

SEQ ID NO: 3632199 - DNA, 23 bp, Homo sapiens
gcctgcaggacctcgtgccaccc

SEQ ID NO: 3632200 - DNA, 14 bp, Homo sapiens
gcctgcaggagggt

SEQ ID NO: 3632201 - DNA, 16 bp, Homo sapiens
gcctgcatgagctggc

SEQ ID NO: 3632202 - DNA, 20 bp, Homo sapiens
gcctgcccagtcgaccccaa

SEQ ID NO: 3632203 - DNA, 17 bp, Homo sapiens
gcctgcctgttcccatt

SEQ ID NO: 3632204 - DNA, 21 bp, Homo sapiens
gcctgcgccaccgcccagaga

SEQ ID NO: 3632205 - DNA, 12 bp, Homo sapiens
gcctgctccaga

SEQ ID NO: 3632206 - DNA, 15 bp, Homo sapiens
gcctgctccagacct

SEQ ID NO: 3632207 - DNA, 17 bp, Homo sapiens
gcctgctccagacctga

SEQ ID NO: 3632208 - DNA, 18 bp, Homo sapiens
gcctggagccccatcggc

SEQ ID NO: 3632209 - DNA, 13 bp, Homo sapiens
gcctggaggtctg

SEQ ID NO: 3632210 - DNA, 21 bp, Homo sapiens
gcctggcagccgtgccttcag

SEQ ID NO: 3632211 - DNA, 22 bp, Homo sapiens
gcctggcagccgtgccttcagc

SEQ ID NO: 3632212 - DNA, 14 bp, Homo sapiens
gcctggccagacac

SEQ ID NO: 3632213 - DNA, 16 bp, Homo sapiens
gcctggccaggcaggg

SEQ ID NO: 3632214 - DNA, 17 bp, Homo sapiens
gcctggccaggcaggga

SEQ ID NO: 3632215 - DNA, 14 bp, Homo sapiens
gcttgcctgaagct

SEQ ID NO: 3632216 - DNA, 19 bp, Homo sapiens
gcttgctgggctttgggaa

SEQ ID NO: 3632217 - DNA, 21 bp, Homo sapiens
gcttggcccttcaagggtcag

SEQ ID NO: 3632218 - DNA, 15 bp, Homo sapiens
gcttgggaattttat

SEQ ID NO: 3632219 - DNA, 16 bp, Homo sapiens
gcttgggcagatctcc

SEQ ID NO: 3632220 - DNA, 18 bp, Homo sapiens
gcttggggattgtacacg

SEQ ID NO: 3632221 - DNA, 15 bp, Homo sapiens
gcttgtactgggaca

SEQ ID NO: 3632222 - DNA, 17 bp, Homo sapiens
gcttgtgtgcgtgcgtg

SEQ ID NO: 3632223 - DNA, 16 bp, Homo sapiens
gcttgtgttctgctcc

SEQ ID NO: 3632224 - DNA, 22 bp, Homo sapiens
gcttgttgaaaacccagactgt

SEQ ID NO: 3632225 - DNA, 18 bp, Homo sapiens
gctttaaaaaaataattg

SEQ ID NO: 3632226 - DNA, 14 bp, Homo sapiens
gctttaaaacaaag

SEQ ID NO: 3632227 - DNA, 19 bp, Homo sapiens
gctttaagtgtgctgggca

SEQ ID NO: 3632228 - DNA, 23 bp, Homo sapiens
gctttaatgagtgcacctgcctc

SEQ ID NO: 3632229 - DNA, 19 bp, Homo sapiens
gctttagagataattgctt

SEQ ID NO: 3632230 - DNA, 16 bp, Homo sapiens
gctttatgcaaataca

SEQ ID NO: 3632231 - DNA, 19 bp, Homo sapiens
gctttcagagccagcctgg

SEQ ID NO: 3632232 - DNA, 20 bp, Homo sapiens
gctttcagagccagcctggc

SEQ ID NO: 3632233 - DNA, 23 bp, Homo sapiens
gctttcagagccagcctggctct

SEQ ID NO: 3632234 - DNA, 15 bp, Homo sapiens
gctttcaggagctcc

SEQ ID NO: 3632235 - DNA, 20 bp, Homo sapiens
gctttcataaatcatgttgt

SEQ ID NO: 3632236 - DNA, 19 bp, Homo sapiens
gctttcccccaggcgcctg

SEQ ID NO: 3632237 - DNA, 19 bp, Homo sapiens
gctttcctcatcaggccat

SEQ ID NO: 3632238 - DNA, 14 bp, Homo sapiens
gctttcctgcagca

SEQ ID NO: 3632239 - DNA, 15 bp, Homo sapiens
gctttctcttcccct

SEQ ID NO: 3632240 - DNA, 19 bp, Homo sapiens
gctttctgctcagcttctc

SEQ ID NO: 3632241 - DNA, 22 bp, Homo sapiens
gctttctttccgtcaccctggg

SEQ ID NO: 3632242 - DNA, 21 bp, Homo sapiens
gctttgagactcctcagcacc

SEQ ID NO: 3632243 - DNA, 14 bp, Homo sapiens
gctttgcccacccc

SEQ ID NO: 3632244 - DNA, 18 bp, Homo sapiens
gctttgcccacccctcac

SEQ ID NO: 3632245 - DNA, 13 bp, Homo sapiens
gctttgcctcttc

SEQ ID NO: 3632246 - DNA, 18 bp, Homo sapiens
gctttgctttctgctcag

SEQ ID NO: 3632247 - DNA, 22 bp, Homo sapiens
gctttggaacaatcacagggaa

SEQ ID NO: 3632248 - DNA, 14 bp, Homo sapiens
gctttggaagtttt

SEQ ID NO: 3632249 - DNA, 18 bp, Homo sapiens
gctttgggaagtttgctg

SEQ ID NO: 3632250 - DNA, 14 bp, Homo sapiens
gctttgggctgccc

SEQ ID NO: 3632251 - DNA, 23 bp, Homo sapiens
gctttgggggagtgggcgcagtg

SEQ ID NO: 3632252 - DNA, 22 bp, Homo sapiens
gctttggttccttctctgggtc

SEQ ID NO: 3632253 - DNA, 16 bp, Homo sapiens
gctttgttgtgagaat

SEQ ID NO: 3632254 - DNA, 18 bp, Homo sapiens
gctttgttgtgagaatgg

SEQ ID NO: 3632255 - DNA, 22 bp, Homo sapiens
gcttttaaaaacaaatgagttt

SEQ ID NO: 3632256 - DNA, 21 bp, Homo sapiens
gcttttactgaagcctttctt

SEQ ID NO: 3632257 - DNA, 13 bp, Homo sapiens
gcttttcactgct

SEQ ID NO: 3632258 - DNA, 14 bp, Homo sapiens
gcttttcactgctg

SEQ ID NO: 3632259 - DNA, 18 bp, Homo sapiens
gcttttcactgctggctg

SEQ ID NO: 3632260 - DNA, 16 bp, Homo sapiens
gcttttctgtcctggg

SEQ ID NO: 3632261 - DNA, 18 bp, Homo sapiens
gcttttctgtcctgggca

SEQ ID NO: 3632262 - DNA, 11 bp, Homo sapiens
gcttttggaag

SEQ ID NO: 3632263 - DNA, 20 bp, Homo sapiens
gcttttgtctaattaaaaca

SEQ ID NO: 3632264 - DNA, 15 bp, Homo sapiens
gctttttaatattga

SEQ ID NO: 3632265 - DNA, 14 bp, Homo sapiens
gctttttgtcatgt

SEQ ID NO: 3632266 - DNA, 23 bp, Homo sapiens
gctttttgtcatgttatgcagtg

SEQ ID NO: 3632267 - DNA, 17 bp, Homo sapiens
ggaaaaacaggaaagga

SEQ ID NO: 3632268 - DNA, 19 bp, Homo sapiens
ggaaaaactgacagatgct

SEQ ID NO: 3632269 - DNA, 21 bp, Homo sapiens
ggaaaaccaagccgtggcttc

SEQ ID NO: 3632270 - DNA, 22 bp, Homo sapiens
ggaaaaccaagccgtggcttcc

SEQ ID NO: 3632271 - DNA, 22 bp, Homo sapiens
ggaaaagcaagaaacagtttct

SEQ ID NO: 3632272 - DNA, 18 bp, Homo sapiens
ggaaaagcagctctcccc

SEQ ID NO: 3632273 - DNA, 12 bp, Homo sapiens
ggaaaaggcccc

SEQ ID NO: 3632274 - DNA, 16 bp, Homo sapiens
ggaaaaggcccctgca

SEQ ID NO: 3632275 - DNA, 22 bp, Homo sapiens
ggaaaagtcaaagtgttgctgt

SEQ ID NO: 3632276 - DNA, 15 bp, Homo sapiens
ggaaaagtcttccta

SEQ ID NO: 3632277 - DNA, 21 bp, Homo sapiens
ggaaaataaacatcagtttct

SEQ ID NO: 3632278 - DNA, 13 bp, Homo sapiens
ggaaacaacagct

SEQ ID NO: 3632279 - DNA, 16 bp, Homo sapiens
ggaaacaacagcttta

SEQ ID NO: 3632280 - DNA, 13 bp, Homo sapiens
ggaaactgccagc

SEQ ID NO: 3632281 - DNA, 18 bp, Homo sapiens
ggaaagagctaggaaccc

SEQ ID NO: 3632282 - DNA, 21 bp, Homo sapiens
ggaaagcacaagactggccca

SEQ ID NO: 3632283 - DNA, 21 bp, Homo sapiens
ggaaagcagagcctcctggga

SEQ ID NO: 3632284 - DNA, 18 bp, Homo sapiens
ggaaagcgggcagccccg

SEQ ID NO: 3632285 - DNA, 22 bp, Homo sapiens
ggaaaggccctgcacaggtggc

SEQ ID NO: 3632286 - DNA, 23 bp, Homo sapiens
ggaaagtcaggctagctgtgctg

SEQ ID NO: 3632287 - DNA, 12 bp, Homo sapiens
ggaaagttttta

SEQ ID NO: 3632288 - DNA, 17 bp, Homo sapiens
ggaaatagatgtgcagt

SEQ ID NO: 3632289 - DNA, 18 bp, Homo sapiens
ggaaatagatgtgcagtt

SEQ ID NO: 3632290 - DNA, 17 bp, Homo sapiens
ggaaatcaaatatgcaa

SEQ ID NO: 3632291 - DNA, 18 bp, Homo sapiens
ggaaatctgtaacaggta

SEQ ID NO: 3632292 - DNA, 17 bp, Homo sapiens
ggaaatgtcaacaagta

SEQ ID NO: 3632293 - DNA, 16 bp, Homo sapiens
ggaacaccctggatgc

SEQ ID NO: 3632294 - DNA, 23 bp, Homo sapiens
ggaacagaagaggaaagagagac

SEQ ID NO: 3632295 - DNA, 13 bp, Homo sapiens
ggaacccagactc

SEQ ID NO: 3632296 - DNA, 22 bp, Homo sapiens
ggaacccccctcccacccaccg

SEQ ID NO: 3632297 - DNA, 12 bp, Homo sapiens
ggaaccctcagg

SEQ ID NO: 3632298 - DNA, 12 bp, Homo sapiens
ggaacctcagcc

SEQ ID NO: 3632299 - DNA, 19 bp, Homo sapiens
ggaacctcagcctggccag

SEQ ID NO: 3632300 - DNA, 22 bp, Homo sapiens
ggaactagaaagaaggacccag

SEQ ID NO: 3632301 - DNA, 15 bp, Homo sapiens
ggaactcagatccag

SEQ ID NO: 3632302 - DNA, 19 bp, Homo sapiens
ggaactcagatccagggac

SEQ ID NO: 3632303 - DNA, 12 bp, Homo sapiens
ggaactgaaatc

SEQ ID NO: 3632304 - DNA, 17 bp, Homo sapiens
ggaactgaccctcaggc

SEQ ID NO: 3632305 - DNA, 20 bp, Homo sapiens
ggaactgctgggcttggcag

SEQ ID NO: 3632306 - DNA, 15 bp, Homo sapiens
ggaagacctgaaaga

SEQ ID NO: 3632307 - DNA, 23 bp, Homo sapiens
ggaagagtgtgggggaggcgcac

SEQ ID NO: 3632308 - DNA, 23 bp, Homo sapiens
ggaagatggagacaccctctggg

SEQ ID NO: 3632309 - DNA, 15 bp, Homo sapiens
ggaagccaggtacag

SEQ ID NO: 3632310 - DNA, 23 bp, Homo sapiens
ggaagccatccctttttttacat

SEQ ID NO: 3632311 - DNA, 16 bp, Homo sapiens
ggaagctcccacccca

SEQ ID NO: 3632312 - DNA, 19 bp, Homo sapiens
ggaagctctccgagctctg

SEQ ID NO: 3632313 - DNA, 21 bp, Homo sapiens
ggaagctctccgagctctggt

SEQ ID NO: 3632314 - DNA, 13 bp, Homo sapiens
ggaagctgtcctg

SEQ ID NO: 3632315 - DNA, 21 bp, Homo sapiens
ggaagctgtgttgaaacagaa

SEQ ID NO: 3632316 - DNA, 22 bp, Homo sapiens
ggaagctgtgttgaaacagaaa

SEQ ID NO: 3632317 - DNA, 21 bp, Homo sapiens
ggaagcttccatgatgcacag

SEQ ID NO: 3632318 - DNA, 22 bp, Homo sapiens
ggaagcttccatgatgcacagt

SEQ ID NO: 3632319 - DNA, 22 bp, Homo sapiens
ggaagcttgttgaaaacccaga

SEQ ID NO: 3632320 - DNA, 21 bp, Homo sapiens
ggaagggagagttctttgctg

SEQ ID NO: 3632321 - DNA, 11 bp, Homo sapiens
ggaagggagcc

SEQ ID NO: 3632322 - DNA, 13 bp, Homo sapiens
ggaagggagccaa

SEQ ID NO: 3632323 - DNA, 17 bp, Homo sapiens
ggaagggagccaaggga

SEQ ID NO: 3632324 - DNA, 24 bp, Homo sapiens
ggaagggctttggttccttctctg

SEQ ID NO: 3632325 - DNA, 24 bp, Homo sapiens
ggaagtacttggcccccttcagga

SEQ ID NO: 3632326 - DNA, 20 bp, Homo sapiens
ggaagtggtggctgtggaag

SEQ ID NO: 3632327 - DNA, 21 bp, Homo sapiens
ggaagtgtgggtctgtgtgtg

SEQ ID NO: 3632328 - DNA, 16 bp, Homo sapiens
ggaagtttgctgtgct

SEQ ID NO: 3632329 - DNA, 15 bp, Homo sapiens
ggaataaagttgcag

SEQ ID NO: 3632330 - DNA, 21 bp, Homo sapiens
ggaatagtatcctccaggttt

SEQ ID NO: 3632331 - DNA, 18 bp, Homo sapiens
ggaatccagaaggaagct

SEQ ID NO: 3632332 - DNA, 17 bp, Homo sapiens
ggaatcctatatagaat

SEQ ID NO: 3632333 - DNA, 17 bp, Homo sapiens
ggaatctagcccaacct

SEQ ID NO: 3632334 - DNA, 18 bp, Homo sapiens
ggaatctagcccaaccta

SEQ ID NO: 3632335 - DNA, 18 bp, Homo sapiens
ggaatggccacaaacctg

SEQ ID NO: 3632336 - DNA, 17 bp, Homo sapiens
ggaatggccctcattca

SEQ ID NO: 3632337 - DNA, 20 bp, Homo sapiens
ggaatggtcaagttgtttca

SEQ ID NO: 3632338 - DNA, 15 bp, Homo sapiens
ggaattcagtgcctt

SEQ ID NO: 3632339 - DNA, 13 bp, Homo sapiens
ggaattccctccc

SEQ ID NO: 3632340 - DNA, 11 bp, Homo sapiens
ggaattgagca

SEQ ID NO: 3632341 - DNA, 14 bp, Homo sapiens
ggaattggagattg

SEQ ID NO: 3632342 - DNA, 23 bp, Homo sapiens
ggaatttctcccagtcatttaat

SEQ ID NO: 3632343 - DNA, 19 bp, Homo sapiens
ggacaatgtccaaacccac

SEQ ID NO: 3632344 - DNA, 20 bp, Homo sapiens
ggacacaacagcagtctcct

SEQ ID NO: 3632345 - DNA, 21 bp, Homo sapiens
ggacacaataggtctttctct

SEQ ID NO: 3632346 - DNA, 22 bp, Homo sapiens
ggccatgctcaacccccctccc

SEQ ID NO: 3632347 - DNA, 14 bp, Homo sapiens
ggcccaatgctgct

SEQ ID NO: 3632348 - DNA, 15 bp, Homo sapiens
ggcccaatgctgctt

SEQ ID NO: 3632349 - DNA, 17 bp, Homo sapiens
ggcccaatgctgctttt

SEQ ID NO: 3632350 - DNA, 14 bp, Homo sapiens
ggcccacacctggt

SEQ ID NO: 3632351 - DNA, 14 bp, Homo sapiens
ggcccaccagggtc

SEQ ID NO: 3632352 - DNA, 17 bp, Homo sapiens
ggcccactccccagccc

SEQ ID NO: 3632353 - DNA, 19 bp, Homo sapiens
ggcccactccccagcccca

SEQ ID NO: 3632354 - DNA, 13 bp, Homo sapiens
ggcccactgctcg

SEQ ID NO: 3632355 - DNA, 18 bp, Homo sapiens
ggcccagagcccagctcc

SEQ ID NO: 3632356 - DNA, 18 bp, Homo sapiens
ggcccagagcgaggaaag

SEQ ID NO: 3632357 - DNA, 20 bp, Homo sapiens
ggcccagagcgaggaaagga

SEQ ID NO: 3632358 - DNA, 12 bp, Homo sapiens
ggcccagcccag

SEQ ID NO: 3632359 - DNA, 22 bp, Homo sapiens
ggcccaggaccatcatcctact

SEQ ID NO: 3632360 - DNA, 17 bp, Homo sapiens
ggcccagggcccagagc

SEQ ID NO: 3632361 - DNA, 22 bp, Homo sapiens
ggcccagggcccagagcccagc

SEQ ID NO: 3632362 - DNA, 19 bp, Homo sapiens
ggccccacctcggcacaca

SEQ ID NO: 3632363 - DNA, 20 bp, Homo sapiens
ggccccacctcggcacacac

SEQ ID NO: 3632364 - DNA, 13 bp, Homo sapiens
ggccccagagaga

SEQ ID NO: 3632365 - DNA, 12 bp, Homo sapiens
ggccccagaggc

SEQ ID NO: 3632366 - DNA, 23 bp, Homo sapiens
ggccccatccaaccactgtacac

SEQ ID NO: 3632367 - DNA, 17 bp, Homo sapiens
ggccccatcctcatccc

SEQ ID NO: 3632368 - DNA, 21 bp, Homo sapiens
ggccccatggcagctcctgac

SEQ ID NO: 3632369 - DNA, 21 bp, Homo sapiens
ggccccccgcgctcgcccagc

SEQ ID NO: 3632370 - DNA, 14 bp, Homo sapiens
ggcccccttcagga

SEQ ID NO: 3632371 - DNA, 16 bp, Homo sapiens
ggcccccttcaggagc

SEQ ID NO: 3632372 - DNA, 18 bp, Homo sapiens
ggcccccttcaggagcct

SEQ ID NO: 3632373 - DNA, 21 bp, Homo sapiens
ggcccccttcaggagcctggc

SEQ ID NO: 3632374 - DNA, 23 bp, Homo sapiens
ggcccccttcaggagcctggcca

SEQ ID NO: 3632375 - DNA, 19 bp, Homo sapiens
ggccccgacgtttgcggca

SEQ ID NO: 3632376 - DNA, 14 bp, Homo sapiens
ggccccgccagggc

SEQ ID NO: 3632377 - DNA, 16 bp, Homo sapiens
ggccccgccagggctg

SEQ ID NO: 3632378 - DNA, 17 bp, Homo sapiens
ggccccgccagggctgg

SEQ ID NO: 3632379 - DNA, 21 bp, Homo sapiens
ggccccgccagggctggggac

SEQ ID NO: 3632380 - DNA, 18 bp, Homo sapiens
ggccccgggctggagaaa

SEQ ID NO: 3632381 - DNA, 15 bp, Homo sapiens
ggcccctccctctcc

SEQ ID NO: 3632382 - DNA, 21 bp, Homo sapiens
ggcccctgaggagctttgtgt

SEQ ID NO: 3632383 - DNA, 14 bp, Homo sapiens
ggcccctggatctc

SEQ ID NO: 3632384 - DNA, 18 bp, Homo sapiens
ggcccgacaggtgggcct

SEQ ID NO: 3632385 - DNA, 19 bp, Homo sapiens
ggcccgacaggtgggcctg

SEQ ID NO: 3632386 - DNA, 21 bp, Homo sapiens
ggcccgacaggtgggcctggg

SEQ ID NO: 3632387 - DNA, 16 bp, Homo sapiens
ggcccgcgcagctgcc

SEQ ID NO: 3632388 - DNA, 16 bp, Homo sapiens
ggcccggccggagggc

SEQ ID NO: 3632389 - DNA, 23 bp, Homo sapiens
ggccctccctgtctccagggccc

SEQ ID NO: 3632390 - DNA, 21 bp, Homo sapiens
ggccctccctgttccccagag

SEQ ID NO: 3632391 - DNA, 12 bp, Homo sapiens
ggccctcctcag

SEQ ID NO: 3632392 - DNA, 13 bp, Homo sapiens
ggccctgagctga

SEQ ID NO: 3632393 - DNA, 20 bp, Homo sapiens
ggccctgccctgcccaacct

SEQ ID NO: 3632394 - DNA, 21 bp, Homo sapiens
ggccctgccctgcccaacctc

SEQ ID NO: 3632395 - DNA, 14 bp, Homo sapiens
ggccctggccagga

SEQ ID NO: 3632396 - DNA, 22 bp, Homo sapiens
ggccctggctcccacaggccct

SEQ ID NO: 3632397 - DNA, 22 bp, Homo sapiens
ggccctggggatcttcccacag

SEQ ID NO: 3632398 - DNA, 23 bp, Homo sapiens
ggccctggggatcttcccacagg

SEQ ID NO: 3632399 - DNA, 15 bp, Homo sapiens
ggcccttcctctcca

SEQ ID NO: 3632400 - DNA, 16 bp, Homo sapiens
ggcccttggaaaaaca

SEQ ID NO: 3632401 - DNA, 14 bp, Homo sapiens
ggcccttggtgggg

SEQ ID NO: 3632402 - DNA, 15 bp, Homo sapiens
ggccgaggtgggcag

SEQ ID NO: 3632403 - DNA, 15 bp, Homo sapiens
ggccgccacggcctg

SEQ ID NO: 3632404 - DNA, 17 bp, Homo sapiens
ggccgccacggcctggc

SEQ ID NO: 3632405 - DNA, 21 bp, Homo sapiens
ggccgccccgccccagagctc

SEQ ID NO: 3632406 - DNA, 22 bp, Homo sapiens
ggccgctgccacccacctccct

SEQ ID NO: 3632407 - DNA, 23 bp, Homo sapiens
ggccggaaggaatgtcagggcca

SEQ ID NO: 3632408 - DNA, 16 bp, Homo sapiens
ggccggctgagtggca

SEQ ID NO: 3632409 - DNA, 22 bp, Homo sapiens
ggccggggctctgggtgctgcc

SEQ ID NO: 3632410 - DNA, 21 bp, Homo sapiens
ggccgtaggggctcctgagtg

SEQ ID NO: 3632411 - DNA, 20 bp, Homo sapiens
ggccgtatgaagacagaggc

SEQ ID NO: 3632412 - DNA, 13 bp, Homo sapiens
ggcctagaaaggg

SEQ ID NO: 3632413 - DNA, 10 bp, Homo sapiens
ggcctatgaa

SEQ ID NO: 3632414 - DNA, 16 bp, Homo sapiens
ggcctcagaccccctc

SEQ ID NO: 3632415 - DNA, 19 bp, Homo sapiens
ggcctcagaccccctcagc

SEQ ID NO: 3632416 - DNA, 21 bp, Homo sapiens
ggcctcagaccccctcagcct

SEQ ID NO: 3632417 - DNA, 20 bp, Homo sapiens
ggcctcagccagagaagcta

SEQ ID NO: 3632418 - DNA, 13 bp, Homo sapiens
ggcctcaggctcc

SEQ ID NO: 3632419 - DNA, 14 bp, Homo sapiens
ggcctcaggctctg

SEQ ID NO: 3632420 - DNA, 16 bp, Homo sapiens
ggcctccaacgcccct

SEQ ID NO: 3632421 - DNA, 17 bp, Homo sapiens
ggcctccaacgcccctg

SEQ ID NO: 3632422 - DNA, 23 bp, Homo sapiens
ggcctccaacgcccctgtggcca

SEQ ID NO: 3632423 - DNA, 17 bp, Homo sapiens
ggcctcccacagactca

SEQ ID NO: 3632424 - DNA, 13 bp, Homo sapiens
ggcctccctgctg

SEQ ID NO: 3632425 - DNA, 17 bp, Homo sapiens
ggcctcctcggagagca

SEQ ID NO: 3632426 - DNA, 15 bp, Homo sapiens
ggcctgaactgagga

SEQ ID NO: 3632427 - DNA, 19 bp, Homo sapiens
ggcctgaagagtcctctga

SEQ ID NO: 3632428 - DNA, 16 bp, Homo sapiens
ggcctgacaccccctc

SEQ ID NO: 3632429 - DNA, 17 bp, Homo sapiens
ggcctgacaccccctcc

SEQ ID NO: 3632430 - DNA, 20 bp, Homo sapiens
ggcctgagggtccacctgga

SEQ ID NO: 3632431 - DNA, 21 bp, Homo sapiens
ggcctgagggtccacctggag

SEQ ID NO: 3632432 - DNA, 14 bp, Homo sapiens
ggcctgccatgcca

SEQ ID NO: 3632433 - DNA, 19 bp, Homo sapiens
ggcctgccccctgggctgg

SEQ ID NO: 3632434 - DNA, 22 bp, Homo sapiens
ggcctgccccctgggctggggc

SEQ ID NO: 3632435 - DNA, 13 bp, Homo sapiens
ggcctgcccctgt

SEQ ID NO: 3632436 - DNA, 19 bp, Homo sapiens
ggcctgcggaggcggtggc

SEQ ID NO: 3632437 - DNA, 17 bp, Homo sapiens
ggcctgctccagacctg

SEQ ID NO: 3632438 - DNA, 11 bp, Homo sapiens
ggcctggagca

SEQ ID NO: 3632439 - DNA, 14 bp, Homo sapiens
ggcctggagcaggc

SEQ ID NO: 3632440 - DNA, 15 bp, Homo sapiens
ggcctggcagccgtg

SEQ ID NO: 3632441 - DNA, 20 bp, Homo sapiens
ggcctggctggtgggaaggc

SEQ ID NO: 3632442 - DNA, 17 bp, Homo sapiens
ggcctgggccgcccaga

SEQ ID NO: 3632443 - DNA, 23 bp, Homo sapiens
ggcctggggacccaaaccccctg

SEQ ID NO: 3632444 - DNA, 22 bp, Homo sapiens
ggcctgtcaagagggaggaagg

SEQ ID NO: 3632445 - DNA, 12 bp, Homo sapiens
ggcctgtcccaa

SEQ ID NO: 3632446 - DNA, 15 bp, Homo sapiens
ggccttaaagaggga

SEQ ID NO: 3632447 - DNA, 15 bp, Homo sapiens
ggccttaactatttc

SEQ ID NO: 3632448 - DNA, 21 bp, Homo sapiens
ggccttatctgaaaggccagc

SEQ ID NO: 3632449 - DNA, 13 bp, Homo sapiens
ggccttccccagc

SEQ ID NO: 3632450 - DNA, 14 bp, Homo sapiens
ggccttccccagca

SEQ ID NO: 3632451 - DNA, 23 bp, Homo sapiens
ggcctttaaaacgcgtctgcctg

SEQ ID NO: 3632452 - DNA, 21 bp, Homo sapiens
ggcctttaagaaccttaatga

SEQ ID NO: 3632453 - DNA, 24 bp, Homo sapiens
ggcctttaagaaccttaatgacaa

SEQ ID NO: 3632454 - DNA, 13 bp, Homo sapiens
ggcctttcctctg

SEQ ID NO: 3632455 - DNA, 15 bp, Homo sapiens
ggcctttttcattta

SEQ ID NO: 3632456 - DNA, 20 bp, Homo sapiens
ggcgagggatgatgagggaa

SEQ ID NO: 3632457 - DNA, 12 bp, Homo sapiens
ggcgcagccctc

SEQ ID NO: 3632458 - DNA, 20 bp, Homo sapiens
ggcggaggggatccagccac

SEQ ID NO: 3632459 - DNA, 16 bp, Homo sapiens
ggcggccccgccgcag

SEQ ID NO: 3632460 - DNA, 15 bp, Homo sapiens
ggcggctgcacaaca

SEQ ID NO: 3632461 - DNA, 21 bp, Homo sapiens
ggcggctgcacaacagccctg

SEQ ID NO: 3632462 - DNA, 22 bp, Homo sapiens
ggcggctgcacaacagccctgc

SEQ ID NO: 3632463 - DNA, 24 bp, Homo sapiens
ggcgggtgtggagaccaggctcct

SEQ ID NO: 3632464 - DNA, 15 bp, Homo sapiens
ggcggtcccagctcc

SEQ ID NO: 3632465 - DNA, 13 bp, Homo sapiens
ggcggtggctgcc

SEQ ID NO: 3632466 - DNA, 15 bp, Homo sapiens
ggcgtactacccagc

SEQ ID NO: 3632467 - DNA, 20 bp, Homo sapiens
ggcgtctggactgttctgta

SEQ ID NO: 3632468 - DNA, 12 bp, Homo sapiens
ggcgtgagccac

SEQ ID NO: 3632469 - DNA, 22 bp, Homo sapiens
ggcgtggtgtgtccctggacac

SEQ ID NO: 3632470 - DNA, 23 bp, Homo sapiens
ggcgtggtgtgtccctggacaca

SEQ ID NO: 3632471 - DNA, 22 bp, Homo sapiens
ggcgtgtatctggtatatgtaa

SEQ ID NO: 3632472 - DNA, 18 bp, Homo sapiens
ggcgttgggagcctagct

SEQ ID NO: 3632473 - DNA, 16 bp, Homo sapiens
ggctaatgtactgcat

SEQ ID NO: 3632474 - DNA, 20 bp, Homo sapiens
ggctactggttacctggaga

SEQ ID NO: 3632475 - DNA, 21 bp, Homo sapiens
ggctactggttacctggagaa

SEQ ID NO: 3632476 - DNA, 16 bp, Homo sapiens
ggctactgtaatgctg

SEQ ID NO: 3632477 - DNA, 22 bp, Homo sapiens
ggctactgtaatgctgcctcag

SEQ ID NO: 3632478 - DNA, 20 bp, Homo sapiens
gggtttcaccatgttggcca

SEQ ID NO: 3632479 - DNA, 16 bp, Homo sapiens
gggtttcgactggtcc

SEQ ID NO: 3632480 - DNA, 18 bp, Homo sapiens
gggtttcgactggtccag

SEQ ID NO: 3632481 - DNA, 19 bp, Homo sapiens
gggtttgtgtttgattggc

SEQ ID NO: 3632482 - DNA, 21 bp, Homo sapiens
gggtttgtgtttgattggctt

SEQ ID NO: 3632483 - DNA, 20 bp, Homo sapiens
gggtttttgtatccagagct

SEQ ID NO: 3632484 - DNA, 14 bp, Homo sapiens
ggtaaagtttgctc

SEQ ID NO: 3632485 - DNA, 19 bp, Homo sapiens
ggtaagaatagtagatgtg

SEQ ID NO: 3632486 - DNA, 18 bp, Homo sapiens
ggtaagttttttgaaatt

SEQ ID NO: 3632487 - DNA, 23 bp, Homo sapiens
ggtaatacccgtcctctcggctg

SEQ ID NO: 3632488 - DNA, 13 bp, Homo sapiens
ggtacaggagagg

SEQ ID NO: 3632489 - DNA, 15 bp, Homo sapiens
ggtacaggagaggca

SEQ ID NO: 3632490 - DNA, 17 bp, Homo sapiens
ggtacctcaagccccat

SEQ ID NO: 3632491 - DNA, 22 bp, Homo sapiens
ggtacctcaagccccatttcct

SEQ ID NO: 3632492 - DNA, 19 bp, Homo sapiens
ggtactgcattctctccca

SEQ ID NO: 3632493 - DNA, 23 bp, Homo sapiens
ggtacttatttctcagctgtgcc

SEQ ID NO: 3632494 - DNA, 13 bp, Homo sapiens
ggtagcagcaggc

SEQ ID NO: 3632495 - DNA, 16 bp, Homo sapiens
ggtagcagcaggctca

SEQ ID NO: 3632496 - DNA, 13 bp, Homo sapiens
ggtagctggggag

SEQ ID NO: 3632497 - DNA, 18 bp, Homo sapiens
ggtaggaactgctgggct

SEQ ID NO: 3632498 - DNA, 16 bp, Homo sapiens
ggtaggaccctcgaga

SEQ ID NO: 3632499 - DNA, 17 bp, Homo sapiens
ggtaggaccctcgagag

SEQ ID NO: 3632500 - DNA, 21 bp, Homo sapiens
ggtaggaccctcgagagcctt

SEQ ID NO: 3632501 - DNA, 15 bp, Homo sapiens
ggtagtggctggggt

SEQ ID NO: 3632502 - DNA, 17 bp, Homo sapiens
ggtatctggcttccctg

SEQ ID NO: 3632503 - DNA, 21 bp, Homo sapiens
ggtatctggcttccctggaag

SEQ ID NO: 3632504 - DNA, 18 bp, Homo sapiens
ggtatgtagccagctgtg

SEQ ID NO: 3632505 - DNA, 21 bp, Homo sapiens
ggtatttttttgtaattgctt

SEQ ID NO: 3632506 - DNA, 18 bp, Homo sapiens
ggtcaaaactgaagcttt

SEQ ID NO: 3632507 - DNA, 18 bp, Homo sapiens
ggtcacaggactctgcct

SEQ ID NO: 3632508 - DNA, 14 bp, Homo sapiens
ggtcaccaggggag

SEQ ID NO: 3632509 - DNA, 22 bp, Homo sapiens
ggtcaccaggggaggagcctgt

SEQ ID NO: 3632510 - DNA, 20 bp, Homo sapiens
ggtcacgtttggtgcttctc

SEQ ID NO: 3632511 - DNA, 22 bp, Homo sapiens
ggtcactcgtggtgaggctgac

SEQ ID NO: 3632512 - DNA, 17 bp, Homo sapiens
ggtcactcttttgatgg

SEQ ID NO: 3632513 - DNA, 23 bp, Homo sapiens
ggtcatcttggaaaggggaggag

SEQ ID NO: 3632514 - DNA, 16 bp, Homo sapiens
ggtcatgccctcctct

SEQ ID NO: 3632515 - DNA, 17 bp, Homo sapiens
ggtccacacctgggcat

SEQ ID NO: 3632516 - DNA, 13 bp, Homo sapiens
ggtccacagctgg

SEQ ID NO: 3632517 - DNA, 12 bp, Homo sapiens
ggtccacctgga

SEQ ID NO: 3632518 - DNA, 17 bp, Homo sapiens
ggtccaggagagcctgg

SEQ ID NO: 3632519 - DNA, 18 bp, Homo sapiens
ggtccaggagagcctggg

SEQ ID NO: 3632520 - DNA, 16 bp, Homo sapiens
ggtccagggcctgaca

SEQ ID NO: 3632521 - DNA, 21 bp, Homo sapiens
ggtccagggcctgacaccccc

SEQ ID NO: 3632522 - DNA, 22 bp, Homo sapiens
ggtcccagagacctcatcagcc

SEQ ID NO: 3632523 - DNA, 14 bp, Homo sapiens
ggtccccactgctg

SEQ ID NO: 3632524 - DNA, 20 bp, Homo sapiens
ggtcccggtgtatcctggcc

SEQ ID NO: 3632525 - DNA, 17 bp, Homo sapiens
ggtccctccaccccaca

SEQ ID NO: 3632526 - DNA, 21 bp, Homo sapiens
ggtcctcagagaatttctacc

SEQ ID NO: 3632527 - DNA, 23 bp, Homo sapiens
ggtcctccgtagggtctttcttg

SEQ ID NO: 3632528 - DNA, 24 bp, Homo sapiens
ggtcctctctgagtcaaatccagt

SEQ ID NO: 3632529 - DNA, 22 bp, Homo sapiens
ggtcctcttttcctggcagctg

SEQ ID NO: 3632530 - DNA, 22 bp, Homo sapiens
ggtcctgcacatgagtggaaat

SEQ ID NO: 3632531 - DNA, 16 bp, Homo sapiens
ggtcctgcagcctgca

SEQ ID NO: 3632532 - DNA, 20 bp, Homo sapiens
ggtcctgcagtctggctgag

SEQ ID NO: 3632533 - DNA, 13 bp, Homo sapiens
ggtcctggccatc

SEQ ID NO: 3632534 - DNA, 16 bp, Homo sapiens
ggtcctggccatccca

SEQ ID NO: 3632535 - DNA, 15 bp, Homo sapiens
ggtcctgggggcagg

SEQ ID NO: 3632536 - DNA, 14 bp, Homo sapiens
ggtcctggtgccct

SEQ ID NO: 3632537 - DNA, 16 bp, Homo sapiens
ggtccttttgacactg

SEQ ID NO: 3632538 - DNA, 18 bp, Homo sapiens
ggtcgcttgggaatttta

SEQ ID NO: 3632539 - DNA, 20 bp, Homo sapiens
ggtcggagtgcctggagtca

SEQ ID NO: 3632540 - DNA, 14 bp, Homo sapiens
ggtcggatctcaca

SEQ ID NO: 3632541 - DNA, 14 bp, Homo sapiens
ggtcgggcagccag

SEQ ID NO: 3632542 - DNA, 19 bp, Homo sapiens
ggtctaaataggatcctgg

SEQ ID NO: 3632543 - DNA, 15 bp, Homo sapiens
ggtctaatcagtgat

SEQ ID NO: 3632544 - DNA, 13 bp, Homo sapiens
ggtctagagagaa

SEQ ID NO: 3632545 - DNA, 16 bp, Homo sapiens
ggtctagtgttcctgc

SEQ ID NO: 3632546 - DNA, 17 bp, Homo sapiens
ggtctcaaactcctgac

SEQ ID NO: 3632547 - DNA, 13 bp, Homo sapiens
ggtctccaggggc

SEQ ID NO: 3632548 - DNA, 17 bp, Homo sapiens
ggtctcccctcctgcac

SEQ ID NO: 3632549 - DNA, 17 bp, Homo sapiens
ggtctctctccaggtca

SEQ ID NO: 3632550 - DNA, 14 bp, Homo sapiens
ggtctctgccccag

SEQ ID NO: 3632551 - DNA, 13 bp, Homo sapiens
ggtctctgggagc

SEQ ID NO: 3632552 - DNA, 20 bp, Homo sapiens
ggtctcttctgaataaagca

SEQ ID NO: 3632553 - DNA, 22 bp, Homo sapiens
ggtctcttctgaataaagcaat

SEQ ID NO: 3632554 - DNA, 22 bp, Homo sapiens
ggtctgaccgatgtgtctccca

SEQ ID NO: 3632555 - DNA, 12 bp, Homo sapiens
ggtctgattggc

SEQ ID NO: 3632556 - DNA, 13 bp, Homo sapiens
ggtctgattggct

SEQ ID NO: 3632557 - DNA, 14 bp, Homo sapiens
ggtctgattggctg

SEQ ID NO: 3632558 - DNA, 16 bp, Homo sapiens
ggtctgccttctgctg

SEQ ID NO: 3632559 - DNA, 18 bp, Homo sapiens
ggtctgccttctgctgaa

SEQ ID NO: 3632560 - DNA, 14 bp, Homo sapiens
ggtctggctgagcc

SEQ ID NO: 3632561 - DNA, 18 bp, Homo sapiens
ggtctgggcgtccagctc

SEQ ID NO: 3632562 - DNA, 21 bp, Homo sapiens
ggtctgggcgtccagctcagc

SEQ ID NO: 3632563 - DNA, 16 bp, Homo sapiens
ggtctggggacaggcc

SEQ ID NO: 3632564 - DNA, 21 bp, Homo sapiens
ggtctgtgtgtgtgtatgtgg

SEQ ID NO: 3632565 - DNA, 19 bp, Homo sapiens
ggtcttcactttcctcagt

SEQ ID NO: 3632566 - DNA, 18 bp, Homo sapiens
ggtcttggccgactcagg

SEQ ID NO: 3632567 - DNA, 18 bp, Homo sapiens
ggtctttcctaaggctgc

SEQ ID NO: 3632568 - DNA, 19 bp, Homo sapiens
ggtctttcctaaggctgca

SEQ ID NO: 3632569 - DNA, 20 bp, Homo sapiens
ggtgaaagcataacatgggt

SEQ ID NO: 3632570 - DNA, 23 bp, Homo sapiens
ggtgaaattataactattacagt

SEQ ID NO: 3632571 - DNA, 13 bp, Homo sapiens
ggtgaactccagg

SEQ ID NO: 3632572 - DNA, 14 bp, Homo sapiens
ggtgaactccaggc

SEQ ID NO: 3632573 - DNA, 21 bp, Homo sapiens
ggtgaactgagctgggcagga

SEQ ID NO: 3632574 - DNA, 18 bp, Homo sapiens
ggtgaatacttattttca

SEQ ID NO: 3632575 - DNA, 14 bp, Homo sapiens
ggtgacaaggcctg

SEQ ID NO: 3632576 - DNA, 15 bp, Homo sapiens
ggtgacacctccccc

SEQ ID NO: 3632577 - DNA, 17 bp, Homo sapiens
ggtgacacctccccctt

SEQ ID NO: 3632578 - DNA, 20 bp, Homo sapiens
ggtgacagctccgggatcag

SEQ ID NO: 3632579 - DNA, 13 bp, Homo sapiens
ggtgacagtgaag

SEQ ID NO: 3632580 - DNA, 20 bp, Homo sapiens
ggtgagaaagggattgctga

SEQ ID NO: 3632581 - DNA, 23 bp, Homo sapiens
ggtgagacgtgatgggctaggcc

SEQ ID NO: 3632582 - DNA, 17 bp, Homo sapiens
ggtgagagtcaaagctg

SEQ ID NO: 3632583 - DNA, 22 bp, Homo sapiens
ggtgaggctgacatgctcacac

SEQ ID NO: 3632584 - DNA, 18 bp, Homo sapiens
ggtgaggggctttctctt

SEQ ID NO: 3632585 - DNA, 21 bp, Homo sapiens
ggtgaggtgaactccaggcat

SEQ ID NO: 3632586 - DNA, 15 bp, Homo sapiens
ggtgatcctgttctg

SEQ ID NO: 3632587 - DNA, 18 bp, Homo sapiens
ggtgattctcagggctgg

SEQ ID NO: 3632588 - DNA, 22 bp, Homo sapiens
ggtgcaaggagtgtaaaatgta

SEQ ID NO: 3632589 - DNA, 13 bp, Homo sapiens
ggtgccccaggac

SEQ ID NO: 3632590 - DNA, 15 bp, Homo sapiens
ggtgccccaggacca

SEQ ID NO: 3632591 - DNA, 16 bp, Homo sapiens
ggtgccccaggaccag

SEQ ID NO: 3632592 - DNA, 22 bp, Homo sapiens
ggtgccccaggaccagctcagg

SEQ ID NO: 3632593 - DNA, 17 bp, Homo sapiens
ggtgcccgcgccaggcc

SEQ ID NO: 3632594 - DNA, 18 bp, Homo sapiens
ggtgccctggatgcccag

SEQ ID NO: 3632595 - DNA, 17 bp, Homo sapiens
ggtgccgctctctctga

SEQ ID NO: 3632596 - DNA, 19 bp, Homo sapiens
ggtgccgctctctctgagg

SEQ ID NO: 3632597 - DNA, 15 bp, Homo sapiens
ggtgccgctgtctct

SEQ ID NO: 3632598 - DNA, 19 bp, Homo sapiens
ggtgccgctttctctgagg

SEQ ID NO: 3632599 - DNA, 17 bp, Homo sapiens
ggtgcctaacctgggac

SEQ ID NO: 3632600 - DNA, 22 bp, Homo sapiens
ggtgcgtttataattggcttaa

SEQ ID NO: 3632601 - DNA, 18 bp, Homo sapiens
ggtgctaaaaatgaaaat

SEQ ID NO: 3632602 - DNA, 21 bp, Homo sapiens
ggtgctacaaaaacacagcaa

SEQ ID NO: 3632603 - DNA, 18 bp, Homo sapiens
ggtgctagatccagccca

SEQ ID NO: 3632604 - DNA, 14 bp, Homo sapiens
ggtgctcctgcatc

SEQ ID NO: 3632605 - DNA, 21 bp, Homo sapiens
ggtgctgcaggagtgtcctgc

SEQ ID NO: 3632606 - DNA, 18 bp, Homo sapiens
ggtgctgttttgccagcc

SEQ ID NO: 3632607 - DNA, 16 bp, Homo sapiens
ggtggacatctgaccc

SEQ ID NO: 3632608 - DNA, 21 bp, Homo sapiens
ggtggaggctgcggtgagccg

SEQ ID NO: 3632609 - DNA, 21 bp, Homo sapiens
gtcacaggttttcagagaatt

SEQ ID NO: 3632610 - DNA, 16 bp, Homo sapiens
gtcacatgactctcat

SEQ ID NO: 3632611 - DNA, 20 bp, Homo sapiens
gtcacatgactctcatttta

SEQ ID NO: 3632612 - DNA, 13 bp, Homo sapiens
gtcaccagagact

SEQ ID NO: 3632613 - DNA, 16 bp, Homo sapiens
gtcaccagagacttta

SEQ ID NO: 3632614 - DNA, 17 bp, Homo sapiens
gtcaccaggggaggagc

SEQ ID NO: 3632615 - DNA, 19 bp, Homo sapiens
gtcaccagttaaaagcatt

SEQ ID NO: 3632616 - DNA, 19 bp, Homo sapiens
gtcacgtttggtgcttctc

SEQ ID NO: 3632617 - DNA, 12 bp, Homo sapiens
gtcactagaatg

SEQ ID NO: 3632618 - DNA, 14 bp, Homo sapiens
gtcactcccaagcc

SEQ ID NO: 3632619 - DNA, 18 bp, Homo sapiens
gtcactcccaagccccct

SEQ ID NO: 3632620 - DNA, 23 bp, Homo sapiens
gtcactgcacagtgcatctcagc

SEQ ID NO: 3632621 - DNA, 21 bp, Homo sapiens
gtcactggtagaccaaaataa

SEQ ID NO: 3632622 - DNA, 14 bp, Homo sapiens
gtcactttttctga

SEQ ID NO: 3632623 - DNA, 17 bp, Homo sapiens
gtcagactgatagacac

SEQ ID NO: 3632624 - DNA, 23 bp, Homo sapiens
gtcagactttgtgttcatttcat

SEQ ID NO: 3632625 - DNA, 20 bp, Homo sapiens
gtcagaggagcgcaggcagc

SEQ ID NO: 3632626 - DNA, 21 bp, Homo sapiens
gtcagccactgtgatagaggc

SEQ ID NO: 3632627 - DNA, 19 bp, Homo sapiens
gtcagctcccctcggagaa

SEQ ID NO: 3632628 - DNA, 21 bp, Homo sapiens
gtcagctcccctcggagaaga

SEQ ID NO: 3632629 - DNA, 22 bp, Homo sapiens
gtcagctcccctcggagaagag

SEQ ID NO: 3632630 - DNA, 13 bp, Homo sapiens
gtcagctgtgggg

SEQ ID NO: 3632631 - DNA, 22 bp, Homo sapiens
gtcagctgtggggaacacagct

SEQ ID NO: 3632632 - DNA, 19 bp, Homo sapiens
gtcaggcgtagatcaccag

SEQ ID NO: 3632633 - DNA, 18 bp, Homo sapiens
gtcaggctagctgtgctg

SEQ ID NO: 3632634 - DNA, 14 bp, Homo sapiens
gtcagggccaggtg

SEQ ID NO: 3632635 - DNA, 17 bp, Homo sapiens
gtcagtatgtggaagtg

SEQ ID NO: 3632636 - DNA, 15 bp, Homo sapiens
gtcagtttttcctcc

SEQ ID NO: 3632637 - DNA, 17 bp, Homo sapiens
gtcagtttttcctcccc

SEQ ID NO: 3632638 - DNA, 21 bp, Homo sapiens
gtcatagcaagcttttgctca

SEQ ID NO: 3632639 - DNA, 22 bp, Homo sapiens
gtcatatgttgtgtttggttca

SEQ ID NO: 3632640 - DNA, 23 bp, Homo sapiens
gtcatcactctaggttttacaga

SEQ ID NO: 3632641 - DNA, 20 bp, Homo sapiens
gtcatctggcggaggtctct

SEQ ID NO: 3632642 - DNA, 14 bp, Homo sapiens
gtcatcttgctacc

SEQ ID NO: 3632643 - DNA, 16 bp, Homo sapiens
gtcatgccctcctctc

SEQ ID NO: 3632644 - DNA, 21 bp, Homo sapiens
gtcatggatcgtgttggtatt

SEQ ID NO: 3632645 - DNA, 22 bp, Homo sapiens
gtcatggtgaaattataactat

SEQ ID NO: 3632646 - DNA, 15 bp, Homo sapiens
gtcatgtgacaggta

SEQ ID NO: 3632647 - DNA, 12 bp, Homo sapiens
gtcatgtgagtc

SEQ ID NO: 3632648 - DNA, 18 bp, Homo sapiens
gtcatgtgagtctgggat

SEQ ID NO: 3632649 - DNA, 20 bp, Homo sapiens
gtcatgttatgcagtgaact

SEQ ID NO: 3632650 - DNA, 17 bp, Homo sapiens
gtcattatgttaatatt

SEQ ID NO: 3632651 - DNA, 13 bp, Homo sapiens
gtcattcagttct

SEQ ID NO: 3632652 - DNA, 21 bp, Homo sapiens
gtcattcgctactatgattta

SEQ ID NO: 3632653 - DNA, 19 bp, Homo sapiens
gtcatttgttaatatttct

SEQ ID NO: 3632654 - DNA, 20 bp, Homo sapiens
gtcatttgttaatatttctt

SEQ ID NO: 3632655 - DNA, 15 bp, Homo sapiens
gtccaaacccactca

SEQ ID NO: 3632656 - DNA, 12 bp, Homo sapiens
gtccaataagac

SEQ ID NO: 3632657 - DNA, 13 bp, Homo sapiens
gtccacagctgga

SEQ ID NO: 3632658 - DNA, 19 bp, Homo sapiens
gtccacaggggccaccacc

SEQ ID NO: 3632659 - DNA, 20 bp, Homo sapiens
gtccacaggggccaccacct

SEQ ID NO: 3632660 - DNA, 13 bp, Homo sapiens
gtccacctggaga

SEQ ID NO: 3632661 - DNA, 14 bp, Homo sapiens
gtccacctggagag

SEQ ID NO: 3632662 - DNA, 18 bp, Homo sapiens
gtccagctctgacatccc

SEQ ID NO: 3632663 - DNA, 20 bp, Homo sapiens
gtccagctctgacatccctt

SEQ ID NO: 3632664 - DNA, 13 bp, Homo sapiens
gtccaggagcctg

SEQ ID NO: 3632665 - DNA, 21 bp, Homo sapiens
gtccaggatgctaacatctaa

SEQ ID NO: 3632666 - DNA, 22 bp, Homo sapiens
gtccaggccccaccggccaggc

SEQ ID NO: 3632667 - DNA, 19 bp, Homo sapiens
gtccaggggagatggggag

SEQ ID NO: 3632668 - DNA, 18 bp, Homo sapiens
gtccagtgagcagtgttg

SEQ ID NO: 3632669 - DNA, 15 bp, Homo sapiens
gtccatccgactgcc

SEQ ID NO: 3632670 - DNA, 22 bp, Homo sapiens
gtcccacactgtgcagacccag

SEQ ID NO: 3632671 - DNA, 21 bp, Homo sapiens
gtcccacccacacagctgccc

SEQ ID NO: 3632672 - DNA, 22 bp, Homo sapiens
gtcccacccacacagctgccct

SEQ ID NO: 3632673 - DNA, 23 bp, Homo sapiens
gtcccacccacacagctgcccta

SEQ ID NO: 3632674 - DNA, 22 bp, Homo sapiens
gtcccagagacctcatcagcct

SEQ ID NO: 3632675 - DNA, 15 bp, Homo sapiens
gtcccagcatccctg

SEQ ID NO: 3632676 - DNA, 18 bp, Homo sapiens
gtcccagcatccctggag

SEQ ID NO: 3632677 - DNA, 19 bp, Homo sapiens
gtcccagcatccctggagc

SEQ ID NO: 3632678 - DNA, 22 bp, Homo sapiens
gtcccagcatccctggagcagg

SEQ ID NO: 3632679 - DNA, 11 bp, Homo sapiens
gtcccagctcc

SEQ ID NO: 3632680 - DNA, 20 bp, Homo sapiens
gtcccagctgaaggcagtgg

SEQ ID NO: 3632681 - DNA, 21 bp, Homo sapiens
gtcccagctgaaggcagtggc

SEQ ID NO: 3632682 - DNA, 18 bp, Homo sapiens
gtccccaccatctgctgt

SEQ ID NO: 3632683 - DNA, 20 bp, Homo sapiens
gtccccaccatctgctgtct

SEQ ID NO: 3632684 - DNA, 22 bp, Homo sapiens
gtccccccaccctcattctact

SEQ ID NO: 3632685 - DNA, 14 bp, Homo sapiens
gtcccctgacaggg

SEQ ID NO: 3632686 - DNA, 14 bp, Homo sapiens
gtcccggccagctc

SEQ ID NO: 3632687 - DNA, 15 bp, Homo sapiens
gtcccggccagctct

SEQ ID NO: 3632688 - DNA, 20 bp, Homo sapiens
gtcccgtctggacctgggga

SEQ ID NO: 3632689 - DNA, 21 bp, Homo sapiens
gtccctaccgagtctcttctc

SEQ ID NO: 3632690 - DNA, 11 bp, Homo sapiens
gtccctctgcc

SEQ ID NO: 3632691 - DNA, 21 bp, Homo sapiens
gtccctctgccccatcctcca

SEQ ID NO: 3632692 - DNA, 16 bp, Homo sapiens
gtccctgaagagaagg

SEQ ID NO: 3632693 - DNA, 20 bp, Homo sapiens
gtccctgcaaaactccaggc

SEQ ID NO: 3632694 - DNA, 12 bp, Homo sapiens
gtccctgcaggg

SEQ ID NO: 3632695 - DNA, 13 bp, Homo sapiens
gtccctgcagggc

SEQ ID NO: 3632696 - DNA, 21 bp, Homo sapiens
gtccctgcagggccatctgac

SEQ ID NO: 3632697 - DNA, 12 bp, Homo sapiens
gtccctggacac

SEQ ID NO: 3632698 - DNA, 19 bp, Homo sapiens
gtccctggacacagctctt

SEQ ID NO: 3632699 - DNA, 16 bp, Homo sapiens
gtcccttgcctctgcc

SEQ ID NO: 3632700 - DNA, 22 bp, Homo sapiens
gtcccttgcctctgccctggat

SEQ ID NO: 3632701 - DNA, 20 bp, Homo sapiens
gtccgcagttgtagcagaaa

SEQ ID NO: 3632702 - DNA, 23 bp, Homo sapiens
gtccgcagttgtagcagaaacca

SEQ ID NO: 3632703 - DNA, 13 bp, Homo sapiens
gtccgtgcccctt

SEQ ID NO: 3632704 - DNA, 15 bp, Homo sapiens
gtccgtgctgacagc

SEQ ID NO: 3632705 - DNA, 20 bp, Homo sapiens
gtcctacagtgactccctgg

SEQ ID NO: 3632706 - DNA, 21 bp, Homo sapiens
gtcctacagtgactccctggg

SEQ ID NO: 3632707 - DNA, 16 bp, Homo sapiens
gtcctacccatccccg

SEQ ID NO: 3632708 - DNA, 21 bp, Homo sapiens
gtcctattatattcattcttt

SEQ ID NO: 3632709 - DNA, 14 bp, Homo sapiens
gtcctcagccttgc

SEQ ID NO: 3632710 - DNA, 16 bp, Homo sapiens
gtcctcagccttgcca

SEQ ID NO: 3632711 - DNA, 20 bp, Homo sapiens
gtcctcagccttgccagaga

SEQ ID NO: 3632712 - DNA, 14 bp, Homo sapiens
gtcctccaagccag

SEQ ID NO: 3632713 - DNA, 13 bp, Homo sapiens
gtcctccaccatg

SEQ ID NO: 3632714 - DNA, 18 bp, Homo sapiens
gtcctctcggctgccagg

SEQ ID NO: 3632715 - DNA, 19 bp, Homo sapiens
gtcctctcggctgccaggg

SEQ ID NO: 3632716 - DNA, 22 bp, Homo sapiens
gtcctctctgagtcaaatccag

SEQ ID NO: 3632717 - DNA, 17 bp, Homo sapiens
gtcctctctggctgggg

SEQ ID NO: 3632718 - DNA, 18 bp, Homo sapiens
gtcctctctggctgggga

SEQ ID NO: 3632719 - DNA, 17 bp, Homo sapiens
gtcctctgaatgaacct

SEQ ID NO: 3632720 - DNA, 17 bp, Homo sapiens
gtcctctgcctgggctc

SEQ ID NO: 3632721 - DNA, 12 bp, Homo sapiens
gtcctcttctgc

SEQ ID NO: 3632722 - DNA, 22 bp, Homo sapiens
gtcctcttctgctcttttcctg

SEQ ID NO: 3632723 - DNA, 21 bp, Homo sapiens
gtcctcttttcctggcagctg

SEQ ID NO: 3632724 - DNA, 23 bp, Homo sapiens
gtcctcttttcctggcagctgct

SEQ ID NO: 3632725 - DNA, 14 bp, Homo sapiens
gtcctgcagcctgc

SEQ ID NO: 3632726 - DNA, 18 bp, Homo sapiens
gtcctgcccatgccccag

SEQ ID NO: 3632727 - DNA, 21 bp, Homo sapiens
gtcctggaggcagggggtgag

SEQ ID NO: 3632728 - DNA, 17 bp, Homo sapiens
gtcctggccatcccaca

SEQ ID NO: 3632729 - DNA, 14 bp, Homo sapiens
gtcctgggcctgca

SEQ ID NO: 3632730 - DNA, 16 bp, Homo sapiens
gtcctgggcctgcccc

SEQ ID NO: 3632731 - DNA, 20 bp, Homo sapiens
gtcctggtgccctggatgcc

SEQ ID NO: 3632732 - DNA, 23 bp, Homo sapiens
gtcctggtgcctatctgcctgga

SEQ ID NO: 3632733 - DNA, 14 bp, Homo sapiens
gtcctgtctttgat

SEQ ID NO: 3632734 - DNA, 18 bp, Homo sapiens
gtccttactcccccacca

SEQ ID NO: 3632735 - DNA, 13 bp, Homo sapiens
gtccttcaaaggc

SEQ ID NO: 3632736 - DNA, 15 bp, Homo sapiens
gtccttccacctgcc

SEQ ID NO: 3632737 - DNA, 13 bp, Homo sapiens
gtccttgggcgtc

SEQ ID NO: 3632738 - DNA, 17 bp, Homo sapiens
gtccttttgacactgct

SEQ ID NO: 3632739 - DNA, 19 bp, Homo sapiens
gtccttttgacactgctct

SEQ ID NO: 3632740 - DNA, 18 bp, Homo sapiens
gttgacttcgcagccccg

SEQ ID NO: 3632741 - DNA, 21 bp, Homo sapiens
gttgagagctttctgccttag

SEQ ID NO: 3632742 - DNA, 15 bp, Homo sapiens
gttgatctggaaccc

SEQ ID NO: 3632743 - DNA, 16 bp, Homo sapiens
gttgatctggaaccca

SEQ ID NO: 3632744 - DNA, 17 bp, Homo sapiens
gttgatctggaacccag

SEQ ID NO: 3632745 - DNA, 13 bp, Homo sapiens
gttgatggaaaat

SEQ ID NO: 3632746 - DNA, 14 bp, Homo sapiens
gttgcactgaacag

SEQ ID NO: 3632747 - DNA, 14 bp, Homo sapiens
gttgccaatctaaa

SEQ ID NO: 3632748 - DNA, 21 bp, Homo sapiens
gttgccacatttagtcctgta

SEQ ID NO: 3632749 - DNA, 15 bp, Homo sapiens
gttgccatggattca

SEQ ID NO: 3632750 - DNA, 18 bp, Homo sapiens
gttgccccattcctaaga

SEQ ID NO: 3632751 - DNA, 19 bp, Homo sapiens
gttgcccccattcccagcc

SEQ ID NO: 3632752 - DNA, 13 bp, Homo sapiens
gttgccgtgctcc

SEQ ID NO: 3632753 - DNA, 14 bp, Homo sapiens
gttgctatagtgac

SEQ ID NO: 3632754 - DNA, 16 bp, Homo sapiens
gttgctgaagatgcct

SEQ ID NO: 3632755 - DNA, 19 bp, Homo sapiens
gttgctgaagatgccttga

SEQ ID NO: 3632756 - DNA, 14 bp, Homo sapiens
gttgctgattgtca

SEQ ID NO: 3632757 - DNA, 18 bp, Homo sapiens
gttgctgttttcctccct

SEQ ID NO: 3632758 - DNA, 21 bp, Homo sapiens
gttgctgttttcctcccttct

SEQ ID NO: 3632759 - DNA, 23 bp, Homo sapiens
gttgctgttttcctcccttctgc

SEQ ID NO: 3632760 - DNA, 14 bp, Homo sapiens
gttggaaatgtgtt

SEQ ID NO: 3632761 - DNA, 15 bp, Homo sapiens
gttggaaatgtgttt

SEQ ID NO: 3632762 - DNA, 20 bp, Homo sapiens
gttggacatttttttcgaat

SEQ ID NO: 3632763 - DNA, 22 bp, Homo sapiens
gttggacgggatgacctccaga

SEQ ID NO: 3632764 - DNA, 13 bp, Homo sapiens
gttggagtgctct

SEQ ID NO: 3632765 - DNA, 15 bp, Homo sapiens
gttggcatagctctg

SEQ ID NO: 3632766 - DNA, 19 bp, Homo sapiens
gttggcatagctctggggt

SEQ ID NO: 3632767 - DNA, 20 bp, Homo sapiens
gttggctttgcccacccctc

SEQ ID NO: 3632768 - DNA, 21 bp, Homo sapiens
gttgggaggatacagaggaga

SEQ ID NO: 3632769 - DNA, 21 bp, Homo sapiens
gttggggggggtggggcagtg

SEQ ID NO: 3632770 - DNA, 20 bp, Homo sapiens
gttggtctgccttctgctga

SEQ ID NO: 3632771 - DNA, 20 bp, Homo sapiens
gttgtattgatttttaagaa

SEQ ID NO: 3632772 - DNA, 13 bp, Homo sapiens
gttgtatttctat

SEQ ID NO: 3632773 - DNA, 18 bp, Homo sapiens
gttgtcaagaatagcatt

SEQ ID NO: 3632774 - DNA, 22 bp, Homo sapiens
gttgtcaagaatagcattgtaa

SEQ ID NO: 3632775 - DNA, 22 bp, Homo sapiens
gttgtccagagataaaaatcat

SEQ ID NO: 3632776 - DNA, 19 bp, Homo sapiens
gttgtgagaatggcctgga

SEQ ID NO: 3632777 - DNA, 21 bp, Homo sapiens
gttgtgagaatggcctggagc

SEQ ID NO: 3632778 - DNA, 17 bp, Homo sapiens
gttgtgtgtatatgtat

SEQ ID NO: 3632779 - DNA, 12 bp, Homo sapiens
gttgtgtgtggg

SEQ ID NO: 3632780 - DNA, 22 bp, Homo sapiens
gttgtgtgtgggagtgtgtaat

SEQ ID NO: 3632781 - DNA, 21 bp, Homo sapiens
gttgtgtttggttcaattttt

SEQ ID NO: 3632782 - DNA, 18 bp, Homo sapiens
gttgttatattcattctt

SEQ ID NO: 3632783 - DNA, 14 bp, Homo sapiens
gttgttgcatgttt

SEQ ID NO: 3632784 - DNA, 21 bp, Homo sapiens
gttgttgtgtgtatatgtatt

SEQ ID NO: 3632785 - DNA, 16 bp, Homo sapiens
gttgtttataataaaa

SEQ ID NO: 3632786 - DNA, 18 bp, Homo sapiens
gttgtttataataaaaat

SEQ ID NO: 3632787 - DNA, 20 bp, Homo sapiens
gttgtttcatgagtttgcat

SEQ ID NO: 3632788 - DNA, 16 bp, Homo sapiens
gtttaaaaagatgaaa

SEQ ID NO: 3632789 - DNA, 22 bp, Homo sapiens
gtttaaaaagatgaaaaagaat

SEQ ID NO: 3632790 - DNA, 18 bp, Homo sapiens
gtttaaagaaagtgtatt

SEQ ID NO: 3632791 - DNA, 17 bp, Homo sapiens
gtttaactgctgcaggg

SEQ ID NO: 3632792 - DNA, 21 bp, Homo sapiens
gtttaagtgactgatggctaa

SEQ ID NO: 3632793 - DNA, 13 bp, Homo sapiens
gtttaatcttttt

SEQ ID NO: 3632794 - DNA, 12 bp, Homo sapiens
gtttaatggtag

SEQ ID NO: 3632795 - DNA, 19 bp, Homo sapiens
gtttacatgaagcagaacc

SEQ ID NO: 3632796 - DNA, 14 bp, Homo sapiens
gtttacgtgtaaag

SEQ ID NO: 3632797 - DNA, 21 bp, Homo sapiens
gtttagatgaggctcagagag

SEQ ID NO: 3632798 - DNA, 12 bp, Homo sapiens
gtttataataaa

SEQ ID NO: 3632799 - DNA, 13 bp, Homo sapiens
gtttatatggata

SEQ ID NO: 3632800 - DNA, 22 bp, Homo sapiens
gtttatatggataatctgagca

SEQ ID NO: 3632801 - DNA, 23 bp, Homo sapiens
gtttatgaaatgccactgggaca

SEQ ID NO: 3632802 - DNA, 22 bp, Homo sapiens
gtttatgtaacttcctgtggat

SEQ ID NO: 3632803 - DNA, 13 bp, Homo sapiens
gtttatgtgtgtg

SEQ ID NO: 3632804 - DNA, 16 bp, Homo sapiens
gtttatgtgtgtgtgt

SEQ ID NO: 3632805 - DNA, 14 bp, Homo sapiens
gtttattaatctta

SEQ ID NO: 3632806 - DNA, 18 bp, Homo sapiens
gtttattaatcttagtgt

SEQ ID NO: 3632807 - DNA, 20 bp, Homo sapiens
gtttattaatcttagtgtat

SEQ ID NO: 3632808 - DNA, 14 bp, Homo sapiens
gtttattctttgca

SEQ ID NO: 3632809 - DNA, 14 bp, Homo sapiens
gtttattgtttgat

SEQ ID NO: 3632810 - DNA, 19 bp, Homo sapiens
gtttattgtttgatgtttt

SEQ ID NO: 3632811 - DNA, 20 bp, Homo sapiens
gtttattgtttgatgttttt

SEQ ID NO: 3632812 - DNA, 13 bp, Homo sapiens
gtttcagaccccc

SEQ ID NO: 3632813 - DNA, 14 bp, Homo sapiens
gtttcagacccccc

SEQ ID NO: 3632814 - DNA, 19 bp, Homo sapiens
gtttcatttagtcatgtga

SEQ ID NO: 3632815 - DNA, 20 bp, Homo sapiens
gtttcatttagtcatgtgac

SEQ ID NO: 3632816 - DNA, 16 bp, Homo sapiens
gtttccacagcctgca

SEQ ID NO: 3632817 - DNA, 23 bp, Homo sapiens
gtttcccattggttcacctgtga

SEQ ID NO: 3632818 - DNA, 16 bp, Homo sapiens
gtttccctctgtgtta

SEQ ID NO: 3632819 - DNA, 11 bp, Homo sapiens
gtttccctgct

SEQ ID NO: 3632820 - DNA, 22 bp, Homo sapiens
gtttcctagctaggagcaggct

SEQ ID NO: 3632821 - DNA, 11 bp, Homo sapiens
gtttcctcagt

SEQ ID NO: 3632822 - DNA, 18 bp, Homo sapiens
gtttcctcagtgatggaa

SEQ ID NO: 3632823 - DNA, 18 bp, Homo sapiens
gtttcgactggtccagct

SEQ ID NO: 3632824 - DNA, 17 bp, Homo sapiens
gtttcgatatttattga

SEQ ID NO: 3632825 - DNA, 21 bp, Homo sapiens
gtttcgatatttattgatgtt

SEQ ID NO: 3632826 - DNA, 14 bp, Homo sapiens
gtttctattctgtc

SEQ ID NO: 3632827 - DNA, 14 bp, Homo sapiens
gtttctcaaatctt

SEQ ID NO: 3632828 - DNA, 19 bp, Homo sapiens
gtttctctaaggaattatt

SEQ ID NO: 3632829 - DNA, 17 bp, Homo sapiens
gtttctctcttgttgtc

SEQ ID NO: 3632830 - DNA, 22 bp, Homo sapiens
gtttctctcttgttgtccaggc

SEQ ID NO: 3632831 - DNA, 18 bp, Homo sapiens
gtttctcttagaaaagct

SEQ ID NO: 3632832 - DNA, 22 bp, Homo sapiens
gtttctgtcgttaaaaacagat

SEQ ID NO: 3632833 - DNA, 14 bp, Homo sapiens
gtttcttgctgcca

SEQ ID NO: 3632834 - DNA, 23 bp, Homo sapiens
gtttcttgcttggaagccaggta

SEQ ID NO: 3632835 - DNA, 13 bp, Homo sapiens
gtttgattggctt

SEQ ID NO: 3632836 - DNA, 11 bp, Homo sapiens
gtttgcaggag

SEQ ID NO: 3632837 - DNA, 21 bp, Homo sapiens
gtttgctgtcaagccattttt

SEQ ID NO: 3632838 - DNA, 16 bp, Homo sapiens
gtttgcttattttatt

SEQ ID NO: 3632839 - DNA, 20 bp, Homo sapiens
gtttgctttgtatgcacttt

SEQ ID NO: 3632840 - DNA, 20 bp, Homo sapiens
gtttgggagccaggactccc

SEQ ID NO: 3632841 - DNA, 22 bp, Homo sapiens
gtttgggagctgctgggtggca

SEQ ID NO: 3632842 - DNA, 22 bp, Homo sapiens
gtttggtttcccattggttcac

SEQ ID NO: 3632843 - DNA, 14 bp, Homo sapiens
gtttgtaccattta

SEQ ID NO: 3632844 - DNA, 16 bp, Homo sapiens
gtttgtaccatttatg

SEQ ID NO: 3632845 - DNA, 17 bp, Homo sapiens
gtttgtagttgttttaa

SEQ ID NO: 3632846 - DNA, 17 bp, Homo sapiens
gtttgtcatggtgaaat

SEQ ID NO: 3632847 - DNA, 22 bp, Homo sapiens
gtttgttttagaagattctatg

SEQ ID NO: 3632848 - DNA, 21 bp, Homo sapiens
gttttaattttcagttctatt

SEQ ID NO: 3632849 - DNA, 23 bp, Homo sapiens
gttttacaataaaatcttgaaaa

SEQ ID NO: 3632850 - DNA, 16 bp, Homo sapiens
gttttacagatttatt

SEQ ID NO: 3632851 - DNA, 21 bp, Homo sapiens
gttttagaagattctatgtta

SEQ ID NO: 3632852 - DNA, 12 bp, Homo sapiens
gttttataaatt

SEQ ID NO: 3632853 - DNA, 21 bp, Homo sapiens
gttttatactgctctataaat

SEQ ID NO: 3632854 - DNA, 22 bp, Homo sapiens
gttttatactgctctataaata

SEQ ID NO: 3632855 - DNA, 18 bp, Homo sapiens
gttttatgccccattgga

SEQ ID NO: 3632856 - DNA, 16 bp, Homo sapiens
gttttattataaattc

SEQ ID NO: 3632857 - DNA, 20 bp, Homo sapiens
gttttcagagaattatctca

SEQ ID NO: 3632858 - DNA, 18 bp, Homo sapiens
gttttcatcatttcagcc

SEQ ID NO: 3632859 - DNA, 20 bp, Homo sapiens
gttttcatcatttcagccaa

SEQ ID NO: 3632860 - DNA, 16 bp, Homo sapiens
gttttcattatctcaa

SEQ ID NO: 3632861 - DNA, 18 bp, Homo sapiens
gttttccagtattgaaaa

SEQ ID NO: 3632862 - DNA, 20 bp, Homo sapiens
gttttcccttgaggaaacaa

SEQ ID NO: 3632863 - DNA, 21 bp, Homo sapiens
gttttccgcattctttgtaca

SEQ ID NO: 3632864 - DNA, 13 bp, Homo sapiens
gttttcctccctt

SEQ ID NO: 3632865 - DNA, 15 bp, Homo sapiens
gttttcctcccttct

SEQ ID NO: 3632866 - DNA, 14 bp, Homo sapiens
gttttcggcagcct

SEQ ID NO: 3632867 - DNA, 15 bp, Homo sapiens
gttttctgagaaaga

SEQ ID NO: 3632868 - DNA, 22 bp, Homo sapiens
gttttctgagaaagactattca

SEQ ID NO: 3632869 - DNA, 21 bp, Homo sapiens
gttttcttgataattttcctt

SEQ ID NO: 3632870 - DNA, 23 bp, Homo sapiens
gttttcttgataattttccttta

SEQ ID NO: 3632871 - DNA, 22 bp, Homo sapiens
taacttgagattcaagacaaga

SEQ ID NO: 3632872 - DNA, 20 bp, Homo sapiens
taacttgctttcttctttcc

SEQ ID NO: 3632873 - DNA, 21 bp, Homo sapiens
taacttgctttcttctttcct

SEQ ID NO: 3632874 - DNA, 21 bp, Homo sapiens
taacttgtattttgtcacttt

SEQ ID NO: 3632875 - DNA, 21 bp, Homo sapiens
taacttttaaaatttgtctta

SEQ ID NO: 3632876 - DNA, 12 bp, Homo sapiens
taacttttgtga

SEQ ID NO: 3632877 - DNA, 20 bp, Homo sapiens
taagaaaccttgctctcctc

SEQ ID NO: 3632878 - DNA, 15 bp, Homo sapiens
taagaaatacagact

SEQ ID NO: 3632879 - DNA, 14 bp, Homo sapiens
taagaacctggaac

SEQ ID NO: 3632880 - DNA, 15 bp, Homo sapiens
taagaaccttaatga

SEQ ID NO: 3632881 - DNA, 14 bp, Homo sapiens
taagaatctttaga

SEQ ID NO: 3632882 - DNA, 22 bp, Homo sapiens
taagaattgaattggaaagact

SEQ ID NO: 3632883 - DNA, 23 bp, Homo sapiens
taagacactgaaaaatctaagtg

SEQ ID NO: 3632884 - DNA, 17 bp, Homo sapiens
taagacataaacaaaga

SEQ ID NO: 3632885 - DNA, 20 bp, Homo sapiens
taagacataaacaaagacat

SEQ ID NO: 3632886 - DNA, 23 bp, Homo sapiens
taagacataaacaaagacattga

SEQ ID NO: 3632887 - DNA, 16 bp, Homo sapiens
taagaccctaattctt

SEQ ID NO: 3632888 - DNA, 17 bp, Homo sapiens
taagagaaacctgccaa

SEQ ID NO: 3632889 - DNA, 14 bp, Homo sapiens
taagagaagtgagt

SEQ ID NO: 3632890 - DNA, 21 bp, Homo sapiens
taagagcttccaattttcctt

SEQ ID NO: 3632891 - DNA, 17 bp, Homo sapiens
taagatgtacatttaat

SEQ ID NO: 3632892 - DNA, 19 bp, Homo sapiens
taagatgtacatttaataa

SEQ ID NO: 3632893 - DNA, 19 bp, Homo sapiens
taagattacaaatcagaag

SEQ ID NO: 3632894 - DNA, 22 bp, Homo sapiens
taagattacaaatcagaagtca

SEQ ID NO: 3632895 - DNA, 14 bp, Homo sapiens
taagattccagaga

SEQ ID NO: 3632896 - DNA, 14 bp, Homo sapiens
taagcaacatcttt

SEQ ID NO: 3632897 - DNA, 20 bp, Homo sapiens
taagcaaccacactgcttgg

SEQ ID NO: 3632898 - DNA, 17 bp, Homo sapiens
taagcagaggaggggcc

SEQ ID NO: 3632899 - DNA, 19 bp, Homo sapiens
taagcagcatggaaaaatg

SEQ ID NO: 3632900 - DNA, 20 bp, Homo sapiens
taagccaaactcaggcccag

SEQ ID NO: 3632901 - DNA, 15 bp, Homo sapiens
taagccaaagaaaca

SEQ ID NO: 3632902 - DNA, 22 bp, Homo sapiens
taagccaaagaaacaagctgtg

SEQ ID NO: 3632903 - DNA, 21 bp, Homo sapiens
taagccagggcccctggatct

SEQ ID NO: 3632904 - DNA, 21 bp, Homo sapiens
taagcccccagggcctccagg

SEQ ID NO: 3632905 - DNA, 16 bp, Homo sapiens
taagccgcagacctgg

SEQ ID NO: 3632906 - DNA, 21 bp, Homo sapiens
taagccgcagacctggagctt

SEQ ID NO: 3632907 - DNA, 23 bp, Homo sapiens
taagccgcagacctggagcttca

SEQ ID NO: 3632908 - DNA, 16 bp, Homo sapiens
taagccttataaacca

SEQ ID NO: 3632909 - DNA, 17 bp, Homo sapiens
taagccttataaaccaa

SEQ ID NO: 3632910 - DNA, 21 bp, Homo sapiens
taagcttggtgacaaaattca

SEQ ID NO: 3632911 - DNA, 16 bp, Homo sapiens
taaggcccactgtaat

SEQ ID NO: 3632912 - DNA, 21 bp, Homo sapiens
taaggctgcaaggtttaggct

SEQ ID NO: 3632913 - DNA, 23 bp, Homo sapiens
taagggactaggaaattccaaat

SEQ ID NO: 3632914 - DNA, 14 bp, Homo sapiens
taagggagaaaaaa

SEQ ID NO: 3632915 - DNA, 23 bp, Homo sapiens
taagggcagtgcccatgtgtaca

SEQ ID NO: 3632916 - DNA, 17 bp, Homo sapiens
taaggtctaatcagtga

SEQ ID NO: 3632917 - DNA, 18 bp, Homo sapiens
taaggtctaatcagtgat

SEQ ID NO: 3632918 - DNA, 19 bp, Homo sapiens
taagtaaaaccacagcagt

SEQ ID NO: 3632919 - DNA, 15 bp, Homo sapiens
taagtaatttagaag

SEQ ID NO: 3632920 - DNA, 20 bp, Homo sapiens
taagtagaataaagaaaaac

SEQ ID NO: 3632921 - DNA, 15 bp, Homo sapiens
taagtatatcatgta

SEQ ID NO: 3632922 - DNA, 17 bp, Homo sapiens
taagtatatcatgtaaa

SEQ ID NO: 3632923 - DNA, 20 bp, Homo sapiens
taagtatttaggtttttgtt

SEQ ID NO: 3632924 - DNA, 20 bp, Homo sapiens
taagtcaaaaggaacaaaaa

SEQ ID NO: 3632925 - DNA, 23 bp, Homo sapiens
taagtcaaaaggaacaaaaatta

SEQ ID NO: 3632926 - DNA, 16 bp, Homo sapiens
taagtccttccacctg

SEQ ID NO: 3632927 - DNA, 17 bp, Homo sapiens
taagtccttccacctgc

SEQ ID NO: 3632928 - DNA, 23 bp, Homo sapiens
taagtgaactaccatgctttgtt

SEQ ID NO: 3632929 - DNA, 21 bp, Homo sapiens
taagtgaagcctaccagaaga

SEQ ID NO: 3632930 - DNA, 14 bp, Homo sapiens
taagtgctgctgtg

SEQ ID NO: 3632931 - DNA, 13 bp, Homo sapiens
taagtggctgcct

SEQ ID NO: 3632932 - DNA, 23 bp, Homo sapiens
taagttatgcctctgacagtcca

SEQ ID NO: 3632933 - DNA, 14 bp, Homo sapiens
taagttgaccttta

SEQ ID NO: 3632934 - DNA, 15 bp, Homo sapiens
taagttgacctttat

SEQ ID NO: 3632935 - DNA, 23 bp, Homo sapiens
taagttgctgtgtgtctgtcctg

SEQ ID NO: 3632936 - DNA, 17 bp, Homo sapiens
taagtttatccaaatct

SEQ ID NO: 3632937 - DNA, 22 bp, Homo sapiens
taagtttatccaaatcttgaat

SEQ ID NO: 3632938 - DNA, 13 bp, Homo sapiens
taagtttgtgtaa

SEQ ID NO: 3632939 - DNA, 16 bp, Homo sapiens
taataaaaagcctctt

SEQ ID NO: 3632940 - DNA, 19 bp, Homo sapiens
taataaacataatgaaaat

SEQ ID NO: 3632941 - DNA, 18 bp, Homo sapiens
taataaactttgtgctga

SEQ ID NO: 3632942 - DNA, 13 bp, Homo sapiens
taataaagagaaa

SEQ ID NO: 3632943 - DNA, 14 bp, Homo sapiens
taataaagagaaat

SEQ ID NO: 3632944 - DNA, 16 bp, Homo sapiens
taataaagagaaatat

SEQ ID NO: 3632945 - DNA, 20 bp, Homo sapiens
taataaagatacaaaatgtt

SEQ ID NO: 3632946 - DNA, 20 bp, Homo sapiens
taataaaggactgtaatctt

SEQ ID NO: 3632947 - DNA, 15 bp, Homo sapiens
taataatatcaaaga

SEQ ID NO: 3632948 - DNA, 20 bp, Homo sapiens
taataatctcacatatacaa

SEQ ID NO: 3632949 - DNA, 19 bp, Homo sapiens
taataatttttgctgaatt

SEQ ID NO: 3632950 - DNA, 17 bp, Homo sapiens
taataccacagctattt

SEQ ID NO: 3632951 - DNA, 16 bp, Homo sapiens
taatactaagacccta

SEQ ID NO: 3632952 - DNA, 14 bp, Homo sapiens
taatactttctatg

SEQ ID NO: 3632953 - DNA, 14 bp, Homo sapiens
taatagaataaagg

SEQ ID NO: 3632954 - DNA, 16 bp, Homo sapiens
taatagaataaaggca

SEQ ID NO: 3632955 - DNA, 14 bp, Homo sapiens
taataggcatttta

SEQ ID NO: 3632956 - DNA, 21 bp, Homo sapiens
taataggcattttaagtaaaa

SEQ ID NO: 3632957 - DNA, 17 bp, Homo sapiens
taatagtagatttgaac

SEQ ID NO: 3632958 - DNA, 21 bp, Homo sapiens
taatatattctgaagcaacat

SEQ ID NO: 3632959 - DNA, 18 bp, Homo sapiens
taatatccctacatgtat

SEQ ID NO: 3632960 - DNA, 23 bp, Homo sapiens
taatattagttggctttcataaa

SEQ ID NO: 3632961 - DNA, 13 bp, Homo sapiens
taatatttaccaa

SEQ ID NO: 3632962 - DNA, 16 bp, Homo sapiens
taatatttaccaaagt

SEQ ID NO: 3632963 - DNA, 21 bp, Homo sapiens
taatatttaggcatgagctct

SEQ ID NO: 3632964 - DNA, 15 bp, Homo sapiens
taatattttatgtgt

SEQ ID NO: 3632965 - DNA, 18 bp, Homo sapiens
taatattttatgtgtaaa

SEQ ID NO: 3632966 - DNA, 22 bp, Homo sapiens
taatcaagagaaacttcaaagt

SEQ ID NO: 3632967 - DNA, 17 bp, Homo sapiens
taatcatatttgaaaac

SEQ ID NO: 3632968 - DNA, 18 bp, Homo sapiens
taatcattttaaattcca

SEQ ID NO: 3632969 - DNA, 21 bp, Homo sapiens
taatcctgtaccaaatctgac

SEQ ID NO: 3632970 - DNA, 22 bp, Homo sapiens
taatccttctttgtaatacttt

SEQ ID NO: 3632971 - DNA, 20 bp, Homo sapiens
taatccttttccttatttgc

SEQ ID NO: 3632972 - DNA, 23 bp, Homo sapiens
taatccttttccttatttgcctt

SEQ ID NO: 3632973 - DNA, 12 bp, Homo sapiens
taatctgagcag

SEQ ID NO: 3632974 - DNA, 15 bp, Homo sapiens
taatctgatgtataa

SEQ ID NO: 3632975 - DNA, 20 bp, Homo sapiens
taatctgatgtataatgtaa

SEQ ID NO: 3632976 - DNA, 21 bp, Homo sapiens
taatctggactcctctgtcca

SEQ ID NO: 3632977 - DNA, 22 bp, Homo sapiens
taatctggactcctctgtccag

SEQ ID NO: 3632978 - DNA, 23 bp, Homo sapiens
taatctgtgctgtttcaaagttc

SEQ ID NO: 3632979 - DNA, 20 bp, Homo sapiens
taatcttattgtttaatctt

SEQ ID NO: 3632980 - DNA, 21 bp, Homo sapiens
taatcttattgtttaatcttt

SEQ ID NO: 3632981 - DNA, 17 bp, Homo sapiens
taatcttttttttaaaa

SEQ ID NO: 3632982 - DNA, 14 bp, Homo sapiens
taatgaataaacag

SEQ ID NO: 3632983 - DNA, 22 bp, Homo sapiens
taatgacaaaagatacaaaagc

SEQ ID NO: 3632984 - DNA, 23 bp, Homo sapiens
taatgacaccacacttgttttct

SEQ ID NO: 3632985 - DNA, 14 bp, Homo sapiens
taatgacttagaaa

SEQ ID NO: 3632986 - DNA, 15 bp, Homo sapiens
taatgagtgcacctg

SEQ ID NO: 3632987 - DNA, 16 bp, Homo sapiens
taatgagtgcacctgc

SEQ ID NO: 3632988 - DNA, 21 bp, Homo sapiens
taatgattcaaatgttttaaa

SEQ ID NO: 3632989 - DNA, 23 bp, Homo sapiens
taatgattcaaatgttttaaagt

SEQ ID NO: 3632990 - DNA, 23 bp, Homo sapiens
taatgcctagcagagaactgcct

SEQ ID NO: 3632991 - DNA, 24 bp, Homo sapiens
taatgctgcaaacttaatgttctt

SEQ ID NO: 3632992 - DNA, 17 bp, Homo sapiens
taatgctgcctcaggac

SEQ ID NO: 3632993 - DNA, 20 bp, Homo sapiens
taatgctgcctcaggaccca

SEQ ID NO: 3632994 - DNA, 15 bp, Homo sapiens
taatggggtcctggc

SEQ ID NO: 3632995 - DNA, 17 bp, Homo sapiens
taatggggtcctggcca

SEQ ID NO: 3632996 - DNA, 18 bp, Homo sapiens
taatggtagttttacagt

SEQ ID NO: 3632997 - DNA, 23 bp, Homo sapiens
taatgtatataaactgggatgta

SEQ ID NO: 3632998 - DNA, 14 bp, Homo sapiens
taatgtatttgaaa

SEQ ID NO: 3632999 - DNA, 16 bp, Homo sapiens
taatgtatttgaaaat

SEQ ID NO: 3633000 - DNA, 17 bp, Homo sapiens
taatgtctgcagctcaa

SEQ ID NO: 3633001 - DNA, 21 bp, Homo sapiens
tagtagcgttttttaaatgta

SEQ ID NO: 3633002 - DNA, 17 bp, Homo sapiens
tagtatcctccaggttt

SEQ ID NO: 3633003 - DNA, 22 bp, Homo sapiens
tagtatcctccaggtttttcaa

SEQ ID NO: 3633004 - DNA, 23 bp, Homo sapiens
tagtatcctccaggtttttcaat

SEQ ID NO: 3633005 - DNA, 11 bp, Homo sapiens
tagtatctgta

SEQ ID NO: 3633006 - DNA, 18 bp, Homo sapiens
tagtattttttgtataat

SEQ ID NO: 3633007 - DNA, 19 bp, Homo sapiens
tagtcaagacgaacatgta

SEQ ID NO: 3633008 - DNA, 14 bp, Homo sapiens
tagtcattcttccc

SEQ ID NO: 3633009 - DNA, 20 bp, Homo sapiens
tagtcccatttttctcttgc

SEQ ID NO: 3633010 - DNA, 14 bp, Homo sapiens
tagtctgaaactgg

SEQ ID NO: 3633011 - DNA, 13 bp, Homo sapiens
tagtgattgtaac

SEQ ID NO: 3633012 - DNA, 19 bp, Homo sapiens
tagtgccttctaaaggtgt

SEQ ID NO: 3633013 - DNA, 17 bp, Homo sapiens
tagtggaaacatttata

SEQ ID NO: 3633014 - DNA, 21 bp, Homo sapiens
tagtggaaagtcaggctagct

SEQ ID NO: 3633015 - DNA, 15 bp, Homo sapiens
tagtgtaatatacca

SEQ ID NO: 3633016 - DNA, 16 bp, Homo sapiens
tagtgtccataaataa

SEQ ID NO: 3633017 - DNA, 13 bp, Homo sapiens
tagtgtgactcct

SEQ ID NO: 3633018 - DNA, 17 bp, Homo sapiens
tagtgttctgctcctgc

SEQ ID NO: 3633019 - DNA, 19 bp, Homo sapiens
tagtgttctgctcctgctt

SEQ ID NO: 3633020 - DNA, 14 bp, Homo sapiens
tagttaacacatca

SEQ ID NO: 3633021 - DNA, 20 bp, Homo sapiens
tagttaacacatcaaatatt

SEQ ID NO: 3633022 - DNA, 13 bp, Homo sapiens
tagttaatggatt

SEQ ID NO: 3633023 - DNA, 12 bp, Homo sapiens
tagttaccttat

SEQ ID NO: 3633024 - DNA, 18 bp, Homo sapiens
tagttaccttatagttac

SEQ ID NO: 3633025 - DNA, 22 bp, Homo sapiens
tagttaccttatagttactgtg

SEQ ID NO: 3633026 - DNA, 14 bp, Homo sapiens
tagttataaaccaa

SEQ ID NO: 3633027 - DNA, 21 bp, Homo sapiens
tagttataaaccaatgaaatt

SEQ ID NO: 3633028 - DNA, 23 bp, Homo sapiens
tagttcaatctggattcatattt

SEQ ID NO: 3633029 - DNA, 11 bp, Homo sapiens
tagttcaatgc

SEQ ID NO: 3633030 - DNA, 15 bp, Homo sapiens
tagttccactgagac

SEQ ID NO: 3633031 - DNA, 21 bp, Homo sapiens
tagttccagaaaacctctcct

SEQ ID NO: 3633032 - DNA, 13 bp, Homo sapiens
tagttctaaaatt

SEQ ID NO: 3633033 - DNA, 23 bp, Homo sapiens
tagttcttgggggaggccacccc

SEQ ID NO: 3633034 - DNA, 22 bp, Homo sapiens
tagttctttcctccccctgcaa

SEQ ID NO: 3633035 - DNA, 13 bp, Homo sapiens
tagttgacagtat

SEQ ID NO: 3633036 - DNA, 15 bp, Homo sapiens
tagttgcaaagcatt

SEQ ID NO: 3633037 - DNA, 22 bp, Homo sapiens
tagttggctttcataaatcatg

SEQ ID NO: 3633038 - DNA, 16 bp, Homo sapiens
tagttgtccagagata

SEQ ID NO: 3633039 - DNA, 19 bp, Homo sapiens
tagtttgtaccatttatga

SEQ ID NO: 3633040 - DNA, 15 bp, Homo sapiens
tagttttatttgtat

SEQ ID NO: 3633041 - DNA, 14 bp, Homo sapiens
tagttttgtataca

SEQ ID NO: 3633042 - DNA, 17 bp, Homo sapiens
tataaaccaatcttaaa

SEQ ID NO: 3633043 - DNA, 17 bp, Homo sapiens
tataaactgggatgtaa

SEQ ID NO: 3633044 - DNA, 21 bp, Homo sapiens
tataaagtatatgttctgatt

SEQ ID NO: 3633045 - DNA, 15 bp, Homo sapiens
tataaagtcagtgac

SEQ ID NO: 3633046 - DNA, 16 bp, Homo sapiens
tataaagtcagtgacg

SEQ ID NO: 3633047 - DNA, 19 bp, Homo sapiens
tataaagtggaagtatgta

SEQ ID NO: 3633048 - DNA, 18 bp, Homo sapiens
tataaatgtaaaaatgaa

SEQ ID NO: 3633049 - DNA, 23 bp, Homo sapiens
tataaatgtacatttccaaatga

SEQ ID NO: 3633050 - DNA, 16 bp, Homo sapiens
tataaattattacttt

SEQ ID NO: 3633051 - DNA, 14 bp, Homo sapiens
tataaattcctctt

SEQ ID NO: 3633052 - DNA, 19 bp, Homo sapiens
tataaattctactaagtta

SEQ ID NO: 3633053 - DNA, 14 bp, Homo sapiens
tataacagatcctt

SEQ ID NO: 3633054 - DNA, 22 bp, Homo sapiens
tataacagttttgagtaattca

SEQ ID NO: 3633055 - DNA, 23 bp, Homo sapiens
tataacagttttgagtaattcaa

SEQ ID NO: 3633056 - DNA, 14 bp, Homo sapiens
tataactaacatgt

SEQ ID NO: 3633057 - DNA, 17 bp, Homo sapiens
tataactattacagtgt

SEQ ID NO: 3633058 - DNA, 17 bp, Homo sapiens
tataactttaacttctg

SEQ ID NO: 3633059 - DNA, 14 bp, Homo sapiens
tataagtgtacata

SEQ ID NO: 3633060 - DNA, 15 bp, Homo sapiens
tataagtgtacatat

SEQ ID NO: 3633061 - DNA, 14 bp, Homo sapiens
tataataaaaatat

SEQ ID NO: 3633062 - DNA, 17 bp, Homo sapiens
tataatgaataaacagt

SEQ ID NO: 3633063 - DNA, 20 bp, Homo sapiens
tataatgaataaacagttat

SEQ ID NO: 3633064 - DNA, 16 bp, Homo sapiens
tataatgaataaatca

SEQ ID NO: 3633065 - DNA, 20 bp, Homo sapiens
tataatgaatgaaacatttt

SEQ ID NO: 3633066 - DNA, 17 bp, Homo sapiens
tataattggatttccta

SEQ ID NO: 3633067 - DNA, 18 bp, Homo sapiens
tataattggatttcctaa

SEQ ID NO: 3633068 - DNA, 22 bp, Homo sapiens
tataattggatttcctaatact

SEQ ID NO: 3633069 - DNA, 23 bp, Homo sapiens
tataattggcttaaagggatgga

SEQ ID NO: 3633070 - DNA, 18 bp, Homo sapiens
tataatttacctaagatt

SEQ ID NO: 3633071 - DNA, 20 bp, Homo sapiens
tatacaattatgaagattta

SEQ ID NO: 3633072 - DNA, 21 bp, Homo sapiens
tatacacccagttctgaataa

SEQ ID NO: 3633073 - DNA, 17 bp, Homo sapiens
tatacactgtaagcttt

SEQ ID NO: 3633074 - DNA, 21 bp, Homo sapiens
tatacacttacactttatgca

SEQ ID NO: 3633075 - DNA, 11 bp, Homo sapiens
tatacatgttg

SEQ ID NO: 3633076 - DNA, 14 bp, Homo sapiens
tatactgtaggtgt

SEQ ID NO: 3633077 - DNA, 19 bp, Homo sapiens
tatactgtggcctgcagga

SEQ ID NO: 3633078 - DNA, 18 bp, Homo sapiens
tatagacacacatacata

SEQ ID NO: 3633079 - DNA, 22 bp, Homo sapiens
tatagaccaaagcaaagaaaat

SEQ ID NO: 3633080 - DNA, 16 bp, Homo sapiens
tatagaccaattgaag

SEQ ID NO: 3633081 - DNA, 17 bp, Homo sapiens
tatagaccaattgaagc

SEQ ID NO: 3633082 - DNA, 22 bp, Homo sapiens
tatagaccaattgaagcatgaa

SEQ ID NO: 3633083 - DNA, 20 bp, Homo sapiens
tatagcatgaaataaaatat

SEQ ID NO: 3633084 - DNA, 13 bp, Homo sapiens
tatagctttattt

SEQ ID NO: 3633085 - DNA, 22 bp, Homo sapiens
tataggcctgtcccttgcctct

SEQ ID NO: 3633086 - DNA, 16 bp, Homo sapiens
tataggtgctacaaaa

SEQ ID NO: 3633087 - DNA, 20 bp, Homo sapiens
tataggtgctacaaaaacac

SEQ ID NO: 3633088 - DNA, 14 bp, Homo sapiens
tatagtaaatgtgt

SEQ ID NO: 3633089 - DNA, 12 bp, Homo sapiens
tatagtacatga

SEQ ID NO: 3633090 - DNA, 13 bp, Homo sapiens
tatagtacatgat

SEQ ID NO: 3633091 - DNA, 13 bp, Homo sapiens
tatagttactgtg

SEQ ID NO: 3633092 - DNA, 22 bp, Homo sapiens
tatagttactgtgtaattagtg

SEQ ID NO: 3633093 - DNA, 14 bp, Homo sapiens
tatataaaatgtat

SEQ ID NO: 3633094 - DNA, 21 bp, Homo sapiens
tatataaaatgtattcaagca

SEQ ID NO: 3633095 - DNA, 16 bp, Homo sapiens
tatataaactgggatg

SEQ ID NO: 3633096 - DNA, 12 bp, Homo sapiens
tatataaattat

SEQ ID NO: 3633097 - DNA, 15 bp, Homo sapiens
tatataaattattac

SEQ ID NO: 3633098 - DNA, 14 bp, Homo sapiens
tatataagactatt

SEQ ID NO: 3633099 - DNA, 23 bp, Homo sapiens
tatataagtgtacatatgtgctg

SEQ ID NO: 3633100 - DNA, 18 bp, Homo sapiens
tatataagttgctgtgtg

SEQ ID NO: 3633101 - DNA, 18 bp, Homo sapiens
tatatactgctatttaca

SEQ ID NO: 3633102 - DNA, 14 bp, Homo sapiens
tatataggctattt

SEQ ID NO: 3633103 - DNA, 18 bp, Homo sapiens
tatatattataagttgac

SEQ ID NO: 3633104 - DNA, 22 bp, Homo sapiens
tatatcaggtgtataaatgtac

SEQ ID NO: 3633105 - DNA, 18 bp, Homo sapiens
tatatcatgtaaagaaat

SEQ ID NO: 3633106 - DNA, 19 bp, Homo sapiens
tatatcatgtaaagaaatg

SEQ ID NO: 3633107 - DNA, 21 bp, Homo sapiens
tatatctaccccagactagat

SEQ ID NO: 3633108 - DNA, 13 bp, Homo sapiens
tatatcttctaca

SEQ ID NO: 3633109 - DNA, 14 bp, Homo sapiens
tatatgatatgcat

SEQ ID NO: 3633110 - DNA, 17 bp, Homo sapiens
tatatgccctcaagtaa

SEQ ID NO: 3633111 - DNA, 16 bp, Homo sapiens
tatatggataatctga

SEQ ID NO: 3633112 - DNA, 19 bp, Homo sapiens
tatatggataatctgagca

SEQ ID NO: 3633113 - DNA, 23 bp, Homo sapiens
tatatgtatttaagatgtacatt

SEQ ID NO: 3633114 - DNA, 13 bp, Homo sapiens
tatatgtgaaaca

SEQ ID NO: 3633115 - DNA, 17 bp, Homo sapiens
tatattacaatgatcac

SEQ ID NO: 3633116 - DNA, 18 bp, Homo sapiens
tatattataagttgacct

SEQ ID NO: 3633117 - DNA, 15 bp, Homo sapiens
tatattattgattca

SEQ ID NO: 3633118 - DNA, 20 bp, Homo sapiens
tatattatttagtcaacata

SEQ ID NO: 3633119 - DNA, 20 bp, Homo sapiens
tatattcattctttttgaaa

SEQ ID NO: 3633120 - DNA, 15 bp, Homo sapiens
tatattcctccagct

SEQ ID NO: 3633121 - DNA, 17 bp, Homo sapiens
tatattctattttacaa

SEQ ID NO: 3633122 - DNA, 18 bp, Homo sapiens
tatattggaattataaat

SEQ ID NO: 3633123 - DNA, 17 bp, Homo sapiens
tatattgtttttatata

SEQ ID NO: 3633124 - DNA, 20 bp, Homo sapiens
tatattgtttttatatatta

SEQ ID NO: 3633125 - DNA, 15 bp, Homo sapiens
tatatttaacaagat

SEQ ID NO: 3633126 - DNA, 15 bp, Homo sapiens
tatatttataaggaa

SEQ ID NO: 3633127 - DNA, 22 bp, Homo sapiens
tatatttgggcctgctccagac

SEQ ID NO: 3633128 - DNA, 13 bp, Homo sapiens
tatatttgtcact

SEQ ID NO: 3633129 - DNA, 18 bp, Homo sapiens
tatattttatttttagaa

SEQ ID NO: 3633130 - DNA, 22 bp, Homo sapiens
tatattttatttttagaatttt

SEQ ID NO: 3633131 - DNA, 16 bp, Homo sapiens
tatatttttaaagaat

SEQ ID NO: 3633132 - DNA, 18 bp, Homo sapiens
tatatttttaaagaatgt

SEQ ID NO: 3633133 - DNA, 19 bp, Homo sapiens
tcacctccaagcatttcat

SEQ ID NO: 3633134 - DNA, 12 bp, Homo sapiens
tcacctgctcca

SEQ ID NO: 3633135 - DNA, 14 bp, Homo sapiens
tcacctgctccaga

SEQ ID NO: 3633136 - DNA, 15 bp, Homo sapiens
tcacctgctccagaa

SEQ ID NO: 3633137 - DNA, 22 bp, Homo sapiens
tcacctggacttaagcatctgg

SEQ ID NO: 3633138 - DNA, 18 bp, Homo sapiens
tcaccttggcaccagaca

SEQ ID NO: 3633139 - DNA, 18 bp, Homo sapiens
tcacgacacatttgcctt

SEQ ID NO: 3633140 - DNA, 21 bp, Homo sapiens
tcacgtttggtgcttctcaga

SEQ ID NO: 3633141 - DNA, 20 bp, Homo sapiens
tcactaatttggctttcaca

SEQ ID NO: 3633142 - DNA, 16 bp, Homo sapiens
tcactagaaaatgaga

SEQ ID NO: 3633143 - DNA, 17 bp, Homo sapiens
tcactagaatggataaa

SEQ ID NO: 3633144 - DNA, 22 bp, Homo sapiens
tcactagtgaccccttccctgt

SEQ ID NO: 3633145 - DNA, 16 bp, Homo sapiens
tcactcaccactacca

SEQ ID NO: 3633146 - DNA, 22 bp, Homo sapiens
tcactcaccactaccagccagc

SEQ ID NO: 3633147 - DNA, 19 bp, Homo sapiens
tcactccccagggagctct

SEQ ID NO: 3633148 - DNA, 20 bp, Homo sapiens
tcactccccagggagctctg

SEQ ID NO: 3633149 - DNA, 22 bp, Homo sapiens
tcactccccagggagctctggg

SEQ ID NO: 3633150 - DNA, 12 bp, Homo sapiens
tcactctggctt

SEQ ID NO: 3633151 - DNA, 14 bp, Homo sapiens
tcactctggcttca

SEQ ID NO: 3633152 - DNA, 18 bp, Homo sapiens
tcactctgggcctgggga

SEQ ID NO: 3633153 - DNA, 14 bp, Homo sapiens
tcactgaactccac

SEQ ID NO: 3633154 - DNA, 15 bp, Homo sapiens
tcactgaactccacc

SEQ ID NO: 3633155 - DNA, 17 bp, Homo sapiens
tcactgcaaacacacct

SEQ ID NO: 3633156 - DNA, 18 bp, Homo sapiens
tcactgcaacttctgcct

SEQ ID NO: 3633157 - DNA, 20 bp, Homo sapiens
tcactgcacagtgcatctca

SEQ ID NO: 3633158 - DNA, 15 bp, Homo sapiens
tcactgcagcctcaa

SEQ ID NO: 3633159 - DNA, 13 bp, Homo sapiens
tcactgctggctg

SEQ ID NO: 3633160 - DNA, 18 bp, Homo sapiens
tcactggaccactgggca

SEQ ID NO: 3633161 - DNA, 18 bp, Homo sapiens
tcactggcaggtgtggga

SEQ ID NO: 3633162 - DNA, 14 bp, Homo sapiens
tcactggcctgcca

SEQ ID NO: 3633163 - DNA, 19 bp, Homo sapiens
tcactggcctgccatgcca

SEQ ID NO: 3633164 - DNA, 19 bp, Homo sapiens
tcactggtagaccaaaata

SEQ ID NO: 3633165 - DNA, 15 bp, Homo sapiens
tcacttaacaaacaa

SEQ ID NO: 3633166 - DNA, 18 bp, Homo sapiens
tcacttcaagctgttatt

SEQ ID NO: 3633167 - DNA, 15 bp, Homo sapiens
tcacttgctctttga

SEQ ID NO: 3633168 - DNA, 15 bp, Homo sapiens
tcacttgtacaaaat

SEQ ID NO: 3633169 - DNA, 20 bp, Homo sapiens
tcactttattaccttctttc

SEQ ID NO: 3633170 - DNA, 14 bp, Homo sapiens
tcactttcctcagt

SEQ ID NO: 3633171 - DNA, 12 bp, Homo sapiens
tcacttttcctc

SEQ ID NO: 3633172 - DNA, 18 bp, Homo sapiens
tcacttttcctccctcag

SEQ ID NO: 3633173 - DNA, 20 bp, Homo sapiens
tcacttttggcaatgactca

SEQ ID NO: 3633174 - DNA, 16 bp, Homo sapiens
tcagaaaattccctgg

SEQ ID NO: 3633175 - DNA, 18 bp, Homo sapiens
tcagaaaggggctcttct

SEQ ID NO: 3633176 - DNA, 14 bp, Homo sapiens
tcagaaataaatca

SEQ ID NO: 3633177 - DNA, 16 bp, Homo sapiens
tcagaacaaaacttct

SEQ ID NO: 3633178 - DNA, 22 bp, Homo sapiens
tcagaactcaaatggggccaga

SEQ ID NO: 3633179 - DNA, 14 bp, Homo sapiens
tcagaactcttcct

SEQ ID NO: 3633180 - DNA, 13 bp, Homo sapiens
tcagaactgccct

SEQ ID NO: 3633181 - DNA, 15 bp, Homo sapiens
tcagaaggccccaga

SEQ ID NO: 3633182 - DNA, 20 bp, Homo sapiens
tcagaaggccccagagagac

SEQ ID NO: 3633183 - DNA, 18 bp, Homo sapiens
tcagaagtcatcttgcta

SEQ ID NO: 3633184 - DNA, 18 bp, Homo sapiens
tcagaagtctttcagcaa

SEQ ID NO: 3633185 - DNA, 15 bp, Homo sapiens
tcagaatcttttcaa

SEQ ID NO: 3633186 - DNA, 14 bp, Homo sapiens
tcagacacagctct

SEQ ID NO: 3633187 - DNA, 15 bp, Homo sapiens
tcagacacagctctt

SEQ ID NO: 3633188 - DNA, 13 bp, Homo sapiens
tcagacatttctt

SEQ ID NO: 3633189 - DNA, 16 bp, Homo sapiens
tcagacatttctttgg

SEQ ID NO: 3633190 - DNA, 14 bp, Homo sapiens
tcagaccagctctt

SEQ ID NO: 3633191 - DNA, 17 bp, Homo sapiens
tcagaccccctcagcct

SEQ ID NO: 3633192 - DNA, 19 bp, Homo sapiens
tcagaccccctcagccttg

SEQ ID NO: 3633193 - DNA, 19 bp, Homo sapiens
tcagactcccattcctgaa

SEQ ID NO: 3633194 - DNA, 13 bp, Homo sapiens
tcagactggccct

SEQ ID NO: 3633195 - DNA, 22 bp, Homo sapiens
tcagactttgtgttcatttcat

SEQ ID NO: 3633196 - DNA, 16 bp, Homo sapiens
tcagagaaatgtctgt

SEQ ID NO: 3633197 - DNA, 18 bp, Homo sapiens
tcagagaattatctcaag

SEQ ID NO: 3633198 - DNA, 22 bp, Homo sapiens
tcagagaattatctcaagtaaa

SEQ ID NO: 3633199 - DNA, 22 bp, Homo sapiens
tcagagaggtagcactctcaga

SEQ ID NO: 3633200 - DNA, 13 bp, Homo sapiens
tcagagccagcct

SEQ ID NO: 3633201 - DNA, 16 bp, Homo sapiens
tcagagcccccagccc

SEQ ID NO: 3633202 - DNA, 17 bp, Homo sapiens
tcagagcccccagccct

SEQ ID NO: 3633203 - DNA, 20 bp, Homo sapiens
tcagagcccccagccctggg

SEQ ID NO: 3633204 - DNA, 21 bp, Homo sapiens
tcagaggaacagtcctgttca

SEQ ID NO: 3633205 - DNA, 19 bp, Homo sapiens
tcagaggagcgcaggcagc

SEQ ID NO: 3633206 - DNA, 16 bp, Homo sapiens
tcagatccagggacag

SEQ ID NO: 3633207 - DNA, 18 bp, Homo sapiens
tcagatctttctccttga

SEQ ID NO: 3633208 - DNA, 19 bp, Homo sapiens
tcagatctttctccttgaa

SEQ ID NO: 3633209 - DNA, 12 bp, Homo sapiens
tcagatggaaaa

SEQ ID NO: 3633210 - DNA, 20 bp, Homo sapiens
tcagatggaaaattcatttt

SEQ ID NO: 3633211 - DNA, 22 bp, Homo sapiens
tcagcaaaaatctcccagtgac

SEQ ID NO: 3633212 - DNA, 21 bp, Homo sapiens
tcagcaaacaggatcagttaa

SEQ ID NO: 3633213 - DNA, 11 bp, Homo sapiens
tcagcaaccct

SEQ ID NO: 3633214 - DNA, 21 bp, Homo sapiens
tcagcagagaaggtaaggtgt

SEQ ID NO: 3633215 - DNA, 16 bp, Homo sapiens
tcagcagtctaaattt

SEQ ID NO: 3633216 - DNA, 16 bp, Homo sapiens
tcagcatcacccacct

SEQ ID NO: 3633217 - DNA, 14 bp, Homo sapiens
tcagcatccagtgt

SEQ ID NO: 3633218 - DNA, 17 bp, Homo sapiens
tcagcattctcactcct

SEQ ID NO: 3633219 - DNA, 19 bp, Homo sapiens
tcagcatttccttgtcccg

SEQ ID NO: 3633220 - DNA, 15 bp, Homo sapiens
tcagccaaagtccta

SEQ ID NO: 3633221 - DNA, 12 bp, Homo sapiens
tcagccacctgg

SEQ ID NO: 3633222 - DNA, 15 bp, Homo sapiens
tcagccacctgggaa

SEQ ID NO: 3633223 - DNA, 18 bp, Homo sapiens
tcagccaggcgtggttac

SEQ ID NO: 3633224 - DNA, 21 bp, Homo sapiens
tcagccaggtctgactccaaa

SEQ ID NO: 3633225 - DNA, 15 bp, Homo sapiens
tcagcccagtgcaaa

SEQ ID NO: 3633226 - DNA, 20 bp, Homo sapiens
tcagccccaccccaggtcct

SEQ ID NO: 3633227 - DNA, 15 bp, Homo sapiens
tcagccctccctgcc

SEQ ID NO: 3633228 - DNA, 16 bp, Homo sapiens
tcagccctccctgccc

SEQ ID NO: 3633229 - DNA, 18 bp, Homo sapiens
tcagccctccctgcccct

SEQ ID NO: 3633230 - DNA, 19 bp, Homo sapiens
tcagccctccctgcccctc

SEQ ID NO: 3633231 - DNA, 14 bp, Homo sapiens
tcagccctgcacca

SEQ ID NO: 3633232 - DNA, 17 bp, Homo sapiens
tcagccctggcctggct

SEQ ID NO: 3633233 - DNA, 22 bp, Homo sapiens
tcagcctaccgctggccctgcc

SEQ ID NO: 3633234 - DNA, 20 bp, Homo sapiens
tcagcctcctgagtagctgg

SEQ ID NO: 3633235 - DNA, 12 bp, Homo sapiens
tcagcctggaag

SEQ ID NO: 3633236 - DNA, 15 bp, Homo sapiens
tcagcctggccagac

SEQ ID NO: 3633237 - DNA, 18 bp, Homo sapiens
tcagccttatccaggttg

SEQ ID NO: 3633238 - DNA, 16 bp, Homo sapiens
tcagccttgccagaga

SEQ ID NO: 3633239 - DNA, 18 bp, Homo sapiens
tcagccttttatgtattt

SEQ ID NO: 3633240 - DNA, 13 bp, Homo sapiens
tcagctctggaga

SEQ ID NO: 3633241 - DNA, 16 bp, Homo sapiens
tcagctgagcatggag

SEQ ID NO: 3633242 - DNA, 21 bp, Homo sapiens
tcagctgagcatggagacagc

SEQ ID NO: 3633243 - DNA, 22 bp, Homo sapiens
tcagctgagcatggagacagca

SEQ ID NO: 3633244 - DNA, 21 bp, Homo sapiens
tcagctggacatactgctgga

SEQ ID NO: 3633245 - DNA, 12 bp, Homo sapiens
tcagctttaaag

SEQ ID NO: 3633246 - DNA, 16 bp, Homo sapiens
tcagctttggctctgg

SEQ ID NO: 3633247 - DNA, 19 bp, Homo sapiens
tcagctttggctctggctg

SEQ ID NO: 3633248 - DNA, 22 bp, Homo sapiens
tcaggaaatcaaatatgcaaag

SEQ ID NO: 3633249 - DNA, 13 bp, Homo sapiens
tcaggaattcagt

SEQ ID NO: 3633250 - DNA, 15 bp, Homo sapiens
tcaggacagatgcca

SEQ ID NO: 3633251 - DNA, 13 bp, Homo sapiens
tcaggagaagcca

SEQ ID NO: 3633252 - DNA, 15 bp, Homo sapiens
tcaggagaagccagt

SEQ ID NO: 3633253 - DNA, 17 bp, Homo sapiens
tcaggagaagccagtgt

SEQ ID NO: 3633254 - DNA, 14 bp, Homo sapiens
tcaggagatgggga

SEQ ID NO: 3633255 - DNA, 18 bp, Homo sapiens
tcaggaggctgaggcagg

SEQ ID NO: 3633256 - DNA, 19 bp, Homo sapiens
tcaggaggctgaggcagga

SEQ ID NO: 3633257 - DNA, 18 bp, Homo sapiens
tcaggattaactaaagaa

SEQ ID NO: 3633258 - DNA, 20 bp, Homo sapiens
tcaggattaactaaagaaga

SEQ ID NO: 3633259 - DNA, 21 bp, Homo sapiens
tcaggattaactaaagaagag

SEQ ID NO: 3633260 - DNA, 17 bp, Homo sapiens
tcaggattctgttcctt

SEQ ID NO: 3633261 - DNA, 17 bp, Homo sapiens
tcaggcacaccttgcag

SEQ ID NO: 3633262 - DNA, 19 bp, Homo sapiens
tcaggcccttattttcaag

SEQ ID NO: 3633263 - DNA, 17 bp, Homo sapiens
tcaggctagctgtgctg

SEQ ID NO: 3633264 - DNA, 22 bp, Homo sapiens
tcaggctatatgcagtccttta

SEQ ID NO: 3633265 - DNA, 11 bp, Homo sapiens
tcaggctccta

SEQ ID NO: 3633266 - DNA, 17 bp, Homo sapiens
tccatccgactgcccct

SEQ ID NO: 3633267 - DNA, 18 bp, Homo sapiens
tccatccgactgcccctg

SEQ ID NO: 3633268 - DNA, 14 bp, Homo sapiens
tccatcctgcagat

SEQ ID NO: 3633269 - DNA, 16 bp, Homo sapiens
tccatctcaaaacaaa

SEQ ID NO: 3633270 - DNA, 18 bp, Homo sapiens
tccatctcaaaacaaaac

SEQ ID NO: 3633271 - DNA, 24 bp, Homo sapiens
tccatctgggcttatatgtacttt

SEQ ID NO: 3633272 - DNA, 18 bp, Homo sapiens
tccatctttctacagaga

SEQ ID NO: 3633273 - DNA, 14 bp, Homo sapiens
tccatgatgcacag

SEQ ID NO: 3633274 - DNA, 16 bp, Homo sapiens
tccatgatgcacagta

SEQ ID NO: 3633275 - DNA, 17 bp, Homo sapiens
tccatgatgcacagtat

SEQ ID NO: 3633276 - DNA, 19 bp, Homo sapiens
tccatgatgcacagtatct

SEQ ID NO: 3633277 - DNA, 14 bp, Homo sapiens
tccatgcaactgga

SEQ ID NO: 3633278 - DNA, 14 bp, Homo sapiens
tccatgctgcctcc

SEQ ID NO: 3633279 - DNA, 15 bp, Homo sapiens
tccatgctgcctcca

SEQ ID NO: 3633280 - DNA, 21 bp, Homo sapiens
tccatggtactgtagcagggg

SEQ ID NO: 3633281 - DNA, 19 bp, Homo sapiens
tccatgtcgcctctgcatt

SEQ ID NO: 3633282 - DNA, 13 bp, Homo sapiens
tccatgttgactg

SEQ ID NO: 3633283 - DNA, 20 bp, Homo sapiens
tccattcctaatcaaattct

SEQ ID NO: 3633284 - DNA, 22 bp, Homo sapiens
tccatttcaggactctctccag

SEQ ID NO: 3633285 - DNA, 23 bp, Homo sapiens
tccatttcaggactctctccagg

SEQ ID NO: 3633286 - DNA, 14 bp, Homo sapiens
tccatttcccctct

SEQ ID NO: 3633287 - DNA, 11 bp, Homo sapiens
tccatttctga

SEQ ID NO: 3633288 - DNA, 15 bp, Homo sapiens
tccatttctttcttc

SEQ ID NO: 3633289 - DNA, 11 bp, Homo sapiens
tccatttgctt

SEQ ID NO: 3633290 - DNA, 23 bp, Homo sapiens
tccatttttctcccaagaaacct

SEQ ID NO: 3633291 - DNA, 13 bp, Homo sapiens
tcccaaactgaca

SEQ ID NO: 3633292 - DNA, 19 bp, Homo sapiens
tcccaaactgacaatttta

SEQ ID NO: 3633293 - DNA, 21 bp, Homo sapiens
tcccaaagtgctgggattaca

SEQ ID NO: 3633294 - DNA, 23 bp, Homo sapiens
tcccaaatcctagactgctcctg

SEQ ID NO: 3633295 - DNA, 16 bp, Homo sapiens
tcccaaatttcatacc

SEQ ID NO: 3633296 - DNA, 14 bp, Homo sapiens
tcccaactctagct

SEQ ID NO: 3633297 - DNA, 16 bp, Homo sapiens
tcccaactctagctgg

SEQ ID NO: 3633298 - DNA, 22 bp, Homo sapiens
tcccaaggcattctcccagctc

SEQ ID NO: 3633299 - DNA, 20 bp, Homo sapiens
tcccaaggttacttaattca

SEQ ID NO: 3633300 - DNA, 15 bp, Homo sapiens
tcccaatctttctat

SEQ ID NO: 3633301 - DNA, 20 bp, Homo sapiens
tcccaatctttctatataaa

SEQ ID NO: 3633302 - DNA, 18 bp, Homo sapiens
tcccaatttcagactccc

SEQ ID NO: 3633303 - DNA, 23 bp, Homo sapiens
tcccaatttcagactcccattcc

SEQ ID NO: 3633304 - DNA, 16 bp, Homo sapiens
tcccacaagtggtggt

SEQ ID NO: 3633305 - DNA, 21 bp, Homo sapiens
tcccacactgtgcagacccag

SEQ ID NO: 3633306 - DNA, 14 bp, Homo sapiens
tcccacactgtggc

SEQ ID NO: 3633307 - DNA, 21 bp, Homo sapiens
tcccacagcagccccaggaga

SEQ ID NO: 3633308 - DNA, 12 bp, Homo sapiens
tcccacaggagg

SEQ ID NO: 3633309 - DNA, 22 bp, Homo sapiens
tcccacaggcccttcctctcca

SEQ ID NO: 3633310 - DNA, 14 bp, Homo sapiens
tcccacatgaggcc

SEQ ID NO: 3633311 - DNA, 19 bp, Homo sapiens
tcccacatgaggccatctc

SEQ ID NO: 3633312 - DNA, 22 bp, Homo sapiens
tcccacatggccatcttctttc

SEQ ID NO: 3633313 - DNA, 17 bp, Homo sapiens
tcccaccaacctccagt

SEQ ID NO: 3633314 - DNA, 19 bp, Homo sapiens
tcccaccagaacgcacccc

SEQ ID NO: 3633315 - DNA, 21 bp, Homo sapiens
tcccaccagaacgcaccccac

SEQ ID NO: 3633316 - DNA, 14 bp, Homo sapiens
tcccaccattcctg

SEQ ID NO: 3633317 - DNA, 15 bp, Homo sapiens
tcccaccattcctgc

SEQ ID NO: 3633318 - DNA, 19 bp, Homo sapiens
tcccacccaccgccacaat

SEQ ID NO: 3633319 - DNA, 13 bp, Homo sapiens
tcccaccccactc

SEQ ID NO: 3633320 - DNA, 21 bp, Homo sapiens
tcccaccccctcctcccccag

SEQ ID NO: 3633321 - DNA, 22 bp, Homo sapiens
tcccaccccctcctcccccagt

SEQ ID NO: 3633322 - DNA, 13 bp, Homo sapiens
tcccaccttccca

SEQ ID NO: 3633323 - DNA, 16 bp, Homo sapiens
tcccactacatctggg

SEQ ID NO: 3633324 - DNA, 13 bp, Homo sapiens
tcccactccagct

SEQ ID NO: 3633325 - DNA, 16 bp, Homo sapiens
tcccactccagctgac

SEQ ID NO: 3633326 - DNA, 13 bp, Homo sapiens
tcccactctgggc

SEQ ID NO: 3633327 - DNA, 12 bp, Homo sapiens
tcccacttgtca

SEQ ID NO: 3633328 - DNA, 16 bp, Homo sapiens
tcccagaacctctaag

SEQ ID NO: 3633329 - DNA, 23 bp, Homo sapiens
tcccagaacctctaagtgctgct

SEQ ID NO: 3633330 - DNA, 22 bp, Homo sapiens
tcccagacaggccctccctgtc

SEQ ID NO: 3633331 - DNA, 20 bp, Homo sapiens
tcccagactactattttctt

SEQ ID NO: 3633332 - DNA, 23 bp, Homo sapiens
tcccagactactattttcttttt

SEQ ID NO: 3633333 - DNA, 19 bp, Homo sapiens
tcccagactgacagactta

SEQ ID NO: 3633334 - DNA, 20 bp, Homo sapiens
tcccagagacctcatcagcc

SEQ ID NO: 3633335 - DNA, 20 bp, Homo sapiens
tcccagaggagccaccagtt

SEQ ID NO: 3633336 - DNA, 18 bp, Homo sapiens
tcccagcaattattacaa

SEQ ID NO: 3633337 - DNA, 21 bp, Homo sapiens
tcccagcaggaatttcttttt

SEQ ID NO: 3633338 - DNA, 17 bp, Homo sapiens
tcccagcatccctggag

SEQ ID NO: 3633339 - DNA, 23 bp, Homo sapiens
tcccagcatccctggagcaggag

SEQ ID NO: 3633340 - DNA, 15 bp, Homo sapiens
tcccagcctgactag

SEQ ID NO: 3633341 - DNA, 14 bp, Homo sapiens
tcccagcgctgctg

SEQ ID NO: 3633342 - DNA, 16 bp, Homo sapiens
tcccagctacaccttt

SEQ ID NO: 3633343 - DNA, 20 bp, Homo sapiens
tcccagctactcaggaggct

SEQ ID NO: 3633344 - DNA, 19 bp, Homo sapiens
tcccagctgaaggcagtgg

SEQ ID NO: 3633345 - DNA, 16 bp, Homo sapiens
tcccaggaactgggcc

SEQ ID NO: 3633346 - DNA, 12 bp, Homo sapiens
tcccaggaccct

SEQ ID NO: 3633347 - DNA, 15 bp, Homo sapiens
tcccaggagacagtt

SEQ ID NO: 3633348 - DNA, 16 bp, Homo sapiens
tcccaggagacagttc

SEQ ID NO: 3633349 - DNA, 12 bp, Homo sapiens
tcccagtgacaa

SEQ ID NO: 3633350 - DNA, 18 bp, Homo sapiens
tcccatcccactgctccc

SEQ ID NO: 3633351 - DNA, 17 bp, Homo sapiens
tcccatcctggggcagc

SEQ ID NO: 3633352 - DNA, 12 bp, Homo sapiens
tcccatgccctg

SEQ ID NO: 3633353 - DNA, 14 bp, Homo sapiens
tcccattcctgaag

SEQ ID NO: 3633354 - DNA, 15 bp, Homo sapiens
tcccattcctgaaga

SEQ ID NO: 3633355 - DNA, 17 bp, Homo sapiens
tcccattcctgaagaac

SEQ ID NO: 3633356 - DNA, 16 bp, Homo sapiens
tcccattcttggccca

SEQ ID NO: 3633357 - DNA, 19 bp, Homo sapiens
tcccattgtccctctgccc

SEQ ID NO: 3633358 - DNA, 15 bp, Homo sapiens
tcccatttagtgtga

SEQ ID NO: 3633359 - DNA, 16 bp, Homo sapiens
tcccatttagtgtgaa

SEQ ID NO: 3633360 - DNA, 11 bp, Homo sapiens
tcccatttctt

SEQ ID NO: 3633361 - DNA, 21 bp, Homo sapiens
tccccaacccctctccaggcc

SEQ ID NO: 3633362 - DNA, 22 bp, Homo sapiens
tccccaacccctctccaggcct

SEQ ID NO: 3633363 - DNA, 23 bp, Homo sapiens
tccccaattatatctcccccact

SEQ ID NO: 3633364 - DNA, 19 bp, Homo sapiens
tccccaccatctgctgtct

SEQ ID NO: 3633365 - DNA, 23 bp, Homo sapiens
tccccagacttctctttcttatt

SEQ ID NO: 3633366 - DNA, 10 bp, Homo sapiens
tccccagaga

SEQ ID NO: 3633367 - DNA, 22 bp, Homo sapiens
tccccagagaaaggggagccca

SEQ ID NO: 3633368 - DNA, 15 bp, Homo sapiens
tccccagagctgtgc

SEQ ID NO: 3633369 - DNA, 16 bp, Homo sapiens
tccccagagctgtgcc

SEQ ID NO: 3633370 - DNA, 21 bp, Homo sapiens
tccccagccagcccttccctg

SEQ ID NO: 3633371 - DNA, 14 bp, Homo sapiens
tccccagccagcct

SEQ ID NO: 3633372 - DNA, 16 bp, Homo sapiens
tccccagccagcctgg

SEQ ID NO: 3633373 - DNA, 17 bp, Homo sapiens
tccccagcccagagaca

SEQ ID NO: 3633374 - DNA, 20 bp, Homo sapiens
tccccagccccagccccttc

SEQ ID NO: 3633375 - DNA, 14 bp, Homo sapiens
tccccagggagctc

SEQ ID NO: 3633376 - DNA, 14 bp, Homo sapiens
tccccagtgactcc

SEQ ID NO: 3633377 - DNA, 15 bp, Homo sapiens
tccccagtgactcca

SEQ ID NO: 3633378 - DNA, 17 bp, Homo sapiens
tccccatgggcacagtg

SEQ ID NO: 3633379 - DNA, 24 bp, Homo sapiens
tccccatgggcacagtggtgaccc

SEQ ID NO: 3633380 - DNA, 14 bp, Homo sapiens
tccccattcttcct

SEQ ID NO: 3633381 - DNA, 11 bp, Homo sapiens
tcccccagcaa

SEQ ID NO: 3633382 - DNA, 22 bp, Homo sapiens
tcccccagcaacgcccctccaa

SEQ ID NO: 3633383 - DNA, 18 bp, Homo sapiens
tcccccattccctccatt

SEQ ID NO: 3633384 - DNA, 18 bp, Homo sapiens
tcccccccatgcactgtg

SEQ ID NO: 3633385 - DNA, 14 bp, Homo sapiens
tccccctcccccag

SEQ ID NO: 3633386 - DNA, 17 bp, Homo sapiens
tccccctcccccattcc

SEQ ID NO: 3633387 - DNA, 17 bp, Homo sapiens
tccccctcttcttctga

SEQ ID NO: 3633388 - DNA, 11 bp, Homo sapiens
tccccctgcaa

SEQ ID NO: 3633389 - DNA, 21 bp, Homo sapiens
tccccctgcaacttccgctga

SEQ ID NO: 3633390 - DNA, 21 bp, Homo sapiens
tccccctgtttcagaggctca

SEQ ID NO: 3633391 - DNA, 12 bp, Homo sapiens
tcccccttccca

SEQ ID NO: 3633392 - DNA, 18 bp, Homo sapiens
tcccccttcccatttctt

SEQ ID NO: 3633393 - DNA, 21 bp, Homo sapiens
tcccccttcccatttcttccc

SEQ ID NO: 3633394 - DNA, 13 bp, Homo sapiens
tccccgcccctgt

SEQ ID NO: 3633395 - DNA, 13 bp, Homo sapiens
tccccgctcaggg

SEQ ID NO: 3633396 - DNA, 21 bp, Homo sapiens
tccccgctcaggggcctggag

SEQ ID NO: 3633397 - DNA, 15 bp, Homo sapiens
tcccctaaagccagg

SEQ ID NO: 3633398 - DNA, 16 bp, Homo sapiens
tcccctaaagccaggc

SEQ ID NO: 3633399 - DNA, 13 bp, Homo sapiens
tcctggccctggg

SEQ ID NO: 3633400 - DNA, 14 bp, Homo sapiens
tcctggccctgggg

SEQ ID NO: 3633401 - DNA, 15 bp, Homo sapiens
tcctggccctggggg

SEQ ID NO: 3633402 - DNA, 22 bp, Homo sapiens
tcctggccctgggggtctgggc

SEQ ID NO: 3633403 - DNA, 16 bp, Homo sapiens
tcctggccttttgtgg

SEQ ID NO: 3633404 - DNA, 14 bp, Homo sapiens
tcctggctgtaaat

SEQ ID NO: 3633405 - DNA, 21 bp, Homo sapiens
tcctgggcacacgctgctctg

SEQ ID NO: 3633406 - DNA, 18 bp, Homo sapiens
tcctgggcatgggtccag

SEQ ID NO: 3633407 - DNA, 21 bp, Homo sapiens
tcctgggcatgggtccagggc

SEQ ID NO: 3633408 - DNA, 16 bp, Homo sapiens
tcctgggccggctgag

SEQ ID NO: 3633409 - DNA, 14 bp, Homo sapiens
tcctgggcctgccc

SEQ ID NO: 3633410 - DNA, 12 bp, Homo sapiens
tcctgggctggt

SEQ ID NO: 3633411 - DNA, 13 bp, Homo sapiens
tcctggggcagca

SEQ ID NO: 3633412 - DNA, 16 bp, Homo sapiens
tcctggggcagcactc

SEQ ID NO: 3633413 - DNA, 17 bp, Homo sapiens
tcctggggcagcactcc

SEQ ID NO: 3633414 - DNA, 20 bp, Homo sapiens
tcctggggcagcactcccca

SEQ ID NO: 3633415 - DNA, 21 bp, Homo sapiens
tcctgggggttctttcttcct

SEQ ID NO: 3633416 - DNA, 22 bp, Homo sapiens
tcctggtgccctggatgcccag

SEQ ID NO: 3633417 - DNA, 16 bp, Homo sapiens
tcctgtaccaaatctg

SEQ ID NO: 3633418 - DNA, 14 bp, Homo sapiens
tcctgtacctcagt

SEQ ID NO: 3633419 - DNA, 15 bp, Homo sapiens
tcctgtacctcagtg

SEQ ID NO: 3633420 - DNA, 16 bp, Homo sapiens
tcctgtacctcagtgg

SEQ ID NO: 3633421 - DNA, 20 bp, Homo sapiens
tcctgtacctcagtggatct

SEQ ID NO: 3633422 - DNA, 13 bp, Homo sapiens
tcctgtccagctc

SEQ ID NO: 3633423 - DNA, 14 bp, Homo sapiens
tcctgtccagctcc

SEQ ID NO: 3633424 - DNA, 16 bp, Homo sapiens
tcctgtcttctttctc

SEQ ID NO: 3633425 - DNA, 23 bp, Homo sapiens
tcctgtcttctttctccatggag

SEQ ID NO: 3633426 - DNA, 22 bp, Homo sapiens
tcctgtgaagtttaattgtctc

SEQ ID NO: 3633427 - DNA, 14 bp, Homo sapiens
tcctgtgccctaga

SEQ ID NO: 3633428 - DNA, 21 bp, Homo sapiens
tcctgtgcctttcctatcacc

SEQ ID NO: 3633429 - DNA, 18 bp, Homo sapiens
tcctgtggggttgttttt

SEQ ID NO: 3633430 - DNA, 15 bp, Homo sapiens
tcctgttctgcgctg

SEQ ID NO: 3633431 - DNA, 23 bp, Homo sapiens
tcctgttctgcgctgtgtacaat

SEQ ID NO: 3633432 - DNA, 12 bp, Homo sapiens
tcctgtttcaga

SEQ ID NO: 3633433 - DNA, 18 bp, Homo sapiens
tcctgtttcagacccccc

SEQ ID NO: 3633434 - DNA, 20 bp, Homo sapiens
tcctgtttggtggggtggca

SEQ ID NO: 3633435 - DNA, 20 bp, Homo sapiens
tcctgttttataatgaaccc

SEQ ID NO: 3633436 - DNA, 19 bp, Homo sapiens
tccttaacccacctctcct

SEQ ID NO: 3633437 - DNA, 23 bp, Homo sapiens
tccttactcccccaccactcagg

SEQ ID NO: 3633438 - DNA, 22 bp, Homo sapiens
tccttaggaggccccctcctca

SEQ ID NO: 3633439 - DNA, 22 bp, Homo sapiens
tccttaggtttttttccttctg

SEQ ID NO: 3633440 - DNA, 22 bp, Homo sapiens
tccttatgtatcagtgtccttt

SEQ ID NO: 3633441 - DNA, 16 bp, Homo sapiens
tccttatgtcctgtca

SEQ ID NO: 3633442 - DNA, 14 bp, Homo sapiens
tccttattcagcct

SEQ ID NO: 3633443 - DNA, 13 bp, Homo sapiens
tccttatttgcct

SEQ ID NO: 3633444 - DNA, 17 bp, Homo sapiens
tccttcagatattttta

SEQ ID NO: 3633445 - DNA, 17 bp, Homo sapiens
tccttcagtgagcccct

SEQ ID NO: 3633446 - DNA, 21 bp, Homo sapiens
tccttcagtgagcccctcccc

SEQ ID NO: 3633447 - DNA, 15 bp, Homo sapiens
tccttccaccaagtt

SEQ ID NO: 3633448 - DNA, 14 bp, Homo sapiens
tccttccctgttct

SEQ ID NO: 3633449 - DNA, 14 bp, Homo sapiens
tccttctctgggtc

SEQ ID NO: 3633450 - DNA, 11 bp, Homo sapiens
tccttctgaag

SEQ ID NO: 3633451 - DNA, 19 bp, Homo sapiens
tccttctgaagtctgagcc

SEQ ID NO: 3633452 - DNA, 12 bp, Homo sapiens
tccttcttccca

SEQ ID NO: 3633453 - DNA, 12 bp, Homo sapiens
tccttctttcct

SEQ ID NO: 3633454 - DNA, 16 bp, Homo sapiens
tccttggactccatcg

SEQ ID NO: 3633455 - DNA, 13 bp, Homo sapiens
tccttggcacccc

SEQ ID NO: 3633456 - DNA, 17 bp, Homo sapiens
tccttggcacccccatg

SEQ ID NO: 3633457 - DNA, 20 bp, Homo sapiens
tccttggcacccccatgctg

SEQ ID NO: 3633458 - DNA, 16 bp, Homo sapiens
tccttggccatgcaga

SEQ ID NO: 3633459 - DNA, 22 bp, Homo sapiens
tccttggctcccgggggcccca

SEQ ID NO: 3633460 - DNA, 17 bp, Homo sapiens
tccttggctttatgcaa

SEQ ID NO: 3633461 - DNA, 21 bp, Homo sapiens
tccttggctttatgcaaatac

SEQ ID NO: 3633462 - DNA, 18 bp, Homo sapiens
tccttgggcgtctctaat

SEQ ID NO: 3633463 - DNA, 20 bp, Homo sapiens
tccttgtcccgtctggacct

SEQ ID NO: 3633464 - DNA, 18 bp, Homo sapiens
tcctttaaatttcagctt

SEQ ID NO: 3633465 - DNA, 14 bp, Homo sapiens
tcctttaatatgaa

SEQ ID NO: 3633466 - DNA, 15 bp, Homo sapiens
tcctttaatatgaaa

SEQ ID NO: 3633467 - DNA, 23 bp, Homo sapiens
tcctttacaactaaataacacag

SEQ ID NO: 3633468 - DNA, 15 bp, Homo sapiens
tcctttactcctggc

SEQ ID NO: 3633469 - DNA, 18 bp, Homo sapiens
tcctttcacaaccttctg

SEQ ID NO: 3633470 - DNA, 19 bp, Homo sapiens
tcctttcattaccctacag

SEQ ID NO: 3633471 - DNA, 13 bp, Homo sapiens
tcctttctctcta

SEQ ID NO: 3633472 - DNA, 12 bp, Homo sapiens
tcctttctctgg

SEQ ID NO: 3633473 - DNA, 14 bp, Homo sapiens
tcctttgaagaagg

SEQ ID NO: 3633474 - DNA, 15 bp, Homo sapiens
tcctttgaagaaggc

SEQ ID NO: 3633475 - DNA, 22 bp, Homo sapiens
tcctttggagggagggctgacc

SEQ ID NO: 3633476 - DNA, 18 bp, Homo sapiens
tcctttgtactttgtgct

SEQ ID NO: 3633477 - DNA, 14 bp, Homo sapiens
tcctttgtctttct

SEQ ID NO: 3633478 - DNA, 22 bp, Homo sapiens
tcctttgtctttctttgtcatt

SEQ ID NO: 3633479 - DNA, 10 bp, Homo sapiens
tcctttgttc

SEQ ID NO: 3633480 - DNA, 16 bp, Homo sapiens
tcctttgttcttacct

SEQ ID NO: 3633481 - DNA, 24 bp, Homo sapiens
tcctttgttcttacctgtatgtct

SEQ ID NO: 3633482 - DNA, 12 bp, Homo sapiens
tccttttaactg

SEQ ID NO: 3633483 - DNA, 16 bp, Homo sapiens
tccttttcctatcctt

SEQ ID NO: 3633484 - DNA, 18 bp, Homo sapiens
tccttttgacactgctct

SEQ ID NO: 3633485 - DNA, 15 bp, Homo sapiens
tccttttgggaagaa

SEQ ID NO: 3633486 - DNA, 12 bp, Homo sapiens
tcgaactcctga

SEQ ID NO: 3633487 - DNA, 23 bp, Homo sapiens
tcgaagccttgcctaaatttaat

SEQ ID NO: 3633488 - DNA, 21 bp, Homo sapiens
tcgaatcttaatttattattt

SEQ ID NO: 3633489 - DNA, 20 bp, Homo sapiens
tcgacccagaatggagcctg

SEQ ID NO: 3633490 - DNA, 16 bp, Homo sapiens
tcgacctccccacccg

SEQ ID NO: 3633491 - DNA, 14 bp, Homo sapiens
tcgactcagcctca

SEQ ID NO: 3633492 - DNA, 12 bp, Homo sapiens
tcgactggtcca

SEQ ID NO: 3633493 - DNA, 14 bp, Homo sapiens
tcgactggtccagc

SEQ ID NO: 3633494 - DNA, 18 bp, Homo sapiens
tcgagacccaaaccccca

SEQ ID NO: 3633495 - DNA, 18 bp, Homo sapiens
tcgaggagctagaacatt

SEQ ID NO: 3633496 - DNA, 22 bp, Homo sapiens
tcgaggccacattgctggctgc

SEQ ID NO: 3633497 - DNA, 23 bp, Homo sapiens
tcgagtgagacagactagaagtt

SEQ ID NO: 3633498 - DNA, 20 bp, Homo sapiens
tcgcagggaatgcagcagga

SEQ ID NO: 3633499 - DNA, 17 bp, Homo sapiens
tcgccctcccaggctct

SEQ ID NO: 3633500 - DNA, 16 bp, Homo sapiens
tcgccggatctgaggg

SEQ ID NO: 3633501 - DNA, 12 bp, Homo sapiens
tcgcctgcctgc

SEQ ID NO: 3633502 - DNA, 15 bp, Homo sapiens
tcgcctgcctgcagc

SEQ ID NO: 3633503 - DNA, 19 bp, Homo sapiens
tcgcctgcctgcagcaggc

SEQ ID NO: 3633504 - DNA, 23 bp, Homo sapiens
tcgcgctggaatccagaaggaag

SEQ ID NO: 3633505 - DNA, 23 bp, Homo sapiens
tcgctagcatttcccaacacaaa

SEQ ID NO: 3633506 - DNA, 17 bp, Homo sapiens
tcgctggactattgtgc

SEQ ID NO: 3633507 - DNA, 14 bp, Homo sapiens
tcggagaagagctg

SEQ ID NO: 3633508 - DNA, 13 bp, Homo sapiens
tcggagagcagca

SEQ ID NO: 3633509 - DNA, 13 bp, Homo sapiens
tcggagctcctgt

SEQ ID NO: 3633510 - DNA, 16 bp, Homo sapiens
tcggagtgcctggagt

SEQ ID NO: 3633511 - DNA, 19 bp, Homo sapiens
tcggatatgattgtttctc

SEQ ID NO: 3633512 - DNA, 13 bp, Homo sapiens
tcggatctcacag

SEQ ID NO: 3633513 - DNA, 18 bp, Homo sapiens
tcggatctcacaggctga

SEQ ID NO: 3633514 - DNA, 18 bp, Homo sapiens
tcggcacacactgtgccc

SEQ ID NO: 3633515 - DNA, 22 bp, Homo sapiens
tcggccaagaatacttgaagaa

SEQ ID NO: 3633516 - DNA, 12 bp, Homo sapiens
tcggccgcccgg

SEQ ID NO: 3633517 - DNA, 14 bp, Homo sapiens
tcggctgccagggg

SEQ ID NO: 3633518 - DNA, 21 bp, Homo sapiens
tcggctgccaggggctctgtg

SEQ ID NO: 3633519 - DNA, 23 bp, Homo sapiens
tcggctgccaggggctctgtggc

SEQ ID NO: 3633520 - DNA, 16 bp, Homo sapiens
tcgggagcacccagag

SEQ ID NO: 3633521 - DNA, 17 bp, Homo sapiens
tcgggcagccagcagag

SEQ ID NO: 3633522 - DNA, 15 bp, Homo sapiens
tcgggctcacgtcgc

SEQ ID NO: 3633523 - DNA, 19 bp, Homo sapiens
tcggggagaggctgaggac

SEQ ID NO: 3633524 - DNA, 22 bp, Homo sapiens
tcgggggcccaagtggggtgct

SEQ ID NO: 3633525 - DNA, 20 bp, Homo sapiens
tcgggtgggggagggaaagg

SEQ ID NO: 3633526 - DNA, 16 bp, Homo sapiens
tcggtatctggcttcc

SEQ ID NO: 3633527 - DNA, 16 bp, Homo sapiens
tcggtcctggtgccct

SEQ ID NO: 3633528 - DNA, 19 bp, Homo sapiens
tcggtgtccccaccatctg

SEQ ID NO: 3633529 - DNA, 20 bp, Homo sapiens
tcggtgtccccaccatctgc

SEQ ID NO: 3633530 - DNA, 19 bp, Homo sapiens
tcgtacataataagtttca

SEQ ID NO: 3633531 - DNA, 21 bp, Homo sapiens
tcgtgatgacatatcacatgt

SEQ ID NO: 3633532 - DNA, 13 bp, Homo sapiens
tctcccctcctgc

SEQ ID NO: 3633533 - DNA, 16 bp, Homo sapiens
tctccccttctctgcc

SEQ ID NO: 3633534 - DNA, 18 bp, Homo sapiens
tctccccttctctgcctc

SEQ ID NO: 3633535 - DNA, 18 bp, Homo sapiens
tctccctgggtctgggga

SEQ ID NO: 3633536 - DNA, 13 bp, Homo sapiens
tctccctttctct

SEQ ID NO: 3633537 - DNA, 17 bp, Homo sapiens
tctccctttctctctcc

SEQ ID NO: 3633538 - DNA, 19 bp, Homo sapiens
tctccctttctctctcctc

SEQ ID NO: 3633539 - DNA, 22 bp, Homo sapiens
tctccctttctctctcctctct

SEQ ID NO: 3633540 - DNA, 16 bp, Homo sapiens
tctccgggactgccct

SEQ ID NO: 3633541 - DNA, 16 bp, Homo sapiens
tctcctacgcaccatt

SEQ ID NO: 3633542 - DNA, 22 bp, Homo sapiens
tctcctacgcaccattttgtca

SEQ ID NO: 3633543 - DNA, 20 bp, Homo sapiens
tctcctcactctgtccctgt

SEQ ID NO: 3633544 - DNA, 20 bp, Homo sapiens
tctcctcagcctcctcatct

SEQ ID NO: 3633545 - DNA, 22 bp, Homo sapiens
tctcctcagcctcctcatctgg

SEQ ID NO: 3633546 - DNA, 10 bp, Homo sapiens
tctcctcagg

SEQ ID NO: 3633547 - DNA, 14 bp, Homo sapiens
tctcctcaggacca

SEQ ID NO: 3633548 - DNA, 16 bp, Homo sapiens
tctcctcatgttctgc

SEQ ID NO: 3633549 - DNA, 18 bp, Homo sapiens
tctcctcccgccccgccc

SEQ ID NO: 3633550 - DNA, 23 bp, Homo sapiens
tctcctcccgcccttccatgtgc

SEQ ID NO: 3633551 - DNA, 11 bp, Homo sapiens
tctcctctctg

SEQ ID NO: 3633552 - DNA, 14 bp, Homo sapiens
tctcctctctgctt

SEQ ID NO: 3633553 - DNA, 22 bp, Homo sapiens
tctcctcttgccactgcctctt

SEQ ID NO: 3633554 - DNA, 15 bp, Homo sapiens
tctcctgacccctgc

SEQ ID NO: 3633555 - DNA, 13 bp, Homo sapiens
tctcctgccctgt

SEQ ID NO: 3633556 - DNA, 13 bp, Homo sapiens
tctcctgcctcag

SEQ ID NO: 3633557 - DNA, 16 bp, Homo sapiens
tctccttcctgtgtgt

SEQ ID NO: 3633558 - DNA, 17 bp, Homo sapiens
tctccttctccttccca

SEQ ID NO: 3633559 - DNA, 14 bp, Homo sapiens
tctccttggccaca

SEQ ID NO: 3633560 - DNA, 14 bp, Homo sapiens
tctccttgtggcct

SEQ ID NO: 3633561 - DNA, 15 bp, Homo sapiens
tctccttgtggccta

SEQ ID NO: 3633562 - DNA, 19 bp, Homo sapiens
tctcctttgtactttgtgc

SEQ ID NO: 3633563 - DNA, 13 bp, Homo sapiens
tctccttttccta

SEQ ID NO: 3633564 - DNA, 14 bp, Homo sapiens
tctcgccccatccc

SEQ ID NO: 3633565 - DNA, 14 bp, Homo sapiens
tctctaacagtgga

SEQ ID NO: 3633566 - DNA, 20 bp, Homo sapiens
tctctaacagtggacaaagt

SEQ ID NO: 3633567 - DNA, 18 bp, Homo sapiens
tctctaatctgtgctgtt

SEQ ID NO: 3633568 - DNA, 20 bp, Homo sapiens
tctctaatctgtgctgtttc

SEQ ID NO: 3633569 - DNA, 23 bp, Homo sapiens
tctctaatttaacttattgctag

SEQ ID NO: 3633570 - DNA, 20 bp, Homo sapiens
tctctatcagaaatacaaaa

SEQ ID NO: 3633571 - DNA, 14 bp, Homo sapiens
tctctatgtatcaa

SEQ ID NO: 3633572 - DNA, 12 bp, Homo sapiens
tctctcagtgaa

SEQ ID NO: 3633573 - DNA, 21 bp, Homo sapiens
tctctcatcggaggcccatgc

SEQ ID NO: 3633574 - DNA, 13 bp, Homo sapiens
tctctccaggagg

SEQ ID NO: 3633575 - DNA, 20 bp, Homo sapiens
tctctccaggagggctcggg

SEQ ID NO: 3633576 - DNA, 12 bp, Homo sapiens
tctctccagggt

SEQ ID NO: 3633577 - DNA, 17 bp, Homo sapiens
tctctccagtgaaatga

SEQ ID NO: 3633578 - DNA, 18 bp, Homo sapiens
tctctccccatatataaa

SEQ ID NO: 3633579 - DNA, 19 bp, Homo sapiens
tctctccccatatataaat

SEQ ID NO: 3633580 - DNA, 11 bp, Homo sapiens
tctctcctctc

SEQ ID NO: 3633581 - DNA, 16 bp, Homo sapiens
tctctcctctctgctt

SEQ ID NO: 3633582 - DNA, 19 bp, Homo sapiens
tctctcgggagccctagcc

SEQ ID NO: 3633583 - DNA, 23 bp, Homo sapiens
tctctcgggagccctagccctgc

SEQ ID NO: 3633584 - DNA, 13 bp, Homo sapiens
tctctctcctctc

SEQ ID NO: 3633585 - DNA, 16 bp, Homo sapiens
tctctctgcccaaccc

SEQ ID NO: 3633586 - DNA, 12 bp, Homo sapiens
tctctcttctct

SEQ ID NO: 3633587 - DNA, 16 bp, Homo sapiens
tctctcttgtcctctt

SEQ ID NO: 3633588 - DNA, 18 bp, Homo sapiens
tctctcttgtcctcttct

SEQ ID NO: 3633589 - DNA, 16 bp, Homo sapiens
tctctgaatgagcctt

SEQ ID NO: 3633590 - DNA, 14 bp, Homo sapiens
tctctgactgcttt

SEQ ID NO: 3633591 - DNA, 17 bp, Homo sapiens
tctctgagtcaaatcca

SEQ ID NO: 3633592 - DNA, 22 bp, Homo sapiens
tctctgagtcaaatccagtggt

SEQ ID NO: 3633593 - DNA, 23 bp, Homo sapiens
tctctgagtcaaatccagtggtg

SEQ ID NO: 3633594 - DNA, 24 bp, Homo sapiens
tctctgagtcaaatccagtggtgg

SEQ ID NO: 3633595 - DNA, 18 bp, Homo sapiens
tctctgattagttgacag

SEQ ID NO: 3633596 - DNA, 19 bp, Homo sapiens
tctctgattagttgacagt

SEQ ID NO: 3633597 - DNA, 23 bp, Homo sapiens
tctctgattagttgacagtatta

SEQ ID NO: 3633598 - DNA, 19 bp, Homo sapiens
tctctgattttcaaagctt

SEQ ID NO: 3633599 - DNA, 13 bp, Homo sapiens
tctctgccctggg

SEQ ID NO: 3633600 - DNA, 14 bp, Homo sapiens
tctctgggagccca

SEQ ID NO: 3633601 - DNA, 16 bp, Homo sapiens
tctctgggagcccaga

SEQ ID NO: 3633602 - DNA, 17 bp, Homo sapiens
tctctgggagcccagaa

SEQ ID NO: 3633603 - DNA, 21 bp, Homo sapiens
tctctgggggctgaggagcag

SEQ ID NO: 3633604 - DNA, 11 bp, Homo sapiens
tctctgtgctt

SEQ ID NO: 3633605 - DNA, 16 bp, Homo sapiens
tctctgttggtctgcc

SEQ ID NO: 3633606 - DNA, 23 bp, Homo sapiens
tctctgttggtctgccttctgct

SEQ ID NO: 3633607 - DNA, 14 bp, Homo sapiens
tctcttatgcatta

SEQ ID NO: 3633608 - DNA, 21 bp, Homo sapiens
tctcttctaacatgaaatata

SEQ ID NO: 3633609 - DNA, 20 bp, Homo sapiens
tctcttctgaataaagcaat

SEQ ID NO: 3633610 - DNA, 13 bp, Homo sapiens
tctcttgtcctct

SEQ ID NO: 3633611 - DNA, 20 bp, Homo sapiens
tctcttgtcctcttctgctc

SEQ ID NO: 3633612 - DNA, 18 bp, Homo sapiens
tctctttccaccatacct

SEQ ID NO: 3633613 - DNA, 17 bp, Homo sapiens
tctctttgttctaaaga

SEQ ID NO: 3633614 - DNA, 15 bp, Homo sapiens
tctgaaaaagacata

SEQ ID NO: 3633615 - DNA, 23 bp, Homo sapiens
tctgaaaaagacataaaacagaa

SEQ ID NO: 3633616 - DNA, 16 bp, Homo sapiens
tctgaaaggccagcag

SEQ ID NO: 3633617 - DNA, 15 bp, Homo sapiens
tctgaaccctccaaa

SEQ ID NO: 3633618 - DNA, 17 bp, Homo sapiens
tctgaacttttgtggag

SEQ ID NO: 3633619 - DNA, 19 bp, Homo sapiens
tctgaagatcagaacattc

SEQ ID NO: 3633620 - DNA, 19 bp, Homo sapiens
tctgaagctgctgcagctc

SEQ ID NO: 3633621 - DNA, 15 bp, Homo sapiens
tctgaagtctgagcc

SEQ ID NO: 3633622 - DNA, 17 bp, Homo sapiens
tctgaagtctgagccca

SEQ ID NO: 3633623 - DNA, 22 bp, Homo sapiens
tctgaagtctgagcccatttct

SEQ ID NO: 3633624 - DNA, 17 bp, Homo sapiens
tctgaataaagcaatta

SEQ ID NO: 3633625 - DNA, 21 bp, Homo sapiens
tctgaatgagcctttgtgctt

SEQ ID NO: 3633626 - DNA, 18 bp, Homo sapiens
tctgacagtccacagggg

SEQ ID NO: 3633627 - DNA, 12 bp, Homo sapiens
tctgacatccct

SEQ ID NO: 3633628 - DNA, 19 bp, Homo sapiens
tctgacatcccttcctgga

SEQ ID NO: 3633629 - DNA, 13 bp, Homo sapiens
tctgaccagcagc

SEQ ID NO: 3633630 - DNA, 18 bp, Homo sapiens
tctgaccagcagcgcctt

SEQ ID NO: 3633631 - DNA, 21 bp, Homo sapiens
tctgaccccaagggggctgct

SEQ ID NO: 3633632 - DNA, 24 bp, Homo sapiens
tctgaccccaagggggctgctgct

SEQ ID NO: 3633633 - DNA, 23 bp, Homo sapiens
tctgactagattattatttgggg

SEQ ID NO: 3633634 - DNA, 12 bp, Homo sapiens
tctgactataac

SEQ ID NO: 3633635 - DNA, 16 bp, Homo sapiens
tctgactccaaagctg

SEQ ID NO: 3633636 - DNA, 16 bp, Homo sapiens
tctgactgccaagcca

SEQ ID NO: 3633637 - DNA, 17 bp, Homo sapiens
tctgactgccaagccag

SEQ ID NO: 3633638 - DNA, 18 bp, Homo sapiens
tctgactgccaagccaga

SEQ ID NO: 3633639 - DNA, 14 bp, Homo sapiens
tctgagaaagacta

SEQ ID NO: 3633640 - DNA, 22 bp, Homo sapiens
tctgagaaagactattcaaaca

SEQ ID NO: 3633641 - DNA, 14 bp, Homo sapiens
tctgagaggctctc

SEQ ID NO: 3633642 - DNA, 15 bp, Homo sapiens
tctgagaggctctcc

SEQ ID NO: 3633643 - DNA, 16 bp, Homo sapiens
tctgagaggctctccg

SEQ ID NO: 3633644 - DNA, 19 bp, Homo sapiens
tctgagaggctctccgtgc

SEQ ID NO: 3633645 - DNA, 21 bp, Homo sapiens
tctgagaggctctccgtgcag

SEQ ID NO: 3633646 - DNA, 11 bp, Homo sapiens
tctgagtcaaa

SEQ ID NO: 3633647 - DNA, 14 bp, Homo sapiens
tctgagtcaaatcc

SEQ ID NO: 3633648 - DNA, 15 bp, Homo sapiens
tctgagtcaaatcca

SEQ ID NO: 3633649 - DNA, 13 bp, Homo sapiens
tctgataaactga

SEQ ID NO: 3633650 - DNA, 16 bp, Homo sapiens
tctgatgtactctaaa

SEQ ID NO: 3633651 - DNA, 14 bp, Homo sapiens
tctgattctgattg

SEQ ID NO: 3633652 - DNA, 14 bp, Homo sapiens
tctgattggctgct

SEQ ID NO: 3633653 - DNA, 13 bp, Homo sapiens
tctgattttctca

SEQ ID NO: 3633654 - DNA, 17 bp, Homo sapiens
tctgcaaggtctttggt

SEQ ID NO: 3633655 - DNA, 20 bp, Homo sapiens
tctgcaccaccatgcccagc

SEQ ID NO: 3633656 - DNA, 15 bp, Homo sapiens
tctgcacccgcctcg

SEQ ID NO: 3633657 - DNA, 18 bp, Homo sapiens
tctgcacccgcctcgacc

SEQ ID NO: 3633658 - DNA, 19 bp, Homo sapiens
tctgcacgctcaatgccca

SEQ ID NO: 3633659 - DNA, 21 bp, Homo sapiens
tctgcacgctcaatgcccagt

SEQ ID NO: 3633660 - DNA, 21 bp, Homo sapiens
tctgcactcccacctgacaca

SEQ ID NO: 3633661 - DNA, 19 bp, Homo sapiens
tctgcagggggtgtgtctg

SEQ ID NO: 3633662 - DNA, 14 bp, Homo sapiens
tctgcagtctcatt

SEQ ID NO: 3633663 - DNA, 14 bp, Homo sapiens
tctgcatcagctgc

SEQ ID NO: 3633664 - DNA, 15 bp, Homo sapiens
tctgcatttaaaaaa

SEQ ID NO: 3633665 - DNA, 20 bp, Homo sapiens
tcttaatgtctggtgtttgt

SEQ ID NO: 3633666 - DNA, 14 bp, Homo sapiens
tcttaattaaaaga

SEQ ID NO: 3633667 - DNA, 18 bp, Homo sapiens
tcttaattaaaagaatat

SEQ ID NO: 3633668 - DNA, 21 bp, Homo sapiens
tcttaattaaaagaatatttt

SEQ ID NO: 3633669 - DNA, 14 bp, Homo sapiens
tcttaccagtctcc

SEQ ID NO: 3633670 - DNA, 16 bp, Homo sapiens
tcttaccagtctcctc

SEQ ID NO: 3633671 - DNA, 23 bp, Homo sapiens
tcttacctgtatgtctccagtat

SEQ ID NO: 3633672 - DNA, 16 bp, Homo sapiens
tcttactaaaaagtat

SEQ ID NO: 3633673 - DNA, 16 bp, Homo sapiens
tcttagagtgtagctg

SEQ ID NO: 3633674 - DNA, 18 bp, Homo sapiens
tcttagagtgtagctgta

SEQ ID NO: 3633675 - DNA, 17 bp, Homo sapiens
tcttagcaataaatgct

SEQ ID NO: 3633676 - DNA, 19 bp, Homo sapiens
tcttagctctttctctatt

SEQ ID NO: 3633677 - DNA, 23 bp, Homo sapiens
tcttagctgtctgctcagacaga

SEQ ID NO: 3633678 - DNA, 17 bp, Homo sapiens
tcttagggattaaatat

SEQ ID NO: 3633679 - DNA, 21 bp, Homo sapiens
tcttataaagtggaagtatgt

SEQ ID NO: 3633680 - DNA, 15 bp, Homo sapiens
tcttatacatttgat

SEQ ID NO: 3633681 - DNA, 14 bp, Homo sapiens
tcttatttaccctt

SEQ ID NO: 3633682 - DNA, 15 bp, Homo sapiens
tcttatttacccttt

SEQ ID NO: 3633683 - DNA, 15 bp, Homo sapiens
tcttatttcatttct

SEQ ID NO: 3633684 - DNA, 15 bp, Homo sapiens
tcttattttgtaata

SEQ ID NO: 3633685 - DNA, 21 bp, Homo sapiens
tcttattttgtaataaactct

SEQ ID NO: 3633686 - DNA, 12 bp, Homo sapiens
tcttcaaatgtt

SEQ ID NO: 3633687 - DNA, 15 bp, Homo sapiens
tcttcacaacagatt

SEQ ID NO: 3633688 - DNA, 15 bp, Homo sapiens
tcttcacaggcactc

SEQ ID NO: 3633689 - DNA, 16 bp, Homo sapiens
tcttcaccctcccctt

SEQ ID NO: 3633690 - DNA, 13 bp, Homo sapiens
tcttcactctggc

SEQ ID NO: 3633691 - DNA, 15 bp, Homo sapiens
tcttcactctggctt

SEQ ID NO: 3633692 - DNA, 16 bp, Homo sapiens
tcttcactctggcttc

SEQ ID NO: 3633693 - DNA, 11 bp, Homo sapiens
tcttcactttc

SEQ ID NO: 3633694 - DNA, 18 bp, Homo sapiens
tcttcagcgtaaaatggt

SEQ ID NO: 3633695 - DNA, 15 bp, Homo sapiens
tcttcagtcctttgt

SEQ ID NO: 3633696 - DNA, 17 bp, Homo sapiens
tcttcagtgactcctgc

SEQ ID NO: 3633697 - DNA, 18 bp, Homo sapiens
tcttcagtgactcctgct

SEQ ID NO: 3633698 - DNA, 17 bp, Homo sapiens
tcttcatgtccagtgag

SEQ ID NO: 3633699 - DNA, 22 bp, Homo sapiens
tcttcattacctcagtgagaag

SEQ ID NO: 3633700 - DNA, 15 bp, Homo sapiens
tcttccacccacaaa

SEQ ID NO: 3633701 - DNA, 14 bp, Homo sapiens
tcttccagggcagc

SEQ ID NO: 3633702 - DNA, 13 bp, Homo sapiens
tcttcccacagga

SEQ ID NO: 3633703 - DNA, 14 bp, Homo sapiens
tcttcccacaggag

SEQ ID NO: 3633704 - DNA, 22 bp, Homo sapiens
tcttccctgctttgcatctttg

SEQ ID NO: 3633705 - DNA, 18 bp, Homo sapiens
tcttcccttattcctaat

SEQ ID NO: 3633706 - DNA, 15 bp, Homo sapiens
tcttccgggcagaaa

SEQ ID NO: 3633707 - DNA, 13 bp, Homo sapiens
tcttcctccactt

SEQ ID NO: 3633708 - DNA, 13 bp, Homo sapiens
tcttcctggcaca

SEQ ID NO: 3633709 - DNA, 14 bp, Homo sapiens
tcttcctggcacaa

SEQ ID NO: 3633710 - DNA, 15 bp, Homo sapiens
tcttcctgtctcctt

SEQ ID NO: 3633711 - DNA, 15 bp, Homo sapiens
tcttccttttcactg

SEQ ID NO: 3633712 - DNA, 14 bp, Homo sapiens
tcttcgctggacta

SEQ ID NO: 3633713 - DNA, 20 bp, Homo sapiens
tcttcgctggactattgtgc

SEQ ID NO: 3633714 - DNA, 14 bp, Homo sapiens
tcttctaacatctt

SEQ ID NO: 3633715 - DNA, 17 bp, Homo sapiens
tcttctaacatgaaata

SEQ ID NO: 3633716 - DNA, 12 bp, Homo sapiens
tcttctccactg

SEQ ID NO: 3633717 - DNA, 13 bp, Homo sapiens
tcttctcctttca

SEQ ID NO: 3633718 - DNA, 20 bp, Homo sapiens
tcttctgaagatcagaacat

SEQ ID NO: 3633719 - DNA, 18 bp, Homo sapiens
tcttctgaataaagcaat

SEQ ID NO: 3633720 - DNA, 21 bp, Homo sapiens
tcttctgcaacatttgacaaa

SEQ ID NO: 3633721 - DNA, 20 bp, Homo sapiens
tcttctgcaagcctcatgcc

SEQ ID NO: 3633722 - DNA, 15 bp, Homo sapiens
tcttctgctcttttc

SEQ ID NO: 3633723 - DNA, 20 bp, Homo sapiens
tcttctggagatggaagctt

SEQ ID NO: 3633724 - DNA, 22 bp, Homo sapiens
tcttctggagatggaagcttgt

SEQ ID NO: 3633725 - DNA, 18 bp, Homo sapiens
tcttctttcctttactcc

SEQ ID NO: 3633726 - DNA, 19 bp, Homo sapiens
tcttctttcctttactcct

SEQ ID NO: 3633727 - DNA, 14 bp, Homo sapiens
tcttctttctccat

SEQ ID NO: 3633728 - DNA, 16 bp, Homo sapiens
tcttctttctccatgg

SEQ ID NO: 3633729 - DNA, 17 bp, Homo sapiens
tcttctttctccatgga

SEQ ID NO: 3633730 - DNA, 14 bp, Homo sapiens
tcttctttcttcca

SEQ ID NO: 3633731 - DNA, 13 bp, Homo sapiens
tcttctttctttc

SEQ ID NO: 3633732 - DNA, 14 bp, Homo sapiens
tcttctttgtgcct

SEQ ID NO: 3633733 - DNA, 15 bp, Homo sapiens
tcttcttttcctgca

SEQ ID NO: 3633734 - DNA, 12 bp, Homo sapiens
tcttgaaaagtt

SEQ ID NO: 3633735 - DNA, 17 bp, Homo sapiens
tcttgaaaagttcaggg

SEQ ID NO: 3633736 - DNA, 20 bp, Homo sapiens
tcttgaacgagcagcccagg

SEQ ID NO: 3633737 - DNA, 22 bp, Homo sapiens
tcttgaacgagcagcccagggc

SEQ ID NO: 3633738 - DNA, 13 bp, Homo sapiens
tcttgaaggtgct

SEQ ID NO: 3633739 - DNA, 21 bp, Homo sapiens
tcttgaataaagtattctagt

SEQ ID NO: 3633740 - DNA, 23 bp, Homo sapiens
tcttgaataaagtattctagtgt

SEQ ID NO: 3633741 - DNA, 19 bp, Homo sapiens
tcttgaccaacagaaacct

SEQ ID NO: 3633742 - DNA, 20 bp, Homo sapiens
tcttgagagaaacgtgaaac

SEQ ID NO: 3633743 - DNA, 19 bp, Homo sapiens
tcttgagtataagaaatgc

SEQ ID NO: 3633744 - DNA, 19 bp, Homo sapiens
tcttgatctctcttgtcct

SEQ ID NO: 3633745 - DNA, 14 bp, Homo sapiens
tcttgcagcattta

SEQ ID NO: 3633746 - DNA, 22 bp, Homo sapiens
tcttgcataggctcttaagcag

SEQ ID NO: 3633747 - DNA, 13 bp, Homo sapiens
tcttgctctgcat

SEQ ID NO: 3633748 - DNA, 14 bp, Homo sapiens
tcttgctgcttcta

SEQ ID NO: 3633749 - DNA, 16 bp, Homo sapiens
tcttgcttctttctag

SEQ ID NO: 3633750 - DNA, 13 bp, Homo sapiens
tcttgctttctat

SEQ ID NO: 3633751 - DNA, 17 bp, Homo sapiens
tcttggcaatattcctt

SEQ ID NO: 3633752 - DNA, 18 bp, Homo sapiens
tcttggccgactcaggga

SEQ ID NO: 3633753 - DNA, 17 bp, Homo sapiens
tcttggctgacccctct

SEQ ID NO: 3633754 - DNA, 22 bp, Homo sapiens
tcttgggaccccagagaaaacc

SEQ ID NO: 3633755 - DNA, 16 bp, Homo sapiens
tcttgggtctatgcct

SEQ ID NO: 3633756 - DNA, 14 bp, Homo sapiens
tcttggtaaaacat

SEQ ID NO: 3633757 - DNA, 14 bp, Homo sapiens
tcttgtcatacaaa

SEQ ID NO: 3633758 - DNA, 16 bp, Homo sapiens
tcttgtcatacaaatt

SEQ ID NO: 3633759 - DNA, 12 bp, Homo sapiens
tcttgtctgtta

SEQ ID NO: 3633760 - DNA, 18 bp, Homo sapiens
tcttgtgctatgaaacaa

SEQ ID NO: 3633761 - DNA, 21 bp, Homo sapiens
tcttgtgctatgaaacaatct

SEQ ID NO: 3633762 - DNA, 12 bp, Homo sapiens
tcttgttcctga

SEQ ID NO: 3633763 - DNA, 18 bp, Homo sapiens
tcttgttttttttttcca

SEQ ID NO: 3633764 - DNA, 20 bp, Homo sapiens
tctttaatttatatcaggtg

SEQ ID NO: 3633765 - DNA, 21 bp, Homo sapiens
tctttactgcactcagattta

SEQ ID NO: 3633766 - DNA, 11 bp, Homo sapiens
tctttagcagt

SEQ ID NO: 3633767 - DNA, 18 bp, Homo sapiens
tctttagcttacctgggc

SEQ ID NO: 3633768 - DNA, 20 bp, Homo sapiens
tctttatttttttcccatga

SEQ ID NO: 3633769 - DNA, 17 bp, Homo sapiens
tctttcatgtcttgtca

SEQ ID NO: 3633770 - DNA, 15 bp, Homo sapiens
tctttccaaaacatt

SEQ ID NO: 3633771 - DNA, 22 bp, Homo sapiens
tctttccaccataccttagaga

SEQ ID NO: 3633772 - DNA, 20 bp, Homo sapiens
tctttccatcaactcccaac

SEQ ID NO: 3633773 - DNA, 12 bp, Homo sapiens
tctttccctgcg

SEQ ID NO: 3633774 - DNA, 18 bp, Homo sapiens
tctttcctttactcctgg

SEQ ID NO: 3633775 - DNA, 19 bp, Homo sapiens
tctttcctttactcctggc

SEQ ID NO: 3633776 - DNA, 11 bp, Homo sapiens
tctttctaata

SEQ ID NO: 3633777 - DNA, 18 bp, Homo sapiens
tctttctaatgtgtgaat

SEQ ID NO: 3633778 - DNA, 19 bp, Homo sapiens
tctttctagttcagctgcc

SEQ ID NO: 3633779 - DNA, 22 bp, Homo sapiens
tctttctagttcagctgcccca

SEQ ID NO: 3633780 - DNA, 11 bp, Homo sapiens
tctttctctca

SEQ ID NO: 3633781 - DNA, 12 bp, Homo sapiens
tctttctctcag

SEQ ID NO: 3633782 - DNA, 15 bp, Homo sapiens
tctttctctcagtga

SEQ ID NO: 3633783 - DNA, 21 bp, Homo sapiens
tctttctgcagaaacagaaag

SEQ ID NO: 3633784 - DNA, 17 bp, Homo sapiens
tctttcttattttgtaa

SEQ ID NO: 3633785 - DNA, 20 bp, Homo sapiens
tctttcttattttgtaataa

SEQ ID NO: 3633786 - DNA, 22 bp, Homo sapiens
tctttcttattttgtaataaac

SEQ ID NO: 3633787 - DNA, 16 bp, Homo sapiens
tctttcttcctctgct

SEQ ID NO: 3633788 - DNA, 14 bp, Homo sapiens
tctttcttgctccc

SEQ ID NO: 3633789 - DNA, 18 bp, Homo sapiens
tctttcttgctccctgac

SEQ ID NO: 3633790 - DNA, 12 bp, Homo sapiens
tctttctttctt

SEQ ID NO: 3633791 - DNA, 13 bp, Homo sapiens
tctttgaataaat

SEQ ID NO: 3633792 - DNA, 17 bp, Homo sapiens
tctttgaataaatgtca

SEQ ID NO: 3633793 - DNA, 20 bp, Homo sapiens
tctttgaataaatgtcactt

SEQ ID NO: 3633794 - DNA, 18 bp, Homo sapiens
tctttgacatttttgcca

SEQ ID NO: 3633795 - DNA, 19 bp, Homo sapiens
tctttgactgtcagcaaga

SEQ ID NO: 3633796 - DNA, 16 bp, Homo sapiens
tctttgcaccaaagac

SEQ ID NO: 3633797 - DNA, 18 bp, Homo sapiens
tctttgcaccaaagacat

SEQ ID NO: 3633798 - DNA, 19 bp, Homo sapiens
tctttgcaccaaagacatc

SEQ ID NO: 3633799 - DNA, 14 bp, Homo sapiens
tgaagtttaaattc

SEQ ID NO: 3633800 - DNA, 15 bp, Homo sapiens
tgaagtttgaatgct

SEQ ID NO: 3633801 - DNA, 20 bp, Homo sapiens
tgaagtttgtagttgtttta

SEQ ID NO: 3633802 - DNA, 14 bp, Homo sapiens
tgaagtttttgaaa

SEQ ID NO: 3633803 - DNA, 15 bp, Homo sapiens
tgaagtttttgaaat

SEQ ID NO: 3633804 - DNA, 20 bp, Homo sapiens
tgaagtttttgaaatacctt

SEQ ID NO: 3633805 - DNA, 14 bp, Homo sapiens
tgaataaagcaatt

SEQ ID NO: 3633806 - DNA, 12 bp, Homo sapiens
tgaataaatgtc

SEQ ID NO: 3633807 - DNA, 20 bp, Homo sapiens
tgaataaatgtcactttttg

SEQ ID NO: 3633808 - DNA, 15 bp, Homo sapiens
tgaataacttgaaga

SEQ ID NO: 3633809 - DNA, 20 bp, Homo sapiens
tgaatacattaacggtgcta

SEQ ID NO: 3633810 - DNA, 16 bp, Homo sapiens
tgaatacatttgtatt

SEQ ID NO: 3633811 - DNA, 22 bp, Homo sapiens
tgaatatatttaagcaacatct

SEQ ID NO: 3633812 - DNA, 23 bp, Homo sapiens
tgaatatatttaagcaacatctt

SEQ ID NO: 3633813 - DNA, 14 bp, Homo sapiens
tgaatatctttcga

SEQ ID NO: 3633814 - DNA, 18 bp, Homo sapiens
tgaatattttaattaaaa

SEQ ID NO: 3633815 - DNA, 15 bp, Homo sapiens
tgaatatttttgtat

SEQ ID NO: 3633816 - DNA, 21 bp, Homo sapiens
tgaatatttttgtattttaca

SEQ ID NO: 3633817 - DNA, 21 bp, Homo sapiens
tgaatattttttatttctaag

SEQ ID NO: 3633818 - DNA, 13 bp, Homo sapiens
tgaatcaaaacaa

SEQ ID NO: 3633819 - DNA, 22 bp, Homo sapiens
tgaatcagaacagatgctgagc

SEQ ID NO: 3633820 - DNA, 15 bp, Homo sapiens
tgaatccgtacttgg

SEQ ID NO: 3633821 - DNA, 12 bp, Homo sapiens
tgaatctcaaag

SEQ ID NO: 3633822 - DNA, 19 bp, Homo sapiens
tgaatctgtctatctgtga

SEQ ID NO: 3633823 - DNA, 21 bp, Homo sapiens
tgaatctgtgcaaacagtaac

SEQ ID NO: 3633824 - DNA, 21 bp, Homo sapiens
tgaatgaaaataactgaacca

SEQ ID NO: 3633825 - DNA, 15 bp, Homo sapiens
tgaatgaaccttctg

SEQ ID NO: 3633826 - DNA, 13 bp, Homo sapiens
tgaatgcagaaaa

SEQ ID NO: 3633827 - DNA, 19 bp, Homo sapiens
tgaatgcctcgctcccttc

SEQ ID NO: 3633828 - DNA, 20 bp, Homo sapiens
tgaatgctgttaatatttct

SEQ ID NO: 3633829 - DNA, 18 bp, Homo sapiens
tgaatggatcaatacaca

SEQ ID NO: 3633830 - DNA, 14 bp, Homo sapiens
tgaatggtttttct

SEQ ID NO: 3633831 - DNA, 23 bp, Homo sapiens
tgaatggtttttcttttctttat

SEQ ID NO: 3633832 - DNA, 16 bp, Homo sapiens
tgaattaatatcccta

SEQ ID NO: 3633833 - DNA, 21 bp, Homo sapiens
tgaattaggctgtaactactt

SEQ ID NO: 3633834 - DNA, 15 bp, Homo sapiens
tgaattagtatttca

SEQ ID NO: 3633835 - DNA, 14 bp, Homo sapiens
tgaattcacctgtg

SEQ ID NO: 3633836 - DNA, 20 bp, Homo sapiens
tgaattggaaagacttctca

SEQ ID NO: 3633837 - DNA, 19 bp, Homo sapiens
tgaattgtttttattgttt

SEQ ID NO: 3633838 - DNA, 11 bp, Homo sapiens
tgaatttctgc

SEQ ID NO: 3633839 - DNA, 17 bp, Homo sapiens
tgacaaaactaaccttg

SEQ ID NO: 3633840 - DNA, 20 bp, Homo sapiens
tgacaacctccattctattt

SEQ ID NO: 3633841 - DNA, 22 bp, Homo sapiens
tgacaagattataatattttaa

SEQ ID NO: 3633842 - DNA, 16 bp, Homo sapiens
tgacaaggcctgcttg

SEQ ID NO: 3633843 - DNA, 17 bp, Homo sapiens
tgacaaggcctgcttga

SEQ ID NO: 3633844 - DNA, 20 bp, Homo sapiens
tgacaattttacctattctg

SEQ ID NO: 3633845 - DNA, 21 bp, Homo sapiens
tgacaattttacctattctga

SEQ ID NO: 3633846 - DNA, 16 bp, Homo sapiens
tgacacaccaggcgct

SEQ ID NO: 3633847 - DNA, 23 bp, Homo sapiens
tgacacagtcttggctcactgca

SEQ ID NO: 3633848 - DNA, 20 bp, Homo sapiens
tgacacccatgccagagagg

SEQ ID NO: 3633849 - DNA, 14 bp, Homo sapiens
tgacaccccctccc

SEQ ID NO: 3633850 - DNA, 16 bp, Homo sapiens
tgacaccccctccccg

SEQ ID NO: 3633851 - DNA, 15 bp, Homo sapiens
tgacacctccccctt

SEQ ID NO: 3633852 - DNA, 23 bp, Homo sapiens
tgacacctttcataatctttgct

SEQ ID NO: 3633853 - DNA, 19 bp, Homo sapiens
tgacactgctctaacagcc

SEQ ID NO: 3633854 - DNA, 21 bp, Homo sapiens
tgacactgctctaacagccct

SEQ ID NO: 3633855 - DNA, 15 bp, Homo sapiens
tgacagactcactgg

SEQ ID NO: 3633856 - DNA, 13 bp, Homo sapiens
tgacagatatatt

SEQ ID NO: 3633857 - DNA, 14 bp, Homo sapiens
tgacagatgctttt

SEQ ID NO: 3633858 - DNA, 15 bp, Homo sapiens
tgacagatgcttttg

SEQ ID NO: 3633859 - DNA, 15 bp, Homo sapiens
tgacagcaattcatg

SEQ ID NO: 3633860 - DNA, 17 bp, Homo sapiens
tgacagcaattcatggt

SEQ ID NO: 3633861 - DNA, 12 bp, Homo sapiens
tgacagccacac

SEQ ID NO: 3633862 - DNA, 12 bp, Homo sapiens
tgacagctgctc

SEQ ID NO: 3633863 - DNA, 22 bp, Homo sapiens
tgacagctgctcctagagggag

SEQ ID NO: 3633864 - DNA, 13 bp, Homo sapiens
tgacagctttgct

SEQ ID NO: 3633865 - DNA, 19 bp, Homo sapiens
tgacagggccagtgcagtt

SEQ ID NO: 3633866 - DNA, 15 bp, Homo sapiens
tgacaggtaaactat

SEQ ID NO: 3633867 - DNA, 12 bp, Homo sapiens
tgacagtattaa

SEQ ID NO: 3633868 - DNA, 21 bp, Homo sapiens
tgacagtcagctgtggggaac

SEQ ID NO: 3633869 - DNA, 15 bp, Homo sapiens
tgacagtccacaggg

SEQ ID NO: 3633870 - DNA, 16 bp, Homo sapiens
tgacagtgttgaaaat

SEQ ID NO: 3633871 - DNA, 15 bp, Homo sapiens
tgacataaaaagaag

SEQ ID NO: 3633872 - DNA, 16 bp, Homo sapiens
tgacatcacttgtaca

SEQ ID NO: 3633873 - DNA, 18 bp, Homo sapiens
tgacatcacttgtacaaa

SEQ ID NO: 3633874 - DNA, 22 bp, Homo sapiens
tgacatcacttgtacaaaataa

SEQ ID NO: 3633875 - DNA, 17 bp, Homo sapiens
tgacatcccttcctgga

SEQ ID NO: 3633876 - DNA, 21 bp, Homo sapiens
tgacatcccttcctggaaaca

SEQ ID NO: 3633877 - DNA, 15 bp, Homo sapiens
tgacatgctcacaca

SEQ ID NO: 3633878 - DNA, 13 bp, Homo sapiens
tgacattccctgc

SEQ ID NO: 3633879 - DNA, 14 bp, Homo sapiens
tgacattgcacctg

SEQ ID NO: 3633880 - DNA, 18 bp, Homo sapiens
tgacattgtagagcttct

SEQ ID NO: 3633881 - DNA, 16 bp, Homo sapiens
tgacatttatatattg

SEQ ID NO: 3633882 - DNA, 24 bp, Homo sapiens
tgacatttgggagacatgtgacat

SEQ ID NO: 3633883 - DNA, 14 bp, Homo sapiens
tgaccagaaagctt

SEQ ID NO: 3633884 - DNA, 15 bp, Homo sapiens
tgaccagaacttttt

SEQ ID NO: 3633885 - DNA, 18 bp, Homo sapiens
tgaccagaactttttcct

SEQ ID NO: 3633886 - DNA, 14 bp, Homo sapiens
tgaccagcagcgcc

SEQ ID NO: 3633887 - DNA, 15 bp, Homo sapiens
tgaccagcagcgcct

SEQ ID NO: 3633888 - DNA, 17 bp, Homo sapiens
tgaccagggatgctggg

SEQ ID NO: 3633889 - DNA, 17 bp, Homo sapiens
tgaccagtgcctgtgag

SEQ ID NO: 3633890 - DNA, 19 bp, Homo sapiens
tgaccagtttaagccgcag

SEQ ID NO: 3633891 - DNA, 15 bp, Homo sapiens
tgaccatcatgccct

SEQ ID NO: 3633892 - DNA, 19 bp, Homo sapiens
tgaccatgcgtcaggggcc

SEQ ID NO: 3633893 - DNA, 12 bp, Homo sapiens
tgacccagcatc

SEQ ID NO: 3633894 - DNA, 20 bp, Homo sapiens
tgaccccgagaagtgctctt

SEQ ID NO: 3633895 - DNA, 14 bp, Homo sapiens
tgacccctgcctgt

SEQ ID NO: 3633896 - DNA, 21 bp, Homo sapiens
tgaccctgggcagttccttac

SEQ ID NO: 3633897 - DNA, 18 bp, Homo sapiens
tgaccgagccctggagag

SEQ ID NO: 3633898 - DNA, 18 bp, Homo sapiens
tgaccgatgtgtctccca

SEQ ID NO: 3633899 - DNA, 19 bp, Homo sapiens
tgaccgatgtgtctcccag

SEQ ID NO: 3633900 - DNA, 17 bp, Homo sapiens
tgacctaccccagccag

SEQ ID NO: 3633901 - DNA, 23 bp, Homo sapiens
tgacctcactggcctgccatgcc

SEQ ID NO: 3633902 - DNA, 13 bp, Homo sapiens
tgacctccagaag

SEQ ID NO: 3633903 - DNA, 18 bp, Homo sapiens
tgacctccgcccctgccc

SEQ ID NO: 3633904 - DNA, 19 bp, Homo sapiens
tgacctccgcccctgcccc

SEQ ID NO: 3633905 - DNA, 23 bp, Homo sapiens
tgacctccgcccctgcccccgct

SEQ ID NO: 3633906 - DNA, 21 bp, Homo sapiens
tgacctctcataaatttactt

SEQ ID NO: 3633907 - DNA, 17 bp, Homo sapiens
tgacctgatttccattt

SEQ ID NO: 3633908 - DNA, 13 bp, Homo sapiens
tgaccttcccagg

SEQ ID NO: 3633909 - DNA, 16 bp, Homo sapiens
tgacctttatttatta

SEQ ID NO: 3633910 - DNA, 12 bp, Homo sapiens
tgacctttcaaa

SEQ ID NO: 3633911 - DNA, 19 bp, Homo sapiens
tgacggccagggagaagct

SEQ ID NO: 3633912 - DNA, 21 bp, Homo sapiens
tgacggtgttaattttgctaa

SEQ ID NO: 3633913 - DNA, 12 bp, Homo sapiens
tgactaaacttt

SEQ ID NO: 3633914 - DNA, 18 bp, Homo sapiens
tgactagaactcctgtct

SEQ ID NO: 3633915 - DNA, 16 bp, Homo sapiens
tgactataaccttgtt

SEQ ID NO: 3633916 - DNA, 14 bp, Homo sapiens
tgactatcataaaa

SEQ ID NO: 3633917 - DNA, 20 bp, Homo sapiens
tgactatgcgtggctggaac

SEQ ID NO: 3633918 - DNA, 18 bp, Homo sapiens
tgactattctcaaatgct

SEQ ID NO: 3633919 - DNA, 22 bp, Homo sapiens
tgactattctcaaatgctggca

SEQ ID NO: 3633920 - DNA, 14 bp, Homo sapiens
tgactcaaagtctg

SEQ ID NO: 3633921 - DNA, 18 bp, Homo sapiens
tgactcagcatcacccac

SEQ ID NO: 3633922 - DNA, 13 bp, Homo sapiens
tgactccaaagct

SEQ ID NO: 3633923 - DNA, 11 bp, Homo sapiens
tgactccaggg

SEQ ID NO: 3633924 - DNA, 14 bp, Homo sapiens
tgactccccagccc

SEQ ID NO: 3633925 - DNA, 13 bp, Homo sapiens
tgactccctggga

SEQ ID NO: 3633926 - DNA, 14 bp, Homo sapiens
tgactccctgggag

SEQ ID NO: 3633927 - DNA, 13 bp, Homo sapiens
tgactcctgctgg

SEQ ID NO: 3633928 - DNA, 14 bp, Homo sapiens
tgactcctgctggt

SEQ ID NO: 3633929 - DNA, 20 bp, Homo sapiens
tgactccttatctctttcca

SEQ ID NO: 3633930 - DNA, 24 bp, Homo sapiens
tgactctaaggttatctactttta

SEQ ID NO: 3633931 - DNA, 13 bp, Homo sapiens
tgactctcctgcc

SEQ ID NO: 3633932 - DNA, 13 bp, Homo sapiens
tgagggccaagag

SEQ ID NO: 3633933 - DNA, 17 bp, Homo sapiens
tgaggggccctggccag

SEQ ID NO: 3633934 - DNA, 22 bp, Homo sapiens
tgagggggaatagtctagatgg

SEQ ID NO: 3633935 - DNA, 16 bp, Homo sapiens
tgagggtccacctgga

SEQ ID NO: 3633936 - DNA, 18 bp, Homo sapiens
tgagggtccacctggaga

SEQ ID NO: 3633937 - DNA, 19 bp, Homo sapiens
tgagggtccacctggagag

SEQ ID NO: 3633938 - DNA, 22 bp, Homo sapiens
tgagggtcgtgggaaaggggag

SEQ ID NO: 3633939 - DNA, 16 bp, Homo sapiens
tgagggtgggggtgct

SEQ ID NO: 3633940 - DNA, 15 bp, Homo sapiens
tgaggtaagtttttt

SEQ ID NO: 3633941 - DNA, 13 bp, Homo sapiens
tgaggtcaccagg

SEQ ID NO: 3633942 - DNA, 17 bp, Homo sapiens
tgaggtcaccaggggag

SEQ ID NO: 3633943 - DNA, 22 bp, Homo sapiens
tgaggtcaccaggggaggagcc

SEQ ID NO: 3633944 - DNA, 14 bp, Homo sapiens
tgaggtcactgcta

SEQ ID NO: 3633945 - DNA, 18 bp, Homo sapiens
tgaggtgaactccaggca

SEQ ID NO: 3633946 - DNA, 20 bp, Homo sapiens
tgaggtgaactccaggcatg

SEQ ID NO: 3633947 - DNA, 21 bp, Homo sapiens
tgaggtgtattggtgttgcag

SEQ ID NO: 3633948 - DNA, 23 bp, Homo sapiens
tgagtaagtgaaggtctcctaaa

SEQ ID NO: 3633949 - DNA, 22 bp, Homo sapiens
tgagtaattcaagcctctaaac

SEQ ID NO: 3633950 - DNA, 17 bp, Homo sapiens
tgagtacaaatgcctta

SEQ ID NO: 3633951 - DNA, 13 bp, Homo sapiens
tgagtatgtgaag

SEQ ID NO: 3633952 - DNA, 12 bp, Homo sapiens
tgagtcaaatcc

SEQ ID NO: 3633953 - DNA, 16 bp, Homo sapiens
tgagtcaaatccagtg

SEQ ID NO: 3633954 - DNA, 19 bp, Homo sapiens
tgagtcaaatccagtggtg

SEQ ID NO: 3633955 - DNA, 22 bp, Homo sapiens
tgagtcaaatccagtggtgggt

SEQ ID NO: 3633956 - DNA, 13 bp, Homo sapiens
tgagtcacctgct

SEQ ID NO: 3633957 - DNA, 15 bp, Homo sapiens
tgagtcacctgctcc

SEQ ID NO: 3633958 - DNA, 15 bp, Homo sapiens
tgagtcattatgtag

SEQ ID NO: 3633959 - DNA, 13 bp, Homo sapiens
tgagtcatttaaa

SEQ ID NO: 3633960 - DNA, 23 bp, Homo sapiens
tgagtcatttaaatgtgtacaat

SEQ ID NO: 3633961 - DNA, 18 bp, Homo sapiens
tgagtcatttgtttaaac

SEQ ID NO: 3633962 - DNA, 12 bp, Homo sapiens
tgagtccctgct

SEQ ID NO: 3633963 - DNA, 18 bp, Homo sapiens
tgagtctgggatattctt

SEQ ID NO: 3633964 - DNA, 19 bp, Homo sapiens
tgagtgagttcaactacat

SEQ ID NO: 3633965 - DNA, 14 bp, Homo sapiens
tgagtgcacctgcc

SEQ ID NO: 3633966 - DNA, 16 bp, Homo sapiens
tgagtgcacctgcctc

SEQ ID NO: 3633967 - DNA, 23 bp, Homo sapiens
tgagtgcacctgcctccaccagc

SEQ ID NO: 3633968 - DNA, 23 bp, Homo sapiens
tgagtgccccacttctggccaca

SEQ ID NO: 3633969 - DNA, 12 bp, Homo sapiens
tgagtggcagca

SEQ ID NO: 3633970 - DNA, 14 bp, Homo sapiens
tgagtggcagcagc

SEQ ID NO: 3633971 - DNA, 15 bp, Homo sapiens
tgagtggcagcagcc

SEQ ID NO: 3633972 - DNA, 15 bp, Homo sapiens
tgagtggtgtgactc

SEQ ID NO: 3633973 - DNA, 21 bp, Homo sapiens
tgagtgtgatccagtttttca

SEQ ID NO: 3633974 - DNA, 23 bp, Homo sapiens
tgagttacattaaaataaaccaa

SEQ ID NO: 3633975 - DNA, 13 bp, Homo sapiens
tgagttcctctgc

SEQ ID NO: 3633976 - DNA, 13 bp, Homo sapiens
tgagttgaagatc

SEQ ID NO: 3633977 - DNA, 16 bp, Homo sapiens
tgataacagaactttt

SEQ ID NO: 3633978 - DNA, 12 bp, Homo sapiens
tgataagaaaac

SEQ ID NO: 3633979 - DNA, 18 bp, Homo sapiens
tgataataggtcatatgt

SEQ ID NO: 3633980 - DNA, 14 bp, Homo sapiens
tgataattttcctt

SEQ ID NO: 3633981 - DNA, 19 bp, Homo sapiens
tgataattttcctttaata

SEQ ID NO: 3633982 - DNA, 22 bp, Homo sapiens
tgataccattctattctccaga

SEQ ID NO: 3633983 - DNA, 23 bp, Homo sapiens
tgataccattctattctccagac

SEQ ID NO: 3633984 - DNA, 15 bp, Homo sapiens
tgatactaccagggt

SEQ ID NO: 3633985 - DNA, 20 bp, Homo sapiens
tgatactctttctaatgctg

SEQ ID NO: 3633986 - DNA, 17 bp, Homo sapiens
tgatactgggtctgcga

SEQ ID NO: 3633987 - DNA, 22 bp, Homo sapiens
tgatagacacatatgaggggga

SEQ ID NO: 3633988 - DNA, 18 bp, Homo sapiens
tgatagcaaatggcctca

SEQ ID NO: 3633989 - DNA, 19 bp, Homo sapiens
tgatataaatcagattctt

SEQ ID NO: 3633990 - DNA, 18 bp, Homo sapiens
tgatatataagtgtacat

SEQ ID NO: 3633991 - DNA, 19 bp, Homo sapiens
tgatatataagtgtacata

SEQ ID NO: 3633992 - DNA, 22 bp, Homo sapiens
tgatatataagtgtacatatgt

SEQ ID NO: 3633993 - DNA, 19 bp, Homo sapiens
tgatatgcagttttcctta

SEQ ID NO: 3633994 - DNA, 16 bp, Homo sapiens
tgatattgaaggaatt

SEQ ID NO: 3633995 - DNA, 21 bp, Homo sapiens
tgatattttcaacgcagccct

SEQ ID NO: 3633996 - DNA, 23 bp, Homo sapiens
tgatattttcaacgcagccctgc

SEQ ID NO: 3633997 - DNA, 18 bp, Homo sapiens
tgatcaaagccacactct

SEQ ID NO: 3633998 - DNA, 22 bp, Homo sapiens
tgatcagaagaacatgatttta

SEQ ID NO: 3633999 - DNA, 23 bp, Homo sapiens
tgatccataaagacaatcactgc

SEQ ID NO: 3634000 - DNA, 23 bp, Homo sapiens
tgatcccaccccctcctccccca

SEQ ID NO: 3634001 - DNA, 20 bp, Homo sapiens
tgatccccgtctctgccctg

SEQ ID NO: 3634002 - DNA, 19 bp, Homo sapiens
tgatcccttgagatatgga

SEQ ID NO: 3634003 - DNA, 19 bp, Homo sapiens
tgatcctcacgccttggcc

SEQ ID NO: 3634004 - DNA, 14 bp, Homo sapiens
tgatcctggaggcc

SEQ ID NO: 3634005 - DNA, 16 bp, Homo sapiens
tgatcctggaggccca

SEQ ID NO: 3634006 - DNA, 22 bp, Homo sapiens
tgatctcattcagaagatgctt

SEQ ID NO: 3634007 - DNA, 12 bp, Homo sapiens
tgatctcccctc

SEQ ID NO: 3634008 - DNA, 14 bp, Homo sapiens
tgatctgctgctga

SEQ ID NO: 3634009 - DNA, 14 bp, Homo sapiens
tgatctggaaccca

SEQ ID NO: 3634010 - DNA, 14 bp, Homo sapiens
tgatctgtccacct

SEQ ID NO: 3634011 - DNA, 16 bp, Homo sapiens
tgatctgttttggatg

SEQ ID NO: 3634012 - DNA, 18 bp, Homo sapiens
tgatcttgagaacctttt

SEQ ID NO: 3634013 - DNA, 14 bp, Homo sapiens
tgatcttgtgctat

SEQ ID NO: 3634014 - DNA, 14 bp, Homo sapiens
tgatgagagaatgt

SEQ ID NO: 3634015 - DNA, 13 bp, Homo sapiens
tgatgagttgtga

SEQ ID NO: 3634016 - DNA, 15 bp, Homo sapiens
tgatgatgaaaacta

SEQ ID NO: 3634017 - DNA, 15 bp, Homo sapiens
tgatgatgatgaaaa

SEQ ID NO: 3634018 - DNA, 15 bp, Homo sapiens
tgatgattttccttt

SEQ ID NO: 3634019 - DNA, 18 bp, Homo sapiens
tgatgcaaggattacaga

SEQ ID NO: 3634020 - DNA, 20 bp, Homo sapiens
tgatgcaaggattacagaaa

SEQ ID NO: 3634021 - DNA, 21 bp, Homo sapiens
tgatgcacagtatctgctgtt

SEQ ID NO: 3634022 - DNA, 16 bp, Homo sapiens
tgatgccaaggggctg

SEQ ID NO: 3634023 - DNA, 13 bp, Homo sapiens
tgatggaaaataa

SEQ ID NO: 3634024 - DNA, 19 bp, Homo sapiens
tgatggaatatcatgaatg

SEQ ID NO: 3634025 - DNA, 18 bp, Homo sapiens
tgatggatggcagactct

SEQ ID NO: 3634026 - DNA, 12 bp, Homo sapiens
tgatgtataatg

SEQ ID NO: 3634027 - DNA, 17 bp, Homo sapiens
tgatgtccttggactcc

SEQ ID NO: 3634028 - DNA, 19 bp, Homo sapiens
tgatgtgaagagtttcaca

SEQ ID NO: 3634029 - DNA, 21 bp, Homo sapiens
tgatgtgaagagtttcacaaa

SEQ ID NO: 3634030 - DNA, 19 bp, Homo sapiens
tgatgtttgccatttgctg

SEQ ID NO: 3634031 - DNA, 20 bp, Homo sapiens
tgattaaaaataccttctat

SEQ ID NO: 3634032 - DNA, 22 bp, Homo sapiens
tgattaaagatgagctttgtct

SEQ ID NO: 3634033 - DNA, 18 bp, Homo sapiens
tgattaaccttttcaaat

SEQ ID NO: 3634034 - DNA, 19 bp, Homo sapiens
tgattaaccttttcaaatt

SEQ ID NO: 3634035 - DNA, 20 bp, Homo sapiens
tgattaacttatactgtagg

SEQ ID NO: 3634036 - DNA, 14 bp, Homo sapiens
tgattactcctcca

SEQ ID NO: 3634037 - DNA, 20 bp, Homo sapiens
tgattactggcctttttcat

SEQ ID NO: 3634038 - DNA, 16 bp, Homo sapiens
tgattacttccactga

SEQ ID NO: 3634039 - DNA, 16 bp, Homo sapiens
tgattcaaatgtttta

SEQ ID NO: 3634040 - DNA, 13 bp, Homo sapiens
tgattcatattta

SEQ ID NO: 3634041 - DNA, 19 bp, Homo sapiens
tgattcatatttaatttga

SEQ ID NO: 3634042 - DNA, 20 bp, Homo sapiens
tgattcatatttaatttgaa

SEQ ID NO: 3634043 - DNA, 14 bp, Homo sapiens
tgattctgattgct

SEQ ID NO: 3634044 - DNA, 12 bp, Homo sapiens
tgattgacagct

SEQ ID NO: 3634045 - DNA, 21 bp, Homo sapiens
tgattgacagctttgctgctg

SEQ ID NO: 3634046 - DNA, 13 bp, Homo sapiens
tgattgctatcag

SEQ ID NO: 3634047 - DNA, 13 bp, Homo sapiens
tgattggctgctt

SEQ ID NO: 3634048 - DNA, 15 bp, Homo sapiens
tgattggctgcttaa

SEQ ID NO: 3634049 - DNA, 23 bp, Homo sapiens
tgattgtcaacacaaactggctt

SEQ ID NO: 3634050 - DNA, 22 bp, Homo sapiens
tgatttacatatattatttatt

SEQ ID NO: 3634051 - DNA, 21 bp, Homo sapiens
tgatttaggtagccttgtgtt

SEQ ID NO: 3634052 - DNA, 14 bp, Homo sapiens
tgatttcacagtgt

SEQ ID NO: 3634053 - DNA, 21 bp, Homo sapiens
tgatttcagtcatagcaagct

SEQ ID NO: 3634054 - DNA, 16 bp, Homo sapiens
tgatttccatttctga

SEQ ID NO: 3634055 - DNA, 13 bp, Homo sapiens
tgatttgagattt

SEQ ID NO: 3634056 - DNA, 23 bp, Homo sapiens
tgatttgtacagattctttatta

SEQ ID NO: 3634057 - DNA, 15 bp, Homo sapiens
tgatttgtactgaaa

SEQ ID NO: 3634058 - DNA, 14 bp, Homo sapiens
tgatttttaagaaa

SEQ ID NO: 3634059 - DNA, 21 bp, Homo sapiens
tgatttttggtcttctgttga

SEQ ID NO: 3634060 - DNA, 14 bp, Homo sapiens
tgcaaaaaaagcct

SEQ ID NO: 3634061 - DNA, 15 bp, Homo sapiens
tgcaaaaaaagcctc

SEQ ID NO: 3634062 - DNA, 20 bp, Homo sapiens
tgcaaaaaaagcctccaagg

SEQ ID NO: 3634063 - DNA, 21 bp, Homo sapiens
tgcaaaaaaagcctccaaggg

SEQ ID NO: 3634064 - DNA, 15 bp, Homo sapiens
tgcatggagaatggg

SEQ ID NO: 3634065 - DNA, 11 bp, Homo sapiens
tgcatgggctc

SEQ ID NO: 3634066 - DNA, 18 bp, Homo sapiens
tgcatggtgccccaggac

SEQ ID NO: 3634067 - DNA, 12 bp, Homo sapiens
tgcatgtagcat

SEQ ID NO: 3634068 - DNA, 21 bp, Homo sapiens
tgcattatatttgtaaattta

SEQ ID NO: 3634069 - DNA, 23 bp, Homo sapiens
tgcattcctgtgccctagatgca

SEQ ID NO: 3634070 - DNA, 16 bp, Homo sapiens
tgcattgaggaaatat

SEQ ID NO: 3634071 - DNA, 13 bp, Homo sapiens
tgcatttatatgt

SEQ ID NO: 3634072 - DNA, 20 bp, Homo sapiens
tgccaaaaaaagacagggct

SEQ ID NO: 3634073 - DNA, 18 bp, Homo sapiens
tgccaaaacccagctgca

SEQ ID NO: 3634074 - DNA, 22 bp, Homo sapiens
tgccaaaataccactagtggaa

SEQ ID NO: 3634075 - DNA, 15 bp, Homo sapiens
tgccaaaggatgtga

SEQ ID NO: 3634076 - DNA, 16 bp, Homo sapiens
tgccaaaggatgtgat

SEQ ID NO: 3634077 - DNA, 17 bp, Homo sapiens
tgccaaaggatgtgata

SEQ ID NO: 3634078 - DNA, 16 bp, Homo sapiens
tgccaaccctgggcta

SEQ ID NO: 3634079 - DNA, 12 bp, Homo sapiens
tgccaaggagca

SEQ ID NO: 3634080 - DNA, 13 bp, Homo sapiens
tgccaaggctctc

SEQ ID NO: 3634081 - DNA, 12 bp, Homo sapiens
tgccaataaagc

SEQ ID NO: 3634082 - DNA, 22 bp, Homo sapiens
tgccaataaagcttttggaagc

SEQ ID NO: 3634083 - DNA, 18 bp, Homo sapiens
tgccaataaattctaaat

SEQ ID NO: 3634084 - DNA, 13 bp, Homo sapiens
tgccaatctaaaa

SEQ ID NO: 3634085 - DNA, 16 bp, Homo sapiens
tgccacacctggcctt

SEQ ID NO: 3634086 - DNA, 17 bp, Homo sapiens
tgccacacctggcctta

SEQ ID NO: 3634087 - DNA, 14 bp, Homo sapiens
tgccacacttcagg

SEQ ID NO: 3634088 - DNA, 15 bp, Homo sapiens
tgccacacttcaggc

SEQ ID NO: 3634089 - DNA, 17 bp, Homo sapiens
tgccacaggcttaggga

SEQ ID NO: 3634090 - DNA, 15 bp, Homo sapiens
tgccaccagcatcca

SEQ ID NO: 3634091 - DNA, 13 bp, Homo sapiens
tgccacccacctc

SEQ ID NO: 3634092 - DNA, 20 bp, Homo sapiens
tgccacccacctccctgcct

SEQ ID NO: 3634093 - DNA, 17 bp, Homo sapiens
tgccacccccttccctg

SEQ ID NO: 3634094 - DNA, 12 bp, Homo sapiens
tgccacctggca

SEQ ID NO: 3634095 - DNA, 18 bp, Homo sapiens
tgccactgcctcttcctc

SEQ ID NO: 3634096 - DNA, 16 bp, Homo sapiens
tgccactgggacagct

SEQ ID NO: 3634097 - DNA, 18 bp, Homo sapiens
tgccacttaatgtatgtt

SEQ ID NO: 3634098 - DNA, 11 bp, Homo sapiens
tgccagagagg

SEQ ID NO: 3634099 - DNA, 12 bp, Homo sapiens
tgccagcaaata

SEQ ID NO: 3634100 - DNA, 15 bp, Homo sapiens
tgccagctgcactga

SEQ ID NO: 3634101 - DNA, 20 bp, Homo sapiens
tgccagcttctctctccagg

SEQ ID NO: 3634102 - DNA, 16 bp, Homo sapiens
tgccaggctgcctcct

SEQ ID NO: 3634103 - DNA, 12 bp, Homo sapiens
tgccaggctgtt

SEQ ID NO: 3634104 - DNA, 13 bp, Homo sapiens
tgccaggggctct

SEQ ID NO: 3634105 - DNA, 15 bp, Homo sapiens
tgccaggggctctgt

SEQ ID NO: 3634106 - DNA, 22 bp, Homo sapiens
tgccaggggctctgtggcaaaa

SEQ ID NO: 3634107 - DNA, 19 bp, Homo sapiens
tgccagtccccctgcccca

SEQ ID NO: 3634108 - DNA, 15 bp, Homo sapiens
tgccagtgaagtcct

SEQ ID NO: 3634109 - DNA, 19 bp, Homo sapiens
tgccagttacttgggcttc

SEQ ID NO: 3634110 - DNA, 17 bp, Homo sapiens
tgccagttatggctata

SEQ ID NO: 3634111 - DNA, 22 bp, Homo sapiens
tgccatcatgtttacagaggac

SEQ ID NO: 3634112 - DNA, 13 bp, Homo sapiens
tgccatctctgct

SEQ ID NO: 3634113 - DNA, 15 bp, Homo sapiens
tgccatgatgtatat

SEQ ID NO: 3634114 - DNA, 15 bp, Homo sapiens
tgccatgctgggcca

SEQ ID NO: 3634115 - DNA, 19 bp, Homo sapiens
tgccatgctgggccactgg

SEQ ID NO: 3634116 - DNA, 14 bp, Homo sapiens
tgccatttcccttc

SEQ ID NO: 3634117 - DNA, 22 bp, Homo sapiens
tgcccaaacccttaactgacat

SEQ ID NO: 3634118 - DNA, 19 bp, Homo sapiens
tgcccaacccttccctcac

SEQ ID NO: 3634119 - DNA, 22 bp, Homo sapiens
tgcccaacccttccctcacctt

SEQ ID NO: 3634120 - DNA, 23 bp, Homo sapiens
tgcccaacctctgtggtcaccca

SEQ ID NO: 3634121 - DNA, 21 bp, Homo sapiens
tgcccaagaatagatgctgac

SEQ ID NO: 3634122 - DNA, 22 bp, Homo sapiens
tgcccaagaatagatgctgact

SEQ ID NO: 3634123 - DNA, 22 bp, Homo sapiens
tgcccacccctcactccccagg

SEQ ID NO: 3634124 - DNA, 13 bp, Homo sapiens
tgcccacttgtca

SEQ ID NO: 3634125 - DNA, 17 bp, Homo sapiens
tgcccagaatttaccat

SEQ ID NO: 3634126 - DNA, 19 bp, Homo sapiens
tgcccaggagacagaccac

SEQ ID NO: 3634127 - DNA, 17 bp, Homo sapiens
tgcccaggcctgcctgt

SEQ ID NO: 3634128 - DNA, 13 bp, Homo sapiens
tgcccaggctgga

SEQ ID NO: 3634129 - DNA, 20 bp, Homo sapiens
tgcccaggctggagtgcaat

SEQ ID NO: 3634130 - DNA, 17 bp, Homo sapiens
tgcccaggggagccctc

SEQ ID NO: 3634131 - DNA, 14 bp, Homo sapiens
tgcccatgtgtaca

SEQ ID NO: 3634132 - DNA, 18 bp, Homo sapiens
tgccccaaactttctcat

SEQ ID NO: 3634133 - DNA, 18 bp, Homo sapiens
tgccccaagtggtgagca

SEQ ID NO: 3634134 - DNA, 21 bp, Homo sapiens
tgccccaccccacctcacagc

SEQ ID NO: 3634135 - DNA, 23 bp, Homo sapiens
tgccccaccccacctcacagcta

SEQ ID NO: 3634136 - DNA, 19 bp, Homo sapiens
tgccccaccccatccagcc

SEQ ID NO: 3634137 - DNA, 22 bp, Homo sapiens
tgccccaccccatccagccaga

SEQ ID NO: 3634138 - DNA, 20 bp, Homo sapiens
tgccccacctcccccttccc

SEQ ID NO: 3634139 - DNA, 19 bp, Homo sapiens
tgccccacttctggccaca

SEQ ID NO: 3634140 - DNA, 18 bp, Homo sapiens
tgccccaggaccagctca

SEQ ID NO: 3634141 - DNA, 22 bp, Homo sapiens
tgccccagtcggccccatctct

SEQ ID NO: 3634142 - DNA, 19 bp, Homo sapiens
tgcccccagaaagcctcct

SEQ ID NO: 3634143 - DNA, 18 bp, Homo sapiens
tgccccccctaagagaca

SEQ ID NO: 3634144 - DNA, 13 bp, Homo sapiens
tgccccctccagg

SEQ ID NO: 3634145 - DNA, 18 bp, Homo sapiens
tgccccctccaggagaga

SEQ ID NO: 3634146 - DNA, 11 bp, Homo sapiens
tgccccctgcc

SEQ ID NO: 3634147 - DNA, 13 bp, Homo sapiens
tgccccctgccag

SEQ ID NO: 3634148 - DNA, 18 bp, Homo sapiens
tgccccctgccagtgaag

SEQ ID NO: 3634149 - DNA, 23 bp, Homo sapiens
tgccccgcagacggtctgtgtgc

SEQ ID NO: 3634150 - DNA, 21 bp, Homo sapiens
tgccccgtcggactgccccca

SEQ ID NO: 3634151 - DNA, 23 bp, Homo sapiens
tgccccgtcggactgcccccaga

SEQ ID NO: 3634152 - DNA, 19 bp, Homo sapiens
tgcccctaaagagcatcct

SEQ ID NO: 3634153 - DNA, 18 bp, Homo sapiens
tgcccctgctgtgctgct

SEQ ID NO: 3634154 - DNA, 20 bp, Homo sapiens
tgcccctgctgtgctgctca

SEQ ID NO: 3634155 - DNA, 15 bp, Homo sapiens
tgcccctggccttgg

SEQ ID NO: 3634156 - DNA, 13 bp, Homo sapiens
tgcccctggcttt

SEQ ID NO: 3634157 - DNA, 16 bp, Homo sapiens
tgcccctggctttgcc

SEQ ID NO: 3634158 - DNA, 19 bp, Homo sapiens
tgcccctggctttgcctct

SEQ ID NO: 3634159 - DNA, 16 bp, Homo sapiens
tgcccctgtctggaag

SEQ ID NO: 3634160 - DNA, 23 bp, Homo sapiens
tgcccctgtctggaagacgtggc

SEQ ID NO: 3634161 - DNA, 23 bp, Homo sapiens
tgcccgcgggagacagcttctct

SEQ ID NO: 3634162 - DNA, 19 bp, Homo sapiens
tgcccgctccatggaaaag

SEQ ID NO: 3634163 - DNA, 19 bp, Homo sapiens
tgcccgctcccacagcttc

SEQ ID NO: 3634164 - DNA, 17 bp, Homo sapiens
tgccctaagcccccagg

SEQ ID NO: 3634165 - DNA, 19 bp, Homo sapiens
tgccctaagcccccagggc

SEQ ID NO: 3634166 - DNA, 20 bp, Homo sapiens
tgccctaagcccccagggcc

SEQ ID NO: 3634167 - DNA, 21 bp, Homo sapiens
tgccctaattaaaaactgtga

SEQ ID NO: 3634168 - DNA, 19 bp, Homo sapiens
tgccctccactccactgcc

SEQ ID NO: 3634169 - DNA, 12 bp, Homo sapiens
tgccctcctctc

SEQ ID NO: 3634170 - DNA, 18 bp, Homo sapiens
tgccctggatccatcagg

SEQ ID NO: 3634171 - DNA, 17 bp, Homo sapiens
tgccctgggctcctctt

SEQ ID NO: 3634172 - DNA, 16 bp, Homo sapiens
tgccctggtgctgcca

SEQ ID NO: 3634173 - DNA, 17 bp, Homo sapiens
tgccctggtgctgccac

SEQ ID NO: 3634174 - DNA, 19 bp, Homo sapiens
tgccctgttaaaagatgaa

SEQ ID NO: 3634175 - DNA, 20 bp, Homo sapiens
tgccctgttaaaagatgaaa

SEQ ID NO: 3634176 - DNA, 14 bp, Homo sapiens
tgcccttgctgccc

SEQ ID NO: 3634177 - DNA, 13 bp, Homo sapiens
tgccctttcaaag

SEQ ID NO: 3634178 - DNA, 21 bp, Homo sapiens
tgccgcgtcgccctcccaggc

SEQ ID NO: 3634179 - DNA, 17 bp, Homo sapiens
tgccgctctctctgagg

SEQ ID NO: 3634180 - DNA, 19 bp, Homo sapiens
tgccgctgtataaagcatg

SEQ ID NO: 3634181 - DNA, 12 bp, Homo sapiens
tgccgctgtctc

SEQ ID NO: 3634182 - DNA, 17 bp, Homo sapiens
tgccgctgtctctgagg

SEQ ID NO: 3634183 - DNA, 16 bp, Homo sapiens
tgccggcaggatgcag

SEQ ID NO: 3634184 - DNA, 15 bp, Homo sapiens
tgccggttccgcccg

SEQ ID NO: 3634185 - DNA, 19 bp, Homo sapiens
tgccgtcacccactctgca

SEQ ID NO: 3634186 - DNA, 22 bp, Homo sapiens
tgccgtcacccactctgcactg

SEQ ID NO: 3634187 - DNA, 17 bp, Homo sapiens
tgccgtgcgggcgaggc

SEQ ID NO: 3634188 - DNA, 16 bp, Homo sapiens
tgcctaacctgggacc

SEQ ID NO: 3634189 - DNA, 14 bp, Homo sapiens
tgcctatctgactt

SEQ ID NO: 3634190 - DNA, 17 bp, Homo sapiens
tgcctatctgcctggag

SEQ ID NO: 3634191 - DNA, 19 bp, Homo sapiens
tgcctatctgcctggaggc

SEQ ID NO: 3634192 - DNA, 23 bp, Homo sapiens
tgcctatgatactgtctctccag

SEQ ID NO: 3634193 - DNA, 21 bp, Homo sapiens
tgcctattatctgtcagctgc

SEQ ID NO: 3634194 - DNA, 16 bp, Homo sapiens
tgcctcacgagatttg

SEQ ID NO: 3634195 - DNA, 18 bp, Homo sapiens
tgcctcaggaggcaggac

SEQ ID NO: 3634196 - DNA, 22 bp, Homo sapiens
tgctcctcttgttcctgaaatg

SEQ ID NO: 3634197 - DNA, 13 bp, Homo sapiens
tgctcctgctttt

SEQ ID NO: 3634198 - DNA, 15 bp, Homo sapiens
tgctcctgcttttct

SEQ ID NO: 3634199 - DNA, 19 bp, Homo sapiens
tgctcctgcttttctgtcc

SEQ ID NO: 3634200 - DNA, 22 bp, Homo sapiens
tgctcctgcttttctgtcctgg

SEQ ID NO: 3634201 - DNA, 19 bp, Homo sapiens
tgctccttggcacccccat

SEQ ID NO: 3634202 - DNA, 23 bp, Homo sapiens
tgctccttggcacccccatgctg

SEQ ID NO: 3634203 - DNA, 11 bp, Homo sapiens
tgctctcctca

SEQ ID NO: 3634204 - DNA, 12 bp, Homo sapiens
tgctctcctctt

SEQ ID NO: 3634205 - DNA, 12 bp, Homo sapiens
tgctctctctga

SEQ ID NO: 3634206 - DNA, 17 bp, Homo sapiens
tgctctggcaccatcag

SEQ ID NO: 3634207 - DNA, 18 bp, Homo sapiens
tgctctggcaccatcagc

SEQ ID NO: 3634208 - DNA, 21 bp, Homo sapiens
tgctctgttaataatctcaca

SEQ ID NO: 3634209 - DNA, 15 bp, Homo sapiens
tgctcttagctgtct

SEQ ID NO: 3634210 - DNA, 17 bp, Homo sapiens
tgctcttcccactccag

SEQ ID NO: 3634211 - DNA, 16 bp, Homo sapiens
tgctcttggctgaccc

SEQ ID NO: 3634212 - DNA, 17 bp, Homo sapiens
tgctcttggctgacccc

SEQ ID NO: 3634213 - DNA, 20 bp, Homo sapiens
tgctcttttcctggtgctct

SEQ ID NO: 3634214 - DNA, 13 bp, Homo sapiens
tgctcttttctcc

SEQ ID NO: 3634215 - DNA, 21 bp, Homo sapiens
tgctcttttctcctcactgta

SEQ ID NO: 3634216 - DNA, 14 bp, Homo sapiens
tgctgaagatgcct

SEQ ID NO: 3634217 - DNA, 22 bp, Homo sapiens
tgctgacggccagggagaagct

SEQ ID NO: 3634218 - DNA, 14 bp, Homo sapiens
tgctgactgtactc

SEQ ID NO: 3634219 - DNA, 16 bp, Homo sapiens
tgctgactgtactcct

SEQ ID NO: 3634220 - DNA, 22 bp, Homo sapiens
tgctgactgtactcctcccagg

SEQ ID NO: 3634221 - DNA, 15 bp, Homo sapiens
tgctgagaaaacatg

SEQ ID NO: 3634222 - DNA, 12 bp, Homo sapiens
tgctgagctggc

SEQ ID NO: 3634223 - DNA, 14 bp, Homo sapiens
tgctgaggcaccgt

SEQ ID NO: 3634224 - DNA, 15 bp, Homo sapiens
tgctgagttggcctg

SEQ ID NO: 3634225 - DNA, 16 bp, Homo sapiens
tgctgagttggcctgg

SEQ ID NO: 3634226 - DNA, 20 bp, Homo sapiens
tgctgatactgggtctgcga

SEQ ID NO: 3634227 - DNA, 16 bp, Homo sapiens
tgctgcaaacttaatg

SEQ ID NO: 3634228 - DNA, 14 bp, Homo sapiens
tgctgcactaattg

SEQ ID NO: 3634229 - DNA, 19 bp, Homo sapiens
tgctgccacacttcaggct

SEQ ID NO: 3634230 - DNA, 20 bp, Homo sapiens
tgctgcccatgcaccttcca

SEQ ID NO: 3634231 - DNA, 14 bp, Homo sapiens
tgctgcccctgtct

SEQ ID NO: 3634232 - DNA, 23 bp, Homo sapiens
tgctgcccgcgggagacagcttc

SEQ ID NO: 3634233 - DNA, 20 bp, Homo sapiens
tgctgccggctctgggcctg

SEQ ID NO: 3634234 - DNA, 20 bp, Homo sapiens
tgctgcctcggatccccttc

SEQ ID NO: 3634235 - DNA, 13 bp, Homo sapiens
tgctgccttcaca

SEQ ID NO: 3634236 - DNA, 15 bp, Homo sapiens
tgctgccttcaggga

SEQ ID NO: 3634237 - DNA, 17 bp, Homo sapiens
tgctgctaagtcattgg

SEQ ID NO: 3634238 - DNA, 18 bp, Homo sapiens
tgctgctcccctaaagcc

SEQ ID NO: 3634239 - DNA, 22 bp, Homo sapiens
tgctgctcccctaaagccaggc

SEQ ID NO: 3634240 - DNA, 18 bp, Homo sapiens
tgctgctcctctcttggg

SEQ ID NO: 3634241 - DNA, 22 bp, Homo sapiens
tgctgctgatactgggtctgcg

SEQ ID NO: 3634242 - DNA, 13 bp, Homo sapiens
tgctgctgcccct

SEQ ID NO: 3634243 - DNA, 14 bp, Homo sapiens
tgctgctgcccctt

SEQ ID NO: 3634244 - DNA, 16 bp, Homo sapiens
tgctgctgccgccgcc

SEQ ID NO: 3634245 - DNA, 22 bp, Homo sapiens
tgctgctggggaagacagtggc

SEQ ID NO: 3634246 - DNA, 18 bp, Homo sapiens
tgctgctgtggagtgagg

SEQ ID NO: 3634247 - DNA, 15 bp, Homo sapiens
tgctggactgtcata

SEQ ID NO: 3634248 - DNA, 18 bp, Homo sapiens
tgctggagtccagtgctt

SEQ ID NO: 3634249 - DNA, 20 bp, Homo sapiens
tgctggcaaatccaggctgg

SEQ ID NO: 3634250 - DNA, 14 bp, Homo sapiens
tgctggcccagggc

SEQ ID NO: 3634251 - DNA, 17 bp, Homo sapiens
tgctggcccagggccca

SEQ ID NO: 3634252 - DNA, 20 bp, Homo sapiens
tgctggcccagggcccagag

SEQ ID NO: 3634253 - DNA, 17 bp, Homo sapiens
tgctggcggacgcagct

SEQ ID NO: 3634254 - DNA, 13 bp, Homo sapiens
tgctggctgcctt

SEQ ID NO: 3634255 - DNA, 21 bp, Homo sapiens
tgctggctgccttagaacctt

SEQ ID NO: 3634256 - DNA, 16 bp, Homo sapiens
tgctgggctgggccct

SEQ ID NO: 3634257 - DNA, 14 bp, Homo sapiens
tgctgggtggcagg

SEQ ID NO: 3634258 - DNA, 16 bp, Homo sapiens
tgctgggtggcagggg

SEQ ID NO: 3634259 - DNA, 17 bp, Homo sapiens
tgctggtcctgcacatg

SEQ ID NO: 3634260 - DNA, 18 bp, Homo sapiens
tgctggtcctgcacatga

SEQ ID NO: 3634261 - DNA, 19 bp, Homo sapiens
tgctggtcctgcacatgag

SEQ ID NO: 3634262 - DNA, 19 bp, Homo sapiens
tgctgtactaacccagtct

SEQ ID NO: 3634263 - DNA, 16 bp, Homo sapiens
tgctgtactgagcact

SEQ ID NO: 3634264 - DNA, 15 bp, Homo sapiens
tgctgtagacatttg

SEQ ID NO: 3634265 - DNA, 15 bp, Homo sapiens
tgctgtatatgcaat

SEQ ID NO: 3634266 - DNA, 14 bp, Homo sapiens
tgctgtatgtgagc

SEQ ID NO: 3634267 - DNA, 12 bp, Homo sapiens
tgctgtctcctt

SEQ ID NO: 3634268 - DNA, 15 bp, Homo sapiens
tgctgtgctgctcaa

SEQ ID NO: 3634269 - DNA, 13 bp, Homo sapiens
tgctgtgctggga

SEQ ID NO: 3634270 - DNA, 13 bp, Homo sapiens
tgctgtgctttgg

SEQ ID NO: 3634271 - DNA, 15 bp, Homo sapiens
tgctgtggagtgagg

SEQ ID NO: 3634272 - DNA, 16 bp, Homo sapiens
tgctgtggagtgaggt

SEQ ID NO: 3634273 - DNA, 20 bp, Homo sapiens
tgctgttaatatttctaaaa

SEQ ID NO: 3634274 - DNA, 22 bp, Homo sapiens
tgctgttaatctgatgtataat

SEQ ID NO: 3634275 - DNA, 17 bp, Homo sapiens
tgctgttacagttttct

SEQ ID NO: 3634276 - DNA, 18 bp, Homo sapiens
tgctgttacagttttctt

SEQ ID NO: 3634277 - DNA, 22 bp, Homo sapiens
tgctgttagtaaatttctgtga

SEQ ID NO: 3634278 - DNA, 18 bp, Homo sapiens
tgctgttatatttcatca

SEQ ID NO: 3634279 - DNA, 17 bp, Homo sapiens
tgctgttcttcagtcct

SEQ ID NO: 3634280 - DNA, 22 bp, Homo sapiens
tgctgttcttcagtcctttgtc

SEQ ID NO: 3634281 - DNA, 16 bp, Homo sapiens
tgctgttgtgaagcta

SEQ ID NO: 3634282 - DNA, 18 bp, Homo sapiens
tgctgttgtgaagctaat

SEQ ID NO: 3634283 - DNA, 16 bp, Homo sapiens
tgctgtttcaaagttc

SEQ ID NO: 3634284 - DNA, 21 bp, Homo sapiens
tgctgtttgtagtgaaataat

SEQ ID NO: 3634285 - DNA, 17 bp, Homo sapiens
tgctgttttcctccctt

SEQ ID NO: 3634286 - DNA, 19 bp, Homo sapiens
tgctgttttcctcccttct

SEQ ID NO: 3634287 - DNA, 14 bp, Homo sapiens
tgcttaaactggaa

SEQ ID NO: 3634288 - DNA, 16 bp, Homo sapiens
tgcttaaactggaaag

SEQ ID NO: 3634289 - DNA, 23 bp, Homo sapiens
tgcttaatttaaatagcattatc

SEQ ID NO: 3634290 - DNA, 16 bp, Homo sapiens
tgcttagagactatca

SEQ ID NO: 3634291 - DNA, 15 bp, Homo sapiens
tgcttaggagacaga

SEQ ID NO: 3634292 - DNA, 23 bp, Homo sapiens
tgcttagttggctttgcccaccc

SEQ ID NO: 3634293 - DNA, 13 bp, Homo sapiens
tgcttcaaaaaca

SEQ ID NO: 3634294 - DNA, 22 bp, Homo sapiens
tgcttccactaccaaaagacat

SEQ ID NO: 3634295 - DNA, 14 bp, Homo sapiens
tgcttcccacaact

SEQ ID NO: 3634296 - DNA, 15 bp, Homo sapiens
tgcttccccttttgc

SEQ ID NO: 3634297 - DNA, 18 bp, Homo sapiens
tgcttccccttttgccaa

SEQ ID NO: 3634298 - DNA, 14 bp, Homo sapiens
tgcttcctgctgta

SEQ ID NO: 3634299 - DNA, 16 bp, Homo sapiens
tgcttcctgctgtatg

SEQ ID NO: 3634300 - DNA, 16 bp, Homo sapiens
tgcttctaaaacaata

SEQ ID NO: 3634301 - DNA, 14 bp, Homo sapiens
tgcttctttctaga

SEQ ID NO: 3634302 - DNA, 15 bp, Homo sapiens
tgcttctttctagaa

SEQ ID NO: 3634303 - DNA, 17 bp, Homo sapiens
tgcttgactttccagaa

SEQ ID NO: 3634304 - DNA, 20 bp, Homo sapiens
tgcttgcaatctaatctgaa

SEQ ID NO: 3634305 - DNA, 22 bp, Homo sapiens
tgcttgcaatctaatctgaact

SEQ ID NO: 3634306 - DNA, 14 bp, Homo sapiens
tgcttgcatggaga

SEQ ID NO: 3634307 - DNA, 12 bp, Homo sapiens
tgcttgcctgaa

SEQ ID NO: 3634308 - DNA, 13 bp, Homo sapiens
tgcttggaagcca

SEQ ID NO: 3634309 - DNA, 12 bp, Homo sapiens
tgcttggccctt

SEQ ID NO: 3634310 - DNA, 15 bp, Homo sapiens
tgcttggtgtgaccc

SEQ ID NO: 3634311 - DNA, 21 bp, Homo sapiens
tgcttggtgtgacccacggag

SEQ ID NO: 3634312 - DNA, 20 bp, Homo sapiens
tgctttaatgagtgcacctg

SEQ ID NO: 3634313 - DNA, 22 bp, Homo sapiens
tgctttaatgagtgcacctgcc

SEQ ID NO: 3634314 - DNA, 23 bp, Homo sapiens
tgctttaatgagtgcacctgcct

SEQ ID NO: 3634315 - DNA, 14 bp, Homo sapiens
tgctttcctgggcc

SEQ ID NO: 3634316 - DNA, 15 bp, Homo sapiens
tgctttcctgggcct

SEQ ID NO: 3634317 - DNA, 17 bp, Homo sapiens
tgctttcggagctcctg

SEQ ID NO: 3634318 - DNA, 14 bp, Homo sapiens
tgctttctgctcag

SEQ ID NO: 3634319 - DNA, 19 bp, Homo sapiens
tgctttctgctcagcttct

SEQ ID NO: 3634320 - DNA, 20 bp, Homo sapiens
tgctttctgctcagcttctc

SEQ ID NO: 3634321 - DNA, 16 bp, Homo sapiens
tgctttcttctttcct

SEQ ID NO: 3634322 - DNA, 13 bp, Homo sapiens
tgctttgctttct

SEQ ID NO: 3634323 - DNA, 23 bp, Homo sapiens
tgctttggatagtctcctacgca

SEQ ID NO: 3634324 - DNA, 16 bp, Homo sapiens
tgctttgggctgccct

SEQ ID NO: 3634325 - DNA, 20 bp, Homo sapiens
tgctttgggctgccctggtg

SEQ ID NO: 3634326 - DNA, 23 bp, Homo sapiens
tgctttgtaagtgaaaaacatga

SEQ ID NO: 3634327 - DNA, 14 bp, Homo sapiens
tgctttttgtcatg

SEQ ID NO: 3634328 - DNA, 14 bp, Homo sapiens
tgcttttttaaata

SEQ ID NO: 3634329 - DNA, 14 bp, Homo sapiens
tggagtttctctct

SEQ ID NO: 3634330 - DNA, 15 bp, Homo sapiens
tggagtttgacacct

SEQ ID NO: 3634331 - DNA, 14 bp, Homo sapiens
tggagttttataaa

SEQ ID NO: 3634332 - DNA, 16 bp, Homo sapiens
tggagttttataaatt

SEQ ID NO: 3634333 - DNA, 23 bp, Homo sapiens
tggagttttataaattaaaaggt

SEQ ID NO: 3634334 - DNA, 19 bp, Homo sapiens
tggataaaataatgctgca

SEQ ID NO: 3634335 - DNA, 14 bp, Homo sapiens
tggataatctgagc

SEQ ID NO: 3634336 - DNA, 14 bp, Homo sapiens
tggatacagctgct

SEQ ID NO: 3634337 - DNA, 15 bp, Homo sapiens
tggatacagctgctt

SEQ ID NO: 3634338 - DNA, 15 bp, Homo sapiens
tggataccattatat

SEQ ID NO: 3634339 - DNA, 13 bp, Homo sapiens
tggatatttcaat

SEQ ID NO: 3634340 - DNA, 15 bp, Homo sapiens
tggatatttgtcaac

SEQ ID NO: 3634341 - DNA, 16 bp, Homo sapiens
tggatctatccctgcg

SEQ ID NO: 3634342 - DNA, 15 bp, Homo sapiens
tggatctcctccctt

SEQ ID NO: 3634343 - DNA, 19 bp, Homo sapiens
tggatctgtgaggggctct

SEQ ID NO: 3634344 - DNA, 22 bp, Homo sapiens
tggatcttcagaactgcccttg

SEQ ID NO: 3634345 - DNA, 21 bp, Homo sapiens
tggatgagaaacagctcagcc

SEQ ID NO: 3634346 - DNA, 21 bp, Homo sapiens
tggatgcaaatagattcagag

SEQ ID NO: 3634347 - DNA, 13 bp, Homo sapiens
tggatgcccagga

SEQ ID NO: 3634348 - DNA, 21 bp, Homo sapiens
tggatgggggaactcagatcc

SEQ ID NO: 3634349 - DNA, 23 bp, Homo sapiens
tggatgggggaactcagatccag

SEQ ID NO: 3634350 - DNA, 22 bp, Homo sapiens
tggatggtttgttgttctgcct

SEQ ID NO: 3634351 - DNA, 13 bp, Homo sapiens
tggattaaattta

SEQ ID NO: 3634352 - DNA, 15 bp, Homo sapiens
tggattaaatttaat

SEQ ID NO: 3634353 - DNA, 22 bp, Homo sapiens
tggattcacccccctctgctgc

SEQ ID NO: 3634354 - DNA, 14 bp, Homo sapiens
tggattcatattta

SEQ ID NO: 3634355 - DNA, 20 bp, Homo sapiens
tggattgtatttaagacata

SEQ ID NO: 3634356 - DNA, 21 bp, Homo sapiens
tggattgtatttaagacataa

SEQ ID NO: 3634357 - DNA, 23 bp, Homo sapiens
tggattgtgcctaatgtgtttga

SEQ ID NO: 3634358 - DNA, 18 bp, Homo sapiens
tggcaaaaaggagccttt

SEQ ID NO: 3634359 - DNA, 22 bp, Homo sapiens
tggcaaaaaggagccttttgct

SEQ ID NO: 3634360 - DNA, 21 bp, Homo sapiens
tggcaaaaggatctttgtggc

SEQ ID NO: 3634361 - DNA, 21 bp, Homo sapiens
tggcaaaggacccttgagtaa

SEQ ID NO: 3634362 - DNA, 22 bp, Homo sapiens
tggcaaaggacccttgagtaag

SEQ ID NO: 3634363 - DNA, 18 bp, Homo sapiens
tggcaaagtgacaaagca

SEQ ID NO: 3634364 - DNA, 17 bp, Homo sapiens
tggcaaagtttaaatgt

SEQ ID NO: 3634365 - DNA, 15 bp, Homo sapiens
tggcaacagatctgg

SEQ ID NO: 3634366 - DNA, 16 bp, Homo sapiens
tggcaacagatctgga

SEQ ID NO: 3634367 - DNA, 17 bp, Homo sapiens
tggcaacagatctggaa

SEQ ID NO: 3634368 - DNA, 18 bp, Homo sapiens
tggcaacagatctggaac

SEQ ID NO: 3634369 - DNA, 20 bp, Homo sapiens
tggcaacagatctggaacct

SEQ ID NO: 3634370 - DNA, 22 bp, Homo sapiens
tggcaacagatctggaacctca

SEQ ID NO: 3634371 - DNA, 16 bp, Homo sapiens
tggcaaccagccagcg

SEQ ID NO: 3634372 - DNA, 21 bp, Homo sapiens
tggcaataaataaagcttggg

SEQ ID NO: 3634373 - DNA, 15 bp, Homo sapiens
tggcaatattcctta

SEQ ID NO: 3634374 - DNA, 13 bp, Homo sapiens
tggcaattttgta

SEQ ID NO: 3634375 - DNA, 14 bp, Homo sapiens
tggcaattttgtaa

SEQ ID NO: 3634376 - DNA, 16 bp, Homo sapiens
tggcacaaaagacagc

SEQ ID NO: 3634377 - DNA, 18 bp, Homo sapiens
tggcacaatgttggagca

SEQ ID NO: 3634378 - DNA, 20 bp, Homo sapiens
tggcacaatgttggagcagc

SEQ ID NO: 3634379 - DNA, 21 bp, Homo sapiens
tggcacaatgttggagcagca

SEQ ID NO: 3634380 - DNA, 15 bp, Homo sapiens
tggcacagaccaggc

SEQ ID NO: 3634381 - DNA, 13 bp, Homo sapiens
tggcacagctggg

SEQ ID NO: 3634382 - DNA, 15 bp, Homo sapiens
tggcacagggcagtg

SEQ ID NO: 3634383 - DNA, 18 bp, Homo sapiens
tggcacagggcagtggga

SEQ ID NO: 3634384 - DNA, 14 bp, Homo sapiens
tggcaccagacacc

SEQ ID NO: 3634385 - DNA, 16 bp, Homo sapiens
tggcaccagacaccca

SEQ ID NO: 3634386 - DNA, 21 bp, Homo sapiens
tggcaccagacacccaggact

SEQ ID NO: 3634387 - DNA, 23 bp, Homo sapiens
tggcaccagacacccaggactta

SEQ ID NO: 3634388 - DNA, 20 bp, Homo sapiens
tggcacccccatgctgcctt

SEQ ID NO: 3634389 - DNA, 21 bp, Homo sapiens
tggcactgactgaatgctgtt

SEQ ID NO: 3634390 - DNA, 18 bp, Homo sapiens
tggcacttttttaaatat

SEQ ID NO: 3634391 - DNA, 19 bp, Homo sapiens
tggcacttttttaaatata

SEQ ID NO: 3634392 - DNA, 21 bp, Homo sapiens
tggcacttttttaaatataaa

SEQ ID NO: 3634393 - DNA, 17 bp, Homo sapiens
tggcagactagagtctg

SEQ ID NO: 3634394 - DNA, 11 bp, Homo sapiens
tggcagactct

SEQ ID NO: 3634395 - DNA, 12 bp, Homo sapiens
tggcagactctt

SEQ ID NO: 3634396 - DNA, 19 bp, Homo sapiens
tggcagactctttaataaa

SEQ ID NO: 3634397 - DNA, 22 bp, Homo sapiens
tggcagactctttaataaattg

SEQ ID NO: 3634398 - DNA, 16 bp, Homo sapiens
tggcagagccaggctg

SEQ ID NO: 3634399 - DNA, 12 bp, Homo sapiens
tggcagagttac

SEQ ID NO: 3634400 - DNA, 19 bp, Homo sapiens
tggcagagttacagttctg

SEQ ID NO: 3634401 - DNA, 13 bp, Homo sapiens
tggcagcagcccc

SEQ ID NO: 3634402 - DNA, 16 bp, Homo sapiens
tggcagccatgataat

SEQ ID NO: 3634403 - DNA, 17 bp, Homo sapiens
tggcagccatgataata

SEQ ID NO: 3634404 - DNA, 18 bp, Homo sapiens
tggcagccgtgccttcag

SEQ ID NO: 3634405 - DNA, 21 bp, Homo sapiens
tggcagccgtgccttcagctc

SEQ ID NO: 3634406 - DNA, 14 bp, Homo sapiens
tggcagctgctgtg

SEQ ID NO: 3634407 - DNA, 15 bp, Homo sapiens
tggcagcttgctggg

SEQ ID NO: 3634408 - DNA, 18 bp, Homo sapiens
tggcaggactcctggcag

SEQ ID NO: 3634409 - DNA, 21 bp, Homo sapiens
tggcaggactcctggcagggc

SEQ ID NO: 3634410 - DNA, 16 bp, Homo sapiens
tggcaggagtctctgc

SEQ ID NO: 3634411 - DNA, 19 bp, Homo sapiens
tggcaggagtctctgccag

SEQ ID NO: 3634412 - DNA, 13 bp, Homo sapiens
tggcagggacctg

SEQ ID NO: 3634413 - DNA, 17 bp, Homo sapiens
tggcagggacctgagag

SEQ ID NO: 3634414 - DNA, 20 bp, Homo sapiens
tggcagggccacctgcagga

SEQ ID NO: 3634415 - DNA, 15 bp, Homo sapiens
tggcaggggagcagg

SEQ ID NO: 3634416 - DNA, 18 bp, Homo sapiens
tggcagggggccccgcca

SEQ ID NO: 3634417 - DNA, 21 bp, Homo sapiens
tggcagggggccccgccaggg

SEQ ID NO: 3634418 - DNA, 23 bp, Homo sapiens
tggcagggggccccgccagggct

SEQ ID NO: 3634419 - DNA, 16 bp, Homo sapiens
tggcagtcctggaggc

SEQ ID NO: 3634420 - DNA, 19 bp, Homo sapiens
tggcagtcctggaggcagg

SEQ ID NO: 3634421 - DNA, 20 bp, Homo sapiens
tggcagtcctggaggcaggg

SEQ ID NO: 3634422 - DNA, 21 bp, Homo sapiens
tggcagtgactccccagccca

SEQ ID NO: 3634423 - DNA, 15 bp, Homo sapiens
tggcatagctctggg

SEQ ID NO: 3634424 - DNA, 21 bp, Homo sapiens
tggcatctctccccatatata

SEQ ID NO: 3634425 - DNA, 23 bp, Homo sapiens
tggcatctctccccatatataaa

SEQ ID NO: 3634426 - DNA, 19 bp, Homo sapiens
tggcatgcgccaccatgcc

SEQ ID NO: 3634427 - DNA, 22 bp, Homo sapiens
tggccaacattgtaaaacccca

SEQ ID NO: 3634428 - DNA, 14 bp, Homo sapiens
tggccaactgcaaa

SEQ ID NO: 3634429 - DNA, 22 bp, Homo sapiens
tggccaactgcaaaaaaagcct

SEQ ID NO: 3634430 - DNA, 12 bp, Homo sapiens
tggccacagact

SEQ ID NO: 3634431 - DNA, 15 bp, Homo sapiens
tggccacatcagccc

SEQ ID NO: 3634432 - DNA, 16 bp, Homo sapiens
tggccacatcagcccc

SEQ ID NO: 3634433 - DNA, 20 bp, Homo sapiens
tggccactccagacccctgg

SEQ ID NO: 3634434 - DNA, 11 bp, Homo sapiens
tggccaggtgg

SEQ ID NO: 3634435 - DNA, 15 bp, Homo sapiens
tggccagtggctgga

SEQ ID NO: 3634436 - DNA, 13 bp, Homo sapiens
tggccatcccaca

SEQ ID NO: 3634437 - DNA, 19 bp, Homo sapiens
tggccatccttctgtgtac

SEQ ID NO: 3634438 - DNA, 16 bp, Homo sapiens
tggccatcttctttct

SEQ ID NO: 3634439 - DNA, 23 bp, Homo sapiens
tggccatgatgtccttggactcc

SEQ ID NO: 3634440 - DNA, 12 bp, Homo sapiens
tggccatgctca

SEQ ID NO: 3634441 - DNA, 18 bp, Homo sapiens
tggccatgctcaaccccc

SEQ ID NO: 3634442 - DNA, 16 bp, Homo sapiens
tggcccagggcccaga

SEQ ID NO: 3634443 - DNA, 18 bp, Homo sapiens
tggcccagggcccagagc

SEQ ID NO: 3634444 - DNA, 20 bp, Homo sapiens
tggcccagggcccagagccc

SEQ ID NO: 3634445 - DNA, 22 bp, Homo sapiens
tggcccagggcccagagcccag

SEQ ID NO: 3634446 - DNA, 22 bp, Homo sapiens
tggccccagtgcggttcctcat

SEQ ID NO: 3634447 - DNA, 13 bp, Homo sapiens
tggcccccagccc

SEQ ID NO: 3634448 - DNA, 14 bp, Homo sapiens
tggcccccagccct

SEQ ID NO: 3634449 - DNA, 17 bp, Homo sapiens
tggcccccagccctggg

SEQ ID NO: 3634450 - DNA, 19 bp, Homo sapiens
tggcccgcatgtgcattct

SEQ ID NO: 3634451 - DNA, 19 bp, Homo sapiens
tggccctaaatagcagaaa

SEQ ID NO: 3634452 - DNA, 16 bp, Homo sapiens
tggccctcctcagctc

SEQ ID NO: 3634453 - DNA, 18 bp, Homo sapiens
tggccctcctcagctccc

SEQ ID NO: 3634454 - DNA, 19 bp, Homo sapiens
tggccctcctcagctccct

SEQ ID NO: 3634455 - DNA, 13 bp, Homo sapiens
tggccctggggat

SEQ ID NO: 3634456 - DNA, 23 bp, Homo sapiens
tggccctggggatcttcccacag

SEQ ID NO: 3634457 - DNA, 12 bp, Homo sapiens
tggccctggggg

SEQ ID NO: 3634458 - DNA, 18 bp, Homo sapiens
tggccctgggggtctggg

SEQ ID NO: 3634459 - DNA, 21 bp, Homo sapiens
tggccgactcagggacctaag

SEQ ID NO: 3634460 - DNA, 13 bp, Homo sapiens
tggccgccatgct

SEQ ID NO: 3634461 - DNA, 20 bp, Homo sapiens
tggcctcccaaagtgctggg

SEQ ID NO: 3634462 - DNA, 17 bp, Homo sapiens
tggcctccccatgggca

SEQ ID NO: 3634463 - DNA, 22 bp, Homo sapiens
tggcctccccatgggcacagtg

SEQ ID NO: 3634464 - DNA, 13 bp, Homo sapiens
tggcctccctgct

SEQ ID NO: 3634465 - DNA, 14 bp, Homo sapiens
tggcctccctgctg

SEQ ID NO: 3634466 - DNA, 19 bp, Homo sapiens
tggcctccctgctgtgcca

SEQ ID NO: 3634467 - DNA, 17 bp, Homo sapiens
tggcctcgtgaggggca

SEQ ID NO: 3634468 - DNA, 19 bp, Homo sapiens
tggcctcgtgaggggcaag

SEQ ID NO: 3634469 - DNA, 17 bp, Homo sapiens
tggcctgaactgaggag

SEQ ID NO: 3634470 - DNA, 21 bp, Homo sapiens
tggcctgaagagtcctctgaa

SEQ ID NO: 3634471 - DNA, 11 bp, Homo sapiens
tggcctggagc

SEQ ID NO: 3634472 - DNA, 14 bp, Homo sapiens
tggcctggagcagg

SEQ ID NO: 3634473 - DNA, 19 bp, Homo sapiens
tggcctggccatttccaag

SEQ ID NO: 3634474 - DNA, 13 bp, Homo sapiens
tggccttccccag

SEQ ID NO: 3634475 - DNA, 23 bp, Homo sapiens
tggccttccccagcatgcaccac

SEQ ID NO: 3634476 - DNA, 19 bp, Homo sapiens
tggcctttatgttctttca

SEQ ID NO: 3634477 - DNA, 14 bp, Homo sapiens
tggcggacgcagct

SEQ ID NO: 3634478 - DNA, 12 bp, Homo sapiens
tggcgtggcctc

SEQ ID NO: 3634479 - DNA, 21 bp, Homo sapiens
tggctagtcaagctcctcctc

SEQ ID NO: 3634480 - DNA, 14 bp, Homo sapiens
tggctatgaacaga

SEQ ID NO: 3634481 - DNA, 16 bp, Homo sapiens
tggctcacaaggccca

SEQ ID NO: 3634482 - DNA, 20 bp, Homo sapiens
tggctcacaaggcccaggag

SEQ ID NO: 3634483 - DNA, 19 bp, Homo sapiens
tggctcacacctgtaatcc

SEQ ID NO: 3634484 - DNA, 13 bp, Homo sapiens
tggctccactctt

SEQ ID NO: 3634485 - DNA, 20 bp, Homo sapiens
tggctccactcttgatctct

SEQ ID NO: 3634486 - DNA, 20 bp, Homo sapiens
tggctccattggtgttgaca

SEQ ID NO: 3634487 - DNA, 14 bp, Homo sapiens
tggctcccacaggc

SEQ ID NO: 3634488 - DNA, 16 bp, Homo sapiens
tggctccccaaggctg

SEQ ID NO: 3634489 - DNA, 20 bp, Homo sapiens
tggctccccaaggctgcaaa

SEQ ID NO: 3634490 - DNA, 23 bp, Homo sapiens
tggctccgtggccccgccctcag

SEQ ID NO: 3634491 - DNA, 16 bp, Homo sapiens
tggctctgccccctcc

SEQ ID NO: 3634492 - DNA, 17 bp, Homo sapiens
tggctctgccccctccc

SEQ ID NO: 3634493 - DNA, 14 bp, Homo sapiens
tggctctgccccgc

SEQ ID NO: 3634494 - DNA, 21 bp, Homo sapiens
tggctgagcaaatattaaaat

SEQ ID NO: 3634495 - DNA, 13 bp, Homo sapiens
tggctgagcccct

SEQ ID NO: 3634496 - DNA, 13 bp, Homo sapiens
tggctgcacaggc

SEQ ID NO: 3634497 - DNA, 11 bp, Homo sapiens
tggctgcaggt

SEQ ID NO: 3634498 - DNA, 21 bp, Homo sapiens
tggctgcaggtgttctgctga

SEQ ID NO: 3634499 - DNA, 13 bp, Homo sapiens
tggctgccttctt

SEQ ID NO: 3634500 - DNA, 17 bp, Homo sapiens
tggctgccttctttcca

SEQ ID NO: 3634501 - DNA, 22 bp, Homo sapiens
tggctgccttgtgaaggaatta

SEQ ID NO: 3634502 - DNA, 22 bp, Homo sapiens
tggctggaaagcagagcctcct

SEQ ID NO: 3634503 - DNA, 15 bp, Homo sapiens
tggctgggccttcac

SEQ ID NO: 3634504 - DNA, 23 bp, Homo sapiens
tggctggtagcagcaggctcagg

SEQ ID NO: 3634505 - DNA, 16 bp, Homo sapiens
tggctggtgggaaggc

SEQ ID NO: 3634506 - DNA, 18 bp, Homo sapiens
tggctggttaatgggaaa

SEQ ID NO: 3634507 - DNA, 15 bp, Homo sapiens
tggctggtttctgag

SEQ ID NO: 3634508 - DNA, 14 bp, Homo sapiens
tggctgtgaggggt

SEQ ID NO: 3634509 - DNA, 14 bp, Homo sapiens
tggctgtgcctctg

SEQ ID NO: 3634510 - DNA, 15 bp, Homo sapiens
tggctgtgcctctgc

SEQ ID NO: 3634511 - DNA, 17 bp, Homo sapiens
tggctgtgcctctgcct

SEQ ID NO: 3634512 - DNA, 18 bp, Homo sapiens
tggctgtgcctctgcctg

SEQ ID NO: 3634513 - DNA, 22 bp, Homo sapiens
tggctgtttcttgtctgttatg

SEQ ID NO: 3634514 - DNA, 19 bp, Homo sapiens
tggcttcaaaaagccacag

SEQ ID NO: 3634515 - DNA, 23 bp, Homo sapiens
tggcttcaaaaagccacagcaga

SEQ ID NO: 3634516 - DNA, 14 bp, Homo sapiens
tggcttccccactc

SEQ ID NO: 3634517 - DNA, 15 bp, Homo sapiens
tggcttccccactcc

SEQ ID NO: 3634518 - DNA, 17 bp, Homo sapiens
tggcttcccgctcagcc

SEQ ID NO: 3634519 - DNA, 20 bp, Homo sapiens
tggcttcccgctcagccctc

SEQ ID NO: 3634520 - DNA, 18 bp, Homo sapiens
tggcttccctaaactgca

SEQ ID NO: 3634521 - DNA, 21 bp, Homo sapiens
tggcttccctaaactgcagcc

SEQ ID NO: 3634522 - DNA, 21 bp, Homo sapiens
tggctttcagagccagcctgg

SEQ ID NO: 3634523 - DNA, 17 bp, Homo sapiens
tggctttgcccacccct

SEQ ID NO: 3634524 - DNA, 18 bp, Homo sapiens
tggctttgcccacccctc

SEQ ID NO: 3634525 - DNA, 14 bp, Homo sapiens
tggctttgcctctt

SEQ ID NO: 3634526 - DNA, 17 bp, Homo sapiens
tggctttgcctcttctt

SEQ ID NO: 3634527 - DNA, 20 bp, Homo sapiens
tggctttgcctcttctttgt

SEQ ID NO: 3634528 - DNA, 14 bp, Homo sapiens
tggcttttcactgc

SEQ ID NO: 3634529 - DNA, 15 bp, Homo sapiens
tggcttttcactgct

SEQ ID NO: 3634530 - DNA, 13 bp, Homo sapiens
tgggaaccactcc

SEQ ID NO: 3634531 - DNA, 18 bp, Homo sapiens
tgggaagaagaagacctc

SEQ ID NO: 3634532 - DNA, 18 bp, Homo sapiens
tgggaagaattggaagtt

SEQ ID NO: 3634533 - DNA, 13 bp, Homo sapiens
tgggaaggccagc

SEQ ID NO: 3634534 - DNA, 22 bp, Homo sapiens
tgggaagggagagttctttgct

SEQ ID NO: 3634535 - DNA, 23 bp, Homo sapiens
tgggaagggagagttctttgctg

SEQ ID NO: 3634536 - DNA, 13 bp, Homo sapiens
tgggaatcaggca

SEQ ID NO: 3634537 - DNA, 16 bp, Homo sapiens
tgggaatgttctttct

SEQ ID NO: 3634538 - DNA, 21 bp, Homo sapiens
tgggaatgttctttctgctct

SEQ ID NO: 3634539 - DNA, 14 bp, Homo sapiens
tgggacagccattt

SEQ ID NO: 3634540 - DNA, 21 bp, Homo sapiens
tgggacccacagaacttgtgg

SEQ ID NO: 3634541 - DNA, 16 bp, Homo sapiens
tgggaccccagagaaa

SEQ ID NO: 3634542 - DNA, 20 bp, Homo sapiens
tgggagaatgtcagtatgtg

SEQ ID NO: 3634543 - DNA, 10 bp, Homo sapiens
tgggagccag

SEQ ID NO: 3634544 - DNA, 13 bp, Homo sapiens
tgggagccaggac

SEQ ID NO: 3634545 - DNA, 15 bp, Homo sapiens
tgggagccaggactc

SEQ ID NO: 3634546 - DNA, 19 bp, Homo sapiens
tgggagccagtcctccact

SEQ ID NO: 3634547 - DNA, 19 bp, Homo sapiens
tgggagcccagagggtggc

SEQ ID NO: 3634548 - DNA, 12 bp, Homo sapiens
tgggagcctagc

SEQ ID NO: 3634549 - DNA, 13 bp, Homo sapiens
tgggagcctagct

SEQ ID NO: 3634550 - DNA, 20 bp, Homo sapiens
tgggagcctggttcagacac

SEQ ID NO: 3634551 - DNA, 18 bp, Homo sapiens
tgggagctggttagaaat

SEQ ID NO: 3634552 - DNA, 13 bp, Homo sapiens
tgggaggaattca

SEQ ID NO: 3634553 - DNA, 15 bp, Homo sapiens
tgggaggaggaaaag

SEQ ID NO: 3634554 - DNA, 21 bp, Homo sapiens
tgggaggaggaaaagaaacct

SEQ ID NO: 3634555 - DNA, 23 bp, Homo sapiens
tgggaggagggaggcggcctcca

SEQ ID NO: 3634556 - DNA, 14 bp, Homo sapiens
tgggaggcagaggt

SEQ ID NO: 3634557 - DNA, 20 bp, Homo sapiens
tgggaggtataggggtcctg

SEQ ID NO: 3634558 - DNA, 17 bp, Homo sapiens
tgggaggtcaggaaact

SEQ ID NO: 3634559 - DNA, 22 bp, Homo sapiens
tgggatagtgttctgctcctgc

SEQ ID NO: 3634560 - DNA, 20 bp, Homo sapiens
tgggatccaggcccctccct

SEQ ID NO: 3634561 - DNA, 21 bp, Homo sapiens
tgggattacagggatgagcca

SEQ ID NO: 3634562 - DNA, 21 bp, Homo sapiens
tgggcaaagcccctcacactg

SEQ ID NO: 3634563 - DNA, 15 bp, Homo sapiens
tgggcaatatagcaa

SEQ ID NO: 3634564 - DNA, 16 bp, Homo sapiens
tgggcaatatagcaag

SEQ ID NO: 3634565 - DNA, 19 bp, Homo sapiens
tgggcaatgatggcaattt

SEQ ID NO: 3634566 - DNA, 17 bp, Homo sapiens
tgggcacaaacagaatt

SEQ ID NO: 3634567 - DNA, 17 bp, Homo sapiens
tgggcacacgctgctct

SEQ ID NO: 3634568 - DNA, 23 bp, Homo sapiens
tgggcacacgctgctctgcccca

SEQ ID NO: 3634569 - DNA, 21 bp, Homo sapiens
tgggcacagtggtgaccccct

SEQ ID NO: 3634570 - DNA, 13 bp, Homo sapiens
tgggcactggggc

SEQ ID NO: 3634571 - DNA, 18 bp, Homo sapiens
tgggcactggggcctcag

SEQ ID NO: 3634572 - DNA, 22 bp, Homo sapiens
tgggcagatctcccacatgcca

SEQ ID NO: 3634573 - DNA, 12 bp, Homo sapiens
tgggcagcaatt

SEQ ID NO: 3634574 - DNA, 18 bp, Homo sapiens
tgggcagcaatttaaatg

SEQ ID NO: 3634575 - DNA, 20 bp, Homo sapiens
tgggcaggtctcctctggga

SEQ ID NO: 3634576 - DNA, 21 bp, Homo sapiens
tgggcaggtctcctctgggag

SEQ ID NO: 3634577 - DNA, 15 bp, Homo sapiens
tgggcagttttttga

SEQ ID NO: 3634578 - DNA, 14 bp, Homo sapiens
tgggcattagcaag

SEQ ID NO: 3634579 - DNA, 23 bp, Homo sapiens
tgggcattagcaaggcagagcct

SEQ ID NO: 3634580 - DNA, 20 bp, Homo sapiens
tgggcatttcaatccatttt

SEQ ID NO: 3634581 - DNA, 19 bp, Homo sapiens
tgggcatttctaaaatgtt

SEQ ID NO: 3634582 - DNA, 16 bp, Homo sapiens
tgggcatttggtgaga

SEQ ID NO: 3634583 - DNA, 16 bp, Homo sapiens
tgggccaactcacctg

SEQ ID NO: 3634584 - DNA, 17 bp, Homo sapiens
tgggccccgggctggag

SEQ ID NO: 3634585 - DNA, 19 bp, Homo sapiens
tgggccccgggctggagaa

SEQ ID NO: 3634586 - DNA, 23 bp, Homo sapiens
tgggccctctttccctgcgagac

SEQ ID NO: 3634587 - DNA, 18 bp, Homo sapiens
tgggccggctgagtggca

SEQ ID NO: 3634588 - DNA, 20 bp, Homo sapiens
tgggccggctgagtggcagc

SEQ ID NO: 3634589 - DNA, 18 bp, Homo sapiens
tgggccgtggcacagctg

SEQ ID NO: 3634590 - DNA, 18 bp, Homo sapiens
tgggcctcaggctctgca

SEQ ID NO: 3634591 - DNA, 11 bp, Homo sapiens
tgggcctgagg

SEQ ID NO: 3634592 - DNA, 12 bp, Homo sapiens
tgggcctgaggg

SEQ ID NO: 3634593 - DNA, 22 bp, Homo sapiens
tggtgcagccttcccctccctg

SEQ ID NO: 3634594 - DNA, 14 bp, Homo sapiens
tggtgcatgggctc

SEQ ID NO: 3634595 - DNA, 14 bp, Homo sapiens
tggtgccccaggac

SEQ ID NO: 3634596 - DNA, 18 bp, Homo sapiens
tggtgccccaggaccagc

SEQ ID NO: 3634597 - DNA, 20 bp, Homo sapiens
tggtgccccaggaccagctc

SEQ ID NO: 3634598 - DNA, 23 bp, Homo sapiens
tggtgccccaggaccagctcagg

SEQ ID NO: 3634599 - DNA, 19 bp, Homo sapiens
tggtgccctggatgcccag

SEQ ID NO: 3634600 - DNA, 19 bp, Homo sapiens
tggtggcaacattcattgc

SEQ ID NO: 3634601 - DNA, 19 bp, Homo sapiens
tggtggcccgacagcctgg

SEQ ID NO: 3634602 - DNA, 21 bp, Homo sapiens
tggtggcccgacagcctggca

SEQ ID NO: 3634603 - DNA, 23 bp, Homo sapiens
tggtgggggaggagcctctggct

SEQ ID NO: 3634604 - DNA, 19 bp, Homo sapiens
tggtgggtaattgtacaat

SEQ ID NO: 3634605 - DNA, 23 bp, Homo sapiens
tggtgggtaattgtacaataaat

SEQ ID NO: 3634606 - DNA, 14 bp, Homo sapiens
tggtggttgctgtt

SEQ ID NO: 3634607 - DNA, 18 bp, Homo sapiens
tggtgtaaggtactttca

SEQ ID NO: 3634608 - DNA, 15 bp, Homo sapiens
tggtgtgaatttgcc

SEQ ID NO: 3634609 - DNA, 18 bp, Homo sapiens
tggtgtgaatttgccaga

SEQ ID NO: 3634610 - DNA, 22 bp, Homo sapiens
tggtgtgatcttaatatatttg

SEQ ID NO: 3634611 - DNA, 16 bp, Homo sapiens
tggtgttgcagccgca

SEQ ID NO: 3634612 - DNA, 14 bp, Homo sapiens
tggtgtttgtcatg

SEQ ID NO: 3634613 - DNA, 16 bp, Homo sapiens
tggttaaattttacat

SEQ ID NO: 3634614 - DNA, 16 bp, Homo sapiens
tggttaatgtagtatg

SEQ ID NO: 3634615 - DNA, 13 bp, Homo sapiens
tggttacatatca

SEQ ID NO: 3634616 - DNA, 14 bp, Homo sapiens
tggttacctggaga

SEQ ID NO: 3634617 - DNA, 17 bp, Homo sapiens
tggttacctggagaagt

SEQ ID NO: 3634618 - DNA, 19 bp, Homo sapiens
tggttacctggagaagtag

SEQ ID NO: 3634619 - DNA, 17 bp, Homo sapiens
tggttatgaatactttg

SEQ ID NO: 3634620 - DNA, 21 bp, Homo sapiens
tggttcaagtattaagcagtt

SEQ ID NO: 3634621 - DNA, 19 bp, Homo sapiens
tggttcacctgtgactcct

SEQ ID NO: 3634622 - DNA, 18 bp, Homo sapiens
tggttccctgctgcgctg

SEQ ID NO: 3634623 - DNA, 14 bp, Homo sapiens
tggttccttctctg

SEQ ID NO: 3634624 - DNA, 21 bp, Homo sapiens
tggttcgtgctgtgctctggc

SEQ ID NO: 3634625 - DNA, 16 bp, Homo sapiens
tggttctgaggccaga

SEQ ID NO: 3634626 - DNA, 15 bp, Homo sapiens
tggttgtgttgaggt

SEQ ID NO: 3634627 - DNA, 21 bp, Homo sapiens
tggtttaaagaaagtgtattt

SEQ ID NO: 3634628 - DNA, 15 bp, Homo sapiens
tggtttcttcattct

SEQ ID NO: 3634629 - DNA, 16 bp, Homo sapiens
tggtttcttcattctt

SEQ ID NO: 3634630 - DNA, 20 bp, Homo sapiens
tggtttgggcaagcagactg

SEQ ID NO: 3634631 - DNA, 13 bp, Homo sapiens
tggtttgtcctga

SEQ ID NO: 3634632 - DNA, 20 bp, Homo sapiens
tggtttttcttttctttatt

SEQ ID NO: 3634633 - DNA, 17 bp, Homo sapiens
tgtaaaaaagaaaaaca

SEQ ID NO: 3634634 - DNA, 13 bp, Homo sapiens
tgtaaaaatgtta

SEQ ID NO: 3634635 - DNA, 12 bp, Homo sapiens
tgtaaaacttct

SEQ ID NO: 3634636 - DNA, 13 bp, Homo sapiens
tgtaaaacttctg

SEQ ID NO: 3634637 - DNA, 14 bp, Homo sapiens
tgtaaaacttctgc

SEQ ID NO: 3634638 - DNA, 15 bp, Homo sapiens
tgtaaaacttctgct

SEQ ID NO: 3634639 - DNA, 23 bp, Homo sapiens
tgtaaaagcacatgagaatgcta

SEQ ID NO: 3634640 - DNA, 17 bp, Homo sapiens
tgtaaaagcattttgta

SEQ ID NO: 3634641 - DNA, 20 bp, Homo sapiens
tgtaaactcaaaatatttgt

SEQ ID NO: 3634642 - DNA, 19 bp, Homo sapiens
tgtaaagtgatttttggtc

SEQ ID NO: 3634643 - DNA, 19 bp, Homo sapiens
tgtaaatcctagacttgaa

SEQ ID NO: 3634644 - DNA, 18 bp, Homo sapiens
tgtaaatgaaacttaaga

SEQ ID NO: 3634645 - DNA, 19 bp, Homo sapiens
tgtaaatgaaacttaagaa

SEQ ID NO: 3634646 - DNA, 13 bp, Homo sapiens
tgtaacaagaaaa

SEQ ID NO: 3634647 - DNA, 15 bp, Homo sapiens
tgtaactaaaataat

SEQ ID NO: 3634648 - DNA, 17 bp, Homo sapiens
tgtaactactttataac

SEQ ID NO: 3634649 - DNA, 18 bp, Homo sapiens
tgtaactactttataact

SEQ ID NO: 3634650 - DNA, 16 bp, Homo sapiens
tgtaactgagagaaag

SEQ ID NO: 3634651 - DNA, 21 bp, Homo sapiens
tgtaactgtttagatgaatgt

SEQ ID NO: 3634652 - DNA, 21 bp, Homo sapiens
tgtaacttccaaataaataat

SEQ ID NO: 3634653 - DNA, 13 bp, Homo sapiens
tgtaacttcctgc

SEQ ID NO: 3634654 - DNA, 16 bp, Homo sapiens
tgtaacttcctgctgc

SEQ ID NO: 3634655 - DNA, 19 bp, Homo sapiens
tgtaacttcctgctgcacc

SEQ ID NO: 3634656 - DNA, 23 bp, Homo sapiens
tgtaacttcctgctgcaccctgc

SEQ ID NO: 3634657 - DNA, 13 bp, Homo sapiens
tgtaacttcctgt

SEQ ID NO: 3634658 - DNA, 17 bp, Homo sapiens
tgtaacttcctgtggat

SEQ ID NO: 3634659 - DNA, 17 bp, Homo sapiens
tgtaagaaatacagact

SEQ ID NO: 3634660 - DNA, 17 bp, Homo sapiens
tgtaagctttgttctgg

SEQ ID NO: 3634661 - DNA, 20 bp, Homo sapiens
tgtaagctttgttctgggag

SEQ ID NO: 3634662 - DNA, 18 bp, Homo sapiens
tgtaagggaaactgccag

SEQ ID NO: 3634663 - DNA, 12 bp, Homo sapiens
tgtaagggcagt

SEQ ID NO: 3634664 - DNA, 14 bp, Homo sapiens
tgtaagggcagtgc

SEQ ID NO: 3634665 - DNA, 17 bp, Homo sapiens
tgtaagtgaaaaacatg

SEQ ID NO: 3634666 - DNA, 16 bp, Homo sapiens
tgtaagtttgtgtaaa

SEQ ID NO: 3634667 - DNA, 17 bp, Homo sapiens
tgtaataaaaagcctct

SEQ ID NO: 3634668 - DNA, 17 bp, Homo sapiens
tgtaataaactctctag

SEQ ID NO: 3634669 - DNA, 13 bp, Homo sapiens
tgtaataaatact

SEQ ID NO: 3634670 - DNA, 22 bp, Homo sapiens
tgtaatatttttatatacagag

SEQ ID NO: 3634671 - DNA, 21 bp, Homo sapiens
tgtaatcattttaaattccac

SEQ ID NO: 3634672 - DNA, 15 bp, Homo sapiens
tgtaatcccagcact

SEQ ID NO: 3634673 - DNA, 22 bp, Homo sapiens
tgtaatctagttgtcaataaat

SEQ ID NO: 3634674 - DNA, 15 bp, Homo sapiens
tgtaatgacaccaca

SEQ ID NO: 3634675 - DNA, 18 bp, Homo sapiens
tgtaatgctgcctcagga

SEQ ID NO: 3634676 - DNA, 20 bp, Homo sapiens
tgtaatgctgcctcaggacc

SEQ ID NO: 3634677 - DNA, 20 bp, Homo sapiens
tgtaatgtaggggaaagttt

SEQ ID NO: 3634678 - DNA, 21 bp, Homo sapiens
tgtaatttaaaattgtgatgt

SEQ ID NO: 3634679 - DNA, 18 bp, Homo sapiens
tgtacacgggaccagctc

SEQ ID NO: 3634680 - DNA, 22 bp, Homo sapiens
tgtacatacgctctcgtctctc

SEQ ID NO: 3634681 - DNA, 12 bp, Homo sapiens
tgtacatagtcc

SEQ ID NO: 3634682 - DNA, 15 bp, Homo sapiens
tgtacattctgccta

SEQ ID NO: 3634683 - DNA, 22 bp, Homo sapiens
tgtaccacttcctgaggcctca

SEQ ID NO: 3634684 - DNA, 11 bp, Homo sapiens
tgtaccagtta

SEQ ID NO: 3634685 - DNA, 22 bp, Homo sapiens
tgtaccagttaatttttccaac

SEQ ID NO: 3634686 - DNA, 23 bp, Homo sapiens
tgtaccagttaatttttccaact

SEQ ID NO: 3634687 - DNA, 15 bp, Homo sapiens
tgtacctcagtggat

SEQ ID NO: 3634688 - DNA, 15 bp, Homo sapiens
tgtactgagcactga

SEQ ID NO: 3634689 - DNA, 13 bp, Homo sapiens
tgtagaaattaaa

SEQ ID NO: 3634690 - DNA, 18 bp, Homo sapiens
tgtagaatgatttcatgc

SEQ ID NO: 3634691 - DNA, 21 bp, Homo sapiens
tgtagagcccctactgtgggc

SEQ ID NO: 3634692 - DNA, 13 bp, Homo sapiens
tgtagcagaaacc

SEQ ID NO: 3634693 - DNA, 14 bp, Homo sapiens
tgtagcagaaacca

SEQ ID NO: 3634694 - DNA, 13 bp, Homo sapiens
tgtagcatataaa

SEQ ID NO: 3634695 - DNA, 15 bp, Homo sapiens
tgtagcatataaatg

SEQ ID NO: 3634696 - DNA, 18 bp, Homo sapiens
tgtagccagctgtgcact

SEQ ID NO: 3634697 - DNA, 16 bp, Homo sapiens
tgtagcctaaagggca

SEQ ID NO: 3634698 - DNA, 21 bp, Homo sapiens
tgtagcctaaagggcagggcc

SEQ ID NO: 3634699 - DNA, 11 bp, Homo sapiens
tgtagctccta

SEQ ID NO: 3634700 - DNA, 17 bp, Homo sapiens
tgtagctctaaaatctg

SEQ ID NO: 3634701 - DNA, 15 bp, Homo sapiens
tgtagctgtaagggc

SEQ ID NO: 3634702 - DNA, 21 bp, Homo sapiens
tgtagctgtaagggcagtgcc

SEQ ID NO: 3634703 - DNA, 12 bp, Homo sapiens
tgtagctttgct

SEQ ID NO: 3634704 - DNA, 22 bp, Homo sapiens
tgtaggccagtagttctcaaag

SEQ ID NO: 3634705 - DNA, 23 bp, Homo sapiens
tgtaggccttaactatttcacat

SEQ ID NO: 3634706 - DNA, 23 bp, Homo sapiens
tgtagggttttttcttctttctt

SEQ ID NO: 3634707 - DNA, 21 bp, Homo sapiens
tgtagtagcgttttttaaatg

SEQ ID NO: 3634708 - DNA, 14 bp, Homo sapiens
tgtagtatggtata

SEQ ID NO: 3634709 - DNA, 16 bp, Homo sapiens
tgtagttataaaccaa

SEQ ID NO: 3634710 - DNA, 19 bp, Homo sapiens
tgtagttttatttgtatta

SEQ ID NO: 3634711 - DNA, 14 bp, Homo sapiens
tgtataaagaaact

SEQ ID NO: 3634712 - DNA, 13 bp, Homo sapiens
tgtataaagcatg

SEQ ID NO: 3634713 - DNA, 13 bp, Homo sapiens
tgtataactttaa

SEQ ID NO: 3634714 - DNA, 19 bp, Homo sapiens
tgtataagacactttgcca

SEQ ID NO: 3634715 - DNA, 14 bp, Homo sapiens
tgtataattggatt

SEQ ID NO: 3634716 - DNA, 20 bp, Homo sapiens
tgtataccagcctactgtac

SEQ ID NO: 3634717 - DNA, 15 bp, Homo sapiens
tgtatactatagtac

SEQ ID NO: 3634718 - DNA, 19 bp, Homo sapiens
tgtatactatagtaccagt

SEQ ID NO: 3634719 - DNA, 20 bp, Homo sapiens
tgtatagaccaaagcaaaga

SEQ ID NO: 3634720 - DNA, 23 bp, Homo sapiens
tgtatagaccaaagcaaagaaaa

SEQ ID NO: 3634721 - DNA, 19 bp, Homo sapiens
tgtatagcatgaaataaaa

SEQ ID NO: 3634722 - DNA, 18 bp, Homo sapiens
tgtatataaactgggatg

SEQ ID NO: 3634723 - DNA, 21 bp, Homo sapiens
tgtatataagtactgaccact

SEQ ID NO: 3634724 - DNA, 15 bp, Homo sapiens
tgtatattacaatga

SEQ ID NO: 3634725 - DNA, 16 bp, Homo sapiens
tgtcttttaaactgga

SEQ ID NO: 3634726 - DNA, 14 bp, Homo sapiens
tgtgaaacagactt

SEQ ID NO: 3634727 - DNA, 18 bp, Homo sapiens
tgtgaaactctaccctga

SEQ ID NO: 3634728 - DNA, 20 bp, Homo sapiens
tgtgaagaggtctgattggc

SEQ ID NO: 3634729 - DNA, 12 bp, Homo sapiens
tgtgaagccacc

SEQ ID NO: 3634730 - DNA, 15 bp, Homo sapiens
tgtgaagttcatctt

SEQ ID NO: 3634731 - DNA, 13 bp, Homo sapiens
tgttatgctgttt

SEQ ID NO: 3634732 - DNA, 16 bp, Homo sapiens
tgttatgctgtttcct

SEQ ID NO: 3634733 - DNA, 17 bp, Homo sapiens
tgttatgctgtttccta

SEQ ID NO: 3634734 - DNA, 19 bp, Homo sapiens
tgttatgctgtttcctagc

SEQ ID NO: 3634735 - DNA, 13 bp, Homo sapiens
tgttatgtattcc

SEQ ID NO: 3634736 - DNA, 14 bp, Homo sapiens
tgttatgtattcct

SEQ ID NO: 3634737 - DNA, 17 bp, Homo sapiens
tgttatgtattcctatg

SEQ ID NO: 3634738 - DNA, 22 bp, Homo sapiens
tgttattattacttatttttga

SEQ ID NO: 3634739 - DNA, 13 bp, Homo sapiens
tgttatttcttcc

SEQ ID NO: 3634740 - DNA, 16 bp, Homo sapiens
tgttattttccttctg

SEQ ID NO: 3634741 - DNA, 23 bp, Homo sapiens
tgttatttttacagcaaaagatg

SEQ ID NO: 3634742 - DNA, 22 bp, Homo sapiens
tgttcaaaacaaaatgaaacaa

SEQ ID NO: 3634743 - DNA, 22 bp, Homo sapiens
tgttcaagtttgctgcaaccca

SEQ ID NO: 3634744 - DNA, 16 bp, Homo sapiens
tgttcacttttcctcc

SEQ ID NO: 3634745 - DNA, 22 bp, Homo sapiens
tgttcagaagaatcttcctggc

SEQ ID NO: 3634746 - DNA, 20 bp, Homo sapiens
tgttccacaagttaaataaa

SEQ ID NO: 3634747 - DNA, 17 bp, Homo sapiens
tgttccagattcctatg

SEQ ID NO: 3634748 - DNA, 18 bp, Homo sapiens
tgttccattacaccacag

SEQ ID NO: 3634749 - DNA, 16 bp, Homo sapiens
tgttcccattcttgca

SEQ ID NO: 3634750 - DNA, 19 bp, Homo sapiens
tgttcctgaaatgtgtttc

SEQ ID NO: 3634751 - DNA, 19 bp, Homo sapiens
tgttcctgaagctgctgtg

SEQ ID NO: 3634752 - DNA, 20 bp, Homo sapiens
tgttcctgaagctgctgtgt

SEQ ID NO: 3634753 - DNA, 18 bp, Homo sapiens
tgttcctttgttaaattt

SEQ ID NO: 3634754 - DNA, 16 bp, Homo sapiens
tgttctaacatgtaat

SEQ ID NO: 3634755 - DNA, 22 bp, Homo sapiens
tgttctaccgtggatttgtact

SEQ ID NO: 3634756 - DNA, 21 bp, Homo sapiens
tgttctccagtcattatgtta

SEQ ID NO: 3634757 - DNA, 11 bp, Homo sapiens
tgttctctgaa

SEQ ID NO: 3634758 - DNA, 19 bp, Homo sapiens
tgttctgcctctccctggg

SEQ ID NO: 3634759 - DNA, 17 bp, Homo sapiens
tgttctgctccatacct

SEQ ID NO: 3634760 - DNA, 15 bp, Homo sapiens
tgttctgctcctgct

SEQ ID NO: 3634761 - DNA, 20 bp, Homo sapiens
tgttctgctcctgcttttct

SEQ ID NO: 3634762 - DNA, 23 bp, Homo sapiens
tgttctgctcctgcttttctgtc

SEQ ID NO: 3634763 - DNA, 17 bp, Homo sapiens
tgttcttacctgtatgt

SEQ ID NO: 3634764 - DNA, 20 bp, Homo sapiens
tgttcttagagtgtagctgt

SEQ ID NO: 3634765 - DNA, 20 bp, Homo sapiens
tgttcttagcaataaatgct

SEQ ID NO: 3634766 - DNA, 20 bp, Homo sapiens
tgttcttatgcaaaatggaa

SEQ ID NO: 3634767 - DNA, 16 bp, Homo sapiens
tgttcttcagtccttt

SEQ ID NO: 3634768 - DNA, 21 bp, Homo sapiens
tgttcttcagtcctttgtctt

SEQ ID NO: 3634769 - DNA, 13 bp, Homo sapiens
tgttctttgttta

SEQ ID NO: 3634770 - DNA, 12 bp, Homo sapiens
tgttcttttcaa

SEQ ID NO: 3634771 - DNA, 16 bp, Homo sapiens
tgttgaaactttaaga

SEQ ID NO: 3634772 - DNA, 17 bp, Homo sapiens
tgttgaagctttaagaa

SEQ ID NO: 3634773 - DNA, 17 bp, Homo sapiens
tgttgactggactgctt

SEQ ID NO: 3634774 - DNA, 18 bp, Homo sapiens
tgttgatagtgatgtatt

SEQ ID NO: 3634775 - DNA, 16 bp, Homo sapiens
tgttgattaaagatga

SEQ ID NO: 3634776 - DNA, 20 bp, Homo sapiens
tgttgcagccgcagagaaat

SEQ ID NO: 3634777 - DNA, 21 bp, Homo sapiens
tgttgcccaggctggagtgca

SEQ ID NO: 3634778 - DNA, 19 bp, Homo sapiens
tgttgccccattcctaaga

SEQ ID NO: 3634779 - DNA, 20 bp, Homo sapiens
tgttgctatacatgttggaa

SEQ ID NO: 3634780 - DNA, 15 bp, Homo sapiens
tgttgctgtggctcc

SEQ ID NO: 3634781 - DNA, 14 bp, Homo sapiens
tgttggagaaagaa

SEQ ID NO: 3634782 - DNA, 21 bp, Homo sapiens
tgttggagcagcaggcctctg

SEQ ID NO: 3634783 - DNA, 13 bp, Homo sapiens
tgttggcaggccc

SEQ ID NO: 3634784 - DNA, 15 bp, Homo sapiens
tgttggcaggcccac

SEQ ID NO: 3634785 - DNA, 14 bp, Homo sapiens
tgttggccaggctg

SEQ ID NO: 3634786 - DNA, 15 bp, Homo sapiens
tgttgggacagccat

SEQ ID NO: 3634787 - DNA, 23 bp, Homo sapiens
tgttgggacagccattttccaac

SEQ ID NO: 3634788 - DNA, 18 bp, Homo sapiens
tgttgggagtgaggatgt

SEQ ID NO: 3634789 - DNA, 15 bp, Homo sapiens
tgttggtattttcag

SEQ ID NO: 3634790 - DNA, 14 bp, Homo sapiens
tgttgtatttctat

SEQ ID NO: 3634791 - DNA, 21 bp, Homo sapiens
tgttgtatttctatacagtag

SEQ ID NO: 3634792 - DNA, 20 bp, Homo sapiens
tgttgtcaagaatagcattg

SEQ ID NO: 3634793 - DNA, 15 bp, Homo sapiens
tgttgtgagaatggc

SEQ ID NO: 3634794 - DNA, 20 bp, Homo sapiens
tgttgtgagaatggcctgga

SEQ ID NO: 3634795 - DNA, 21 bp, Homo sapiens
tgttgtgagaatggcctggag

SEQ ID NO: 3634796 - DNA, 22 bp, Homo sapiens
tgttgtgagaatggcctggagc

SEQ ID NO: 3634797 - DNA, 16 bp, Homo sapiens
tgttgttcttacaaac

SEQ ID NO: 3634798 - DNA, 14 bp, Homo sapiens
tgttgttcttataa

SEQ ID NO: 3634799 - DNA, 17 bp, Homo sapiens
tgttgttgtgtgtatat

SEQ ID NO: 3634800 - DNA, 23 bp, Homo sapiens
tgtttaaataaaatttaatttca

SEQ ID NO: 3634801 - DNA, 15 bp, Homo sapiens
tgtttaatggtagtt

SEQ ID NO: 3634802 - DNA, 13 bp, Homo sapiens
tgtttaatgttaa

SEQ ID NO: 3634803 - DNA, 17 bp, Homo sapiens
tgtttactttaaacttg

SEQ ID NO: 3634804 - DNA, 18 bp, Homo sapiens
tgtttactttaaacttgt

SEQ ID NO: 3634805 - DNA, 16 bp, Homo sapiens
tgtttagaagaagtgt

SEQ ID NO: 3634806 - DNA, 15 bp, Homo sapiens
tgtttagatgaatgt

SEQ ID NO: 3634807 - DNA, 14 bp, Homo sapiens
tgtttagatgaggc

SEQ ID NO: 3634808 - DNA, 16 bp, Homo sapiens
tgtttataataaaaat

SEQ ID NO: 3634809 - DNA, 20 bp, Homo sapiens
tgtttatatggataatctga

SEQ ID NO: 3634810 - DNA, 22 bp, Homo sapiens
tgtttatgttgtttataataaa

SEQ ID NO: 3634811 - DNA, 14 bp, Homo sapiens
tgtttattaatctt

SEQ ID NO: 3634812 - DNA, 17 bp, Homo sapiens
tgtttattaatcttagt

SEQ ID NO: 3634813 - DNA, 20 bp, Homo sapiens
tgtttccctctgtgttagag

SEQ ID NO: 3634814 - DNA, 20 bp, Homo sapiens
tgtttccctttcactggcat

SEQ ID NO: 3634815 - DNA, 20 bp, Homo sapiens
tgtttccttttcaggagatg

SEQ ID NO: 3634816 - DNA, 16 bp, Homo sapiens
tgtttctattttttga

SEQ ID NO: 3634817 - DNA, 23 bp, Homo sapiens
tgtttctctaaggaattatttca

SEQ ID NO: 3634818 - DNA, 18 bp, Homo sapiens
tgtttctggcttagaaca

SEQ ID NO: 3634819 - DNA, 16 bp, Homo sapiens
tgtttctttgttttat

SEQ ID NO: 3634820 - DNA, 14 bp, Homo sapiens
tgtttgatgttttt

SEQ ID NO: 3634821 - DNA, 14 bp, Homo sapiens
tgtttgattggctt

SEQ ID NO: 3634822 - DNA, 14 bp, Homo sapiens
tgtttgctgaaatt

SEQ ID NO: 3634823 - DNA, 20 bp, Homo sapiens
tgtttggaatgttagaatga

SEQ ID NO: 3634824 - DNA, 13 bp, Homo sapiens
tgtttggacagct

SEQ ID NO: 3634825 - DNA, 16 bp, Homo sapiens
tgtttgggctttaaca

SEQ ID NO: 3634826 - DNA, 21 bp, Homo sapiens
tgtttggtggggtggcacctg

SEQ ID NO: 3634827 - DNA, 19 bp, Homo sapiens
tgttttaacaagaagcaat

SEQ ID NO: 3634828 - DNA, 13 bp, Homo sapiens
tgttttacaatag

SEQ ID NO: 3634829 - DNA, 17 bp, Homo sapiens
tgttttagcatttgtat

SEQ ID NO: 3634830 - DNA, 17 bp, Homo sapiens
tgttttagtgtaaaatt

SEQ ID NO: 3634831 - DNA, 18 bp, Homo sapiens
tgttttagtgtaaaattg

SEQ ID NO: 3634832 - DNA, 14 bp, Homo sapiens
tgttttcatcattt

SEQ ID NO: 3634833 - DNA, 17 bp, Homo sapiens
tgttttcatcatttcag

SEQ ID NO: 3634834 - DNA, 15 bp, Homo sapiens
tgttttcccccagca

SEQ ID NO: 3634835 - DNA, 14 bp, Homo sapiens
tgttttcctccctt

SEQ ID NO: 3634836 - DNA, 16 bp, Homo sapiens
tgttttctttgtttct

SEQ ID NO: 3634837 - DNA, 16 bp, Homo sapiens
tgttttgccagcccat

SEQ ID NO: 3634838 - DNA, 23 bp, Homo sapiens
tgttttggatgttgctatagtga

SEQ ID NO: 3634839 - DNA, 20 bp, Homo sapiens
tgtttttcatgttttagcat

SEQ ID NO: 3634840 - DNA, 23 bp, Homo sapiens
tgtttttgggaagaagaagacct

SEQ ID NO: 3634841 - DNA, 13 bp, Homo sapiens
tgtttttgtattt

SEQ ID NO: 3634842 - DNA, 14 bp, Homo sapiens
tgttttttcatttg

SEQ ID NO: 3634843 - DNA, 17 bp, Homo sapiens
tgttttttcatttgtaa

SEQ ID NO: 3634844 - DNA, 16 bp, Homo sapiens
ttaaaaaaaagaaact

SEQ ID NO: 3634845 - DNA, 11 bp, Homo sapiens
ttaaaaaaact

SEQ ID NO: 3634846 - DNA, 13 bp, Homo sapiens
ttaaaaaaactgg

SEQ ID NO: 3634847 - DNA, 13 bp, Homo sapiens
ttaaaaaagagac

SEQ ID NO: 3634848 - DNA, 18 bp, Homo sapiens
ttaaaaacaaatgagttt

SEQ ID NO: 3634849 - DNA, 19 bp, Homo sapiens
ttaaaaagatgaaaaagaa

SEQ ID NO: 3634850 - DNA, 15 bp, Homo sapiens
ttaaaaaggtaaatg

SEQ ID NO: 3634851 - DNA, 17 bp, Homo sapiens
ttaaaaaggtaaatggt

SEQ ID NO: 3634852 - DNA, 19 bp, Homo sapiens
ttaaaaagttgttctttgt

SEQ ID NO: 3634853 - DNA, 14 bp, Homo sapiens
ttaaaaattgttat

SEQ ID NO: 3634854 - DNA, 21 bp, Homo sapiens
ttaaaagaatattttaacttc

SEQ ID NO: 3634855 - DNA, 15 bp, Homo sapiens
ttaaaagatgaaaat

SEQ ID NO: 3634856 - DNA, 18 bp, Homo sapiens
ttaaaagatgaaaatatt

SEQ ID NO: 3634857 - DNA, 20 bp, Homo sapiens
ttaaaaggatgtataaattt

SEQ ID NO: 3634858 - DNA, 14 bp, Homo sapiens
ttaaaagtattcat

SEQ ID NO: 3634859 - DNA, 15 bp, Homo sapiens
ttaaaagtattcata

SEQ ID NO: 3634860 - DNA, 16 bp, Homo sapiens
ttaaaataaaccaaat

SEQ ID NO: 3634861 - DNA, 14 bp, Homo sapiens
ttaaaataaatatt

SEQ ID NO: 3634862 - DNA, 18 bp, Homo sapiens
ttaaaatacacactcaaa

SEQ ID NO: 3634863 - DNA, 12 bp, Homo sapiens
ttaaaatataat

SEQ ID NO: 3634864 - DNA, 22 bp, Homo sapiens
ttaaaatcatttctgcatcagc

SEQ ID NO: 3634865 - DNA, 18 bp, Homo sapiens
ttaaaatgcattgaaaga

SEQ ID NO: 3634866 - DNA, 18 bp, Homo sapiens
ttaaaatttgtcttaaaa

SEQ ID NO: 3634867 - DNA, 22 bp, Homo sapiens
ttaaacaatctttcatgtcttg

SEQ ID NO: 3634868 - DNA, 21 bp, Homo sapiens
ttaaacacaggctgtccttaa

SEQ ID NO: 3634869 - DNA, 18 bp, Homo sapiens
ttaaacagggtctcactc

SEQ ID NO: 3634870 - DNA, 18 bp, Homo sapiens
ttaaacagtgagcctgaa

SEQ ID NO: 3634871 - DNA, 16 bp, Homo sapiens
ttaaacggattatttt

SEQ ID NO: 3634872 - DNA, 21 bp, Homo sapiens
ttaaacggattattttttcag

SEQ ID NO: 3634873 - DNA, 22 bp, Homo sapiens
ttaaacggattattttttcaga

SEQ ID NO: 3634874 - DNA, 15 bp, Homo sapiens
ttaaacttcagcaac

SEQ ID NO: 3634875 - DNA, 21 bp, Homo sapiens
ttaaagaatgttagtaaagga

SEQ ID NO: 3634876 - DNA, 12 bp, Homo sapiens
ttaaagacagag

SEQ ID NO: 3634877 - DNA, 19 bp, Homo sapiens
ttaaagctgagagaccctg

SEQ ID NO: 3634878 - DNA, 19 bp, Homo sapiens
ttaaaggttgagtatgtga

SEQ ID NO: 3634879 - DNA, 17 bp, Homo sapiens
ttaaaggtttttgaaat

SEQ ID NO: 3634880 - DNA, 19 bp, Homo sapiens
ttaaagtttaagtgtgcag

SEQ ID NO: 3634881 - DNA, 13 bp, Homo sapiens
ttaaagtttaatg

SEQ ID NO: 3634882 - DNA, 17 bp, Homo sapiens
ttaaataaaatttaatt

SEQ ID NO: 3634883 - DNA, 15 bp, Homo sapiens
ttaaataaatcataa

SEQ ID NO: 3634884 - DNA, 20 bp, Homo sapiens
ttaaatattagttaatggat

SEQ ID NO: 3634885 - DNA, 19 bp, Homo sapiens
ttaaatattttgctaactg

SEQ ID NO: 3634886 - DNA, 16 bp, Homo sapiens
ttaaatctcattgctt

SEQ ID NO: 3634887 - DNA, 14 bp, Homo sapiens
ttaaatggttctgt

SEQ ID NO: 3634888 - DNA, 19 bp, Homo sapiens
ttaaatgtatactatagta

SEQ ID NO: 3634889 - DNA, 19 bp, Homo sapiens
ttaaatgtcaaatgtgaat

SEQ ID NO: 3634890 - DNA, 16 bp, Homo sapiens
ttaaatgttatgacta

SEQ ID NO: 3634891 - DNA, 13 bp, Homo sapiens
ttaaattatatga

SEQ ID NO: 3634892 - DNA, 22 bp, Homo sapiens
ttaaattatatgatatgcatgt

SEQ ID NO: 3634893 - DNA, 16 bp, Homo sapiens
ttaaattccactgaaa

SEQ ID NO: 3634894 - DNA, 21 bp, Homo sapiens
ttaaattccactgaaaattta
